United States Patent 11,882,838 (BACTERIAL INOCULANTS) - sequence listing, part 3

SEQ ID NO: 63 - DNA, 26497 bp, Unknown
  Kingdom: Bacteria, Phylum: Firmicutes, Class: Bacilli, Order: Bacillales, Family: Paenibacillaceae, Genus: Paenibacillus
agggtgtaaccttgaaagtagaatttacgatgtaaattcatgtttggtggcgatagcggaggggttccacacgtacccatcccgaacacgaccgttaagccctccagcgccgatggtacttggaccgcagggtcctgggagagtaggacgtcgccaagcagagctttatgattaatattccctgatagctcagttggtagagcactcgactgttaatcgagttgtcacaggttcgagtcctgttcggggagccatatggagaggtgtccgagttggccgaaggagcacgattggaaatcgtgtaggcgccaaaagcgtctcgagggttcgaatccctctctctccgccataattattttattgtatggcccgttggtcaaggggttaagacacctccctttcacggaggtaacaggggttcgaatcccctacgggtcataagtagtatggaggcttagctcagctgggagagcatctgccttacaagcagagggtcgggggttcgagcccctcagcctccaccatttatttgaaaagcagtacctaatattatcgcggggtggagcagttcggtagctcgtcgggctcataacccgaaggtcgcaggttcaaatcctgcccccgcaaccaattaacttttgaatgtaaactgctatggaactgtggtgtagaggcctaacatgcctgcctgtcacgcaggagatcgcgggttcgaatcccgtcagttccgccattttcacaaagttatattaccctgttgggagccattagctcagttggtagagcacctgacttttaatcagggtgtcgaaggttcgagtccttcatggctcaccattcatgacttatatgtcatggatataatgatattgcggacgtggctcagcggtagagcatcgccttgccaaggcgagggtcgcgggttcgattcccgtcgtccgctccatatttgcgcccttagctcagctggatagagcgtttgactacgaatcaaaaggccgggagttcgaatctctcagggcgcgccattaacttcataagccggtgtggcggaattggcagacgcgcgcgactcaaaatcgtgagggaaaccgtggaggttcgagtcctctcaccggcatgtatttcgggatgtagctcagcttggtagagcacctggtttgggaccagggggtcgcatgttcaaatcgtgtcatcccgattcaaaaggaaagtcgctggaagcagcggctttttttatattcatatctttttgtataaatcagtaatcctcaggtcacactaacacaaaaagtgggacggaagggattactgtgaagcgattaagttggaaaaaacagatgaaacggcgctggaaacagtggagaagaacagtgtgggcatgtagcatttttggtgcggcttgtttgctggcagggttgggtattctgttttcgaattatttgcaggctatgttgtcacagccactcgctactaccgtcatggcagaggagagcatggaggaagcttcacatctgagtccaattgaagatcactcctcacagatgcaattattgcaaagtattcgtgcttccggtataagcaggaagacccgtctgctaaccacctacgtgtgtggtacggaaacactttccttgggaacgctaagttcacagcagctagagaccttactgaagcaacatcccgattggaagggacgacttaataccaaaggagaggtgtggctggagcgcagggtggaagacttgtcagagtcatgcaaagagcatggatacatggggttgagcactgacgggcagcttacattgtatgaagggctacctaaaaaggaaaaagttatccgcactttttttcaattggatgtgggttccatggagacggccttgccagaaggggtatataaacaacttcagcagggaatacgtgtacaggatataaatgagtataacagtgtaatctccacttttagtgactttgccctggagcgaacacaaagggtattaaagcagcactattgattacaactatgagacgttaggcattgcccatgtggtgaggcttgaagcgtctctttttatgtttttactcatgtttaaattttttcctctattagatacaaagttttgttataatgaaaagaacgacacatatgttcgctttatttggtatttggccatgattatattcaggataacgctggctttggttaggtacgccatgtttgagcgataggggagagatttttttgcgttttttaggaattgatccgggtattgccattgtgggcttcggatttgtagacaagattggcagcaaggtagttcctgtgcagtatggctgtatccagacggaggctcatacaccggaagaagaaaggctgcttcatgtgtatgaaggcatgttgcaattaatagataaatataagcctgatgcggtagcactggaaaagctcttttttaatcgcaacgttacaaccgctatgtctgtaagtcaggcacgtggggtgctggtactagctgcaaaacaacgtaatttgcctataggtgaatacacgccgatgcaggtaaagcaggctattgtagggtatggtaaagctgagaagaaacaggtacaagaaatggttagaatgttcctaaagcttcaagttgtgcccaaaccggacgatgtagcggatgctttggcggtggctatttgtcatgcgcactcctatggactaaattcaaaattaaatgaggtattgcgaaaatgatagatttcttgcgtggttctgtggcccatttggaaaatgaatatgttgttttagatgtgcagggtgtagggtatagggtattttgtccgaatccttacgcgttcgccaaaactgaaggtccagtggttatttacattcaccatcatgtaagggaagatgctattttactgttcggttttgcgacccgtgaggagcagcagcttttccgtaaactgattgatgtatctggtattggaccgcgtgttgcgcttggtattttaggaggcggtacgcctgctcatgtggtaacggcgatttatcaggagaatatcacatttctcaccaagttaccggggatcggtaaaaagactgcacaacgtatgattctggatttgaaagacaagctggacggtattggctcgttggggatggcaaccggattgtttgctgagcctgtcgtagaagaaggcgaaggttcatattggggcgaggcccgtgaggcgctcaaggcgctcggttacactgatgctgagttggataaggtatggagcagaatgaagaaagatgcgaaacctgatgaatctgccgatattttgatgaagcgggctttgcaactgttgtttgccggataggacgatgatgtccgctaacaaatgtctggtgaaaagaggagcgatggaacatggatgaccggattatttccgccaatttgatgatggaagaccagacggcggagctaagccttcgcccccgttatctaaatgaatatatcgggcaaaatcaggttaaggaaaatctgaaggtatatattgaagcggccaaattgcgtaaagaagcgttggaccatgtactgttgtacggaccgcctgggttgggtaaaacaactcttgctaacattattgccaatgagttgggggttaatttgcgtacgacttcaggtcctgcaattgaaagaccgggagatttggcagcattgctgaccaatcttcaagagggtgatgttttgttcattgatgagattcatcgccttcatcgtacggtggaagaagtcatgtatccggcgatggaggattttgcgctggacattatgattggcaaaggcccgagtgcacgttcggtccgtctggatttgccaccctttacccttataggggccaccacgcgcgctgggctgctctctgcgccattgcgtgaccggtttggtgttattagtcgattagagttttatacgacagacgagctggcttacatcgtatccaggaatgcggatattatggagattgagattgttggggatgcggcggaggaaatcgcattgcgttcacgggggaccccgcgtattgctaaccgactgttaaaaagggtgcgtgattttgcccaggttgcgggagacggtattattcattctgagttggctgcagaggcgctaaagagacttcaaatagatccactcgggctggatgaaattgatcataaaatgcttaaggccatgattcattcattccggggcgggcctgtaggattggacaccattgctgcaaccattggtgaggagagtcagacaattgaggatgtgtacgagccctatttattacaaattgggcttttacaaagaacacctcgaggacgaacagtgactccggcggcatatggccaccttggaatcccaatgccaacggatccacggtgagtaggaaacatgatgcacttttcaaaaaatcattgcatggttacacgcaagtatggagaatacgatatcggctgacggatgattgagggaagtgagagtgtaagtaagattcgagcggattcatatttcggtttattccgccgatgtatttaaagggatagacaagggtcgagatctcgataaattacgcaatataagtgctagacagctagattgggggagccagaaatgagtggagaagcatttaaccgaaaaagtattttcggtgcatggatgggccgggccaaacgagcagcagcgattatggtattagctacagtgtgcataccttggtcttcgggcgttcacgctgctgccgcccaagaggaaattcgtgtagtgatttttgcggatctaggtagcaaatataaagcgacagtccccgctgtaaccttgaaatcctcaggaggtctgagtgttggacagaacagtgggggcagttttcaaacttggatgggactaccagacagtacggctcgttttagtgtagacagctatcgggtgaaggtacttgaaggaaatgaagcagcggcaataaaagcggcccaagccctgcaaaagactaatgataaacctacggtttttatcggttcaaaaaatggtagctcagtgtatcaagtgtacgcgggaatatatgctagtgagcagtctgcgcaggctgctgtacagcggatttcctccgcaaccggagcgcaggccgaagttaagggaaacaagcattggtccacaggaagctacggaagcgagcaggaagctaatctcgttcgaacgacaattgctgcggcaggctttgatgcttttactgtaattcaatcaagaggccagtatgctgtatgggttggagaagaaagtaatgacagcaagctgccggctttgaaaacagagctggagagcaagcagccgagactcacgctgtctaaagttaatgctactcaaaccggcctcattataagacaggaagcaggagtcacgactggctcgcaggtgatgtctcattacatgctaagtggttctgatcatagcaaggtaattgtcaacggcggtaatgatggaatacaagtgatggagagatcacagcgtacatatcgcggcgagatggagattgccatgacgtcaggccagctggcgcttgtgaatgaagttcctctggagcagtatttgtattccgtggtaggagcagaggtctattcctcatggccagatgaagcgctcaaggctcaagcggtagcggctcgtagctacgcgcttgcccaaggcaatcggtttcagatcggcaatgtagtagatggcacgttaagccaggcttacaacggtaagagctcggaacatgccaatgtcaatgaggctgtagatgcaacagctggtgaagtcattaaaagtggcggcaaagtggtcgaagctgtattttcatctaatgcgggcggtgtgacagcagatgcttccgaggtgtggaacagtggtggcgaagcctttgccagcgtagacagctcgggagatacttcggcgcaaaaaggagcacaggagtggtatcatgtacttctctccagtggcaagacagggtatattcgtgaggataatgctaaggaactggagggtgtcacagaatcggggttagacaaaatcaccgtcactgcggaaaatacaaatgtgcgtcctattccccaaattcaatcgacggttacaccaatagctaaggcgcagccgggcgaagagatcattgtattagaaaagatgcctcagtccggagactatgcatgggtgcgtgggccctttacgtcagctcagcttgctaaatccctgcaagggaaagtaacgggcacagtgccttcctctattaatcacctcgatgtcaccaaacgtggtccatcagggcgagtgttggaggttgaagcgaacggaacccctttgaaagtgaaatatccggatatgtttcgctcagcaatgggcggactcccgagcacactgtttgatattgcgagtaccggaagttatactgtattaggcgctgatggggctacttctcatgtaagtggtacacaaggcactcaaatcctgtccgcatcgggcagcagtacttcaagtggtaacggggtgatcgtcatgaatgaagatcgtcatgcacgagtcattgacaaaacacaaagctttatttttacaggtaaaggaaatggtcatggtttgggcttatcccaatggggtgccaacggtttggccgagcaggggtatgattacaagaaaattttgcaacactattacaaaaatgtggatatagttaaggactgaccaatatatgaatgtaaacgactacgattttgaactgcctgaaacattaattgcacagacacctttgcttgatcggagcgcttccagattactgacgttaaacaaaaataacggtgaagtgggtcatcatacgttttcggatattgtgcagtatctccaaccaggggatacgctggtattaaacgatacgagagtgattcctgcacgcttgtttggcatcaaggaagacacgggagctaaggctgaggttttgctgcttaagcaactgcaaggggaccgatgggaagcattggtgaaacccggtaaaaagctaaaaaagggtgctgttattgttttcggtgatgagctgaaagcagtaattgaggaagaaggagatatgggcggaagggtgctttcattttcatatgacggtatttttcaggagatcttggaccgtctggggcagatgccgcttccgccgtatatcaaggaacaactggatgaccgcgagcgttatcagaccgtttatgctcgacatgaaggttcggctgcggctccaacggcagggctgcattttacagaagaattgctggaccagattaaaaagaagggcgttaccgttgcctttatcacacttcatgttggcttagggacgttcagaccgatgtctgtggatacgattgaagagcatgtcatgcacgaagagtattattcattatcacaggaaacggcagatgtacttaatgcaaccaaggcgcgcggtgggagaatcgtggcagtgggaacaaccagttgtcgaacgctggagacggtgggcaatacattcgcagatggagtgctgcaggccagcagtggctggacacagatttttatttatccaggctacgaattccgtgtggtggatgcgatgattacgaatttccatttgcctaaatccaccttggttatgctggtcagcgcactggcgggcagggagaatattatgcatgcttaccaggaggcgattgaccgacaatatcggttcttcagcttcggggacgcaatgttcatttattaattaaggatggtagagaaaatatggcaccagcaataagatacgaacatattaaaacctgcaagcaatcgggagctcgtctcgggcgtgtacacacacctcacggagttattgagacaccaacctttatgccggtgggaactcaagcgactgttaaaacgatgagtcctgaggaactgaaagcgatggatgctcaaattattttgagtaacacgtaccatttgtttcttcgtcccggacacgatattattcgtgaagcgggtggactgcacaagtttatgaattgggatcgccctattttaacagacagcggcggattccaggtgttttctttaagtgaaatgcgtaaaatttcagaggagggtgttcattttcgctctcatttaaatggagataagaagtttctttcaccagaagtggcgatggaaattcaaaactcgcttggctcagatattatgatggccttcgatgaatgcccgccgtttccggctgaatatgagtatgtgaaaaagtcactggaacgcaccagccgttgggctgagcgttgtctagaggcacacgcgcgccctcatgatcaaggtctgtttgccattgttcagggaggcatgcatgaagatctgcgcaagcaaagcgctgcggatttgacttccatggatttcccggggtatgctattggtggactgagcgtaggtgaaccgaaacatttgatgtatgaagtgctcgattatacggttcctctgcttcccaccaacaagccacgttatttgatgggcgtgggttcgcctgatgctttgattgaaggctctatccgtggtgtggatatgttcgattgtgtacttccaacccgaattgctcgcaacgggacaacgatgaccagccaaggtcgtcttgtcgttcgcaatgcccaatatgcaagtgattttggcccgctcgatcccgcttgtgattgttatacctgtcgcaattattcacgtgcttacttgcgacatttgattaaagcggatgaaaccttcgggctccgactgacaacgtatcataacttgcatttcttaatacaattgatgcgtaatgtcagacaagcgattatggatgacaggctgcttgatttccgagatgaattttttgagcagtacggtcttcatgataatgataaaggcttttaagttttagggagagtatacgaaagggggatttaacatgtttcattttgctacagccgctgctgcacccggtggaactggcggacttttccaaatgatctggccactggctctgatgtttgtaatcttctatttcttgctgattcgcccgaatcagaaaaaacaaaagcagcgtcaaacgatgcttcaagctttgaaaaagggagataaagtaattacaatcggaggtcttcacggtacaattatggagattacggatgatgtagtagttttgcgtgtgaatgatgtcacgaagctgacctttgaccgcagtgcaatcagcaacgcgattgcaaaagacacggcatctgaggaagttgtttccaaatcgtaaaatgctggtgaccgttatgcaaaaaccgagcctttaaggaggctcggtttttttgtgttgttttattacatggatacaaacaatttgattacttgttgagattaatgccaaacatcccaccacctgcgcctatgacaaacgcgaaacctaagtgtaacaggtccttgccgttcatgcccgcatccaatgccagaaaaccgaccagaagaacgattagcccatacaggatgcctgtaataccgccttgataccagcctttgtttgtggatcttttaccggcgacgaagccgccagatagcatggcgaatgcatggacgatgtacgtatacaatgataagtcctgttcctgcatctgtgtcagccacaagagtaatgaaagaatcaatgcgccaagcagcatccatgcaaaagcataaaataaaccggataaaatgggatgggccagacgaaacgaacaccagcggcgaatgagctccattgataattcctcctgtaccaaggtttgaactattatcattctatggccaagcctcccggcttagtaccaagtcgcaagcagtctttctctttatttcaataatttagccttttgttttttgtatgagccaagtgaggaacggtcagaatacgtgtacaatgaacgactcatgtcttattgcaagtacaggggaggaggcgaacatattgagtcacgatatttttgctcatatttttcggacgctgctcatgtattttattgtatatctggtgatgcgcttgatgggtaaaagggagatcggcaaattgtctgttttcgatctcgtcatatccattatgattgcagaaattgctgtattcagcttggaggatataaaacgtccactttatgaagggttgattcctttaggagtgctgttaattttgcaaataggtatttcatttttcagtctgaaaagtcggcgactgcgcttactatttgatggtaggcccagtgtattgtactctaatggacaattaaacaaggatgaaatggtaaaacaacgttataatttagatgacttgctgttacaacttcgcgaacaaaatatagaaagtctggacgaagttgaatatgttattttggaaacgacaggtaagctaacggttataggtaaggatgataatgatggagtggaacacgtaaaaatgaagcaggaattaaacggaacagatttgacaaacaaagagcaacaggtgaataaagtccatccttctccacaaatcggtggaaagtttagatatgagggactgcctattccattaatcatggatggcaaagtgctggatagaaatttggaacggatggatatgaaccgtttttggcttaagaatcaaattcaagcgaagggacacaaagattttaaggatgtttttttatgctcagttaaccatagaggtgatgtgtacattacaccaccggcctatggaaaatcttcagattaggtttcttatgctttaaaccatcttctcaggattggaatgcgtgtaaggttgtcccaatcaatcattttgatcaaggtcattaggaaaaggtacagtataattcccgatcctgcggcaaaaataaactgaagccacatttggttgaacatcgttagatgtctgtaggtatataatactgctgctgccatgatgatcatgcctatcccggtcttccagaaatcgagcaaacgtacgcggaagcgaagcagtctgctgacactgaagccgtgaaggagagtaacaatggcactattaatacaaatggcgatgacagctccatagataccatactgaggttgggaagcaagccagacgatcagtacaattttgataacggctccgataaaggtatttaataaggcacttccaggacggtctaatgcctgaagtgctgcctgaagcggggcctgaatgtacataaaaagagcaaaaggtgccatgagcttaagcatgcctgcaatatcgccattattgtagagtagcagacacagaggttctgccaatacatacatgataacggcaaatggggctcctgcaaccaaagcgagccgaagcgattgatgtagacgtttgtgaatggctgtaatatgccccttagctgctgcttcggataacgaaggaacgagtgaaactgctagcgaactggttagaaccccaggtagtaataacacaggaatgaccatgccctgcatggctccatactgtgcggttgccacgccagttgcgatgcctgctacggcaaggctgcgcatgcacaagatagattcgagcaaataggataaggaaccgacaagccttccagcagtaacgggaacggatatagacataagacgtgacaaaacggatgattgctcgggatgaacttcagaagaggggacaggcgactttggctgaaggatgcgatcttttcgctggttacacacgtattgccatagcagtacaatcatgccaatgaattcgcccgccagagcaccgagcatggcacctgcagcagcgtagtctaccccatggggaagtaacaagtaagcaaaccaaatgacgcaaaaaatgcgtataacggtctccgcaatcgaggagctggcggaagggatcatattttgctttccctgaaaatagcccctataagctgaagaaacagctacaatgacaatcattgggctcatgctcacaaatgtataatacacgcgactgtcggtcaggagatggcttgtgatccaaggcgcgaacacaagacagagcaccatggcgatcagactgagtgtaatggtgaagcgcaggctggtgtgcaaaatacgccgcgacatttcgggctgtccagccgtttcagcttcggctacaagcttggctaccgcaagagggatccctcctgtaataagcgtcaccagaacgataaaaaagggatacccctgttggtacaagccaactccttcggggccgatgatacgcgggagtgcgattcggggaataaaaccaagtatccggttaataattcccgctgccaataaaatgattgctccatggatgaaagtctgctttttcaatcgcaactccctcttccccaaaatgtaattctgcgtctatgcattactttagaagatatgctggacctgtccatgttcatgacaagcttttccgttcagaaacaaagtgatttagacaacaagagggggagtggtgaattctgctattgacgagcgaaatgaatgcatatattgttgatttaaggctattttcaacgaaaagaagggttttccaggatcaggacagaaatgttctacaaagcagtcaataaccccgctaattgctgatctgcggaaccggtagtcgctgggaggaggaacggccatcgtgggtatggaagagctggatgagcaggattgggatgacgcaattgagatgctctgtcaaagtaaggcggacgagttgattctcgtaggctatgagcatgtcacaagtaaggacgtgtggaattgcgtcagccataaatatgaaaaggagggtatccctccgctgcacaagctcgttaatgatatactttcccttaaagcgacgagctttatgaactatttgacgatgtccgcattacggggctccactttcgaatagaagggggtctttttttgcgttcaaattgactgctttttgaggggtagctataataggaatattgagaatgaaaggggaacatgggacggaatgaagagaattctaagtttcatcgtggtcgtgctcataactactggtgttatgatcgggacaagcccgggcctactgaacagtttaaaattaggcctcgatttaaagggaggctttgaaattttatatgaagcccagcctttggaagccgggcagagtgtaaccagccagtctcttatacaaacagctcaaagtctggagagacggataaacgcgcttggtacaactgagccggaagtaacaacagagggtaccaaccgtattcgtgtgcggcttgctggtgtctctaatgaagcagaagtgcgctctatgctgaaaaagcctgccgagttgaccttccgcagtgcaacggcagcggatgctaaaaagccaggccaatacagcaaaattgagctccgcggtaatgattttgtggagaatggcgctgttgtcggctatgatcagctgaaccaacctgagattagtatcaaagtgaaggacaaagctaaatttgcagaaatcacaaagcgacttctgaataaagaattggctattttcctggatcaggaattgctgtctgcacctacagtacgtggggaattaacggacggtagcgcgtcaatcacaggtagctacactcgtgatgaagcgaataaactggcggatacaattaatctgggtgcccttccgctcaaactgacggaaaaatattctcagagtgtaggtgctacgctgggtcaattgtcactagatcagacgattcgtgctgggttgatcggctcgatcattattctggtatttatgattgcgatgttccgtgtaccgggattagtcgctagtttctgtctcatcgttcatacctgggtggtgcttgccatcttttatttgggtggattcgtgcttacgcttccgggtattgcagccttcgtgctcgggatcgggatggcggtagatgccaatatcattacgtatgaacggattaaagaagaaatcaagtcaggcaaaacgattcgttcttctgtcattgcaggtagtaaggcctcgttccgtaccgttatggatgccaatgttacgacaattatagcagcagcggtgatgtttggtctggggacaggctccgttcgaggtttcgctctggtgctcatcgttgatattgtcaccagtattttgacgaacatcttcttctcccgcttcttactcaatctgctggttaaagcggatgttgtgaagaagccaaagtattttggtgtgaaggagagtgatatcagtgcgctttaattggaacttgaaatatatcaagatgagcaagtggttttacacgttctcgattattatcacactgcttggtattctgagtttgtcgatatttggcttgaattacggagtagactttcgttccggttccaatgtggatgtcaatttgactaaagttgttacacaggaacagattcaaactttgctggataagcaggggatcggcaaagaggtggattatacaccgggtaaagagcgtttcggcattcgcttttcacaggttttgacggatcagcaagtgaatgactttaagatttcttttaacaaacagctggatccgaaggcttcctttgaggttaatacagtggatacggaaatggcgcaagaactagaacgaaatgcgttatgggcgattttattggcttctgtggctatcgctatttatatctcaatccgttttgaatggcggtttgccgttgcagcaattgtttcgttgttgcatgatgccttcctcgtcatcagtattttctcgattttccgtcttgaggtggatttgacctttattacggcaattctgacgattgtcggtttctccattaatgacactgtcgttatttttgaccgtatacgggaaaatctacgatttgcgaagaagaagtctagggacgacttagagcaggtagttgatcacagtattgcccagacaatgactcgttcacttgcaaccgtgtttacggtatttattgcctccttatgtttgttcatatttggcggcgaatcgatccgtatgttctcacttgcgatggtcattggtttgttgtttggtgcttattcttccattttcattgccagtccgctgtgggtagctttgaaaggaaaacaaaaatctccgacagctggcgggggcgcggccaaaactgcaaagtcttaagttacgtaaataccagtagtataaattaaagagaaagccgcgtctgcctgggcgcggttttctaaggttttgagatttaccttgagtaaggcacaatagtggacacttaaatgagaatggttttttgttttgagaaattcggttattttagaatggagctttatttaggaaagggttagttcaggattgagggggaaacgttgtgaatagcgaacgcagccgatcattggaaactgcggcgttgagcgggattgtaggcaatctcgcgctggctgttctaaagggaaccgtcggttatgcggcaaacagcaaggcgttgttgggggatgcactgcacacggctgcggatagtgcttcccgtttgcaggagcttctgttttccaagggtgctacagggcacggaatgctggcccggttgcggaacggtgaaaaagttaggacgatcatatctgtagtgctggctattttagtgctgatgagtggtcttcagctagctatctcggcggttcgttcattaagcagttcggaaccgcaggctcccagtctgtatgcattaactaccgtatttattgcgttggtgttgagagaggcgttatttcagtttcaatatcgctattcgattaaacatggtcataaagcggaagcagatcggtacgctaaccatgaacgttactcgctgtatgcatcgttgattgcattgatcggcatgatcggtgcaatgactggcgaagcaatggaatggcctgcattattatatcttgatccaaccgcagctttgctggtagcctgtctggtgcttcgcaaaggatatttgatggtaatgaataccgcttaccaggttcctgcacagcccttgcaggaggaagactcccgccgctttatggagacgattcaacgggtgtatggtattgtaacggttgagcacttacatgcccaggaaacaggccatttcataacagtggatgtaacgataagtgtgaacccgcggattacggtacaggaagcgcaggaaatcgccgatcgagccaaaaatctactgttagcccgttttccacaggtgacccatgtacaaatgcagttcattccttatcaagccgggtatccttacaaatccaatcatgaactgccagataatgatgtgtcgtcgttgcttcaatagagcaggatgactatgaaagaaaggtgaacaggattgcttcattcgcagtacagatggaagaccccagaggctaacctagaagcggctcagctgttgacagaagagctggggatttcaccattgttgtcccggcttttagtgaaccggggcgtcactaccgccggggaagcaaaccgctttttgtacggaagtgtggacgatgtacacgacccttttttgcttcttggtatgaaagaggctgtaccgagaattcgccaggctctggaacgtggcgagcatatattaatctatggcgattatgatgcggacggcgtgtccagtacatcattgatgattcagctcatgcgttttctcaaggcttcttatgatatttatattccccatcgttctaatgagggatatggtctgcataaccatgctcttgattgggctcatcagcagggagttacgctggtcattacggtagatacgggaattagtgcagtagagcaaattgcttatgcaacttccttggggatagatgttatagtgacggatcatcatgagccgcctgctgtacttcccgaggcatatactttgattaatccgaagctacccggttgcccatacccatttaaaggtcttgcaggtgttggtgttgccctgaagctcgctcaggcgctgttggatgaggtgccagaggaatggtttgaaatcgccgctatcggcacggtagccgatctgatgccactacatggtgaaaatcggacgatggtacgcagagggattcaatccatgagaaactctgcatttccgggtatccgtgcgttactccatgtagcgggcgtggatatatctacagtgtcttcagtcaatatcgcatttgcattggctccgcggattaatgccagcgggcgcctggatcatgcgggacgagcagtttctctgctgacgacagaaaaagaggaagaagcagaccaacttgcgcatgcgctggatctgctcaatcgtgagcgtcaacaggtggtcgaacgtattgtggagcaagccgagcaacaattggcctccaaactgaatggaggcaagctaccgtcagttattgtgttggctggtgaaggctggaatgtcggcgttgtcggaattgtggcatccaagctattggatcgctattatcgaccgaccattattcttggtatagatgctgagacaggcacgtgcaaaggttctgcccggtctattcctgcattggatatctacagtgctcttacggacagccatgagcttatggagcattttggtggtcatccttcggctgcgggtatgacgctgtcccgtgacaatctgaaattgtttgaagagcagctgaaccgctatgcgggttccattctgacaccagaagatctcattcctgtagcggaggccgatatggtctgtcgtctggacgaggtgtctttacaagtggttgaagaactggagttgcttcagccttttggtatggggaatccttctccacgattcgtattacagggtctgcaattgcgcgaggctcgtaaaatgggacgtgagaaaaatcatgtgaagctcctgctggagcagaacggtttatcgctggacgcgattgccttccgtcgtggcgaattggctgattttttacagcaacaaacagagatagatctgctgggtgaattgtcaattaacgaatggaacggtaaacggtctcttcagctaatgatgcaggacattcgagtgcaggcgccacaaatttttgattatcgtggagtgtcggacccttttgccgaattagaacggggactgaagatttttcatccacgtattgaggaaagaaagaaagacgttgcggtgttgattcatccgtcatccaggcttcgtccatcgagctccgtggacgctgaatccttatggttatacgataaagacggtagcgttattcccagtgatggtcaaagagatgcacagcactctgtaaagtcgctgttcgtactggagccgccggatacaccggttcagtttcaggcattatggtctacctttgagaatgtagagaacgtatttctccttcattcggtcagtgagcgtggcggtcgactcgtaagccctgacagagagctgttcaagcgcatttacgttgtgctttctcgaatggggacacagcctattgatgaaaaagcaatgctgcctgctcttagccgacagtgttcctgttcagtacgcatgttatccaaagtattggacatcttcgaagagcttgagtttatgacgcgtacagatggtcaattccgttttgtatccaatccgcctaagcgggatttaaccgcttctccacgctatcaggaattgtataatatggctgaaatggagaagtatttgctggatgcggacactacccagatgacgagctggattatgtcgcttatgaagggtgcgtcttgagatactatttcgcaatttatgttgtaaaatgtatatactaatttgaagttacagtaggaggaactaagttggactacaaagaatatattcgggtgatttccgattttccacaaccagggattagttttaaggacattacgaccctgatgaaaaatggtgaactgtaccgcaaggctatcaacgatatgaaggaactggtatcggatttgaaaattgatttgattgcagggccagaagcacgtgggttcgttgttggtgctcctttggcttatgcgcttggtgttggttttattcccatccgtaaaagtggcaagctccctggggaaaccattgaggaagcatacggtttggagtatggtaaagatacactggcgatgcataaggatgctatagagccaggccaaaatgttctgattgctgatgacctgcttgctacaggtggaactattgctacatccgtgaacttggtacgccagcttggtggcaatgtggcaggggctgcttttcttatcgagctgtctgatctaaacggtcgggcgaaactgcctgatgtagatgtattcactctgattacgtattaagtacttcgaaaccgggtttcccgggaaataattatgaacggatcacctaaatagtccgatggaacatctctttatctaaagagttgctccatcggactattttgtttaagcagtgttttaggtgtgactttgtttgattggttcaaattaccactctttttattggaaatggttataaaaaatatagaataaatgtcgataaacaattaaaaaggagcagaggtggtcataatgggtttatttcgatttaggagtttacgagcacggacattttctaccttggttccgcttgtacttataacgctgattttaatcagctttttgtcatatttttttgccaagcaaaagctggatacggaaataagccaaaatgctgcgcattccttatcgagggttaaagcagatattgcagctaacgtagatcgtcatgctttacttgtttcgatgctgactaagagtgcggaacaactgggagcaggaatgaacattgagggttatggacgtttttttgaacaagagctggaattaaatgatatgacctatgggttagggatatattttgctaatgctgcgtatgatccaggagtgacataccgttccatatatgtgcatagagatagcgagatattcaagcaatcgactgaatatgatgatccacaatatgactatttaacgcaaccttggtatacagaagccattgaacgtggaaaagatataaattttacggagcctttttacgatagcagactgaaaatcaatatgattactgctgggaaagcattttatgacagggaagggaagctgttaggtgtcattactggcgacttgaacatgacaaacattcaaacgtttattgaaaaaatgaagtttggtgctaacggtagtgcgatcttgatggataagaatggagccattttgtcatccggtcttccgtccttaaaagcaggcgagccgttaacaaaaacgatgaatgcggaagcagcacaatctattcaaagtggtacgtccggacaactatccgtacccattgatagtgaggactaccggataatgtacgaaacactcccacaaaccggatggaaaatcggcgtattactgccagaatccgatttgaaccgctctgcgaacgaaatgcttaaacttcttcttattgttagtgttataggtatcttgctaattatgggagcattaataattaacaattcaggtatgatcaaagagattaaaaaaattatgcagataaccaatcgtatggctcttggagattatagcgttgaactaacacatcaacgtaaggatgaatttggccaaatggctgacgggatcaataaggtaattgcggcaaccagaggaatggcatcacgtttaagcgaagagtcagatgttatctcaggcgtatctataaaaatttcgcaagagatttctggggcgactaaagatgcacagcacaatgcaggtgaactaactaaggtgaaggaaggggccgagcttcagttggccgccgcagcagagagtgcgactgcaatggaggagatggctgttggaatacagcgtattgctgaatctatacagcatgtatccgaggctaccactgagattgaacataaggcacaacaaggaaatgaacggttgaccgtggtcaaccaaggaatgcataaagcgaaaatgtctatggatgaggcaggcagggtagtaagctcattgaatgagcggtccgcccaaattggcagcataattggaatgattcaggaaattagtgggcagaccaagttgctatcactgaatgcttccattgaagccgcacgtgcaggggagcatggccgagggttcgctgtggtggcttcagaaatcggcaagctggctgtaaacgtgagcgagtctgcggaacaaattacgagtcgaatccgatacatgcaggaagaaaccaaattagctttggaaggaatgcagcagggtgctctggagatggatgaaggagtatctattttacttgaggtggaagaacgttttattgcgatgaatcaagatattcagcaggtggcgatagaagtgcaggaagtttcatctgcctcagaagaaatgtcggcaggttcagaggaagttgcagcctctattggatatcttgcagacattgcgaaagcttcagctaaacgtacagggcaagccgcggaacgatccgaacggcagcttaaggatctggaaggtatggacagctctgtcaagacgcttacaggtgtttctgatacgcttaatcaggtcgtatctcgctttcgtgtgtgatatttttagaaaaaaaggccgtgaataaaaaaacgccgctccatgagatatggatctttacacgcttgtctatacagcctgagcgtgttgatccataactaacatggagcggcgttttaaagttgaaaaaaagacatcaatctggtgttttctccgttaaaggttcctgcgatttatcgttggaccagccgagcacgtcaatcagcttaaagaacaagctgaggatgatgccgatgattgtagccaatgccatacctttcaaggttacagcgccccaagtgagcgtagtaccgctgattccgacaacaagcacgatggtcgcaagcagcatgttggttggcttggcgaaatcaaccttttgctcaacgaagattcttagaccggaggcagcgatgacaccgaataatagtaaggatacgccacccataactggagctggaatattagaaacaatcgctgagaacgtgcctgagaaggacaataggatggcaatgacagccgctccgccaatgacccatacagagtacactttagttaatgccatgacaccaatattttcaccataagtcgtattaggtgtagaacccacaaaaccggaaatgacggtggaaataccgttacctagcagagagcgatggagaccaggatctttggacagctcgcgcccgacaatgttgctagtcacaagcaagtgaccaatatgctctacgatgacgaccagagcaacaggaagaatcgtcagcatagcagaggtattaaaaacgggagtggtaattgcaggatgttcgaaaaaaggagcgtctgcaatggcttgtgtattgaccatgcccataaaataagcaagtacatagcccactacgataccgatcagaatatgaatgattttggcaaagccgcgaaacaataccgcacccagaacagtgaccccgagtgtaacgagcgaaagagtaatcgttttgggatctggagtccaggccttagtaggatcggcattgataatgcctgccatacctgctgcaaccggaaccagttccagaccgattaaggctacgatggagcccataacagctggaggaaaaacgacgtccagccaacgggttccggcatatttgatcaccagtgcgacgaggcagaaaataatacctgtaacgatgaaagcaccgagggccatagcatagccgttgccgccgggattgtttttaagcacaagactgacgggagcgataaaagcgaagctggagccgagataggcgggaattttgccgcggcagatccatatgtacaacaatgtgccaataccgttcattagcaaaatcatgccgggatcgacgccgaaaatattcggcaccagcacagtgctaccaaacatggcaaacaaatgctgtacgctgagcaggaacccaggtcctgccggtagcttttcattaacttgaatttcgcgttgcaacgcagttcactccttagttctttcaattattcttatatacattaattacttttcgtaattttttcaatataattcgtttcatttcgtcaacaatcctgattttacttaccatgtgtgacagaataatgcgacaatgccaaacctgtaatagttgacgtgtgacgtgctaaccgtcataattgtaggaaatcacttttaaaagggaacctttgcgcgacattgatcggcgggttccattttgcatagaaaggacacggaatagagcagaatggggatagagcaattacttaaaaaggccggggcctataccagagaagcagatcttatccgcatcagggacgcctatgattttgccgagcaggcccattccggccagactcgtaagtccggtgaaccttatattctgcatccgcttgcggttgctgatatcgtcgttaatatgcagatggataccatctccattatcgccgctcttttacatgacgttgtggaggatacaacggtgtctttggcgcagattcgcgagcattttggcgatacatgtgcgatgcttgtcgatggtctgacgaagctggagcgtattcagttccgttccaaggaagaacaacagaacgaaaattatcgaaaaatgtttattgctatggcgcaggacattcgtgtcatcgtcattaagttagcagatcgtctgcataacatgcgtactttgaaatatcagtcagaggaaagccagcgtcggattgcttatgaaacgttagagattttctgtccggttgcaaaccgactgggtatttcggccattaaatgggaaatggaagatattgctttacgctatctgaatcctcagcagtattatcgcatcgctaatttgatgcataaaaagcgggcagagcgggagcagtttattgataatgtcatacagcgtatcagagaaaagctggaagagatgggtattcaggctgacctgtccggacgccctaaacatatttacagtgtgtttaaaaaaatgacgacgaagaacaagcaattcaatgaaatatatgatttgctggcgattcgaattattgtggataacattaaagactgttacgccacactggggattatccatacgttgtggaagccgatgccggggcggtttaaggattatatcgctatgcctaaggccaatatgtatcagtcccttcatacgacagtagtaggtcccaacggggagcctaccgaggtacaaattcgcacagtggatatgcaccgtaccgctgaattcgggattgcggcccattgggcctataaagaaggcaacggagcaaacaacactaactttgaggataaaatcaccttttttcgagaaattctggagctgcaaaatgaagcgaaggatgcgtcggaatttgtggaatcgctcaaaatggactttttctcagaccttgtgtttgtgtttactcctaagggagaggtcattgagttgccggccggatccgttccgctggactttgctttccgtattcataccgaagttggcaatcgaacgattggctctaaggtaaatggaagaatcgtacctttggattatcggcttaaaaccggtgatattgtcgaaattatgacgtccaagcattcttatggacctagtcaggactggctcaaaattgctcagtcctctcacgcgcgcagtaaaatcaaacaatggttcaagaaagaaaagcgtgaggagaatgttgaaaaaggccgcgaaaatctggaacgtgaactgagaaaacgtgatatcgagccatcggtgtggatgagcgacgacaagcttcaggaagtggcacagaagttctcttttaacgattccgaagatatgctgtctgcgattggctttggtggtataaccgcagcgcaggtctgtacacgtttgacagagaagctgcgtaaggaacaagaagaggcacggttgatcgaattgacgaccgaggtcaaggagtacaagccgcagggcgaacggaaaaaaacaccgaccaacggtgtcagcgtcagaggcgtcgataatttactcgtccgttttgcacgatgttgtaatcccgtaccgggagatgacatcattggctatgtaacacgtggacgcggcgtatccgttcaccggacggattgcccgaatattccttcgggtacgggcgaagaccaggcacgtgtgattgaagtagagtgggaagaagcagcggaagtcaattacagcgtcgatattgagattacagggcatgatcgcaacggtttgctgaatgaagtgcttcaggccatttctgagaacaaaactagcttctcggccgttacaggtcgtacagataaaaataaaatggcgatgattcacatcacgattctcattcgcaacacggatcatttgcattctgtagtcgaacggatcaaacgggtgaaggatgtatacactgtgcatcggattatgcaataaccttattaagcgtacagataggtttatagcctttgtaacacatcttgggtagaaagacccatggggtgctaaaagagccataatacggctgtgagcaccttttaaaagggaaggttaaaggagatatcggataggcgatgaagatcattattcagcgctgtaaagacgctcaggtaacggtgaatcaaaaggtggtcggcaagattggaaccggattaatgctgctggttggtattggtcagggagatacagcagccgatgccgtttatttggcggataaaacagcgggattacgtatatttgaggatgctgaaggtaaaatgaatgacagcgttctggatgtcggtggagccattttgtctgtctcccaatttacgttgtatggtgactgtcgtaaaggaagaaggcctaactttatgggggcggccaaacctgaggaagcggagaaactgtatgattttttcaacagccagcttcgagccaagggcctggaggtagaaacgggaatctttggggctatgatggatgtttcattgacgaactggggcccagtgacactgattttggataccgaacgtttgtaactatacattcatggcgtgatctgagtagaataaaatagctgttcagagggaccataatgtcatcccgattggtgattagccaggcggatagcctaagggtgacaggagagacgaagctatgcgtcaaaccccgaaaatggacgggcatcgaagcactgtgctgctttttcccggtagcatgcaggaggcaatcagccttactcgtaatgctgatacgttattacagcatgttgcagcagccatcgacaagccgggacgcggtgctttgccacgcaggtaacatcgggttaaatgtagtgttaatgaggtgctacccgaaagtagcacaaagaggccaaaaataaaatatgtagcattgaattagtgtaggagccgaaaggctcgtcagattgtcgagaaacccc

SEQ ID NO: 64 - DNA, 96103 bp, Unknown
  Kingdom: Bacteria, Phylum: Firmicutes, Class: Bacilli, Order: Bacillales, Family: Paenibacillaceae, Genus: Paenibacillus
gtaggacgtcgccaagcaacaagtaaaaaggatcatgatctcgttgagattatgatcctttttttgcatatacgtatattttagaaatatccttacaaaaggaaggtaacatttttgttacggaatgtaggagtaaaccctgtataatataggtattgaatcccatacacacacgctgcattattgcagaattatgcaaactccatcataggattttgtatagtcaatcaggctggtaaggagggaagatcatgcggcgaaataaatggcttgctctattggtgctattcagtgtcgctgtcgcgattcttaccgggtgcgtggaagaggagccttcttggacatcgtttgagggtgctgccaacgagaagacgtttccggttcctaaagaagctagtaaaaccgatcgggccagcagtaattcggacatggactatgttcgctatgcactgccagcgttgaaggaaagtgatagtctacctgctccttatctagaggagattgcagcttggggctggactgaggaaccgaatttatccacctcgaatcagaaggtgtttcagaaaaataagcatatggtgcatttgtctgtgcatgatggttcttttactgtattggttccaaaagacagaaaggctgttgtgaagagcaaaagcgtggatcttaattagggacacggttttcaaccgagtaagtagcataggatttattgtagatcatatttatagtaaactcagcatattgtatgcagtgtatcatgatgaatgaagagatcggatatggggaagcactcagaactgccgttgagtagggagtggcttccttttatatatttgcatgttgatcaaatgctctacatgaataacgtggataacgatgaggaaaagttacttgataagagaataaagcgattttaattgttaagccataaaaaaaggagtaaccgtttgaggttgctccttttttattgcttcagtctagattgttgataggttagttcagacctgagttttctatctgtacggataattagtggttaaatttactgttgataatatgaggcatcttcatcggtaaacttcaacatgccgtcttttctctcgcctgtaagccgactgaggatgtatagacgcggtgcaataagccatagatgccagaagagtaaggatacagtaaaggctggtggagaccagagaatgaatacggctgataagcagataccgatccagagggtatgtatgtgcacacgacgaaagatgctatagcctatgtactggtctgtcatatagcctagccaaggtaatttacggtggaatgcccagcgtttgcggaaggatgttccgccaccgatgtataggacagatcgtgagattacgaagtgtacccataaggttaggaaaaaggcaagagcaaacaaaaacacgctagtccaggaaaaggcaagaagtagaaagagaagcataataacaggcagtgtgatatgactccatattagttgacgcggtatactgatttttttaatgagcttgtagtgatagtaggtagctttggttccggtttcctctgtcatgcgaacagtcctttcattaatctactgcatcacaagtggcttcccgtccacagccggaaaaagggacggtacttcgctcatgccgctttaaataagcatttaatcgtttttgtagaaatacagaatgatcgacatccagtgttagctagcctactctataattactggaaaagctatcactgatgaagtgttcaagggctccgatgaaagggtatccatacataagagcttttcttattatatcggcatagacggctgttttttaaacatacggggtacaaacaccataatggcccagatggaatatatatagagtatatcgtcgaactgggctatgaaaaggtttaaaatagtagaaagtgccccatactaatagtaaaagaaacaaggtgggatggatatgcatgatcaaggcggccaccgctgtattatatgcgggcagcacaagcatgaaggcatttttatcgtttccgagtttatctgtgatacgtgtgaagctgaaatggtgcacacggatgcaactgatgccaaatatcatttttttattgatcaactaaagcaaatctgggtacagaaaaatgcataatatcctttgctaattagtctttgaaggattggcattctaaggtctgtcgatacgggcctttttttctgtgagtaaaagtaggattccgcttgattttacgataaaataaggtagatataaagctttgtttggaaggattgcagaatgatggggaaaaaggcggtacatgcaccattaatggaagctctaatacgttaccggactcagggcaatgcttctttccatgtacccggtcataaaaatggagaagtatatgagcatgaaaatattgcatctctgttgcaagaagtgatgtctattgatgcgacagaaattactggactggatgatttgcatcacccagaagatgtgattcgtgaagggcaagagctagctgcaaagtgctttggtgctgaagagagcttttggctaattggaggaagcacggtcggtaatttggctatgattttaactgtatgtacggagccgggagatctactgctggtacagagaaatgtacacaagtctgtcctgaacggtctcatgctgtcaggggctaatgcggtattcctagatccggaaatagatacactaagcgggctggcggttgccccaacgacggatacaataaaagctgcactgaagtcctatccttcggctaaaggggtgttacttacactacctaattactatgggatggggcatgacctgaaggcaacggctaaggcctgtcatgcagcccatgtgccgctattgatagatgaggcacatggtgcccattatgggctgcatcctcgtttgccagcctctgcgctatcctgcggggctgatgtagtcgtccagtcgacacataaaatgcttccagccatgaccatgggggccatgttacatgtgcagggagagagaatccatcgggaactgcttcgtcagcgtttggcgatggtgcaaagctctagcccttcttatccgttaatggcttcactggatttggcaagatggtatatagaggcgtatggaacagatgcttttacagtgggcttagcggcggcagatgcttttagaaagggcctggagcagctcccacgctttcgcttgctagaacctacacagcaggcactagagggagaatatgctcacaggggaatctctgaggtcctagaaagggctgatgagggaataagcggatattcaacccaggatccttttaaattggtgctgtatgatacatggggtatactggatgggtttggactcaagcatgagttggagacttacggatgtgttccagagatgagcgacgaaaaacatgttgttttattgtttacgttaggctctacggctaaggatgcgagtcacctgttgcaggctcttgtgcatataaataatgatataagatttaaggagacggctggtgagccggggtcaacggaaaaagggcagcaaagattcgaattagatttttccacgtggaacaatgatagaatgaagggatactctagtccggtgccgtttgggcttcgaccgattagcccggatcagatggagaccgtgcctgtagacgaatccgctggcagggtagcggctgaaatgattatcccgtatcctccaggtattccactgctatatgcaggagaaacgattacagaagcgattgcattgcggatgagtcgtctacgtgagctgggagccaagtggcacggggtagcagatgaaagtatgcttacaattcgggtattccgtttacaataaagattagatactagagacttaacaaatacagaagactgaataaaagaagcatacgtagcctatgggtgacttttatttttcaggcaggaaagcagggaataacatgaatcgcaaaggcatttttatcacactggaggggggagacggctccggtaaaacaactatgattcaacggttggcgaagtttatggaggaagaaggctatccagtcatcacgacgagggagccgggtggcatcgaaatttccgaaaagattcgttctatcattttggaccctgctcataccagtatggatgctcgaacagaggcgcttttatacgcggcggcgcggcgccagcatttggtggagaaggtaaagccggctattgaacagggagctatcgtattatgtgatcgttttgtggatagtagtttggtctatcaaggatttgcaagagggatcggaattgaagaggtagcttcaattaatcgcttcgcggtggatgattgggagccggatgccacattttatctggatattgagcccgaattgggattggcaagaattaatgcgtcacgaggagcagaaatggaccgcctcgacatggagagtatatcgtttcaccataaggtgcgagaggcatatttggagttggctcgcaaatttccagagcgaattacaattgttgatgcatctccggcgccagagcaggtggagcaagtattgaaggatttgctgaaaaagcggtttgttcagaattttagcatataattgtcgaaggatatacggtaaaattgagctagggacaaggttgtctctaatatgacctgaaggaggaatacaggatgaagctgattattgcgattgtacaggataaggacagtaacagattatccagcggactggtgaaagctaatttccgtgctactaaattggcgagcacaggaggatttctgcgtgctggtaatacgacatttatgatcggtgttgatgacaatcaggtggactcattaatgaacgtcattcgcagcagttgcaaggttcgtgaacagctggtcacacccgttacccctatgagcgggacgacggattcctatttaccgttgcctgttgaagtccaggtgggtggagcgacggtattcgtgatgcctgtagaccgtttcgagcatttctgaatctacacaatagggcctattctgccgatatgataggggaatcgcctgtatcttctcacatgatgagagtgagggcagatccactaaaacggcagcgctacagcgcagttcccggaaagccgaaaaaaccctgagttctagattgaactgttcatgaagggggaaagtggaagcatccggggagaaagcaggtttatatgaaaataaatccgggctatcgccctttacaaagtacattgtctacaaatgaaatgagtgcaaagccaattcagcccaagagcttctccgacgttatgcagcaaaatggggagcaagcttcgcaggaggaattgaatcggcgctttaaggaaatacaaatgcagggagatcgtcttgcacgttcaatgacgattcgtgagctgaaggcctataagatgttggttaaacggtttttggaagataccgttcggcgaggcgtgtccatgaaggacacgaagggctgggatcgccggggacgcagcaaacgttataagctgatagatgaagtggatgagctgttgctcaaaatggcggatgagctgctcgaaaccgagcaaggcaagattgagcttttgcaaggggtcggtgagatcagaggattgctaattaatctctcattttaatgtagacttatgttataaatgaatacagacgggctgttgccacgaagaaataatctgcttgctgatcatgctggcagattatttttgactatgtacatgcctggaagaacaacgatttgccgatggatcacagttgttttcagtggagaaagtgaggaaatatgtcttttcaacatataatgggccaggatgtagccaaaaaaatgctgcaaagtgcactacggaatcatacggtcaaccatgcctatgtttttagcgggccgccgggaagcgggcagatgaacatggcgcagatctttgctaaggctttattttgtgagcgacagacggatgatgcatgcggggagtgtttgtcatgccgcaaggtagagcacgggaatcatccagatttgcatattgtagagccggatggagctacgattaaaattgatcagattcgtgggcttcaacgtatattttcttacaaatctgaaagctccaatccgaaggtatatatcattcggcaggcggataccatgacagtgcaagctgctaatagcctacttaaatttctggaggagccccagattccagtggtcggcatactcatttctgaaaatggacaggcgttgctgcctacgattcaatcacggacgcagcaggttcctttccacgctttacagccggagatgatgatgcaggcattaattggggaaggctatacggcagggcttgtccggtcggtcgttcatattgcttcaggactggaatcatgtagagaaattctccagcagaattggtttgcagaaattagaaacgtagtgttacaattagtgaaggagtccatgagtcgggggagctcgtctattattctggctcaacagaagatttttaaaactggactttctgaacacctggatattctgtttcatctgtttcatttgtggtttaaggatatgcttcatttccgttacggaaggcacgaaagcattgttttcatagatcatttggagtccgtctccaaattggcaatcacccgcagcacggaacaatgggtctcttatatggatttggccgcgaattgcaggaagaagctccgttttcacgtcaacgggcaattatgcgtggagcagcttctgattgggttgtccgatacaagcggttctatcaccggctaacaggaaggcgcgcttgttccactctgcacaatccgcgacgccaggttcccggtttgtgcgacagtgagacttcaattgcggccattcgtacaatgtcggcttcaaatgaggtttagtggcatacaagggggttaatttttgtatagtgtagtgggtgtccgtttcaagaaggcgggcaagacttattattttgatccgctggatcttccagtggagaaagaaaactgcgtcattgtagagaccgcgcgcggtattgaatatggcaaggttgtagtgggcaaaaaagaggtaaatgattcggatgttgtcctgcccttaaaaaaagtcattcgtattgctggggatgatgacgctcttgttgtagaagagaataaattggcggccaaggatgcattcggcacgtgtttaaataaaattaaagaccatggccttaaaatgaagctggtagatgtagaatttacatttgaccgaaataagatcattttttattttacggcagagggtcgggtggattttcgagagcttgtaaaggacttggccagtatttttcgtacacggatcgagctgcggcagatcggcgtacgggatgaggctaaaatgcttggcggaatcggaccttgtggacgtattctgtgttgctcctcatggctgggggattttgagccggtatctattaagatggcgaaggatcagagtttgtcgctgaatccgacgaagatttccgggttgtgcgggagattgatgtgctgtctcaagtttgaacatgataactatgaaagcatgcgagaagagctacctcaggtgggtaagatggttatcacctctttgggagaaggtaaagtcgtaggtgtgaatgcaggtcatcgcacggtgcatgttcaactgtttgagatcagtaaggtcaaggaacttccaatggacgatgtagtcgtcaagtaaaccattaggttgcttcggggtggaaacttggataaattaaatgtttttgcgcgtattcacgaaatggaaacccaaatgggacagttgcatagcgatctgggtgaattgaaactggcagtaaaagagctgctggaggaaaatcaacgactaacgattgaaaacgaacaggtgcgcaagatgctcaaacgtgaaacctctggggaagaaaagacggcaaacaagccgaagcttcctcctccgatcatcattaaggatgaagggcaaacgggtgaggtcgtgggcgaaggctacgacaatctagcgaggctgtatcatgaaggatttcatatatgcaacgtgtattacggacatttgcgaacggaaggcgattgcctcttctgtctgtcatttttgaataaataaaacaagccgtaggagcaagatgcctacggcttttttgtaaggaagtatgagtgaaaagcgattttggttataaaagatgggagagcattatgtacgaaaatgaaaagaagtcggaacgaattgatgatctgctttcacataatttgcgtataatccaaagtgatgaagtattcagcttctcgatggacgcagtcttgctggcacgttttgccggtattccacagcgtgggaagattctggatctgtgtactggcaatggggttgtcccgctgttgctaacgacacgaacaaaggcgtctattgaaggaattgagattcaaccacgcttggcagatatggctagacggagtgtcagcttgaatggattagaagcagcaattcagattcgggaaggggacctacgtgagctggttcacatcacgggacatggtgtttatgatgcgattaccgtgaatcccccctatatgccgctaaatggtagcgatatcaagctgaatcctcaccaggcaattgcccgtcatgaagtgaactgcacactcgaagaagtcattcaggcatccacccggcttgtccgtaatgggggaaaggtatctatggttcatcgcccgcagcggctgggtgagattataaccttgatgcgtaaacatagtttggaacccaaacgaatacgttttgttcacccacgagttcatatggaagccaatatggtcctggttgaagcattacgtgacggcaaaccggaggttcgtttgttgcctccgctcattgtatatcaggaaaatgggaattatactcaggaaataagagatatctatggagaagtaagcaagggggattctgtgtgaaagcagctgtacaaaaaagctttagtaccagcgaagaagaacggggaaagttgtatcttgttgcgacacctattggaaatctggacgatatgacctttagggcgattaacaccttaaaatcatgtagtattatcgctgctgaagatacacggcagacacgcaaactgctcactcatttcgaaattacaccggatatgctcttcagttatcatgaacataataaggctgctagtgggcctgaactgatacgttatataatagaaggaaaaaatttggcactggttagcgatgcaggtctaccggccatttctgaccctggttcggatctggtcaaactggcactggaagcggaaattagcgtcattcctatcccaggagcaaatgcggcactatcggctttaattgcctcaggactggatacagataggttcaccttcgctggctttccaccacgggagaaaaaggacctagagaagctgttgctatcgtttcaggtatctcacggcacaattattttttatgaatcgcctcatcgtattgtgaagacattgatggtgttgaaggaaacattaggttcacgcaaagtggtgcttgcgcgtgagctgaccaagctgcatgaggaatgggtgcggggaaccgtggagcaatgccttgctaaactagaggggaatccgccaattggtgaatattgcctggtggttgaagggaaagacgaagaggaagaggaacaggaacgtcaggcatggtggcagtctttatctttggagtcccacgtcgcacattatgaggcagagggactcacacgcaaggatgcaatgaagcgtacagccacagatcgttcaatctccaagagagatgtttataacgcactcttatgaatatctgcctaaacaaaaaagggccttccaacggttgggttcaaaccgtggaaggcaacaaggagtatatatgaaaaaggttagaattaacaatatctgataagtctattatatactaaaattctcagtttgtcacaggtgttgggatttcagaaatgcaatcttggcaaacaatttttcctttgaagtaaattacgttctcagcattgccgcagaagatacaagctggctcgtattttttaagcatgatgcgttcgccatcaacataaatttccaaagcgtctttctctccgattcccagggtacggcgcaattcgattggaataacaacacgtccgagctcgtcaacttttcttacaataccagtggatttcatcataataaatcaggctcctctcgccgtttaaaataatataagtgtcatgattcgacaaaattttctcttttctgatatttactataccaacgattcccaaaacagtcaaccttaaaaatgtagtaacagtctgattatgcaaaagtatttagattaaagagctttacttgtgtgtattgccttatcttattgatgatttattcagtttgtcgatttggaaatgtcgaaaaactataattcgacatattacgacaaagaatgtcgaatgagggaaaccatttaggattttattgtattttaatccattattccgaatattaaaggagctgatatcttgcaccagccactcagtgaagaaaaagtttttaaagacccggtacataattacatccatgttcaggatactgtgatatggcggttgatcaacacgccggagttccaacgtttacggcgcatacggcagttaggcacgtcgtatcttacgtttcatggagcggagcatagccggttttcacactcattgggcgtatatgagattacgagaagtattatttctcaatttgaacgtggagatttcccggattggccgaaggaggaaaggctggttgctctgtgtgcagctctattgcatgatgtggggcatggcccattttctcattcaattgaggaagcctttcatatgaaccatgaggattggacatgccgcattgtactgggagacacgaagatcaacgccgtgctacggcaagtcgacgagaagcttccacaaaaggtggctgcggttatagccaaaacgtatgataaaccgattgttgtcaacctggtaaccagtccgctagatgccgatcgtatggattatttgttgcgggatgctcactcgacaggcgtcaactacggcacgattgatttggatcgtattttacgactgctgcgtcctcataatgggagaattgttgtgaaggaatcaggtatgcatgcagtagaagattatttaatgtcacgctaccagatgtattggcaaatttattttcatcctgtaacacgcagctcggaaatccttttacgtaaaatttttaagcgagcaaaggaattgtttaaaaacggatatgagtttggctttctgctggacccgttgccggatctgttgaaaggagatcttacagtagagcaatatctgatgctcgacgagtcattaatccagaccgtatttagccagtggaaacgagaaaaggacgagattttaagtgatttgagcagccggtttatggaccgtagattgtataaatatgtagagattgaaaatatggatacagataccattgacagtattcgagaagctttgaaagaggctggtttgcaccctgaatatgattttgaaattgattttccgacagatcttccttatgatgtgtttcggcagggtggctcgacggacaaccagattttactgcttggacgtcagggcgaggtgagtgaaatatccgaagtttcggaaattgtacgctcaataagtggtattcaccgagggaaatatcatatgtattttccccagaataaattgaacgcggtaaaagacaggcttccttccgaaataaggaattattttgtcaaagaatagacaacaatatagaaatgtaagtaaaaaaaggagatgtaaaccttggatttattcgacactcatactcacttggatgcgccacaatttgacgaagatcgtgaagaagttatagcacgtgctgtcgaatcaggagtaacgcggatgatcaatatcggatttaatcgtgagaccattccatccaccatgaaattggccgagacgtatgattttatttatgcggcagttggatggcacccacaggatgctattacaatgcaggagggcgatctagaatggattgcatcgttatgcagtcataaaaaggttgtagccatcggggagatcggtctggattattattgggatacgtcaccgaaggatgtgcagcatcgggtgtttcgaaatcaaattggtctggctcgtgagctcaagatgcccattgttattcataaccggaatgcacatgaagatattgttaagattttgcgtgaggaaaaagcgagtgagattggtggagtcatgcactccttttcgggtagctgggagacagccaaaatggtgctggatatgggatttcacctttccttcggtggtccaataacgttcaaaaatgccaagcagccaaaagaggtgctcgcacaggtgccgctggaccgtctgctcattgaaactgatgctccctatctgacacctcatccgtttcgtgggaagcgaaatgagtctgcacatgtgagactggtagcagaggctgcagcccaaatcaaagggattacagtggaggaattagtgtcaataacgacccgaaatgccctggaacgatttgacattcaatgaaaaagtgaagaaatcgatcaaaataaagagatagacgaagctaatcatgaatttgttgcaggaaactcgagaatattacaatattttaaccgaatattttaaaaaatgtacttgaaacctgctttacaacatgcatagaaacaggatatcatcttttcagtgaattgttgtttgaatgtaaacatcaacaagtcatttcatgaaccagtctcgctgagtcccttttacagggaacgggggaaccgatatggcttacagtacgtccggcgtatgtgcaagaagggaacgtctcttccgccagccggctcgacctaaattcttttcccggatgggattgaacaggtggaggagccgtatttcgatttctttctgggtcttcggggtgaatgtgaaggcgaccgccatgagcggttgacccaagctagggcgactctctacgtccgaacccgacagctaaccccgtaagcgtaacaagagagaagccatctcgtgcatgagttttcccgcatattcacacatgccggaagccacgaaagagctctctagtctctttctctggctttttttgttgtgaataaaagaaaatctgtcatcatactgtggttaaacaggggaggacagcatgccgcgaagacgggtacatggtgcaggacagtcgtagtttgggcttgtcttgtagaaaatctgttatagtcacgtcaaatctcaactatgtcttactccagacggcgggctatgtaaggaggacggaggaaatgggcattttccaaaaaaaggatacccatgagtcacgctcatccagcatgtcttacgtattgcgttggaagcaagagaatgtgcgccaggctgctttggttgctatttttctaatcgcgctaacgattatgatttcaattctgatgtacacgcaatctaaaaaacaagtcttttttgtcatcgatggcaaggcgtctgcggtagaaacccgggaatccatgcttcaagatttgctgagcgagcattccatttcacttcagccgcatgatacagtttccatgccgctaaatggagcaatacaggatggcgatcgcgtagtcattaaacgtgccaatcaggttaaagtatcttcaggcaatgagacgaaaaagctgtacacaacagaaaatacagtagaaggtgccattcgtacctcgggctataaattatcatcaacggataaagtttatcctgcgttggatgcctctgtttcgtctaacatggacataaaaatcgtccgtgtgaagaaacagcaggtcgaacagaaaaaacaggtgccttatcaggtcatcaaaacggccgatccgagtctttataaaggcgataatcgggtcattcaaagcggcaaatcgggtgtggtcgtccagcacgttcaaaaggtatatcatgatggaaagttggtatccaaacagctggttaacaaggaagttgcacagaaccgggtggataaggtcattgcggtaggaacgaagaaaaaaccggtcgttcttgctgcttccgtcggtcccaatgatgcggttaaggcaacgacggttagttcgggcagtgctgtccgtaaagcaggcgtaaattttaaatatagcaaagttttacaaaacgtctccatgacggcgtattcctcacaggagccaggtatcggtacacgtactgcatccggcgcacgtgtcacggaaggacgcaccatcgcggtcgatccgagtataattccaatcggctggtgggtgtatatcgaaggggtgggcttccgtcgtgcggaggataccggtggcgcgattaaaggccacaaaatcgatgtgtattatgagagtttgagccgagccaaccaatttggtcgtaagcacggtaaaaccgtatatgttatcggaccggtaaagcctgaaatcaactaaaacaggttgtgtatgttgagggcaatgcgatagtattaacaacatagttatgccatgctaagaagaggatatcctcttcttattttgttttcaaaagcagggaaagataaatatagcttgctgtgtagcagtggagggaaacgcaaatgatcaaggaagtgatcgtggtagagggccgggatgatacggtggccattcgccgcgctgttgaagcggatacgatagaaactggcggctccgccattaataaaatgacgctgcgtaaaattgcattggcgcaggagcggcggggggtcatcattttaaccgatcccgatcatgcaggggagcgcatccgtaagattatcgcttccaaggtacccggctgcaagcaggcctttatacccgaggcagaagcgacgcgtaaaggagatattggcgtggagaatgcctcaccagaagcgatcagacacgctcttgcacgggtccatacgacagtggaaggcgccgacccgctgattgagtgggcggacctgattgatgctggactcatcacccatcccaatgctgctgcacgccgtatggccttagggaatgtgctgggtattggttattgtaacggaaagcagctacataaacggctctctgtatttcagatcagccgcgaggaatttgccggggcgctggcacaaattgaaagtgaaggattgtgatgtccgtatgacagggattcaagatatagcaacaccgcggcgtacgaaggaaattattcaacggcacggtttttcgttcaaaaagagtttgggtcaaaatttcctgattgatcaaaatattctcaataagattgtaaatgctgctggattggatgagacgaagggtgcacttgagatcggtcctgggattggcgctttgaccgagaagctggctcaatcggccaaggcagttaccgctgtcgagattgaccagcggctgctgccaattctcgaagaggtgttggccccttacgagcatgtgaaggtacgtcatggagacgtgctgaagctggatttgcgagaggtgttcgcagccgattttgcagacgtgagtaaagtaagtgtcgtggctaatctgccgtactatgttaccacaccgattctgatgaggctgctggaggacaagctccctctggagaatatcgtcgttatgatccaaaaagaagtggctgagcgcatggctgcgtctcctggaacgaaggattacggcagtctgagcattgcagtgcaatattacagcgaacctgaattagtctgcactgtgccgaacacagtatttattccccagccaaatgtggagtctgcagtcatacggctgcgtgtacgggaagcccctccggtggaagtggtggatgagaagcacttctttgaagtggttcatgctgcttttgcccagcgtcgtaaaaccatttccaataacttaaaaagccgtttcttcaccaaagagaacagggacacgctggagccgctgttgcaacaagctggtattgaaccctcccgtcgaggagaaacgctaagtattgaggaatttgcgcgtctcagcgctgtgctgttggaggcaggtatatcctaagctggaaccaaactgtgcattcacccatacgatataggaggggtgatacagtgtgatgagtttaggggacttggtcgttcggaaatcgtacggcggagatgtcacgtttcgtgttgaggacatccagcgggataaagcgatcattaagggaatagaatttcggctgctggccgattccccggtgaacgatctggtcagagtgcctgcagaccagattagcggtaagactcagcaggcccacattaaggctggtgagtctcttaatctgttgcaacgggcacgccagcagcaagctgctcgtagtcaggcagctctggtaggggactggagtgatccggttgagtcaacatattttgaaatgccgggaaaggttcttcacctggatggagatcccagctatctgaaaaaatgtctcagtttatatgaacagctccgtgttcctgcagagggacatcacgttcacgaatcggcaatggcggacacgttgtaccgactgcttcctcgtatccgtccggatatcgtagtcattaccggacatgacggtgtgctgaagcagccacagccttacgatttgtacagcttgaaaagttataaaaattcgcaaaattttgtggcggcgattcaggtagcaagacaatatgaacgtcatctggattcgctgacgattgtagcgggggcgtgccagtcccattttgaggcgctgctacgtgcgggagcgaacttcgccagctcaccagggcgtatcctgattcacgcgctggaccccgtttacgtggctgccaaggcggcctttacttcgatccgtgatacggtcaacatgggggacctgtttcaccagacaatcagtggcagtcgcggagtgggtggaattgaaactaggggaagctatcgcatcggcctgccgaagcttgaaaatttatcaacgcttaaagtaacgccttccgcaatctaggattcaaatgtgccaataggattaacctgagcaaaaagcctctgctttgaggctttttgtcattttttatataaattattcctgttcgcaaaaaattaaattgacaacttatttttcgtgttgttataatatttagcttgatttgacaatccctctaaaattcgttataatggacaaggaaagaggtggtcgttaggcaatggctaaaaatacgctgttggaaatcaaacgcagtctcgacgcacatgtagggcaaaaaattttgctgcgggctaacggcggacgccgtaagaccgtcgaacgaactggtgtcttggaagaaacgtacccttctgtttttatcgtcaagctggatcaggagcaacagacgtttaaacgtgtctcctacagctatgctgacattcttaccgagtcggtagaagtcagcgtatatgatcccgactcccatacaagtgtagtcgaatattttgaaacaccttaattgatttcgtgatttataccagctttgcaggtttaacgacggcttcgtcatttcaaatgacggggccgttttgtatatacagagcaggatgaagcatgacatctctgcacatactaagccgggaatgatcttccttattccattgccgaaggaggcgtatgtatgagccgaagaagacggagtgtcatgtcggaggagctaaagtacgagctggccaaagatcttggattttacgacacggtcaaggaagaaggctggggaggcattaaagccaaggatgcgggcaatatggtcaagcgggctatccaacttgccgagcaggcagcttcccgcaaatcgtagctatcggtggtgctgatgaaaagcggggatatccgggattagaccgggtcatctccgcttttttgaacctcatgacttgacacgctgagtctgatataatatgttaagctgtcttgagggaaaagttgaaggtgggtgaacgccttgaaaatatatgaaaaagcaccggcgaaaatcaatttaatgcttgatgttctacgtaagcgggacgatggttatcacgaggtcgaaatgattatgaccatggtcgatctgtctgaccgattgacgatgtctgagttaccgcgtgataccattattatttcaagtcaagctgggtacataccattggatgaaaagaacttggcttttcaggctgctcgtctgatcaaagaacgttataacgtgtctacgggcgtccacattcatctggataagcatatcccggtggcggcagggttggcaggtggaagtagtgatgctgccgcagcgctgcgtggactgaacaagctatggaagcttggtatttcggatgccgaattaagggtgctgggtgcggaactgggctcagatgtacctttctgtattacagggggtacagctttagcaagtggacgcggagaactgctcaagccacttccgaatccgccacaatgctgggtgatccttgcgaagccgccgattaatgtatcgacggctgaagtgtatggtcgtgtcaaagcagatcagattgcgcaccacccgtctgcccgccagatggagcatgcgatccataacgcttcttttacggatgtatgcaacgcgctggggaatgtacttgaggatgtaacactaaagctgtatccagaggtagagcatcttaaaaactccatgatacgcttaggagcagacggtgtgctgatgtcaggtagtggacctacagtgttcggactggtatcgaaggaagccaaagtgccacggatttacaatggactaagagggttttgtaaagatgtgtatgcagtacgacttttgacctgattttagatatttctttcatattatagtggtaattgttgtacaaatacgtacgaagatgatatatttactattaaatattcggattttactatatcacttacattccgccagcaaccggccagtccgccggtgctttactgtacaaagcgggcggcaggagaatagatcgcgaggaattgttgtgaaaaaacttaaaagaagctcacgattggtggaaatgacgcaatttttgttgtcacggccgcatacgctggtgcctcttactcattttgcggatcgctacggggcagctaagtcctccataagcgaggatctggccatcatcaaggaagtttttgaggatgagggcactggcgagcttctgacactggcgggagcggcagggggcgtgaaactgatcccgaggctttccaagcaacatgcgcttgcgtttgcgaacgacctgtgtgcacaactggagcagcctgaccgcatattaccgggaggatacctgtatttgtccgatttgctgggccaacctgcgatgatgaacgaagctggtaaaatattcgcgaccgcttttgccaatcgtcagattgatgtggttatgacggtggagaccaagggtattccacttgcctatgcaaccggagcacagcttaatttgccagtcgttctcgtacggcgtgatcatcaggtgacagaaggctcggctgtaagtattaattatgtttcaggatcacaaaagagcctgcatacgatgtctttatccagacgtgcgatgcgtgagaaatcgcgtgtgctcatcgtagatgattttatgaaggccggtggcacgattcaggggatggtcgacttgctggctgagtttgatgctgaggtggccggtgtaggtgtgctggtagaatcaggcgaggtggagaacgaagagcgcctgctgcacgattatatttcactggcgaatctgaccgcagtcgattctcgaagcaagcaaattacggtcaagctgggcaattattttgctgagtgaacagggcagtaaattgtcacaatccatcataaaatacctaaatatgtcgaaaagaaatcttttcaaaaaaattacctgaatttaggatacgaattaccgaaaaaaagaaggatttcgaactgctgtgtggaatgtatacaccaagtcctatttggaaaaaggtggtgaaacacacatgcagattacggatgttagactccgccgagtgaactcagaaggaagaatgaaggcgattgcatccattacgattgataacgagtttgttgttcatgacatccgagttatcgacggtaataacgggatgttcgtagctatgccaagcaaacgaactccagacggagagtttcgcgatatcgctcatccgatatcttcaggaacccgtgagaagatccaagctgctgtattgactgagtacgaacgtgcagctgtggatgaagaagttgctattgaagaaggcgcttaattcgcctaaagcaggattggggtacaaaagaaaaagagagccactaactgtggctctcttttctttttgtctggaatgagatatattctttagtgagttaacagtcagttttaaggcaacttggagccatccgggctgccgaagcggctttttcataagacagggactaggcagagatgcgtcccggggatgaatgtccagcacaagctggcctgaaaaaatagccattaaccaaaggttcgccgttatttttcaggaggattgtgaaaagttaagcaaaatctgatctgggaattaacgttttagccaaggggtaactgttattttcaggataggaggttggacttgttggaaaggttggcagtcattcttgccgcagggcagggaaaacgtatgaaatccaaattatataaagttctgcatccggtgtgcggaaaaccgatggtggggcatgtgctcgacacggttcgtgaaatcggtgtgtcccgaagcgtagtcgtcgtgggtcatggagcagaggcggtacagtcttatttgggaccgtcggcagaatatgcgcttcaggctgagcagttgggaacgggccatgctgtcaagcaagccaaggacttgctcggtcaggaaaaaggtacaaccattgtcatttgtggggatactcctttgatcacagcggaaacgctggagggcttggtgcaactgcacgagagccgtggggcggctgcgacgattctgaccgctgagttggacgacccgaaaggatatggacgagttattcgtgatgcttccggggccgtgctcaagatcgtggaacagaaagattgttcacctgaggaagatgctgtccgggagatcaatacgggaacgtactgctttgacaatgccaagctgtttgcagcgctggacaaggtaacgaacaccaatgcacagcaggaatattacctgacagatgtcattggtattttgcatggtgaaggtgagcaggttgaggcgtatttgacagatgatgtgtctgaatccatcggtgttaacgacagagtggctttgtcgatagctgagggctatatgcgtgagcgcattgttcgcaagcatatgctgaatggtgtcactgtcattgatccgtcttctacctatatcgggagcgaggttgttattggttccgatacggtactgtacccgaacacatggctgcatggtcaaacacaaatcggagaagattgtgtgattggtccacaggctgagattcagaatacgattatccattcaggcgcaacggtaaaacattcggtgttgaacgaagcggaagtgggaagcagtacatctgtggggccgtttgcttatctgcgtccaggcgcgaagcttggcgaacatgtgaaaattggtgattttgttgaggtgaaaaatgcgaccattggagatcattccaaggtgtctcatttgagctatgtcggtgatgccaaggtgggtacaaacgtaaatattggctgcggggcaataacggtcaattatgatggatataataaatccattacagaaattgaagacgatgcctttattggcagcaacgtgaatctgatcgccccgattaagattggaaaaggtgcttatgttgtagcaggctccactgtaacacatgctgtccctgataacgatctggccattgccagaccacgtcaagagaacaaagccggatatgcggacaaaatccgcgcacgtgccaaagcgaagaagaaaagatcggaatgaccttaatcagcaagctgttgaatctgtaatgaatgaaccagcacggagggtttctattaatgacttattgcgattccaaactcaaaatatttacttgtaactccaatccgaagttagcccaccagattgcggactacatcggcatcccaatgggggaatcccataccacatcgtttagtgacggtgaaatccaggttaagctgtcggaaagcgtacgcggctgccatgtgtatattgtgcagtcaacttgtctgccggttaacgacaacttgatggagttattggttatgattgatgcacttaaacgcgcttctgccaaaagtatcaatgtcgttatgccatattacggttacgctcgtcaggatcgtaaagctcgttcacgcgatccgattacagcgaagcttgtcgctaacttgattgaaaaagcgggagctcaccgcgtaatcagcatggatttgcatgcgatgcagattcagggattctttgatattccagtagatcatatgttgggagcgccaattctggcccaatatttccgttccaagcaaattgagaacccgattgtcgtttcacccgatcatggcggggttgttcgtgcgcgtaagctggcagacttcctgagtgcgccgctcgctattattgataagcgtcgtccagagccaaatgtcagtgaagtgatgaacatcatcgggaacattgagggtaaaacggctattttaattgatgatatcattgatacagccggaacgattgtattaggtgcaaatgcgcttaaagaaggcggcgtaaaagatgtgtatgcgtgttgtacacatgctgtgctgtccggtcctgctatggaaagactggagaattcgccattaaaagaggtggttgtgacggatacaatcccgatcgttcacccgaatccgacaagcaagctgaaggtattgtctgtggctccattaatgggagaagctatcatccgtgtgcatgaagaattgtcgatcagcaaactgtttgaaatcgaataagcgctggctcattaaaaaaggggttgccttttccatatggaaaaggtaacccctatcagcatgtcaggctaaaagcctgggcgagatatgaatgtgaaacgttgacgattgtatagtgtgtcctctatttcgacgaaatgctcattaaaacgcgcaacgatgccaatctgaatatgtacattcccgtcatagatctggacgggaacggaatgttttaaatgatatagaaaatggctgtcatataagaggatatcaccttgattgagcataccggcacgcaccttcctattcaatacaactattttaccaaaaaatcaagactgcgaaagagggtgtcaaagttatgaagtggattgtaggattgggcaaccccggtccccaatacgagaaaacgagacataatgtcggatttatggcattggatgctcttgcctcgcgtcataacatccagattaaccaaagcaaatgcaaggcattaattggagagggtcacattggtggcgtaaaaaccgtactgattaagccaatgacctatatgaatctatcaggcgagtctttacgtgcttatatggactattataaggccgatatggaagatctgattgtcgtgtacgatgatctggatacagaagtcggtaaaataagattgcgttatcaaggtagcgcaggcggtcataacggcattaaatcgatcattcagcataccggcacgcagtccttcaatcggattcgtatgggcatttcccgcccggagcctggacatgctattgtcgattatgttctgggtacctttcccaagaaggaaaaagaattactggccggaatgatcgaggacacgtgcaacgccttagaacacagcttgagtcatccgtttgaacggacgatggctgaattcaacaagtaagttcagacgtaggcagacgggcttaaatggaagattgttggacatactgaaaggtatagaaaactttcaggaggcatatacattacatgattgttaattatgtatgcagacattgtcgaactttcttgggacgaattgattccgcggcaataaccgaagaaaggttgggcttccattccttgacccctgccgaacgtagagatataatagcgtataattcgggtggtgaagtgaccgtcaaagtcatttgcgagcattgcagtcaggcattggagaataatccagagctgagtctgctcgttaatccgctacaataacaggtattcaactggtaggatgtaccagcttgagaggtgaagcggcaattccgcttatggagccttggcagcattgctgaggcttctttttcggtttacatgtaactatttataagcataaaggggtgccttttttgttacaagcacttattcaggcttttacgaaggatgctgattatgcatccattgcagcaggtatttcatcagggatgaaggaacaactgatatcaggtttatcaggctcttcccgacaggtactgatggccgcgcttgccgaagataccggacgaccgttaatggtcatgacgcacaatatgtttgccgctcaaaaaatagcagatgacttacaggaagcgctttctcctgatcaggttttattgtatcctgctaatgagctggtagctgctgaagctgcaatatccagtccagagacattgtcccaacgaattgatgtattgatacgctgcgcccagggttttcgtgggattgttgtcgtgccgttttctggtgtccgacgtttactgccaatcccggaaacatggcgtgaggctcgtattgagctgaaagaaggcgaaacgattcagctggaagcgtttttgctacatatggtcgagatgggctaccagcgtgtagagcgtgtggaatcacgtggagagatgagcgtacgcggaggaattattgatttttatccaatgacaacccgttggggctatcgtgtggagctgtttgacgatgaaatcgattcgatccgtaagtttgatccgcaagatcagcgttcggtggaaaaggttcaggacgttaccgtaacgccgtgtaaggaagttattgcgaataaccagcgtatggatcaggcggcggatgccgctgctattttgctggaggagcagctgggcaaaatgacggatcgtcaagctaagcagcacctgaaagaagagatccatcgtgaaattgagttgctgcgagagcatgtgtattttgacgaaatctataaatatatctccctgctgtatcctgaacgtaaaaccctagcagactatatgccggaagatacgattctgattattgacgaaccggcgcgtatgctggaaacagccaagcaactggaacgggatgagtcagaatggaatctgcatttgcttcaaaacggtaaaacgttaccgcagctagaactgtcagatgacgcggacaatctgctgtacaaccggagatttcagacgttgttcctgtcgatttttctccgtcaggttcctcatacccagccacaaaatattttgaatttcatctgccgaggaatgcaggatttccatggccaaatgaatgtgctcaaggcggagatggatcgttggcgcaaagccggcacgcaggttatgatgctggcaagtggagatgaacgtctggaccggatgcgccgagtgcttgaagattacggtattgatgagccgacgatggcaatcggcaatctgcaaagcggttttgaaatgccgtctattcatctggcagtcattaccgagggcgagatgttttcccagaagcagcggaaagctcgtaagcagggccggcatgtggacaatgcagaacggattaagagctatagcgagctgaaggtgggcgactacgtcgtacaccaaaatcacgggatcgggaagtacatggggatcggcacgctggaggttggcggtatccataaggattacatgcatgtcctctacgcgggtggagataagctgtctgtgccgattgaacaaattgatttgattcagaagtatgtcggctcagaggacaaggaacccaagatttataaactgggtggcaatgagtggacacgggttaaaagtaaggtgcgcagctcggttcaggatattgcggatgacttgatcaagctatatgcagaacgacagtcggcaccagggtttgcttttgaaaaggattcaccggagcaacaagagtttgaggatatgttcccgtatgatgagacacgtgaccagattcgggccattgaagagattaagaaggatatggagcagagccgcccgatggatcgtctgctatgcggtgatgtaggttacggcaaaactgaagttgccattcgtgctgcttttaagtctgctattgaaggcaaacaagtagcggtgctggtaccgacgacaattttggcacaacaacactatgagacgttccgtgaacgtttttcagggtatccgttcaatattcaggtattgagccgtttccgctcgcgcaaagagcagaatgagacgattaaaggagttcggcaaggcacggtcgatattgtcattggtacccatcgtctgttgtcgcaggatctggtgtttaaggacctcggaatgctgattgtcgatgaagaacagcgatttggcgtaactcacaaggaaaagctgaagaagctgaaaacgaacgtagatgtgctgacgttaacggcaacacctattccgcgtacgttgcatatgtccatgctgggtgtacgtgacttgtcagtcattgagacgccaccggaaaaccgttttccagtgcaaacctatgtggttgagcacagccaaactctagttcgtgaggccattgaacgcgagatggcacgcggtggacaggtgtactacctgtataatcgcgtgcagggtattcaggagatggctgccgagatcaatgcgctcgtaccggaggccaaggtgggcgtgggtcacggacagatgtccgaaaccgaactggagaaaacgattttggatttcctggatggcgaatacgatgtgctggtcagcaccagcattatcgaaaccggcgtggatattccaaatgtgaatacactcattgtgcatgatgccgataaaatggggctatctcagctttatcagctgcgtgggcgtgtaggtcgttccaatcggattgcctatgcttatttcacgtaccagcgggataaggtgctcacggaagtggcggagaagcgccttcagtcgattaaagaatttacggagctcggctccgggttcaagattgcaatgcgcgatttgtccatccgtggagcgggtaacttgcttggcgctgagcagcatggattcatcgcatccgtcggttttgatctttactcgcagatgctggctgaggaaattaataaacgtaaagtcagcgtacttggagaagaggatcagtccaatcggaattggagtacgtcgattgatttaggcgtcgatgcttacttgccgggagactatatttatgacagtatccagaagattgagatttataaaaaggttgcagcggtcagcacctttgacgaggcttccgaactggaggatgaactggtcgaccgatttggcgatctgccagaggctgtgcgtcatttgctagccgtggctcgcctcaaggtatatggacgtatgtatggcatcgagtccatggtgcaacgggatgacaatatagtgctgaaattccatgaagggcgccagcaggcggtacagaccgccaaacttgccgagattggcaatcgctttgaaagacgtgtacaatttgaacagggcacttctatgagcgcacgcataaagggcaagggtctaaatgatccacagttgctagaactgctggaacaatttctgagtgcattgaaagaagcattcacattgaaggaggaactgcaaaatgccacaactaaataaaagaaagccttggagaatgctctccttgggaatggcagcgctgctagctatatccgtgctggcagcatgtacgaagcaagcggatgagaacaaggtcaaggatgaaccgaaggacaacagcaaggttgtcgtgacctataagggtggaaccattaccgaaaatgagttcaaccaagaaatcagcatgatgaaattcctttacccggaatatgaggctgcgttagcatcggatcaggtacgggagcaaattgtaaagcaggaagtggtgtacaagcttctggcggccaaagcggacgacaaagccaaggagcagggtgccaaagaagggaacgaacagctggagcagtataaaaagtcagtcggagaagataagttcaagacatttctgagtgataaaaaactgaccgaacaaggtgtgaaagattacttcacgcgtgtaatgacggtaatcaacagcgaaaccaacaaagtaacagatgatcagctaaaacaggaatttgagaaaaataaagatcaattcacaacagcaactgtgcgccatgtattgattaacttcgaagatcctaaaacgaagaaacagcgcaaaaaagaggataccctcaagctggccaaagaagtgaaggcgaagctggatggaggagcggattttgcgacgattgctaagaaatattcagaagacccaggttctgcgtctaacggaggtctgtatgagaatgcatccgtagcgcaatgggtacctgcttttaaagaggccgctgagactcagccgattaacaaaatcggtgagccagtggaaacggaatacggatatcacgtgatcaaagtggagtcccgcaatgagccaacgtttgataaattgaaagacaacgaaaaggcagccctgaaaaataaattggccggggaaagtatccaaaactttagcgaaaatgatttggcgaaacttgatttgaaaatcaatctgccgaaggtaccagctacgcaagagaaaagcggtgcaacttccggtgccggtagcacaactacaccgggcgcaacaacaaacggtacaggcaataccaacgcaggaacagccaaagatggagctacaaacgaaggtaaataactgaacatgcataaggaattgggaacagatgaatactatggtcagatatcaccataaacaccatgaccgtgacgttcttcgtgaccgcttctgggggagtggaagcgtctttcgataccgtcagtagtttactaaattcttcttgagaaagtggggcaacatgtgaaatgaaagctactggtatagttcgccgtattgatgaccttgggcgggtagttattccaaaggaaattcgccgcaccttgagaattcgtgaaggagatccgcttgagatttttgtggatcgtgacggagaagtcattttgaaaaagtattcacctattggtgaacttggtgatttcgccaaagaatatgctgagtccctgtttgaaagcacgggccatattacaatgattaccgatcgggacaccattattacggtggctggaggctccaaaaaagattttctggacaagccaatcggtagcattatcgaaggtagtatggataatcgcaaaactgtgctggagacagccagcggctcttatgagctaacgcgagaccacgaagaaacactctcgtcctttgtggcggctcccattgtttccggtggtgatcccattggttccgttgtattgttgaacaaggacgaaaatgtaaaaatgtccgaaatggaagtcaaaatggctgaaacagccgctggcttcctgggcaaacaaatggaacagtaacatcccgtttcacccctgtatgacgtacagaatggcgaaagccgtcctacgttgtacagggttttttttctttccgggagaagaggcggtataataggactcgtgaaagatgcatatttcaggtgggagtgaagacggagaatgcaggaaaatcgcgccgcttcgcggctgctacggggtgctgtcattttgacactggcagcagtagcgagcaagctgatcggcacagtgcaaaaaatcccgctgcagaatatcggcggcgacggcgtgtttggcatttataatacggtttatcctttttatacgctattcattaccattgcagctgctggatttccggctgcaatatccaaatttgtagctgagtttgaggcagtgggaaaccgggcagcggggcaacgtgttgctcggctatcttcgcttgtcttgggtgtctttggattgatcctgggcgtgctgatgtatacgtgtgcgccgctcattggtcaatggatcgacaatgctcacgtcattccgtcggtgagggcggcggcgtttgcctttttgttcgtgccggttatggcgggattgagaggatattttcaaggtttgcaaaatatgcttccgactgctatctcccaagtgacggagcaggcgatacgggtaagcgtgatgattatgctgttgctgttcatgctgtcacaaggagcgggggcggatatgattgccgccggagcagtgtttggttcagcagcaggcggagcagcgggcttggtcgtcatgttgctatattggcgaaatcacaggaagaggcctagaaggcaagggacggtcatggcgacagtgcaagcacaaactggagagctacacccagcggaaagcaacggtgccttgctaaaggcgctgctgcgttatgccttgcctgtttgccttggagcgctagccgttccgttaattagtctggtagacacatttaccgtacctcgattgttaaagcaggagggtttggacgatactgcggttatggtggcctttggcgtgtataaccgaggtctgccgctggtacagctagtcatgatgtttgccaccaccctgtcggcattattcattccatcgctggctgaggcccggataaccggcggtacggagctggcacgtcgccagtgcgagcaatcgctgcgctggttttggttgctgggactagccgctgcgacaggcttgatcgtgctggctgtgcccgtcaatgtgatgctgtatgcggacgacaccggcagcggggttatgcgctggatggcgctaaccgccgtaggcggcacgctcagcatcatctcggctgcgctgctgcaagggcttggcgcggttcgtgcgccggctctggcgatgctcgcggctgcagtagccaaggcgctgctaaactggctgctcgtgccgcagctaggcacggctggagccgccattgcgggggctgtcgcctatctgctggcggcggtgatcaacatcgtgctgctggctcgcttggtaggcctgcgtgggagctggtccgccagcgtgctcaagccggcggcactgcttatcgccctggctggtgcggccggggcggcgatgtggggcaccagcgctgtgctgggtgccttggggtgggctgccggaggtcgtgccacggcagccgcggagagcctgctgggcgtagccgcaggcgccgtagtgttcgtgatcggcctcgcacgcttgaggctgatcacggaagccgagcttgtggcggtgcccaagctcggacgcccgctggcagccgtgctgcgcaggctgcgtgtactgacgtagcccaggcatagggcttagggcacgaaagcggcacagccattttatgagcctatacaactttgtggtatagtaaatgccaaagcaaaggaagcggaagcgggttaggccgtgtattttttcgagcatgaaccttgtttctgcgaaacggaggattgaatatgagcgtaacattaacggtcgtaggtttgggctcgggagacccggatcagcttacgatagggatattgaacaaaatgcggggcgcttcagcgctgtatctgcggaccaaggagcatcctgccgttcaagtgctgaatgagtttgaagtggcttttgagtcgtttgacaaggtatatgagacaaaggagtcctttccagaggtatacgaggaaattaccagccaattaattacgacggctgctaaggcggcagacggaagcgaaatcgtctatgcggttcccggtcacccgatggtggcagaagcagcggtgcagttgcttaaggagcgttgtcctgcgcaagggattgaactgaacattctgggcggcgaaagtttcctggatgaagcttttgtgcgtcttggttttgatccgattgagggtttccagctgttggacgcaggtacactggatgccagctggctccagcctcagctgcatacgctgatcggacaggtgtatgacaccttcacggcatctgatgtaaagctgtgcctgatggagcgatatcctgacgattatgaggtgtatgtcggtcacgctcttggggtggaaggtgaggaagcggtgcacaaggtgccgctgtacgagctggatcgagtagagggctacgggaacctatccttggtatacatacctcgcagtgaagatgaggcactgaaacggcgttcttttgaccgtctacacgagattgtcgatattttacgcagcccggagggctgtccatgggatcgtgaacagacacatcagtcgattcgcaaaaatctgatcgaagaaacgtatgaagtcatcgaaacgatagatgaggacgaccctgagcatatgaaggaagaactaggcgatctgttgttgcaaattttgctgcatgcccaaatggaagaggaagtcggaacctttaatgtgtatgatgttatccaggggctgaatgataagcttattttccgtcatccacatgtatttggtgacaatcaagcgaatgatgcggaagaggcgctgcaaaactgggagcagatgaaggctgaggaaaaacggcttaaaggcacgacggcagcatacccttccgtactggatggggttccacgtgatctgcctgctcttatgaaatcgtacaagctccagaagaaagcagctaaagtaggctttaactgggatagcattgagggcgtatttgataaattagacgaagaagtggctgagttgaaggaagcggttcgtgaagggcatgccgtggaagcccagttgctggagttaggcgatgtgttatttgttgccgtgaatgcagcccggttcatgggagtagatccagaagaggcattgtccgccaccaatcgcaaatttgtcgaccgtttccagtatattgagcagaaattacgcgagcaggggcgtcgtcccgaagaaagcagcgtagatgaaatggagacttactggcaggaagccaaaaagctccttggcaaagcgtgattccacacattcgcttttggctgcacagaccagtaaaatgagacatatgcagggttgaaagaaggcccagtttgagaagacttgccaatggacagagttttgtagtaggatgttggcttaactggggtcgaataaaaaaacgcctgtcattgcaggatttttacggacaagccagaataacttgtagtaattctgaaaataactgtagcttatagttaagcgtgttacagtgacattcaggagggcttcggccacagttggacctcacgtctgctccataaatggacatgcagcgtgatgattattttttgacatttgggaggcttttatcttatgaacaagacagatctgatcaacaatatttccagcaaaagcggtttgagcaaacgtgacgttgaagctgtattgaatggcgttcttggtgaaattacagatgcacttgctagcggtgacaaagtgcaactgatcggctttggtactttcgaaacacgcaagcgttccagccgtacaggccgcaatccacaaaccggtaacacgattgaaattccagaatcgaccgttcctgcttttaaagccggtaataagcttaaagaagccgttaactaatgcgtcttgataaattcttgaaagtctcgcggctgattaagcggcgtacggtagccaaggacgtctccgaacaagggagagtgctggtgaacggacgcgaagccaagccgagcagtgcggtcaaagtaggcgatgaaattaccgtccagtttggccagaagctggtgaccgtgcgagtggaacggctcgccgacactacacgcaaggacgaggctgcaagtatgtacactttggtaaaggaagagcctattgccagggacaatggtttgaactggtaagcagacctctgattttctcataactgtacatgaaagcattccttcattattttatgaaggagtgctttttttctttaatgacgagttttcgtccatcatatgctgattaacagcaaaagcggttctaaatcatacggcccccttcataagctaagaacagaaggaggggtacatgccatgattgaacaagggaagtccaagcaccatgatctgcgcatgcaaagccgcaagcaactcgatatttcaggcgtcagcaatgtggagagctttgacagtgaagaatttttgcttcagaccgagctgggccatctcaccattcgcggacaacatttacatatcaaaaacctcagtctagaagaggggctgttgtccattgaaggtctgattacttccctcgtctacctggagcccggggccccggccaaaaacggaaaaagcctattcggcaagatcttcaaatgaacccttacacgcaatggctgacgttgacgtggatgctgttgtcgggcatagccatgggagtggtgtttgacagctaccgggtgctgtccatccgctttcattttgcccgctggagcgttcatatgttggacgtgctgtactgggtggcctcggctttgtttattttccgtgtgctatacgcgagtaatcgcggtgagctgcggttttatgtctttttaggactacttttgggggtttggctctatttttgggcctttagtgttacaacccaacgttttgtggtaatgttattagagatagttcgcagactgacgttgatcgtgaacagcatactgcgcatcctgattgttcttccggtgttagcgctgtatcggctgttacgcaagctggtcggatggacatgggcacttattgtgttcctgggaaggatgctgatatacatcctgatgccggtttggaagccgatcctatggctgatcggtccgcttaaagcacgctggaagactccagagttgctcgtaaagctgggtatcagactgaaaaacacagcgaaaagatggtttggaaggaggtagtatcatgcgtaattcgtctgtagatcgccattcatcttctacgtctaagtccaacgcgggcgggcgcaggcgaatcatgatttggttgctatcgcttgccgcctttggtagttgggcaatttttacctttttttctcaaggcatgattatggccgatcgaagtgaacagctcacccagaaggaaaagcagaagcaagctgctacacaaacggaacaacagcttcaaaccgaagtgaatcgtctcaaggaccctgagtacattggcgagattgccagaagcaagtacggtctttacaaaccggaagagacgccaatcatcggagatcagaaataggaacattatcgggccaatgcttagttgaccttggttccgccattttgtataatcaaatcaccacagcgggatttttttgcaaaaaaatcggttgtatattttaagggaggatcattttattctatggcaattgaagtgggcaccaagttagagggcaaagtgacaggcatcacgcattttggagcatttgtggatttgtctggaggtgtcacgggtctcgttcacatctcggaaatcgccgataactatgttaaggatgttaacgaccacctgaagattaatgatgttgtgacggtgaaagtcattaatgttgacaaagatggcaaaatcggactttccattaagcaaacgattgacaagccggcaagtgaagcccgtcccccaagagctccaagaccggagcgtacaggaggaccaggcggaggcgaccgtttcggcggtggaggttcaggtccaagtcaaggacgcggtggtggtggcggtggtttcaaccgcgatcgtggaggccgttctttcaagcctgcaccgggtaaaccttcatttgaggataaaatgtcacgcttcctgaaagatagtgaggaacgcatttcgtcgctgaaaaagaacaccgaaggtaaacgcggaggacgcggcgcgaagcgtgtttaattcactttgacaaccgtatcaatcatacacggaaaaccgtacagtcaagagactgctacggtttttttgcgttctaccgacaacagatgcgataagcagcggctgtgggcgctgaatccagtggttagtcgtacgggcatttatgagattcgcaattttgatgaagaagaaaagagcttcgatgctggaaagcggatgttttttttgtcgtgaggacataatcgtccgacaaactccaacggttttccgtctatcttctgtgcaaatcgctagattggacatcaggatgaacgacatcgagaggtcatataaggagtagcgggacgtttcttccatcggcttccatacgggcgtagcttgatgttcagagtgatgctctgtcctttcgcgcagaacgtttttttgtcggaaatttcttggaataagacgtgaggttctgacaaactttctcagtcgttccggtttaagataggaacatcaaattgatgaatggggtgcctgacgcatgatggagaaatggaacgtggtacattttccagggttaaaatctagaaagtccaaatccaaagagcgtacggaagggtggtcttccagactcaagaaacggctggattcacataaagtggtgcaatgggtaacggcgcaaagatggatgctgctattgtcagctatgggagttctactgggacgcgccactattttggacgagctttctccttttgccctcgcttattttgcggtcataacgtttcttcggcgtgatctgatgctgcctgtagctgtatccgttgtgttaggcagcctgttagctccttacccatcgttatttatgattggtggcgagctactggtattttatctcctgtatcgcggactacgaaccttcgaccgtctggaattatcctatgccccgcttatggttttcttgtcggtgtttatggtcaatttatttaacgccgtgatggctccaactttcacatggtatgagcttatcattgtgggaacggatgcggttctcagctttatgcttacgctggtgttcacgcaggccataccgttgtttacgtaccgcaagaagacaagccagctcaaaaatgaggaaattttatgtcttattattttattagcctctgtgatgacgggagcagtaggctggactgttcattcattgtctgtcgatcatgtactgtcgcgatatttggtcttggtgtttgctttggtgggaggtgcttcgctgggtgcatcggtcggtgtaattaccggtttaattttaagcttggccaatatgtctgcaattgtgcagatgagtttactcgcttttgcaggtttgctggcagggatgctgcgtgaagggaaaaagggtgctgttgcgcttgggatgctgctaggctcctcaattctgacgatctatttggacggaaccggagacgtactgacgtcaacctgggagagctgtgcggcgattctattattcttaatgaccccaaaaagtttctttaaagcggtttctacctatgttcccggtacgcaggaccacgccaaatctcagcatgaatatgccaaaagggtccgcgatctcaccgcagagcgggtaacgaagttttcccgtgtattcagtcagctatcccgcagctttcaccagatatctgcgagtgagagcacgaagtcggacggagaaatcgaacactttatgaatgcggtggccgaagggacatgtgcctcctgcttcaagtgtgagcagtgctgggacggcaagtttatgcaaacccatcagtatatgacggaaatgatgagcgccattgaggataacccggatttggagccggagcagatacccccgcaatggagcaaggcatgtgctaaaacgggcgctgtcctgcaagtgatgaagcagcagtatagcctctaccaacataatatgcagtggaagcgtcaagtatacgatagtcgtcagcttgttgctgaccagctatcgggtgtatcacaaattatggaggatttagcgcgagaaattcagcgggaagggcagaccatgcatcggcaggaggagcaaatacgagaggctcttgatagactgggcttgtccatccaatctattgagattattaacctggatgcaggtcaggtagaaattgagattgtccatgcctatacaaggggatttgatgaatgtcggaaaatcattgctccacttctgtcggacatactggacgagcatatagctgtgatgcgcgaaacggaggcagatcgccgccaaggcttggctacagtcatgttcggctccgctaaaacgtatgagattgctacaggggtagctagtgccgccaaaggaggcgattttttctcaggagacagctacagcatgatggagctagggaacgggacttttgcagtctcattaagtgatggtatggggaacggagagcgcgcgcagcaagaaagcagtgcagcacttaacattttggaggaattactacaatcgggtatggacgaaaagttggcgatcaagtcggttaactctgtcctgatgctgcgatcacctgaagaaatgtatgctacggtcgatatggcgctgattgatcagtacacggcccagacaacttttatgaagattgggtctacgccgagctttattaaaagaggggaggaggtcatccctgtatctgccagcaacttgccgattggcattatacaggatattgaaattgatttggtatcattgcagctccagccgggcgatattctcattatgattacagacggtatatacgactcaccgggttacgcggttaataaggaaatatggatgaaacgcatgattcaggaaattgaaagcgaagatcctcagcagttggccgactgtttgctagaacgggttattcgataccagcaaaatcaaatctatgatgatatgactgtagttgttagtaaaatcgaccacttccgcccagagtgggcaactctccatgtacctggcatgaggtggttggaacgtccacggacggtgagctaagccgacattgcccgggaaattccttacccatttttaaaaatccgcatccttcgtttgaatcgttccggattaggcaaagatagaatctatcgggatagattaagaggaagcggaggtcaaaaaacgatgaagcaaattttgatcattacagacggatgctcaaatgtaggtgttagtccagtcatggcggctgcccaggctttacgggaaggtattacagtgaacgtcgccggagtcatagattatggaactattggcgagcttggcagtgcggagattcaagaaattgctaaagcagggggagggtttagccaaatcgtagggacaaaacagttggcgcagaccatgcaaatgatgacgcgcaaaacggtggttcaaaccattcagcaggcggttaatagagagttaacgcacattctgggtgagggtggcgccaaacatatcggtgaacttcctccggccaaacgagcccaagtggttgaggtgatggatgaactgacagaaacaagcaccctggagattgctttgctcattgatgcaagtgcgagcatgaagcccaagctgcctgctgtagaggacagcatccgcgatttgctgctcagtttacagtccagaagcgggcacagccgtatatctgtatttcattttccgggcggcaaaatgggagaagacgcagtcatggatatcggttggacctctgagcttaaccagatcaaatcgatatttggacgcttgcggatgaaaggggcaacaccgacaggtcctgccattttacaagtgattgattattaccgatatgttacactaggagaacagaaagatctggaagaatcctatggcaaaggagaagggatgctcggtgactacgtcgtctgatcccgttcttgcacccggaacggtcatcaagggcaagtggaagcggagcagctatgtcatccagcgcttgctgggccggggagcgaacggaactgtatatttggtaaaagaagcacaggccgatcggcaatttgctctgaaaatggggaagaacacgcttgatctgcaatcggagattaatgtgctgaccacattgcagtctcagggcactcaggccgcccttcagcgaaatggaaatccttcctttttgtttgaggtggatgatgtagtgttacgcagcggagaaatccccttttatgttatgcgatatgttaagggtgatccgcttcatcgttttgtggcagccaaagggccggaatggtatggtgtggctggaaccggtatactgaatcgtctggcggatctccatcaggcaggatgggtgtttggcgacctgaagccgcagaatattttggtcaatgcctatggagaggctgaattaattgactacggtggggtgtctcttgctggtcggagtgttaaacaattcacagagtggtatgataggggattctggaatgctggcagccgaaatgctgattcccagtatgacctgtttgccttcgctcttctaacgattcatatattggagagcgaatcattaaagaccgctgcgagtaggctgccccagttgcgtaatacggcagaattgacggtcatcattcgccgtagccgtgtattgcgcccctatgccgaatggctgctgggtgcagtgcgtggagaatattccgatactcgtgcagcggcccgatcttggtcacgtttggcttccgcacatgtcaggcaatcgtcggtcaaaaaagggaacccacgctggctgggatatgctttcacggtatcgcttttgctgcttgccggagcgctctggattgcgttaaggtagcagcagacttacataagataacagatgatcatcatttttacggtcgggagaaaagagggtcgtgaatgggaacaacaaaaccgaccggtgttgtacaggaagtgctcgccttggcgcgagatcattcactgtggagccccggagaccgcattgtggttgctgtatccggtgggccggattcggtggcccttttgcacattttacatgaaatatccgttatacatatgcctttacaactcgtctgcgctcacgttcatcatggcttcagaccagaggaatcggatgtggaggctgaagaggtacgcaatattgcccgaaagctcgaacttccatttgaaatgactcgggtggatgtacccgcttatatgaaggagagcgggaaggggccacaggaagcagcccgcgagctgcgctacagctttttacatgatatggctacaaagtgggaagcacagcatattgcaatggctcaccacggcgacgatcaagccgaaacggttctcttgcacttgctgcgtggtagcggcccagcaggtttggcaggtatgcgtttggcgcgcagggaaaaaaatgtgcaactcattcgcccgctgctacgtatgtacaaggctgacctgattgagttttgtaacttttatgatctttcctatgtgatagacagcactaatttatcatccaaataccgtcgtaacgccattcgcatggatgtgcttccttttttggggcaatataatgagcgactgacaccgtccctaaaccggctggccgaaacgatggctgacgaaaatgactttatggaggcatccacgctgtcggcatacgagaaaatggtgcgcttggataatggcaggtacatgtttcccatcgcttcataccgtaagctatccgttgctttacaacggaggttgattaaactaatattaaattatctgccttcggacagtgaaaattttgattttcgtaaaattgagaccgttcgactaagacttctccaagaggcatcgtctacatggagtttggatttgggaggcggtgcggttggagtccgcgaatatgaccaggcggttttgtttgaccgtacgcaagtcgttatgggcgaatggtgctatggactaagtgtattgcctttttccggtgagctagagttgcctgaggcaggtggtatacttcggtggcgaagggcttcctattcggatgcggactatccggcgaataaggaggaagcgtggttcgacgcagatcaattgagtctgcctttgactgtacgctcgcgattacctggagataccatgtatgtaatgggattaaacggaagaaaaaaggttaaagatatttttattgatgaaaaaatacctccttcaatgcgttccgttactcccatcgtctgcgaccacgctggagctattctctggattccgggcgtacgacgttctgtacatgccgcagtgcaaaagcacacgtcttcggttatatatatgtcatggcaaagacgagagagtccggggcaccggtaattgtgcaggaacggctttcatagtataaacttaggaggtttacaccgttgcaaaatgatattcaggaaatattgatcagcgaagaagaaattcagagtaaaattaaggaattgggtgcacagctcagcgtgaaatatgaaggtaaaaatccattggtgatttgcgtactgaaaggtgcgtttatctttatggctgatttggttaaaaccattacagtgccgttggagcttgatttcatggctgtatcaagttatggagcatccacaaaatcctcaggtatcatcaaaatcattaaggatttagacgcatctgtggaaggacgcgacgttctaattgtcgaagatattatcgacagcggcctgacgctgacgcatttgattgaattgcttaaaaaccgtaatgccaattcggtatgtgtcgtaaccttgttcgacaagcctgcacgccggacagttaatcttgaagcagattatactggatttacgcttccagatgcgtttgttgtcggctatggtctggactatgccgagcactaccggaacctcccatacatagggattttaaagccggaaatctacaccagctaatctcagcctccagtcctaggactaaataaggccctttgttgagaaggacttacaggctatggtaaaataacttaagtgtctcgagaggaggtaggggatgaatcggttcatccggaattctggtttttatttgattctttttttagttgtggtgggtatcgttcagtttgttagcaacagtaacgaagcctccgatctccctagatatgaccaattacggcaagaggttaaagctaataacatctctaaagtaacggtccaatttgacggttacgcctatcttgtaaccggtgcatataagaagcagccggctaatgctaaatcgaccaatttttccgtatatgttccaccaacggatcaagcactaagtgaactggtgaatgccagcgaaacgaacgggtttgaatacgtgcagaagaaaatggaaggcgaaagcatttggctgacgtttttgacttctatcattcctttggtgatcatgttcctgttgttcttcttcctgtttaatcaggcacagggcggtggcggcaaagttatgaacttcggcaagagcaaagcccgtctgtataacgaagagaagaagaaggttacgttcgaggacgtggcaggggctgacgaagagaagcaagagcttgtcgaagtcgtagaattcttgaaggacccacgcaagtttgcagctgtgggcgctcgtattccaaaaggtgttctgttagtgggccctccaggtacgggtaaaacactcttggcgagagctgttgcaggcgaggccggagtaccgtttttcagcatctcgggttctgattttgtagaaatgttcgtcggggtcggtgcttcccgtgttcgtgatttgttcgagaacgcgaagaagaacgcaccttgtatcattttcattgatgagattgatgccgttggacgtcaacgtggcgccggattgggtggcggacatgatgaacgtgagcagacgctcaaccaattgctcgtagagatggatggatttggcgcaaacgaaggtatcatcatcgtagcggctacaaaccgtccagatatcttagacccggcgttgcttcgtccaggacgttttgaccgtcaaattacggttgaccgtccagatgttaaaggccgtgaagcagtattgtatgtacatgctcgcaacaagccattaacgaaggatgttaaattggacgtaattgcgaaacgtacaacaggctttacaggcgctgatctggaaaatctgttgaatgaagctgctttgttggcggctcgtcgtaaccgcagagatatctcgatgcgagaagtagatgaagctatcgaccgtgttatcgtaggtacagaaaaacgcagccgcgtaatcagtgaccgcgaaaaacgaattgttgcttatcatgaagcaggtcatacgattatcggcttcttcttggaaaatgcggatatggttcataaggtaacgattattccacgtggacgtgcaggcggatatgtcatcatgcttccgaaggaagaccgcatgttgacaactaagcaggaattgctggacaaaatcactggattgttgggtggacgcgtatccgaggaactgttcattggtgagatcggaacgggagcctatagcgacttccagcaagcgacaagcattgcacgcagcatgatcgtagaatatggtatgagtgagaagcttggtccgatgcagttcggtacttcacaaggccaagtattccttggacgcgatatcggtcatgagcagaactacagtgatcagatcgcttatcagattgaccaggagatgaatcgcttcatcactgagtcttatgagcgtgctagagaactcctgaccaagtattccaaagaggttcatttgattgctcaaaccttgctggtagaagaaactctggaacttgaacaaatcaaacgtttgatcgagacaggttctttggatggtggcacaacggagggagaaggaacaccagaaaacggtgagcctgtgatcgacaacattggagacgtccgtgtacgtattcaaggtaaggatgacgagcctaagaatacaacggatcaaccgaatgatatccctaatctgaaaaagccagaggatgataacaattcgggcaactccggtggtactccaccgacaacaccctaatcatccgatggatagttgaataagcgtataggtaagctccggggaaccaggtattattggttttccggagttttttaaatggaagattattgctaacgtgatttgacagacatcggaacgttgtgtacatttattgttaaataaacggctgtcgtcttcttagcgtataaaagccaacagtcgctgcaatcgactctctatcattttgaacatatacgtgagcgcatactgtagaacttatggtgtgcgctattcttctgtgaaatcaggtgaaggcatgattccaagatatctagttgattttgatgtagcggacttgacccgattggaggccgacgtgttaattatcggctcgggcattgcgggcttatatacggcgattaaggctgcggagaatcggaaagtgttgctgattaccaagaagactttgatggaaagcaacacgcgttatgctcaaggcggcattgctgctgtcacatcggacgaggatacaccagcctatcatatggaagatactctgattgctggagcaggtctgtgtgaacctgaggcggtcagtacgcttgtccatgaaggtccagttggtattcaagagttaatacgtatgggaacggtttttgatcgtgtggatggtgaactagcgttgacacgggaaggagcgcatagtcaccggcgtattttgcatgcgaatggagatgctaccggttatgaaattgtgcgtgccttatcagaccaggttgctgcccatcccggtatcgaagtgtgggaagaatgcatggtaattgatctgctgacggagcatggtgagtgtattggagccctcgtccaaaagccaggtggggaaaggtcgtatatcactgctaatgcaacgattttgtgctcaggaggtagcgggcaattataccgttatacgaccaacccggatattgcaaccggggatggtatcgctatggcatatcgtgctggggcgattatacgggatatggaattcatacagtttcaccctacggcgttgtgccatccgggcgctccaaggtttctaatttccgaagctgtacggggagaaggagccgtattacgcaatattcacggagaacgcttcatggacaagtatgattcccggcaggagcttgcacccagagatatcgtagctcgtgctatcattcatgagatggaacgcacccaagctgcgtttgtatacctggatattacacacgagtcgcctgagcgggtgaagcaacgttttccaacgatttatcggacatgtctgtcatttggtttggatatgacgacagactggatccccattgcgcctgctgcccattatatgatgggtggtgttcagactaatctacacggggaaagctccattgcgcgtttgttcgcctgcggggaaacctcttctacaggtgttcacggagctaatcgtctggcgagcaattcgttatctgaagctattgtattcgccagcaggattattgagcgactgcattcattgccaccgctagtcggccatacgttgatatcttatagcgataaccgtacagagttcccggcttcatccgttgcggagcagcggcataggctgcaagaagcaatggttcgttatgctggagttcgtcggcacggcgaagggctgcaagcagcattagatgagttgcaagggctaatgcctatttttgaggctgcgatcgctagccgggaagagatcgaatttgccaatttgctcacctgtgctttattagtaacagatggtgcgctgctgcgtgaggagagccggggagcgcattatcgcgaggatttccctgagacagatgatagcgtctggcgaaagcatgttcagcagcgacgtgagcaagggataacggaggagtacgttcatgacatctaacagcaagctttatggagagtttagtggatatcaggaagaactgacggcacaaattcgcagctggctgcgagaagatacgggctctggcgatgtgactacgcgctggacaattgagcagggccaccaatccaaggctgtcattcatgccaaggagagcggcgtggttgcggggttacccgtggctgcccttgtatttcaggtagtggacccttccttgtcgttcactccgctggtagtcgatggacagtggattgaaaaggggagcgttttggcagaagtaacggggagtacccatgcaatcctgaccggggagcgattggcgttaaatctgctccaacggatgtctggtattgccacgcggactcgggcttttatagatcaattgcatggtctgtccactcgcttggtggatacacgtaaaacaacaccgggacatcgactgctggagaagtatgctgttcgtgtaggcggtggctcgaatcatcgttttggcctgtacgatgctgttatgattaaggataatcatattaagggcgcaggtgggattgaacaagctgtgagtcgagcgcgcgctaatataccgcatacgatgacgattgaagtagagacggaaaacatgaaacaagttcaggaagccctggaagctggggcggatatcattatgctggataacatgtctgccccagatatgaaggaagccgttcggttcattcgggaacgggcaccacatgtcaaaacagaagcctcgggcaatgtatcgctggatacagtgcgtgagatggctgagagtggcgtagatgtgatttctgtaggcaggctgacatactcttttcataacctggatatcagccttgaccttaacgcaaagaaagataggtgacacccattgattcttgtagtggatgtaggtaataccaatattgttctggggatatacgaagggcgggagctgttgcaccattaccggatcagtacctccagacaggcaaccgcagatgaatacggcgtactcatacataatctttttagtatgggtggcgtattaaagggtgacatccagggagtgattatttcctctgtcgttccgccattggtccgtgtattagaagaaatgtgcgataaatacataggcaaaacgccgttaatcgtcgggccgggaatcaagactggtcttaacctgcgttatgagaatccacgtgaagtaggtgcggatcggattgtgaacgctgttgcggctgtcgaacggttcggcgggccgctggttgtggtggactttggaacagcgacgacgtttgattgtattgacgataagggaaactacttgggcggtgtcattgtgccggggatcggcatttcgacggaggcactgtatcaacgggcttccaagctgccccgcatcgagttggagaaacccaaaaaggttattggtcgtaatacggttcatgccatgcaagctgggattatcttcggttatgcggggcaagtggatggcattgtgaggcgcattaaggaagaaatgcaggtggagcctacggttattgctaccggaggtcttgcagagctaatcgcatcagagacagagagcattcagaaagtgttgccgatgttgacgctcgaaggattacgcatcatttaccaacgtaacgctgaataaaaaaagtggatataagctgccgctgagtccaaccgatgatcttatcggtttggattagcggcgtttttcgtctatactgaaatatgttacgtttttgaacaattcgcgtgatctgtcgatgcaggttgtttatataataggaaattatgcttcaatgatgagccatactaacgaaaataagcagcatagctgtcctggagaataggggaggatatcaatatggaaaataagcaggatcgacttattcgtggcacagccatggatggaagggttagagcttttgctgttcggacaactcaattggtagaggaattgcggagaaggcatgatactcatcctacggcaaccgctgctttggggcgaaccctcacagcaggtgctattatgggttctatgctaaaaggcaaagagcgattgaccattcaagttaaaggtgatggaccgattgggcaaattgtcgttgatgccaatgctgtaggggaagtgcgaggttatgttactgaaccgcatgtgcatttgccgagcaatagtatgggcaaactggatgtagcgggtgccgtaggtacagaggggttcattcatatcatcaaggatttggggttaaaagaaccgtatcgcggcagtactccgattatttccggtgaactgggtgaggactttacctattattttgccaaatcggaacagaccccgtcagcggtgggcttgggtgtgctggtagatacggataactcggttattgtggccggtggatttattattcagttgcttccaggcttgaatgatgatgagattactgcgatcgaaaatgcagtcagctccattccacccgttactgctttgctggatcaagggttggaacttgatgaaatgctgcgctggatgctgccggacgttcggattctcgatgaattggatattcattttcaatgtgagtgttcacgtgagcgcgtggaaaaaacattgatcagtttgggagaaagcgaattagagcagttaattgaggaagaaggacaggctgaggtcgtatgccacttttgtaatgaggcttatcaatttaataaagatgaattgcaaaatctgttagatcaggccaaagcctaaccggatgggcggtgcaagcgatgactacacgggaaaaaggattatggacagctgtcattattctgaccgttagcgtcgccgccttgggtggtcttatcatgcttcgggggctgtcaaagccgggtgatgtaagcaaggatgacggcgatcatactgtggcggagatgggtcaggaaggcatatcggaggaacagtgggtagcggaactgaaaaagcgatatggaaccaatacgctattgcaaatgttgaatcgtaaagccgtgcaggctgaaaccaagcgtctcggtatcaagatcacccaagaggatctacagcaggtgctggagcaggatagtaaagggtatgactcagatcatgcctattttgatgaaatgcagcgacagtttggcttaggtccggttgatttgcggaatgaagcggaataccggattggtttggagaaaatagctactcagggtattcaggttcaggaagctgagattgacgagtattgggagcagcatcctgaggaatttgccgtcggtaagcagatccaattggcagctctttatgtggataatgcggaggaagcagaagcgttgctagatcgggttaagcagggggagagcttcgatgtgctgattcaagagcatgcaggtaagcctttcgacaaagatagcagtggacagctgggatgggtggatgaatatgatccattgcaaccggaggcgatcatgaaggcggcgagagagctaagctctggggatgttgcaggtccgatctctgttaacgatggctatgctgtcatttatgtacaggatgtaaggttgaagaattctccggataagcagcagatccggcagcaaattcgccgatctcttgcgcttgcacaagccgctcctttggaagaggtcgagaagggtctgcgtgataaatatggagcgcgtattttatctggaaagaatgcatcctaaacttctctgcaacgtagtgaaagaatattggtttgaaggaagcacgatgctgataacgcgggttgacagcatcgcggcttattcactcgtattgacattggaattgaagattgttatgattagcgtataaaaccaactatttttatcggaaattaatgaacggcaccaaattaaagtaattgactaagaatcatctacaatatgatttcgcaatttttaatatatcatctacagtcagggaggaattatcatggctaaagttgttaataacattaccgaacttatcggagaaacacccctcgttcgcctcaaccggatcgtaccggaagatagcgccgaaatctatttgaaactggaatatcagaacccaggctccagtgtaaaagatcgtattgcgattagcatggtagaagaagctgaacgtgaaggtctgcttaagccaggcggtaccattattgaagcaacaagcggtaatacaggaatcggcttggctatggtagctgctgcgaagggctataaggcagtcatcgttatgccagaaacgatgagcatagagcgtcgtaatttgttgcgtgcttatggagccgagcttgtgttaacaccaggatcagaaggcatgaatgggtccgttaagaaaatggaagaattgctgagtgagaatccggattattttgctgctgagcagtttaagaacaaagctaatatcaaaattcaccgtgaaacgaccggtcctgagattgtggaagccattcgttccattggcggaactctggatgcttttatagcgggaataggcactggcggaaccatttctggtgccggagaagtgcttaagaaagaattccctgatattaaagttgtggctgtagagcccgcttcttccccgctgttagcaggcggtaagccaggaccccacaagatccaaggactgggtgccaactttattcctgaaattttaaaccgtgatatctatgatgaaattattcatgtagaaaacgatgaagctttcgaggtagcacgtagagtggccaaggaagagggcattttgtccggtatttcatctggcgcggctgttcatgcggctttgaaacttgctaagcaattgggcaagggtaaacggatcgttgtcattgttccaagtaatggagaacgttacctgagtacgccactatacaatttcgagctgtaattatgtcgtaattgtgtatactatacgtaaggattccctcatttccctgttgcaggggggtgggggtttctttttaaggagagaatgtagacttattgaaaagtagggaaggggaagcacacacggatgaaatcgacagctagagtgacggaggcgcagtggcaggtttggcaggaggaaggctggagcatacttccctatatcgctgagtacccattacctgtgggagggctaccgtcatcgtggcggaaggcttgggaggattcgtcgccatatgcctttttgctggagagcgctaaaggtgggaggtacacctatctggctttaaatccggttgctatattggaaggcaagggagaacatgcagtttggaccgatttgcaaagtgggaaacatggagatatacatggtcaacctttgaaagtcatgaacaactggatcgctccttaccgtgcaccgcgtgtacctggcatgccttttttctccgggggatttgcgggttatcttggctacgatgtagctcgctcgttggagcgtttgccatctcaagctgcagacgatacgggcatacctgattatgtatggatgagggtgaatgagctatggatttatgatcacgaaaaatcctgcatatattgtgctgttcatatgcctgctcctgcgcattccgataaagtcagccgtgataccgatttgaccaatcccgttatactggatgggccaaatcccatactttgcgagcattatgcggaagctgcccaacgtgcagaacgtatgctgattcagtggaataacatcataaatgcaggagagattgatcctgagtaccctcgtcgttgtgctaggcttgccgaagaggggttagaggctgctcatcaagaatctgatggttggacagcggcattcaaccaacaagattttgaacatgccgtaagacgtgtgcaggaatacattgcccaaggggatgtattccaggttaacttgtcgattcgtcagcaacgtgcccttacagcccttcctgaaaatatatatgaatggcttcgtctgctgaatccttccccttatatgggtatgctgcgtatgccagatttacggatcgtcagtggctcaccagaattgttggtgaagctggaggatggacgtgtgagcgcccgacctattgcaggtacgagaagaagggggctaacaccggatgaagatgccgctatggcagcagagcttctatcaagcgaaaaagaacgcgccgagcatattatgctcgtcgatctggagcgtaacgatatcggacggattgctgaatacggatcggtgcatgtgcctgaactgctgactgtcgaatactattcgcacgttatgcatctggtatctcaggttgagggaaaattagcccagggtcgtacagctatagatgtaattgctgctacctttccaggcggaaccattaccggggcacccaaggtgcgcaccatggaaattattgaagaattagagcccgttcgtcggggtccttatacagggtctcttggatggattgactataacggcaatatggaattaaatattataataagaacactagctgttaaaggcagcactgcctatttacagacaggtgcggggatcgtcattgattcagacccgtacagggaatatcgggaatgtcggaacaaggccagagctgtcatgaaggcggtacaatgtggtgaagaagaagctgctttgagcagaagcggtatcacaggagggtgagtcgtatgattttggtgattgataattatgattcgtttacgtacaatcttgttcaatatttgggtgaacttggcgaagaagtaaccgtaaaacggaacgatgagattgatgtgaaaggcatagaagagctggcaccagagcatattttgatctcgccgggtccatgcacgccgaatgaggcggggatatcactggatgtgatcagccattttaaaggtcgcattccgatttttggcgtttgcctcggccaccaggctatcggacaggcttttggcggtaaggttatccgggctgaacgactcatgcacggtaaaacatcaccgattcttcatcacaatacatcggtgtttgaaggcttgccttctccgttcacagcaacccggtatcactcattgctggtggaacgcgagagtctgcctgagtgtctagagattaccgcagaaaccgcggaaggtgaaattatgggtttgcggcataaagaatttgccgtagaaggagttcagttccatccagaatccattattacggattacgggcatcaactattacgcaatttcctaaaacgcaaggtaggcgtctgattcatgaaatatatcggagtcaacggcgtcctcacggaagccgcaaaagccgtgattcacgtaagtgatcacggctttttatacggaatgggcttgtttgaaacattccgcacctacaagggtgttccattcttactggatcggcatctgcatcgactacagaaaggttgccgaatgctcggcattccttttcaaccggatgaggagcagcttacgagacacatccaacatctgatggtggcgaatggactggatgaagcctatatccgctacaccgtatcagcaggcgaagaggtgctaggattgccgacgggggactatacgcgccccaaccatattttgtttgcgaaaccgttaccctctaccaatacacaaaccgggcaatccatttccccatcggcgcttcagttgttgcgaacccccagaaacactccagagggtgaggttcgtttaaagtcgctccattatatgaataatattcttgcgaagcgggaacttcagcagtatgccgaggctgtccgttataaggctgaaggaatgatgcttacggccaatggttttctggcggagggaatggtcagcaatctgttttttgtgcggaataatacgctgtatacccctgacttgtgtacagggattctgccaggcattacgcgtgaattcattttggagctggcgcatctgcgagacattccttgtgagcaggggttgtaccgctgggacgagctgaaacaggctgatgaaatttttatgaccaactctatacaagaaatacggcccgtggatttgttgttggagccgggtggagcaacgaaccatgtatcggttcccttgacacagcccaggtccataacagctttgctgttgcacgattatagacagaaagcagggatcaagtgaacataccgaccctttatcaacgtagttaccgaatgggggatgccgagcttacgctcggacactccacacagatcatgggtatactgaatgtgaccccagattcattttccgatggaggattacattatagtcccgagattgctgttttacacgcattgaagctggtggaagatggagccgatatcattgacattggtggggagtctacccgtccgggtcatgatccggtaggtgtggaagaggaactggcacgggtcattccggtcgtccaagccatccatcgtattgcaccgcacattccgttatctgtagatacttacaaagccgaagtagccaggcaggcaatcgaggctggtgcacatatcattaatgatgtgtgggggtttaaggcagaccctgatatggcgcgtgtagctgcggaattcgattgcccggtcattttgatgcataatcgtcatgatcgtaattatagtgatttggtttctgatatgctgtctgatttgaaagagagtatccgattagcgctggatgcgggggtacgtgaggaacagatcattttagacccaggcatcggttttgccaaggattatgatgaaaatatccatgccatgacttctctcgatacattgagtcagctaggcttcccactgttattggctacgtcacgcaaaagatttattcgtacagcacttgatttgcctgtgaatgatgtagtggagggcacggcggctactgttgcttttggcattgctcaaggttgccagattgtgcgtgtacatgatgtggcacaaatcaagcgcaccgtacgtatgtgtgatgcgatggtgtacgggtctaaaaatgcactgagttatggtggttagtagacgctccacgaatgatttgatcctacgatcgctgttgcaacgggattctttgaattggtaaaacatgtaactgtaagaatcccgttacaaaggcgagcgcttcgctaccaccagtaaagtcacttgattagaaaaatctaataaaaaacagggggtctacccacgatggataaaatggttttgcatcgtatggagtattacggatatcatggcgtttttccagaggagcgcaagctgggacagcgtttctatattgatttggaactggagcttgatctgcgtgaagcgggtgagcaggatgctttggacaaaacggttaattacgccgaggtacattacaccgttaaagatattgtagaaaaggaatcttaccaattgattgaagctttgggcgaacgtattgcatcttccctactggacacttatactagtgtcaatgcactgactgttaaagtcacgaagccgcatccgccgtttgatattcattttcaaggcgtgacggttgagctttatcgcgcaagaaagtaggaacgatacatgaatgcacattcgacctctgagggatcagaggcttatattgctttaggggctaatttgggggagcgcgagcataccctgtatgaagccattacggcgctggacgaacatccgggtatacgggtgatgcggtgctccagcctttacgaaacagaacctgttgggtatctggatcaaccttcttttttgaacatgacggtagccgtatctacaacacttgctccagaggagcttctggtatatatgctggaggtggagagtcgtctggggagagtaagacatattcctaatggtccacgaaccattgatctggacttgttatggatgggagcggcgcaactggctacaccggatttggagcttcctcaccctcgtatgttggagcgtgcttttgtactggttcctttggctgacatcgttccgaaccaagatccgtccggtctgtacagtatcgtgcatactgcattgaattctgtggatggaaaggacggcatacagctttggaaaacatgcagctggcgcagcgactccgcgcatttcggaagctaaaagggttcacacagcaggagttggcagaacgtactggtatatctttgactgtattaggtgctgtggagcgaggcaatcgtacagtagacccagacatgctgaacatcatcgcccaaacgctagagattgaagtccgggaattgacggattgacgataagtatacgatataaaagaaggaataaaggggtgaacagatatgttgaaaatcggcgatattgaaatgaaaaaccaagttgtcttggcacccatggcaggcgtgtgcaatcctgcttttcgcttgatcgccaaggaattcggtacaggcttggtatgtgcagagatggttagtgataaggccatcattcacggcaacaagcgtacacgtgagatgctgtttgtagatgagcgcgagaagccgcttagcttgcaaatttttggaggcgaccgcaaatctttggtggaagctgcgaaagtcgtagaccaggagacgaatgcagatattattgacatcaatatgggctgcccggttcccaaagtgaccaaatgtgatgcaggcgctcgttggctgcttgatccaaacaagatttatgagatggtatcggcggtagtggaatcggtaagcaagccggttaccgtgaaaatgcgtattggttgggatagcgagcatatttatgccgtagagaacgctcgcgctgttgaacgtgccggaggtcaggccgttagcgtacatggccgtacacgggagcaactgtatacgggacatgcgaattgggatattataaaagaagttaaagaagcagtttccattcctgtaattggaaacggtgatgtggcatcaccggaagatgcccgccgtatgctggatttgaccaattgtgatggcgttatgatcggacgtggtgctctggggaatccgtggatgctctaccgtacgattgagtacctgcaaacgggcgagctgttgcccgatccttcaccggaagaaaaaattcgtattgccattctgcatatggatcgtctggttgcattgaagggtgaagcagtagctgtccgtgaaatgcgtaagcatctggcttggtacctcaaagggtttaaaggttcggcacgtattaaggatgtcattatggaagaaacaaagcgcgacgatatggtacgcattttggatcaatttgtatctcaattgcacatggtagataacgatgagtcttctacaagcgctgcttctcctgctgctgttgcgcaataaggaacctgtaccggcctgtgcacgcgattgacttttccaattgcttgccctataatcgttcagtataaaatcttgatgtatgctacaaattgtgtgcagctctcaagacaacagaaggaaatgttctcattccctcagagtggcatattatgttttgaaagcgtgcattccgatgcacttttaaacttttcccatgacaggagaatcggttaagatgagcgataaagaagtcattctgacacaggaaggtcttagaaagctcgaagatgagcttgagaacttaaagtctgtcaaacgccgcgaagtggctgaacggattaaggtagccatcggatacggagatattagtgaaaactccgaatatgaggatgcgaagaatgagcaggcctttattgaaggccgtgtaattacgttggaaaagatgctacgcaatgcccgcattatcaatagtgatgaaattgacaccgatgttgtgggagtaggcgcaactgtgaccgttgaagatttggaattcggagatattacagagtatgctatcgtaggttcagccgaatctgacccgttacaaaacaagatttcgaatgaaagtccggttggcaaggcaattctcggtaagaaaaagggaactgttgtggatgtcaccgttccagcaggcgttattcaatataaaatcgtggatatcaagaaataagacacggactttggaatttaatgtaaaagcttccttgtggaagctttttttctctacacccggacggaccccggcccgtctattcatattgaaggagctgatttagcaccatgtcggatgaaactactaaccaggaatcacaagaaaatcgcgaggaattaagtgaactattgcaaattcgccgtgccaaattggacgagcttcgctcattgggcattgatccctttggacacaaatacatacgcacggctgaagcgggcgtactactgagcaagtatgacagtttgactaaggaagaactggaagaaaagaatattgaagttagcatagcaggtcgtattatggctaaacgtgtgatggggaaagccagctttgctcatatacaggatcttagcggacgtattcaaatttatgttcgtcaagacacggtacctgaatccaaatataaagcatttggtattttggatctgggcgatattgttggtgttaagggtgtgctctttaaaaccaaaacaggcgaaacgacaatcaaagtgctggatattgaggtcttgtccaaatccttgtatccattaccagagaaatatcatggcctgaaggatgttgaattgcgttaccgtcagcggtatgtcgatttggttatgaaccctgaagtacaaaaaacgttcattacacggtcccgtattattcaatccatgcgtcgttatctcgattcgctcggctatttggaagttgaaactccaacattgcattctattgctggcggagcggcagcgaagccatttgttacgcaccataatgcattggacatgcagctttatatgcgtattgctattgaactccatttaaaacgactaattgtcggcggaatggagaaagtatatgagatcggtcgtgtttaccgtaatgaaggtatttcgacccgccataaccctgagtttacgatgattgagctgtatgaagcgtatgctgattataaagatatcatgcaattgacggaaaacatggttgcacatattgcgcaggaagtactaggcacacagcacattcaatatcaaggccaggaagtggatctgacgccgcaatggcgcagagtctccatggttgatgctgttaaagaagtaacaggcgtagactttagcatgcagatgagtaatgaagaagctcatcgccttgcgaaagagcataaagtttcggttgaaccgcatatgacatttggccatattctgaatgcattctttgagcagttcgtagaggaaacgcttattcaaccgacctttattactggacatccggttgaaatctcaccgttggccaagaaaaacgaacaagatccgcggtttacggatcgcttcgagttgttcgtggttgctcgtgagcatgcgaatgcgttcactgagttgaatgatccaatcgaccagcgccaacgttttgaagcacaattgctggaacgtgagcatggtaacgacgaggcgcatgaaatggatgatgactttatccgcgccttggaatacgggatgccaccaacaggtggactgggcatcggcatcgatcgtttggttatgttgctgacagatgcgccttccattcgcgatgtgctgcttttcccgcatatgcgtaaccaacagtagaataacataacattatgaatatagaggatcagccgggcttcccgtgtcttgttcctctttttcataagaacggatggagagaatactctaatgaaacgcagcgtcaagcttagtcggttcgcatcgcctccttttatattggtcatcggatatttattgattattgcattgggtactttgctactgatgcttcctgttgccaatcatagtggtcatgctccgcattggattgattcgctttttacgtccgtctcagccgcttgtgtcacaggactggttgttgttgacgtcgattcaacgtatacgatgtttggcgaaaccgtcattttggtgctgatgcagctaggcggtctggggtttatgaccttagcgaccttgtttgcgctgttgttggggcggcgattatcgttaaaggatcggttgctgcttaaggaggctattaatgccgatagcatggaagggatcgtgcgtattattcgcaaggtgctgatcttttcttttaccattgaggcgatagctgccgtcgtcttggctttgcggtggatgcgagagatgcctgtcggacaagcgatctattatggaatattccattccgtatccctctttaataacgggggattcgatctgtttgggactagcttccaacagtacgctggagattttgtttttaatatgattgcatctgtgctcgttatatctggaggcttgggtttccttgtacttagcgatttgttcgattttcgccgtacccgaagactgtctctacactccaaaatggtgcttagcgtgtcgggagtgctcattgtgattggtgcgctggttatatttatttttgagtttaccaatgcacgaaccttgggcgcgttgaactgggaaggcaaagtatatggagcggtctttcaatcggtctccacgagatcatcaggtacgagcacagtcgatatcagcgggttaagacaggcaagtcagttttttattatgttgctgatgattatcggtgcttctccgggctccacgggaggaggaattaaaacgactacgttcctgcttatggtaggtgcgctaatcgccgtcatgcgaggacagaaggaaattgtgtttttccgccacagggtccctaacgatatcatgatgcgggcgcttaccattattgtactggccctatttatattctcgattgtggttgtactgctcctaatgacagaggatgccccatttctctcccttgcatttgaggctgcttccgcaatcggaacggtaggcttgtccgtaggagtaacgccaggattgtctgatgcaggcaagctgattatttgtgtgaccatgtttattggtcggattggtcctcttacgattgcctatgccattcgtccacgctcgaccaagacattgtaccgtcgtcccgaaggacatattgtaattggatagtgtatctgtagaaaagatgtacccgtgctgattagcataggtacatctttttttatttcagatcatcataattctttatgggtagcatatcatgtaaaatgcccattttgagaacaaaacgaaatgttctgaacagatacagtttttcgcagaaaaaaacggctatttgtttccttttatgtaattatagacaaaatactaggaatattatgtataatattgtatgatagtgggcatgaaagggggatagttttggtaaataccaatttctaatttgaaaggaatcatctattatgtatttatttattattagtgctgaagttttattttgggtttttgttgttgcaggcttgatcgcaaggtatatgtttggcttgaagaagttaggcggtcttcttttactatttacccccattattgatatcctgttactgattgcggtgttcatcacggtgaaaagtggcatggagattacgactgctactggcttggcggcctgttattttggtattacagtagcatttggtcataggttaattaagtgggcggatgtacggttctcccattggtttggtaagggacccaagcctgaacgcaagtatggtgctgctcatgcaaaagaggaacggataggttggttgcttcaccttttgggttgggctataggtaacgctttgttgctcgccatcattgtatatgttaatgatcctcagcgtacgatgtctttggagggcattatgcaaacatgggcaatcgttctggcaatcgactttgttgtctcctttagctatactttagctcccaaaaaacaaaagcgtagtctataaaggttaaggcttacacttagatgatatctggctggtcactcaggatgttcaaatcggaagagtcattgttggtgaaaatgaagtggttacttccggtaggggggtgattctgtcatcgtaatgtaaatatttacaaaaatatgcggattttatgtttaactcgctttgacagtcaccttgtttttgcctcgctaccttttttcacacacatgtattcctttcgatttgaacacgaccaacagaagcaacacaactatttcttgtgagatgacagacagcatacacgatgtgttttccagaccttagtaagaaggatcgttgtaaaatgaatttatgggtctagtatggaggcgcttggaatttgaaaaaattgggctcgagattatagctaaaatcaactgcggagtagtgttctacccattcacacaaattttaaaataaattttgtgatttgcctaaaacgtcgcctatccaagtttggcaattaacgcgataatattccaggaaagattacatatgtctataaatgtagacatacgcaattaagttgttattttgtttaaaaatgtaaaaaagaaaggtggtttctgtggcagtactactgagcggtaagaacattttgattatgggcgtggctaataacaggagtattgcctgggggacagctcaatctttagctgctgaaggagcacagctcatttttacttacgaaaatgagagggttgcagagcgggtactaaagctcgttgaaaccattccgggagcactggtctgtccttgtaatgtacaaagcaatgaagagcttgatgcattggcggattttctaaaagaaaaagtaggcgtactgcatggttattttcacagtgtcgcctatgctaaggctgaggacttggatggcttgttcgttgacacttctcgcgaggggttcgctgttgcccaagaaatcagtgcctattctctggctgctgtatcccgtcgagtatacccgctgatgacagagggtggaagtatcgtcaccatgacgtatattggcgcagaacgagcgatcaaaaattacaacgttatgggtgtagcgaaggcttcactggaagccagcatgcgctatctgtcgaatgatctgggcacatatggcattcgtgtaaatgcgatttccgctggtccgatacggaccttggctgcctatggcattaaagattttaacacaatgctcaaacatattgaagaaactacgcccctacgcaagacggttgatacgtcggaagtcggagatacggcgttattcctattttcccatttatcgagaggcattacgggtgaagttatccatgtagatgctggataccatattacggggatgtaaggagggaacgttgtgcttattacgcatacggattgccgtattatctcacctgaaggaattatgactagagagcgtctggagcgagacgttacgatcttctcccggatgttgacgctcagaggaattcccgaagacggtagagtgattctgaaagcggccaattcctattggtttgttgtgtctctgttctccctgtgcaatattgctgtttcagtgactgtagtggacgagcagactgtgctcgatgaggtggcccaaatctatgatgaagcgggtgcctgttgcatccttacggattccgatttagaacttcctcatgctctcgttattctgattcaagatctgattcaagaagaagcagtacacccggattgggtgggagagccaaagcttgaagccctcgactttagtaagtggtgcgagaggtcagatgcgctcattctgtattcttcaggtacgacgggcaaacccaagggaatcgtgaaagctggttcagcttttatggagaatatcaggcattccatacacgccatgaactacctaccgtctgaccatatgctccccgttgtgcctttttctcatttttatggaatctcacttatcttctcctggtggttaacttcatgttctctcatcatctgcaatccaaaaaacctctggagcgtcattgcaagtattacgaaagaccgggcgacggtcgtagacgctaacccctctgctttttacaccttgttgcgtatgctaaaccgaaaacccgaacaactggaaatggtcaaggaagctccggtgcgcatgtggtgcgtaggcggttccccacttacccaggaccttgaagagaaatttaacaacatatttggacagccactgctgaatggttacggcctttctgaactgggcaacgttacgctggggacgctagagtgtccgaagggttgtggcctaccattacctggtgtggatctgaaaatactagattctacaggcaaccagcaggcggacggtatcgtaggcgaagtgtggatacgcagtgctggatgcatggaaggttatctaaatcgtccagacctgacgcaatccgttctacaggacggctggtttaagacgggggacctgggctatctggatgacggaatgctgtatgtcattggtcgtagcggtaagacggtcaaccggatgggctatatggtctctccagtctatatcgaggaccgaattggttcgctaggctaccgatcctgcgtggttaccttggaggatgaggctaaagggacattgcttgtcgcattcatcgaaagtgattcctcacaggtcgtgcctgtgctccgcaaagaaatgagtcaggtactcccttcatacatgtttcccgatcttttgcttccgctcgatcattttcctttaaatcgcaatggaaaagtagatcgtctggagatggagcgtgttgctctagagaaagctgcttctcgcaaagcataacaagatatataccaaaactgcatacaggaaagggagaatgtgccatgagtataaatccagaactggcagaaaacacactgtttctgaaaaggcatgaatctattctgaaatgcctcaattatttgattgaaaatcggcaggaagtgatggatattctcacacaattttcatcctatcgggctgccaatgcagaaattgactccacgatcctcacacttcaaggtgctctgcaagaagttcagacctatcagccaagctggcaacgatctatggctgtatttatgccttccaacgtcattttgtactcctatgcattatacctcttgattccgtccctgtacgttgaaaatatagactttcgtccttcttctcacgtaaacgagtacgttaacatgctgcatgaaaagcttcaggctgtacatggattacccatctatattcgtaaagttagccagaaggtgttcatggagaattccgtgatgccagctgatattgtggtgttcaccggaagctataccaatgcagagaagatcaaaaaacagattcgaaaagatcagctctacattttttacggacaaggactaaatcctttcatcatcggacctgatgcagatctggagctggcggttaccgatgtgatccgaatgagattgttcaactctggacaagactgcctaggccccgacatcattctggtacatcaagatgtgagtgagcatttcaaagatctgctgattcaacagcttgaccaactcgtgtttggagccaatgatgatccgaacgcaaactatacccctatattctataaagacacgctatattcggtttccgaatatttcaacacgaacgataagtttattatttacggcggcggcattgatttccgtacaaaaaagatggagccaacggttgtatatagtgaattggatcagaatctggagattattgagtatttttcgccagtcttcaatgtagttagctaccaagacgacgagcaattgatcaagcgtatttcctccagttatttcagtgaacgtgcaatggggtgcagcttatacggatcggagcacctgactgacgttctgcgaaagaagcacacgctgaccattaatcagacgcttgaggatgtggatcaaggtaataagccttttggtggctacggcacgatgtcgaactatattttttacgatttcaagctcatttcgaagccgatcttgatttcagaaattgtcgcagaatatttgtcggaaaagaggagtttggtatgactgcgagcttctttccctgggatgccatcattggctacttaaaatcggctggggttcagcatctctttggattaccaagtgatgatctcaaaatcgtatcgtcactcccctcatccggtatggattttatcctgtgcaaagatcaacgtaatgctgtgttcatggcagcaggttatgcgctcaccaccaaccagatgtccgtgtgtgttgtggggaaaggccctgcgctcagtaatacactcacagggctgctggaagccaaaaacctgggcgctccgctcctgcttctggcgcttggcactggcggagacaagctgggtacccgatcctttcaggaagcggatcaaatctcactcgtgaagccgctcgtaaagtgggcttatcgtgtcgagcatgtggatcggcttgtatgggcgatggagcgggctgcctttttggctatcaatggagcaccaggtcctgtctatatcgaactccctgaaaacctgatggaccagcctgtgccaacagggcttcagtttaccccaccagaaaaggtgtcgtgctctccgtctcatcgggagttggatgcatcgtggggaattattgagaacgcccgcaggccactcattctagtcggaggcggaatgaagtcaggtacaggtgatgtgattgaacggtttgctaaccaacatggagcggccttgttcgcaaccgcctcgggacggggtgtagttgatgaagaccacgaactcttctgtggtgttgcgggactctatacagatcttagtctaagacaaatctggaaggaatctgatgtggtaatcacactgggcagtcgattggaagaaacggctactttcgagtgggatattttgctacgggatacacctttgattcaagtcaatgtaaatctggaggattttgcacacgagtacaggggtatcaaggtgcttggtgatggatatgcagcggtggagcagtggcttgaacggcgcggccaggagcctgatggagtgtggcttgaaacgattaggagctgtaaacaggaggctttttctcacagggctatttatttggaagagctgaaaaagacccctggaatccacgttcctgagctgttggacatgattcagacggagtttcctgaaaatttggtgcttcttcaagagaatggattgcaggatatgtggtcctatttttatccatattttcgctttgcccaaggctctctttcgattgttcctagtgatcaaacgagtcttggattcggtgcggctgctgctctgggagcaagcgtggcaacacaacgtccagtagtagcactcgtaggtgacggtgcgttcaatctcttcagttcggattttatgacggcggtggagtatcaaataccgttaatctatctcgtactcaataatggtgggtatggttggttacagaatcaaatgaattataagcatctcacagggcagtccctcccgtttgtttctgaggcggccaagacaggaattcaaattcctcagtacgagtttgtggaaagtcttgcaattcggagtaagggagaggcacgggaacagcttcagcttgcttggcaaaagtatcaggagaacaagcttgtgatcgtcgaggtatatgctgatcttgcggatgtgcatgaaaaaatcagtcatgtgtatggcgactttcctctctacgagcaacaggcttctaagaattaatttcaacgaaggacgtggatacagtgagaagacgtgttgtagtgactggacagggagtcgtaacgccggtcgggcttaatcttacggatttctggaattcactgttggaaggaaaaagtggaatcggacctgtcactgctttcgatacagcggacattccgacaaagatcggtgcacaggttacgggctttgaccccttgcaatatatgagcaagaaggaagctaataaagtcgcacagttcactcagtttgctttggcggctgcccggcaggcaatggagcaatcaaaattagtgattgatgagcggaatgcaagtcgcgtgggggttattgtcggctctggagcaggcggcctcgacgttatagaggagaactatgggaaattaacaaagcttggtcccaaaagagtttctccttattttgtttcctcgatgatgattaattcagcacctggtgaaatctccattgctattggagccaaggggccgtcttttgctgtggttacggcttgtgccacaggaagtaatgccattggtgaggcattacgtacgatccagtacggcacggctgatgttgtggttgccggtggagcagaagccaattttagtcagcttgatctggcatcttttgcgaatatccatgctctctccagacgtaatgaagagccgcagaaggctagtcgtccgtttgatgtggatcgcgatggattcgtcatcggtggaggagcaggagtcttggtgctggaggagttggagtatgctttgaaccgcggagccaccattctggccgaagttgtgggttacggatgcacaactgatgcgtatcatatcacggctccagatccctctggctccggaccggcagaagcgatcaatatcgcactgcaggatggcggcttaacaccgcaggaaatcgactacgtcaatgcccacggtacgagtacgccatttaatgatcgtatggagattaatgctattcaaaaagtattcggggagcatgccccccgtttggcgatatcgtctattaaatccatgactggtcatttaatgggcggtgcaggggcagtcgaattaattgcgactgtgcagagtatgattcacagcaaagtaccaccgacactcaattgcgacaatcctgaggctcctgaattgaattttgtgccgcatgtatatcaggaacgcgaggtccgcgcggcgattagcaattcatttggtttcggagggcacaacgtctgccttgctgttcgcaagtgggaaggggaataagcctgtgagcgaagagctaatccatatcccggatgtgcttccgcaccggtacccatttcttctgttggatggcgtgaccgggtacgaaacgtcgcaatgggcgaagggatacaagcttgtcacctggagtgagtggttcattactgacactaacccatacatgcctcctatgttgattgtggagtcgcttgcacaattagcggcattcgctgcgattgataaaaaaggcatttcatacctgactaacctcaatggaattcgattccacagcttggccaagcctggagaccgaattgatctctattttgaagtgatcaagcgtcggcggggctatattctcggaagcggtcgggcttccgtaggggatcgattggtggttgaggcggaagaaattgtttcactggatcaatgacggggtggaagcgcacgttaaactgtccttttgtcctcctgactgccaggtgcagcgggaggatattcacatcatggaataggagtgaatgagatgaatgacatgcagttatatgatttaacaaatgcgcagaagcgtatatggtataccgaattactctacccagatacgtcagtgtcacagctttccggtacagctaagatgaaggggcatatccatattgctgcctttatgcagtccattaatttgattatcaaacagtatgatgcgttccgcatccgtattacctcagtggatggagtgcctcagcagtacgttgttccttatgaagagagacagttggagtgcctggatcttagtcactatgaaagtgtatctgaggtggaagccttacttgagcaacacaaaagaaaccccttgcccctgctggattctgagctcttccagtttttaattgtgaagattagcgaggaagagtattggattaatatcaagatgcaccatattatttctgacggaatatcaatggtggtctatggcaatcagctgacagcattttacatggagttaattcaaggaaatgaaccgaagctgggcgacgattgctcgtatattcaatatattgcagatgagaatgcatacgaactttctgacagataccaaaaggataaggcttactggctggataaattttctgatttgcctgagcttacgggttggaagtcatataatccgttatctttaagcacccacgctgttcgggagcattttaccgtaccagaagtgctatatcacgacctgcaagcattttgccaacagaacagaatttctttgttccagttcttcatgggtgcgatgtatatctacatacacaaaatgacgaatcagccggatgtggtgattggaacttcgttcgctaaccgggggaacaaaaaagagaagcaaaagataggtatgttcgtcagcaccgctgctgccagaacatacgtcaaaaaggatatagatgtgttgagcttcctgcaggatgtagccagagatcagatgtcagtcctgcggcatcagaaatatccatacaatcagttaattcaggatcttagagaaatgcatgggaacaaggatattcagcggctttttggcgtttcaatggaatatcgtcttatcaattgggttgatttggatgatgtgcgtattttgacagattatgatttctgcggggacgaagtgaacgatttcgtgcttcatattgtagagatcctggatgaaggcgaactggtactggatgtcgattatcggacagagctgtttgaacgcagtgaagttaaggacatggtttcccagttgcttacgatcgccgagcagatcattcattcacctcagctttctattgcagaggtaaacttattgggtgaaccagaagagcagtccattttggctctttcggaaggcgccgcagtcgattatccacgtgagaagaccatccatggcttattcgaggaacaagccgagcgcacgccagatcacgtagccgttcagatggacgagcagagcattacataccaagctctaaacgagcaggctaaccagcttgcgagatatttgcgctccgagggagtaggagcagatacgctcgtagggattatggctgaccgttccttggagatggtcatcgggatgttggccattttgaaagcaggtggtgcctatgtaccgattgaccccgattatcccgaagaacgtatccattatatgctggaggattcaggtgtccgtctgttgctcacccaaagtcatctatgggagagcaccgcttttgacggaaagcttgtgagtctggacgaagctacaacgtatacaggagatgcttccaatctggagagtatttcgggaccaagccatctggcctatgttatctacacgtcgggtacgactggcaagccgaagggcacgctgattgaacacaaaaacgtagttcgactgctctttaacgataaaaatttatttgacttcaactctcaggatacgtggacgctgttccattcgttctgcttcgatttctccgtttgggagatgtacggagcgcttctttacggagggaaattggtgattgttccatctctcacagccaagagcccagcagctttcctgaagttgttgaaagacaaccaagtcaccatcttaaatcagacgccgacgtatttttatcaggtgctacaggaagagttaacgcactcttcgacagagcttggccttagaaaaattatttttggtggagaggctttaagtccatctcttctgaggaactggcgggtcaagtatcctgatgtacagctgattaatatgtacggaattacggaaacaacagttcatgtcacctataaggaaatcacggaacatgagattgaagcggggaaaagcaatattggcagaacgatccccacacttagcgcttacattctcgatgagcaaagacgcctgcagcctgttggggttccaggagagctatacattgcgggggacggtcttgcccgtgggtatttgaatcggccggatttgacgtctgagaaattcgttgagcatccgtatcgggtgggagagcggctgtaccgaactggggatcttgctcgttggttgcctgatggcaatattgaatatttggggcggatcgaccatcaggtcaaaattcgcggctaccgaattgagcttggcgaggtagaagcccaaattctcaaggctccaagcgtacgagaaacgattgttctcgcacgggaagacgaacagggccaaaaattgctgtgcgcctactatgtagcctccagtgatctttcgccgggggaattgcgggctcagctggcggcggaactccccgcttacatgattccttcttattttgtccggctggagcaaatgccgcttacaccaaatggcaaactggatcgccgtgcgttgccggctcctgaaagcagcgtacaatccggcgaggcttatttggctccgagaactgctgtggaagctcagatggtactcatctggcaagatatcttgggcgttgctcgtgtcggtgtcagagataatttctttgaaattggtggtcactctttgcgggcaacagtgctcgtttcacggattcacaaagagttgggatgtagcatttcgctgcgtgaggtgtttcagtcacctacggtcgaatccttggcgcaacttgtgaagaaacacattccgaccatgtatgaatccatcccacaggcaacggaaagcgaagcttacccagtgtcctcagcgcaaaagcggttatacgtgctgagacagatggacgggggagagctcagctacaatatgccaggggtcttcacagtggatggaccgttggatcgcacgcggctggagtctgcgttccaggcactgatccagcgtcatgaatccctgagaaccggcttttatatgcaggatggagaacttgttcagcgtgtgcataggaatgtgccgttcgcgttgaactacacagaggcttcggtggaggagacggatacgttcattcacaactttattcgtgcctttgatctgagccaggctccattactgcgtgttagcttggtgaagctccaggaggagcgtcatctgttgctgtttgatatgcatcacatcatttcagatggggtttctattcaaatattgatagaggaacttactcatttgtatcaaggagaacagctaccagagctgcacatccagtacaaggattatgccgtatggcaacgggaacagtcagagaaccaatggcaagatcttgagaaatattggctgcaatcctttgaaggagagttgccggtattggatttgcctacagacttccaacgaccttcagttcggagcttcgagggtagccgaattgattttacattggatgagtctggaaataaggcgatacaagagcttgcatcccgtacaggtactacactgtatatggtattgctggccgcttattcggtactactgcacaaatatacaggacaggaggacatcgtcgtaggttctccagtagccggaagaccgcaggctgagcttgagggcatcatcgggatgtttgtcaacacactggccttgcgcagttacccgataggagataaaacctttcaggattaccttcttgaaatcaaggaaacggcgctcaaggcgtttgagcatcaggattacccttttgaaaaattggtcgaaaagctgggcgtaggacgtgatgtcagccgcaatccgctctttgacaccctattggtattacaaaataccgagcaggaagagcaagatatggacggagtgcactttactccttacttgatggacaccgtcacagccaaatttgatctgtccctcaatgtagaggagaaggggtcaaaattagcctttggcctcgagtatagtacggctttatatcggcgtgaaagtgtagagcgacttgcaacgcacttgctgcggattctgcacgcagtctcggccaatcctcagttgcaactggccgagattgaaatgatcacaccggaggagaaagtacagatcgttgaagtatttaacgcgacatcggctccttatccaagggacaagaccattcatgagctgttcgcagaacaagtcaagcgtacaccagagcagacggcgcttgtattcggcgatgtccagctaacgtaccttgaattgcaagacaaggcgagccgactggcccaaacactgcgtcgtttgggaacattgagggagcagcctgtggccgtgatgggcggacgaagcatcgagatggtcattggtatgctcgcggtgcttcaagcgggtggagcctatgtgccgattgatcctgattacccggaagatcgggttcgttatatgcttaatgattccgacgccaagctattattggtgcaaaagggcgagcttataagtgtagactacggtataccgattgtcgatcttagcagtgaagaggcctatgcagctgaacctgctcagccggagactgctcagggatcgcaggggcttgcttatgtcatctatacatcgggtacgacgggtagaccgaagggcgttatggttgaacaccggaacgtggtccgtctggtcaaagagaccaactatgtggagctgaatgaatccacacgaattttgcaaacaggagccgtggcctttgatgcttctacattcgaaatatggggagcgttgctcaacggtgggcagctctatttcgtggagaacgacgatatcctgattgccgataggctcaaagcggccattaccaagtacgggattacaacaatgtggcttacttcaccgcttttcaatcagctttccctgcaggatgaatacctgttcaaagggctaaaaacattgctggtcggcggagacgtactgtccatatctcatatgaaccgtgtaatcgaggctaatcctgatcttgtccctatcaatggctatggtccgacagagaatacgaccttctccaccacctacaagattctgggtcgtgccgaaggggtcgtgccgattggccgcccaattagtaattcgaccgcttatgtggtcaatggatcgctgcaattacagcctattggtgcttggggtgaactcattgtcggcggtgaaggtgtagcgcgcggatatctcaatcgtcctgacctcacagcagagaaatttgttcctagtcctgtgaaggacggagaagcctgctacagaactggggatctggtacgctggcttccagatgggaatttggagtttaaaggaagaattgatgagcaggtcaaaatacgtggttaccgcatcgaactccctgaaatcgaggcccaactggccaaggtggagtcagtaatcgacgccgtagtggtcgttcgcgcggatgagcttggcgagaagcagctttgcgcttattatgtggcggatcgtacgctcacggcaggcgaagtacgtctttccctatcgcatgtacttccaggctatatgattccatcctactttatccagatggatcgtatgccattaacgtcaaacggaaaagtggaccgcaggtctctgccggctcctcaagtaggcgcgcatacaggacggaagtatacagctcctcgtacaccggctgaggaagctttggcatctgtctggcaaggggtactgggtgccgaacaggtgggtatccatgacaatttctttgaattgggcggagactccataaaagctattcaggtgtcgtcacggttactgcaggccggctatcggttagagatgaagcagctgttcaaatcgccaaccattgccgagctaggcgcggaaattcaaacggctgtgcatatggctgaacagggagttgtgcgtggaacaactcgcttgactccagtccaacagtggttctttggacggaagcaggcagagcctcatcacttcaatcaagcggttatgctgtatcgtgaacagggatttgaggaaaaggccttgcatcaggtgctaagaaaactcgctgagcatcatgacgcccttcgcatggttttccgtcagacagagcatggctacgaagcttggaatcgtgatcttgaagaaggagagctgtatagcctgttcactgctgatttacggaatgaatccgatccgactgtagccattacatcgctgtcggatgacattcagcgcagtatcaatctggcagaaggtccgctgctgaagttaggacttttccattgtcaggatggagaccacctgctgatcgtgatccaccatttggtggtggacggagtatcctggcggattttgttcgaggatattgcagcaggttatgagcaggtgattcaaggacaagcgctgacattcccgcagaagacggattccttccgtgattggggagacgcccttgctcgttattcggaaggtcctgaaatggagactcatcgggcgtattggagagagctggaggatcagccactcgaacagttgccgaaggatgaggctgtggaaagccttcttgtacaggatagcaaagtagtaacagcacaatggactctagaagaaaccgaccaattgttgagaaaagcccatcgtgcttatcaaacagagacgaatgatctgctattgactgctctgggcatggcggtatccaaatggtctggcatcggaaaggttgctgtgaatctggaaggacacggtcgtgagccgattataccgaatatcgacatcacccgtaccgtagggtggtttacaagtcaatatccggtgattttagacttggggaataacccggaagtggcctccttgatcaagtctgtgaaagaagggctgcgccgaattccgaacaaaggtattggctacgggttgctcaaaacgatggcaagtcagttggatgaaggcagcttcagcttgcagcctgagatttcttttaactatctggggcaatttgatcaggatttgcaaggaagctcattgcagatttctccttatccgaccggaagcgcgcaaagcctgttggaggaaccggcctatacgctagatatcaatggcatggtgacggacggagccctgactctgacgattacttataacggaaaacagtataagtcatctacgatggaacagctcgctggatatattgaagaaagcctgcgggaacttctccagcattgcgtaacccaagaaaaaaccgtattgacaccaagcgacgtgcttgcgaagggtctgagcattgccgatctggaggagctttctaagcagacgagtcacattggcgatattgagaatgtatatagtctgacgccgatgcagaagggcatgctgttccatgatatgtttgagccgcatacaggtgcttattttgagcaggccgcctttgattttaagggtagctttgatccgatcgccttcgggcacagtctggatgcagtagtggagcgtcatgctatcctgcgcacgaacttttacagcggatggggcagcgagcctttgcaggttgtatttcggcacagaggcgctaaattggtgtacgaagacctgcgggagatgaatgcatcgcagcgcgaagcttacctgaagacatttggtgctaaggacaaagcactgggcttcaacctagctgaagacgagcttctccgtgtatccattttacaaacagatgaagagagcttccgtctcttatggagttttcaccacatcgtcatggatgggtggtgtgttccgttaattacgcaggaggtatttgaacactattttgccctcctggaaggaagagagccgcagttggcagaggttcatccgtacagtcgatatatcgaatggctcgaacagcaggatgaagcagctgcgtccaactattggagccgatatctggccggttacgagcagcagacgcttttacctcaagtcggtggagcaagtaagggagaaggctatatagcagaaaagctgaattatcctctcagcagggaattgactgggtgccttgaaaaggtggccagggatgctcatgtcacgatgaatatattgctgcagtccctctggggcattgcgcttcaacgctataacggtagccgagatgtcgtgtacggaagtgtagtatcaggcagaccagcagaaattccgggcattgatcggatgatcggtttgttcatcaatacgattcccgttcgtgtgaagacagaggagaatctccccttcaccgttctgatgaagcagcagcaggaacaatatatggcctctcatatgtatgacacctacccgctgtttgagattcaggctcagacggatcagaagcaggatctaatctcacatattatggtatttgagaactatcctgtcgaggaggaggtagagcgtctgggtggtggcgaggctgcctttgagattgaggaggcggagcttcttgagcaaacgaattacgattttaatctaattgtcctccctggcgaagaaatgagattgctgttccagtacaatacacttgtttatgacccagtgacaattgaacaaatcaagggccatctggttcacctcatggaacaaattgtagagaaccctgccatttccgtggatgcactagaattagtcacgccgcaggagagagaacagattctgaacgtatggggaaatacaaaaggcatttacgagcactgtaacacgttccacgggctgttggaggaacaggcgggacgaacgccggatgcgactgccatttggttcgaggacgagagtcttacctatgccgagcttaatgcaaaagccaatggactggcgagaaggctccgtactcagggaatcgagacgggagatctggtgggactgattgctgaacggtcgctcgaaatgatcgttgggatctacggcattatgaaagccgggggtgcctatgttccaatcgatccagagtatccgaaagaacgaatcagttacatgcttgaagattctggggcgaagctgatccttacacaggcccatctcttggagcatctcggatggacggaaaatgttttgctgctggatgaatcatcgacctatgatgccgacacctcgaatttggaggctactgctggcccggatgatctggcttacgtgatctacacttcaggtacgacgggtcagcctaagggcgtattagtcgagcatcggggactaccaaatctttcggacgtatacgggacacacttcgaagttacaccgcaggatcggatcgttcagtttgcaagtctgtcgtttgatgcatcggtttcggaaattttaacggcgctgagccacggggctgttctgtgcatcccttctaaacaagatattttagatcatgccctgttcgagcagttcatgaacgataaggggattacggtagcgactttgccacccgcttacgctatccaccttgatccagagcgtttgccaacactgcggtgcctgctaaccgctggatcggccgcatcggtcgagttgatcgaagagtggaggaagcatgtacgttactctaatggctatggcccaacagaggactccgtatgcaccacaatctggtctgtcccggacagtgaggaagcaacggatattgtatctattggacgacctattgctaaccacagtgtgtacatcttggatgaccattttagattgcaacctgtcggtgtagctggagagctatgcatttcgagtatcgggttagcacgggggtatcataatcggcctgagttaatggatgagaagttcgtggacaatccgtttgctccaggagagcgcatgtatcggacgggtgacctggttcgctggttaccgaatggaatcatcgagtacttaggtcgaatagatcaccaagtcaaaatccgcggctaccgtatcgagctaggcgaggtagaagcacaaatgctcagagtgccgtccgttcaggaagtcgtagccatggctgtagagggcgatgacggctacaaagatctagtcgcttatttcgtagctgctcagaaacttgaggtatccgagcttcgggccgtcctgtcggagatattacctggatatatgatcccttcccgcttcatacaactggaggatatgcctctgacgtcgaacggaaaaatcgatcgaaaagcgctgcagggcgagcatggatgggcagcggcttcatctgaggctccaaggacacctgtggaaattcaattagccgagatctggcaagaggtgctgggtgtagagagcgcgggagtgaaggataatttcttccattttggaggtcattcactgcgtgcagctctgctagtctcacgaattcgcaaggaaatgaatcgcgagattagtctgagagcagtgttcgagtctcctactattgaaggattggctcgtgccattgagggctatacgccgttgaatttcgaagaaattcctacagcgggagcgagagagcattatccattgtcctcggcccaaaaacgactgtttattctaagtcagctggaaggtggagagctgagctacaatatgccgggtatccttaccgttgagggagctttggatcgggaacggctagagcaggcattccgtcgtctaattcatcgccatggttcgctgcgaactcgttttgtgactgtgaacggtgaacctgtacagcagctcctgacggatgttccgtttactgtggaatatgcggagttgagcgaggaagaggcaggagctacccttcagcagttcgtccgtccttttgatttaggtgtagctccattgctgcgggtcggccttattcgaattgcacatgagcgccatttactattgtttgacatgcaccatattgtctcagatggggtttctatgaatattctcatagaagagtttctccgcttctaccaagaggaggacgtatttcctgagctacagatccagtacacagactatgctgtatggcagcaagagcagctcggaagcgagcgtcttaaggcccaggaagcttactggcaggatgctttccgtggaagcttgccagtgctggatttgccaggagatgaagttcgtcctgcggtgcgaagctttgcgggcgatcgaatcgacttccaaattgattcttctctgagtgcttcacttcaggagttggctacccgaacgggttccactctgttcatggtactgctggcagcctatacagcgctcttgcacaagtacacaggtcaggaagatgtcatcgtcggttcacctgtggcaggaagatcccatgcgacactcgaaggcctcatcggtatgttcgtcggcacagtggcacttcgtacttatccagaaggagagaagcctttcgaggcttatctgcaggaagtgaaggaaacagcgctgcgggcctatgaaaaccaggattacccgttcgaggagctggtagaaaagctggagcttcagcgtgatttgagccgtaacccactatttgataccatgtttgtcctgcaaaatatcgagcagggagaacaagaaatagaaggattgcgcttcactccttacgataatgtacatccggctgccaaattcgatcttacgctgaccgtgagtgaagcagacggagcattgaactgcacgcttgagtatgcgactgcgatctacaagcaagagactgctgagcggatggcaggccactttgtacagcttattcgggaagccatcgccaatccggcactgccgttgtcatcccttgatatcgtgacacctcaggaaaaatcaaggctgatgaaagcaccggacgaagccaaggcagattatcctcgtgacaagacgatccatgcgctgttcgaggagcaggccgcacgtactccgaatgcagtggcagtcgtatgtgaagatgcaaccttgtcctacagcgagctgaacgagcaggccaatggacttgcccgaacgctgagggaacgtggtttgcaaccagacggtttggctggaattatggcggatcgttcccttgaaatggtggtcggaattttagccatcttgaaggcaggcggggcctatgtccctgtagaccctgaatatccagaggaccgcattcgctttatgcttgaggattcgggagccaagctactgctgacacaagcgcatctggagcaacgtgtctccttcgccggggatatcgtaagtctggacaaaacggcttcctacaagaaggatgtctcaaacctgcagcctgcagccggaccggggcatcttgcctacgtcatctacacatcgggtacgacaggcaagccaaagggaacactgattgagcataaaaatgtagttcgcttgctctttaatgataaaaatatgtttgactttggtcctcaggatacgtggacactgttccattcattctgttttgacttctctgtatgggaaatgtacggagcattgctgaacggaggacggttggtcatcgttccatcgcttaccgcgaagagtccagatcgtttcttgcaattgcttaagaatcagaaggtcaccgttttgaaccagacaccgacgtacttctaccaattgctacaggaagagctcggtcatcaagcggcagaactgagcctccgtatgattatcttcggtggagaggcattagccccggccctgctcaaggactggagaacgaagtatccgcaagtgcagcttattaacatgtacggcattaccgaaacgaccgtgcatgtaacctacaaggaaattacagagttggaaattgaacagggccgcagcaatatcggcaccacgattccgacgctgcgagcgtacattttggatgaacaacgccgtccacagccgattggcattccaggtgaactctatgtggcgggcgtaggtctggcgcgaggttatctgaaccgaccggaattgacggaagagaagtttgtcgctcatccgtttgaagcgggcgagcgcatgtaccgctcgggtgacttggcacgctggttgccggatggcagcatggagtatttgggacggattgaccatcaggtaaaaatccgtggttaccgtatcgagctgggcgaagtggaagcgaagctgctccatgctccgtctgtaagggaggccgttgtgctcgcccgagaggatggaagtggacaaaaagtgcttgtcggctatttcactgccgatcagatgctgacggtaggcgagttgagaaaagccttggctgccgaactgccgacttatatgattccatcttactttatgcaattggaacagatgcctttgacgccaaatggcaagctggatcgcaaagcgcttccggctccagaggccaatgtgcagactggagcggtttatgaaccgccaaggacgaagactgaggaagccttggcttccgtatggcaaggtgtgctgggagcgcagcaggtcggcatccatgatcatttctttgatctgggtggtgattccatcaaggcgatccaagtgtcctcgagattgttccaagccggatataaattagagatgaaggatctcttcaaatatccgacaattgccgagctaagcccgtatcttcaggcagccggacgtacagcggaacagggcgaaattaaaggtgcagcagagttaatgcccattcagcgttggttctttgaacgccatacagcggagccgcaccattataatcatgccgtcatgctctatcggaaagacggctttgatgaagctgcactccggttgacaatggaccaaattgcgatccatcatgatgcgctgcgtatggttttccggtctacagaagctgggtatgcagcttggaatcggggaacggacgaaggcgagctctacacattggacattgccgatgtgcggcaggcggaagaccagacagctgtggttcaggcccaagccgatgccattcaggcaagctttgacttggaaggtggcccactgttcaagctaggcctgttccattgtgacgatggcgatcatttgttgattgtcattcatcacctcttggttgacggcgtatcctggcgcatcctgtttgaggacattgcagcggggtacgagcaggcattgaatggacaagcaatcgtccttccacaaaagaccgattcgtatcttgtatggtctgagcaagcgacgaagtatgcagcagggcctgctctggacaaggagcgtgcatactggcagctaatcgaggaggcgattgtggccccactgccgaaggatgaggatcagaagccaggcaccattcgggatactgaatcggttacggtaacgtggtctgcgcaggaaacagacctgctgttgcggcaagcgaaccgggcgtatcatacggagacaaacgacttgctcttgactgctctgggggcagccattcagcgctggacaggcatggagcagattttggtcaatcttgaagggcatggacgggaaatgatcgtaccagacctggatattacccgtaccgtgggttggttcacaacccagtatccggttctgctgaacctgcaaggcggacaggaagtatctgcgcgcatcaagcgcatcaaggagaatttgcgagaggttccgcacaaaggaatcggttacggtcttctgaagtatatggcaccggagaaaagtgtcggatttggcgtggagccggaaatttccttcaattatcttgggcagtttgatcaggatctggagggtaatgcccttagcctatccacacattcagttggtaaggcgctcagcgacctcacaccacagcaatatgctctggatgtgaatggcatgattgctgaaggccagctatcactgacgattacgtacagcagcaggcagtatcgtaacgagacggtgagtcattttgctgaattattacagtcaagccttagtgaggtcatccgtcattgtgtggctcaggagcgttcacagcttacaccaagtgatgttctgtttcaaggattaacattggagcagcttgatcgactcacggcgcagacggctcacatcggagagattgaggatgtgtacaagctgacgccaatgcagaagggaatgctgtttcacagcctgctggagccggactcctcttcatacttcgaacaggcaacgtttgagctgcgtggtagcttcgatgtagatatcttcttcgagagcttccaggctttggtgcagcgacatgccatactacgtaccggattttacaacaacattgctgatgtaccgctgcaagttgcctttaagcaacggttaatccctctgcactacgtagatttgcgcgacgcatctatgcaggaacaagaagcccgaatcaaggcttatattgctgaagatatggttaaggggttcagcttgtcagaagatccgctgatgcgggtgaccgtcttgcagaaggatcaaagctgtcttgtattgtggagcttccaccatattgtcatggatggctggtgtatcccgatcattacacaggagctgttcgattattattctgctaagaaacagcaagtacagcctgtcctaccgccagctcagccctatagccgttatatcgagtggcttgatgcacaggatgatcaagaagcttcaacgtattggagccaatatctcgaagattatgacgggaacaccgtattgccggaaggtaaaacgaaatctcaagcaaaagaagcgggctatgttctaaaagagcatgttctccatctgggtgcatctttgacaggtaaaatggatgttgtcgcgaagcgcaatcacgtaaccgtcaatacactcatgcagacagcttggggactgattcttcaacgttataatgccagctcggatgtcgttttcggcggcgttgtgtcgggtagacccgctgagattgcagggatcgaaaatatggtgggtctgttcatcaatacagtacctatccgtgtacagtcatccaaagacgaagcctttgtcgaagtgatgaaacgtacacaggcaaagtcattggctggtcgtgcctacgacacctatccactgtatgagattcaggggaaaacaacccaaaagcaggacctgatttctcatattatgatctttgaaaattacccgctcgacgagcaggtggagcaatcgggtaaccaaacggaggacaatctcgaagttgccaacttcaccatgtttgaacaaaccaactatgactttaacctggttgtgattccaggcgaagatatcaaggtctgcattcgctataatgcttcggtttacgagcaagaaagcattgcacgtatcggaggacacttgttgcagatgctcgatcaggtggctgctcgtccgcaggcgacgatacaggaactggagattgtaacatccgaggaacggatgaacctgcttgactggggcggcaaggcacatacctatccaagtgatcagggtctgcataccttgtttgaagaacaggttgtccgtacgccggataagattgcggctgtaaatggggacactcagatcacctatcgggagctgaacgagcaggcgaacagactagcttccaccttgatagaccaaggactacggagtgaacaagtggtaggtctgttggcagatcggtctgtagaactgcttgtcgccatcatgggtgtgctcaaagcgggtggagcctatgtacctattgatcctgaatatccgcaggagcggattcagtatattctgaaggattctggcgctgaaattttgctcacacagagccacctgacggagttggcctcttttgagggaacggttatggaattggattccccgcacatctacggaaccgaggtggataatcccaatattcctgttggaggaaacgatctggtgtacttaatctatacctcgggtacaaccggaaatccgaagggaaccatgattaaccacaaagggatcgtgaactacatctggtgggccaataaggtctattgtgctggaaaaccaacggatttcccgttgtattcatccatttcgtttgacttgacgatgacatcaatgtttactccgttaataaacggaggaatagtacggatttatgatggtatagataaagcggaggttgtacagcatattttgcgcgaaaatgcggtggacattctcaagctgacgccgactcatctcagtctgattaaagatatgaccatcccggcagaaagtcgcattcagcagcttattgtgggtggagagaatctgaccacacatttgtcgaaaaccatcacagatctctttggcagcaacatcaaaatctacaatgaatatggaccaaccgaaacggtcgtcggctgcatgattcacctgtacaatcctgcgaaggatacgcgtgaatctgtaccgattgggttgccagcagacaatatatacatccatattctggatgatcagctgcgtctcgtaccgttaggcgtggagggcgaaatgtacatcgccggggacggggtagcccgtggatatctgaaccgtcctgagcttaccgcagataaattcattagaaatccgttcgcttcggaaggaaatatgtaccgcactggggatttggctcgtcgccttcctaatggagacattgagtacattggacgcattgaccaccaagttaaaatacggggctatcgtattgagcttggtgagattgaggccaagctgctggacattccacttgtcgaggaagctctcgttgttgcgtgggcagatgctcatgggcagaaatcgctgtgtgcttacttcgtagctaatcgcgaaatgtctgtcagcgagctgagagacgaactgtctgccggactgcctgcatatatgattccgtcttacttcgtccaactggacgtgatgcctctgacaccgaatggtaagctggatcgcaaggcactgcctgaaccgaactcgggtataaaggcgggagcagactttaccgctccgcgcacggatgtggagaacattttggcttcaatctggcagggtgtactcggcgtgccgcttgtcggcatacatgataacttctttgagcttggaggtgactcgatcaaatccattcaagtatcctcaaggcttctccaagcaggctataagcttgaaatgaaggatttgttcggttatccgacaattgcagagctggcacagcgcgttagtgtggtcagccgaattgcggaccaaagcgaggtacacggagcggtaagactgggacctgcccagcacagattcttcgatgaacagtcgatggatctgcatcactttaatcagtcggtcatgttgtaccgacgtgatggcttcaataccgatgcgctcgccgaggttgttcggaaaattgcagagcatcatgatgctttacgactggtgttccgccaaggagagcagggattggaggcctggaaccggagcatgggtgagggtgagctctatagcctccaaatccacgatttgcgggatgagacagacccggcttcagcaatagaagcaggtgcggaagccattcagcgcagcatctctctggaggatggacctctctttagattgggtctgttccgctgtgcggaaggcgaacatctgttgatcgttattcatcatctggctgtggatggcgtatcctggcgtattctttttgaggacctgcaggatggctacgagcaggcagcacgtggagaagcggtcaagcttccacagaagacggattcgtaccgtgcatgggttgagggaatcacacaatttgcgaacagtctggcggctgaacaagaacgcggctattgggcagaggtagagggagatggctttgtccctcttcccaaagacaaggtagacggcgctcttctcatcaaagacagtgaggctgtcacggtgagatggtcaccagaagagacagagcagttcctgaaagaagcgaaccgcacttacaatacggaggtcaacgatctgctcctgacggctctgggtatggctgttcacgagtggacgggaatcgaacgtgtaggcatccttctggagggacatggacgggagcctgttgtgccggaactggatattactcgcacaataggctggtttacaagtcaataccctgtcgcccttgagatgggaggggaattggagatcggcgccagaatcaagcacgtcaaggaaagcttgcgtcgtatcccgaacaaaggtgtcggatatggtattttgaaatatttaagtgacggttccgatgtctcctccttctcggctgaacctgagattaccttcaactacttgggacagttcgaccaggatcttgcagaaggggtcatggaagtatcgtcttactcagtaggacctgaggtcagtgagcagatggtgcagcatcaggcattgaacattaatggactgattgccgaaggacagcttcaactttcggtcagctataaccgtcatcagctcgacggggagtccgtgactaagtttgttggcattctgaagaaccgtctcagcgaagtcattggacattgcgtaagtaaggaaagaacagaacttacaccaagcgatgtactcctcaaagatatcagcttggaaaaaatcgaggagatagaagagcagacacggcatatcggcagtattgaaaatatgtataaactgacgccgatgcaaaaaggaatgttgttccacagcttgctggagcctcattcggaagtctactttgagcaggccaaatttgaaattcagggagcattctatcctgaggatttcaaacgcagcttaaaatatctgatgaaacggcatgccatattgagaacgaatttccacgccgggtggggcgatttccctattcagattgtgttcaaagaaagagcatgcgacttcgtatacgaagatctgcacgagctggaatccgctgaaatagaagcgcgtcttgcagcttatgttgcccaagacaaagcgagaggttttgatcttgcgaatgaagccttgctgcgagttgctatcctacgtactgcaaaagagcattaccatctgttgtggagctctcatcacatcattttggatggctggtgtatgccgcttgtgctccaggaagtgtttgaaacatacggagctctacgtgagcaaagggaacctgagcttcctgcagcagcatcgtacagccagtacattcaatggttggagaagcaaggtgaggaagaggcatcctcttactggagagggtacctggaaggctacgagcagcagacgaagctgccacaagccatcacacagccatcagcaaaagcagaagcctatgtgtcggagaagctggtattcacgttggatgcggaattgaccgatcgcctggaacaggtggccaaacagcatcaggtgacgatgaatacattgatgcaagcagcctggggaatcgtgttgcagcgctacaatagaagccaggatatcgtcttcggaagtgtagtatcggggagacctgccgagattccgggtatcgaaagtatgatcggtctcttcatcaatacagttccggttcgggttcaggccgagggaagcgatttgttctcccaagtgatgaaaagacagcaggaattatatttggcaggacatgcatatgattcctatccgctctatgagattcaagcacagagcgaacaaaagcaagatttgatttctcatattatggtgttcgaaaattacccggtagaagagcatctagaagagaaaatttccagtgaagaggctgaatacagaattacggacgttcagatgtttgaacagacgaattatgattttaacctcattgtgctgccgggccgtaatctggagttcttgtaccgttacaatgcccgcgtctatgatcgggagagcgtggaacgcattcaaggacacttgacgagaattctgacaagcgttgctgttcaacctaccatccgtattgatgagctggagttgatcacgccagaagagaaatcgcagattatagaggtgtggggcgatacagcagctccttatccgcgtgagcagacccttcacggtatatttgaggaaaaagcagcgctcacaccggatcgtacagcacttatttacggtgaaacggagcttacctatggagaactcgatcagcaggcgaaccgtctcgcacgtacgctgcgtgcccaaggggtcagaccggaccaaccagtcggcatcatggtcgagcgctcgcttgagatgatcattggtattcatgccattctaaaagctggcggggcctatgtaccgattgatccggagttcccagaagatcgtattcgccacatgctggaggattcgggagcgaagcttctgctgacgaagaaccatctccaagatcgttttccgttcactggcacgatcctggcacttgatgatccgcaggcgtatcatgcggatagctcgaatctggagccaatggcggggccggagcatctggcgtatatcatttacacgtcaggttcaaccggcaagccgaaaggggtaatgattgaacatcgcgctgccgtccatacgctgagtcagttggaagctgaatatccgatgttggcaggcgaccgtttcctgctcaaaacgacattcacctttgacttctccgtgccggagctgttctgctggttctttggacaagggactctcgtgatcctgccacaaggcgtggacaaagacccgatggcactgctagaggccgtggatacgaaccgtatcacgcatctcaatttggtgccgtcgatgctcagtgtgctcgttcaatacttgaaagaaagcggcaaccaaggattccttactctgaaatacctgtttgcctgcggcgagacgctgcctgccaaacttgtggaagagtattataaagtatctccttacgcagtactggaaaacatctacggtcctacggaagcagccgtatatgcgactcggtatacaacgagccttgagactgcggctctaacgcatgtgcctatcggcaaaccgtacgctaacgtccaagtatggatgatagacggcgcctctcaggtatcaccagtaggtgtaccaggagaactgtgtattgcaggcgagggggtagcaagggggtacttcaatcagcctgaactgacggcagagaagttcattcctcatccgtacaaaccgggagaacggatttaccgaacaggcgatttggcccgatggctgccagacggaaatattgagtatttggggcggatcgatcaccaggtaaaaatccgcggttaccgcattgagctgggagaagtggaagcacaaattctgaaggtgccgtcggtacaagaagcggttgttctagcactggctgactccagcggaagtactcagctttgcgcatactttgtggccgaggaagggctcgcagcgggcgtactacgtgaggcactggccagcgagctgccaagctacatgattccgtctgccttcgtacagctcgcacaaatgccgctgaatccgaatggcaaattggatcgcaaagcactaccggcaccggaaacccttctgcggagcacagcggagtatatcgcgccgcgtacgcagacagaagtagagctcgctcagatttggtctgaggtgctcggcgtacaggaaatcgggatcagggatcatttcttcgaacttgggggccattccctgaaagtattgggcttgatccaaaggatctcgtccagtatgggcgtccatctcccactccaggccgtgtttaatctgccgactgtggaagaaatggcgcatgaaattttcaagctgcaggcaacgaatgctgccgacgaacaagaaatggaaattatccgcttcccaggaaaaggaacgattaaagtgttttgcttccctccacgggtaggccactctctggggtactatgagatggccaaggagctggaagggttttgcgaggtgtacggaatggaatttatcggcgatcggtaccagggtcaagatatgctggatcgatacattgatgccattgtggatattcaagcagagggcccatatgtattcctaggatactcacttggaggaaatctcgccttcgaggtagctaaagccatggaaagccgaggtcaccatgttagcgacattattatggtagatgctatgagaaagatgtccaaggatgaatcgacaccagaggagctcgaagagattgtcgagacggtactggacagcattagggaccagtacaaagcattcctcgccgatccagtggacagggagcgagtcatggacaaaatgttggtgtactccacctaccgcgatgagcttattaacgcaggtgaagttcatgcgaatatccatgctctgattgcagaggatgatagtattggtccagatacatcattagataaattgttatggcaacaggcgacacttggtcaatacaaagaatacgaagtcatcggaacgcatgatgtgctgcttgattccggttttattggggaaaatgctaaagtactgagacagatacttggcaaggtcacagaggcttcatctaataacaagcccattttgtcctaagctcaatcaagcataataagtgttaggcagcaaagacgcccggattcctttattatagaaggaactcgggcgtcttttgtttttttaagctgtccttaacatataaagtccctaatcatctgtgtatgctttagacgtggttgactgaaagtgactggtgttggtgatgagttcacggatgacttggatgacaagatccggttgatcatggatgatcatatgctcgcttttcttggcaacaattaatttgctgtttgtagagatgttaagcatctcgcgctgtccgatttgccagctttgttcaatctgattatttccgcgtttactaataccgaactgagtcaaatcttgttgaatgccccgagcaattacacgtacagggagattacccagatgttgtccccgtatggcatcttcggtagtgctcgctaggtcaccctcctctgcaacagaccgaaagtatttagaagaagcgacaatattcacaaaagattttctatcttgatattcgacccgacccgtcagcataaaattggggaacaggcgaaaagcccctgatttttctaggagaatggatattaacggggagggattggccttaggccgttccttggcatagatcttatttgtccgtcgggcgtcattctcaggcctggcatccaccagaaccaatcctgccacttcgtctctgtacgtctgcgcgtacagtcttgagtacatccccccgagggaatgacctacaaggatataaggaggtcggatgtccgcattctttagagcagtatgaagctcccgaacgatgttttccccggtgcgtggtgtatttgcctcctcgctccatgcatagcctgcccgatcataggatacaacggtggcgaatgatgacagcttttcgggaatatctctccaggagaggctactttccccgctccctgattcaagcaaaattgttggagaaccgttaccgagtttacgaatatgaagtcgatagcccccggcatcgaccaattcccccggaggtgggtattgtgatttatccttcttggatgcaatccactcatacacaaatccggagatcacgaaaagcaataagcaagagatgataagaaacacaattctcgtccatgtttgccttcgttgcttcattagaaaatctactcctctatacagctataattaatcattacctaaagttgcgtgaaacaatagctgctacagtatggtttgtggctagctccttatctttttacccatcctttctttgtaaaatcatcaatattaaagaaaaaaacagaatatgcacttgagttgtaatgagcaacccgcgtattcttgatcattgaatggatatcacgtcgttcttggatgcggataactaagtccatttggcaaaagtacagtgtacacagggtaaaattacaacaataaagatagtaaaaactattcattaaaaagggttgcatttaaatatgcagaatggtatactctaattccggccaagaaatacgatattgcgagcgagtgtttcaaaaaaagattctaaaaaatgcttgcaaagttggttcggacatgatatgatataagagttgatgaggcgacaaactgaatcaacgagaaaagatgtttgatctttgaaaactgaacaacgagtgagtaaagcgattttgcttgcaaaatcaaacaagagatatttttatctcgtcagtttcaaaatgagcttatcgctctt

SEQ ID NO: 65 - DNA, 4046 bp, Unknown
  Kingdom: Bacteria, Phylum: Firmicutes, Class: Bacilli, Order: Bacillales, Family: Paenibacillaceae, Genus: Paenibacillus
atgttctcgctgtccctatttaaggaatgagaaggggactcgtcttttggaagcggctgatatacgccttgttccatttcctgccagaatgcgagttctgctgccatggccggactgttcgcatattgagactgcccatccgcccaggtgcggaacgaatccgttttgtgcggaagacgagccgcttgtccgttcaatgcctgctcataagcggtcgtaatatcctcgaacaaaatgcgccaagatacggtatccaccactaagtgatgaatcgccatcagcaaatgatctccatcgggacaatggaacagccccagcttcaccagcggtccttcgcttaaatgaatacccgcctgaatttcattcactttggccgcgatcgccgcagatacctcagactcatttctgaagtcggcccgatccagcgtatacagctcgccctcaccgaccgcgcggttccaagcttcatatccgcgctccgtaggtcggaaaatgatacgcagtgcatcgtgatggctaacgatttgatccatcgctgtgcgcagggccgtttcatcaaaaccgtccttgctatgcagcataatggactggttatgatgatgagcatccgtcaggttctgctcaaagaaccattgttgaacgggtgtcagcttcacagcgcccaccacttcgctctgatccgccaatcgggtcaccgattgaactttcagtgccaaggcagacacggttggatgactgaacaggtctttcatctccagtcgataacctgcttgcagcaatcgggaggatacttgcaaggctttgatcgaatcgccacccagttcaaagaagttatcctgcgtgcctaccgcttccacgccgagtactccggcccataccgcagccagcacttgctccaccgtggtacgcggtgccacataggctgcaccggtatggatgcttccttccggttccggcaaggccttgcggtcgatttttccattgtgggtcagtggcaaggtctccagacgcatcaagcgtgcaggtaccatatgtgctggcagtcctgcttccagctcggcctgtacctcctcgatccgcagctcggtttctcccgtgatgtatccgcacaaatacttgtgtccacgctcatccgtccggtcgatgactaccgcttgacgcacgcccggcacccgctggatcgccgtttcaatctcgcccagctcgatccggtagccgcggattttcacttgataatccatccgcccgataaagtctacattgccgtccggcatccaccgcgccaagtcacctgtgcggtacagtcgttcacctggcacgaacggattggccacgaatttctcggctgtcaggtccgcacgattcaggtagcctcgtgccaccccgccaccgccaatgcacagctcgcccagtacgccgatcggcaccggattcaactggctgtccacaatgtagaagcgggcgttcagccacgcctggccaatcggcacattgccgctgcttggcagcttcgacaattcttcgtcgtagaagctggagtcaatcgccgcttccgtgacgccgtagctgttcataatgcggatatccgcgccaaaccgttcttgcagcacccggtagtctgtcacgctgcagctatccgagctggtaatcagcaattccagactgctcatgtccagtccctgttcatacacatgctgcataaacggtacgatcagggccggggtcgattcgaacaccgtaatctggtagtcgcgaatccagccgtacagacggcttgggtcaatccggtcgtctttcgggcagatgaccatcgtgccaccgttatagagcgtccgtgcgatatccccgacgaacacgtcgaaggaaaagctcgccagttgcaacaaccgtaccgggaactggttcagacggtaatcccgacggtaggccgcggctgtgtttaccaaactgtgatgctcgatcatgacccctttcggacgtcccgttgtcccggacgtgtagatcacatacgccagatcctgcggttcattgatgtgattgacgtctgtggtatccccggtgtacaacgactcatcgtccaacgccagtacggtatgcagacgcaaacccgctgcggattcggacgttgcttcgctgtcaggtggcgaatctgctgttccattcagggtttcatggagagtacttgattccatcgtctcagcgccagccgctgtttccaactcgccctcagtctgccctccggccaaggcctgtcggctttcttcgagccatgcctgtgcacgctcctgcaaccccgtttgggtcaacagtaccgtcgcaccactgtcctccagcatgaaacgaatacgttcggacggatagtccgcatccagcggcacataggcgcctccagctttccataccgccaatacgccgaccagcatgtctaccgaacgttcactcaaaatgccgaccatcgactcgcgtccaatgccttcatttcgcaatttacgggccaattggttcgcacgctcgttcagtgtgcggtacgtaagctgctgctccccgtacaccaccgccacgtgatccggtacaagctgcgcttgttcttccacaaaggtatggaacagtgctcctgcttctaccgcagcaacatccgatacccctacatctccaaaaccgtagatgatttgtgccttttcctcgacggttaccatctccaaagctaccagtggctgctgcggatgcagcgtaattgcacggacaagctcggtaaaatgctgtgccaatcgcccgatggtctcagccttgtacagcgccgtgctgtattccagactgcacagaatgccttccggctgctccactgcatccaaggtcagatcaaatttggccgtatgattgtccgtcggatacgttttaaaggtcagaccctccagctcgaactcctgctgttcaaatgttttcagctcaaacatcgtgtcaaacagcgcattccggctcgtatcccgcgttaaattcagcttttcaaccagttcttcaaaaggatattcctgatgttcataagcactgagcgcatgctctttgacctcttgcaagtaatccaggaacgttttgtcgccagacggataattgcggatcgccagcgtgttgaggaatacgcctaccaagccctccagttctgcatgcggtcttccggcaatcggcgtgccgacgataatatcctcctgccccgaatatttatgcaagagcgtgctatacgcggccagcaacaccatgtataaggtggagccggtttgcgcggccagctgtttcaactgctcgctgtcctccaagctgatcgcaaattccaatcgagctccttctagacgctgtacggctggtcttgcaaaatccgttggcatatccagtgctggaatgtcaccagccatcgtgttcatccagtagctttcctgctcacgaagacgttcactttgcatatcggcatgctgccaaacggcatagtccttgtattggatgcgaagtggcggcagttccttgccttcatataattgagagaactcctgcacgataattccttcagtcacaccatccgaaataatatggtgcatgtcatagagcatgacgtgacgctccggtccggtttccaccagctgaacccgcagcaacggtgcttgtgcgagatcaaatgcacgtacaaagtcctgtgcgtactgctgggtctcttcttcgcttgcctgcacatgctccacgttgaatgcgacgcccgattcaatccgttgaatcacctcaccatctaccatgtcgaatcgggttcgcagggcttcatgacgggcaatcagctggtggaaggcttgctccagtcgcgttttatccaaggaaccttcaatgatcaaagcgcctggcatattgtagctaacctctccgccttccaggtgactcagcacgtacatccgtttttgcgccgaggaaaccggataatatgcacgttcctccgcaacagggatggatacatacgtttgctgtgtctgaacttctcccatcacctgtaccagttgctcaatcgtcgg

SEQ ID NO: 66 - DNA, 655 bp, Unknown
  Kingdom: Bacteria, Phylum: Firmicutes, Class: Bacilli, Order: Bacillales, Family: Paenibacillaceae, Genus: Paenibacillus
atggatacatacgtttgctgtgtctgaacttctcccatcacctgtaccagttgctcaatcgtcggatattggaaaatatctcgcagcgccagcttgtaattcagctcctgatggattttcgccatcagggttgtcgcgcgcagagaatgtcctcccacttcaaaaaaatggtccttaataccgatctgcggatgattcaaaacactttgccaaatacgtaccaactgctcttccagcagtgtccgcggtgccacgtacgctgtgcctccttcgaggcgcgcttccggcgcaggcaacgctttgcggtcaattttcccgtttggtgtcagcgggaaatgatccagttgtacgacatatgtcgggatcatataccccggcagcttgggctgcagcaggtttcgcagctctggcaaattcagcgcatcagaagctacgacatacgcacacaaatccttgtctccatcttcgttttcccaggcggtgacgatggctttctgaataccgtccacggtcagcagctgtgcttccacctcgcccagttcaatccggaagccccggattttgacctgatcatccatccggccgataaagtccacattgccgtccggcatccaccgcgccaaatcgcctgtgcggtacaatcgttcacccggta

SEQ ID NO: 67 - DNA, 1283 bp, Unknown
  Kingdom: Bacteria, Phylum: Firmicutes, Class: Bacilli, Order: Bacillales, Family: Paenibacillaceae, Genus: Paenibacillus
gggactgacccccgtttgtgagacagggatcaaaacacctttcaagtttaagcagccagtcgcctgtaatctaccggcgactggttatttagtttcgtttgaatccgaattgagttatagtaggtgacgtagtctcgaacggtctgtacaacgattgcagtcgttgtacagatgagatcttcgaggtagaacgtttcggactttagtgtggaatgaaacgattcgatgggggcattatcagcgggcgttccttttcgggacatgctcatggtaatgccttttccctttactgcagcttgataagcctgtgacgtatatacgcttccttggtcgctatgaagcagcatgtttgtccgttttggaagttgattcagcgtatccaaaaccaaggacgtgtcttgcttgtccgctatactgtaagccacaatctccccattgtacagatctagaatgctagagaagtacaacatttttccgccaaacggtaaataggtgatgtccgtgacgagcttttgcaggggcgcctctgcatggaattgccgcttcagcagattttctgccggataagcgggctgcccagtgatctttcgttttttcatcctcacgcggcactgtaacccctcacgctgcataatccgctgaacccgtttgtgattcattctttgctctgcccgaaggagtgcggtgattttccggtaaccataccgaaatttatgatggatgcaaagcccccggattttctccaccgtagcatctgtgtgctctgtcttcacggctgctttccagcggtagtaggtcgctcttgcgattccgagccatgtacaagcctcagacaccgtcacttcgtctcgaatggattcgacccaggcaacggcaacttctggttccacctcctttccagttccttgtacttttttagtaggtccaattgctgcttcaggaatcggttctccgcctttactttttcaagctccgaagagtgctccggaccttttccgtagctgtattgtttacccacaggttgctccagacgatgtacttcgccttttcgataccacctcatccatgtttttagttgtgtcttattccgtattcccaactgctccataacctctcttactggaactcttgccaatctcatttcaatagctttcatcttcacttctactggatagctaactctcgttgccaacgtaaaaacacctccaaggttatctccatatcttacgacatggcttgattctcttgaaggtgttttgatttgtctcacgttatggggtcag

SEQ ID NO: 68 - DNA, 8114 bp, Unknown
  Kingdom: Bacteria, Phylum: Firmicutes, Class: Bacilli, Order: Bacillales, Family: Paenibacillaceae, Genus: Paenibacillus
atccagttttcagggtgtaagttttgtatggtataggctcaagtagcttatatgaaacaagcgaacacacagcatttggcgatgctgattcctgaaaaagaatttgcacagcaaattcatgtttggtggcgatagcggaggggttccacacgtacccatcccgaacacgaccgttaagccctccagcgccgatggtacttggaccgcagggtcctgggagagtaggacgtcgccaagcaaccccataatggggattttttttcgcctatcatgctattgattatacatacaaaattgattttttagatggggctatagctcagctgggagagcgcctgccttgcacgcaggaggtcaggggttcgatcccccttggctccaccaatattccctgatagctcagttggtagagcactcgactgttaatcgagttgtcacaggttcgagtcctgttcggggagccatgtggagaggtgtccgagttggccgaaggagcacgattggaaatcgtgtaggcgccaaaagcgtctcgaggattcgaatccctctctctccgccagctcttaataatagatatatggcccgttggtcaaggggttaagacacctccctttcacggaggtaacaggggttcgaatcccctacgggtcatagtaattcggaggcttagctcagctgggagagcatctgccttacaagcagagggtcgggggttcgagcccctcagcctccaccacttgaaaaataaacatttattactgtcgcggggtggagcagttcggtagctcgtcgggctcataacccgaaggtcgcaggttcaaatcctgcctccgcaattactttcaactaagagagttgtctctggaaccgtggtgtagaggcccaacatgcctgcctgtcacgcaggagatcgcgggttcgaatcccgtcggttccgccatttaacttaatatgccggtgtagctcaactggtagagcaactgacttgtaatcagtaggttgggggttcaagtcctctcgccggcaccattttggaggattagcgaagtggccaaacgcatcagactgtaaatctgctcccttacgggttcggtggttcgaatccatcatcctccaccagttttacgagccattagctcagttggtagagcacctgacttttaatcagggtgtcgaaggttcgagtccttcatggctcaccattatcattgtatgcgcgtgtggcggaattggcagacgcactagacttaggatctagcgtctttgacgtgggggttcaagtccctccacgcgcatcttgtttttgcggacgtggctcagcggtagagcatcgccttgccaaggcgagggtcgcgggttcgattcccgtcgtccgctccatatattagtccccttagctcagctggatagagcgtttgactacgaatcaaaaggtcgggagttcgaatctctcaggggacgccattaacttcataagccggtgtggcggaattggcagacgcgcgcgactcaaaatcgtgagggaaaccgtggaggttcgagtcctctcaccggcatttatttcgggatgtagctcaatggtaaaactcagccttccaagctggtagcgtgggtccgattcccattacccgctttatataaatgaaaaaggagagatggcttatttttatgccatctctccttttttacttttaaacaattcctatcgacatgacaaccagtagaaacctcaaggcaatctcctccgttcctttgcgttattaacatacacaggcaacttccagaatttttattttctgatcttcttcatatacttaagtttcagctcgtagttcagttcttgaaggcaatatcagcatgcagacagaaattgcccccgcaacctaactctggtatcggcgagagaagcaaccgctccagatccagagtttcaatctgcttaactatcggttaatgggctttgagcgaagcactgaccggagtcatcttcgtctgagaagcaactggacctggtgaccatggatatcacgatgccagatatgacaggtacacacgaggctttctatggataggcgtaaaactaacgaggaacgatagttaaataacacacaatgttgagcaggcgcttcaagtctgctctttttattaaactaacgggcaggatagttataaatatgttaaaataagggagaataaaatcagaggtgagctaatgttcaatccgaagatcttcttctattagttgtgtctaaggtcatggcttcaaatgccaaaatctaacccggcacaacggggatgaagatgtttacacgggaagagattcaattctgggaagatgagaaacagcaaagtctggagatcaataataagcccaaagatccaagaaaagagaagcttaaggatttccgtaaaggaatcaagagtgttcattacaacaaagaatgtaaaatagcaagaaaagatgattatcgtctgtatagaacaaaaatgaaacgactgatgcgtagtgaagaatacaagctcctacacagttacaaacgaacgagtggttggattacttggtaaatgaggtagcctttgaatgaactcatcctattgttgaagtgagtagcagtagggcagttcatgaggggctgctttttttcattgagctaacgggcagtttagttgaacaagataagtggaggttttatgtcgcatttgacgcaaactgtgaaggaggaagctgggaaaatgatagctaagtgtaaagtgttgagttaactatccagcttgtttgttgatgtctttaatgtttgtgcagcctcatcgagatagatatctaaataagtaccatcagtaaatttaataaccacagcattagtagtgatggcgacatcttcaatcgtcctacctttaagtttttcaggtataactttgaaattagtcgattccacattcatcaaatcctttcattgattacacatcttagtaatcggtaataagtatataaaacctatattagtctaacacttctcattataaaagtaaaagatgaatgatagaaatactgaacagtacgaagatattgtgtaataaaagaaagcgtgcttattcaactaacgaggaacgttagttaaataaagaacagcggtagtctaggactttctcctttttcagtccaaggctgccgctattactatattcaattcagtctaatactatatttttatcagacaccggctttcagaacggcatcagaggtggggaacttcaataaggttttcaacgacaccggagaatgaagatctccgataaacacccttgtattcaggagacatctgatccaatgcggcttggaactgcagtttaatttgaatatatagaccggtaaacgcgtcatgctgtcgcgataagtttcggagattcaagcaactgaacgccccttgttttataatgatcaaagtcttctttgtagaaatagaatcatcttcggttgattactcctcgggtaaaagttatgaacggttgaccttggcttcaaaacgcttttccaactcgtcccagggtgtggggacccgggactgttccctccaaaggtgaaacacgcggctcaaagctacgatttcccctacgaatccgtcaaccagtcggctgatcggcatcctatgataaattttcataaaaggcgcattaacgccggtcgtttgcggattagtgaagcttgcgcggccggcgttagcggatattgtaaggcctctaacacgcgaaagccttcgtccatagccgcgatcatctgccgcaacaacttgtcgtcgccggcgttttttttcatttggcgctcgtgtataaccgttacaaagtttagcgcaattacaggcacgatatgattcttcagctatgtatctatattttcatgatagataggcatcgtactcatttggtttacatatgcgggtacgcccccttccatgcagaggggctttccaaacaaacatgacctaacggccaccatcatgaatgaaaatgtcttggcttgtgaatctgaacctccttaatggagtacagggcacaggccgagagttttttgttaggacatactttgagtccttaatttcccgacctagaggaactataggcagcattgtattatctcgctggtcgaatatttaaagcggtgtttgtgaataccagtctatgtgaacactatttaacaaactaacaaattcgccattgaaaatcttctcttgaatcaattttggtatactatgtggtagataagagaattaatttgaagtctggctataagtgtgtttctacaacaacttgaaaaatgaattcgattttgatgaaatgcggaagctgttagggcgtaaagagagaagaggaggaatggaaatgtcgtatctcgttgattttaaaggtgtatctacggttggattagagtcttcacctgtagcagaagcgcttgctggtttacgtgctaatgaggcccgttattttatgaacaaatacaagtatgaatttacggttgtaccagctagcgaaagccaggagagccttgattatgtgaaccgaattttgagagaagaacgtgatattgcgtttgcggctaaacctttagaaacgtcgcgttttcaagtggaaaatatccaatttacctacgttttttatgaggatggtcttgcaatcaatgtcatgtatacggtggatgaccctaagaagcgggccgttggttttaagctttctgaggggatggaggtaccaaaggagctagaagggaagtttaagtttgctaggcagaagtctaaactagctggaacaattcggggttcgttttttgtaattaaaggacaatattaaagtatgcaaaagcgcaaatggaggaatccagccccttatttctctttacaaaaaaaatgtgaaattaaagtaagggctatcccgcaaaaggatggcccttttttgaaagaagttcctgagttgcaacgcttgatctcgggatatcgagcgctgcaagtgtgctgaggaagccgaagtgggtgtctgcttcttcacgtgaaatgctgactacaggcacgttcaggtgtttaccgataacacttgcgatgtcgcgaaatggcacgccttcatctgcgaccccatttagtcgtgaaccggcgggtgccttttctaacgcaaggcggtatagatgtgcggcgtcaaggcggtgcacagccggccagcggttgctcccctcttccacataggctgagaaacccttcgttttggcaatgttgatcagtctcggcacaaatcctgtgtcaccctcaccgtgtaccgaagggcaaagctctacgatcgatgtccgcactccgcgctcagccagcaataacattacgttttctgctgccactccattggcgtgcgtgggtgatcacgaacggcttcccggacccttccagcgccgcccccatcgcttcgacggcgtgcagatctgctgcaagtgccctggcgaagttcgagaagtcgtgattgaatgccagatgaataatgccatccgcagcagccgcaccactacgaaggctgtcgagatcgtcaatgtcaccgcggtgcacttcggccccggcctcttttagtttcgcagcgctattgtctgagcgcacaagaccgacgacctgatgacccgcatcaatgagttcacggacgacagcggaaccgatgtaacctgttgctcctgttacgaaaacacgcatcatgaaatcccccttaagctactaaccattattgtataaattataattaccacgcgatgggtccatcctcatctgagaatgttcctgttggaccgtccgcaccaatcattgcaagccggactgcttcacgcgccccttgttcaacactacgagtgccagcaaaattattgagcgcagtcgatgtaaaacctggacaggccgcattgaccttgatgtttgtcgattcaagcgcaaaggcaaaggcaagtgtcaccgcatgaacagccgattttgatgccgaataggccccaaacatcgcacgatgtgagttttccggaatggagttccagctaagggagccgccggtgctgtccatgttgacgatgcgtgctgcaggagcctcacgtaaaagtggcaacatggcctgggtgacagcaatgacaccaaaaacattagtttcataaaccgaacgaatgtcttcgagcgaagcaacggtcaaaagaccgctcgtcgcgccactgctcggaaacggatcgtccggtttacctgcgtgtgatatgcccgcattgttcacaagtacatcgagacgaccaaattcgttccgaatacgctctgctgcagcaacaatggagtcctgatcggtaacgtcgagctggagagcgtgcgcatccgaaccgatgcttttggaggcagtttctccattttcgaggctgcgtgatccaacgagcacggtgaagccgtgttccgctagatccttcgcaatctgtaaacctattcctttattggcaccggtgatcaaggctacgggtttgtcctgcatggttgtaatctcctttttggtatggggcaccatctatatatttcccgttggatgtgggataatgatattaaatcacacaaaaaagaaactgtaaagttccggaactaattagtttcttaatatatattttaaaaggagctaagtttatgagtaaaataaaaaaggaaatgtctgagaggggcgaattaactgaggtcgtggcaaaaaagcctgcgaaaacattgggacgcaagagagatcacacgcgggatgataaaatcctcgaggcggcaatcgacatcctcgccgatacgagtttcgatggtatgacaatggacatggtcgcggctcgagcaaaggctgggaaggcgacggtttaccgccgctggtcttccaaggcggagttagtccgagacgccttggcatggatgaatcgaaatcatcttgagctcgaaagcttgcctgatacaggaaccttacgcgaagatctcctcgtgcttttgaagccgcaatcgatcgcggaagaagaacgcaaatttcgagtcctagcgggcctaggctcctttttgcagcatccggaatttgccgaagcaggaacagccgggattttcgagccatgggttgttgtaaaccgcgagcttatgaaccgagccgtcgtccgcggtgaaattcctgctcacgcggacattgagatggcttgccaggtcattacttcaatggcttcttttcgcggactcatccagcgcaaaccgttcgacaagcctttctttacagcgctaatcgatggtattctactgcctgcactcaaaaacccgcgaacagctccaaatatcatggaccgatgatgaccaggcgcttaccagaagaatctacaaggtggatcaagaggtgagcaggattggtttcaggatagtgagcctaggagaaaaatattacggagtcgaacgctctgttgtattatcacagaaatgattcaattaacgggaacgatacttgaatttagaacagggagcacactgccactgtgaggtacaaaaaaagaaccaaatgtgattttggttgacgcagtgaaggacgatttaaattatgtaattatactgaaagattgttgtggtttgtggtataacatcaccctactaaacacccaatattctaaaaatggattttagtctagcgaataaccggctattcgtccatgcctaaaataaacaactcacgtacactgaaccatatttatagggaggtgtcgttgttgagttgtccggataaaaaaaaacgtgcaaaaagaaaaccacaattgtttgccatccaaaaggaaaaaaaaagaaacgacgtcttctagttattaaaaaaatagtgcgggtaccgtgtcccccacctaaaggtcagcaattacttcaaggacttgcgggagcaattgcagaagctggacctcaaggacttgtaggagcacttggcccccaaggattggcagggattgcaggagcgataggcgcacttggtcccgaaggacttgcaggagcacttggcccccaaggattggcagggctcgcaggagcgataggcgcacttggtcccgaaggacttgcaggagcacttggaccccaaggattggcagggat

SEQ ID NO: 69 - DNA, 6425 bp, Unknown
  Kingdom: Bacteria, Phylum: Firmicutes, Class: Bacilli, Order: Bacillales, Family: Paenibacillaceae, Genus: Paenibacillus
caagatgagatttcccagtatgtaagaccccttgaagacgacgaggtagataggttgggggtggaagtgcagtaatgcatggagctgaccaatactaatcggtcgagggcttatcctaaaataaaacgcaaataagtttcggatccagttttcagggtgtaaccttgaatgtagaatttgcacagcaaattcatgtttggtggcgatagcggaggggttccacacgtacccatcccgaacacgaccgttaagccctccagcgccgatggtacttggaccgcagggtcctgggagagtaggacgtcgccaagcgatatccttcaaaggataatgaagttttgcatgttagggcctttagctcagctggttagagcgcacccctgataagggtgaggtcggtggttcgagtccactaaggcccaccacttccagaataacaaaaagattggggccatagctcagctgggagagcgcctgccttgcacgcaggaggtcagcggttcgatcccgcttggctccaccaatattccctgatagctcagttggtagagcactcgactgttaatcgagttgtcacaggttcgagtcctgttcggggagccatgttttgaatatttctgaattttatatataaggtggcggcgtagctcagctggctagagcgtacggttcatacccgtgaggtcgggggttcgatcccctctgccgctactcggagagatacccaagtggctataaggggaccctctgctaaggggttagactgcgaaagtggtgcgagggttcgaatccctctctctccgccataaatttattgaaaccagaacttattttgcaaggcccgttggtcaaggggttaagacacctccctttcacggaggtaacaggggttcgaatcccctacgggtcatattatggaggcttagctcagctgggagagcatctgccttacaagcagagggtcgggggttcgagcccctcagcctccaccataagaaaatttgagaaatgccttttaatgtcgcggggtggagcagttcggtagctcgtcgggctcataacccgaaggtcgtaggttcaaatcctacccccgcaattaatttcctgttggaaatgcctctggaactgtggtgtagaggcctaacatgcctgcctgtcacgcaggagatcgcgggttcgaatcccgtcagttccgccattttaacttcatatataattggcatataaagtgcggattatatgatgtagtaataaaaaaatatggctcggtagctcagtcggtagagcagaggactgaaaatcctcgtgtcggcggttcgattccgtcccgagccacctttcaagtgggaaatgagtaatgtgccggtgtagctcaactggtagagcaactgacttgtaatcagtaggttgggggttcaagtcctctcgccggcaccattttggaggattagcgaagtggccaaacgcatcagactgtaaatctgctcccttacgggttcggtggttcgaatccatcatcctccaccagtcttttcataacatatggcggtcgtggcgaagtggttaacgcaccggactgtgactccggcattcgtgggttcaagccccatcggccgccctttattcttaatctattggggattagccaagcggtaaggcaacggactttgactccgtcatgcataggttcaaatcctatatccccagccattaagagccattagctcagttggtagagcacctgacttttaatcagggtgtcgaaggttcgagtccttcatggctcaccatttataattattttgcggtcgtggcggaattggcagacgcgcacggttcaggtccgtgtgggctaaccccccgtggaggttcgagtcctctcgaccgcaccatattttgcggacgtggctcagcggtagagcatcgccttgccaaggcgagggtcgcgggttcgattcccgtcgtccgctccattatccatacggcgccatagccaagtggtaaggcaaagctctgcaaaagcttcattccccagttcaaatctgggtggcgccttgactactcattatggaatttaatatgcgcccttagctcagctggatagagcgtttgactacgaatcaaaaggccgggagttcgaatctctcagggcgcgccatttcttaaaaaatgtataatgtcgggatgtagctcagcttggtagagcacctggtttgggaccagggggtcgcatgttcaaatcgtgtcatcccgatactgatttgcgggtgtagttcaatggtagaactccagccttccaagctggtagcgtgggttcgattcccatcacccgctttttgctatagcggattcttgttgcctcagtggtgacaccttataaataaagagagcctgtctggggacagagctctctcttttttttgtatttatcctcatgtaatccacaatgtgttgattatccataatcttcggtatcggtgtatatcgttctgattacaactggcatacaccgataaccgatctagtggacagtttttacacgggaatggtcagctggatggaggttcccttgtctggagcagaggttatgctcataaatccccctacccctctagctcgttcttccatactgaacaatccaactccctctccttgggactttccagagaatccaatgccctcatcccgaatggtcacttgtatcatttcattttgatcctcgacgtcgacatatgcctctgctacatctgcgtatttggctacattcgttaatgcttcttgtacaatccgataaattgcaatttccttgcgaatatcaacccgtttacgtaaagtgcattgaaaatgcacctcaatcccgtaatgagaacagaagttttcaatataggttcttatggctgggacgacacccagatcatccagaactgagggacgaagttcccacgctagaccacgaacatctttgatgatgtcggtcacctgcgaacgaagattctccagagtagcactaggttgttcggcaagttggctatccaattggataataagtgaaaacaagctttgccctatcccatcatgcagctctcttgaaaagcgtttacgttcttcttcctgtatttgcatgacttgcgtcatcatagactggagttctgcttctactttcttcagtttagtgacctcattgcggatcgctaagtactgatagggtttaccttcctcgtccataaacggaacgatcgtagtattcacccaatagtagctgttatctttagcacgattacgtatttctccttgccatacctcacctgaacggatcgtagtccacaggtttttcatgaaggcagaggtatgatagcctgaattaataagacgatgatcctgaccgatcagctcttcacgactgtattgcgaaatctcacagaacttgtcgtttacgtactgaataatacctcgatgatcggtcaaagcaacgatggaagacgtatctagagcaaatttcagattggataattggtggagtgagttacgcagcgcatgaagaaaaggggattctggtatataaatttccagatcattcagcagtttatcggttgattcaccaaaggcatgctgcagtaaagggttagaaggttcattcataatggagcagccccttttttagtgcgaatttgactagctcaggtcgtgttttcaagttaagcttctccataagattgcttttatgggactctacggttttgacgctaatcaccaggtgctcggcaatttccttgttggcatatcctttggctacccacgatagaatctctttttcccgctcagacaaggattcatagggtccggctatgccttcctgtttgattttgtccagatattcactcatcagtcgtttggttgcattcgggtacaaataggcactaccttcggccacagactggatggcagcgagtaactcctcgtgaggtgcgctttttaaaatatatccggatgctccagcctgaatggctcggaacagatattcttcatcgtcatgcatcgttaaaataaggacttctgtatcgggcaactgtttttttaattcagtggttgccgtgagaccatctttgccaggtggcatgctaaaatccatgagtacgacattaggttgtagctctactgctttacggatcgcctcatccccgtctgctgcatctcctacgaccttaataccatttttgccgtccaatagggccatgaggccagaacgtacgacaacatgatcatccactactagtatacgaatcaatttgtcatcccctcgaacggtaaaaaaaccgtgcgttttgtcataatcatagcaaattttagggatttcaatcaacaaagatagttagggacagccatatcaagtgttttatgagttttattatctacagtaacattgttgatctatggagtgagagggtaagcacatagttggctaaggcgttgagcgacttgagtggcctcggccacatcagactctgtgaacgtcctcacatcacgattaccaagaagcagcacaccgttaggcagatcccctgtgctggaaaagggaatagcaacagcagagtgaagctgctcggccagcattagtgcacactcctgacgcagacgtatactacctgatagtaaagcacttacagtcacggtacgtcccaagcgaacagccatcccggcaataccatggccaatcttaaaagaaataaggcgatagcgattgcttcggctgccggaggcgtaataccaatgcagcttaccacccgacttggacataaatgcaagggcagtgagatcactataaatagtatctctcaactggttcagttcttttcgcatttcatccgttatttgtagcatagaagacacatcctttttcataaccaaactatatctctaattcattgtagttccgacagttacaaaagtagatcagggaaccccctgatctataggcgcaggaaacactgagttttgatgaggtcgggtaaggagtaaggaaaaggtcaataaatggggcgttagcttacctcggaagtgatatttatcacagtaaatcagggagtaggaaggtataaaatcaggtgttctcccgataacaacccaggcattaaaacattatgatatagatatcaggtaaacacgaggaggacgctaacatgcaagcgacttgtatggaacggtttggggacgaagcggaacgcacgggaattcagatttatttgacagaagaacattttgttctgctaaaagatattatgtcctggaagaaggtaaaggcaggcgttatgcttttccgagaaggcgatgatgcagagcagctttattatatacattcaggtcatgttaaacttcgtaaatcgacagaagatggtaaagaactgattctgaccattcagcatcaaggcgacttaattggggaatttagcgggatagatggagaagagtatagttgcactgcggaaacagccgatgtgtgtgagttaggcgtcgtgcttgttaaggatctggagtcgctcttgtccaaaaatggggaaatggcacttcagttcatccagtggatggcgatgaagcaacgcattatgcaatcgcgttttcgggacttactgttgtatggtaaaactggagcgttagcatctacattgatccgtgctagcaatacatgtggcgtggctgtgaaggatggcattttactaaatatgaagctaagtcactccgaattaggtgagatgattggagcgacgcgagagagtgtgaaccggatgctgagcgcgctgaaagagcagggaaccctagatacaagggatggaaagattgtcattcacgatctcaaggtattacgtggcatgtgctgctgtccttcgtacggccaatgtgcccatgaaatttgtcgcctctaatatatgaataccattaggcggggtccaagagacttcgccttgctgcatgtcttctaacaatctagcacatggggtaacgaacaacatagattagaaaaaaactaatcaacgtcgtatagcggctaattaccaataatgtatttatattaaatggaactgaacacatgacattttatgaactagctgttttgaagtaacattggagctaataatggttgactaaaaggtggagggatttcaagtttaaaaaagggattatttacaagttgctttcttttgctgaaaatgatatattatttgagctgacaacaaaacagcagtttcaaaagtgaaaagcttgggtgaaatgatcttcaaaaaaagaaaaaataacccttgcatttttgaaacgaacatgatatgatcttatagctgctgaaaaacgcggcggaagagaaatgtttgatctttgaaaactgaacaacgagtgagtaaaacgattttgttcgcaaaatcaaacaagagata

SEQ ID NO: 70 - DNA, 3881 bp, Unknown
  Kingdom: Bacteria, Phylum: Firmicutes, Class: Bacilli, Order: Bacillales, Family: Paenibacillaceae, Genus: Paenibacillus
attccctactgctgcctcccgtaggagtctgggccgtgtctcagtcccagtgtggccgatcaccctctcaggtcggctacgcatcgtcgccttggtaggcctttaccccaccaactagctaatgcgccgcaggcccatccacaagtgacagattgctccgtctttgctccttctcccatgcaggaaaacgatgtatcgggtattagctaccgtttccggtagttatccctgtcttgtgggcaggttgcctacgtgttactcacccgtccgccgctaggttgtgtagaagcaagcttctacacaaccccgctcgacttgcatgtattaggcacgccgccagcgttcgtcctgagccaggatcaaactctccattaaagaccaaccgaagttggtttatagaaagagcgataagctcatgttgaaactgacgagataaaatatctcattttcgcttccatttaatacaatctaatggcatgtaccaaaatttctgcgttggattttgtaaacaaaatccatactcactcgttgttcagttttcaaagatcaaacttgcataatgtcttactttgtttcgtcaccgcgtctcagtggcgacctttataatatatcatctctttttagaatttgcaagagttttttttaatttcttttttcgagcaaatccttcaaaaaggaacgaaaattaatttaccatgaatattgaatagagtcaatactttttttgatatcagaaagtataagctttttaaaatagtttacttcctgatatctctgatatgttttctaacctatctattgtttggtttgtgggactcgccctctgcgagcatattttgatagttccttggcgggtgcaaaacgggcatacatgcggaagactgttttatatcgaagtgcgattgcgtagcgaatatcttgatccaatcgagtatcgctcatatcaagcagcatttcatctagctccttacgaagaacgtagtcaagttccttgcattctttttcgttaaacagcattcccaacatatgaccaaactcccctatcagcagattatatagtacttatatttgctcaactattgttccaatctttacctgtttttaaactcaactgctaaggtttcaaacttcccccgattaatcttcagcttctctttaagctctcccctttgttatgttcaattttcaggaaatatataaataattggccataatattttattgtgacaataaacgataagttatgccactctcaatagcagctgctataagcagtaagatgacagaccatagggataccctcaacgtttgtttcctaaatacattccacgatgggccagttcctttgcgctttagccctatgcttgtacctatagtagacattatgttgattccaaacttcaatccgaaggcacaggcgataatcaaaacaggcaattcaatcacaccgtgaggcagtaacccttttacaacaacttcatacatacttcttcccatatctgtctgcaagtgtactacaaaccctaaaaccataccgttcacaatcaaaaatataaacggtacgattccaaatacagcccccataaatatgaccagcacacatttaattgcattattgaaaaagataaatacaaaaaaactccattgtggatgctcagaattctgcaagcgctgcgccacttctcccagtccctccatttgttgcgccagcatggattgaatagcgcctgtacttaaccaccccactataatacttgtgcagaaaagaagtgcagagattaaaattaaccgtcttgtcatgtgtaaatcgtgaaaaaatgcgtttagtcccatttgataattcctcctattagtccaatggaataattgacaacccctggcataactttaagtaaacaagcacttctaggatgaaaggggcgttattaaccatgaattcttttttttatgtattaaacggtaaaaaaatcaaacgattcttaatcgtaatggctgcagccatctttactgtcggagtcatttatgtagaaaccgataatgttacagttttttccgaggaagcaccaaccgctatttatagtgtgcccacggacaaaaagttgatcgctctcacctttgatattagttggggcgataagcgcactgcccccatcttaaaagtccttgaggataagaaagtgaccaaatccaccttttttctttctgccccttggagtaaaacacatccggaacttgtgaatcagattaaagaaagcggatttgagatcggcagtcacggccataaacacgaaaattacagcagcttaagcgatgaagatattcgtaagcagatttcaattgctcataccacattaaccgaactgacgggacagtccccgaagttgatccgcatgcctaatggcgactttgataaaagagtccttcaggttgccggcactttaggctacaaaaccattcagtgggatacagattccttggactggaaaaaccctggtactcaggtcataatcgaccgtgttgtaaataaagcgcatcctggcgatatcgtccttctgcatgccagtgattcctgtaaacaaacgcatgaagccctgccggtcattatcgacaagttgcgagcacaaggctatgaattcgtgactgtatctgaactgcttcaacagggtacagtaaaaggcaaagaggtacgcgatcaggcactgggtctttaaggagttattttacatcgttctcagctaaaaaccaaaagcaaatcgacatatttctccccattcatccgcatactatccacattcatgatgaaggaggaatacggccatgaattggactcgtttgcgatttgttagcatggtatgcgtactgggcgttgcactgagtggatgcggctcggatcagggttctgcgcccccccagaacagttataaagagatgaaaacgatggttgtcgatatcctgaaaagcgatgatggaaaaaaagcggtagaggaggctttaaccggggaaaacagttcatccaaagaaggacaatccggtcaaagcagtgaagagggtgggtctggtggtggatctggtggtagcatgggaatgaaaatgcttatgcccatgcaatcggctgaacagatgaagatcgcagtcaaagatactttgatatcacctgaatataaaaaagaaatcgaaaagattatgactgatccgcgttttgccggagaatttgccaaagccatcaacagccaaagcaaacagcttcatatgcaacttataaaagacccttcttatcaaaaatcaattgaagcaatgctcaagtcaccagaattaaccaaaatgtatatggacttaactaaaacccctgaatatcgcaaacaatctatgacagtcatgcatgatgccatgcaaaatccgattttccgacttgaggttatgaatttactcaaaaccgtcgtacaagaggagcttcaacccaaggttgagaaaaaaagtggtgagcaaagcggtgcaggcggcgaaaagcaaggtggtggaggcgaaggagaacaaggaggaagccaataataaaaaggctggtttaataaaccagcctcagattgtcgagaaaccccgtcttttgagacgtgggtttctttttctttacatcataaggctctggtctctggagaaatagggggttacccctgtttctccaggcgatccaggtggatcgccatcttcttcatgttctgcacggctgccgtcataagggcttgttccctgacgtttggtagaccgcgcaaacggcaatagcgaaacccatggagctctttggcatccgcgaagcttcgctcaatcgtctcttttcgtttgcggtacagccgtttcccagatgggcttagccggttgctccgtac

SEQ ID NO: 71 - DNA, 1317 bp, Unknown
  Kingdom: Bacteria, Phylum: Firmicutes, Class: Bacilli, Order: Bacillales, Family: Paenibacillaceae, Genus: Paenibacillus
tgaactgcaccccatttgttagacacgactaacaatggaggtgcagttttttgcctaaattcagtttagatgagaaattggaggccattcgtaggtatcagcgtggtactgagggagtcaaaagcattgcacaatcattagggatgaatcatgaagctttacgtatgtggattaggcaatacgaatctcacggggtaaaagcttttgaaaaaacctatacagcttactcctcggcatataaactagacgtacttaactacatgaacgagaatgggacgtctccgaatgaagcagctgtcattttcaaaatatcctcacctggagtcattaggaaatggcgtagtcaattcaatgaacatggagtagacgccctgaattcaaagaaaaaggggcgtccacgcatgacagataagaataaaaacatcacaaagaagcaagaacctgccaaggattcaatggaggctctacaagctgaattagaacgtttacgtatggaaaacgcctatttaaaaaagttgaatgccttagttcaaaacaaggaaaaatcaccaaacaagacaaagcgcaagtcgtctatgaattaaggcatgagttcccggtggttgcattactaaagctcgcagaagtcaaacgtagcaccttttattattgggtcaaacagttgggtaagccagatccagacgcgggtctgaaactccttatccaatctatttacgaggaacatcaggggcgctatggctatcgtcgtatccgtgacgaactatttaatcgggggcgccgagttaatcataagaaagtgcagcgtattatggtcgaattaggcttgaaatcggtagtgcgtatgaagaaatatcgttcctataagggatcagtgggtaaagttgcaccccatgtactcgatcgtaattttcattcaggcaagccaaacgagaaatgggttaccgatattacggaatttaagttgtttggagaaaagctttatgtatcccctgttttagacttgtttaacggtgaaataatcacctacacagtaggggctcgccccacttattccttagtctccgagatgctgaatgaggcatttaaacgcttatccgaaaaggataaactgctcctgcattcggatcaaggttggcactaccagatgaagcagtatcaacacgctttaaagaaacaaggaattacccagagcatgtctcgtaaaggaaattgttacgataacgctgtaatggaaaacttctttggcatcatgaagtcagagtttctttatctaaataagtttgaaagtgtagatcacttcaagcaagaactagagca

SEQ ID NO: 72 - DNA, 1415 bp, Unknown
  Kingdom: Bacteria, Phylum: Firmicutes, Class: Bacilli, Order: Bacillales, Family: Paenibacillaceae, Genus: Paenibacillus
tcccgattgctgcaagcaggttatcgactggacatgaaggatttgttcagcaatccgacggtagcgtcactcagtcctttacttcgtacagatggcaagatggccagtcaggaagaagtcgtaggccaggtggaactgacacccattcagcggtggttcttcgagcagcagccggctgacctgcaccacagcaaccaggcgatgatgctgtatcgagctgggcgctttgacatagaagcgctgcgccgtacgatggaacgaattgtccagcatcatgacgcattgcgcactgtattccgtgaggcggagcagggttatgtcgcttggaaccgcagtgtggaggaaggcgagctatacacgctggacattatagattttagcggagtggaagacgaattcaccgctgtagaagccaaggcgagtgaaattcaagcgagcattcatttgagcgagggtccacttgtgaagctcggtctgttccactgcgctgagggcgatcatttgctaatcgtcattcatcatttggttgtggacggtgtatcgtggcgtattttgctggaggatttggcatccggttatgagcaggctgttgcaggtcaaacaggcacagctattcgactgccgcataaaacagattcattccaggtatgggctaaacagctgtcagcctatgcgaatcgtgcgacgatgggacgggagctagcctactggcagcatatcgaacaagcagaagtaagccttgtgaagcctttgccgaaggattttgcaaatgacaatgcacggctcggagacagtgaggttgtgactgtccgctggacgaagcaggaaaccgagcagttgctcaaacaagctcatcgcgcatacagcacggaaatgaatgacctgttgctggctgcgctcggaaaagctgtctatgactggtctggttccgaacgggtgctggtcaacctggaaggccatggacgggaagctattgtaccggatgtggatattacgcggacggtcggttggtttacgagccaattcccggttgtactggatggaagtctggcacaaggaggaaataccgctcgtctgatcaaacgggtcaaggaagacctgcgtcatatcccgcaaaaaggtattggctacggtattttgcgatacctgtcagatatgaatgttttggagaaagcaggcgtgcagttacaggcgcagcctgagatcagttttaactatttgggccaattcgatcaggattataaaggcaacgatctggagccttcctcctattccattggtgcacctgtcagcacgaacgcggctatggattttgcactagatatcaatggattaatcgaggatggggagctgatgttcactattcgctacggcacaacgcagttccgtcatgaaacgattgaacggctgggaga

SEQ ID NO: 73 - DNA, 907 bp, Unknown
  Kingdom: Bacteria, Phylum: Firmicutes, Class: Bacilli, Order: Bacillales, Family: Paenibacillaceae, Genus: Paenibacillus
tctttgtattgaatccgtagcggtggcagctcttcatcgctgtataagcgagcaaattcgcgagtcaacacgcccgtcgacacaccgtccgagatgatatggtgcatatcgagcatcagcaaatactgcggctcttcttctattccctgtacgcccaaatcgatcagggcaacccgcagtaacggagcggcttgcagatcaaatggacgtacaaagctttggatcttttcttgtacttccttgctcacaagctgctcagtcaccgatgcataccgttcctgcactacatcacgatgtaacacttccacatcggtttgtcgatctgctgctgtataagctacgacatgtcccacctgcaccttcgcatactccaactcgaacgatacggtatcctgaatctgctgcttcggctcgttatttatcatttcaaagcgggtacggagtgttgaatggcgtgagatcaattgacggaatacttcttccatccgcttcacatccagcgggccgcttacccggaacatagcaggcatgttgtagtttacatcgtcagggtcaagctggtgcaatacgtacatccgcttttgtgcagaggacagcggataaaaagttcgttcttccgtcaccggaatcaatgcatacttcatctgttccaaactttcaatcactacagccagctgttcaatcgttggagcttcgaaaatactgcgtaacgacagggatttattcagttctttgtgaatctttgaagtcaaggtagttgcccgcagtgagtgtccaccaatctcgaaaaagttctctttcacgccgacttgcttcaggcccaatacatcctgccaaatttgggtcagcttcgattccattggcgttcgcggtgcgaaataatccgttctgctttgcagattatctt

SEQ ID NO: 74 - DNA, 623 bp, Unknown
  Kingdom: Bacteria, Phylum: Firmicutes, Class: Bacilli, Order: Bacillales, Family: Paenibacillaceae, Genus: Paenibacillus
ttaacctagacttttctttcaaagaaagaaaatgtcgatgttcgataaagaatgatttttgccaaaggcaaaagatctttccttacctgctacctttatttcacttgtttacacaagatcagcttaaaggaatattctaaaacgcaatttcgtttcggtatccagttttcaaggtgcaatgataataaatctttttggtggagccaagcgggatcgaaccgctgacctcctgcttgcaaggcaggcgctctcccagctgagctatagccccaaaaggaatataaagttatatggtgggccctagtggactcgaaccaccgacctcacccttatcaggggtgcgctctaaccagctgagctaagggcccataataaaccaccaaagaagttcttctttagtggttgcgcttggcgacgtcctactctcccaggaccctgcggtccaagtaccatcggcgctggagggcttaacggtcgtgttcgggatgggtacgtgtggaacccctccgctatcgccaccaaacgttcgagagtttgagctctcaaaactgagcaacgagtgagtagtttttgaagctaatgcttcatatttgaatgtttccattgcaggaaacgattctcca

SEQ ID NO: 75 - DNA, 986 bp, Unknown
  Kingdom: Bacteria, Phylum: Firmicutes, Class: Bacilli, Order: Bacillales, Family: Paenibacillaceae, Genus: Paenibacillus
agacccgcgcccaaatcaaaatccagacactccgcctgataacctgttttgctctggattttaacctgtggcaaacgggcctgttcttcatacccatccaggtatgcggtccagtaacgagaagccttctgacgttcttgatacactttcagtacatccactgtttcttccactgtaatccattccagctcactcaatgtggtatctgggctagccgtaatcacttcagccaaccgtacaaagtggcgtgtgatctgctcaattgtttcccgctggtacagcgtggtcgcatactgcaatccgaactgtattccggattcttcctctctcgcttccagcgtcaggtcaaacttcactggagtttgctctatatcgtatagtcggaagctcagttctttgagcttcaactcgctttgctcggtgttttgcagtacaaacatcgtatcgaagatcggattccgactcatatcccgcttcacattcaacttgtccaccaggttttcaaatggatagtcctggtgctcgtaggcttgtaaagcccggattttcacatcttctagaaagctgcggaacgtctgctctgcagtcggataattgcgtagtgccagggttccgacaaacatcccaatgatgggctcaagatcggcatgtgggcgtcccgcaattggggtgccaacaatgatatcttcctgccctgtatattgatatagtaacgctgtataggccgctaataacaccatgtacagcgtcgaacctgtctgtgctgccagttcttttaagcgctcgctaacttcacgctccaatctgaatacaaccgtgtcgcctgctgtgctccgtaccgccggacgggcaaaatcggttggcaggttcagcacaggcagattgccccggaaagtattgagccaatacgcttcctgaccttccatccaatcctgttgcgcttcactttgctgccatacggcataatctttgtattgaatccgtag

SEQ ID NO: 76 - DNA, 6993 bp, Unknown
  Kingdom: Bacteria, Phylum: Actinobacteria, Class: Actinobacteria, Order: Streptomycetales, Family: Streptomycetaceae, Genus: Streptomyces
ggtcggcgtccgggcccggcgccgagcgggcgacggcggccagccgggcggcgtcgcggcgcatcgcgacatgcatcagggcgaacccgtggaagtgagcgggcagggacggcaggtgctcgctcgtcatcggtccgctgccgcccgtcgtgccggtcatggctgtctcctcacgcgaggggaagagaagggacgggtacgacaggacggggacgggcgcctgtacggcacggcgcccgtccccgtccccgtcgtccccaggtcccctccgggtcagacgttccagacgccggtggcggcggcgtccctggcgaagtcggcgaagtccttcggcttgcggccggtggcctcctcgacgccgtgcacgaggtgggcgttgcggccgtccaggatcagcccgaacaggtcggcgaactcgacgggcagcccgtgctcctcgagcgacttgcggtactcgtcgacaccgaccgggatgtacgtgatggtcctgccggtcgccttggacagctcctgggcgatgtcgccgaagctgagcaggcggggaccggacagctcgtacgtcttgccgatgtgccgctcgtcggtgagcgcggcgacggcgacgtccgcgatgtcgtcggcgtcgacgaacggctccacggcgtccccggtcggcaggacgatctcgccggcgatgaccaggtcgtggaagaagctttcgctgaagttctggttgaaccagctggcgcggacgatggtccagtccgcgccggactccttcaccttgttctcgctgatgacggcgccctcctcaccgcggccggacagcagcaccaggcggcgcgcgcccttggcgacggcggccttcgcgaacgcgccgacggtctcggcggcgcccgggaaggcgaggtcggggtagtaggtgatgtagacggcgccgacgccctccagcgcggcgtcccacgtgccggggtcctcccagacgaagggaggcgtcccgttgcgtgatccgatgcgtacgggcagccccttggcggtgagccgctcggcgacccgccgtccggtcttgcccgtgccgccgatcaccagggtcgtgttggtcatgatcgtcccgtctgtcgtggcgtacgtcgtgtgcgtggtgcggtcggtccgtgcgctcgtggtgtgcgtcgcgcacgtcgtgctctcgtcatgggagttccgtccgcgtgcggcgtggtggtgtccgcacggcggctacggtcccccgcagcgtaggcaggcctgcgccgcgcgagccatgccggcgggccgtccctcgagcggtcctctagcggagcgccgagatccagccgtgccggcgtgtgctcagtagcggtagtggtccgccttgtacgggccctcgacctcgacaccgatgtacgcggcctgctccggacggagcgtcgtgagcttcacgccgagcgcatccaggtggaggcgggcgaccttctcgtcgaggtgcttgggcagcacgtagacgccggtcgggtactcgtcgggcttggtgaacagctcgatctgggccagcgtctggtccgcgaacgagttggacatcacgaacgacgggtgaccggtggcgttgcccaggttgagcagacggccctcggacagcacgatgatcaccttgccgtccgggaacgtccacgtgtggacctgcggcttgacctcgtccttcacgatgccgggaatcttcgccaggcccgccatgtcgatctcgttgtcgaagtggccgatgttgccgacgatcgcctggtgcttcatcctcgccatgtccgaggcgaggatgatgtccttgttgccggtcgtggtgacgaagatgtcggcgctctccaccacctcgtccagcgtggtcacctggtagccgtccatcgccgcctgcagcgcgcagatcgggtcgatctccgtgacgatcacccgggcgccctgaccacgcagcgactccgcacagcccttgcccacatcgccgtaaccgcacacgacagcggtcttgccaccgatcaggacgtccgtggcacggttgatgccgtccaccagcgagtgccggcagccgtacttgttgtcgaacttcgacttcgtcaccgcgtcgttgacattgatcgccgggaacaggagggtgccgtcgcgctgcatctcgtacagccggtgcacaccggtggtggtctcctccgtcacaccgcggatctccgaggcgagcctcgtccagtccagcggactgttctccagcagggagcggacgacggcgagttcgtcgttcacggcctcgggcagctcgccggtcttgcggtactcgacgcccttgtggaccagcagggtggcgtcgccgccgtcgtccaggatcatgttggggcccgcgtgaccgggccaggtcagggcctgctcggtgcaccaccagtactcctgaagcgtctcgcccttccaggcgaagaccgggatgcccgcggcggcgatcgcggcggcggcgtggtcctgggtggagtagatgttgcaggagacccagcggacctcggcgccgagggcgaccagggtctcgatgagcacggccgtctggaccgtcatgtggagggagcccgtgatccgcgcgccggccaggggctgcgcggcggcgtactcctcgcggatcgccatcaggccgggcatctcgtgctcggcgagggtgatctccttgcggccgaactccgcgagggagaggtcggcgaccttgaagtcggtgaactcagctgacacgaaggctcctagagctcagtacgttgcggtggatgtccagggcggccgtggacttgttgagcgtgatgtagtgcaggccgggcgcgccttcggcgagcagccggtccgccatgtgggtggcgtgcgacacgccgatctcgtacgcgatgtcgggccggtcgcgtgcggcctcgagccggtgggccaggtcctcggggaacgccgcgtcggagagttcggcgaagcggcggatctgccggacgtcggtggccggcatgatctccgggatgatcggcgtctcgcatcccgccgccgcgacccggtcgcgcagcctcagatagtcctccacgtcgaagaacatctgcgtgatggcgtagtccgcacccgccttgcacttggcgacgaagtgcctgatgtcgctggcccagtcgggcgagcgcggatgccgctcggggaaggccgcgacaccgatggtgaactcccccagcgatctgacgagttccaccagctgccacgcgtaggtgaagccgtccggatgcggcgtccacgggcctttggggtcggcgggcggatcaccgcgcagtacgagcacgtcgcggacgccggcgtccgcgtactggccgatgatgcgccgcagctgggccaccgagtgcccgacggcggtcagatgcgcgacgggcctcagcgtggtctcggcgacgatgcgtttggtgacgtcgatggtgcggtcccgggaggtgccgcccgctccgtaggtgacggacacgaagtcgggggcgagcggctcgatccggcggatcgcccgccacagcgtctgctcgcccctgggcgtcttcggcgggaagaactcgaaggagaacgtggtcacgaccggccgcctcccgcgttgaagtagctcgcctcggggtggtggacgacgatggcgtcggtggactgctcggggtggagctggaactcctcactgaggtggacgccgatccgctcgggacggagcagctcggcgatcttcgcccggtcctccaggtcggggcaggccggatagccgagcgagtagcggcagccctggtactcgctacggaacatgccggccatcgcggtcgggtcaccagcggagatgccgagttcggagcggacgcgggcgtgccagtactcggcgagggcctcggccaactgcaccgacaggccgtgcagttcgaggtagtcgcggtaggagtcagaggcgaacagctcggccgtggcctcgccgatcctcgatcccacggtgacgacctggaggccgacgacgtcccgctcgccggactcctcggggcggaagaagtcggccaggcacagccgccggccacggcgctggcgcgggaaggtgaaccgggtccgctcgttgccgtgctcgtccaggacgatcaggtcgtcgcccttggacacgcacgggaagtagccctgcacgacggcggcctcgaggaggttctccgtgcgcagccggtccagccacatccgcagcctgggccggccctcgccctcgatggtggcgcccttgaggccccactggcccttgaacagggcgtcctcgtcgagccaggacgcgtagtcgttgagcgggatccccttgacgacccggctcccccagaacggcggcgcaggcaccggatggtcgacggccacgtcggaacggccggcgctctccggctccgccagccgcagctcccgcttgggcacccgccgctgcttcagctccggcagcacggcacccggaacaccccgcttcaccgcgatcagggcgtccatcaggcgcaggccctcgaaggcgtcgcgggcgtagcggacctcgccctcatagatctcgtggaggtcctgttcgacgtaggcgcgggtcagggcggcgccgccgaggatgaccgggtagttcgcggccaggcccctggcgttgagctcctccaggttctccttcatgatcacggtcgacttcaccagaagacccgacatcccgatcacatcggccttgtgctcctcggcggcctccaggatcgcggagacgggctgcttgatgccgaggttgacgacgttgtagccgttgttggagaggatgatgtcgacgaggttcttgccgatgtcgtgcacgtcgccgcgcacggtggcgagcacgatcgtgcccttgcctgcctcgtcggtcttctccatgtgcggctccaggtgagccacggcgaccttcatgacctcggcggactggagcacgaacggcagctgcatctggccggagccgaacagctcgccgacgaccttcatgccgtccaggagcgtgtcgttgacgatgtcgagggcgggacgggtcgtgagcgcctcgtcgaggtcggtctccaggccgttcttctcgccgtcgatgatccgccgcttgaggcgctcctccagcggcagcgcggccagttcctcggccttgccggccttcagcgacttcgcggtggcgccctcgaacagctgcatgagcttctgcagcgggtcgtagccctcgcggcgacggtcgtggatcaggtccagagccgtccgaacctcttcctcgctgaaccgggcgatcggcaggatcttcgaggcgtgcacgatcgccgagtccaggcccgccttgacgcactcgtccaggaagacggagttcagcaggatccgcgcggccgggttcagaccgaaggagatgttcgacagccccagcgtcgtctgaacgtccgggtgccgcttcttcagctcgcggatcgcctcgatcgtcgcgacaccgtcgccccgcgactcctcctgtcccgtgcagatggtgaaggtcagcgtgtcgatcaggatgtccgactcgcggatgccccagttccccgtcaggtcggcgatcagccgctcggcgatctccaccttcttttccggggtacgggcctggccctcctcgtcgatcgtcagcgcgatcagcgccgcaccgtgctccttggcgagctgcgtgaccttcgcgaaccgggactccggtccgtcgccgtcctcgtagttcaccgagttgatgaccgcacggccgcccagcttctccagacccgcccggatcaccgcgacctcggtcgagtcgaggacgatcggcagggtcgaggcggtcgcgaagcggcccgccagctccgccatgtccgccacaccgtcccggccgacatagtcgacgcacaggtcgagcaggtgcgcgccctcgcggatctggtcccgggccatctccacacagtcgtcccagcggccctccagcatggcctcgcggaacttcttcgacccgttggcgttcgtccgctcgccgatcgccaggtacgaggtgtcctgccggaacggcaccgtctgatacagcgacgacgctcccggctccggacgcggctcacgccggaccggctccctgtcccgtacgcgctccaccacttggcgcagatgctccggcgtcgaaccgcagcagccgcccaccagggacagaccgaagctgtcgatgaaattctcctgcgcgtcggccatctgctccggggtgagcgggaagtgcgcgccgtccttcgtcaggatcggcaggcccgcgttgggcatgcacatcagcggcgtcgtggagtgccgcgccaggtagcgcaggtgctcgctcatctccgccgggcccgtcgagcagttcaggccgatcaggtcgatgcccagcggctccagcgaggtcagggcggcaccgatctccgagcccagcagcatcacaccggtcgtctcgaaggccagcgagcagatcagcggcaccgacacgcccagggcgtccatcgcacggcgggcgccgatcaggccggccttcgtctgcagcaggtcctgggtcgtctccacgatcagcgcgtccgcgccgcccgtgagcaggccctccgcgttctgctggtacccgtcgcggatcgtcgcgtagtcgatgtggcccagcgacggcagcttggtgcctggccccatcgagccgagcacccagcgctgccgtccgtcgcgggcggcgaactcgtcggcgacctcacgcgcgatccgcgcaccggcctcggacagctccgcgatccggtcggcgatgtcgtactcgctcgacgccgtgtggttcgagccgaaggtgttcgtctccacgcagtccacaccgacggagaagtactccgcgtggacggaccggacgatgtcgggccgtgtcacattgaggatctcgttgcagccctccaggttctggaagtcctccagggtggggtcctgtgcctgcagcatggtgcccatcgcgccgtccgcgaccaccacacgggtggcgag

SEQ ID NO: 77 - DNA, 2978 bp, Unknown
  Kingdom: Bacteria, Phylum: Actinobacteria, Class: Actinobacteria, Order: Streptomycetales, Family: Streptomycetaceae, Genus: Streptomyces
ccgggcccgggccagcaggcgggggtacatcgtgctcagcccgagggtggggtggccgagcaggatcagtggcgctggtgtggaggcggatgcggcttcgggcgtccacaggatgccggggatctcaccgagggagaatttgcgttcgaggacaccgtcgtcgaaacgctgctcggaagtgaaatgcatggtcgtgcctttcgggagtgcaccagaaacggcgctcccggacgacctgcctatcgcccgaccgtgaccccggaggggagcacccatgtcgatactgtgttcacgggtaccacctcctcgctctctcgcacggcctccggaactgtagcaggggccgcccctcctccgccaaggggttttcgcggagtctccgtggcaaggcgccacggagaccccgcgaagagctggggccgggccacggtgccggcgacggcgtcgaccggcgccttgagtcacggatggcggtggatgtcgccccttcccgtcgtctgcaccaggtgggcggagttgccggccacgcggtcgtaggacccacggaccgtgccgagttcggccgggcggtcggcagggtgtgtgcgcatcagccgacgacggtgcggcacggggcacttggcgccccaagcgcggcggacgcggtccgccggccccggttgatcacggcccggaggtagcggtgcgggcgccgacgcggtgccgggcggtgcgggcgccgacgcggtgccctgcggccacgtcggcgaggccgtggaatgccagggccctcgcggaagttgatcgcagcatgactcaaggacccgcgcctcgccccctgtccgacgaagccctctccgacctgctcgcaaggcagcagttcggcaccctggccacggtcaagcgaagcggccacccgcacctgaccaccatgctctacagctgggaccccggggcccgcgtcgtccggctgtccaccacggccgaccgcgtcaaggtcaggcacctccagcgcaacccgcgcgcggcactgcacgtgcagggcggcgacgtctggtcgttcgccgtcgccgagggcacggcggagacgtccgaggccacggcgatccccggggacgctgtcgggagggagttgctcgcgatgatcccggcggctgcgaaacccgaggacgagcacgcgttcttgaagcaacaggtcgccgagcgcaggatcgtcatccggctggcggtcgagcggctctacgggacggccctggacatcgaaggccagtgacgtgagtcagagaccgctctcccgctacggccgcgtcgtcggtctggtctgctcggaacagcgtcgccctcgcctcggacgagtccgagacggctggacctttacgtccgtagctgttcccccggctccgagacgaacgcggccggccgggtgtaggacaggatccccatgagcacgatgcgcaggacctcgcgcagttcgatgtggagcggcactcgcggctccgggctctgggaccagcggtagagcaggcccaggtaggagtcacgcaggatgttgccgacccgtagagggtcgatgtcgacggcgatctcgccgcggcgccggcccgcctcgacgacagtggcgaacacgtgcccggcgtagggctcctcgagcagcggccgccccgccttcacccaggcctggagcatggctgcggtgatgtcccgctccgtctcgttgaactcggcgagcgccagcatgcagcgttccagatgcacggtgaccgcgtcgtcctgggtgagcatggacttctccatgctctcctccagacgccggcggcgcgcttccgcccaggccgtgaccaggtcttccttgcgctggaagtagttgaagaaggtcccgcgcgcgacgtccgcgcgctcggcgatctggtcgatcgtggtgcggtcatagccctgctcggcgaacagggacagcgcggaggtgtagatacggtcctttatgcgctgcttgctgcgttcacgacgcccgaggggggtcggctcagcactcatgtgttcctcgcttctcacgcctctgtgagatcccccggccctgaaatttataccacagtacatgaatgaatcgtgggctgcggcccgcccgggccccgcgccgctcactggcccgggacgccgtcgagcgcggcggcctgggatgcggtggtccgctgcgcggccagggaggcggcgatctctgcggcaggttcggacccgagcagtcgccgggcggtcacgtccacgccgagggactcgttcagccgcacccgcagctccgtggccagcagggagtccagcccgaagctgcgcagcgggcggtgcgggtccagccgcgaggccgagatgccgagcacggtcgcggcgtgccgcagcacgtcggtgggctgaaccgccgtcccctcctgcggcgcctgtggaggcgccactgccgccatggcggtgtgaccgcgccgggcgaggggcggacgcgtcggctcgtggggtcgtacaccccggtgcggccgtacggtgccggtggccgccgtccggggtgcggcggagtgcgggggtacgcctggcaggacgccggcgaccgcccctgtggcccgcggcaccgccggtatctcccgcgccgggagcgggctgagccgcacaccgaggaactccgccagcaggtgcccgtccggtgcgatgagccggacgtcgcagtgggcctgaccggtccgggggtcgggtgcgcagcgggccagcgcccagtggtccgcggccagggcgccgggatcggggacgtggacgcggccgaaggacaccggcaggaaggtggacgaggaggctccggccgccgcctcgggccaggtggccgccatcgtcaccagcgccgcctccagggccgcggcggccggagccggaggcgggaccggacctgccgtgcatccgggcgacgcactcgccgtcgtcgagccacacctgggcggccgtacgcagcgcgtcgtcgaccgccaggc

SEQ ID NO: 78 - DNA, 2020 bp, Unknown
  Kingdom: Bacteria, Phylum: Actinobacteria, Class: Actinobacteria, Order: Streptomycetales, Family: Streptomycetaceae, Genus: Streptomyces
gtgatggcgaggccggtcacgtcgcgggtcgtgtcacggcgaggccggtcgtgttccgtacacgcggtgcggttcggcgtcggcccacttgacctccaggccgaggccgggccgggacgggtcgggccgcagggcgccgccggcgggcgggagggtgccgtcgaacaccaggtgctcgaagcggacatggtcgtggaagtactccaggtgccgcagccgccgcacggcgcagaaggcgtgcgcggagaccgccggggcgcagtgcgcggagaggtcgaggtggcgggacgcggcgagtccggcgacctccaggaccccggtgatgccgccgcagcgggtgacgtccgcctggagacagtccaccgcgcgcccctcgacgaggtcggcgaagtcgcggctgatgtaggcgtactcgcccgcggtgatctccagccgtgccgggccgtgctcgcgcagtgtccgcagaccctcgatgtcgtccgagctgaccggctcctcgaaccaccgtacgtcccattcctcgtggaaccggcgggcccagtacagggcctccttgcggcccagcgcgccgttggcgtcggtgaagaggcgggggccgtcgccgatcgcccggcgtaccgcggtcagccgctgcgggtcgcgctcggggtcgcgcgaggtcttgagcttgacccgcgggatgccctgcccgacccagccggcgagctggtcggcgaggcggtccagggagtagttggtgaagcctccgctgccgtagaccgggacccggtcgtggtaggcgggcaggacgtggaccaggggcagttccagcaggcgcgccttcaggtcccacagggcgatgtcggcggcggagacggccatggcgcctacgccggggcggcccgcgttgcggatgtgccggtccatcagctgccagagggccagcggtgcggtggggtcctgtcccgtcagcagcggggcgagggtgccggacaggaaggcggcgaccgacacgtcaccgtaggtgtagccgaggccggtccgtccgcccgcgtgcacccgtacgaggaccatggtggtggagccccactccagggtgccgtcctgctccgtcccgccgggcccgtcggtgggcagttcgaaggcgtggacgtcgacggcgtcgatccgcgcgggctccatggctgactccttcgacgacggcgctgccgtcctgcgtgtgacccgggagccgggtgcgtaaacggttgggtggcctcggcccgccgtctcacacgggccgcggagaccgcggaaggcccgtggcacagggccgcggatggcggccggggcggcggaggcgacacaccggtggatcactcctggggcggaacgtgcgcggcaggcgggggaagtcctgcatggagaactcgcgcagcgggtccgaatgaagcactccgtgcgcctaccccgacccgtcctggacgccgggcgcagccgtccaccgatgggaagcctgctgtgcagacctcgaccagcgtcccgggacgcggtgcccgtcgcaccctgccgtcccgtcactccggcacgtccgaggaccaggaactggtgtaccggatggcctcctgcccgcccggtccgcagcgtgcggcgctgcgcgagcaggccatccgcgcgttcctgccgatggcgcgcaggatcgcgcgccgctacagcacgcacgccgacggcgacgaggacctcttccaggtcgcctgcatgggcctggtcaaggcggtggaccggttcgacccggagcgggggcacgcgttcctgtcgtacgcggtgccgaccgtggacggcgaggtgcggcgccatctgcgcgactgcgcgtgggacctgcgggtcccccgtgccctgcaggacaagcaccggcggctgcgggcggcgcaggagacgctgcgccgctcgggacacggtgacggcggcagtgcggcggagctggcgcgggccaccggcatggccggggaggacgtccggctggcgctccaggtggaggtggcccggcctccggcctcgctgg

SEQ ID NO: 79 - DNA, 6550 bp, Unknown
  Kingdom: Bacteria, Phylum: Actinobacteria, Class: Actinobacteria, Order: Streptomycetales, Family: Streptomycetaceae, Genus: Streptomyces
gcacaccaccgccctcgccgcccggaccccgatgggcgcggtggcggcccacccggaagccgacgccgggctcgtcgaggccgaggccatcgccacccaccggcccgcgtacggagacatcgcctacgccgccgacccggccgaccccgcccggctgctcctcggcccgctgcaccgccacgcggccaccggcttccacctggacgccgcctaccggaccctgttcgtccgcccggtcctggccggcgcgagcctcgtccggttcctcgaccgcgaggtcgtcgagacctacgtacgcggtgccggggccgccccccggctgctcggggccgccgtgcggcgcgcccagaccggcaatgtgcagacctatgtgagcgcgctgctcgccggcaccgtcgtcctcgcggtcgccgtcgtcctcgtcgccacgggagcgtgagcaggcgtgatcgatatcagcgagtccgtgatgcagttccttctggcgttcgtcgtcgtcggcccgctccttggcgcgctcgccgccctcctgccggccccgcccggcctgaagggaaagtcacccgagcaggccgtgctccggcacggcgtgaccgtcaccggcgtcatcctggccgccgcgatcgtcctcgcactcggcttcgaccacgcccacccgtcgaagatgcaggccacgaccgacatcagctggatccccgcactccacgtgcgcatccacctcggcatcgacggcatctccctccccctgctcgtcctgaccgcgctgctgaccttcctctgcgcgctgtacagctacttcaagccgcccgcgggcccggccccgaaggccttcgtcgcgctgctgctcctgctcgagtccggcacgctcgcgaccttcgccgtcctcgacctcgtgctcttcttcctcgccttcgagacggtgctcgtcccgatgtacttcctcatcgcccgctggggcggcgagggccgccgggccgccgcctggcggttcatcctgtacaccctcctcggctcggtcgtcatgctgctcggcctgctcctgatcggaatcaaggcgggcacgttcgacatggtggcactcgccactgacaacggccggtcactgaccgcatccgtgcaggtcatcgccgttttggcgatcgggatcgggctcgccgtcaagaccccgatgtggccgctgcacagctggctcccggacgcccacaccgccgcgccgaccgtcggctcggtcctgctggcgggcgtcctgctgaagatgggcacgtacgggttcgtccggatcctgctgccggtcgcaccgcacggcttccacaccttcgcgccctacctcgccgcgttcgccgtcgccgggatcatctacgggtccctggcctgcctggccctggcccggcagggcgcgaagggcgacctgaaacgcctcatcgcctactcctccgtcggccacatgggcttcgtcctgctcggcatcgccacgatgaccccgaccggcgtgaacggcgcactcttcgccaacatcgcccacggcctcatcaccggcctgctcttcttcctggtcggcggcctcaaggaccgcaccggcaccaccgacctcgacaccctcgccgagagcaccggagccgccctctacggcagggctccgcgcctgggcggactgatcgccttcggcgcggtcgcctcgctcggcctgccgggcctggccgggttctggggcgagatgctcgccctgttcggctccttcgaccccgccgcgggtctcagccgccccgccttcctcaccttcatggcgatcggcgcgttcggcaccctgctgaccgccgcgtacatgctcgtcgtggtccgccgcgtctgcatgggcgccgctgcacaggagaccccgaaactcgccgacgtacacgggttcgagttcgcggcctggacgccgctcgtcgccctcaccgtcctcgccggactctggcccaaggccctgctcggcctcaccgaccctgccgtgcagcagctcctcgcaggaggcacccgatgagcgccctggcccagccgctggccgcctccgccgtccagtccgtcgactggctcgccatcgcgccgcccaccctcaccgcggtgaccgccctcgtcgtgctcgtcgccgacctcttcgtgcccgccgcgcgcaaaccggtcctcggctgggtgtcggtcgccggcctcgccgcctccgcactgctcctgctgcccctcctggacggcgaccgcagcaccttctgccaggcgggccaggccggtgtctgcagctacacggccgaccacttcgcgctcgtcatccagttcctcgtcctcggcggagcgctgctggcggcactgctgtcggtcaccgcgctcaaggacgcgcacgggggactgcccgaaggggagtactggttcctgctgctctcctcctccgccggagccgccctcctgcccgcctcccgcgacctggcgaccctgatcgtcgccctggaggtcgcttccctgcccgccttcgccctggtcggcctcaggaacggggaccgcagatcctccgacgcggccctgaagttcttcctgtcgtcggtcaccgccaccgcagtcagcctcctgggcgtcagcttcgtctacgccaccaccggcaccctctacctcacccaggtggccgaccgcctcccgcacgtcgacgcgcagttccacaccctcgcccaggccggggtcgtcctcaccctgatcggcttcgccttcaaactggccgccgttccgttccacttctgggtccccgacacctacgtgggcgcaccgctgccgatcgccgcctacctgtccgtcgtcggcaaggccgtcggcttcaccggcctgatcctcaccgccgtcatcgcgttcccgtcgtacgccgatgtctggggccccgccctcgccgtgctggccgcgctcaccatgaccgtcggcaacgtcggcgccctgcgtcagcagtccacgcgcgcgtacagcgcggtccggctgctcgcctggtcctccgtcggccaggcgggctacctcctggtgccgatcgccgccgccggtcacgccaaggacgcgcagaaggcgatcggggccaccgtcgcgtacgccctcatgtacgccgccgtgaacctcggcgcgttcgccgtcgccgcgctcgtgggccgcacccggacccgcaaccgcatcagcgactaccgcggcctgtacgccaccaacccggtgaccgcgctcctcctggccttcttcctgctgtgcctggccggactgccgccgggggtcatcggcctcttcgcgaaggtcaccgtcttcgccgcggccgtcgacgccggactcggctggctcgccgtcctcatggccgtcaacgtcgtcatcgccctgtactactacctccagtggacggccctgctgttccgcgcccccgagggcgcacccgtacggcaccgcgtcccggcgcccctcaccgcggcgatcagcctgacgggcctcgtcggcatcgccctgtccggcgcgccccaactggtgctccgcttcgcgagcggcggcctgttctgagtcacccggacggcccgccccgctccgcacacgccggggaacccagggcgttcgcctggcgttgaccagtgcggaagggtccactggacgtgacaccacgacaccggtggaccgagcaagcagaagcgaagggttcccctgccgcaccacttggagggcgtaccgtgcaccgccggcacaacgggctcaggaccgcagtactcctcgggggactgtccgcactcatcatcgtcatcggcagtctcttcggccgcaccggcctgatcgtcgcggtcctcgtcgccatcggcaccaacgcgtacgcgtactggaacagcgacaagctggccctgcgcgccatgcgcgcgcgcccggtcagcgagttcgaagccccggccctgtaccgaatggtccgcgacctctccacccaggcccgccagccgatgccccgcctgtacatctccccgacggaggcgcccaacgccttcgcgaccggccgcaacccgcgcaacgccgccgtgtgctgcacggaaggcatcctgcgcatcctggacgagcgcgaactgcgcggtgtcatcggccacgagctgagccacgtctacaaccgcgacatcctgatctcctccgtcgccggagccctcgcgtccgtgatcatgttcctggtcaacttcgcctggctgatcccggtgggccgctccgacgacgacgagggccccggcatcttcggcatgctcctgatcatgatcctcggcccgctcgcggccagtctcatccagctcgccatcagccgctcccgcgagtacgaggccgacgcgtccggcgcccgcctcaccggtgacccgctggccctcgccggcgccctgcgcaagctggaggcgggcacccagcagctcccgctgcccccggagccccgtatcgagaccgcgagccacatgatgatcgcgaaccccttccgtcctggccagggactgtcgaagatgttctccacacacccgcccatggcggagcgcatcgcccgactcgagcagatggcaggtcgccaaccgtgaagacaatcctgaacgtcatctggctggtcctgagcggcttctggctgttcctgggctacctcttcgcagggttgctcctgtgcatcaccgtgatcggcatcccgttcggcatagcggcgttccgcatcggcgtctacgccctgtggcccttcgggtacaccacggtcgagcgccgcgacgcgggcgccccgtcctgcgtcggcaacgtgctgtggctcgtgctggccggctggtggctggcgctcgcccacatcgtgacgggcgtcatgctctgcgtcacgatcatcggcatcccgttcggcgtcgccaacttcaagctcatcccggtctcgctgctcccgctgggccgcgagatcgtccggacggacgagcccttcgcgacgcgctgagacggcgcactgagaccgcacgcagggacggcctgctgggaccgcgcgcagggacggcgtgccgagacgaggcggcgctgagacgaggcgctggggcggagcgccgagacgccgcgtgtcacggccccgggaccgcgcgggccggtgcaaccgtaaggaggcaccacggcgtccttcccgacgacacggtgtgaatacgcgtggtggcacgaacgggcgacgaccaagggtcgccgggaaaggcaggttcaggacatgggcgtcgtcagctggatcatcctgggactgttggccggggccatcgcgaagttcctgctgccgggccgtgaccccggcggcttcatcggtacgaccctcatcggcatcgccggtgccttcatcggcggctggatctcggcgcgctggctgggccacacgatcaccaagcagttcttcgacgggcccacctgggtggcggcgatcggcggctcgctggtcctgctgatcgcctaccgccttctcttcggcgactcgcgcgactgaagcgccggacgaacgaacgaaagggtgggcaccgctcccggtgcccgccctttcgtctgccggtcctaccggtagttgacgaactgcagcgcgaagtcgaagtcctggcccttcagcagcgcgatcacggcctgcaggtcgtcccggctcttggagctgacccgcagctcatcgccctggacctgggccttgacgcccttggggccctcgtcacggatgagcttggccaccttcttggcgttctcctgggagatgccctcctcgatggaggcgaagagcttgtactccttgccggacagctgcggctcgcccgcgtccagggccttcagcgagatgccgcgcttgatcagcttggactggaagacgtcgagggccgccttcacccgctcctcggagtcggcctccatgaggatcttctctccggaccacgagatcgacgcacccacgcccttgaagtcgtagcgctgcgagatctccttggcggcctggttgagggcgttgtcgacctcctgccgctcgaccttcgagacgatgtcgaaactggagtcggccatgtcctgtggctccttgtatcggggtgtgtcgggatgtgccggagcgcgcttcaggcgcgtgccgacgggtgtgggggcagccgccgggcccggtcgtggggcccgggcccgcatccgccccagcctagtcacctcccgccccggcgacgccgatcaatcgggtggcgaagcacccctgtgcatcgggtattgtttacgtcgttgccagagagcacagccgaaaggcagttcgaacggcagcaaaccccggcggtgtgcccgagcggccaaagggagcagactgtaaatctgccggctcagccttcccaggttcgaatcctggcgccgccacactggggaaaaccccctccgaccagccttcacggcaggtcggagggggtttcttcgttcctgagcgggtcgatgtcggtgccccggtgcacactggccccatgtcctcgtcgtcctcgtccgcgcgccgcagatcctgtcccgtgtgccgtcgcgagatcgctgtcgtcgccgggcgcatcgcgcg

SEQ ID NO: 80 - DNA, 2734 bp, Unknown
  Kingdom: Bacteria, Phylum: Actinobacteria, Class: Actinobacteria, Order: Streptomycetales, Family: Streptomycetaceae, Genus: Streptomyces
gcggccgaggtcctcggcccagcggcgttcgccggccaccgcgtcgcgccaggcccacagccggcgggtgaagcgctgcagggcgtactcctcggtgatgcccatggcaccgtgcaactggtgggcgatcctggccaccgtggtggccgcggacgcggtggtgagccgggcggtggcggcggccatgtcggtgggtccccactcgcgtgccagcgccagggcagcgtccgcctggaccagttcgacccgcatgagggccaggttgcccgccaccgcggggatcttcaccagcgggccgccgaactgacggcgttccgccacgtaggtcctggtgagctggaacgcgctgtgcgccgcgcccgccaccgcggccgaccacagcagggcgagccgcgcccgtacctgcccgaagccgggtgctccgggcagcggcgtgaccggcactccgtccagcaccaccaggtcgcggggctcaccggccaggttctcccccgggcgcaccgcgaccgagggatggccgagatccaccagcaccggggccgcgccgggcccgcagacgaccagcagctcgctgtcgcgtgcccagggcaccgcccgcagttcggccgtcgccgtccccgccgaggtgtccagggcactgtccagcaggatcagggtggtggcccggtcggtcacctcggtgtcatggccgatcacccagtccgccgtcgacgtctcgacgaccggcaggctcactccgttgcgtcccacggcctcgacgatggccagaaggtcctcgaaggtgcccccggagccgccccgttcctcggcgatgccgacccggtgcagccccagatcgcgggcctggtcccaccgggcccgccgttcgtgcggcgagtcgccggcaccgctcctgcggaccagctcgtcgaccaggtcgctcagttccgcggcgagttggctcatgaacgggtctcctgcctggcgatgagggagagcaggacttcggccgagccgccgcgcagcccgaaaccgggtgaggcgagcagggcctggccgaagaccgagtcgggggtgggttcgcggtacggctccgtgcggcgcagcgcctcgatggcgtcgcgctcgaaggcgttgcccaggtacttgagcgccgcggcctgccgcatcggggcctgtccgctgtccatggcggcggcgacgtcgaagcacaggcggcgcagcaccgccagtcgcgcgaccagtgccccgagcacaccctgcagctcgcggtcccccgtgtgccgggcggcctcgtcgaggagggcgaccagggcggggtagctggagagcacccgctcggcaccgccccgctcgaaggacagctgctcgacgacctggcgccagccgccgcccacggtgccgagcacccggccggcgggcacggcgacgtcgtcgaagcggacctcgttgaagtggtgctcgccgctgaggtcgcggatcggggtgaccgtgatgccggggctgtccatgtcgatgatgaactcggtgagcccctcgtgccggttgccggtccgctcgctgcgggcgagcaggtagatgtgcgtggcgcggtgggcctgactggtccagatcttgtggccgttgatccgccagccgtcgccggtgcgcaccgcggacgtgcggacggccgcgaggtcggagccggcctccggctcgctcatgcccaggcagaagaccgcgtccgcggaggcgatcagcggcacgatctcccgctggagttcccgggtgccgtggcgcagcaccgcggggccgatctgccggtcgccgatccagtgcgcggccaccggggcgccggcccgcagcagttcctccgtcacggccaggcgctccacatgggtgcgcccgccgccgcccaggtccttcgggtaggtcatggcgaccagtccgcgggccgccagttccttgctgaagtcgaggtcgaaggagcgcagccacgagtcgctgcgcggggtgcagcggccggccgcacgccaggaggcggtcagttctcggacctgagcgcgcagcgcgccgcaggtgtcggtcgtcgggatatggtccatggtggcctttcgggcgagggggcacgcgaagcggatgccgggcctggggaccgtggtggcgtccgccggatcggcgctggtgtcttccgttcggatcaggccggatcagggagcgtgccgggcctcgtgagcccggcacgacccggacgagaggacctagtcgcgttccaggatcagggcgttggccatgccgcctgcttcgcagacggcctgcagtccgtagcgctggtcggcgtcctccatggcgtggagcatcgtcgtcagcaggcggcacccggtggcgccgagcgggtggcccagagcgatggcgccgccgcgggggttgagggtgtgctcagccgctcccagttcggcctgccaggccagcgggaccgaggcgaaggcctcgttgatctcgacgtggtcgatccggccgagagccagcccggtgcgggcgagaatcctgcgggtggccgtgatcgggccggtcagcatcatgagcgggtcgtccccgcaggcgtcgaaggcgcggaagcgtgcgcggaccggccacttcatccgccgggccatgcgctcactggcgatcagtacggcgctggcgccgtcggtcagctgggaggaaccggcggcggtgatccgccagtccagttcggggaaccgctcggcgaaggcgtcggtgcggaaggccgggc

SEQ ID NO: 81 - DNA, 1396 bp, Unknown
  Kingdom: Bacteria, Phylum: Actinobacteria, Class: Actinobacteria, Order: Streptomycetales, Family: Streptomycetaceae, Genus: Streptomyces
gcccgagagtagtgcgcccggcgtcccgcgcgcgggctccgggcgcactactctcgggcccatgagcgacgagcacatcagtcagcacttcgagaccctcgcgatccacgcgggcaacaccgccgatcccctcaccggcgcggtcgtcccgccgatctaccaggtctcgacctacaagcaggacggcgtgggcggtctgcgcggcggctacgagtacagccgcagcgccaacccgaccaggaccgccctcgaggagaacctcgccgccctggagggcggccgccgcgggctcgcgttcgcgtccggactggcggccgaggactgcctgctgcggacgctgctcgtccccggcgaccacgtcgtcatccccaacgacgcctacggcggcacgttccgcctgttcgccaaggtcgtctcccggtggggcgtggagtggtcggtggccgacaccagcgacccggccgccgtacgggccgccctcaccccgaagaccaaggtcgtgtgggtggagaccccgtccaacccgctgctcggcatcaccgacatcgccgccgtcgcccaggtcgcccgggacgccggtgcgaagctcgtcgtcgacaacaccttcgccacgccgtacctgcagcagccgctcgcgctcggcgcggacgtcgtcgtgcactcgctgaccaagtacatgggcggccactcggacgtcgtcggcggcgcgctgatcgtcagcgacgccgggctcggcgacgaactggcgtaccaccagaacgccatgggcgccgtcgccggccccttcgactcctggctggtgctgcgcggcaccaagacgctcgcggtgcgcatggaccggcacagcgagaacgccacgaaggtcgccgacatgctgtcccggcacgcgcgcgtgacgcgcgtcctgtacccggggctgcccgaccaccccggtcacgaggtcgccgcgaagcagatgaaggcgttcggcggcatggtctccttccgggtcgagggcggcgagcaggccgccgtggaggtctgcaaccgggccaaggtcttcaccctcggcgagtccctgggcggcgtcgagtccctgatcgagcacccggggcgcatgacccacgcgtccgccgcgggctccgcgctggaggtccccgcggacctggtccgtctctccgtcggcatcgagaacgtcgacgacctgctggaggacctgcagcaggccctcggctagagcggccggccgggccggggccggaccctcgggtccggccccgcactcaccagctcgtcacgggcggggtcgtctgcgacggcggttccgcccacgggcgtaccgtcagcgcccacaccaggaaggccacggccgcggcgcacagcagcagccacagcgcgcggccgtggccttcctggt

SEQ ID NO: 82 - DNA, 13392 bp, Unknown
  Kingdom: Bacteria, Phylum: Actinobacteria, Class: Actinobacteria, Order: Streptomycetales, Family: Streptomycetaceae, Genus: Streptomyces
gggacgacgccggtcccgccgacgcggcccgccaggcccacgaggtgcccggcgcccccggcctggccaccggcgacggagtcacgacggcacgcgccgccgtgcgcgccgccgtcctcccgctcctgcaagggcagcccgcgtcggcgggaccggcgtcgtcccagagcacggcacggcagccggtcttgcccaggtccaccgccactgctgatgtcatacaacacgccttcgtgtgctccagggatccgtcgcgtcgggcggtcacggtacggccggggccggtgcggtgacgggcgcggatcgcggtccagtgagtatcagaaggtcgccctacgcatgtcaataagtaacctcacgaaacttaagacgtaactttttgacgtcacgggtgcggtgtgattaccgtgtcgctcacccacccaggagggaacgcccatgtcccagcaggaaccgtcccgcgctcccgccccgccggcccaggacaccgccgcggccggaacgctggcgggcatccgggcggcgctgcccaccctggccccctccgagcgccgggtggccgaggccgtcctggccgacccggcgcaggcgtcggaactgtcgatcagcgcgctcgcgggacgggccgacacctcggtggccacggtgatgcgcttctgccggaccatcggcatcgccaactacccgcagctgcgcctcgcgctggccgcggcggccgccagggagcacgtcctcggcggggaccgtccggcgccggtcaccgacatcagcgccaccgacacgctggacgagatcgtcgggaagatcatctacaacgaggtgcacgcgctgcaggactcgggggcggcactggacaccgaggtgctgggccgggcggtggacgcggtcgccggggcccggcggatcgacatcttcggcgtcggagccagcgcgttcgtcggccaggacctgcaccagaaactgcaccgcatcggccgtacggcgttcgtgtggaccgaccggcacgcggccctgaccgccaccgccctcctcggccccggcgacgtcgccctggccatctcgcactccggggagaccgaggacaccgtcgaaccgctcctggccgccgccgaacacggtgccaccacgatcgccctgaccaacgtgccgcgctccacgctggccaggagcgcggacctcgtgctgacgacctgtgcccgtgagacgcccttccgctccggcgcgaccgtcagccgcatcgctcaactcgccgtcatcgactgcctgttcgtcggtgtcgctcagcggtcctacgatgccacgacggcggcgctggagaagacctacggagccgtccagcaccgcagacgctccccttcgcagcgccgctccgcccccggcgactgacccggacccgcctctccgcggcgccgccggccgaccgcgtggccctggcgcgcgcaccgtcccggctcccgcaccgccgccctgcagcccgaccacccgaaaggacgaccgcgccgtggacctcagcacgctcggtaccgagacccgcaacgagcggaccaccgaactggaccgcatgccggtcctcgacctgctcaccgtcatgaacgccgaggaccagagcgtcgccctcgccgtgcgggacgccctggaggagatcggggccgccgtcgaggcgatcaccgagtcgctgcgtcagggcggacgcctgatctacataggtgccggtacgagcggtcgcatcggcctcctcgacgccgtcgagtgcccgccgaccttcggtacctcgcccgaccaggtggtgggtgtgctctccggcggcccgggcgccttcgcggtcgcggtcgagggcgccgaggacgacccggccagggccgtcaccgacctggacgagatcggcgtggacgaccgggacacggtcgtcgggctcgccgccagcggccgtaccccctacgtcatcggtggcctcaagcacgccgccgcgaagggcgcggtcaccgtgtcggtcgcctgcaacgcgaacgcggccgtcagccgctacgcggacatcccgatcgaggtcgccaccggcccggaggtcgtcaccggatcgacccggctcaagggcggcaccgccgagaagatggtctgcaacatgctctcgaccgcgtcgatggtgcgtctcggcaaggtctacggcaacctcatggtcgacgtgcgggccagcaacgacaagctcgtggaccgcgcccgccgcatggtcgtcgaggccaccggcaccgacccggacacggcggccgaggccctgcgccaggccggcggccacgccaagacggccatcgtcatgctcctcgcccactgcaccgccgaagaggccgcccggcgcctggagcgggccggcggcgacacacggacggccgtcggcagggcatgaacgcgcagggtaagacgcggccggccatgaacgcgcagggtatgagcgggcagcgcgcgggaacccactgagcatgtccgctacgcagcagttcgccgtcggggaccatgtccggtggaattccgaagccggacacgtccaaggtgtcatcgtcaagaagcacacccgggacgtggaatggaaagggtatgtgcaccactgcaccgagagcgacccgcagtacgagatcaagagcgacaagaccgatcacgtcgccctgcacaaaggtggcgcgctgacgaagctgtaggcgacaggacgacgggcgccggggcgacggcggggcgatccgggcgaggcagcgggatgacgaaccgcatcttcacggtggggcattcgacacgtgacttcgacgacgtgctggacatgctgcgcggcaacgagatcacctgcctcgtcgacgtccgttcgttcccgtcgtcgaggaagtacccgcagtggaaccagtcggcgatcaccgaggccctgccgcccggcatcggataccggtggattccggaactgggcggccggcggcacacccccaaaggcgtgccgagcgcgaacggcgcctggcgggtcaaagccttccgcgactacgccgactacatggcgagcgaggaattcgcgaaagggctggaagaactgctcgaactggcggaacacggaaggccggcgatcatgtgcagcgaggcggtcccctggcgctgtcatcgcaggctgatcaccgacgcgctgatcgtcgcgggcgcgcaggtggtgcacatcatgtcggccaccacggcgaagcctgcggtcctgaaccccgacgcgcagcttcacgacgggcacctgacctacccgccccctccctcgtgacaccgcgatgagcatcgtcgacgacgtccgggaagccgtcctcgccatcccggccgggtcggtgtcctcctacggcgccgtcggacggcggatcggggcggggccacggcaggtggggcgggtcatgggcctgctcgacgaaggcgtgccctggtggcgtgtcgtccacgccgacgggaccccggccgcctgtcacggcggccgggcgccggaactgctccgcgaggagggcacgccgatgcgcggtacgcgggtggacatggagctcgcccagcactcgtgggtgccctgacgggcgtactcgtgggtgacgagcgtactcgtgggtgcctgacgagcgtgttcgcgggcgcttcccccggtcagggctgctccggcaggaggcacaggccggtcagcggcgtccccagcgcgaccacctcgcgtgcctgctcaccggcggccgggccgtccggcaggggcaccgcgcggatgtggccgccgaggtcggagacgtaggcgaacccggcgctgccgtcgacggcgagaccgatcgcctcggcgaacccgtccgcgaggatctcgggtgtcacgcccggtgtgccgggagccgggaggggcgcgcggttgagcgtgttgccggcgggcgccgcaccgcggtcggtccagtacaggcggtcgccgtccaggtgcaggtcgatcggttcgggcagaccctgccagagcacctcgatgtcggagcggttcgcggcgctctcaccggccgggacgtccaggcccgcgcggaggatccggcccctgccgcccttgggcggccccttctgcgtccagtacaggtggccacggccgacgtcgacggccacgccgacgcactcccccatgacgccgtcctcggcggggttcaccacgaggtcggtcagtccgccgccgtccacgcggacccggctgacccggtggccctcgcggtccccccagtagagcgtgccggcgccgtcgccggtcagctgcttgccggtcgtcatcgcgccggccgggaccacgtcgcgccggtgaccgccgccgtccaggtccacggcgtggacaccgccgttgcggcgggagaagtcctggccggcctcgccaggtgtgccggggtcggccagcggggcgcccatggtggtccagtagacgacgcgggagtccacgacgacgccgtccggtgcgtcgccggcatcgtggaggagcgtgtgcacccggccgtccgggatgccgacctccagcattcgtccgggcacgacctgcagcgcgagcagtcctttcggcacggtgatcgtccttgtcctcggcggttgtcgttgcttatccggtgttgtccgcccttctccgcatcagcccgtactgctccgtgttcctcgatgtctgcgccgtactcgtcgcccggcacggactcggggtgccggcgcccgtggacggcgccaggtccgcggtgaaggccggcgtcggtgaagaccggcgtttcggccaccccgggtccggcgtcggcggcctgagcacggtgacggcgtggccgggcccttgtcctccaaggactgcagcgcgtccgaaatcgagcgcgttcgattcccgttccgcctcgttgagccggacagcaccgagccacgcaggcgcggtaccgactcatgaggaggaacccggatgaccgcgaccgacgcgtcggccgagagtgccaagacgccgccgcctcccccaccggccactctcaccttcgggggcgagtacggcaagaatcccctgccagaggccagtttcggcgccctgtgccgccgccttcccggggtgctcgggcgcaccgcgcggatggcctgggccgtcgacaggcccggtgtcgtcctcctgctcgtctgccagttcctcagcggtgtcaccgccgcgctcgtcctggcgttcaccgcgcgtgcgatgacgcacatcctgggagccggcacggtgtccgaacgcctgcacggcgccctgcccgcgctgatcgtcgtcacgtccgccgcgggcctcggccggatcagcggcgctgtgtcctcctacgcggacggccggatcacgcccctgctgacgaccgaggcggacatcgcactggtcgccgccgtctgccgggtcgaggcgtccgcgtacggcgaggacggattcgccgaccggcaggaggccgcggaggtcggtgtcacccggacccggctgatggtccaggacgcgcagcggttcatggccgcgctgatccgcatgaccgccgccggcggtgtcatcaccgcgctgcacccgctgatgctgccgctgctcctgctggccgtgctgccggcgggcgccggcgcggtgctctccgcgcgcgtcgactacgagacccactacctgaacgtgggcgaccgcaacgtacggggcatgatgcgctggtgggccacctactcccggcacggggaggaggtccgggccaacggcatgaccggctacctgatccactggtaccgcgccctgtcggaccgcatcgacgcgcgcgtgctcaccgccgcgccgcgcatgctgcgcatcaccttggcgacgagcgccctgggcggagtgttcctgctggccacctggacgacgctggccttgctggccggcaccggccgcgtggccctgccggtcgcggcgaccgcggtcgtcgccgtgcagaccacgctgggcgcgctctcccagttcgtgctgcacggtgccgcgatgttccacacctcgctgtacctcgccgacatgcggtccttcctcgacatggcccgggcacgcgccccgcggcgcggcgagtcgaccgtcccggaacgcgtggaggagatccgcctggacgacatcacctaccgttaccccggcaaggacgaacccgccgtgcgcggtgtctcgctctcgcttcgccgcggggagatcctggccgtggtgggcgagaacgggtcgggcaagtccacgctggtcaagctcatcaccgggatcctgctcgccgacaggggccgcgtgctgtgggacggtaccgacctcgccgacgcggatccggacgccgtgtggcggcgtaccgccctcgttccgcagaacttcgcctgctggccgctgcgcgcccgcgagaacatcaccctcgggcagccgaggacgttcgacgacggaccggtgtgggaggcggtcgacgccgtcggcatgcgcgaggcggtcgagaaactgccgcaggggctcgacaccctgctcgccagggaactgtggggcggggccgagctgtccggcggccagtggcagcgcctggcctgcgggcgcgcgctctaccggcagtcaccgttgctgatcctggacgaaccgacctcccagatggacccgcgcggcgagcacggaatcttcgcgcggatcaaggccatcgcctccgaccgcatcaccatcatcgtgacgcaccgcttggagaacaccaaggtcgccgaccacatcgtggtcatggaggagggacgcatcaccgaacacggccgctacgacgacctcgtccacgcgagcggcaccttcgccggcctcctgcacctgtcccaggatcgctgaacaccgtcccaccacggcgtacgccgtccacgccggccgaccgcggccgacgccgcccggtctcgacaccgcctgcctaccgcgggagttcggctcgccgtaccgcgccggaggccagggtgacggtcgcgcccaggccggcgaggacgccgcagccgacgaacaccggggcgctgccccaggcgccgatggcggccccgaccagcgggtagctgagcggcgcgagcccgaccatggtcagcatgacgacggaggtgacccggccgaggaaggccgggtccgccgcgttctggatgagcacgttgtccaggccgccgaagacgcccgcgttcagcccgagcacggccgccagcaccacggcggtccagaggtgcggtacgagagcgatggctgccgctcccgccgagcccgccaggagcgtcccggacagcaccagaccggcccgcggcagccggccggcgacggcgagcaggagggcactggccgcggctcccgccccgaaggcgctgacgatccagccgtagccggaagggccccagccgcgctcggcgttgaggagcaccatgccgacgctgagggggccggtcaggccgagttcgcagatggcaccggcgacgacgagcgggccgatgaggcggtggcggcggatgtagcggaggcctgccagcagctcctgtcgcgcggtgccgggctgcggcggttgcgcgccgcccggtcgcagcggccgtatgcgtatcgtcagcaggagcggcagggacagggcgaagagcagtccggcggcggcgaaggccgtcgcgggtccgccgagtcccatggccaggccgccgaccggcgggcccgcgatctggctcagccgcagtgagagcgagcgcataccggcgacccgggccagctgttcgggggcggtgatccgcggtgggagggcgccgaccgcggggacgaacagggcgtccacggtgccgaagagcagcgccagggcgaccaggatccacagggccggtgtggtcagcgcgacggcggcggcgaccgtcaggatgagtacgcagcgcgccccgtcgctgccgaggatcacccggcgggggtcgaaccggtcggccaccactcccccgccgagcatgagcagggcccgtggcagcgccccggaggccatgacgaggccgacttccgcgggtcctgcggccttctgggcggaccagccgagggcgacgaagtacacgctgtcgccgacgagggaagcggtgtacgcggtgagccagcgcaggacgtttgcgtcgcggtgggccggggcggtggcgcgtgcgggcagggctgtctctgcggtggccatggtggcgggctccgaggcgtcggggtgcggcagggtcagggtctgaaggggaagccgtagaggtgcacggagacgtgctcgcggccctcggccccgtccgccgcggcggcggccttgccccgctcccgccagcgccgggccagcgcctcgaactcgtcgctcatctctgcgagttcgtccgcggtcagctcgagcagccactcggagctgaaggacgcgtcggtccacgccgcgccccaggcggccttctggtcgaggtaggtgcggtactgggcgacgcgggtgtcgaagatgccctgggtgaccgcgcggaccgcggcggctccttcgggtgtgtccgcgaagtccgagtcgcgaaagccccagccttcctcggaggcgaccttccaccagcgctcgcggccgtcggcgccccgctcgctcgcctgcgtcacgaagccgtgctcggagagctttcgcaagtggtaactgaccagcgagggcgtctcgtcgacatgttcggcgagctgcgaggcggtcgcggtgcccgcggcgtacagcagccggtagagccgcatccgcagggggttcatgaacgccctcaaccgtgcgagatcggtgatctgctcgtgctccggctcgggttcgtgcccgggttcgtgcttcggtggccgcatgagcccaccgtagatgtgaagcgaaaacttcgcaataattccttcaggttttccgtggcgagcggagcggctcgtgcgctcggctgcgtgtccgcgaagtacgcctgtttcaggcccggttcaccgccggtgacgcggcgctgcggcacctgacgccccgtcgggccgttcccatggtcacggtctcgtcgaaccggtggtcatcgggtgcctggtcgggggaggatggccgccatgacggatgaaggcctctcgatcgaccccaccaagccgagtatcgcgcgcgtctacgactacctgctcggcggcaaggacaactacgccgtggaccgcgggatcggcgacgtgttcaagcgtgacctgcccggttcggtggccatcgccttcgccaaccgggcggccctgacccgtgccgtcgcggagatcgcgacgtccaccggggtgcggcagttcatcgacctgggcagcggtcttccgaccgccgacaacgtccaccaggtcgcgcagcggcacgccccggacacccgggtcgtctacgtcgacatcgacccgcaggtactggtccacggccgtgcgctgctgcaggagaacgaccggacccgggtcatcgcggccgacgtacgggaacccggcgtcatccgcgcccaccccgacaccctggagctgatcgacttcgaacgtccggtcgccgtcatgttcagcgcgatcctccaccacgtaaacgacgaggaggaccccgcggcgatcgtccgctactggcgtgatcaggtgccgtccgggagttacttcttcgtcagccatttccgttccggtcacaacgcggagaccgcggaggccgagcgagtcctccagcagacgttcggccgcggccggtggcgcacggacgaggagatcgcgtccctgctggacgggctggagatcctggagccggggatcgtcccggcgtccctatggcgtcccgacgcggtggacggccccggtggcaccggcggcgaacgggaactccccgtctgggaacggctcatcgccgccgggctggcccgtaaggcgtagaaccgacgtcacggcacacgccaggcgttggaccgacgtcacggcacacgcgaggcgttggaccgacgtcatggcacacgcgccgacgtcacggcacgcgcgccatgacgtcggcgggggtgtgaccgacgggatgtggccggtgggtcacaggggtgtgccgccggtgtcgcccggggtgatccggccgcgccacgctccgctctcgccgccgcgttcctcgatgtacttcttgaaccgcttcatgtcccccttgacgcgccggtccatcacacccagcaggtcgccggccttctccgccatgccgctgggttcgatgtccatcaccagctcgacgcgcgtgtgcgcgtcgtcgacccgctcgaagcggaccgagccccgctgatgggtgtcgccgctggtggtgcgccatgtgatgcgctcgtcggggagctggtcgacgatctcggtgtcgaattcacgcgtcacgccggacaccttcgtgacccagtggttgtggcggtcgtccagctgccggatctcctcgaccccgtccatgaactgcgggaaggactcgaactgcgtccactggttgtacgcggtgtggacggggacgtcgacttccaccgtttccttgaccgtgctcatatccgtgcgcctccggttctgctgatcagttccgcggttcaggccctgctgtccaggtccggctgagcagcggaaccgatcaggtctcactgatcgactgcggcggacctgcggcccgccgttcggcatggtcgcgagtacccgacacgtacggctttacgaccgcgcgtcccgcctcgcccgacagacgaggctcaccaccccggcccgggtggcccggaccggcgtggacggcccgcggcccaccgtgtacgcagtacctaccgcacacgcgcccataatgtggctatggccgcagatcgtccggttcgcgggcttctgacccgttcgttccgaagaacaacacagacgcggggccggccgggtgggccccgcacgcgcgggccgggggcgtggagcgtcgcgggacaggtcttcgtactgcaagtggtggtcgtggtcctgctcgccgtcgcggcggcggtcgcactggtcctccaggtgcagcgtgacagcactcaggaggcccgcaggcggacgctctcggtggcgcagaccttcgccgaagcacccggcaccgtggcggcgctggacggcccggatccgacggccgtgctgcaaccacgggccgaggcggtccgcaaagctgccgacgtggccttcgtcgtcgtctccgacacccacggcatccgctacacgcaccccgatccccgcctcatcggcaagcacgtcatcggcccgtaccggaaggtgctggagggctttccgcagacgacggagatcagcgccagtgtcggaccggccgtggactcgaccgtcccggtcttccgcagtgacggttccatcgccggtacggtcgccgtcgagatcacgctcggggacatcaaccagtccgtcagccgccagatgccggtcatcttcgccggcgcggccggggctctcctgctcgccgtcggcggtgcggccctggtgaaccggcgtctgtcccgtctgacccatggtctcggccccgccgagatgacgcgcatgtacgagcatcacgacgcggtactgcactccgtccgcgagggtgtgctgatcaccgacgggcaggggcggctggtcctggcgaacgacgaggcgcgcaggctgctcgccctcccgtccgccgtcgaagggcgtccggtcgccgaggcgggcctgcatccacggatcgccgggcacctggagtcgggccggtcggccagcgacgaggtgctgccggtcggagagcggctgctcgcggtcaatgtgcggcccaccggtgcggcaggcggtccgccgggcacggtcaccacgctgcgggacaccaccgaactgcgtgcggtgaccggccgggcggaggcggtgcgcgagcgcctcctgctcgtctacgaggccggttcgcggatcggcaccacgctcgacgtggccacgaccgcgcaggagctgacccaggtggccacccctcggttcgcggacttcgccaccgtggacctggccgagacggtgttccacggtcaggaaccgggcgaatcggcgggcgcggtcgtgcagatgcgcagggccgctctcgcggcgctgcgcgacgaccaccctctgtatccgctcggcagcgtgagcggcaccgtgcccaccagcaccggctccctgggaggcacccgccggcagtgcttcgcggagtcgggcctggacaccgtgctggaccggcaccgggacgacccggagcgcgtcgggcgggtcctcgcgtacggcttccacagtgcgctcgccgtgcccctgcacgcccggggcgtggtcctcggcatggtcacgttctggcgttcgcggaacccggccgccttcgacgaggacgacgaggcgttcgcccaggagctggtgaccagggcagcggtgtgcatcgacaacgcccgccgctacacgcgcgagcaccggacggcggtgaccctgcagcgcagcctcctgccgagcgggctgcccgagcaggacgccctcgacatcgcccaccggtatctgccggcggaggccggagtgggaggggactggttcgacgtgatcccgctgcccgggacccgggtcgctctggtggtgggcgatgtggtgggtcacggtctgcacgccgccgccaccatgggacgcctgcggaccgccgtccacaacttcgccacgctcgatctccccgccgaggaactcctcgcgcggctggacgaactggtctcccggatcgaccaggaaggcaccgccgacagcgccggggccgccggggccacctgcctctacgcgatctacgacccggtggcgggccggtgctgcctgagccgtgcggggcaccccggccccgcgctggcgctgcccgacggatcggtgtgcttcccggaaagtcccgcgggtgtcccgctcggtgtcggtgggctgccgttcgaggcggtggagttcgaggtgcccgaaggcagccggctcgtgctgttcaccgacgggctcgtcgagacccgcggccgggacatcgacagcgggatggagctgctgcggcagagcctggcccgcggcgggcgcacacccgaggagacgtgcgcggaggtgctggccacgctgctgaccgggccgcccgaggacgacgtcgccctgctggtggccgccacccgcgtcctggacccgtcccgggtggcgacctgggaggtgccgcgcgaccccgccgccgtcgggcccgtgcgccgtgcggtcgcaggtcggctcgccgcctggcagctggacgaggaggccttcgtcacggagctgatcctcagcgaactgctgaccaacgcggtccggtacggcaccgatcccgtgcgcgtgcgcctgctctacgaacgggtgctcgtctgcgaggtctccgacggcagcagcaccgcaccgcacatgcggtacgcggcgacgaccgacgagggcggccggggtct

SEQ ID NO: 83 - DNA, 4606 bp, Unknown
  Kingdom: Bacteria, Phylum: Actinobacteria, Class: Actinobacteria, Order: Streptomycetales, Family: Streptomycetaceae, Genus: Streptomyces
  misc_feature (409)..(413): n is a, c, g, or t
cctcggctcgtgggacaaccgcatcagctcctacgccgactacacggactggccggtgtgcttctccctcgccgccgggctcgatccgcagcagggcgcgacccacttctacacggggcacggttccttcgacgagagcccggaacccgagtacgacaacgccatcagctccctcgacctgggacccgaagcggacgacttctgcggcagcgagagccggtacgcggtcttccagtgggacggcaggcccaagccccggcccgctgcgctccccacccagggggccttcggcgacgtgaactccgacgggtacgccgacctcatctcccgcaacaagttcgggcagttgtggacgtcccacgcgtacgacagccgcggcaaggaccggctcgtcggcggcggctggaannnnncggcgactacaacggggacgccaaggaggacctgtacgcccgcgacaagtcgggggtgctgtggttctacccgggccgcggcgacggcaccttcggcgcccgggtacgggtcggcggcggctggaacagcatgcgcgacctcgccgccgcgggcgacctgaccggcgacggccgggccgacctgctcgccgccgacaccgcgggcaccctgtggacgtatcccggcgacggcaagggcgccttccgggcgcgcaagaaggtcggcggcggctggaagaccatgaacgaactcgtcggcgccggcgacatgaactccgacaagcgggccgacctcgtcgcccgggataccgccggcaagctgtggctgtacccgggtgacggcaagggcgccttcgccgcccgcaagctcatcgggaccggcggctggaacgccttcaccgaactcgccggcctcggcgacgtcaccggcgacgggcggccggacctggtcgcccacgctccgggccaggccgcgctgcgcctgtatcccggaaccggcgcggcgagcggcggcctcaagtcccccaagaccctcgccggcctcgagtcgaacgtccacgtcctgtgaccggtggcgcgcactgcgggccgcctgctttccactcagccttaccgaccgagatccggcccgaccaccgggccgggtccctcggaccatacggagaccgaaccatgctcctcacccctccgggcctccgagccccgggcacgccctcgccgcgcgcacgtaccgcccggcgcatcctgggcaccgcggtggccctcgccgcctccatagccgccctcacggccacggcgccgcaggcggccgcggccgacaactccgcccgctgcccctcgggcaagctgtgcctgttccagtacggcgactacaagggcgagatgaagaccgtctcgtcgagcctggccaccatgggcgcgttcaacgacaagacctcgtcgctggtcaacaacagttcgttgtgggccgtcgcgtacaccggagccggctacgccggcgacgacacgctcctcatcagcccgcacaacggagccatcgacctcagcggcggcgcgttcgacggcgcgttcgacaacaagatcagctcgatcggggtggccaccaccgagtacgaggccattcagggcgtcccctggatggactggctgcgccaggcggaggacaagcggccgaccggactgcctcaagccggcaagttcggcgatctgaacaacgacgctcgccccgacctcctggagcgcgcggacgacggccggctgtggttcctctcgggcatcggcgacgccgagtggcagaccaagggcaagctcgtcggcggcggctggaacgccatgacgcagctgacccggcacggcgactacaacggggacgcaaaggaggacctgtacgcccgggacaagtcgggggtgctgtggttctacccgggccgcggcgacggcaccttcggcgcccgggtacgggtcggcggcggctggaacaccatgcgtgagatcagcgccgcgggcgacctgaccggcgacggccgcagggatctgctggctcgtgacaccgccgggaaactgtggctgtacccgggcaacggcaagggcaccttcagcgcccgcaagctcagcggcagcggcggctggaacgccatgaagcagctggtctcacccggcgacatgaacggcgacggcaagggcgacctgctggcccgcgacggatcgcgcgcgctgtggctgtaccccggcaacggcaagggcgcgttcggcgcgcgcaaaaagctgccgtacgcctggcccaccgacgagccggtgatctcgaccggtgacgtcaacggcgacgggctgtccgacctcatgcggcccatcgacacccagctgttcgtgtatcacggcaccggcaagggctccgtcggcggcccgaacgccgacatgctctgggacaccgcgtcccacgtgcgcgtcttctgacgcacgggaccggtatcccggtcccacgcagcggggaccccggctccgccaccgcgacatggggagagccgggccccgctggctcaaccggtcagcgggtcaacgagccgaagcaccaaacgaacaccggccgaagtcccgttcgcatggccgcggttcgcccactcctcgcgcagcattccgaagagcacgcggtcgtagcggaaccggtgcgcaaggagaacctgccatcgtcggacctggcccgtatctggtccgcgtccacgccggcgaccgctcgacggacagtaagaagccccgcttcctcatccaggtcatccccggcgaccgcgcgaacgccgggacccgggccggcggcccccatgatcgaggaggccgccggccccccctcctggtccgcacctcctccaaccagccagactcatgggcacgcctgctccaggccctcgaaggcggctcggagcactacgagtcggtcactctcatcgacagcccgatctacacgggcttcacggccgaccagcctaaggaacgggtcgtacgcgacgacgaggaccggcccgacagcactctcctcctcatcgccgacgagcaggccctggcctccggggagtttccgctgccggccgtgaacactcggcccgacgaggacgacgatccgttcaggatcaccctcgccgcagccggctccctcatcgtcaacatggagctgggcaacacgagcttcggcgactggagccgcggcgtcggcaccgacggcgtctaccgggcacagcacagcactactgacagtgtcatggccttgtcagccatggatacgaccaacccgtgaacatgaccggcgggcgaaccgcatcatgctcaggaagacgaagcgcgccaggttggggcccaccttccgtgaggcgtaatgcggtggtgggcgctgtcacagcaatgccgcgatgccgtcccggtcctcgggcagcccggccgcgcggaaccacaacacgttccgggcgatgccgcccgtcgactcgtcggtctccacgaaggcccgtagcaggtcgctttgcgcggaggcgagcgggcggatcgagtcgtagccaccggggaaggctctgagcaggatcggccctcgttcgaggtcggtgaccgacatgccgccggcggccacgatggcgacagccaccggcgccacctcctcgaacgattcggccaggttgagcgcggaacgcagcacggtgaaccggaaccacccgtccagcccgggcagcggctgggggaaccagccgtccgtcgttcgcgggtcccccagcgcgtcgagaaggacggcgagagcgcgtggccgatccacctggacaggaccgagcgcggcgcagacccgtaccgccgggtcggagtcggcgagcaggtcggaggtgtccgtcccccacacgctgagcgcccgcgccacacccgctcgctcccgtcgatcctccacggcgcccagccgggcccgcagcagtgcggcggcctgcggcatccgttcggcgcgctttcgggcgtagaaacgacgggactcgtcgcagcagcggatgctgatccacgcggcggggccgcgagttggtcagggcgtatgaccttgcggttgcgcagccaggcgtgttggaggcgtcggctgtatcgcttgggccggtgcaggttgccgctgatcctgcccgagtcccgggccgcaggggcgaccccggcgaacccggcgaggcgttcggcgttctcagagatgtccatctcgccgccggtggccgctggatcgctgtcttctgctgtcgcggcaggacttcggaggcggcctcagtcgccagccaccgctgtaggcgagtctccggtgacgatgccggccgcgacgacctgttcgatcaccgggtgagcttctccttggcctgacccagttcgtcgatacgcgtggcgatgctgtcacactcggtaactagttggtccaacatgccctgggttgccagccctgtggtcacgcagggcaggagatcgacgatcgttctgctcggcagtccggcggcgtagagctgctgtatgaaccgtacagcgccccagcagaaggcctcaccaggacgttcactgggcgtcgggacaggcgggttgggcggagggcgcggtggggatcgaatggcggcgttctctggtgcacgaccccagccgggccgcgaccccagccgggccgcggc

SEQ ID NO: 84 - DNA, 1454 bp, Unknown
  Kingdom: Bacteria, Phylum: Actinobacteria, Class: Actinobacteria, Order: Streptomycetales, Family: Streptomycetaceae, Genus: Streptomyces
ccgctgctggccgccgggttctacgcggtcgagcggcgcgcggaccggcggggccgtacgccgctggtgccgccgagcctgttccggctgctgtcactgcgccgcggtctcgcgctgatcgtgccgttctccatcgggttcagcggcttcatgttcgtcatcgccgtggcgttgcagcagggcgccgggctcggcccggtcccggcggggctcgcgctcgcgcccatggccgtcgccttcttcctcgtctcgctggccggaccgcggctggtcgcccggtacggcacgcgcgtggtgacggcgggcgcggtcgtgcaactgctgggggtgggcctgctggcgctcaccgtccgcgagtcgtggccgcacgtgggcttcgtggagctgctgccgggcgccgcgatcgccggggcgggccaggcgctgcaactgcccgtcaccttccggatcatcctctcggaggtgccgaccgcgcgggcgggtgtgggcagcggcgtcatggtcaccgcccagcagtcggcgctggcgctcggtgtggccacgctcggcaccctgttcctgtccctggtccccggtctgggcatgcgggacgccctggtgagcacgctgctggtccagctggccgcgatcgtcctgacgggcctgctcagcctgcggctgccccgcacgatcgggtgacggcgcccgtgggggacgttgccggcggatctcggtcactctgtgtgaccgagtgggcaaaggtaagaaacaagtgaaccgacctatggccctgacctgccgttttgctccaaacctgccctttccccgaccagttccgaacctcctcgacatgccgcgcggacgaacccgggcaaacctgtaggtggcccgatcagccctgcggggcgcgatcgcggtgcagggggaaatccgtcgaccaacgggagaccaccatgcctgtcaccaccagccgctgggtccgtgcgctcgccgccggcgccctgtccgccgccctcgtgtcggccggttcggccgccgccgtcgccgcggacaacgcgccggccgccaagccgagcccgacccacagcacgatgccgatgaccaaggcgtcgatcacggtcaaggccaaccacacctcggtcaaatccggccagagcgtgacgttcgccggtcacaccaaggacgagaagaccggcaccaagctggtcctccagcacatgcacaacggcaagtggaccacgctgcacaccagcacgaccgtcaagaagggcggcgtctactcgctgagccacaagttcagcaccaagggcaccgagcacgtacgcgtggcgacgtccgacggcaagacgcactccccgacggtgagcatcaaggtccactgacgcccgcccggaacgccgttcgcggcctcagggccgcagaccgcgcagcagcaggtccaggaggaggtcgaactcctcctggacctgctgctg

SEQ ID NO: 85 - DNA, 4055 bp, Unknown
  Kingdom: Bacteria, Phylum: Actinobacteria, Class: Actinobacteria, Order: Streptomycetales, Family: Streptomycetaceae, Genus: Streptomyces
ctcgcgaccgtcgccgatgcacgtgcggttgccggcggcgaacgggagcatcgcgcccgccggtatggcggcaccggtgcccggcagccagcggtcgggccagaaccggtccgggtcggggaacgacgcgggatcgtggtggagcaggtaggggctgtagaggacggtggccccgcggggcagccggcacccgcccagctcggtctcctcggtggtgacgcgggtgaagagccagccgggcggggagtgccgcagcgtctcggtgacggcgttgccggtgtggaccagacgcggcagatcggcggcggtgggcgggcggccgccgagcaccgcgtcgacctccgcgtgcacccggcgctcggcctgcgggtgccgggccagcaggccgaagagcgaggccaggcacagggcggtggtctccacgccggtgagcaggagagtgatcaggtggtcgtgcacctcccgcccggtgaccggcgggccgtcctcaccgcgctcggcggccagcagggtgccgagcagatcgtcgcgcggagcgtccgcgcggcgctgggctacggccgcgtcgacgagaccgtgcaggcgtgccagggcgtgcaggtagcggcggttggccggcaggggtatgcggaagggggcgtccagcgggaccaccgtgcggacgaacagcccgcgcaccacggtggacagacagtccctcagctccgcggccgtcgcctcgtccagggcgtcggagagcaggaaccggctggtcacccgggtcgtcagggccatcatcgcggcgctgacgtcgatccgctgtccgggccgccacgtctcgcacagcgccagggtctcggcgcccatcagctcggtgtacgcggtgacgtgcgcggcatggaaacgcggttgcagcaggcggcgctgccgacggtgcgtgtcctggcggctggtgaccaggccgtcgcccatcagcatccggagccggtcgtactggggtccgcccttgtcgaacgtacgcgtgtccacgagcatcctgtggaccagttccggatggcacaccacccaggcgggcaacgggccgagccggatccggaccacgtccccccgcgccggtaaggagctcaggaacgacagcggacggcggaacagggcgataccgtggctgaagaaagggaacatgcccggcgcggtggccacggtccaggaccggtcggaccggcctgtcgtggacacggcaccagttgacgcaccgctcatcgaataccacctgcctcagtcggcacacacaactcgggcggtctttcagggcttggcgttcgcaccatgtcctgcccagtccaacgcgcgaccggcgcaccatgcgcctttcaacgggggcgcacgggagcgcgcggaagcgtgggacgaaccgtctgtgtgaccaactggggcaactggccgttttccgccgccaggcctcttcgagcgtcaggcctctttgagggacagacctcttcgagcgtcaggcctctttgagggacagacctctttgacggacaggcctctgtggacgtcaggcctcgccaggtggcgggccacgtccagtgtgggaccgcgcttggcgtcagcctccgtccaggggcaggctccgtccaggtcgggccccgcctggcgtcgggcccgcccgatgccaggaccttcccgttccggtcagttctgcgggtcgcggccctcttcggcgcgctcggcgttccgcttcttcagacgagcggcctccttgcggacctccgcctgagtggcccgctccttctccagccactcgggcccctcctgcttcagggcctcgatctgctcggtggtgagcgcctcggtgaccccgccgcgcgcgagacccgcgatggagacgcccagcttggccgcgaccaccggacgggggtgcgggccgtcgcgccgcagctcccgcagccactcgggcggatcggcctggagctggtccagctcggcacgcgagacgacgccctcctggaactcggcgggcgtggcgggcaggtacacacccagcttcttcgccgccgtggcgggcttcatcgtctgggtggtctggtgcgacttcatggtgtccagactatcgaccggcgaggggggatccgaccacgctccggccgccggccacctcgggcggagacccacggcccacgccggccacctcgggcggagacccacggcccacgccgaccgcaccgggcggaggcccacgccggtggaccggacgggtaacctggccgggtgacaggctcggaagcagcatcccccacgttccggctcgcgtacgtccccggggtgacgcccgccaagtgggtgcggatctggaacgagcgcctgcccgacgtccctctcgacctccgccaggtcccggccgccgacgccccggcgacgctgcgcgagggcaccgcggacgcgggcgtcgtacggctgcccgtggaccgtacgttcttcagcgcgatccccctctacaccgagaccacggtggtcgtcgtcccgaaggaccacgtggtgaccgcggcggacgaggtgtccgtcgccgacctggccgacgaggtcgtcttccgtcccctggacgacgtcctcggctgggagcggccgccgggggagcccgccttcgaacgcccggccaccacggaggacgccgtcgagctggtggcggcgggcgtgggcctgctggtcgtgccccagtcgctggcccgcctgtaccaccgcagggacctgacctaccggccgctcgtcgacgccccgcagtcggaggtcgcgctggtgtggcccgaggaggcgaccaccgacctggtcgacgacttcatcggcatcgtccgcggccggaccgtcaacagcacccggggccggaagccggcggccggcgaagcgggcacggcgggcaaggcatcgagcgccgggaaggcgggcggcagagccacgggcggaccgggcggcaagtcctcgggccggacggcgggaggcaccggcaaggccgccgcgcccaagggcggctcgcgcggggcgcctcgtggcggcagaaaaacagggtcccagggctcggccaagggcacaaagggcacgaagggcaccaagggcggcaggccgcgccgcggatcgtagccgggcgcccgatcacttccccgtcgtacgcccgatcgactccacgagcggcagcagccggtgcgggacgcgttcgcgcagggcgacctcggtgcgggtgcggaccacgcccggcaggctgatcagcttctggatcacgtcctccaggtgggcgttgtcccgcgccacgacccgggtgagcaggtcgccgccgccggtgatggagaacgcctcgacgatctccggcaccccggccagcgcgtccccgacgtcgtccaggtggccctgggtcacctcgatgtgcacgaacgccagcaccggatggccgagggcggcgggggagagggaaggtcccgtgccggtgatcaccccgtcccgctccagtcggtccagccgcgcctggagcgtgccgcgcgcgacgccgaggacgcgcgcgtactcgcgcacgctggtgcgcggctgttcgaggagcagccgcaggatgcgggtgtcgagttcgtccacggccatgacggcaccggcctcccagcggcgggtcgatcgactccgactgtaccaatggctcagtggggcgcgagacaggtgggccaggtgatctcgtccattggcccgctgccggtgcagtcttcgaaccccggattggtccaatggctcagtcatgcggcggtgacttgagccagggggcctgatggtgctctgatggacgggtcgatggcgctgcggatcaccgcggcgcctttttcgtgccggtgttcgaagtctgccgagggggcggtcaacagtgctgaagagggtgttcgcggctccggaccccgggcgggcgcgcctgcggttcgcgtcccgggccgtgctcgggatcggcttggcggccgtcgtgtccggcctggccgggcactccctgcccggcgccgtcgccggcgggctcgccgcgctgctcgccctgttcaccgtctccgaccccacgg

SEQ ID NO: 86 - DNA, 6580 bp, Unknown
  Kingdom: Bacteria, Phylum: Actinobacteria, Class: Actinobacteria, Order: Streptomycetales, Family: Streptomycetaceae, Genus: Streptomyces
ggccggctgaccggcccggagccgacggcgggcgccccggaggaccgtactccggggcgcccgcccggctgtgcgcgcgggaccgcccgcgcctgtccgtacgagcggacctaccggcccgccagcgggttggacagcgtgccgaccagttgcagcgcgcccgacgggtcggccaggtccaccatctgccggttgtcgcgcagttgcagccggttgaggcaggacagcgcgaactcggggacgaacaggtcgtaccggcggaaccgttcggcgagttcgggcaccgactcctggtactcccggaccacctcggcgaccgtcgaccagaagccgtcctcctccagcacgccctcctcggccaggatcgcggccaggaagcggaagaagcagtcgaagacatcggtgaagagggacagcagcttgtggtcctccgggacctccacccggatccggccgacctccggcggcagcgccgcgtccgggtccatcaccgcgatctcctcggcgatgtccttgaacaccgcccggcgcaccacaccgtcctccaggaccaggatgacgttctcgccgtgcggcatgaacaccaggtcgtaggcgtagaagctgtgcagcagcggcaccagataggcgtgcaggtactggcgcagccactgccggggcggcagcccggagcgggcgatcagcgcgcccgcgaaggaggccccctcgtggtcgacgtggagcagcgaggccatggtcgccggtgactcgccgccgcgcagcgcgggcaccgggctctgacgccacagcgcggccagcatcttgcggtacggcgagtagcggtcggtggcggcctcgtactccaggtgccggtagcccaccgccgcccgctcccggaggatgctcagcccggtgtccttcaggaccgggtcgccggcgatcagccgggccagccagtcgttgatggccggggtggcctccatgtaggcggcggacaggccgcgcatgaagcccatgttgaggacggacagggccgtcttcacgtagtgcttcccggggtgggagatattgaagaaggtccgtacggactgctgggccaggtactcgtcgtcgccctcgcccaggcagaccaggtgcctgcgggcgatctcggcggcgaaggtgacggagagcttgttccaccactgccaggggtggacgggtatgaagaggtagtcggccgggtcgaggccctgctcggtgaggacgccgtggaatcggcggaccgtttcctcgcccagctcctcgcgcaggaacgcttcgtactcgatgccggtgccggcggtgaacgccgcccgggagcggtgcgcggccagccacaccagccgcagcgggctcgcggtctcgggcgcgtacgacaggtactcgtggactccgaagccgagccggccgttgttggcgacgaagcacgggtggccctcggtcatcccggtctcgatgtcctggaaggagcccttcgccagttcggctgaggtgacctggggcttggtgagcttgtagcaggtgctggagagggtggaggagatctcctccaggtagaccggcaggatgtcgtcgctcaggccgagtgccgtcttcagctcgatgaagaagtcgagggccgtcagcggcacttcggcgccgtcgcggtggcgggtgagcgagccggggtcgacctgccagtggtccagggcgcggcgggtggcggtgaagcggtaggtggtcagcccgtcgtcgctgcgcacgacgtaaccgtcgccttcgccgtcgccggcgggctcgggcgtgatcagccgttcgtgggcgaactcggcgagcgccttgcggatcagcaggcggttggcccgctcccagtgttcgggggtgaggtgggacacggcgtcggcgaggctcacgcggccaccgccttctcgaactgctcccgggtgcagaagctcagcagtgccttcttctccggcttctggatctcgcgttccggcacgaagccgacggcctcgttcagggcgtgcacggcggtgttgcgtacgtcgggttcgaccacgatccgccgggtcgccgggtcctcgaacaggtaccgcagcacggcggtgatcacggcccgggtgaagccgtgcacgggcgtgccggtgggcgcgaccaggaagtgcatgccgacgtcgccgggctcggcctcgtacagtccggtcagttcgcggtgggcggggtcgtagcgttccatgaggaagacgggttcgccgtcgtccaggccgaggaaggcgtcgtggtgctcgtcggccgcgatctcgctgtaggcgcgctccacgtcctggagctcggcctcctgcatcatccagaacaccgccttgggatgggtgacccagccgtgcaacagctcggcgtccttcagcgggtcgagcgggcggatcgtgaaggtcatgcggcgaactcctggaatgcgatcgacttctcgacggggtagtactcggtgccgagcagctcgcggatgatgcagctgttgcggtaggcacccatgcccaggtcggggctggtgatgctgtgggcgtgcacgcccgcgttctggaggaagacgccccggccggtcacgtcgacggcgtagttgcgtgcgatgtcgtggttgccgtgcgcgtcgtagcgcagccggtggcggacgggcgcgaggaactccggttcggtgtacttgtatccggtggccaggaccaggccctcgctgcgcagctcgaagtccttgccctgctcctcctggcggaatccgagggcgtaggtgccgctgcccgggtcgtaggaagctctgttcagggcggagttggtgagcaggcgggtggggacggggccgctgaggttcttctggtagagcaggtcgaagatctcgtcgatcaggtcgccgtcgatgcccttgaacaggcctttctgctgttcggtgaggcggtagcgggtggcctcgggcagcgcgtggtagtagtcgacgtactcgggtgaggtcatctccagtgtgagcttggtgtattcgagcgggaagaagcgcggggagcgggtgacccagttcagccggtagccgtggacgtcgatctcgccgagcaggtcgaggtagatctcggcggcggactggccgctgccgaccagcgtgatcgacttcttgcgctggagcgccgccttgtgttccaggtagcgggagttgtgcaggaagtcgccgccgaggtcctggcaggcgtcgggcaggtgcggcggggtgccggtgccgaggaccagccggggcgcccggtaggaggcaccggtgtccgtccgcacggtgtacagcccgtcgccctcgtcgtacgtcacctcggtgaccgtcgtgccgaagccgacgctgctcagccggcccgccgcccagcggcagtagtcgtcgtactcgacgcgcagcgggtagaagttctccctgatgtagaaggagtagagccgccccttctccttcaggtagttgaggaaggagtacggggacgtcgggtcggccagggtgaccaggtcggacaggaacggggtctgcaggtgggcgccgtcgaggaacatcccggcgtgccacgtgaagtcgggcttggactccaggaagaccccgtcgagttcgccgatcggctcggtgaggcaggcgaggccgaggttgaaggggccgagcccgatacccacgaagtcgtggaccgtggtggtcgtggcggtggcagtggtggcggtgccggtcgtgccggcgggttcggcttcaggacgcgcggtcaagggactctcccaggtactgctcggcgtggccggcgatcaggtcgaggacggcggcgaggtcgcccgtggtcgtctcggggttgagcagggtgaacttcaggtagtggcggccgtccgccttggtgcccgccaccacggcctcgccggaggcgaacagggctttgcgggcgtagagattggcgcggtcgacggcggccgggtcggtgacggccgccgggacgtagcggaagaccagggtggacagcgacggttcgacgacgacgtcgtagcgggggtcggcggcgagcatccgccagccctcggcggccaggtcgcacacctcgtcgaagagccggccgatgccgtcggcgcccatcacgcgcagcgtcgtccacagcttgagcgcgtcgaagcggcgggtggtctgcagggacttgtcgacctggttggggaggcgttcggcgaccgtacggcgggggttgaggtactcggcgtggtaggtggcgtgccgcagggtcgccccgtcgcggaccagtacggccgacgaactcaccggctggaagaaggacttgtggaagtcgacggtgaccgagtcggcgcgctcgatgccggtgagcaggtggcgccgggtgggggagaccagcaggccgcagccgtaggcggcgtcgacgtgcagccaggtgccggagcgcgcgcacagctcggcgatctcgggcagcgggtcgatggagccgtagtcggtggtgccggcggtggcgaccacggccatgggcaccaggccctcctcgcggcagcgctccagctcgcgggcgagcgtgaccgtccgcatccgcttgtcccggtcgacgggtacggggatcacggcgtcggggccgagaccgagcagtttcgccgacttctggacgctgaagtgtccggcctctgaggcgaggacgcgcagccgtgccgggtcgtcggtcttggcctcctcgcgggccagcagcagcgcctggaggttggactgggagccgccggaggtgaacacgccgtcggcggcgggccccaggccgatccgggcggccgtccagtcgacgagcttgcgttcgatgagggtggcgccggccgactggtcccaggtgtccagggaggagttgacggcggacaggaccgcctcgccgagcaccgccgggatgacgaccgggcagttgaggtgggcgacgtagcgggggtggtggaagtagacggcgtcgcgcaggtagacctcgtcgagttcgtcgaggacggcggtggtgtcgtgcagcggccggtcgaggtcgatcccgtcgatgcggggggccagggcatcgggtgtgacacccgtgaacggacggtcggtggcggcgagttgggcggccacccgctcgactccttcggtcacggagcggcggtagtgctccgcggtgaggtcattgagcaggtgcgagcgcatgggggtcctccgggggtggggacggtccggggcaggacatggcgaggggcggagcctcgcgatcaacttaggtaagcctaacctaactgcgcatcgctcaaactccgcccctccgtgagtggggtcactggtgtgacgggtgggtcggggtggtgcggtgcgcgcggcggtgccttgctcctggacgtgggtgcggctgcgggtgcgcgtggccctcactgctgggtgcggtggcgcctcgttcccgggcgtgggcgcgcgcggcgccgcctcactcctgggcgcgcaactgctcctcggtcagcccgcgccgccagtagccgacgaaggtgacccgccgcttgtcgataccgcgctcgccgacgcagtggcggcgcagcgcccgcacgcagccggactccccggcgagccagacgtacggccgctcggccgcgggcaggcgggcggcacgcagtgcgccgagggccatgggggagccctcggcgtggctgccgtcgtgcaccagccaggtgatctcggcgtcggcgtcggtcgccacgtcctgcacgtccccggcgtggcgcacctccagccaggcgcgcacccgggtgccggccggcagggactccaggatcgcggtcgcggccggtacagccgtctcgtcgccccacatcaccacgaggtcggtgtcctcgggcggccggaagcggatggcccggttgtccgcgacggccggaccgagcagcagcacgcggtcgccgggccgggcgcgggcggcccaccgggaggcgggtccggcaggagtggcagtcccggactccatgccgtgcagggcgaagtcgatgtcgatgccggtgggcaggccggcggcgtcccggtgcagtgcgcgcagggtgtacgagcgcatcaccgcccgtacgtcgtcgggcagttcgcgccagccctgccaccagccgtcgccctgctccagcgggacggcgggctcgcgttggccggggtgcggcaggaacagggagagggactggtcgagcccgtgggactcgaaggcgtgcaggtcgggcccggcgaagccgatccggacgagcgacgggccgagccgcctcgttccggtgacctgcagggagaagaaacggaacggggcggccacggccgtcgtcatgggtgctcctgagtcgtcgtcgattcgtcgtcagggggcggggcgggggtggcggggctgggggtcaggagaccttcttcgccgtctcgatggccttggcgaggtcgtcgaggagcggcacgcacttgtcgtacgacaggatcggctcggggttgcgcgcgatgacctgcccggccttgaccgcgggcagcttcttccaggtggcctgggtgatcgcggcgggctggatggccgaggtgcggttgtccatcatgatgatgtccgccgggtac

SEQ ID NO: 87 - DNA, 2684 bp, Unknown
  Kingdom: Bacteria, Phylum: Actinobacteria, Class: Actinobacteria, Order: Streptomycetales, Family: Streptomycetaceae, Genus: Streptomyces
ccgctcgggcgccggtccacgctccgcctggctgacggtctgtgtcccgcccgggtgacggcccgcgccgcacccgggtgacccgaacggccccgtcctcggacggggccgttcggctgtccggcgcccgccgggcggcccgcttggcaagagggcgtgtgtcacagcgccgcgtggttccgcaggcgtcgggccgcccctatcgtcaaggtcatgttcgctgtctacgccgcccgaatcgaccgcgaccagccgctgaacggcctggagacgggggagcgcccggcccccgagacccgccccggctggagcacgatcgacgtcagggccgcctccctgaaccaccacgatctctggtcgctcaagggcgtgggcctgtccgaggacaagctgcccatgatcctcggctgcgacgccgccggggtcgacgaggacggcaacgaggtcgtcctgcactccgtcatcggccagagcgggcacggcgtcggcccgaaggagccgcgctccatcctgaccgagcgctaccagggcaccttcgccgagcaggtctccgtgccggcctggaacgtcctgcccaagccgaaggggctctccttcgaggaggccgcctgcctgcccacggcctggctcaccgcgtaccggatgctgttcaccaacgccggggtgcgccccggtgactccgtgctggtgcagggtgccggcggcggggtggccacggccgcgatcgtgctgggcaaggcggccgggctcaaggtcttcgccaccagccgcgatgcggccaagcgcaagcgggcgctggaactcggcgcggtggaggcggtggagtcgggtgcgcggctgccgcagcgggtggacgccgtgatcgagaccgtgggtgcggccacctggtcccactcggtgaagtcgctgcggcccggcggcacgatcgtcatctccggtgccaccagcggcgaccggccctcgcacgccgagctgacgcggatcttcttcctggagctgaaggtggtcggctccaccatgggcaccaaggacgagctggaggacctgctgtccttctgcgacgccaccggcgtccgtccggtcattgacgaggtgctgccgctggagcgggcccgtgagggcttcgagcggatggagtccggcggccagttcggcaagatcgtgctcaccacgtcctgagcgcaccgatcactccctcccaccctctgcatgtcaactgtggttgacatgcagagggtgtcaacgtatgttgacggcatgacggaagcaacggatctcgccgaacgcgcgggcgaccgcgatccgcgggtcgggctgcgggccgtcgccgcgctgcgccggctgctggagcagctggaggcggtgcaggtgcgcagcgcccgcaaccagggctggtcgtggcaggagatcgccgccgaactcggcgtcagcaggcaggccgtgcacaagaagtacgggaggcagtgatgttcgaacggttcacgcaggacgcccgcgccgtggtgcggggggcggtggtcctcgccgaggaaggcggctcgtcgtccgtggacgccgagcacctgctgctcgccgtacttgaccgccaggccagccgcgcctccttcgccctggcggcgctggggctcgacgcgcacaaggaagccgtacggcaggagttgcgcgacgcgcggcggcgcgccggtctgtcccgcgccgacaccgacgccctcgccgggctcggcatcgatgtcctggagatcgtctcccgggtggaggaggcgcacggcgccggcgccatgtccggtgaccgggaggacggtgaccgggaggacaagggctggtggtcggggcgccgtgccttcagccggaacgccaagagcacgctcgaaaaggcgctgcgcatggccgtcgcccgccgtgaccgccgcatcggcgacgagcacatcctgctcgccctgaccgcccgcccgggcctgccctgcgaggtcctcgccgaccatggggtgacgtacacgtcgctgacgcgcgtgctgtacggcgacggagagacgcgggcggccggctgaggccgcctgcgcccgccgcccgtgcgtctcgggccctcgggctgcgcgtctcaggccttcgggctgcgcaggaccgacccgatgtgtgccgcggccgccgccagatggcgacgcgtggcactgacctggtcggcggtgacaccgtggtcgcgggccgcgtcacggatgtcgtcgcggaagcggtccaggagccggtccaggtcgcgggccgggtcgccggtgctgtcctcgtgcgcccacgccggttcgtagacggcggggaagtccgacggggtctcggagtactcggtgtgcgcctgcgggccgccggccgccgggccgaagccgaagtccttggccagtcccttgccgaactccttgccgaagtcgccgaactccttggtcagttccgtcaggccctcacgcacgcccgtcggccagtcgccccgcgcgaagtggtcctgcacctggtcctggacccgccgggcgatgcgctggaactcctcctgcgcctgggcccgcgcccgctcctgggcctccttggcctggcgccgggcccgctgggcctcctcgcgcgcccggcggctctcgtccttggcccgccgggcgcgcgaggaggcccagcgggcccggcgccaggccaaggaggcccaggag

SEQ ID NO: 88 - DNA, 1877 bp, Unknown
  Kingdom: Bacteria, Phylum: Actinobacteria, Class: Actinobacteria, Order: Streptomycetales, Family: Streptomycetaceae, Genus: Streptomyces
gtgctgctgctgtcgcagtacgaggagcggctgctgatggacgacctgcaccgggtgtggaacgcccggccgggcttccgggtgcacttcggaccgtacgacagcgcctaccgggccgctcccgcgggtggcggcctccccgacgagctgcccgcgcgcacctggccgcccgagcgcggcaccgccgacgccctgatccgcaaggcggagtacgtcttcaccgagggcaccgaacacgtcctggtgctgcacgccgaccacgtctaccgctacgactacggtccgctggtcgccgcgcaccgggcctccggcgccgcgctgaccgtcgcctaccagcgcatcgatccgcgctgggtgcacctgttcggcatggtcggcttcgacgggcgcggccggctcaccgagttcgtggagaaacccgagaatcccacctccgacctggtcttcgcggcgttctgcgtgttcgacgcggccgtgctgcgccgctacctgaccgcgctggacggcaccggctggcagcacgacatcagccgggacgtgatccccgcgatgctcgcggccggggagcacatccgcgggcacgaggtgcgcggccactgggaggacatcggcaccgtggagcgctaccaccgcgcacacctggcgctggcggcaggtccgcgcgcgccgctcccggtgaccgacatgccgctgaccctgcggccgggcacggcacgccagtgggtggccgccgcgccgggcgtgcgcgcctcgctggtcccggccgacctggtcaacgccggtctggtggaggacagcgtgctgttcccgggcgtgcggatcggcgccggggcgcgggtacggcgcagtgtgctgctgcccggtgccgtggtggcgccgggcgcggacatcgacggggcggtcgtcctggaggacgggcacgtccagcaagtcaccgaaggagtgagggcatgaccgtctccgagcacgccgcggatgagcggcgtacgggttcgagcgactatgacgtgctggtggtcggcggtgtgggcgtcgacaccatcgtgcgcgtcgacgaactgcgggtgccgccgggcgactcggtgttcgtggaaccgctggtggactacgtggggcacaccggcaacggggtggcgctgggttggcacacactggggctgaggacgaagttcatcgacttcctcggggacgacccgcagggccgcatggtgctcgaccactacgcgcgccacggcctggacttcactcacgtcgtctccccgcacggcaccccgcgcgcggccaacctcgtcgacccgcaggggcgccggttctccttctacgacggccggcaccccgccgacctgcggctgccgcgcgacttctacctgccgttcctggagcgctcggcgcacgtccacctgtcgatcaccggccacaaccaggacatgtacgaggacatccaccgcctgggcgtgaccagttcgacggacctgcacgactgggacgggcacaatccgcaccaccgcacgtacgccctcgcctccgactacgtcttcctgagcgcggcggcgatccacgaccggctggaggcggtgctgcgctcggtcgtcgacgagggccgggcgcggttcgtcgtcgccacggacggcgccgacggctgccatctgctggtgcgcggcgaggaccgggtgcggcacttccccgcggtgcgtccggagcggccggtggtggacaccaacggcgccggtgacgcgttcgtcaccgcgttcctgcacaccctcttcgaggggcgcgagctggaggaatgcgtgctggcgggttcggtggccggggcgtacgtgtgcggcagcgtgggcacccacaccgagttcatcgacctcccgcgactgcgcgcg

SEQ ID NO: 89 - DNA, 8123 bp, Unknown
  Kingdom: Bacteria, Phylum: Actinobacteria, Class: Actinobacteria, Order: Streptomycetales, Family: Streptomycetaceae, Genus: Streptomyces
ggccgcggtggtgccgagcacggtgttgcgttcggcgatgacgacgaggtcgccgatccggtcggcgggcagctcgaaccgcgcgcaggcgtcctcgcgggtgaggacggtgtcgacgccgtcgacggcggcgagcgggccgagcagcgccgcccggtccgcgccgtcgggcaggtgcacggtggcgtaggagccgagggcgccgtggtggacggtgtaggggtcggtgatcggcaggatgacgcggctcgcgcccgggtcggtccgcgcgtcgaaccagtcctgcaggaagaccacccgggcctcaccgtcgatgtcggacttggcgttcatcccgtggtcggcggtgacgacgaggaccgcgccgagcgcgtcgatgcgggcgaagtagcggtccagcatggcgtagaagcgattggccaccggtgagccgggcgcgtgcttgtgctggatgtagtcggtgagcgagaggtacatcaggtcgggccggtcgcgttccagcacgtcacagcccgcggccagcaccagctcgctcagctccgcgctgtacaccgacggcagctcgaagccggtggattcgaggaccttctcgatgccgtgctcggcgagcgtgacctgatcggccttctcggcggagaagcagatgccgccctcggcgagcccgctgccgagcagccgccgcagcttgtccttggcggtgatgacggcgaccctggcgccggtgcgggagaaggccgcgaagagggtgggagcgcgcagcagttcgggcgcgttcatcatgacttcttcgccggattccgggtcgtagaagtagttgccgcagatgccgtgcacggcgggcgggacaccggtggcgatggagaggttgttggggttggtgaaggacggcatggtgcactcaccgcgcaggtcgccgccccgctccagcatcgcctcggcgaacggcatcagcccgtcggcgatggcccgctcgtggtaggcgtcctcgctgccgtcgatgcagacgaccacgacgggccggccggggcgcgggtaggtgcgcccgttgacggtgagccggccgtcggcggaggtctgccacatggtgccggcgacaggattcatgtacgtccacccctgttggtcgaaggtgcggaaggccgtcgggcctttctcgctgtcatgggtaccaccggggttccgcgccgcagaaccacgaagttcgctatgggcgccatagccgggccggcgcccgcgagaggtgctgaacgggcctgtcccgccgtggtgggtgtgggatacgctcgcccacctgtgatccggccggggaggagacgtggagctcaacctgcaccgtctgtggatcttcctgaaggtggtggagtaccaggggttctcggccgccgcgcacgaactgttcatgagccagccctcggtctccaaccaggtacggcggctggagcagtccctgaaggtgacgctggtggaccgctcgggcgcgcgggcccggccgacggcggagggcgaggtgctcgccgcgtacgccaagcgggtgttcctgctggcggacgaggcggtggcggccgtgcagcaggtgtcgtcgctggagcacgggcggctgctggtgggcggctcgacgacggtcggcacctatctgctgccggccctgctggcccggttccgcgagcggtaccccggggtggagtgcgacgtgttcgtcggcaacaaccgggcggtggccgagcggctgctggccggggacatcgggatcgcggtggtggcgggcggaccggccaccgcgcatctgatggtggagccggtgctccaggagcggctggtcctggtggcgcgtgccgggcatccgctggccggacaggcgggaacgctccagccggacgtgctggcgggcgagcgtttcctcatgcgcgagcccggctcgcacacccggaccgagcaggaacgcgtcctggacgagtggggcctcgcgcagacggtgacacggtcggacgtgtggggcccggaggcggtcaagcagtgcgtggcggcggggctcggcgtcgcgctgatctccgagcacgcggtcgtggacgacgtcgagcgctcccgggccctgacggtgctgccggtgcggccggaaccgcggccgcgtccggtctcgctggtacggcgccgcgaccggctgctgtccccggcagagcgcgccttcgtgcgcctgctgcgctctcccgacggtatctggccgcgcgaactcgaccacggacctcaggcacccgcgctccgcgaggacaccggaggcgagagggacttcaccgcggagccgacctgaggtgggtctggccgaccttcttggccaggaatacgacagcaacggaacaagtgctctgcgccagtagaagctccagaagatcagcatcgatgtcaaccagagccagaccgggcccgtctgccacgggacgccgtggcagacggggcgccggcacagccgggcagcgtagccgtggccggaaggggtgaacccggtcacggacgcccggcggtttggatgccctggctgacactcgcgcggccgccgggcccttgcggctcccaaggtggcgtcgaccgatcggccggccccgcgaaccgccgcaccgccttgcgcccgtcctccacggttgaggacgggcgctccagcgatcaccgccgcttgctctgccccacacaccgaaagcggacgaatacccttcgtgcagccgcccttgcggcagatcgttgacgtcaggttcgcctgcgtcaccgccggagagatcccacccggcgtgcacttcgggtcttccagcggctcgctgctgctggtgtgccggtagtggcagctgcccgccggttgctgctgctgcaccgtgtacgtcttctgcgggccagcacccccagggatcgtctgatccgtcactcccgaagggctggccggcggaccgcccttgggatcggccgcaccgcgcccttcgaagtgccggagcagcctgcaagtaccaggcaggcaagcagggcagacgaagcagcgcggcaggatgagcgcatgacgacacctcacgattcagagaacggcctgcagatcctgccccgaccatgtcgtcgacctgccccgggggtaccggcgcacagatgcgatggccgaatcttatgaggcgctcggaggagccggctcccccgaaccggatcagggggcaaggcccatccagcaagccgccggcatggggatgagtcacccagtgggctgcggaggagactgacggccggggtcgaagacgcgcgccatcatcagagcgctccggcgccggctcatgaaccggctcatgaggacgccgaaccggttggaacgtccgtcgatgacagccgggccgggatcgcggcgttcgaggtggtgcagcgctgtggtcacgacgtcttcgggagtgcgcagcttcccggcggtcagcaccccggcgtccggtcccatcccggtggtgaactccgtgcctgtggcaccgggcgagacggcgaacacggtgaggggggtgccccgcagctccgcccacagcgattcggtgaagctgagcgcaaacgccttggtggcgccgtagacggccatccggggggacgggagatatgcggagacgctggcgaggttgatgatgaagccgttgccggcgttcctcatctggggcaggaacgctgcggtcaagtgcaccggcgccgtgacgttgacggcgatttcggctgcgagccgttcaggatccgtgccggggaacatggcgaacgagccgaacccggcattgttgatcaggcttgtgatgtggatgccccggtccgcgacctcctggtgcagctcgcttgcggcggccggggcggagaggtccgtggggatcgcctcgatgcgggcatcggtggtgcggcgcagctcgtccgccatcgacgcgagccgctcggcgcgccgggcgacgatcacgaggttcgaaccgcgggcggccagggctttggcgaaggcggctccgatcccggagctggccccggtgagcaggacggtctgtgcgcggtaatccatggtcatgcgaccagccaacggtctgtcggcggtctcgtccaagacccgtttcgcaccccgtcatgcagaagccgcatgacggacgggggcagcgagcggtcaggtctgacgggcgaggaaccttgtcgcggccttgacgaactccgcgacgagggggtcggtactcgcggcgcgggtggcgacgacgacctggcagggttcgacctcgtcgacgggaacggtgacgaggccggggcggagcgtgtagcgcaggtcaccagccgggatgacggcgacggcgttgccgtcggcgatggcctccagcttgtcgtcgtaggtttcggcaagggtggggccgagctgagcggaatcgtggtccggccggggttccagccgccagaaggtggtccagtcggcgcccgtgccggtgcagccgacgagtggttccgcggagatgtcggcgacggtgaccgactccttgccggcgaggcggtgggatgcggagacgagcaggacccgtggctcggagtagaggaccgtcaagtcgaggccgtcggccgggacgggcagcggtgcgcggatgaccagggcgtcgacctgccggtcggtcagggcaccggcgtccggcgagtcgaggtggcgcgtgcggacatgggcgtcgggatgccggcggcgcaggtcttgcacggcgggcgtgacgaccaggtcgtcggcgtacccgatggtgatcgtgcgcgccggcgccgcggcgcgtgcggtgagcaccgcttgccgggctgcgcgcaccagttgctgcgcctgcgggaggaaggccgcgccggcggcggtgagccggctgccccgagtggtgcgctccagcaggcgtacgccgagggcggtttccagccgctggatctgacggctcaaggagggctgggcgacgcgcaactcctcggccgcacggccgaagttcagatgctcggcgacgaccgcgaagtaccggaccagccgcagatccagatcgggaagcatgcccgcagcctacctgttatgcgattactgcatgacgaggtgtggaacgggtcttggacggctgcccaggggcgctgctgtccttcacccatgaccattgtcttcgtcaacggcgttcccgcgacctccgcggtgtggacgccgctgatcaacgagttgtccaagtcccggcagcgcgagacggtccagctctcacctcccggcttcggcgcgccgcttcccccggacttcgattccacgttcctcggctaccgggattggctcatcggcgagttgtcacggttcgaggcacctgtggacatcgtcggccatgacttcggcgggggtttcgccaccgaggtggcgatggcccgtcccgatctgctccgcagctgggtcagcgacacggtcggcggctacgagccggacttcacctggcacgagatcgcgaagctctggcagacgccgggcgccggggagcgtcacgtggaggaggtcttctcgggagacgtcgaggagcgggcagcgcgcatggccgcatggggcattcccgggccggcggccggcgagatcgcgctcggccagagcccgcagatgggcaaggccgttctcgcgctgtacaggtctgtgccaggggcggtgctcagcgagcgcggtcgggatctggccgcggccgcggtcaggccgggtctggtccccgtggccaccgaggaccacacggccggcagtgtcgctctccggcaccgcgcagcccggcgtgccggcgcccgcgccgtccatctcgacggactcggtcactggtggatgctgcaggacccggcgcagacggcccgcatgctgtcggacttctggagcagcacgtaaacgacctggtctttcgtggtcggagcgcccgacgatccagcctggagctctcgttggatgcgctccacggcccaccacccgatcggtagccacctccaggaagccccgtgaaccgccgcgccgctgaggcgtccgtcgccccgtgtctgtcccccatcagagctactcggactgtccactcaggggtgattcgcagacgtcgcccctctcataacgttcttggcaggccgccggaaggcacgcggctgatgacatacggagatcaccttgaatacgactcgcaccgcgtcgccccgatccgcacgccggagtggtggccgcttgcagtctcccctcgcttggatgctgaccggcatagccggtgtgggtctggcgtccagcctggcctcggtgggcggggtggtcgccatcgtgggtgcggtcgtggcggttgtcatctactgggcggttatgcgctacgtcgctcggcggagcatgccggagatcgcgaagccgggggctgtcacacagaccttgttcggtgtcgcgatcggcttcgggttcatcaccgtgtcgatgctcatgcttctcacagagttctcattcaacgaacggcccggtaacggcctgtcgatcgtggcgagcatggccgcgatgtcggtcggtgccgccgtgaccgaggaactgctcttccgcggtctcgccctccaggcactggagaagttgtgcggcagctgggcggccctgacgatcaccgcagtgctgttcggtggactgcacctggccaacccggatgccacgctgtggagctcgatcgcgatcgccatcgaggccggcgtcctcctcggtgccgcgttcctgtggaagcgcaacatctggttcgccgtgggcctgcacttcgcctggaacaccaccctgggcctgatcggtatccccgtctccggccacgcctccgagggcctgatgaccacccatccgaccggtcccgacctgctgaccggtggagacttcggtcttgaggcgtcgatcgtgcccgtcatcgtcagcctgctgatcgcgatccccatgctcatcgccgcccgccgacgcggcaacctggtacccatgcgtcgcgggcaccgctgaacaaccgtcgcgacggccacgagatctcgctcacgtcggagcggatgtcggcccggtcggcgaagagggtctcgccgccgtccttcttcgccttcgcgccggtctccggccagatctcctgctgccggcgccggaagacttccgggtcctgctcgacgccccgtttgtccggacgtcggaaggcttcgtcgctctttcggccgggccaccgccctcgccttcgccgagcggggcgcctcgccggcgctgtgcgacgtcaccccggacagtctcgaccgcaccgccgaactcgcgcgcccgctcggcgccgaggccacggcccaccgggtcgacgtctcggtcgggccggcgatgaccgccttcgccgagaaggtcgcggccgggcggggcgtgccggacatcgtgggaaacaacgcggacatcggccactccggcaccttcctggagaccgccgagaaggagtggcagcgcgtcctcgacgtcaacctgtgggggcgtcatccacggctgccgggtgttcggcgcgctgatgaaggagcgcggccaggacggacacaacgtcaacctctcctcggccgccgcctgcctgccgtccgagatgccggccgcccacgccaccagcaaggccgccgtgttcatgctctccgactgcctgcgcaccgacctggccgccgtacggttcggcggcagcacgatctgccccggcatcgtgcggaccgacatcagccggaccacgacctcctccggcctcggcgcggacgaccaggccgcccggtaggagaagtccaccggcctctacgcccgccgcggcttcccgccggagaaggtcgccgcacagatcctgcgggcggtacggcgccggcgccccgcggtcccggtgaccctggagcccacactggcccgcgtcaccagcaggctggcaccggccgcgacgcggtgggggggcgcggatcggcctgtgaccggggccgctgtcaccttcccggtggaggacgcgctgatgaccacagcggtccgcacctggctcgatcgtcaggccgatcgcgccgctccgcgcacggtgaaagagggccggagggcggagacctgacgagtcgggtcctctggccggcgctggtcgagctgctcatgggcggccgggcggccg

SEQ ID NO: 90 - DNA, 24371 bp, Unknown
  Kingdom: Bacteria, Phylum: Actinobacteria, Class: Actinobacteria, Order: Streptomycetales, Family: Streptomycetaceae, Genus: Streptomyces
ctagcacggccggcacgggggtcacggccggagcccccggggccgccgctgggggccggcctgccggtacgggcggcaccgcacggtccccggccgcgctcagaaccgccccggatgcgccgccagccacgccttcgcggcttcccgcagcccggggccgggtgcgggggcctcgtccgggtgacgctcggcccacttggtgacgtacgggcacagcgagaccagcgcaacgccctcgcgctcggcggtggcgtacagctcgcgcgcaagggacccggcgatgccctggccctcgtgggccggttccacgatcgtgtggaccggcacgagggcgcggccgggcgattcgaggacgaagtactcgatgcggccgaccacttcaccgtccgcgacggcctccagccggccggcctgccggtcgtcgcggatctcggtgtcactcatcggtaatctcctcacagtctgcgggcgggcgcccggcagcggctgtcgggtcaggcgggcacggaccgcgggctgcgctcctggtccgagcccggtacgggcgcggaggggtcggcgcccagctccacgatccggttgtccgcgtcgacgtgcaccacccgcggctccagcgcccgcgcctcggcgtcggtgacctgggcgtaactgatgaggatcaccaggtcaccggggtgcacgaggtgtgccgccgcgccgttgatgccgatgactcccgacccacgctcgccctcgatgacgtacgtctccaggcgcgaaccgttggtgatgtcgacgatgtggaccagctctcccggcaggaggtcggcggcgtccagcaggtcggcgtcgatggtcaccgagccgacgtagtgcaggtcggcatgggtcacggtggcacggtggatcttggacttgaacagagtacgcagcactttggactcctggaagacggctccctgcctgctttgtgcaggtcaggggcgttgttcactgtacaccgacactcatcaccctcgaagatgctgaggaacatcgatctctcttggacaagaaggttccccgcctgcgcttccgcgtagaatctggctgttgtgccatcgctgtccaaggacccgctcgagcacctgcctcggagtatgcgaggactcatgctgaccagatgctgacttacctgacgatgcgccaggtaagcacttcgttgagcacggagccatcctctgcatcgacctgtgagtcgttcaacgaacccggcagcctggggcttcatccggccccaaagcattaggggctgtctgtagttgtgatcaatcggctttcaggaggctgctgatccagatggtcgctgcgcggagatggagtccggcgaggtagctttcgggtgtcttgtcgtagcgggtggcgatgccccgccgctccttcatcctgttgatggcccgctcgaccgtgttgcgatcgcggtagagatcggcgtcgtgggtgacgggcctgccgccccgcctgcctttcttcttgcggttggcggcctggtccttcttctccgggatgaccgcctcgatgcggcgtttgcgcaggtgggcgcggttggcgcgggaggagtaggccttatcgccggccacggcggcgggccgggtgcggggacggccgacgggcagacggacccgcaccctgctcaggaccgggatgaactgggggctgtcggcggcctgcccggcggtcagaaggagcgccatcggccggcagcgccggtcggcggccaggtggatcttgctggtcagcccgccgcgggaccgcccgagcagggcggccttcagccgggctcgccgtcgtaagcgggtgcgtcggcgttcggcgcggactggatcgatctcgccgtcctgtccgccttgttcctcgggcgctaccccttttgcgaggccgcctcttcgagcgcggccagggtctcttcactgacccgcatgccggctgcgtcgtgatgagcccgtgtgctgcgggcggcctcggcgatcgcctcgtccagcaaggcctggaaaacgcccgcgtcccgccatcgcatgaagcggttgtagacggtctgccaggcgccgaaccgctcgggcatctcccgccactgactgccggtgcggaaccgccagatcaccccctcgaactgctcacgcagccgctcggggtaggggccgaacctgccgaccggcaggaacggtccgatgaactcccactcttcgtcggtgagttgcgtacgcgtcacaccacagtcctaccggatcggcaggtaccgccgagcttgatcacgactgaagacagcccctaggcggtcgagtggacccgccactggctgccccaccgtcgtctgtggagcactcgatccgggcgcctcgtggttcaaaccaaaccggccgtcctgacctatgtctgggacaactacgaggtcatgcgcgagcccttgctgaagtggctcacgtccggggacggcagcgaggcaaacgagcacgtcgtggatgccatcgccgccctgaccctgcggcacgggaacatcggccatctcgtccaactcggacccccgacctacccggtgaagaaggaactcctcagcgcactcctggtccaggccgtccaggacgagcacgtcggccgccaggtatggagcattctgtatggctgggcatcggtcaaggaacgcgcgaccaccgtggtggccacctgccgacaggtcttgagcaccccagatgtcacctcttctcaggccaggatggccacggtccgcctacggcgagccgccaacagcgggcacgaatcagcctggtctgaggccctcaaagccttcgccgagcaggctcagcaccccgccgggatggcgcggctcatcaccgaagtacgcacatggcagcagtcagatcggtcccgcggggccggcaccgcggccttcctggccctgatgtccgtaccgggcaccaccccatggctgctgtccgatgaagtcccttccgaagtagacgtgaagcgggcactgcaggacctgttgggagacatcgctacggcgccggacgccatcaaccgcctcaccacatgggtcaggcagtcagcgaccgatcccgacgcctacgcccgcgtccgcgacgggttgctccccgtcctacgcggccaaaagatcttcaaggcttccgtgagcctgatgcaagcactggagcacgtatcggtcgacggggagacgaacgcggcgaacgacttctgggaccgtctcgtagacccacgtgtccgcacggtgtttcagctcaacagggattcggcgtgaggtggttctggcagcgccgggcccgtacgattcactgcacccagccacggatgctccgctgcgcgacccccggtatccacttcgaggccacgttcacgatcgagtggcgccccgcgttgcggacccggctcaatctcgaagacctcgtactcagccagaccctagcgcgggccagcgaggttgcgcagctcttcccagccgtcgaggtgcgcaccgcgcaggacaccatcaacgccgagctcggcgccccagaacacacccgcgccaccgggtaccggtgcctggctgcccctgtggaactggcgctctcggagaacgcacaggaagaccttgctcaacagcaggcagacgaggcacgggtacggcggctgcggttcctccgcacgaacctgtacgagcagcccgaccttttcgtgctggaccggatcgaaaagcaaggtgattggccgggcgctcagcaggttgccgaatggcagcgcctggcacggtggatggtcgcggctgacgaatggtggcagcccatgctcgaccagtgggaaaaggtcggccaaggcttcaacgacattgagctacagaaccgggccatgctcgcgctctgcgacgcgctccagaagctgaagggcgatgactcgccggacgactcctccgtcgcttctcgtgctgcggaagggcggcgcaaggaatgagccccacgctgtggcggatcgtcctggaccccgcctcttcctggcgtgcacttcgcctgcgacgcgaagcgggcagccaattgtcattcgatgcagcctggcggcaggcacggatgctggctgcgccagacgagatggtgtaccggctgcacggccaccagttccccatcgaggacgagggagaccctgcgcaaccggacgggaagatgtaccgccttccgtaagtacctgtgtcgcgttccgggccccgctctcacgcacatggtcggatgctggactgctgaggactcgacgggatcgagaacctcccccagcgcgggcgcggaccaccgcagacgtaccgggtccatggctacgggatacgtggaagggggactctgcctgacaaggaggcatcatctcggccggccgagtggacgcatccctcccggcttatgcgtcctcagcggcggcgtcgcgctcgacccagatccgctgcaggtcagtgcgtcgtgatcggcgctcaactagggctacggcgtctcgaaccacctcgcccagctcaaaccgatcgtgctcttcgccgcctacggctaccagcggaacggtcgtcgaagcaggttagcaagcccggacacgctccggcctggcactgggcaccgctaacccggacgcgatgaccatgaccggccgcggcctcctcctggctgacgtcctggccgaccactgaggtgcggagcctcgcccgccctcccgcaggaccctgcggcggagatcaaaaggcgcgcaggcgccagccacgatccgccacagggcttggatcacggctgagcagcgcaccccgcacggcacaatggacaccgtgagcgacaacagaacggatcttgccgacttcttgggcactcaggagaccgcgtcccttgagttcaaacgcaccgctaaacgcgaggggaaacgcggagacgctatcggaaacgcggtgtgcgccatggccaacgatttgggcggccacggtggtggcgacattctcatcggtgtcgatgacaagggacaccctgtcgacgacgtcgacctgagcgaccgagcactccttcagctcaccgagctgcgggacgacgggcgcatcctcgaccgtccgtcccttaccgtcgatagagccatctttcgaggcaaaccggtcatccgccttcatgtggaggcatgcgccactccaccagtccgattcgagggcgttatctgggtccgtcccggccccaccacacgcagagcgagccgagaggacgagcgtgtgctggcggagcgtcgtcgcgccaaggacatcccgttcgacacacggccgctgcctctcacccgcctcgaagacctagaccttgacctgttccggcagtcgtatctgccttccatggtcgcgcccgaggtgatcgaagagaacggccgtcccgtaaacctccagttgtcgtcactccacctcatgacgccggacggtgtgccgaccgtgctcggcctactcaccatcggcctcgacccgggcagccacattcccggggcgtacctccagttcatccgctatcagggcatggacctagacgcccccgtcgcggacgagcaggaactgcgtcagaacctggttggactgtcggcccggctcgaacccctgctgcggagtaacctgcgcactcgcctcgtggaggacggcttccgcgagacgccccgcccagactatccgctagaagcactgcgcgaactctgcatgaatgccctcatgcaccgtaattacgagacctcttacgcgccaactcgcattgtgtggttcgatgaccgtatcgaggtcaccaaccccggtgggcccttcgggcaggtccgggacgacaacttcgaccgggtcaccgattaccgcaatccttccctggccgccgcaatgaagggtctcggctacgtgaaccggttcggccggggtattggccgggttaaaaaggcgctagagaccaatggaaatccgcccgccgagttccaggtcgacgacacgtcctgggctgtcgtcatccggagagccgcatgacatcgatcgcgttgttcaacaacaaaggtggggtgggcaaaacgaccctcacctaccatctcgcccacatgatcaggcgactcggcctaagtgtgctggcggtcgacctcgatcctcaggccaacctcacctcgatgtgcctggaggaaacagagatcgaggaactgtgggagaactcttccgagcttatcaaccaaggcgcggcaatggcgggcctgccgggcacggggcgggtgcgtagcggtcagaccattgctgacgccgtccgtcccattctggagggcaccggtgacattgcggtcgtcgagccggttcggctccagccggacctatggctgctgccaggcagtctcgacctgagtcgcttcgaggacaaactgtccaatgaatggtcacgcgcctatgcgggcgacgtcgccgccattcgcacgtccacgtcgttccaccgcatcatcgagcaggcggcgcggtccgtggacgccgacatcattctgatcgacgtcggccccaacctgggtgccattaaccgggccgccctaatctcagctgacacggtgctaatgccgttggccgcggacctgttctcactgaagggccttagcaacctggggccgactctgcgccaatggcgcaccgattggcagtccctcgtcctgccaagggttcccgataacatctccgcccctcgcgcgagcatgcaaccgctggggtacgtcatcatgcagccagaaatgcgacttgacaggccagtaaaggcgtacgagcgatggctccagcgcatcccttgggtatattcctcagcagtcctcggtgaatccccgccctcgcgaggggacgatagccaccgtattgccaccatgcggaattaccgcagcttgatgcccctcgcgcacgatgcacgcaagcccatgttcgatttgaggccggctgatggtgcactcggcagcacccagcaatacgtgaaaacctgcttcaaggagtttaaggcgctgtctgaaggtgttcttgccaggctagaagatctcccccgagacacgggcgacgcgtccaaggttggttgacggttttcatccgacgagtacgtcatccccggctcggtcacccatcttgctcgacagatcgcgtgggaagcagcggtacagggtctctcccagggcttgatcaagttccggggtcggggctgttggtctggccctgaccggttggggtgcatagcagagcaggcacggacttcgtgatcattgaggtgtcgaagctcaacgatcatgaggtggcccgtgcctgccgctgcatcttctcccatccccgccgtgctggtgaaactggggcccctggacatcggacgagccgctgacctgcggccgttcctggatctggtacccgacccgcgtgcgcggcgaggccgctggtactcgctgaccgccgtcctcctcgtctgtgcctgtgcagccgtctcgggagccaggaccctcgacgagatcgccgaatgggcccagcgggcctcggacgcggtgctcacaactgtcggcgtccgccggcatccgctcaggtggcgtcgttctccctcgcaggccacgatcggccgggtgctagggagtgtgccgagttgagatcttcatgtgaggctgcggagccagatgaccgcgccgcgtaggtggagtccggcgaggtagctggtcggggtcttgtcgtagcgggtggcgaggccgcgccactgcttgatcttgttgatgcagcgttccaccgtgttgcggtcgcggtagagctcggcgtcatgggcgagggggcgcccgccccggcgccccttcttcttccggttggccgcctggtcggtcttctccgggatcaccacccggatcctgcgtctgcgcaggttggcgcgggaggagtacgccttgtctgcggccacggcggtgggacgggtgcgtggccggccgaccgggccctgcaccttgatgcgctccaggacggcagcgaagcggggactgtcggcgtcctggccgggggtgagcacgaaggacagcggacgacagcggctgtctgccgataggtgcactttgctggtcaacccgccgcgtgagcgccccagctcggcggcgcggagccgggccttgcggtgccggcgcaggcgtcgccgctcctcccgggtggcatccgcttgcccgtccggctcggctaccggggcgttctgtccctttgacgaagccccttttcctcagcgacggccttctccagggcttttggcaactccgcatcggcggccatcccggcggcgtgctggtgggcccgggccacggtggagtccacgctcaccaggccgaggttcacctgaccgcgcgcggcggcctcggcgatcatcgcttccatcagcacctggaagaccccggacctggcccaaaggtggaatcgcccgtagacggtggaccagggcccgtaccgctcgggcatgtcccgccacggaccgcccgtacgaaaccgccacatcacaccgttgacgagcctgcgcaggccggggatcggcccgcgctcgcccagcggcaggagcggttcgaacacagtccactcgtcatccgtgagatgaccccgagtcatcccgcctgttcaccggcccggcccgggcccggacagcgaaacagccaaacccgtgatctcaactcggcacacactccctagtcggggcctcggaaagcagccgctcttgaaccagggcacctcgtcaccggcacggcacaccgcgtggatacgcgagccggggagccgcagggtccacgagagctgcgcaacgccgtcagcaatcgcaatgatcaaggagacagccgatatggccgaccatgaattcgagcagatcttcccgctcggggacaccaacgacgcctacgccgagaacttcatcgggcagagctatctggctccgctgaccggcgggagcgtcccggtcagcaacgtgtccttcgagccgggctgccgcaacaactggcacatccaccatggcaccggtggcggcggcgaccagatcctgctgtgcacggcgggcagcggctggtaccaggccgagggccaggagcccgtcagcatgaccccgggcactgcgatccgcgtccctgcgggcacgaagcactggcacggcgcgaaggccgactcgtggttctcccacctcgccttcatcacgccgggagatgacgtcagcaacgagtggctggagccggtcaccgacgaggtgtacggccggctgccgaagagcggagagaacgcatgagcatcctgaacgagacctacaccctgtccaacggcgtcgagatcccccagctcggcctgggcacgtggttcatcgacgacgacaaggcccccgacgcggtgcgcgcggcgatcgagatcggctaccgcaacattgacaccgcgcaggcgtacggcaatgagcgaggggtcggagaaggggtccgcgcctccggcgtggcgcgcgaggacctgttcgtgtcgacgaagctggccgcggagatcaaggactacgacgcggcggccgccgcgatcgacgagtcgctggcgaagctggagatcggctacatcgacctgatgctgatccacgccccccccagccatgggacgacttccgtggcggcgactacgccgagggcaaccgccaggcgtggcgcgcgatggaggaggcccacaaggcgggcaagatccgcgccatcggggtgtcgaacttcctccagtccgacctggagaacatcctcgcccacgggaccgtggcaccgcacgtggaccaggtgctcctgcacgccgggaacaccccgtggacttctgcgcggagcgcaacatcctcatgcaggcgtactcgccgatcgcccacggcacgctcctggacagccaccagatcaaggcgatcgccgacaagtacggggtgagcgtcccgcagctgtgcatccgctacaccctgcagctgggcacccagccgctcccgaagaccgcgaaccccgagcacatgcgctccaacgccgacgtcgacttcgagatctccgaggcggacatggccgccctgcgcaccctcgacgagcgcgactacggcgagcacgccgccttccccgtctacagcggcaagtagacccgtccccgggccggccgccaccgtcacgccgcggccgtcccgacatcacgcctcggcgccgccgtcacgacggcggccagcccataccgatggagcaccgacatgacggacacgatgaaagcactgctgctcggccgcgggccggagtgggtactggacgacgtgccggtccccgagcccgggccgggcgaagtcctgatccgcaaccgcgcttcggcgaccaacaacgcggacctgcccttgctcgccgaagccgaccccactcacggcggcacaggcaaggagtccatcgccgggttcgagtacgccggcgagatcgctgcggtcggccaggacgccggcgactggaaggtcggagaccccgtcatgggaaccttcccgtccgcgttcgccgagtacctggttgccgatcaccgtttcgtgctgccccgcccccagactctggccccggaggtggcgtgcgcattgccgaccgcactgctgaccgagttcggagcgctcagcgtcgccggcttccagtcgggacagagcgtcctgatcacgggagcgtcgacgggcatcggcatgatcggcatccagatcgccaaggcactcggcgcatcgaagatcatcgcgccaccacccgcagcactgacgagaaggacctgctcaccaggctgggagcggacaccgtgatcgtcaccgggaaggacgacgacctggcccagggcgtgctcgccgccaccgacgacgaaggggtggacgtggtcctcgaccacgtcgccggcgacacgttcgccgcctgcttgccggcgaccgccctcgacggacacgtcgtgaacatcggccgcctcgccggccccgccacaacgatcgacctggacgccctgtccttccggcacctcaccgttcacggcgtctccttcggattctcccgcgattgggagaccgtcccgatcctggaaggactccgagccgaggtactgccgaccgtcagccgcggcgacatcacgcccgtcatcgacaccaccctcagcgccgagcagtaccgagaggccgccgaccggctccgctccggaaacacgatcggcaagacggtcttcacattcacgtaaggccccgaaccggcctgacccacatcgcgatggccgccaacagcagggacggcgtggacacggcccactccgcattccgcatccagaagatcgacttcgcactcagtcggctggaaggcagccccgacccggtgtctgcgtctgggccagccatgcccaagagggcgtcaacgtggcgctgggtatcctgcgcgatgctctcggcctcggtgaggaagccctcaccttccgcggcgacatcgagatcggctttgttgaccgtggagcgagacccagacctgagagggcgtttatgcaggtctggccctatatgcggctctcgcccctgccctgccttgagagctttcatcccgtaggcggcgaatggcctcctcgggacggaggccaggccgaccgactcgttcaccttcataaccggaagtccgtctggtttgaggatgccatggaatcgcccgatgggcggcggaaccgagtcctccggctcggctgtgatcacgctacgccgtgagtgagcgcaggccggatcccagcggcctgtccgacgcccgatgggccctgatcgagccgaccctggcggcctggaggaaagtccggctcgaccgcaggccaaccggacggccagccaaggtcgatttacgcgacgtcttcaacgcaatcctctacgtcaaccgcgcgggaatcccctggaaatacctcccgcacgacttcccgaaccacgccaccgtctatgcctactacgccgcgtggcgcgacgaaggagtcttcgcccagctcaactacgatctgacgggactggcccgggcgaaggaaggccgcaagcccgagccgaccgcctccgtgatcgacacccagagcgtgaagacctccagcaacatgcccctgaccagccagggaacggatgcagccaagaaaatcgtcgagaggaagcgcggcatcctcaccgacacgatcggcctcatccttgccgtgaccgtcaccgccgccggcctctcggagaaaaccctgggaatacgcctgctcgacaggcgaagaagacacacccgaccctctccaaaagctgggtcgacaccagcttcaagaacgccgtcgtcgagcacggcgcccgtctcggaatcgacgtcgaaggcgtcaacagaaaccctggcacccacagctttcacgtcgtgaaacgacgctgggtggtagaacgcagcatcggctggatcatgatgcaccgccggctcgcccgcgactacgaaaccctcaccaccacgggcaaggtcgtcacccgcgacagccagagcctgcttcagatgggccaggtccggaatgaccaccctctggcgaacgtactccggctcctgcacccccttgaccgggtcatccgccattgctcccttgtcgtaggcgtcccgcagaatcgccttgagcgtgcgcaggatgttgacctgattgccccggccgacgccgtcggcctccaactcgtccaggaaacgctccaccacgatgggggtgacggatatcagcttccgtgaacccaggcgcggaacgatatggacgttgatggagctgttgacgtgctcacccgtggagtattcggtcatccggtgctggcggggcagccactgcttcgcatattccgctaccgtcttctgccccagctcccggcgcgcttccgcgactgacggcgccgtgcgcttcttctccgcgtagatctgcgtgaggcgctcgatcgcatcgtcctgcgtgtcgaacccgccctcctcgacctgcttgcccagaccgttgcggaaacggatcgtgtacgggtgcgggcaccgcgtcggcctggcacagccgcagtccttgaagaacgaccccataccgcgagcgagctgacgagccacgtgacgcaccttccagacgggagccaggcatctgcgcccaggcacccgccgcgacggtcaccaagtcagcaagctcggacgcttctgcgcccattgctgaccacttgctgacctgggcgacccgatcattcctctgacctgcacaaacgcccagatgctagatcttggacttgaacagagtacgcagcactttggactcctggaagacggctccctgcctgctttgtgcaggtcaagggcggtcttcactgtacaccggcacgcgtcgaagtcgatgattgtgaggaacatcgcttgtcatttgggatagggctcactgcctggacttctgcgccatccaggctgttgtgacgccaccgaccaggtgcctgttcgggcagcctctcaggatgttcgggaactgatgctgaccagatgctgacttacctgacgccgcatcaggtgcagcggttacaggttgactcgccgcccgggagcacctactgccgctcggaagattccgcgaggaactcacgcagccggcgtcagacccacggctagatttccggaatcttctctacgaccgagacccccgacgcccccgcgaccagtgagccgtctcgttccgttgccacgacggggccgaccgagtgcttactgacttcggctcgtcaggctgacgttggatcgtccagagtcaggccggtgccggctatgaaaccgtcgagggtgtcgggccggtactgaaggcgcttgagccggttgcggacgagcatctcgagccgatcgagagcgaccacggcaaggttggccaggctgcgcttgacgtgcgcccatacccactccacggggttgaggtcgggcgagtaagcgggcagcaggaacaccgtcagccactcacgctcggcgatcagcccacgcatgacgcgggagacgtgggtgttcagccgatcccacaccagcacgatcggcgccctgacgagctggtggacgccgtcgaccagcgcgatgaagtcccgctcgcccatgctgcggcgcctgcccttgcccgctggatgggtccgtagacggtggcacagccgggtccgggaacccggtcgcatcgcgatcagcccggccaccgacaggcgccccgagcgtcgcccgctgaccgtcacgaccggggtgcggccgcgccggccccaggtgcgtcctttgggcggccgtcgggtgaacccggcttcatcctcgaagcagacgtagcccccgcaggccttccgttctagtggtcgttgcaacaccccagctcaaggggtgcgatggacttcgagatccggaacgagcggaagccgcagggccggaagaagctgacccgagagcgggccgcatacttccagctcatggagcagggctacagcactcaggaagcggcccggattgttggcatcaacctgcgtaccggtaggcggtggcgcaacggctggcactcgccgccgggaggcaagaaggcggtccctccgatctacccggagccgggacagacgcccccgagcccaccgaaatcggaggaaccgccctctcagccgtcgcggtatctccaggagaaggaccgcatccacatcgcagaccggctgcggatagccgccgagctgggccgcagcccctccacgatcagccgggagatacgccgcaaccgacggcccatgcccaagggcgggtgggcctaccagcccttccacgctcaccgccgggccgagcgccgtctcggccgccccaaggtgggcaagatcggccagaaccccgaactgccggacttcatccagcgccatctcgaacgccggtggagccccgagcagatctgccaggctctgcggactcaattccccgccaagccggagatgcacgtggtccacgagacgatctaccaggctctctatgtccaaggccgcggagaactgcgccgggagctgacccgttcgctgcggacaggccgggccttgcggcgaccgcatcgccacaacgccaagcgcatcagccgccctgtcaagaacatggtcatgatcagcgagcggccggccgaagcccaagaccgggccgtcccgggccactgggaaggcgacctcgtcatcggcaaggatggacgctccgccatcggcaccctcgtcgaacgcgcgacccgctacctgctgctcgtgcatctgccgcgcggccacagcgccatggccacccgcgccgcgctcgtcgacaccatcaagacactgccgacgcacctatggcgatctctgacctgggaccagggctcggagatggccgcccacagcagcttcacggtcgccaccgacatccccgtctacttctgcgacccagccagcccctggcagcgcggctccaacgaaaacaccaacggactgctccggcaatacttccccaagcgcaccgacctgagcctccacacccccgagcacctggcggccgtcgccgccgagatgaacagccgtccacgcaaaacactcggctgggaaaccccagccgagcgcctcgctaagctcccgaccacaggaacgtgaccagcagtgttgcaacgacccctcgaattcgccggccgcccgggctcttttacctccgcccaggtcccctccttccacgcggtcacggcctgctcgtcgcgctcggcgacccgccgcgcggggacctgtgggctgaagccgagccggtgcatcagcctcgtcgcacccgagacgctgtaggagacgtggaacttccggccgatcagcgtggccacccgagcagcggtccacacctgatcctccacccagccgtgcgcggccggcccctgctccagatacgcggccaacttttccaggcagcgcggggacagacggcaccgggatccgctcgggcctcggggggccagcgcctgcacgccgccgtcccgccacaactgatgccactggtaggccgacttcgcactcaccctcaggcgccgtgccacctccggcggcttgaacttctgctcgaacagctcggccgcctgcatccgcaccgtctcccggcgttgccgccccgcaggagtcagcccgcccccatccgcatatctcacccaccaggggatacaggcatcgctccgggtccctcacggacttcatgaaggttcaccccaacgagccgaaatcagtaaccctccctcggtcatcaccatcagtgccaagtctctccacggcagagcgagctggaaaagggccaacagtagagcgtcccgtcgttactcgattttggccgccgacaggacacgggtgtgctggtcgggtctcggtggggccaggcgcaactccggccccacctgactcatgagaccttggcctaaaggacgcccaacgccgtatgcaggaccggctccaggcgcaggcgcgtcccgtcccggtcgaacacctggagcgcctccaggcagacgacggcccagcgtgcctcctcggacgagagcccggccatctctgccgcggtgacgaggtaggcctcgtcatgccagtcggtaccgagctgctcgaccaccccgtcgtaggcggtcttaagggtgtcgttctccagcagccccacggcatcgataaactgttccgcgccgctgctctgctccagccacgacgtcaggtctgccagcactcggtcctggtccggtcggcgatcacgcagctgcagcgccttgtccagcaggtacggccagccaccggtcgcctccgccaggcgcgtcagccgttcctcggtctcgcacaggctgtggcgttgggtccagtccttcaggctgggcaggtcataccggcgcagcaccacgacggtgtcgtggtctgcgtcgggaccggtgaggaggccagaccagaagccgagctgttccacacccgacacgaggaccaccgagcgggtcgcctccgcggcttcgggcagcactgccctggccaggtcaaaggactcccggcaggacttctcgctgctctgcgagagatcgctgatgagcagtcgccgctcgcgggcgcggccgacggcgagctccttccggaacgccttggcgctgccgatcgcgggcacggaccagcccgccaccctgccggtcacctcacgcagagtccgttccacatccgcgacgccggtcccctgcgtaccgagaacgacgcggacctggttgacgtattcgcccagcaggtaatcgatctggttgacggtgagcggggccgacctgccgtcagagaggtccggacgactctccaggacaacggtctcctccagccgggactccgtctccgctcgcagcaaccgcgcctcgatctcctgggcagtaccgatcatgcgcagcgcgttgggcccccgcagatgccagccctgcccgtcgttgttcggcgccaggacaccgaggccgaccatctcctgcagataagcacggaaaccctcgctgtccaggtgctcgaagccgcggggccaccagccggcacattcctcccgcaactccctgtcactgagccgggtttccagaccgttatcccgggcatgctgggcaaggacattggcgatcacgtggtagcggtcgtcgagggcgagggtgtccttgaaggccgcggtgatgtccgagcgcagcgaggcgtcctgctccaccgcgtcgacatcggactcctcgatggtgtacggaggcggcgcgagtggtgcgcgtgcccgcttgtcctgcatgacctgcaccatccggctgccgaagatctgcagcaggaagggctggtacgagcagaagccgagcacccggttgacgaggtctacgtcggcgaactcaaggccgagcgcacgcatcgggtgcacgatcaggtcggcggcgaactgcggggtgagcggtccgacgaccgtcggggtctgcgccaagtggctgaacgggccgttcctggcgagccgggtgaaacgctgcaccgagtgcagacctgcgaagaccaccttggcccgcccgcgcgagtcttcacccagaccacgcaaccggcgggtctccgtgcactcggggacgtctgcctcgaaaaagcggtcgcactcgtcgaggaggatgagcagccgccggtcggcatcctgagcgagccaccgggcgatcccatcggtgacccgctgccatgcctcctgttgtggaccccggcgtcgaggctcctccaggactccctgcctgatcagctcctggtccaacgtgggccagatggcctcggcaccgagtgcggtgccccggccgatgccgatcttgtccaggttgaggtagagcttgcggtaggaccccggcctctgctcctcgaaacggtcccccgcgtcggcgagcagggccgacttgccgagaccccggccgccatagaggatttgggtccccgcagggtcgtggatgctcttgcgctcacggtcccgtccgtagaacatctcccggccgatctgcccccgtttttccttgatgtacgggttcaccgcggagaacggcagcagcgtctcggtcgtggcgtccacccgccggttgccgtgcgcgatgaggtaggccagcgcggcgtcgtccaccaccatgatcggcttggtgtcctgggaggcggcggccagctcagttcgggtcctgctgtccagcgtcccgaagtggacgaccagcagactgctctcgtcggggtcctgcagagcgcgggtgatgagcagtttggccgcgggccggccccagatcagcagggcgcggagcttgccgccacggtccttgatctgcgatccgaaggcgggcgcccaggcacggccggtgacgtgcacgggtgcgagttcgaagaaccggtagtccttgccgcgcggtaggtcatccagaggccgtgcgcgccgcgcctcgtatccgaggagggccagagccggattgagactctcgcgtggattgatattgatccggtccttggtcgcggcgagcgtgctccacaactccagtgctgcggtcgcccgttcggcctcctcctccgaaagtcctgcatagtccagcacgacgttgtcgccgtaccggccacgggcgcggacggccgcgatcagctccgcgtcgataccgcccggcaacgagtccggcacggcgggaaagaaggcttccagatgcgagtcctcggacctgatctccggtaccggctcacccagttcgaggaaatagaccagttcagccgcggtggccaggctgtcggtgtccagattgcgcaggactcgttcgcgatcctccgcgctcacgtccgtcagcgcggccagccgggcacgcagacggtcagcagcttcctcgcggtagcggggcagcagctcctcgactcggtcgaggttgcggcggaccgcggccagctcgcccggccggccgtgctccaagtgtgctcgggcgtccgcgagcagctcctggaggctgacgtcctgttcgacggtgagtgcctcgtcagcctgtgaccggcggagccgagcggccagtcgccgctgcttctcggcgagcgccgcgcggcgcttcttctcgaacgcgctgaggtgtgcgcgacgctcctccaagagcgacaaggtatgggccgcaggaaggacgccgaagtccgcgaggtccgtgatgatgcgaatcacaccgaattcgtcacgggcgagctgctgctcaatcgcgtcgtcccaggtacggtccactgcattcagcaagcggtccaaggccggcttctcgccctgcacggccggctcgtccttgtggagctcgacgtccaaaaccgtctgaacgtccggttcggctcccgtctcgaccggtcgactgttcgcatccagcccgtcgaagacctcggcgaacaggtcccgcgccacgtaggcggtggctttcgccaggacggcggagctgcgttcggccgcggtgagatcgtcggcgacccgttcacgcaggccgaggagggagaggcgcagggatgcgacggactggaacgcccacacgttctcctccgcgcgtcctgcttccaggtcgcgcttgaccgcacgccactgccgtacggcatcccggacgcgctctaggcagtggcggacgttgttgcggcccgacccctggatgccacgaccgcccgggccacgcagcgcagcgtccatctcgtcgatcgccgcctcgacctgaactcggcgagcgaggttctccagcagctcgtcggccaggtgctcggcgtccggggcaccggccacgatggcggttagcacgctgccgagcagaccggtcggcgccagccagcgctgcaccatggcgctggcccgttggaaacgcaaccgaggcacggtaagcagagcctggcaggcatccacagccgcacgcagttcgccctcggtttgggagacatcggcgacaacggcatggggcggcgcgatgagtagtgctccctgcagtgcgcgttctgccaccatggtggccacctcgtgcagggcatcgggcagttgcggggcaagcgccctcagctgcgcaccgaccacgggcgcaccagtcacgagggccgcgcggaccagcgtgggcagcaggagcaaggacagcgcgtcgctgtcgctctccttacgggcttcccactcgtgcagagcctcctcaatgacctgagccgctcgcccggtcctggagtgcagcagtgtcgccgcggcggccaggcgcaggaccgtggactcggtgtccgggcggccggcggcctgcgaaaggtgggcggcaagcccgaagcgcttctcggcgatgagccgggcgaggacgggttcaatgtccttcgttcccgtgtcgtcggcggcacccgtggtgttgtcgacggcagcgctcaccgcgggggcggccgcgacccgccgttccggcgccagctgctgctcgtcggtgtcggcggaccggggaggtcgctcggccgggacggaatcggcagtgctgtggtcctgcgtctcaggcgcgccgatgtcagcctgtgcggcggtggccgcctccgaggatgtggccagtgctggcgcctcgggaacctcggcggagtcctcgccctgcggggcggcggccgtgtcgtgggtggtggtcctgtcctcggtcagcgaaatctggtgatacaggacggcggccacagcgtacggcggatgtgcgaccgacaactgctgttggagttcgatgatctcctgctgtgcgcccaaccggtccttcatgccggcgaggcgcaccagcagcgtgagaacatgtgcgtacgcgtcgtcctgttcgtcccactcctgcttcgcgagcagtgactgcgccctcagcctggcgtccgcgatcaccgcggccaccgcactgcccggagagcagcctagagccgtcaccgtctccaccacgtgacggacctcggcgttcctctccttccgttccacgcgtgcacgagcctcgtcgatcgccctcaggacgtcggtgaggcgatcggtcacgccggtgacgccgagtgcggagagtacgcctagcgcacgggagaacgccggggcgacggtggcgagcgacgccagatccgtgtcggcgggcgggcacccgtcaagcagtgcggcgctcacgcggtcggcggcgcctcgggccttctcgacgacgtgcttgaccttctcctcgacgaaggccagatcgtccagggaacacccctcatcagggggctgctctccctgctgcactgaggactcggccaggtcgggaaccgagatgtgatcgggccgccggggaaccgggacagcagcggtcggctgagtttcctgagccgccgcatcctcgtccatcgcggtgacgttgtcgcacccgagagtcgcgtcgatcacctgctgagcggccttgagtacggcggccagtgccgcctcgtccgcctccatgccgaaccagtcgtgttccgcggcccataccagcagtcgggcgtcgtgtgccgaagcctgaaggtgggagaagagcgccaaacggagcaggcaggtaccccagcggtctacgagaccggggctcgtgtcggcgaccccgcgctcagcgaccacgtgatcgatgtcgttcatgatccgggcggtgagatgggaggcggcatgcctgtggtgagtcggctccatccgctgcaaccgcttgagcacctgctcactgagcacgcgcccgaatcgccgcggctcgaccttgcgaaagccgaggcccctcatgatggcctgacggtccttggggccaagggagttcagcgcgagttccgtctcgccgaccgtgagagcgtcgagggcagcgtccaaaacctggccgagcccgtcgagcgttgcggcgagttccttgagcagtccaatcggtgtgccgtgcggggagtacggtggcttggcaaccgcgggatagctgacggtcattcagtcccgatctcttgtttcctgtgatgtggatgggggggtgtggcgtgtggcgagcgcatgcccggccgatccggccggggcggatcagcgccggcgggagtgttccgtgacgaaggtgtagccgggcggcagttcccagccgtctgcctttccgacgtggcggcagtgctcgcggtaggcagcgcgctgggcatccgtcggattcgagcccgcaggcagcctccgcagaaagccgtggacgaagtgtgcgacaccgtggacctgcggcggcacgccagcgcccgagcccggccgtggcaccaccacggggttcggcgcgtaaccgatcagggcgatgggcggctcaccgtcgcgggcaggatggtggggctcgccgtccgcaccgcggctgccgatagccgggtacaagtagtcctcggcgaggagctcgtccacagcctgctctagtgcggtggcttggtggggggcgggagttgtgccgtaaacgcctcgagggagggcggcccggtcgaggagggcatgtccgtcgggcgtgaggcggccgaagcgtcgtacggtacgcaggacgagacgccgggtgtctaggccggcggacgaatcaccgtcccggtcactacccggcgctccttcccgggtgagcactcccgggtcgtagcggtgcgcgacgagctgcccgtcgatgtcgacggggtgttccagttcgacggtgtggacccggaagacggtgccgccgcgcggccactggatgtacaggcacagaccggggaagaagtcgatgggccactggaggttccggagcatgccggtctcatcggtgaggtccagaagcacctcctggacctcctcggacgcgtcgagctcgccgccgggatggctgagttccaggcgtacgcgcacgggcacggtatccatgccgagatatgccaacccgtcccggaccctggcgctcaacggcagccgatcctccatgaggtgggcgagacgcagtggggtctgccagcagacttcgctgtcgttgatcctcaggtagttcggcggaccgatccggtcaccgtccacgaggggggcgtccgcgggttcggcatcgatatacggttcgtcctcaggctgttcctctcgagggacactccgtgcgttcggcaccgcgacaggctggggtggcacgggtggatgcatcgtgtcgtgccagccgcgccccgccgggcgcagcggatcactgtcgtccgcttcctccgagcccgggtggtgggaccgccagatgccaccgttctgaaagtcgtcgtcgagggtgatccgtacatcgcttccggcgcgtatgccgttgtccgtgtctccccggacgaagtccgcgaccgccaggttggcgcggcacaccgagaccgcgtattccactcccttgagcagtggttcggcgccgtggacgccccgcagccagggcccgatcgccgtgtacacggtgcgggaaccgttcaggccgtgccgccggcggatggcaggggctgcactgcgttccagggagccagcaagggctctcaggtcgtcgccgcccagcggcccgtcccgacccagggcggccccgatgcgggtacgagtcagtgcgtagtggccccagctgcgcaggctgtcgctggtgcgcaaggcgtgatcgacggtgtccagcagcccgctgagggcattcttcagccgctcctccgtgccacccccagccaggtgggcgacggacacgggaacgagggggctcaacagtgcttcccgctggtgagtcagcaggtgctgcacgaaggcggtgcagccatcgagcccggcctgcggcgccgagccgtagcgggcgtcgacgacgacgtgaccgtccttgttgagccacttctggcgggcccggaaccgctgcaacttcacctcgtcgagctgcagcgcggagccgaaggccgcgaggtcagggaccagcagctcccgacgcactgggtttggtgcctccgacagctccttcggtccccgggcaccggccggtgccccgg

SEQ ID NO: 91 - DNA, 4841 bp, Unknown
  Kingdom: Bacteria, Phylum: Actinobacteria, Class: Actinobacteria, Order: Streptomycetales, Family: Streptomycetaceae, Genus: Streptomyces
ccgcggcgccgcgccgcaaggcaccccgccgcaccgccgccgcctccacggccccgtcccgcacgatcaaggcgaagttccccggccgctgcctgtgcggccgctcctacgccgccggcgagtccatcgccaagaacgcccagggctggggccacccggagtgccgtacggcggacgcctgaccggcccggggagcacgcaccggtctacggcgagcgagcgcggagcatcgcggtgacagtgcgtcgcggcatgcgcgcactctgttactcttcgttgcccatcgaccggtctccgtagtcatcaggggtgcgcgtgaaggtcgcctgcgtcggcggcgggcccgccggcctgtacctctccatcctgctcaaacggcaggacccgtcccacgagatcaccgtgcacgagcgcaaccccgagggctcgacctacggctggggcgtcacgtactggcagggactgctcgacctgctgcacactcacgaccccgagtcggccgccgccgtggaggcgcactccgtgcgctggcgcgacggggtcgcccacgtcggggacctgacggcccgccaccgcggcgaccagggcttcggcatcggccggcaccggctgctcgagatcctcgccgaccgggcccgcgccctcggcgtgcgggtggagttcgagagcgagatcaccgcggacaacctccccgcggccgacctggtggtcgccgcggacggcgtgcacagcgcactgcgcacccggcacgccgcacacttcggcacccgcacccacctgggccgcaaccgctatctctggctcggcaccacgaaggtcttcgacgccttcaccttcgccttcgtcgagaccgcccacggctggatctggtgctacggctacgcgtacgacgccgggcacagcaccttcgtcgtcgagtgctccccgcggaccttcaccggtctcgggctcgaccggctcgacgaggccagcgcggcggccctgctggagggcctcttcgccggtgtactcgacggccaccgcctgatccgccgcgccgccggcaccggcggcacaccctggctcaccttccgcaccctcacgaaccgcacctgggtccgtgacggcctcgtgctgctcggcgacgccgcccacaccacgcactactccatcggcgccggcaccaccctggccttggaggacgcgatctgcctggccggcgccctgcgcgcgcacccgagcctgcggccggccctcgccgcctacgagcaagagcgccgctcggccctgctgcccgtccagagcgcggcccggcacagtgcccagtggtacgagaacctgccccgttacatccacctgcctccgcaccggatgttcgcgctgctcggccagcgccactcgccgctgctgccctacgtaccaccgcaggtgtactacgggctcgacaaggcggccggccggctggcggcggcgcgacggctgaagcggtggctcggaccgaggctcgcgcggaccgtgcaggcccgcgcgcagcagcgttcgcaggcccgttgagccgcagggccccggcccgcgctgtcccgcaggtccgttctccggtcgcacgggccgcgggaacgccgttccggcggacgccgggtgacagactggcggcatggaagaacgtgaattcggcaggttgcaccagcacgtgtcggtcgtcgggctcggcacctggcagctgggcgccgactggggccgcgtcgacgagaaggaagcacacgccgtgctggaggccgccgccgaggcgggggtgaccttcttcgacacggccgacgtctacggcgacgggcgcagcgagcagaccatcgccgccttcctcggcggccggcccgacctccacgtgctcgtcgcgaccaagatgggcaggcgcgtcgagcagctcccgcagaactacgtcctggacaacttccgcgcctggaacgaccgttcccgccgcaacctcggcgtcgaccgcatcgacctcgtgcagctgcactgcccgcccacgcccgtgtactccaccgacgaggtcttcgacgcgctcgacaccctcgtcgaggaggagcggatcgccgcgtacggcgtcagcgtggagacctgcgccgaggcgctgaccgcgatcgcccggccgaacgtggccagtgtgcagatcatcctcaacccgttccgcatgaagccgctgcgcgaggtgctgcccgccgcgcgggaggcgggcgtcggcgtcatcgcgcgcgtcccgctggcctccggtctgctgtcgggcaagtacaccgaggacaccgtcttcccggccgacgaccaccgcacctacaaccggcacggtgaggcgttcgaccagggcgagaccttctccggcgtggacttcgccaccggcgtgcaggccgcggccgagttcgccgcgctcgccccacagggatgcaccccggcccagctggccctgcgctggatcgtccagcagcccggggtcaccaccgtcattccgggcgcccgctccgcgcagcaggcccgcgcgaacgccgccgtcggcaagctgccgccgctgcccgaggagacgctggcggccgtccgcgacctctacgagcggcggatcaaggaccaggtggagggccgctggtagaccgccggccgcccacggcccggccgtacgcgcccggcgcgccggacgcgtacggcaggtttcccgcctcccggggaagacgcggggggacagggccggccggtacagggcctggccacgggtgcgggaggcggtgccatggcgacggagcgggcggcggaggaacagcggcgccgggggcgtgacgagacggaggaggagcgggccgaccgcatgtgggtcgagctgatccaggaggtgcgggtcgcgcagaccggggtgcagatcctcttcggtttcctgctcacggtggtcttccagtccacgtacgcgaccctcgccccggccgaccggaccatctacgtcgtgacggtcgtcctgggcgccgccgcgaccggtgcgctcatcgggccggtctccctgcaccgcctggtctccggacgccgggtcaaaccgcaggcggtccgctgggcgtcccggatgaccttcgcgggactgctcctgctgctggccaccatgaccgcgtccctcgtgctggtcctcagggtggccacgcacgacgggctcgtaccgtggctggtcgcaccggtcgtcgcctggtacctgctgtgctggttcgtgctgcccctgtgggccaggcagcgccacacctcccggtgagcgccctttggactcggcctctccacctcaacctcagcttcagccgaaggcttcccggagagcgggcagcaggctcttcgccgaccagtccaggaacggctcctgtgtgtcaccgccgatctggaccagcgcgacctcggtgaacccggcctcggcgtacggccgtacggcctcgacgaacgcctccggatcgtcgccgcacggaatcgactccgccacgtcgtcccgggtgacgaactgggtcgccgcctcgaacgagtccgggtgcggcagctcggagttgaccttccagccgctgccgaaccagcggaactgctcgtgcgcgcgcccgatcgccgcgtcccggtcggtgtcgtagcagacgggcagctgccccacccgcggcttgccctcgccgccgtgccggtcgaaggcctccagcaggccgggcttgggctcggtggcgatgacgaggtcggcgaggtgcccggcgagcctgcaggactgttcgccggagacggcgacgccgatcggcggcggctcgtccggcaggtcccacagccgggccgactccacgtcgaagtgggcgccgtgccgggtgacatgcccgccctggaacagtgcccggatgatctcgacggcctcctccagacgctcgtggcgcacgtccaccgagggccagccgccgcccacgacatgctcgttgaggttctcgcccgagcccaggccgagccggaacctgccctgcgacagcagctgcaccgtcgcagccttctgcgccacgaccgccgggtggtagcggaacgtcgggcacgtcacgtacgtcatcagcgggatccgtgtggtcgcctgggccgccgcccccagcacgctccacgcgtacggtgcgtgaccctgcgcacgcagccaggggaagtagtggtccgagatgaccgagaagtcgaagccgacgtcctcggcccgcaccacgtggtccaccagctcacgcggaccggcctgctcggtcatcatcgtgtatccgatttgcaccatgaccgccgagtccccggccggcgcagccggaaacggccttctcagcgcagcccgaaccgttccgcccagtccaggatgtccgtgaccgacgcgttgccgccgcacaccacgagtcccagccgggcgtcggcgccgacccgctcgcgtacctgccgggcggccggcagcagacagccggcggcgggctccgtccacaccttggcgtgctcggcgaggtcgagtacgccctggacggccgcccggtccggcaccacgagcacctcctcgaccaggtcgcgggcgtgctcgtacgtcagccgcgacaccgagggggcgctcagcgtggtgacgaccgaggagaggccgaccggcacggggccgcccgccgccagcgcctgcgacatggcctcggcgccctcggtctccacgccccagacccgtacgccgggccggagcgcgcgcagcgccgcggccacacccgcgatcagcccgccaccaccgacgctgacgagcacgtccgtgagcggaccggcgtcctcggccagctccagcccgaccgtgccctgtccggcgatcacgaccgggtcgtcgaagg

SEQ ID NO: 92 - DNA, 7110 bp, Unknown
  Kingdom: Bacteria, Phylum: Actinobacteria, Class: Actinobacteria, Order: Streptomycetales, Family: Streptomycetaceae, Genus: Streptomyces
cgcggccgaccaggaccacctggccgcgcgggtgtcgaggacggtggcggggcgggcgccgtcggcggtgaggcggaagaacgcctcgaagacgtcgccgccgggtgcgcagcgcgagcgggatgcagggtcggcggggacggcgagggcggtggtgcgcggggccggggcgtaggtgtggtcgcgggcggcggccagggtgtgcgcgaggtccttcgggcggccgtcgttcgtgaacaggccgagtgtgtactcgagttcggggaagtcggccagctcgcgggagacgtcgtgcgagcaccaccaggtgatgccccacaggtcggggcagtccagtgcgttggccaccgtcgcctcggtgaaggcggcggcgctttcggcggggatcagcggggcgggggcgccgacctcctggagccagaccgggcggtgcgggtcgtcggcccaggccttgctcagctcgatcaggtaggcggcgtggtgctcggtgggcacggaggtacggccgtggcgctgggcggtgccgttgaagatccaggagtggacggcggtcagggcgccctgccgggcggcctgggcgggggtgaacggcatgtcgtcctggtaccaggtggcgtcgtactcggcgtgcaggtgctgcttgccgggggcgcccttctcgcaggcggcgagcatgcgctccagccaggcgtcgatctggtcggcggtggcccggtcggggtcggggtgggggccggccgagaactggttgacctcgttgccgagcgtcatgccgaggaagttggtgcggtcggcgagggcggcggcgagggtacgcaggtaggcggcctggccgtcgaggacctccgggtcggtgaagaggttgcggcggtgccaggtgcgggtccaggcgggcaggaagtcgaagctggacaggtgcccttgcaggccgtccacgttgacgtcgagcccgcgttcgccggccgcgtcgaccaggtccaccagctgctcgacggcgcggggccggatcagggcgcggtcgggctggaagtaggtccacagcgggaagacgcggacgtggtccaggccgagggcggcgatggagtccaggtcggcgcgtacggcgtcgaggtcgaagtcgagccagtggtggaaccacccttggctcggggtgtagttgacgccgaagcgcacggcagaagacatgcggggtccttgcgggtggggtgcggtgtacagcttgggagctgcgatgacgtgcggccgggggcggtccttgaggggcctcgcccctcagcccttgacggcgccctcgccgaccccgcggaagaagtagcgctggagacaggcgaagagggcgatcagcggggccacggcgatgacggtgcccgccgcgacgaggcgttcgtcgttggcgaaggtgccgtgcaggtagttgaggccgatggtcagggtgaacctggacgggtcgctgagcacgatgagcggccacaggaagtcgtcccaggcgcccatgaaggcgaagatcgccacgacggcgagggtgcccttgaccgacggcagcgcgatccgcaggaaccgctgccagacgttggcgccgtcgacataggcggcctcctcgatctcgtagggcaggttgaggaaggcgttgcgcatcagcagcacgttcagggaggcaatggcgccgggcagcaggacgccgacgagcgtgttgttcaggcccagttcccgcatggtcgtgaactgggcgatgatgatgccctcggcgggcacgagcatggccagcacgaagacgagggtggccaccctgcggccgcggtagcgcagccgggccagggcgtacccggcgagggcggagccgacgcagttggtgacgacgttggcggcggcgaccttgagggagttgaaggcgtagtcccacaccgggatcgtgtcggcgacccgctcgtagttgtgcagggtgggatgggcgggcaggaacttcggcggggagctgaagatgtcctcggtgggacccttgagcgaggtggacagctgccacacgaacgggcccacggtcagggcgagtacggcgagcagcagcacgtagcgcaggacgagttcccacacgcggtagcggcggccgttctcgtcggtgaagcggggcttgcggggaggtgccggcaccttggcggtcggtgcctcggtggccgtcgccttgccggccggtgtgtcgacggtgctcattgctcctccttccggtcggcgcgcaggacgagcagcatcaggacgacggtgatgacgaagacgaccagggagatcgcggaggcgtaaccgacgcggccggtcaggccggtgccggtgcgctggatgagcatcacgagggtggtgtcctcgccggccgggccgccgctgggtcctgccatcaggtacacctcggagaacaccttgaaggcggcgaccgaggagagcgcggcgaccaggaccatggtggagcgcacggccgggacggtgacggtgaagaaacggcgcaccgcgcccgcgccgtccacggcggcggcctcgtgcagttcgcggggcacgttggcgagcgccgcgaggtacacgatcatgtagtagccgaggcctttccagaccgtgacggccatggcgctgatcagcagcagccactggtcgctgaggaagccgaccttgcccagcccgaccgtctccaggagcgagttcaccaggccgcgttcgtccagcatccacacccagatcaggccgaccacgacgatcgaggcgacgaccggggtgtagaaggcggaccggaagaaggtgatgccggggatgttcttctgcaccagcatggcgagcagcagcggcaggatcaccagcgccgggacgacgccgaccatgtacagcacgctgttgcgcaggccgatccagaaggcgtcgtcgtgcagcagctcgcggaagttggcgacgccgacgaagtggcccgggatcagggtgcggcggtcggtgaaggcgttgatcaccgtggagacgaacgggtacaggatgaaggcgccggtgaccagcagtccgggggccgcgaacagccagggactggtgggaagttggcgtcgtacccgggtcgccgggcgaccttcggcgcggcggccgggccgccggtccgggcgcgcggcgggcgcctgggagacggtcgaggtggacatggtgcgttatccctgctgcttcaggagctggtcacatgccttgacagcgttgtcgagcgcctccttggggctctgcttgccctggagcgccttggcgacctcgttgcgcagtgcggtcttcatctggtcactgaagagcacgggcgtgtagttgaccgcggtcttcagggacttggcggcggcgatgcgcacccgggtctcgtcggtgccgtcctccttggtgaagtacgggtcgtcgagggagcccgcggtgctcgggaagatggcgaccttcttggcgaacgacatctggtgctcggcgtcggtgacgtagtgcgcgaaggcgacggcggcgggggtgttcttggtcttggcgttcaccatcacgcccatcacgtacatgttgacgtgcccggtgctggtgatctggtcggtgatgccgatgttcttgtacaggttcggcgcctgcttcttgaagttgtccaggtccagcgcgctgcccgggttcatggcgacggcgccggtgaggaacttcttgccggtcgactccggggtggcggtgagcgcctgcgggtcgagggccttggcgtcgtacaactgcttgtacttggtgagcagttcgacgcccttggcgtcgttgaaggtgaagccggtgccttccttgttcatcagggccgagccgtagcggccgaagtcctcgatggtgggcacgttggcgagggtggcgaccttgccgccggacttctgggccagctggagggcgtcgctgaagagttcgtcgtacgtcttcggcggcttctcggcgtccaggccggcctgcttgaacagcgtcttgttgtagaacagcgggccggtgttcaggtaccaggggaaggcgtaggtgccgggcaggccggggacctggtggctggcccaggcgccgggcaggtactcgctcttgtacttggcggcggccttgtcgaggtccatcgcgaggcccgccttggcgagcggcgcgaccaggtccggggagacgttgacgacgtcgggcagggtgccgccggccgcgtccgcgctgatcttgtccgggtagccctcggcgggctggtcgacccacttgacgtgcgtaccggggtacttcttctcgaagtcggcgaccaggccctcgaagtagtccttgaagttggcgcgcaggttccaggtctggaaggtgatgttgccctcgaccttgccggaggcgtccgtcgaaccggcgtcgtcgccgccggagccacaggcgctcaacggcaggacgagggcggtgatggcggcggcggcaagtgctctgcgggatatgggcacggtgacacggctcccttgcggcgtcggcggctggtgtcggcagtgacgatgcatgccgagttcgtgaaaagtcaatggattcggccctgctaatgcaacctcggtcacattagtgcaggtcaggcgtgtcacggaagggacttgccagtcaggactaatgcgctttagggtgcttccactcaagcgctttagcgatcaccgctgggaaatgaggggaacatgccggccaagcgctccccggcgcgccgtccgacgatgaaggacatcgcgcgccgcgcgggggtctcggagagcgccgtctccttcgcgctcaacggccggcccggcgtctccgaggtcacccgcgaccgggtccgccgggtcgccgagcagctgggctggcggcccagcactgcggcccgcgcgctgtccggcgagggcgccgccaccatcggtttcgtgctggcgcggcccgccgacacgctgggcgtggactccttcttcctgcaactggtctccggcatccaggaagtgctctccgagcgccatctcgggctgctcttccaggtggtggaggaggtgcccgacgagtgcgacgtgtaccgcaggtggtgggccgagcaccgggtcgacggcgtgctcgtcgtcgacccgcgcaccgaagacccgcgccccgacctgctcgacgaactcggcctgcccgccgtggtgatcggcggcgcgcccgacgaacgacaccccggtctctccacggtgtgggcggacgacgcgggcgcgatggcctcggtggtggacgggctctacgggctcgggcaccggcggatcacgcacatcgcgggcctgtccggcctcgcccacaccgaacgccggatccgcacgctgcgcgccgaggccgagcggcgcgggctgaccggcgtgcagtcggtgaccacggactactcggacgccgagggcgccgccgtcacccgccgcgtcctcggctcgcccgctccgcccacggccctgatctacgacaacgacgtgatggccctcgcgggcgtcgccgcggcgaccgaactgggcttctccgtgccggcggacgtgtcggtggtggcctgggaggactcggccctgtgccgcatggtcaagccctggctgtccgccctgtcccgcgacagcatggagttcggccgcacggcggcccgggaactgaccgccctcctcgacggcggcccggcccgcacggtacgggtcccggtcccccgcctgatcgaacgcgagagcacgggggcggcacgggacgcctgagcggcggccactgcctgaccggaccgggccgggagcgggcctcccgagggtcccgggccgtcagcggcgcggtgccaggtgcagcaggggggcgccggccgggaacaggtacttggcggccagtacggggcggccggacacggcgacggtctgggtgatgatgagcgccggggtctccggggggcgggaggtggcggcgccgcgttccttgccgagcatggtggcgcccagggtgctgcgggccgtcatcgaccgcggggcgacggcgaggaaggcggcgagcatggtggtcgccggcccgtccggagcggcgtcgaacacggcggccagagccggatcgacggcttcgaggtccgtgcggtcggccgcccactcgtgcgcgaagcacgccgcggccccgtcgacgtcgacgaccgtctcccagaagcaggcgcgcgccgagggcgccaggcgcaggtggtagccggagaagtcggtgggctcctccaggtcgacggcgagccgccggcagcgtacggcgccggggccgagcaggtcctcgacgggcagcagccgctccagaccgggcgcgggaggcagctggttcaccgtgctgccggagccctggcggcgggtgatgaccccgtcctcctggagcaggatgagcacctcgcgcagcgcgggacggctgacgccgagccgcgccgcgaggaccggttcggagggcaggcgggcgcccggcgggaaggtgccgtcgtcgatcgccgcgacgatgctctggtacagctcgacgcggggtgagtggcggcggtctccctgccgaggcatcgaggctcccgatatatgtctgacatttatggcggcaccggattgcggctgggtcaaccatagcccgtgcccccgtaggccgtccgagcgagccgcccggacctgcgcggcagcatcagccatggcctgacgcatgcgggttccgccgcgggcggtcctgcggtgtgcgcgggatcactcttgtgtccgcagcgacggcgtgcgtaccctctcgccagctcatcaaagttgtcagacaaattacggggcttgttcacccggccgtcgctcccccggcgccggcccccgccgcaccctgaaagagacgccatgtccgtcaccgcctcccgtccgctgctcatggactgcgacaccggcatcgacgacgccgtcgcgctgctgtacctgtgccagaccccgggcgtcgacctgcgcgcggtcaccaccgtcgcgggcaacaccagcgccgagcgggccgcgctcaacaccctgcaggtcctggaggccgccgggcgcaccggcgtcccggtcgcctccggcgccgacgccacgctgcgcggcgtcgtgaacgccgacgcgagtttcgtgcacggcgacggcg

SEQ ID NO: 93 - DNA, 4442 bp, Unknown
  Kingdom: Bacteria, Phylum: Actinobacteria, Class: Actinobacteria, Order: Streptomycetales, Family: Streptomycetaceae, Genus: Streptomyces
gcgcgggagggtgcgtaggggccggaaggggcggccgtggagagttcggtgagccggccggccaggcgttgcagcaccgtgagggaggcgagcgcggaccgttcctggtcggcgctgcggagccggaaggtgagctggcgtatcaccaggccgctgacgcgggggttctgggcgaggaagcggcggaaggcgtcgccggatatgagccgggcctcgacgggtccgagtgcgcgcacggtggcgctgcgcgggtgcgggtccaacgcggccatctcgccgaggagttcaccgggaccgcgcaggccgagtatcagccgggtcgcgccgcggtccgtcgacaccgagaccgtcacccagccgctgtcgatgatcaggacgtgggtcgaccggtccccttccgtcaggagatgggcgtcggccgggtagtgcttgcggctaccgagcgccagcacgctctcgcgctcttgggcagtcagggcgtgcgcgaacgcctgctcaccgccgagcagccccatgccacgccccccgccgcagtccggatgcctgtgcctcgttggcgatgatggtgacagagagtcggtttagggcgagtgaattacgccacattggcgtactgatcagtaaggtgcgagcgggcaggtggaccgcccggccgccccgcggccgcccaccaccccgtcggtcctggcccgctcaggggccgtcagcggttcgtcgcccctgcggacgatggtgaggtcagacccggcgcggcggcggcgcgcgtcctggccgacggcgcgcggccgatggcccgcttttggcgaaaactcaggtttccccgccgcggaggcggtgacggaggcgtgatgagcgcgtgagagtccggtgacgcgccctcccccgcgcgcgttccacttaccacgccgccaccatggcctgttacgccgccaccacccggtgacgcgcctgcgcgtctgcccgcccgggccgaaccggccgggcgggacccgcgtgcacgcctgcgccggtgctctactccgcgctcacggccgcgctctcacccctgctctcgtccccgctctcgtccgcgctctcctgcgcctgcaggctgtccatgaaggagctgaccgagaagacggcgcggccgggtccgggcgggccgtagccggggggcgaggagagaccgaagtcgtccatggtggcgcggtaggcctccaggagccggatgtggtactccagcggagcgccctgcggattggccttgccgagcggggtggtgggctccgggcaccaggtggtgaagcggggcgtgatgccgtgcgacatgaagaagcgcaggccctcggtggtggaggcgatggcttcgtcgacggtggtgaagccgaacggctcggccatctcgacgccggccacgaagttggggatcacgttgcgcgcgccgaagatctcggcggagtcgaggatgcgcttgtgccactcgtcccggccgacgtagcgctccttgccggggcagtacagctcgaacagacggcggtcccacacctcgaagttggggtggtagatctgtacgccgtagtccttgaaccgctgcacgtcgtccttgggcagcgcctgggcgacgaccttgccgatccagcggcccgggaagcgctcctcgatggccttggcgtagtggccgtagaagtcggcctcgtcgcggcccgccaccttggacgtgatggcgccgccggtgagggtgtaggcggtggacgccttctgggtgtcgtaccggtcgatgatctccagcgcctcaaggacctcttcgacgtccttgacgccggtgtagggccggccggccgccttgtgctggcgccagttgtggttgatgtcgcagtactggcactcctccttggcgccgaagtactggcagacccggaagacggtgaggtagatcaggtagccccactggatggtgggcgccacctccatcacggacttcccgttggcgagggtgtgccggtagtactccggcatgggcggcacaccgacgtcggcgatccgcttgccgtcgaggtagagcccgagcaggccctcggcgtcggcggccacccggtagggcgaggcgggattcacccgtacggagacgacggtgcgcctcaggtcgtacggtcccccggtgaggatgatctcctcgggcgggcggcgcagcgcggcctcgcccagctcgggaagggtgccgtggtcgaacgagaagatgaagtacgacttgggcttcacctccccgctctcgttgtcgctgagtgcggaggggtcgaaggccacaccgcctcgcagcaggtcctccttgaagaccgcttccctcggcacgtgcgggaagcggtccatcagatcctcgaccagcgcggtacggctgcccatcccgtctctcctcctggctcgtacgtacgactcctcacggtatgcccccgcgcccgggacggcggtgccgggtcccccgacggcgggtgcggtccgcggacggcagggccggggacagaattagtattgcctattgacaaatgtcgtggcaccgtcggcaccggcaggcccccgccactgccgggccgccacctcgggagggacgccacgatgaccgacgctgtgaccagggccgcagccgaaaccgggaccggtacctcgaccggggccgtgaccaactgggcaggcaacatcacctacaccgccggccaggtgtgccggccggagtcggccgacgccctgcgggcgctcgtcgcccggagcgcgaaggtgcgcgtcctcggcagcgggcactccttcaacgagatcgccgacccgggcgccggcggcgtcctgctctcgctggcggccctgccggccgaggtggcggtggacacggcggcccgtaccgtgcgggtaggcggcggcgtgcggtacgcggaactggcccgccgggtgcacgcgcacgggctcgcgctgcccaacatggcctcgctgccgcacatctcggtggccgggtcggtggcgaccggcacccacggctcgggagtggccaacgggccgctcgccaccgccgtgcgcgaggtcgaactggtcaccgcggacggctccaccgtgcggatcggccggtccgacgcccgcttcggcggggccgtcacctccctcggagcgctgggcgtcgtcaccgcgctcaccctcgacctggagccggccttcgaggtggagcagcatctgttcaccgaactcccgctggacgggctggacttcgagacggtggccgccgccgcgtacagcgtcagcctgttcaccgactggcgcgatccgggtttccggcaggtatggctcaagcggcgcaccgaccagccgctgccggacttcccgtgggccgtgccggccaaggtggcgctccatccggtgccgggcatgcccgcggagaactgcaccgagcagttcggcgtgccgggcccctggcacgaacgactgccccacttccgggcggagttcactcccagcagtggcgccgaactccagtcggagtacctgctgccgcgcggcgacgccctggccgccctgcacgccgtggacgcggtccgcgaggcgctctcccccgtgctgcagacctgcgaggtgcgcaccgtcgccgccgacgagcagtggctgagcccgagccacggacgggacacggtggccctgcacttcacctggatcgaggacaccgcggcggtgctgcctgccgtgcggcgcctggaggaggcactggagcccttcggcccgcgcccgcactggggcaaggtgttcaccgtgccggccgccgcgctgcgcgagcgctacccgcggctggacgacttccgcgccctggcccgcgaaatggatcccgccgggaagttcaccaacgccttcgtacgggatctgctcaccggctgacactcgccgcccgcgccccttgtttcctgccgcccccaggcctcatcctagagtctctaggaaacgagggaccggggcggcgacgcccggacaggccgaggggacggggagcgcatggcccgagccggactcaccgcggaccgcatcgtcgcggcggcggccgaactcgccgacgcggccgggctcgacggggtcagcctgtccgcgctggcccggcacttcggcgtcaaggacgcgagtctgtactcgcacgtcagaagcgtccaggacctgcgcacccggctggccctgctggccggcggggagatgatcgacgcgatcgccgccgccgtggcgggccgggccgggaaggacgcgctgaccgcgttcgccggtgcctaccggtcctacgcgcaccgccatcccggccgctacgccgccacccggctgcgcgtcgacccggccctcgtcaccgacttctccgccctgcggcgcaccaccgagatcacctacgggatgctccgcgcctacggcctcgacgagccggacctcaccgacgcggtccggctcgtcgaggccgt

SEQ ID NO: 94 - DNA, 4342 bp, Unknown
  Kingdom: Bacteria, Phylum: Actinobacteria, Class: Actinobacteria, Order: Streptomycetales, Family: Streptomycetaceae, Genus: Streptomyces
ccagccccagcggtcggccagaccgtcgacgagggcgaggccgcggccgttcgtggcctcgtcgcccgcgcagcgcggttgcggcgcacacgtgctggcgtcggcgacctccaggcgtacgggggtcgcttcggccgccgtgccgggcagcgagagtctcaggacggccgggcaaccggtgtgcaccaccgcgttggtgaccagttcggagacgagcaggaccagggtctcggcgagcggctcgtcggccgctatccccgaccgggccaggcgcgaacgcgcccactcgcgggctcgccccacctccgcggggtcgggccggatctccagctgcacttgaagcacctgcaccgctcacaccatccgaaccggaggacccgtgaccccgcgccaagcgggagccacgatcaccgccattctctgcatggccaggacaacggccagagcaagggtcacggactgtgactcccttgccagacagcatggttgacgtaccgtcaccgcaacaagcgcttcgggcatattcccgcgcgaaggagtacccgtgcggcatactgtgcgacgcccgcagcggggagtcgaacaggcgggcgggacgggccgcccgacctcgcgaacagcggcgcgcaccgccggatccggagccgccgctcgggcaacaccgtgaccgccggccctcggaaccactcgcatctcacacaaggtacccgagcggggcggcgactccgggacgtgacgagacctgtcccggaccgcccgtcggagacgactctccgtgatcaaggtaggccgcggtccgcgagcgccggttccggaccggccggacagcaccgtgacggcgccgccggtacggaggcgtgcggcatcccggcgtccggaccggccccgagccactgctgactctccgtgacgccagtgccgggccggatcccccttccccacccctcggaatcggcacggcggcgaggactgcctggtgaggcccgcgcgagcgcggtgtcccggcggcggtggcgcgcggcgcggcccggcggactcgcggcgcgccgggcaggccgcttccgtgtcctcggctccgaagggaccgacggagccgatggcggcgccctgcgctcacccggcggcgcgggccgtgcccgcctccggcgcacggttccgcgcccgtccgccgaaccgccgaaggccccgcgcggagccgccggaactcctcgcgtggccgggcgtgttgcaccaccctgtcgcacacccgcacgacacggagcgccggttcagccgtgcggccgtaccgcccgccgtacgggcaggaggcgggggcgtcccgaaggcgggctcggtgctactcggggaccgtgaagtagcgggcgaaggcgggcacgatctcctgttcgcccacccggccgtcggcgtcggtgtcgagcacggcggcggtcgcccgcgcgacctcctcgggcactccgagcacccggagcacccgcacggtgtcctctacggtcgcggcgccgtcgccgtcggtgtccgcgacggccagggccgcgtgcaggaagggacgggcgatctccgcgaaccgggcggggttgtcacgcagccgtttgaccgcgccggtcacgaactcctcccgggtgatgcgctggtcgccgtcccggtcggcgatccccgccatgccctgccagaaggcctccgcaccggcgtagagggcctggcccttgtcggagcgggcggcggtgtggaactcggcgagcagtgccttggccgccacgctgaagtccgcgcggtcgatgtagccgttgccgtcctggtcgaaggtggcgaaccgggccgcgatcctgcgctcgtactcgctgctgaccatgtcttctcgggccgcctcacgtgtgggggtgcatgtggcacggagcgtacgacgcggacggccgtccggggacgggaaagccacggttgtgccaggaccgggtgaattccgggacacgggcgggggacgtacgcgtacgggcggctcaggcggagaggggttcctcgtcgacggccgacgccaggtcggggtagacgtcgaagaggcggcgcacgccgagggcgccgagcacgcggttgacgtgggacccgtcgacggcgcctccggcgggcaggatcagccgcagccggccctggcaggaacggatcaggcggcgcgcggcgatgagcacgccgacgccgctggaatcgcagaagaagacgtccgagaggtccagcacgaggtcgtgccggccctcggcgaccaccgcgtggatgcgctgacgcagcaccggggaggtcaccaggtccagttcacccgccacccggagcacgctccacccgccctgtccgtcgccggtcacgttcaacgccacggcctgccctccgctcgccggatcttccccggaaccgcccggaaacggaagcagttcctacgcttctttccgcgcggctgcccagcggccgttcccccaaacaccgcacagcaaacgaccatggttcctcaaggggcttgtttcggtcaccttccgtcgtgttcgatcagagttgatctgaaacgaaggggtaagaggggtaaccaccggtgcgcgccccgtccgtgcgccaaccgtgcaccgccggtgcgcccctttaccacctggggctctttagggggcgcacatcaccataaaggggcgtgcgcgggcgaacgtgccgactacattcgaggagatcaggcagccaggctggtccgaggaccggccggggcggcggcagggtacggccgggcgtgaagggggccacatggcgaagagggacgcaccgccccgctgggaccgcaggatgcagcagcggctggcacgcggcgaggccgccgccctgggcgagctgtacgaccggttcgcctcgctcgtgcacgggctcgcccaccgcgtactcggggacgagcaggccgccgacagcatcacccgcgaggtcttcgcccacgtctggcagcaccccgacgcctacgacccggccggcggtccgctgcgctcatgggtggccacgctgacccaccggctcgccgtacagcggctgcgcgtcaccgagaccgccgcgctcgccgacggcggcacaggttccgccgaggagctggagcgcaaggtgcaccgcgcctccgtggccgctcgcgccgactacatcgtccactccatgccggccccgctgcgcgccgccctcgaactggcctacttccagcgccgcgactaccggcagaccgccgtcgacctcggagtcagcgaggacgaggcccgccggcgcctccgcctcggcctgcaactgctgtccaccgcccacgacgcggcggggtacgacgccggacacgacaccggcgtcctcggcgccccgcccggatacgggggcgcggcatgagcggcgcgggcggcatgagcgatacgggcggcacgggcggtggcggggcgtcccgggccgtcgggcagccgccgcccggccggggagaaccgacagagcagagggaccggaccgtgctggagcatcacgtcctgaagtcgctcctcggagcctgggcgctggccgcctgctcaccggaggagaccacggccgtcgaggagcacctgggcggctgcggcgactgcgcggacgaggcgctgcggctgcgggacgcggtcggcctgctgcaccggcccgacagcctcgacctggacccgggcctgcgcacccgcgtcctggacgcctgcctggaacggcggccggcgcgcgtcccggtgcccggttgggcggcgccctacgacgcggagaccgcgcgcctcgacgcgctgctgcaggacttcggggactccgagtggcacgcgccggtgcggctgcgctggttcgaggacgggcgggcggtgagccgccgcacgacggtcgccggggtcatcgcgcacctgatgagcgtcgacgggctcgtcgcggtcgcgctcggactggaggacccgctcggtgaggcgcccgcggacggcccgacgcccacggcacgaaccgaggcgtactggcgggcgtcgcactttccgccgacccgcaccgtccgcggcccgtggcgggaccagacccacgcgatcgtccggacggcggccttcgccggagaaaacggaggggcaggagaagtcggaggtaacggtgcggcaggcggggccactggggtcggcggggccatggaggtccgcgaggccacgggtatcgccggggccgccgggtcctgcgggccgccgaccgtgccgtacggcggcggcttcgcgctgccgctgcaggacgcgctgctcgaccgggccttcgagtgctgggtccacgcggaggacatcgccgaggcggtgaactacccctacgacacgcc

SEQ ID NO: 95 - DNA, 11581 bp, Unknown
  Kingdom: Bacteria, Phylum: Actinobacteria, Class: Actinobacteria, Order: Streptomycetales, Family: Streptomycetaceae, Genus: Streptomyces
gggtcgtgcactcgcccggcgagggctgctcaccgtacgcgccggtggagggctgctcgccgtacgcgccctggtcctcgcagtcggggccgtgcgacggcggcggcgtcgtcttctcggagacgttggcgcacttgttgccgaacgccgggttgagcgcagccgcggcgtcgacggtgttgccgcaggcgttcaccggtacctcgaccggggcctggatggtgttgccggacagcaggccgggcgaacccgcgctgactccgtccgccgtcgagtcggcgaaggcggcacttccgtacagggacagcacgctcgtcgcggcggcagccgcgaacactcccctgctcagggtctgtcgcaatctagtggtcttcctgctcgaagccgctcgcggcggcttgaggaacgttcagatgtgggagggccggccctgggtcgcgagttcgacgtccagaggccggccctgacgcggccggccggggcggccggtgcgcctgtgcggtcagtcgttggtgcaggtgttgccgaacgcggggttcagcagcgcgatgacgtcgatggtgttgccgcacacgttgatcgggacgtgcacgggcacctggatggtgttgccggagatcacacccggcgagttgagagccgcaccctccgcaccggagtcggcgaaggcgggggcggccatgcccagagccaggatggcacccgtcacgacagcgacgctcttcttcatgggagttcccttctcggggccatgccccaatgacggcgagaaaccgcgtgaacacgacctgaatggtcgcggcactgaacgaggaatagacgtaatggaaaacggcggaacgtaaatcgcccgacaattcactcgattgccccgcgcaccatacgactcgccctcgactgctcggacgaattgaattctgcggaaccggcccgggcgtccgcgggagaagcggcggacggcccgggcctgcctggatcggttcagcgctcgccgttggacgagaggaccgacagaccctccaggacgtgcgacagggcgccgtcccgcttggcctgcgtggagtcgtccgagcactgctggttctgcttgtccgacaggaccggcacgtcctgcacgttgacgagctgcagcacgccgacgttggtctcgttcagacccaggcacggcttgttgagcgtgccctcgaccagcgagagctgcgggctcatgtcgcccttcgtcgacgagttgccgaacgacgacgtggcgccggcaccgttcgagacggccgggccgttgtcgttcccgatggcgagcgccgcgggagcagccgccatcgacccaccgacgacagatacggcggccgcagcggcgaccattgccttcttgagcactgcgcgttcctttcctcgtagcgacgcaggtcctacggcctcatcaacacggcgggagatgtttggttgcgggggttcacccggttggcccgcacggcattccaaacgcccgacaatcacggagtcgggaaaacacacaaacacttcgcggtatccgccgtgggggtgaacgggagaaaccccgatggcggcgggcagttgtccagaacgctccggtgacggggttccctcagaaaggaccgcccagtgatcaagaagtttgtcgccaccgcggccatcgccgcctccgcgctcggcgccaccgccgccgcggccccgcaggccctggcgatcggcaacgacagcggcccgacggcctcgaacggaaccggctcgtggcagagctacggcaactcgaccacctacgggaacatgagcccgcagatggcgctcgtccaggggtcgttcaacaagccgtgcgtcgccgtgggcgagctgccggtcggggtgctccaggccgtcgacgtccaggacctgccgatcctgtcggacaagcagaaccagcagtgcaccgagaactccacgcaggccaagcgggacggtgcgctggcccacctgctgcaggacgtgtcggtcctgtcccagaacagcgagcgctgagccggacccacggcacatgcgggagcgggccgccgagtcctttcggcggcccgctcccgtatgcccgtacggaggtacggcgccctacgacaccacgtccttgcgggcgaaggcgcggaaggccagggcgaagagcaccagcgcgtaggcgacggagacggccgtgccctggatcatcccggaccactcggggcgcggctgcacggcgtcggcccaggcgaactgccagtgcgcgggcaggaagtcgcgccagtggcccagcgcggtgaccgcgtccaggacgttgccgacgatggtcaggccgaccgcgccgccgaccgctcccagcggcgcgtcggtcctggtggacagccagaacgccagggcggcggtgaccagttgggagacgaagatgtacgccacgatcaccaccagccgctgaccggcggtgcccgcggcgagcgcgccgccggtggggatctgcagcgggccccagccgtaggcggcggtgccgacggcgagggcgacgacgggcagcagcaccatggcggccaggctcagcccgagtgcgacgacgagcttggaccacagcagccgggcccggggcacgggcgcggccagcaggtagcgcagcgaggaccagctcgcctcggaggcgacggtgtccccgcagaacagcgccaccggaatgaccagcaggaagccggccgacacgaacaggttcaccgcggcgaagttggcgcccgaggcggtggcggtgtccatcagggtcacctggttgttgcgtccgccggggtcgccgccgatcgcgaaggccaccgcgagcacgaacggcagcgcggccaggatgccgcccatgaccatggtgcggcgccgcttcagctgccgggccagctccacccgcagcggcagggtgcgcccggcgtggtagccgggggcgacctccgcgggctcggcgcccccggtgctctcggtgagcgtgctcatgcggaacctccgatcagggtgaggaaggcgtcctccaggcggcggtgcgggccgaccgaggcgacgggcacctcgaggcgcaccagctccaccaccaggcgctcggccgtggcgccggactccagccggaccagcaggccgccgtcggtgcgcaccgcggaggtcacgcccggcagcgcggccaccttctcggccaccggctcgtccacgggcgcggcggtgccgaccagcagggtgtccccggagccgacgatgtcgccgaccgggccggcctgcaccagccgcccgcggtccatgacgaccaggtgcgtgcaggactgctcgacctcggcgagcagatggctggagacgatgacggtgcgcccgccggccgcgtagcggatcatgacctcgcgcatctcgcggatctgcggcgggtccaggccgttggtcggctcgtccaggatgagcaggtcgggcaggcccagcatggcctgggcgatggccaggcgctggcgcatgccctgcgagtaggtgcgcaccgcgcgggccagggcgtcgccgagaccggcgatctccagggcctcctccaggtgggcgtcctcgggcgggcggccggtggcccgccagtacagttccaggttctcccggccggacaggtgcggcaggaagccggcgccctcgacgaaggcgccgacccgggagagcacgggcgcgccgggcctgatggcgtggccgaacacgcggatctcgccgtcgtcgggccggatcaggcccatgagcatgcgcagcgtggtcgtcttgccggcgccgttggggccgagcaggccgagcacctggccccgctcgacgcggaaggacaggtcgcggaccgcgtaccggtcggcggagcgggcgtagcgcttgctgaggccgctgatctggagcgggacgccggacagcgccgggtcgggggccggggcggtggtgcggcgccgggcggtgagcagcagcgcgagggcgaccagcgcacccgcgacgggcagccaccacacccaggcgggcagcggggccgccgctgtggtgacgccgggcgcggtgggcaccgacaggccgctgcgctcggccacgacggcgagggtgaggtccagcgcccggcgccgccgtcgtacggccgcgcccacccgaaggggctgctctttgtggtcgcccatcgctccggctccctccttcgctcgtcgatccgctgtccgtcgccccgtgccggggcgcacgcgccccgatcggttctctgcaccttacgcaggtgcggcaaaccgtttcccgccgccgtcacttccccgtgcggtgagcgcaccggcggcctggacccctgtcgtcaggtcctcgcggttcgcctcggcggaccggccgtgctcaagcccacggtacgggttcccgccggagcgcggggtgactgtgcgtggatggccggattcctgctgtggacggcccgaggggcgggccccgtcccacggtgtcaggaccgtggcgggcccgcccctcgggcggtgtgcggtggcggtgtccgcggggtcgtcgtccgccgggtcacccggaagcgaccgtgcggacggctatgcggtgggccgccggttcactgcggggtcatccgctggacgacgtccgggtgctgcttgatccaggcgtcgaccgcgtcgtcctcgtgcgccttgccgcgcgcgttgatctcgctctccaggctgcccagctcgtcctcgctcatcctgaagttcttgatccactcggtgagctgcgggtactgcgcggggaacttctcgctggagatggtgcggacggtgttgcccacgccgaagagcttcttgtcgtccttgagcttggtgaggccgtagcggctgtacgcccagtgcggcgaccacagcacgacggcgacgggctgcttcttggcgtaggcgcgcttcagctcggccagcatcgcgggcgtggagccgtcgacgaccttgtactccttgtccaggccgtagccgggcaggaccttgctcttgaggaggttcatctcgccggtgcccggttcgatgccgatgatcttcccgccgaacagggacgactttcccttgaggtcctccagggacttcacgtccttgacgtaggaggggacggcgatctccagggacgtcggctggtaccaggtgccgagatccttgagtttgtccttgctcttgtcccagtagttcttctgggcgtagggcagccaggcgtcgaagttgaggtcgatgtcgccgccggccaggccggtgtagacggggccgacgtccatctgcttgaggttcagcttgtagccgcggcgctccaggacgttcttccacaggtgagtgacggcgacgtcctcgtcccaggggaaccaggcgacgttcaggggccgcttggcctcggccggggtggagccggagccgccgggcaccggggccagcttgccgacgacgcccgggttggccttcagccaggtgcggacggcgtcctgctgctttcccttgccggccttgttgatctcggcctccaggctggtgagctgcttctcgtccagcttgaagttcttcagccagtcgccgacgacggggttggcggccgtgaagcccttgcgggccagcgtgtgcacgccgtcgcccttgccccaggcgcccttggggtccttcagcttcttcaggtcgtagtcgttgtacgcccagtgcggcgaccacagggtgacgaggaccggctgcttcttggcgtaggcgcgcttcagctcggccagcatggcgggcgtggagctgtcgacgaccttgtactccttgtccaggccgtagtccttgaggaccttgctcttgagcagggccatctcgccggcgctgggctcgatgccggtgatcttcccgccgaacagggacgccttgcccttgaggtcgtccagcgagtcgatgcccttcatgtacgacggcacgctcagctccagcgacgtcggcccgtaccaggagccgaggtcgtcgagctgcttgccgtacttcttccagtactgggcgtgggtcgtcggcagccaggagtccgtctcgaagtcgacgctgccctgggcgagcgaggtgtagagcgggccggcgtcgaactgcttggcctcgacctggtagccgcgctgttcgaggatctccttccacaggaaggtggaggcgacgccctcgtcccaggggatgtagccgatgctgatcttcttgcccttgccgacgtcctgtccgtcggcggcggccgtggcgctgccgccgccgccaccgaagatgcccatgccgccggcgacgagcgcgaggacgaccacgccgaccacggcgatctgcgggctcggccggtaggaccagatcttcaggccctgcagggaccgggcccgggcggcggcgcgccggccgagcggcgagacctgggtgcccagggcgctggtcatgcggtccaggtagatcgcgaggatcacgatggcgacaccggcctcggagccgaggccgacgtcgagctggccgatggcctcgttgacgtcgccgccgaggccgccggtgccgaccatgccggcgatcgcggccatggacaggccgagcatgatcacctggttgacgccggccatgacggtgggcagcgccagcggcagctggacgcgcagcagggtgctgcggggcgtggtgccgaacgcctcggcggcctccaccagctccttgtcgacctggcggatgcccagctcggtcatgcgcacgccgggggcgagcgcgaagatcagggtggcgacgatgcccgcggggccgccggtgccgaagaacaggatggccgggatgaggtagatcatcgcgggcagcgtctgcatgaagtccaggaagggccgcacgacggcgctgacccggtccgagcgcgccgcccagacaccgaccggcacggagatcaccagcgcgatgatcgtcgcgaccaggacgagcgccagggtgaccatcgcgtcgtcccacagtccgagggagtcgatgaaggcgaacccgacgaaggtcaggaccccggcgagcgtgccgcgcagccagaaggcgagcacggcgaagatgccggcgagcagcagcggctgcggtgcctggaggacggcgttgatgccgtcgtaggcgccggtgaagacggtcttgaagaagtcgaagagccatgccacgtggtcgagcagccagtcgaccgcggagttgacccagttgccgagcgggatcctaggcacgggccaccgccttcctgccgcccttgtcgcgcggtgcgtcgcaggtcacgggcgtggtgtcgcgttcgtcgccgaggaagcggacgagccgccgccgcgggacgacgccgacgaggtcgcggtgctcgttcagtacggcgaccgggtgggacagccgggcgctgatcgcgcacagctcggtgaacggggtgtccggcgtggccgtctcgcatccgcagtcggcctcgtcgccgcgcacctggcggtccatgaccgtttcggcggtcagcacacgggagcggtcgacgtcctggatgaaggaggcgacgtagtcgccctccgggcgcagcaggatgtcctcggcggtgccgttctgcacgatccggccgtcgcgcatgacggcgatgcggtcgcccaggcgcatggcctcgttgaggtcgtgggtgatgaagacgatcgtcttcttcagcgtcttctgcagctggagcagctggtcctgcatgtcgcggcggatcagcgggtccagggcgctgaaggactcgtccatcagcagcaggtcggcgtcggtggccagggcgcgggcgaggccgacgcgctgctgcatgccgccggacagctcgtcgggccaggagttctcccagccggccaggccgcacagggcgagcgcctcgtcggcgcggcgtccgcgctcggcgcggggcacgccctgcacttccaggccgtaggcggcgttgtcgcggacgctgcggtgcgggaagagcgcgaagtgctggaagaccatgctgatcttcttggagcggacctcgcgcagctcccggtcggtgagcgcggtcaggtcctggccgtcgaagcgcacctgcccggcggtgggctccagcagcccgttgagcatgcgcaggagcgtggacttaccggaaccggacaatcccatcacgacgaagatctgtccggggtccacggtgaaggaggcgtcgatgacggcggcggtggtgccgctcgcccgcagttcgtcgcgatcggcaccctgccggagcttctccactgcctcttggggtcgtctgccgaacaccttgtacaggtgttcggcctcaagcctggatgccacgcgcacctctcgtcataggggacagggacagatgcgaaggatcagtaacagttgaataacgcaactaccttcgctcggccgcgcgcctgccccggtccatgcaggtcaaacagaaaagtgacccgcctcacatcacggccggtgactgtcagaggcgtacggcatgatgcgaggcgtgaccggaccactgatgctcctcgacaccgcctccctctacttccgcgcctacttcggcgtcccggagtcgatcaaggccccggacggcacgccggtgaacgccgtgcgcggactgctcgacttcatcgaccgcctggtcaaggaccaccggcccgcccacctggtggcctgcatggacgccgactggcgaccgcactggcgggtggagctgatcccctcctacaaggcgcaccgcgtcgccgaggaacatgcgggcggccccgacgaggaagaggtcccggacactctctccccgcaggtccccgtcatcgaggcggtcctcgacgccgtcggcatcgcccgcgtgggtgtccccggatacgaggccgacgacgtgatcggcacgttcacggcccgcgccaccggcccggtcgacatcgtcaccggcgaccgcgacctgtaccagctggtggacgacgcgcgcggggtgcgggtgctgtacccgctcaagggcgtcgggaccctgcagagcaccgacgaggcggtgctgcgcgagaagtatggcgtggacggcagggggtacgcggatctcgcgctgctgcgcggcgacccgagcgacggactgccgggcgtgcccggcatcggcgagaagacggcggccaggctgctcgccgacttcggcgacctggcggggatcatggccgccgtcgacgacccgaaggccaagctcacgccgtcgcagcgcagacgcctcgacgaggcgcggccgtacctcgcggtggcaccgaaggtcgtgcgcgtcgccggcgacgtgcccctgcccgacgtcgacaccgcgctgccgcgcactccgcgcgacccggccgcgctggacgagctggccgcccgctggggtctgggcggctccctgcaccgcctgctcggcacgctcggggcgtgaagtccccgtgagaatcggggcgcggtcgtgcccgtgaaagaggtgtcaccggagggaaggtgctaacttaggtaagcctaagcaagggaactgggaggccgtcatggcagaacgtccggcgcgcaagccgcgaagggcccacaccgcgcgggtggtccgcaccgagcggctcactccgcacatgcagcgtgtggtgctcggcggcgagggtctcgccggcttctcggccgacacgtgcacggaccactacgtgaagctgctgttcccggccgccggcgtcacctatcccgagcccttcgacatgcagcggatccgcgaggagttcccgcccgagcagtggccggtgacccgcacctacaccgtgcgcgcctgggaccccgaacaccgcgaactgacgctggacttcgtgatccacggcgacgagggcctggccggcccctggtcgctgctggcgcggcccggcgagaccgtgcgcttcatgggccccggcggcgcctacgcccccgacccgagcgccgactggcacctgctggccggtgacgagagcgccctgccggccatcgcccgctccctggaggcgctgccgcccggcgccaccgcccacgccttcgtcgaggtctccgggcccgaggaggagcagaagatcgattccgacgtcgaggtggtctggctgcaccgcggggagcggcccgtcggcgccgccttggtggaagccgtacgggcactggagttccccgggggccgggtgcacgccttcgtgcacggcgaggccggcttcgtgaaggagctgcggcggctgctgcgcgtggagcgcgcgatcccgcgcgagcacctgtcgatctccggctactggcgcctcggccacaacgaggacggctggcaggcctccaagcgcgagtggaacgcccggatcgaggccgaacaggaaggcactgcaccggccgcgtgagacgacgtgacatgagagaggggcggcacccggaagtacgggtgccgcccctttctcatccactgccccgggcaccggccgttctcatccgctcacacggcaccggctcgccggcaggacgctcacaccgaccgctgataggaccggaacgtgcgcaccgacagccacaccgcggccaccgcgagcgccagcagccccccggtcctgacgaggacctcgctccagtccgggtcggcggacagggccgaacgccccgccaccatcgcccagtccagcggattgaagtcggcgacgtgccggatccaggacggcatctgcccgggcgccatgaaggcgctggacaggaacgtgagcggcatcagcaggaaggtgttgatgccgatgatcgactcccgctcccgcaccagcatgcccagcgcgttggacagcgcaccgaagaccgtccccagcagcatcgaggcgacgaccaggacggcgataccggcgacgccgccggggtagtcggcgccgcccagcagcccgagcagcacgatgacggccgactgcagggcggtgaccaggccgttgctgatgacgttgccgttcatcagggcgccccggccgaccggggtggtcaggaaccggtcgagggtgccgcgctggatctcctccagcgtgcccatccccgcccacaggttggagctgagcgcgctcatcacgaccacgcccggcaccaggtagtccaggtaggagccggtgccgaagccgccgagccggacgaccttcttgaacaggccgccgaacaggaacagccagatgaccggctggacgagcgtgatgaccgcgtaggcaggctggcgtacgtacgccatgaggtgccgctgggtcatgtaccaggtctgcgggagggccgtgctcatcgggcacctccggacagcgtgagggcgtccgcttcaccggacacggcggcggcgcccgcctcggcctcggcgtagtggcgtccggcgtggcgcaggtagacgtcgtcgagggacgggcgggccacggtcgcggtggccacgctcaccccggcccgttcgagggccgtcagcaggacgggcatcgcggcggcgccgtcgtcggcgcgggcgctgatccggcgcccgtcgatcagcacctcgcgcacgccccgcagcccgtcgagggcgccggccagcagggtgcggccggcctcgccgaccggctcgcgcagctccaggcggacggcgtcaccgcgcagttcgcccttgagcgcgtcggggg

SEQ ID NO: 96 - DNA, 694 bp, Unknown
  Kingdom: Bacteria, Phylum: Actinobacteria, Class: Actinobacteria, Order: Streptomycetales, Family: Streptomycetaceae, Genus: Streptomyces
ccccagccccgcccttcacgcccgcggccggccgtggcccgaccgtgacgtccacgctggcctcgccgcagcccggaactccggcccccgggaccgacgtccgcggtggcgctcgcggcatgccggaagcgcgggccgacccggtaggcttcctgaaggcgcgtcttcgcggcgccattcgggaacgcacggacgcgaaacggggaggaaccggcggtgcacgtccaggattggctcgacacggtgcctgcggccgctgtctacgcggtggtggcgctggtcatcggagtggagagcctgggcattccgctgcccggcgagatcgtcctggtctccgccgcgctgctgtcctcccagcattcgggcatcaaccccatcgtgctcggcgcgtgcgccaccgcgggcgcggtcatcggcgactcgatcggctacgccatcgggcgcaagggcggcagacccctgctcgcctggctcgggaacaagttccccaagcacttcagcgagggtcatgtcgccacggcggaacggtcgttccagaagtggggcatgtgggccgtgttcttcggccgcttcgtcgccctgctgcgcatcttcgcggggccgctcgcgggtgtgctgcacatgccgtactggaagttcctgatcgccaacgtcctcggtggcgtctgctgggcgggcggcacgacggccgcca

SEQ ID NO: 97 - DNA, 23323 bp, Unknown
  Kingdom: Bacteria, Phylum: Actinobacteria, Class: Actinobacteria, Order: Streptomycetales, Family: Streptomycetaceae, Genus: Streptomyces
atgccaaatgagatgccctgtaaacggcgcccccaccagcaagatcaagacgtcatgttgatgatctgcaagcccttagctccgcgacgtcgcgtcgctggaggcgccgtcaagctcttgtaggggccgtttctggatccatgtccccgctggccgatggcgtctgctcgggcagccggtgcgcgatcagcgtggcgactgcgaccactccagcgagcgcagcggctactgttcgcgggccggtgaaggccaggagctggccacccagcgccgcccctgctgccgatcccaagttgtatcccgagccgagccaggcgttggcttcggcgtgtcggggggagtcgatgcgttcgtcgacgaggagataggcgatgacgaagatcggggtcatagggaggccgatgaagaagacggccacgatcgtcaggggcgatgaggagaatgcggccagcaggagagcccccactacgagcccgaccgtggccgccgagtaccgaagacgcagaggcgcggtccacttcctgcgtccgtaggccagtccgcccacgacaccgcccagcgagaatgcggcgaacgagtatccggatgagatgacgttgccgaagctgacggaggcggccgggatgatgacagtgagacattcgccgcagagcccaagggcgatcacgggaatggtgatgccgcgaccatcgcgggtccggatgatggaacgttgccgctgggccttgatcttggcggtgctggaagctgtgccctcctctacaggaccaagtgaccgcagaacccgtgtgagtcccgcagcagccggcaggaggagaaatgcgctggagacgagcactcaacgagcgtcagtcagcgtcatggctgtggtacccagcaaaggtgcaacaacgaaggtcagctcttcgacggtcgagtcgagtgcgtggatgctttgcaggtgctgcttgtccggcatcagccgcgaccaggcggcccggagactgggcgtgagcggaggaaacacggcgcccgccgcagcagtgatggcgagaggtacctgccaataccccaaaccgatcgtggatgccgctgtgacgtacagcagcacgctggccagcgccatgagcaggacggcgcccgggccgcgggtcgagcaccaccgtgcgcgcgtcggcccgggaatggcgatagccagcagcagagctccggagaccaggccggcgattccgataccgtagtgctgggtgaaggagatcagcacggagaacggtatgaggccggaaggcaagcggctcattaccccgagggccagcacctgcttggctttgggaaccgcgagcaccgcgcggtaactcggggtggtcaggtcattcacaggttcactccagcgtgctgttgcagaggcaggatgaaggcgggaacactgtttgcatccgcccattggcagatcgtggcgagagcttcgcgcagatgggccggatcctggccgtcgaggagttggtgtccttcgatcacagcggtgcccttactggcacggaccgcgatgcgaccgactaccgtcgtgccgacgaggacgggcatgccgaagtagccgcactctctcttggatgcgggtttgtacgcctccagcaggtactcgacgccaaagaggcgtcgcatgcgcggccggtgccagatcagggagtcgaagggtgacagcggggtgcacgcctcttggttcagctgcggtgggctgagcgcttcgcgggaaacccaggcggcgtcctgccatccctcaacccgcaccggctgggcttcctccagcgtagacaggcaagccgcgaccttccgggacggcaggcggaagtagtcggcgacatcgtccgctgtggcgacaccgagagcctgcaccgccagccgggccagcgagcgcaggcactcagcctcgtcgggttcggcatgcagcaggtcgcgggggaccacggactcggctctctggtagacgcgctgccagccacgtcgatggacgcaggcgagttcaccggtggccagcagccattcgagggcccacttgttggccgaggagcgttcccagccgctgcccttggccccacccagatcgctgatcgtgactgcatcacgttcggtcaagacggcccggacgtgctcgacggccgacaaatcgacctcgggccccttccaccccttggcggcataaccgcgacgccggaaggcgaacagcggccagaggctgagcgggatcagcgatgcggcatgtgcccagtattcgaacagcaccggcgggttggactcgccgatcaactgctgagcctctgtgaccgatacgccgcgtgccagctgaacgagttcatgggaacgtcgtacgacgctgatcgtgtcgagctgaatgcagcccaggcgacgcagggtgtcttcggcgctcagcggggctgaaaaggtttgcaagccctgggtcgtcacagcgatcgctcgggcctcctgcaaggacagctcaagcaccggtgccctcctggacgccgacttcctcggtcttctcgtagcgaccgcgggcctgaagggagtcggcgtgcaggagcacgatgcgggcgatctcttgacctcggcttattgcgacgggagccgtcggacgtaccgcgatgcccagcccgttctcgcggctcatccgcgtcgtggcggtgctactgaggattccggtggagacgtcgagcccggcaacgggacgctccagcggcaggaccagcaggaagtggccacggggaatatccgctgcccagccgagccgccattcgaccgtgcccgccccgttgggaaggaacatgttctcccagccgcgcgacgtcttgaactggtacaggtgaagccaggaggtcttctccacggccagatgggacttttcccgctgccacagctcggtgcggttcacggcccggccggcggcttccggctcctcgacaccattcaactcgatctggtcgagcggggtgaacgagatatcgatgggactgtgcacccgccaacccagttcctgtcccatcacccatggcgcacagtgctcggggcgccgctcggcacggacgaaacggaagttctcgcggtagacctcagcgtgggcgcggctgttctgccggtcgaccttgtgctggcgcggggcgagagaccatggatggagctggcggaaccggacctcgacgggcaacagccatcacctttcgcagggttggcccccgcgggcagttacccgcgggggccaatggaccttgggctctgtactacttcgcagccttctcggtctcgctgaggcgggccgccgcctcgttgagcttggcctcgtggtactcgacctgcgccgagtcgaacactgagacgctgcaggggccgtacccgaccttgatctcgtcgtactgaaccttcccgccctcgtcggccggcaccgacaggtccacgccgtcaaggtggacaacagtcaggctgtgggggctgaagcggaactcgaccttctcgtcctccgagggtacggcccgaggtatgagacgaggcggatgccaactccacgcgggggttgctgacgaccgagcccgaccgaggtgacgtcgggctgagccgtgacgcgctgccggtacgaccgtccgcggcgccttcgtccggtagcacggtgcggtcagcggagcggcgccatgcctggcggcagttcggccgccttggagtggccgaagtcggcacccgagctgagcgaacaatagttcgtcgaactggggcgagagttggagaaggggcggccagaaccactgcggtgatgtttacctcgatagcgcgtaccggcgccgggaagggccgaaccggtgggagagtgcggtttctgagcgaggcggctgtccgatcgggtttgctgggagaccctgggggacgtccgccaccgcgacgtcggctggtgagtgccgtggcccggtcgaaggccagcagtggcgcgggggatgatgaagaggtgaacaaggaacagaccgtttgctggttggatagttcgggagaggagcggtgcgccctgtggcggtcggagagcggcgcgccgccaccaaaacaggtgctggtggccgatgaccggatgaacgccgacaccgcgttccgcctggcgtgcgagggaacctcgctgttatggcgcggtgacttccacaacgcccgtcaactgctgggggcgatggcgcgccgcgtcgaccgtaaaccgccgaagccgggggcgtcaccggagcagagcttccatctgtaccgtcaggcgcagtcgagacgtgcacgaatcctgggcatgctgctcttgccggtcgaagcggggcatgtgattcccctgcgccgagccccggacgtgcgactggcttgcgagcaggcgtacgggcagtgtcacgaaccttatgtcatgtcactgcgcgagcttcagggtgtccttggggccggcgaatggcgcaagaagggagtccgcgtgccggcgctcggcgagtcgatcacgccgcactacggtgtgttctccccggtgcgtggcgagtacgtcgatctagtggccgaggcaccgctgccgccacagggcacggcattcgacatcggcaccggctcgggggttctcgccgcagtcttggcccggcgcggcgttcggcgggtggtggccacggaccttgacacacgtgcactcgtctgcgcgcgagagaacatcgaccggctgggcctgtcatccaccgtggacatccagcaggccgatctgttccccggcggccgggcatccctgatcgtctgcaatcctccgtggcttccgggccgggcccggacgccgctcgaacacgcggtgtacgacccgggaagccggatgctccgcggcttcctcgacggcctgtccgcccatctggaacccggcggtgagggatggctcatcatctccgaccttgctgagcgcctggggctgcggtcccgcacagagctgaccgaactgttcgatcaggccggcctgacagtgatgggacgccttgacgcccggccgctgcacccccgtgcccacgaccccgccgatccgctgcactcctcacggaaggcggaagtgaccacgctgtggaggctggcggtgagtccaggcgccgccgatggaacacgccggtagcgtgatagcgggagcctggagcgtcaggctcccgtgcgaccccagtcaccgaacaactccggtcgcagcgagtccagagcggactcgaacgccacggacagggcttccagatccctgtccgctcgcaggtaccagtcccgggtgacgacgcggccgaatgccttgaacactgccacgatgaaccgcggacggaagtcgtcgcttagatccacaccttcacgcgcggcgacgacccgggcgagcttgtcctccatctcctcgctgcggcgcagatgctccgcgaggagctcgggagtgcgctcgaccagccgcatcattgccatgtgcaacgcgccgtccccgccatccagttcaccgtcgcgtacgcgctccaggacggcccggaaggcaccgctcatggcctgcaacgggttctcgcccgccggccgggcctccagggcggcgagaaacgcctcgtcgatggcgctgatgggtgtgagagccacctcttctttgctggcgaagtggcggaagaacgtacgcggatgcacctcgaccgcctcggtgatctgttccacggtcgtgtgctcgtaaccctgcgctaggaacagctctagagcttcgcggatcagttgattacgcgtacggcggagctttcgttgccgcaggccagtgctgttgggggtcttggtttcggcggtatccaccccgcaaccctaccttgcgccaccagatgacatctgtctcgcattgtcaaatgtcactcactgctgttaccttcggctcatgttctcctcgtcacacccgtgtccgtcctgccggaaatcgttagggggacgctgaatgagcacggcaacgcacgacgagccgccaggcgtcagggaaactcctgcatccggtctgcgtggacgtccctggccgacacttctcgcggtcgcggtcggcgtgatgatggtggctctggacagcaccatcgtcgccatcgccaaccccgccatccagcaggacctccacgcttcgttggccgacgtgcaatggatcaccaacggctatctgctggcactcgcggtctcactgatcacggccggcaaactgggcgacaggttcggacaccgccagaccttcctggtcggagtggcgggcttcgccgtcacttcggcggccatcggtctttccgacagcgtcgcggcgatcgtcgtcttccgcgttctccagggcctgttcggcgctctgatgcagccgtctgcgctcggcctgctgcgggtcacgttcccgcccgacaaactcaacatggcgattggcatctggagtggcgtagtcggcgcctcgactgctgccgggccgatcgtcggcggactcctcgtccagcatgtcagctgggaggcggtcttcttcatcaacgtgccggtcggtctcgccgcgctcgtcgtcggcctcatcatcctgacggacgcgcgcgccgagcgcgccccgaagtccttcgacgtctccggcatcatgctcctgtccggagccatgttctgcctggtctggggcctgatcaaggctccagcctggggatggggcgatctgcggacgctgggcttcctggccgccgccgtcctcgccttcgccggtttcacgctgcgcgagcgcagggccatcgagccgctgatgccgctcgccatgttccgttccgtgccgctgtctgcgggaactgtactcatggtgctgatggcgttctcgttcatcggtggactctttttcgttacgttctacctgcagaacgtccatggcatgagcccggtcgagagcggtgtgcacttgttgccgctcaccggcatgatgattgtcggtgctccagtgtccggggccgtgatcagtcggttcggaccacgcgggccactggtggtgggcatgctcctgacggcggcctccttgtgggggatgtcgacactggaagcagacagcagtatggggaccacctcgctctggttcgtgctgctgggccttggtctcgctccggtgatggtggggacgacggacgtcatcgtcagcaacgccccggccgaactggccggtgtggccggcgggctgcagcagtccgcgatgcaggtcggcggaagtctcggcaccgccgtactcggcgtcctcatggcctcccgggtcggcaacgtcttccccgacaagtgggcggaggcgaacctgccacgaatcagcccggaagaggccgcgacgatggaagacgcggccaaggtcggagtcgccccgccggccgacgccgtgcccggccagcatgccgagactctctccgatgtcgtccactcctcattcatctcgggaatgggcctggccttcaccgtggctagcgtcgtcgcgctcgtgggagccgccgtcgccctgctcaccaagaaggcgaagctcgagaaggcgccagacaaagcactggccccagcctccaccggatgacagccctgaaactcctcatgaatacccgttggtgatgccggcggggtccggccgaacgggccccgccggcatcattggtgtccaaacggtgaacagcccctgaatcagaaggcgtaacgcagcagccggtgcgcgtagcgaagttgtggaatgctgcgcatgctggcgcccaccaacctttcgacgggacgggcgctggcgagatgcggcgaatcgagcagcgaccactgctcctggaatcgcaagcccgggatcctgctctccagagaccggggatctccgacaccccagccaaatgtggcgcccgtggcccgcaggagttgcgagtacttagcgaatcggagagtccacgggagtacggcgtcaaacatgaccgcaccctgtggaagatgccgggtgagccgtcgaagcattccctccccgtcggcttcctggagatacggcgtcagcccttcggcgaccacaagcgtcggccggtctccaggcacagaattcaaccactcctccgtggtaaccgatgctccgatcatccggtaaccgtcgcggttcggatagagccggcttctcaactcgatgacgtccggtacatcaacgtcaatccactcgacaccgtcgggtaggtccatccggaatgcccggctgtccagaccgcacgcgagatgcagcaccactgcttccggatgggtctccaggaaccccctggcccactcatcgagcttcctggcacggaacgtcacgatccgcacgtctttggtggctgttctgatgcggctgaagtcgtagtcgatgcggcgcagcagctcctccgccgtcgcgtctcccaatacgggatccggttgtcgattgtccacagcacgggcctgaagtgtggctaggagcgtctcgtgtacgccggccagccggatcgtttcacccatgggacagcagcctccaagtgcacacggcgtggcgtcaagagagccctgggtgcacaggagggagcagatttgggacacattacggaagcaaaaatcggaacattttgggtattcattgccgaaacgcaacagtgatcggtgtggcgcttggcgcgatctgaccaatgcacctgcgaagtgcaacgccctgggatggcctgatctttttgttgaaaagccaaagagggagttcaggggggtgaaggtttcaccgtgcatgttcgaatctatcggccgttagggagaggttgacgtttggcgtcctaatttgatgggtactaatgccgcttcagtttttccgatgtacctgactcgtcgtcaggtgcagctatccggcccatcacaggcgattgttcgatgttgactgggtggatcggaagatgttcatgtggatgagccaagcagcgctgcactcgtcggcccgaggcgaaaaccgatctcatcgccggggcgactcgggtgcgtgtatccgatcgactgaaaggttgcaccttgtccactgaagaaatcccggtactgatagccggcggaggtcttaccggactatccgcggccctctttctcagtcagcacgggatctcatgccgcctggtggagaagcaccggggaaccacggttctgacccgggcgtcgggaatcagctcccggacgatggagctgttgcgtggtgtgggcctggaacagaccgtgatcgagcgcgggccgaaactcatcgagggagcccgctggcgcgaactcggtcagccggcgaaccagatcccctgggtcgtcatccgggccaacggcctgcacgacctggagaacgcggtgaccgtcgaggagccttcgcttgacgtcggccacctcagccccacccgtccctactggtgcgggcaagacaggctggagccgatcctccgcgacgaggccgtccgccgtggggcccgtatcgacttcaacacgcgtatggacgcgttcacggcggacgagagcggagtcacggccacgatcgtcgaccaggccaccggcgaggagagcacggtccgcgcccgatacctcatcgcggcggacggggtgcgcagccccgtacgggagaagctggggatctcgcgcaccggacacggcacgatcggcaacgccatgagcgtcctgttcaaggcagacctgaaggatacggtcaagggtcggcgcttcgtcatctgctacctgccgaaccccgacgaacccggagtcctccagctcccggacgtgccggccgtactccagctgttcgacgaggaacgctggatcttcggcttcttctacgacccgcgggagacctcggccgagcagttcaccgacgagcgctgcgcgcagatcatccggaccgcaaccgggctcccggaccttccgatcgaggtccagatggccaggccctgggagatgtcccacaacagcgcgcgctcctaccgcagcggccgggtcttcctggccggggacgccgctcatgtgcacccgcctgccggtgccttcggagcgaacggcggtatccaggacgcccacaacctggcatggaagctggcggccgtcctgaagggaacggccagcgacgccctgctcgacacctatgagcaggagcgcctgccgatcggtgccgccgtcgccgatcaggcatggatccgtcacacctggcggctcaacgactccgaggaactgcgccgcgagctgcgcgagtcgacgctggtcgccaccggctaccgctacacctctgacgcaattctcggtgccgcctacccggaacccatccccgccgaacacgacctcaccggccggccggggtaccgagtgccccatctctggctgaaccgcggtggggagcgcgtctcgacagttgacctcagcacggacgcgttcgtcctgctcgccggacccggcggagacgagtggcaagctgcggccgacaaggtcacacaggacctgggcgtacccgtgcactgccacactgtgggcagcgacgggcaactggcagatcccgatggggccttcctcaacaccacgagtctcacacggaacggtgcgctgttgatccggccggacggcttcgtggcgtggcgggccgacaacctgccggaggacgccgcagggaagctgcggtccgtagtggagcggatcctggcgcgaacccccgacacgtcccgcgtcacggtgctggagggctgaccgcatggcgaccatctccctctcgccggacctgttcaccctcgtcaacgtcttcaccgtcgcccctgagaagcagcaggaactgcgcgaccacttggtccaggtgaccgaggacctgatccggcacatgccgggtttcgtctccgcgaacttccacctcagccgcgacggcggacaggtcgtcaactacgcccagtggcggtcggaggccgacttccgcgccatgcacgccgatccgcggctgcagagccacttcgactactgccggtccgtctcccggccgaagccgatcttctgcgaggtcacccactccttcgacgccgcgtcaccggacggagcgtgaacatggcctaccgggcactcatggtcctgcgtatggacccggcggacgcggagcacgtggcagccgcgtttgccgagcacgacaagacagaactgccggtggagatcggggtcaggcgacgggtcctgttccgcttccacgatctgtacatgcacctcatcgaagccgacgacgacatcatggagcggctctaccaggcgcgcagccacccgctgttccaggaggtcaacgagcgcgtagggcagtacctccacccgtacgcgcaggactggaaggagttgaaggactccaaggcggaagtgttctacagctggaccgcccccgactcctgaccgccggccatccgtgaccaccgctcagcacgaaggagaacacaccgtggcagccgccgccaagatcgccatgtccagtgtggcgcccagtcaccggcaggggggaagcacccgcgccctgctgacaccgtcgtcggtgggtacgacctccggattcctcggccacatcgagctggcaccccaggagtccatcaccgagcactaccacccgttctcggacaagtacctgtacctgatcgaagggaacctcgtcgtccaggtgaacggcgaggaggtgcgcctggagcaggacgaggccctgttcgtcacccgcggccagcgacaccgcatcgagaaccgaggaaacgtatctgcacgagtggtcttccagatctcaccgctcgccccgaggcccgaactcggccatgtcgacaccgagcccgtgccgcacccggcctccgcgccgcccaaggtgggaggctgacatgacccagcacgcggagaagcgggtggtgatcaccggcatcggtgtgcgagccccaggaggcgtcggaaccgcggccttctgggacctgctgaccgccggacgcaccgccaccaggaccatctccacattcgacgccgcgccctttcggtcccggatagccggagagatcgacttcgaccccatcagcgaggggctgtcgccccggcagtcgtcgacgtacgaccgggccacgcagctcgccgtcgtctgcgcccgtgacgcactgaaggacagcgggctggacccggccgaggtgaacccggaacggatcggggtgagcatcggcaccgccgtcggctccaccaccagcctcgaccgcgagtacgagcgggtcagcgacggcggctcgcactggctggtcgaccacacgctcgccgtcgagcagctcttcgactacttcatacccacctccatctgccgagaggtcgcctgggacgtgggagccgagggaccggtgacggtggtgtcgaccgggtgcacctccggcctggacgccgtcggatacggcacggagctcatccgggacggacgcgccgacgtggtcgtctgcggtgccaccgatgcaccgatctcgcccatcaccgtcgcctgcttcgacgccatcaaggcgacatcggccaacaacgatgaccctgcgcacgcctcccgccccttcgaccgcaaccgcgacggattcgtgctcggggagggctcggcggtcttcgtcctggaggaactgggagccgcccgccggcgaggagcgcacgcctacgcggaggtccgcggcttcgctacgcggtcgaacgccttccacatgaccggcctgaagccggacggccgggagatggcggaagccatcactgcggccctgaaccaggcccgccgcaccggcgaggacctgcactacatcaacgcgcacggctccggcacccggcagaacgaccggcacgagacggccgccttcaaacgcagcctcggccgacgggcgtacgacgtgcccgtgagctccatcaagtccatgatcggacactccctcggagccatcggatccctcgaactggccgcctccgcgctggcgatcgaacacggcgtggttccgcccactgccaactacgaggaacccgaccccgaatgcgacctcgactatgtgccgaacgtcgcgagggaacagcgggtcgacaccgtgctcagcgtcggcagcggattcggcggcttccagagcgccgcagtgctcgcccgtccgaaggagaccagctcatgagcgcgccgacccccgtcgtggtcaccggcatgggcatcgtggcacccaacggcatcggcaccgaggagtactgggcggccacgctcgccggcaagagcggcgtcgatgtcatccagcgattcgatccccacagctaccccgtccgagtgggaggcgaggtactggcgttcgacgccaccgcccatcttcccgggcgtctcctgccgcagaccgaccgcatgacccagcacgccttggtggccgccgagtgggcactggcggacgccggactggagccggagaaggaggacgagtacggcctcggcgtcctgacggccggcggcgcgggagggttcgagttcggccagcgcgagatgcagaagctctgggggacaggtccacaacgcgtcagcgcctaccagtcgttcgcctggttctacgcggtgaacaccggccagatctccatccgccacggcatgcgcgggcacagctccgtgttcgtcaccgagcaggccggcggcctcgacgccgccgcccacgcggcgcgcctgctgcgcaagggaacgttgaacaccgccctgaccggaggattcgaagcctcactctgcccctggggcctggtcgcccagatcccgagcggcttcctgagcgaggccaccgatcctcaccacgcctatctgccattcgacgcgcgggccgccggatacgtgcccggcgagggcggagccatggtggtcgtcgagcgggcggactccgcacacgagcgagacaccgccatggtctacgggacgatcgccgggcacgcttccaccttcgactcccgccccggcacaggcaggcccaccgggctggcccgggccatccgcctggctctcgacgaggcccgggtcgcgccggaggacgtcgacgtggtctacgccgacgccgcaggagtgccggccctcgaccgggtggaggcggaagccctcaccaacgtcttcgggcccggcgccgtaccggtcaccgcacccaagacgatgaccggacgactctacgcgggaggagcggccctggacgtggcgaccgcgctgctgtccatcagggactccgtcatcccgccgaccatcagcaccagtgtgcccgcgcccgggctcgacatcgacctggtgctccaccagccacgtgagctgcaggtgggcaccgccctggtcgtcgcgcgaggtatgggcgggttcaactccgcaatggtcgtccagcggcgcatctgaccaagctgtctccatgtcacccgcgctgagcgcacaccaccgcatcacaccactcatccggaggttcatcgtgccccagatcggcctgccccgactcgtcgagatcatcagggaatgcgcaggagaccccgacgaacgggacctggacggcgacatcctcgacatcacctaccaggacctcggatacgactccctcgcccttctggagatctccgcgaaactggaacaggacctcggagtgtcgataccgggggaggagctgaagaccccccggcacaccctgcagctggtcaacaccgagacggccggggaggtcgcctgacatggcagcgcgcacggacaactccatcctcatcaacgcgccgttcgagctcgtctgggacatcaccaacgacatcgagtcatggccggagctattctccgagtacgccgaggcggagatcctccgtcaggacgacgacggcttcgacttccggctcaagacccgccccgacgccggcggaaaggtctgggagtgggtctcccaccgtgcgcccgacaaggaatcccgcacggtccgagcgcaccgcgtcgagaccgggcccttcgcctacatgaacctgcactggacctaccgggccgtcgccggaggcaccgagatgcggtgggtgcaggagttcgacatgaagcccgaggccccgttcgacaacgcacacatgaccgctcacctcaacacgacgacacgggcgaacatggagcgcatcaaaaaaatcatcgaagataggcactgcgcgggacaggagaccgcggcgccggtcattcccaccgagctccacgcccagcagctgctcctgctggccgcctccggacgcctggcccggatcgtccacgtgctgaccgagctgaagatcgccgatctcctcgccgacggcccccgccatgtcgcggacctggccaaggagacggacacccacgaactctccctctaccgcatcctgcgcagcgccgcctccgtcggcgtcttcgccgaggggcccgtcaagaccttctccccgacgcccctgtcggacggactgcgcaccggcaacccggacggtgtgctgcccctggtgaagtacaacaacatggagctgaccaggcggccgtacgacgagatcatgcacagtgtgcgtaccggcgaaccggccttccagcgcgtgttcggaagctcgttctttgagcacctggaagccaatccggaagccggcgagttcttcgagcggttcatggcccactggagccgccggctcgtcctcgacggactcgccgaccagggcatggagcgcttctcgcgcatcgctgacctcggcggcggcgacggctggttcctggcccagatcctcaggcgccacccgcacgccacgggcctcctcatggacctgccgcgggtggccgagtcggccgggcccgtcctggaggaggccggagtcaccgaccgcgtcaccgtactgcccggcgacttcttcagggaccccgtacccaccggttacgacgcctacctcttcaagggcgtgctgcacaactggtccgacgagcgagccgtgaccgtcctgcgccgggtccgggaagccatcggtgatgacgacgcacgcctgctgattttcgaccaggtcatggcgcccgagaacgagtgggaccacgccaagatgctggacatcgacatgctggtgctcttcggaggccgcgaacgggtgctggccgagtggcggcagctgctgatcgaggcgaacttcgacatcgtcaacacgccctcccacacctggacgacgctggagtgccgccccgtctaggcccctcccggacattcgaaaaccgcggggtctggcacgcaccagaccccgcctgcctgaaccgccagccccacgttcaaggagagcaagcacaccatgacgccgcacacggaaatccgcggaccgggcgacatcctccagctgaccatggccttctacggatcgcgtgccctcatcagcgcggtcgaactggacctgttcaccctgctcgccgggaaaccgctgcccctcgtagagctgtgcgaccaggcgggcatccatccccgaggctcgcgagacttccttgacgccctggtggcgcttggactcctggagcgggagggcgaggagatgtatcgcaacagcccggccgccgaccgatacctggaccggcgcaagcccggatacgtcggcggctacacccggctcgcggacaccaagctgttccccgtctgggcacagctgactgacgccctgcgcacgggtgagaagcaggtaccgagccagggcggcttcttcggcggctacgcggaccccgaggcggcccgcggcttcctcggcgccatggacgccgtcaatggcggcgtcgggcacagcctggctagcgcgcttgactggacggagtactcctcattcgtcgacctcggtggcgcgcgcggcaacctcgccgctcacctgcaccgagcacacccgcacatccaggccacctgtttcgacctgcccgagatggaacccttcttccaggagcacatgaagtccctggagacgacggaccacgtgcgcttcgccgggggcgacttcttcaccgacgccctgccgcgagcggatgtgtacatcgtcgggcacatcctccactacttcggtctccggcagcgcgaggcactgatcgcccgcatccaccaggcgctcaccccgggtggtgtcgtcctcgtctacgaccggatgatcgacgacgaccggcgcagcgccgcactgagcctcctcggcagcctcaacatgctgctgacctccgacgaaggacgcgagtacacccccagcgagtgcgtccagtggctctccgacgccggattcaccgacatccgcaccacggcggtgagcggacccgacaccctcgccatcggccgcaagccccggtgaggtggttcggcaggaccgtctggctgggtctgctcagcctcggcgcgttctggaccgggcacctgcccgctggccctcacggggaggagcgggccgtgcccgtcccgccggccggacatccggaacggctcgtccctacggcgctcacccctcaggagctgatcctgtcgcgcgagctgggctggacccgctgacccgacgaagagcccgacgaggagcccacccatgacagccccggtgccccagcacgtccccgaagccaccctgcgggaccggaccgccgaacttcacgcacttcgggagaaggtacggcaggggcccggccggaaggcgaccgagacccagcacaccaagggcaagctgaccgcccgcgaacgcgtcgaccttctgctggacgagggatctttcaccgaggtggagccgctgcgcagacaccgcgcctccggattcggcctggaagccaagcgtccccacaccgatggagtgatcaccggctggggcaccgtgcacggacgtaccgttttcgtctacgcacacgacttccggatcttcggcggtgcgctgggcgaagcacacgcggcgaagatccacaaaatcatggacaaggcggtcgcggccggggcgccgctggtgtcactgaatgacggggcgggcgcccgcattcaggaaggtgtcgccgcactggccggatacggcggcatcttccgccgtaacaccagcgcgtccggcgtgatcccgcagatcagcgttgtactcggcccctgcgcgggcggcgcggcctacagccccgcgctgaccgacttcgtgttcatgacccgcagcgtgtcccagatgttcgtcaccggccccgacgtcgtccaggcggtgaccggtgaaaaagtcacgcacgaggcactcggcggcgcggacgtgcacgcggagacctcgggcgtgtgccacttcgcgtacgacgacgagcagacctgcctggaggaggtgcgctacctgctgtcgctcctgccacagaacaaccgggagcacccgccggaggcacactgcaccgaccccgtccaccggcgctgcgacggccttatagacctcgtcccctcggacggaagccggtcgtacgacacgcgggccgtcctcgcgcaactcgtcgacgacggcgactacctggaggtccacgcgcgctgggcccccaacgtcgtctgtgcgctgactcggctgggcggtcaggtgacgggcatcgtcgccaaccagccggcggccctggccggagccctggacatccaagcggccgagaaggcagcccggttcgtccagacttgcgacgccttcaacatccccctggtcaccctgctggacgtgcccggcttcctgcccggggtcgaccaggaacacggtggcatcatccggcacggcgccaagctgctgtacgcgtactgcaacgccaccgtgccgcgagtgtcggtcgtcctccgcaaggcgtacggcggcgcgtacatagtgatggactcgcaggccatcggcgccgacctgacctatgcctggcccacgaacgagatcgccgtcatgggcgcggaaggcgcggcgaacgtcgtcttccgtcgccagatcgcggccgcgcacgacccggacaccatgcgggcacggatggtcaaggagtatcggtccgagttgatgcacccgtacttcgccgccgaacgcggcctggtggacgacgtgatcgacccggcggagacccgagaggtcctgatccagtcgctgaccatgctccgcaccaaacacgccgacctgcccctgcgcaagcacgggaacccaccgcagtaaggagaaggagagaccgtgtcccgtcgcctgttcacctcggagtccgtgaccgaaggtcaccccgacaagatcgctgaccagatcagcgacacgattctcgacgcgcttctacgcgaggacccgacctcccgggtcgccgtcgaaacgctgatcaccaccggcctggtgcatgtggccggcgaggtcaccaccaaggcgtacgcggacatcgccaggctggtccgcggcaagatcctggagatcggctacgactcctccaagaagggcttcgacggcgcctcctgcggcgtctcggtctcgatcggcgcgcaatccccggacatcgcgcagggcgtggacacggcgtacgagtcccgggtcgagggcgacgaggacgagctggaccggcagggcgccggtgaccagggcctgatgttcggttacgcgacggacgagacgccgacgctgatgccgctgccggtcttcctggcgcaccgcctgtccaagcgcctgtccgacgtgcgcaagaacggcacgatcccctacctgcgcccggacggcaagacccaggtcaccatcgagtacgacggcgacaaggcggtccgtctggacaccgtggtcgtctcctcccagcacgcctccgacatcgacctggactcgctgctcgcccccgacatccgcgagttcgtcgtggagccggagctgaaggcgctcctggacgagggcatcaagctcgataccgagcagtaccggctgctggtgaacccgaccggccgcttcgagatcggcggcccgatgggcgacgccggcctcaccggccgcaagatcatcatcgacacctacggcggcatggcccgccacggcggcggcgccttctccggcaaggacccctccaaggtggaccgctcggcggcgtacgcgatgcgctgggtcgccaagaacatggtcgccgcgggcctcgccgcccgctgcgaggtccaggtcgcctacgccatcggcaaggccgagccggtcggcctgttcgtggagaccttcggcaccgccaagatcgagcccgagaagatcgagaaggcgatcgacgaggtcttcgacctccgcccggccgccatcatccgcgacctcgacctgctccgcccgatctacgctcagaccgcggcgtacggccacttcggccgtgagctgcccgacttcacctgggagcgcaccgaccgcgtagacgcactccgcgtcgcaaccgggatatgacatgcgcatcgccgtgaccggttccgttgcaaccgaccacctgatgaccttccccggccggatgaccgaccaactcctcgccgaccacttggaccacgtctccctgtccttcctggccgacacccttgagatacgcaacggaggccccgccaccaacatcgcctacggcctggcccgcctgaagcaccgtccgctgctggtgggcgccgtaggcaccgatttccggccccacggcgaacagctctcgaaactgggagtagacgtctccggcctccaggagtccgcttcccgccccaccgcacgcatcctgcgcaccatcgacgcgcacggcaaccagttgatgtccttctaccctggcgcggagaccgaggccgccgccattgacctcgtcgacgtcgtccgccgtcacggcggcatcgacctggtcctcatcggggccgacgacccggcggcgatgctgcgccacagccgtgcctgccgctctctgggcatccgcttcctcgccgccccgtcccaccgactggaccggctcgacggcgctggcgtccgcgaactcgttgaagacgccgaccacctcttcaccagcgaatccgaacgcgaactgctcatcgcaaaaaccggctggacccctgctcaggtgctctgcaaggtcggcacctgggtgacgaccctcggcgaaaagggcagccgcatcgaccgagccgacgagcccccggccgaggtccccgccatcccgctcaccacagtcgccgactcgtcaggcttcgcggacgcatttcgcgccggctaccttgccgcccttgccaggaacattgacccggtacgctgcgcagagacgggagaggcgttggcagccctcgccctctcgaccgtgggtgcgcagagttacgagattccgcgagagatccctacagtgctggctgcggccatgggcctcgaacaaagagcttagaagtcgcgcggataggggtgcggtcatggtcggcggtccgggcgttcgtcccagcggtgagtcgtccatgcccgccggatcaggctgcgcacggtgatgatcgtgtcggcgaggtcgaagaatgcgtcgatgacggtggcgcgccgctcgtagcagcgggcgagccggtggaaggcgttctgccaggcgtgggtgcgctccacgtgccagcgccgactggcctggatgggcgccttctcgcctttgtgtgcgatgcggccgtgcagactgcgcgtggcgagttcggcgcgggtcttgtccgagtcgtagccgacgtccaggtgcacggtgacgtcgtcgggcaacgggcccaggtcgttcaggtggtccagggtcggggcgagcagcggggagtcgtggcggttggcgccagccaggacacgacccaggggaatgccgtacccgtccgtcatgcccgagcgtttcaggccctatttgccgcggtcgaccggggaacgcccggccacctcgccgcctccgggagccttggtgatggagccgtcgacggcaatctggtcgaggacgagaccgacgatccggtcgtaggagtcgagcgcgatctgcttgagccgggcgaagacgccctgtcgtatccactcgtcgcggcggctgcggatcgtggtggccgagcaggtcgtgtcggcgatcgcctggtaggagcagccgaagcgcagcagttgcagcagcttgtcgaagatgatccggtcgctgatgcgtcggcggtggcagccaagtggatggtccgggtggtactccggccgctcgggaagcaggaccgcgaattggtcccagagaggttcggccagccatgatggaagcgcgggcacaggtctccccagtgatcacagagcgtcgcaactccatggcttgtggttcgaggccaggttgcgggctggcgcccttacggcctttgtaggggcagtggttgaagcgcgggccatcgggtgagcatggctcccttgatggccacggcgagttgtcccaggccgttgagctcactgacgtcagcggtcatctggctgacgattccaagacggtggacgagtcgctgccgggccgttgccgtgccccatttccagtcccggttcgggatctcggccaagtggtcgacggttccacgttcggctcgctggaccagtgcgtcgcctcgtagcagccaggcagcacatgcatcggtgagatcatcttcggcatcagtgcccgtcgcgtcgcgccaggtcgcgcgataggcgatctctgctgcgtacagcaggggccgtgccggggccgtgacgcaccagcaggtcgggaagccgatgcgaaggtaggcgagttccacgagcccattgcccagcgcggcctgctcgaagtcgatgaacctgaccccgcggctggtgtgcatgtcattgccggggcaggggtcaccatgcagcagagcatggccctgtgtgccggccaggcggttcacgaggtcgtccagctcggttcggactccggtcggaaccgcgacgccgagcgtccaggcaagtccgaggaaggagtcgatgtcgccttgggtcgggccggaccaggcgggaagtgtgcctgtgtcgtcggtgctggtggccgcatggagtcgggccagtgccgcggcgtagtcgaccacccagtccgcgcggggcggttggtggtccaagtgttcaaggaccaggacgcgttcgtccggattggtgccgagaagtatcggcaccacgggcgggtcaacccgggacgcgagcttcagcgccgccacttcgcgggcgtacctctcggccgcctccggagcgtcgatgagctgcttgaccaccacgggtgtgccggacagctcgacccgccatacccgagatcgcgggctacttcccagtcggcgagcccgacgaggtgagcctagctcggaccgcagctcgtccccgaatggcagtcgtgaccacatggactcatgctcgcacgcacgcgtgcccgcgaactgcgtttacgccacggcattgctccgcctatccgcgtggcctcttacgagttggtgcgtgatagcggatgcggcgtcgtgcctggccg

SEQ ID NO: 98 - DNA, 5097 bp, Unknown
  Kingdom: Bacteria, Phylum: Actinobacteria, Class: Actinobacteria, Order: Streptomycetales, Family: Streptomycetaceae, Genus: Streptomyces
gccctgagccgccgcagcggcctccggccggcccggtccaccgggcgcgccgacagcaccgggtgccccctgggtgcccggcacgcccggagcaccagtggcacccggggctccggatgcccgtaccgccgccctggcggccgcggcgcctgcgccaggcggcaccggcgcgccaccggccgggtcggctccgccgtgcgcctcgggcccgggcacgtaacccatcgcgggggcgcccgccccggtgctgaagctcacaccccgctcgatccggtcgaggcgggccatgacggaccgctcgtcgccgtaggcggcgggcagcagtacgcgcgcgcagatcagttcgagctggagccgcggcgaggtggcaccgcgcatctccgtcaggccttcgttgaccaggtcggcggcgcggctcagctctgcggcgccgaaggagcgggcctgggcctgcatgcgttcgatcacgtcggagggggcgtcgatgagccccttctcggccgcgtcgggcacggcggccaggatcaccaggtcccgcagccgctccagcaggtcggcgacgaagcgccgcgggtcattgccgccctcgatgatgcggtcgacgacctcgaaggcaccggagccgtccccggaggagaacgcctcgacgaccgagtcgagcagcgaaccgtccgtgtacccgaggagggaggtggccatggcgtacgtcacaccggcctctcccgcgccggcgagcagctggtccatgacggacatggagtcacgcacggagcccgcaccggcgcgcacgacgagcgggagcacgccgtcctcgaccgggatgtcctccttctggcacacctcgcccaggtagtcccgcagggttcccggcgggaccagccggaacgggtagtgatgggtgcgcgaacgaatcgtcccgatgaccttctcgggctcggtggtcgcgaagatgaacttcagatgctccggcggctcctcgaccaccttgagcagcgcgttgaaaccggccgacgtgaccatgtgggcctcgtcgatgatgtagatcttgtaccggctgcgcgcgggcccgaagaaggctttctcgcgcaggtcacgggcgtcgtccacgcctccgtgcgaagcggcgtcgatctcgatgacgtcgatggatcccgggccgttgcgcgccaggtcgcggcacgagtcgcacgtgccgcagggcgtgggcgtcggaccctcctcgcagttcaggcaccgggcgaggatgcgcgcgctggtcgtcttgccgcacccgcgcggaccgctgaacaggtacgcgtgattgacccggttgttccgcagcgcctgctgcagcgggtcggtgacatgcccctgcccgatgacctcggcaaaggactccgggcggtagcggcggtacagcgcgagagacgacacgcatacgaggttataggcgcccactgacatccggcccggcccgcgaagcccggcccacgcgcccggccggcgaaccccgccccgcaacgcaagcgccccccacgcacccgccagagccgacctacccttgctgccttccggccctgggggagttcagtcagatagcgccgcgtgaggggctgcgccacacgttacccgatccagggccctcagaacgagttcgcaagcactctccgacgtcatgtaatgtttgccgcggaggattcgcctagaggcctagggcgcacgcttggaaagcgtgttgggggcaacccctcacgagttcgaatctcgtatcctccgcaggcagaaggcccggaccgagtgatcggttcgggccttcgtcgttctccgtctcagtttccgtctccgtgcagacctggcggaccccagagagcttcgccaacctgatctgccaccttctccagcatcggacccgtgacgtgggcatgtaccgagcgcgcatccgtgccgcacctccgggttcccatcccgtgatcgcgtcaacgacaacgtccggaacgccgaggaggagcagcaccgtcccggcagtgtggcgagcgtcatgcaaccggccgtcacgcactccggcatcggcaaggagctgcttccaccggtgatagtccgtgttcgggatcaacggcccgccagtcggtgaagcgaagacgtaccccttgtcctcccaccgatccccggcttcctggcgctcccgttcctgctcctcctgatgcttgccaagaatcttgatgaccggctcaggcagaccgatcgtccgacgtcccgcgcgggacttcatgtccttgaactcgcgccggatctgctggcgctccgggcagtagcctggcttccgtccacacgggtcagtgcagccgtgcacgtacttcggccgtaggcggtgcttccgcgtacggatgtacccggcgtcgaggtacacgtcgtcccgttggagtccgagcgcttcgcctcgcctcagatcaagccccggctgcgcgccgctcctgcctccggcccaatccgcccgcgctacgtcgacgcgcgcccacaggtggatagggccgtaggccatgagtcgagcaccgcatccaacggtgcggtcaaagagaatgcctccggcgggggatcggccggcaccgggatggagggggcgccgtcgccgactgcgagtccgctggggtaagtggtgggctgagcccggtgacttggcccgctgtacggtgtccgctccggggagggccatgtaatcgtccccaattggcgatcacaggatgcgaggacaccgtgcggggattgaagaagctctacagaacgttcaagggcacgcaccatgcgcccggggacgagacgttcgccaagacagcgccctgctcgtgctcaccctgctggcctgccttggagacaaccgccaacggctacatggtccgggcactgccgtcgtcgcactacagcatcatgacgaacccggaggtcggaacgttcgtcgcgcggtgcacgggttgccatgctcgctaccttgagccgtggatcatcgacaccgccgaccagatgccgtacgcctgggcgcgtgattccgactgaggtgcccggacacagccaccggccgagtgggcccggtgggccgggagaacggcacctgtgccccctgcgtgccgatcgagcggcatcgcgcggggaaagcggggagtcacggcgagcgtccgaagaacacgcaggtcagcgtctttcctggtcagggcgggtgcgcgtacgcgatcttccccactaggtgagtcggtggtgccgcctagagtgcgtgatgtcggcacaagatcaagcacccggcggtgggacgtggaggagcgcgggcggttcacactgctgcggatcatcggcaagcacggcggcagtgtcgtggtccagttgaacgactcgtacgccccgggcatcccggatgcgcagggacagcttctggtccacaacgacttcgtgtccggcattcacgacaccttcgtggaaccgagagacctggccagctgggcgcacgtatgggacgaggttgccgcaggacgcaacgccgtctggcgcgaagccgcgcgagtcgccgaaataggcatccgtttggactggcgagagaacgaccacgatcgaatcacggtcaccctcgccgaccagcagaccacccgcctggccatctcccttgacgtggatcgcggctggatcgacgagcaacgtgtcttgctcgaaagactccgtgccgtctgggcgcacctactcccagcagactgagaagcttcagacagcgctaccgcctgtcataggtaggcgagtgccgggtacagcagcggagtaccgcaaccacggcaaccgatcacgtccagcagtgtccctgcaaggcccggggatgaccggtctgacccgcgcgaccagtccacatagagctacggatcacaagttgcccgtgccccagccctgcccgatggagcggggagccacggggaacaccgggcagtcacggcagccatgcatgagaacggcctccggcctactcgtcaggtcgagggcggttcccgtcgttctcagcgcggaggcgggagggtgaacccacgatgaggtcgctgccacgaggtacacaagctcagggacggtcacgctcggccgggtccgtagcccgtccgtggcctcaatacttgcctcctagaagcacgacgattaccacggcgaccgtgagcaagatggctgctcccaaccagtctttcggcgtccttcccggacgttgcggccgctgcgggcgctcggttgcaccaaccatgagtccacatcgccgacaggaatgaagaccgggccccacaccttccactggaccgcgcatctagcgcaccggactagccgaccctgatccgccatccaaaccgcctcatgctgcatgcacgcttcagcttcccaagctgagggcacaacgcggctgggcaatgagggtgaccaacctcggcgagggtctcatgtcagcctgtcggggcagtgcttggcagcctcgtcagcgaaagtgcagagctcgccaatgaaatctcggtagctggctggggccgcgcggtccttgctgggcggcccgtcgatccactgctgccagagtccaccggggacaagaaaccgggccgcgtggtcagcaccgagcttggcgtcgacccacaagaccgcgccgagggcggcttgctggtcgtagtagaggtcggggcgacgcaggtagcggtcgaggtaagcggccaagaggtcagcatcagcacgggtgccgaagacggccagagcgacgcagtacgcctgccccgcgtagggcccttcactggcgagcaggagttcgccgagacgatcgcggaactccgatttgccggccacggcgacgagccaggctgccgtcttgcgctcgcgccaccctcggtcgaacagcatgtccagttcacgatgactgataccaccggcagcctgtcccagcttgcggaggaacctggttcggtcgcgtccgctcatcccgagaaggctgccgccaagtttgaggtaccgccggtcgggcgtgacgtagcggcggatcaacttgagcggctcttcctcttcgtctgcgcggcgcatggcagcatcctcgtacggacgaagctgcctactgaggttcaactcgtg

SEQ ID NO: 99 - DNA, 20901 bp, Unknown
  Kingdom: Bacteria, Phylum: Actinobacteria, Class: Actinobacteria, Order: Streptomycetales, Family: Streptomycetaceae, Genus: Streptomyces
cgggcgcaccggtgcgcccgccgacgatgccgtgcactcccacccaccgcaccaccgcaccggcgcgccgcaccgcacgcggagagcaccgacctcctgctccaccttcgcctggccgagcagggagatgtcgcggcgatcctccccgacctggtctggaccgacagcccccgaccgtcgcgctgaggcagctccctcgcggacagcaggtccggcgcatcaccacagcggtgcgccggggcagcagccgccatcccgccatcgtcgcgtgcagaactgcactgcggcaggctgtggccgaacacgccacgcgcggaggataggccagacaccgaaagccgtacatgaacgcgcggtggtgagactttgccgcgctctacgccgaaggtcttcatctggtccacgacgtgagccgggcgaagcgatggggcacggtggccgctttcgtgccggcggtctgctacgccacggtgcggatgagcttcttgttgacgaattcctcgatgccggggcggcccagctcacggccgaagccggagcgcttgatgccgccgaagggaagctcggcgccctcggcgccgacgccgttgatgaagaccatgccgacgtcgatgccctcggcgacccgctgagcctgttcggggtcggtcgtgaagatatacgaaccgaggccgtacggggtgtcgttggcgatccgcagggcgtcgttctcgtcggcggccttgaagaccatagcgacagggccgaacagctcctggtgggcggtcggggactgtgcggtcagcccggtcaggacaccggctgggtagtgggcgcccttgcgctcgccctcggagtgcagcgtggcgccatcggcgacggccgctgccacctgccgctccagggtgtcggccgctgccacggaggacagcggagccccggtctgggcggcgaggattcgggcggtgaacctctccacgaacgcgtcgtagaggtcggcgacgacgatgaagcgcttggctgcgttgcaagcctggccggtgttgtcgaggcgggcggccaccgcggattccacgaccgcgtcgaggtcgccggtggacagcacgatgaacggatcggagccgccgagttcgaggacgaccttcttcaggttccgtccggcgatctcggcgaccgcggcgccggcgcgctcggagccggtcagggacacgccctggacgcgcgggtcggcgatcacctcggcgatctgctcgttggtagcgtagacattgacgtacgcgcctgcagggaagccggcctcggcgaccagccgttcgagcagcgccgcggtggcggggcactggggggcgtgcttgaggacgatggtgttacccagggcgaggttcggtgcggcgaaccgggcgacctgataggcggggaagttccacggcatgatgccgagcaggacaccgaccgggctgcgccggatgacggcgcggccggggccggaggtgacggggagctcctcgtcggcgaggaactcctcggcgtggtcggcgtagtagtggtagatgtcgacgcagaagtcgacctcgccctccgcctcgtcgagcggcttgcccatctcgcgcacgatgctcgtggccagttcgacgcggtgctcggcgtgcagatccccgagccggcgcaggagcgcggcacgctcggctacggaggtggtgcgtccccaggcggcggccttgtgggcggcgtcgacggccgaggccacctcggcgtgggtggccgtcgggtaggtctgggtagtcgtgccggtggacggatcgatgacggcgtacatcaggtctccagggagtgcgcaggagtggtgacggggaagttgcgccggcctcgggcccgggtgtgccctgcggccggcgggcgtggaatcctatggttcgagaatggtgcgggctccgaccgcggacttgaggtcctcgaaggcggcggcagcctcgtcgagcgggcggagcttgccgatcagctcgtcgagcggcagccggccggccaggtagagacgggccagcttcgggatgtcgatcgcgccgacgctggagccgtagttgcagccgaggatgcgcttgccctggtcggcgaggtcgaagaggttgaacgcgcccgtggcgtcggcggcggccatgccgaccaggacggccgccccgccggaggtcagcatgccggggagggtctcgatgaccttggggctgccgatggcctcgaacgcgtagtcgaccccgccgagttcctcctggcaccaggcggccacgtcggtcgtggcggcgtcgagcgtgcgcgtcgctccgaatcgttcggcggcagccaggcgctcgggcgagaggtcgacggcgacgatggggtcggctcccaccaggcgcaggcccatcaccacggacaggcccaccccgccggcgccgacgacgaccgcggactcgccgggccgcacgccggcggtgttcatgaccgcgccgatgccggtggagatggagcagccgaggagggctccgatgccgaacggcagctcgtcggggaccttgaccgcggccgattccggaacgacgacccggttcgtgaacgcgccgagccccaggtagggccagacctcttcgccctgggcgtcggtgatgggggtggtgccgtcgggcagggtgttcgcgacggcctgggtgccggtgcacagccaggccatgccggccagacacttgcggcagcggcggcagggcgcgaaccaggagaggacgacgtggtcgcccggcttcaccgcgctgacgcccgcgccgacgttcgtgaccactccggcggcctcgtgaccgaggacgagagggcggtcgctgggccagtcgcccgtcaggatgtgcaggtcggagtggcacaccccggcggcgcggacatcgatctcgacctcgccgggcccggcgggccggtgcgagatctcgcgggtgtgcaggccggcctcggggtcataggcgatggcgggggagaggtgcgcggacatcagtgagtctcaacttcttcggtcgacggggcgggggagagccgggtgtggggtttggcaacggcgacgtaggccaggccggcgaggagcagcgcggagaagaccaggaccacggcccagacctggatccagctgcccgagggcggggcgagtgcggtgcgaggccaggcgatgttgaccgcctcgaacagcagccacacgacggcaaggacgttgatcaccaggccggtccggccgaggcggaactcgccctccgccgggttccagcggccgcgcaggcgggcgaggagcgcgacgagggcgaccgccaggaagacgaagtagaagccgccggatccgaaggagatcagcgtggccgccgcgttgccgttgagtccgagcaggaggccgagaccggccaggacggccgtcacggtgagcgagacccaggggatctggcgctctccgatcttggcgagctgggcggaacagggcagctgccggtcccgcgcgaaagcgtagacggcccgcccgatgtaggtctggatcgagatggcgcaggcgaagaacgcgatgaggacgacgacgatgaacggcttctcgctccaggcgcccaggctctgtgtcaccgcttcgaagacggggtccaccgttttcccggagacggcgtcctcggggcggcgcagcgcgaacgtcaccgcgaccgacgtcagcatcaccgtgaacgccacgaatacgtaggagcgcagcaaggcccggggcacactgcggcgcggctgctcggtctcctcggcgacctgcgtggtcgcgtcgaacccgaggaaggcccagccggccacggccagacacgtcacgaaccccgccgcgacggacccgccggaagcagcctccgcgcccaaggcgtcgaacaggatgctgaagccgtggtggcgcgcgaagagcagcaggaacacgctgacggcgatggaagcgacgccctcggcgacgatgcccgcgttgaggaagtgcttgaccgggttgacgccgagcagattgatgcccagggccacggcgatgaagaccgccccgagcagcacatgagccgccggtgacagcgccgagtcgctgaagagcatatgcagccagctggagccgagataggccacggtggtcagcgaggcgacggccgcggcgaggtagatccagcccaccagccagccgagccgcggcccgcccagccggcggacccactggtagacaccgccggtgatcgggaactgtgaggagagctccgcgtagaccgtggcgaccagcaactgtccggcaaaggcggcgacgaccgcccagatccatgcgggaccggcgaagacgaacccgagctggacgacggcgtagatgccgaccaccggcgagatcgtcgcgaaaccgagagcgaacacggcccacgcggacagggtgcgtttgagctcctgctcatagccgtactcggccagctcgccggcatcggcgcggttgtggtccacgttcgtctcctggcattgctacgggcgcgcctctggtggcgcgctcacatggggagtcggtcaccggactgccgttcctgcccgctgcggggcgggagccacgacacctggaggggcggcgaccacctaattggctctggagccaattgtcttttggctgtagagccaatagcatccgtggcatgacgtcaagaggtcctggcaggcaagttcgcaaatcggcggcagagcgccgccgcgagatcgtggccgcagccgcccaggtcggcctcgaggagggactggagtgcgtcacccggccccggatcgccgaagccctgggcgtccagaccggactcatccaccactacttcccggtcatcgaggaactcgtggccgaagccttcaccaccgccaccacggcagaactggacagcctgctgcccgaagcagcggccgaaggcgaagacggtggcgcgcggagtaccctccagcgcttcttcaccctcatctcgggcgccgagttcgacaacatcagcaagctctggctcaacgcgcggcacctgtcccgctaccgccccgtactccgcgaccaggtcgcagcccaggaactgcgctggtgccgccgcatcgaacagatcatcgcccaaggcgtgaaggaccaggcgttccgctgccaggatccctgggccgcagccgtgcggatcctcgcggtcgtcgacggagccggcgcttacatcaacaccagcgccgaccagcgcatgaccccactcgccgatctcgcccgctcgctggcggaaacagaacttggcgtgccggccggcaacctgctcatgcgctgacacacccctcgccaggaggcacagcgatcatcgtcccctcgtgagtgacaggactcaggtgcttgcgtctcctccggggggacggcttcttcaccctgtaggcccggaagccaggcaccggacagcatcgaccggggggaagtttccggggcatgacgaaggcccggacacctggtccgggcctcgcctgtcgaagttccctctagtcttctgagtcaggagttctgttcagttgtgtaggcttgcggggtggcacgtactgggcggccgaaggctgagttgatcctgtcggatgaggaacgggctgcgctggagggatgggtgcggcgccgttccacgccgcaggcgtgggctctgcggtgccggatcatcctgggctgcgcgtcgggggcgtcgaacaaggacgtggctgcgcaactcggttcgactccgcatgcggtgggccgctggcgcaagcggttcgtcgagcaccggatcgccggcctgggagacatgccacggcctggcgggccgcggacggtcaccgacgagcaggtcgccgcggtggtgaagcggacgctggagtcgacgccggagaacgccacgcactggtcgacgcgggcgatggccaaggagatgggcatgtcgcagtcgaccgtgtcgcggatctggcgggccttcggcctgcagccgcaccgcaccgagacgttcaagctgtccaccgacccgtacttcatcgacaaggtccacgacgtcgtcggcctctacctggacccgcccgagcgcgctctggtgttctgcgtcgacgagaagtcccagatccaggccctggaccggtcccagccggtgctgccgatgatgcccggggtcccgcagcgggtcacccacgactacgtgcgggcgggcaccaccacgttgttcgctgcactggaggtggccacggggaaggtgatcggctccctgcaccgccggcaccgggccgaggagttcaagaagttcctgatcaaactcgaccaggagataccggcgggcctggacgtccatctcgtgctggacaactacgccacccacaagaccccggccatcagaacctggctgctggcccacccacgcttccacctgcactccacgcccaccggctcgtcctggctcaacctggtcgagcggtggttcgccgagctgacgaacaagcagatacggcgcggcgtccacagaagcgtccaggcactggaaaaggacatccgcacctggatcaccgcatggaacaccgaccccaagccctacgtctggacgaagaccgcagacgagatcctcgaacgcctcgccagttatctgaacagaattccagactcagaagactagagcggacggacccggatcaggccgcgctcgaacggctcctgcagggttttcccgatcacctgcgggacgaggcggacgcctggtccgcgtgctccgcggagaaggccgcaagccctccctcacgatgaactgggccaccatccgacgctatgcgcactacaacgtcccggccctgcagcaggggggccagcgggtcagcagtctccgtgagatcacccagaaggacatcgaggacatactcagcagccgcacgggagaacaagcccgttcgctccacgcaagcctgcgatcgctcttccgcgcattgaaacgcgagcgcgtgatcttccgcgatccagcccgcggtgtctccgtggcctccaccgtcaacgcaccccggcgcatcccgtcggaccggctcgtgggtctgctggacaaggcaccgaccgcgatggcgaaggtcgtcgttgctctggtggccatccacgcgctggggccacaggagatccgccatcagctcctgaccggcctcgaccgtccagcagggcgcttggtcgtccgccgccgcttcggtgatcacgtcgtctatctcgacgaactgaccatgaagctcctgaccgactggcttcgcgcacgggctgagcgctggccccgcagcaccaatccgcacctgatcgtcacgcaggtcaccgcagtcgaccccaacggccctccggtgtccaaggacgggctgcggttggtgttcagaaagctcggtatccagccccggaggcttcgcatcgaccggctgctcgatgaggcacacgaaactgccggccccgtgcacctgatgcgcgtcttcgggatctccgacacgaccgcactgaagtacgtcagagcagcccatccccaccgattcgggccagagcccacccaagcctgatcggcagtcccgaacggggtacagaactggcaacctggcgtaatcgagagtcgcgtattccttggccggtgagggttcgtggtcaccgtgagtggccgtggggagcgtagcgactccaggtccctccggcttctgcgacgaggcgggcgttcaggccactgggcggatccggccaccggttgcctgtcgcaacgcggcttccagccggtcgcgggcctcggtctgggcagcgatccgttcgttgaggaccgccagccgttccaacgcgacccgcaggcccttttccgagggcggtgcggcggccaaatcgccgtccaggcacggcaggaacacccgcacgtcgtccagggtgagcccggcggccagcaggtagcggatgttgcggacccgcaccaccgcccgctcgtcgtagacgcggtagccgttgggggcccgctgcgaggagatcagtccggcctgctcgtagtgccgcagcgcacgggcggttgtcccggtcgccccggccagctcaccgatccgcacccatcccacctcccgggccactcctatcacgccacgactgctccgccgtcgaccgggagtaccactccggtgacgaacgacgcggccggtgcggcaagttgggtgactgcccaggccacctcctcggctcggccgatccgggccagtggggtgtgcgccagctgccactcccgcaccgctgccatccgctccggcgtcagaccctggtgctcgccgatgggcgtgtcgatcgcgccaggggcgaccgccaccacccggatcccgcggggtgccagctcgaccgcccagctccgggtcagcagctcaagagcggtcttggtggccgcatagaccgagctgccgggccaggcacgctgccccaccgacgtactgacattgacgatcaccccgcccgacttctccaaaagcggcaacgcggcctgggccagcatgatgggggcgacgaggttagtggcaagctgggctgtgatcatctccggcgtcagcgtgccgagggcgccgctgcgcacgatgcctgcgttgttgatcagcacgtccagccggccgtgtgtctccagcacctcccggatgatccgatccggctcgccctcggcggtgatgtcggcggccagcggcgtgatccggtcgtgcccggccccggtctcatcgaggggctcggcccgccgcccgatcgcgaccacatgggcgccctcagcggcgaaggcacgggcggtggcccggccgatcccggtgccggctccggtgacaacgacgatcctgctgctctgcggtgcggtgctgttcatgccggtcatcgtgcaaccctgccgccagcggcaaggtcaagcagcgcctgacgggcgatagtcaccgccggtggtcaccgggggcatagtgacgccatctcgttgcccctttggcgcgtacctcggtcacaccccaacccgtcggctactccgccagcgggcgccacgtcccgctccggttccccgctattccaccccgagaatccgcgaacccgtcggcttgcgtccaggagggccgcgacgatgtcgccgtggtcggctgagtcctggcggcggaccgtgacgatgtcgccgtcacagatcgcaccatcgatcatgctgtcgcccacgacccgtcggccgacagcgacgacgagtcgggtatcggcgtcgatgacgacctggtggttggtggagtaccggtagttcttcgactgctcggcgatggtgtggtcgcgggtgggaaccaaggtgccgtccacgatcagaacggtgcccttgcggaaccgctgccggggatggagcccgagcaggggaccgaggtggttgatgacccggtccgcggccgacttcgacacgccgaacagcgggccagttgccgcagagtgaggttcgtgcgccagtacgcggcgaccagcaggacccgactctccagcggaagcgaccacggtcgacccttgcggaccgggtcggcaccctcgcgccgcagcgcggtgatcagcttgttgaactggcgtgggctcaacccagtgaacggggttatccaggagggctccgacgccgtgatcacaccagccatgcggagatcattccagttgccaacacctccccctgcgactgatgctgggcactaggcgagcaaggggggacaccgtggggctcatgctcttccccggagacagcgacgtgaacagccctgacgtctcctggtcctacaccggcttccacctgttcaggcagtggctggccaccgtagaggggttcaccgttgctgagatgcacgggttcggtggagaccgcgcgtggagcagtgtctccacgcccctgacaccgctgctcgaccatccagatgatgacggattgctcaccgccgctcaatgcgcagccatgctgcccaggctggaggcgatcatcgatcagctccgccctgagggccgcgacgtcgttctccagcgccgtgtcgccgacgcacgccaactggtcaccgtcatgaagtactgccgggacaagggcgttgagctccgcttcggctgatcgccgcggacggcctcttgccgaaggcgaactgcggttacgagacagtccttacgagctcgtgcacggtaggcggtgaggcgtcgagggcttcggtggggctcgatgttcacatctaccgtgccgagccaggtccgcggtctgctggtgggacagcaggccggcgatggcctggacgatgtcgctgatgtgctcacggcggccgaggtggcgggtccatgctcgccagttcttcaggtgtgcgatgccgtgctcgacccggatgcgtcgcgaggagtgggctttgcgctgtcgctcgtgcatttcctcgtagcactccggagcgttcttcttgaacttgcggtgcggcgggcgtgttcacacgcccgccggtctgcgtgtccaagccctggtagccggtgtcggcgagtatgtccactgccggcccgtcggccaggagcttgaccagccctgactggcgggcctgggtgatgtccgcacagctgccggggcttgtcgggcttcagagcagcacgtgcccgttctcgtccgtgacgaccatggtcttgacggcgttctgcttgctcttgccggagatgaagttgtcccggtcctcgcgtccggcggccggccgccggacgcggatctcggtgccgtcgacgatgccggtcttgctgtcggtgccgaggtggtggacgatctcggcgagggtccgcaagcgcacaccgggactgacggtgcagccgcgctcggtgagcagcggccgcggttcaccgatggcaagggtgatggtggagcggtccacgtcgaaccagcgggccagtgcgtcgtgagtgaccccgtggcggagatggacgagcgtggccgggagccggtcgatgaacatcagtcgatgcttcgcaccggcgcccagggcccgcttccgcggctgcgagaggagcctggcctggtgctgctcgtgccacaaaggccctgtctcggctacgagttctgcattcacttcagccgacaagcccttgattctccggtcgctgacgttcgctgcacgagaaccgttccccaccacacacccgtgatcaacgatcacgggctcgacgtctcaccgcctaccgtgcacgagctcgcaagtggtgcaccaggaaggatgccgggtcagtgacgcacgaaacagcagcgcgagcgacgcgcggtgcgtcactgcccggcgggtgctcgggtgcgtccgattccgaccttggtcagcatctggctgaggaggtggaggactcgtggccgtgttggcactccgcgcgctgttcccgtccagtgggcgtcagtgagcttctctgtcatcgcgaggatctggtcgtcgccgcttctgaacggcgatatggccttcctggatcgcaatggggtcttctgggcgcgtaagcaagggcacctcattcaggaccccggtccgctggcaaccaagaacggtgtggtgggccacgtcaccggtctgccgacgtatcgcgcgttgagcggctgcgaggacagcgcgggctgactgagacagggtctcacggctgggctgccttcgaagccgctgttccggcgcgggaagcccctggcaggaacaggttcgggaagaacctgttcctggttccagaggcttcacgcggtgaccgaccgctcagccgcagtcggaaacgtgctcctccgttacgtacccatgcgctgcccggatcaggtggtcgtagcaggcgccggtgtctgtcgtccccgtccagtgctcggagtcggagccgtcggcggcggtcaccacgccgttggtgcgggcgaggacgccggtcgcgtcgacgatgtcgcgggtggtgccggcggtacgccagtggttgccctggctgacgctgtcgctgaggatacggccctggtggacggtggcggagagcgagtagttgttcccgtcggtgagcagcggcacgtccgagtcgacggtgatcgggtagtcccaggtgtgcttggtcgccgtcgggcggccgtgctcgggggtcgtcgtgacgacggtggtgccccgctgctcctgcgtcaccgcctgcttctgcccgccgctggagacggcgtcggtgttgaggtaactcgcgtgctgggtcaccgtggtgcggacgcggccggcggaggtgtcgaggtagccggaggtcttccagtcgcggtccgcactgacgcggacgttcaccaggtcaccggcgcccggggtcttcgtcgtggagacggaggggctcagcgacagggtgtcgtcggtgagcgcaccgctggtccgcgcgccgtggtggtcggtttcgaggaacagcgtgctgtccacggtccagccgtccgccgcgccgtagggggtgatggtgaaggtgtgcggcctgccgtccaccagcagtccggcgaaaggcgtcaggtccaggtcgtatgcctgggtgacgaactggtccaccgccgggagcggccgccacagcgtcggcacgatgccgcccgagtagacgacggggtagggctgcgcgagcccggcgggccgcccgtccacggagacctggacctcgcggtaagggccgccgccgcacaggaagtcggggtgctggttcgccacgtcatcgggcacggcggtgaaccactgctcgtcgcagccgccgccgcgggcgtagagctccatccgcacgtgggtgaggttccgggggagcgtgaccgtcttcgaggaggactggccggggttgaggctggtccagccggtgtcggtggtcgaggcggagagcggcatgacctggtcggcggtgtgcgccgccgggtagcggcggtcggcctggtagtaggtgagcgtcagcttcatgtggtagacgccggtgtaggtggagttgacaacgttgccaagcgagacggcgatgggctgcgtcttccgcagcagcgggatgaactcgctgacgtccttctccagcgaccagctgatgccctcctgcgtcggctccggcgtgctggtgcgcagcacctccgcaccgccgatccacacgcccgcgagccggtcgtactgccggccctgcacgctgccggaccagttgagcaccaccttgctccacggtcccggacagtccgccggcggtgtcaccgtgccgttccacgcgggcgaggagagggtgttgccgaagtcgtgctgcatcgccgtgacggcgcagtggtgcgtgtccggccggcttaccggcggcagtgcggtgaccgggttctggtagctggtctcgatctgtcccgagtcggcctgggccgtgcccgtcccgagcagcgcggcgcagagcagtgcggctgctccgagcacacctgcgatgcgtatgcgcatgtgttccccttccgtcgatcttggctgcgatcgcacgggagggaaccttggcaccccagcacggcagtacacaagaggggccgcgcaactcaccgatccgccgctccacggtgcccgctgcagacccgttggaccggacctccctcgtcccacatccgccgccatcgctgcaccgagcgcacgctgacccgcaggtccctagcgatcacagagctcgcctcaccccgagcgaaccgctccgccgtcatcaaccgcaacgcctcacggaaacgctgacgttcggcggtcagcccgcccccttgtggataccgcgtgcaccggtgataccgcagcggcgacgaaccgtcagcccccacgacaccacgagttcaacctcagcagccgggtcacgttaccgtgacctggccccctctgtcccgtcgcactccagctgtcagattctcaatgttctgcagaccgaccttgcgggttctcattcgccgcggaggcggaccagacgccgaggtcgcctcccggcagggacacgaaccgccatcctccaggtcctgtgatctgccatgcctcgaccgccgcatcggttggacacgtcaggtgcgtgccgtcctcgaacacaatccgaagcatgccggacttgaaagcgaccgcagagacgaccttcgtcccgaagagcggaaggactgcggccacgtcctgggtctctggcaccaaaagcacgccgggattggtgtgggccggcccggatgagagccgagcaggcgtttcgagtgtgacttcccaaccttcgtcgagggccagcgtgaggcggtagtcgacactgatcccagcaacgccccgccctcggagattcaggatccaccggtcatcgtgttcgaccggctctgcttcggtgctcatcacctcaccatggtgcacgggccagccgagggcgacggacggtcatcgaggcttccgccgaagccacgtctgtcgacaatcgggcaaggcgtgttctcgatctgcttggcgaaccagcagctcaggccaagatcaagagacagctccgatgcgacgggacaggtggttgtcgatctaagccttgattcgtgcggcagacctggcggcctgctcgatcttcgcgcagtgggccgcacgggcttcctcgtcgatctgcttctcgtgttcggcacgcaacccggtccggccgtcgaggccctcgcgcaggatgtcggcgtgcccggcatgccggatggactcgccgaggacatggaccatgatggcgaacaggttcgtgttcgtataaggctccggccaccacggcacgtggccgggggcgtcgaggggaagctcgttgatcgtcgcgtccgagtgttcccacgtgcgccggtagaacccgacgatgtggtcgtgggtctcgtcctcggccgcccacagatcgctgccgtcggagtcctgccaccggggcagcggttccggggaaggccggtcgaagacctcgccgaagtacctggcctcgacggtggccacgtgtttgaccaggccgaggaggttggtcccggtcgctgtcaaaggtcggcgggcgtcgtattcggacaagccgtcgagtttccagagcagcgcctcgcggtcccgtcgcagtctcccgtgcaggttgtccttcgccaaatcaacgatcatgcggcatgagcctgccatgggctgcttctggtctcaagatcccgtacgtggtccgcaacggccggcagagccgaggctaggcgtccggctgctgcggccggcccgcaagggaaaacccgaacgggccggcgcggcgctgttcaagccgctacggcagctgatcgagtccgtcaaccagaccctgccggggcgtccgcgtcgtgcaacgactcctcgctctagccactgcggtctggcacaaccaccacaccgaccaaccagtcatcgggtcactgaccggctacgaccactgaccttggcatcattcatccaggcgcctggcccggggcgatcagccccgtctcgtaggcgaagacgacggcctggacgcggtcgcgcaggcccagcttcgacaggatgcggccgacgtggctcttgactgtggtcgggctgaggaacagccgggaggcgagttcggcattactgaggcccgtcgcgagcaggcggagcacctcgagctcgcgcggggtcaggccggacagatcgcggtgcggggcgatggtctgtggttcgtcgtgatgggcgaagcgctcgatcagccgacgagtgatcgtgggcgcgaggagagcgtctccggtctgcaccaggcgtaaggcggagaccagatgttcgggggtgacgtccttgaggaggaagccgctggcgccggccgtgagcgcggcgtagacgtagtggtcgaggtcgtacgtggtgaggatgatgacccgcgttccggccgggcggccggcgtcgccgatgatgcgcctggtggcctcgatgccgtccatctccggcatccggatgtccatgaggacgacgtcgggccgcgtacggcgaaccgctgcgaccgcctcggacccgtcggcggcctcggccgtcacttcgatgccgtccgcagccaagatcatcttgaaaccggtgcgtacgagggcttgatcatcggcgatgacggcgcgcagaggcggccggtccgcggtcataccgcgctccgtgggatgcgggccgtcacccggtagccgtcggtcggcatcggtccggccgtcagctcgccctcgtagacggccaaccgctcgcgcagccccatgtggccccggccgttgctctgcaccggcggggaatccttggcgccaccggtgtccgtgatctcgatctccagacaggcgtcggtgtaaccaatggcgacggacgcccgcgcgccgcgcgcatgtttgatcgtgttggtcagcgcctcctgtacgacgcgatacgccgcgaggtccacccccggtggcagaggatccggcggcaacgacaccccgacgctcacgggcgtaccggcggcgcgtactcgtgcggcgagcgcgtcgagccgtgcgagccccggctggggctccaggccgtcgggcttctcgtagtcaggggcggccagcaggcccatcacgtggcggagttcggccatggcggcccgaccgcccgcctcgacggccagcagtgcctccttcgcctgctcgggcgccatgcccatcactttgcgggccgcgccagcctggatcaccatcacgctcacattgtgggtcaccacgtcgtgcagttccgcggcaatgcgggcacgctcctcctcgacggcgcgacgcatggcctcctcctgaacggcctgcagttctgtcacccggtcccggctggacgccagccgcagttgcagaaagcggacgaggctggccagcatccctgccaccaggagcacgaatcccgggctggaccatcccgggagcacgggttccgcgttgcggaaagtgaaaccggacagcgcggcggcgatcaccaggacggcgatcgccgttatccggtaacggctgtatacgacagcgctgtatgcgccgatgacacaggccaggacggtgatccaggaggcagagctgccgatggccagtgctgcgcccagcaccaccacgaacaaggccagcggataccggcgccgggctgccagaggcagcgtcgacaggacgaccagggcccagggcacggaggagggttcctcctccacgggcagctgaccagggtcgggcggcgagggcggggccggaaccccggtcccgacgtccaccacaggggggttgatgttcaccggcccgtcgccgggatagcgcactgccacgaacagggccatgacggtcagtacgaatgccagcaccgcatcggcgcgcaccgctcgccgcgacagcggagcggccttcgcctccggacgtagcgcgtcgatgagttgcagatgccagctacgccggtcttccgtctccatccgtgcattgtgctgcctctccgcccggcccgcgtccacctgaccggccagggcattgccccagaggcctacttctcaggaatgactccgcccgccgaatcctccgcaggtagggcctgaagttggttccgcggccgacgcgccccataggcggcacctctaggttcgcaggaccggcaacggcatgcgcctctcgcgaccgcaaggacggacaactgacatgcgtcaagtgatcgaactggagggtgtggcgaagcgctatgacagcgctggcgcaccggcgctcggaccgctcacgctcagcgtcgccaagggtgaggcccttgccgtaacgggcccttccggcagcggcaagtccacgctgctgaaccttgtcgctggcctggacaagccgaccgacggcgccgtgatcgtggccgggcgacggatcgaccagttgagcgagcatgccctcgccaagttccgtcgcgagcacatcggcatggcgtttcagttcttcaatcttctcgacgacctcaccgtcaccgacaacattcagctcccggcccagctgaccgggaccagtcggcgcaaggccgcggcccgcgcgggtgagctcatggagatgctgggcatcctggagcatgcccgcgcctacccgggccgcttgtccggaggcgaacgccaacgagtcgcagtcgcccgggcgttggtcaaccggcccgcgttgctgctcgccgacgagcccaccggtgcgctcgacaccgcctcgggccacaacgtccgcaacctgctgatcgatctgcaccgcgccggacagaccatcgtgctggtgacacatgacctgacgctggcggaggcgtgcgcgagccgcactgttcacctggtcgacggccacgtcgccctcgactcttgcgcgcaggccgtccgatgagcctgttcggtaccggcgcgctgggccgggtcgtacgttccggcgtcgaccgacggcgggtgcagaccgtggtgatcgccgtggccacgatgatggccgtggcctcggccgtggtcgccgggtcgctgatggccgccgcggccgcgcccttcgatcaggccttcaggaagcagcagggctcgcacatcaccgcgcagttcgatccggccaaggccagtgcggcgcagttggcgaagaccgggaagctgcccggcgtcgccgcgagcgcgggaccgtacccgtccacggcggttcgcccggtggaccggtcgggtttccagctgccgaagctgaccctggtagggcggtccggtcctgacggcgcagtggaccgagtggatctgaaggcgggccggtgggcgcagaagcccggcgagatcgtactcgatgcgtcgttcgaggggcccgccatcgggatcggcacccccatgaagacgtcgaacgccaaggacgcccccaccctttcgatcgtcggcttcgccgtgtcggccagcaagaccgccgacgcctgggcggccccctcgcaggtcgacgcgctgggatcggagggcaacccggtctcgagtcagatgctctaccgcttcgactccgcgagcacgaagcagcagattctcgccgaccggaagaagctcgccgcctccgtggggtccggagcgctcctcgggacccagtcctggctggacaccaagcgcgccgctgatcagggtgcggcggcgaccgtcccgttcgtgatggctttcggcgcgctcggcatcgtgatgtcggtgatcaccgtcagcagcgtgatcagtggcgcggtcggcaccagcctgcgcaggatcggcatcctcaaggccatcggcttcactccgcgcgaggtcgtacgtgcctacgtggcccaggcgctgatcccggccgtcgtcggcatcgccctgggagccgtcctgggcaacctcctggcagtgccgctgttgtccgacaccgagtcggtgtacggcggggcctcgctctcggtggcctggtgggtggacggtgccgtgccggccgccgccctggtcgtcgtggggttcgcggcgctgatccccgcgttgcgggccggcaggctgcgcacggtcgaggccatcgcggtcgggcgggcgccgcgcacggggcgcgggcagtgggcgcaccgggcgatgaggatgctgccgctgccgcggccggtgacctacggtctcgccacccccttcacccatccggtacgtaccctcgcgatgctgctcgcggtggcgttcggcaccatcgcggcgacgttcgcggtggggctgacctcgtccctgaacgcgatcggcacctcgcaggaccccgagaaccgtgccgcggtcacggtcacgacgaccaaggcgatcgacgtcgctcccgcgccgcctcctgtggggggcggcgcgggagacccgcctcccgtggagaacagcgctgcgagcacgtccaggaagcccaaggctgccgacccggcgaaggtgcggtccgccatcacgtcgcagccgggcacggagtcctactacggcaaggcccagaccgaggtcgccgtggccggggtctcaggatcgatccgggccagtctctacgagggcgattcgcgccccggcagctacgagatgctctccgggcactggatcaccggcaagggacaggtcgtggtgccctcacgcttcctggaaaggaccagcaccaagctcggtgacacggtgcgggtgacctacgaaaaggagaccgcgaacctgcgcatcgtgggcgagtccttcgacacgtcgggcagccagctggagatccacgcggacatggccgacttcacgtcggccgagcccagcaccttcctcgtcgagacgaagtccggcgtctccgccgccgagtacgcccagaaggtcgccgcggtcgtacagccgctggggggcgacgccacgaccggctccgaaccggggcaagacggcgtcaccctcatcatggcggcgacggcggtgctgctcaccctcatgctgatcatggtggccggtctcggcgtactcaactccgtggtcctcgacacccgggaacgcatccacgacctgggcgtctgcaaggcgatcggcatgtcgccgcggcagaccctgagcctcgtgctcgcctcggtggccgtgatcggcgtgatcggcgggttgctcggcgtccctgcggggtacgcgctgcaccacgtcgtcatgcctgtgatggggcgtgccgtaggcaccagcctgccgtcgcttgtcctcgatgtgtacgggcctttccagctgctcctgctggggctcggcggggtcgtgatcgcgatgctgggcgcgctgatcccggcaggctgggccgccagggcgcgtacggccacggcgctgcgcaccgagtaacgtccggcggagcgcgagctgctggggcggatccgccaggtccgcggggtcgggccgctcgacaggcacagatgccgatgcccccgcccagagaggccctcttgagagggactcggaaggcccgggcgggggccggcagcgggaagcagtgcgcggggtatcggcggcgggaccggatgcggggcaggggctccgacccggtttcgccgccgcacagacccggccccacccgcagaagtcccccgaga

SEQ ID NO: 100 - DNA, 5456 bp, Unknown
  Kingdom: Bacteria, Phylum: Actinobacteria, Class: Actinobacteria, Order: Streptomycetales, Family: Streptomycetaceae, Genus: Streptomyces
ctaggccctttcgtttggatcaccgggcagaccagaggaagatgcccgcgatgtggagtccggccaggtagatggttgcggtcttctcgtagcgggtcgcgagccctcgccactgtttcaagcggttgatgcagcgttcaacggtgttccgctgcttgtatgcctcacggtcgaacgcgggtggcctgccgccgtggcttccgcgacgaagccggtgaccgcgttgacccgctggaactgggatcaccgcgcggatccggcgcttgcggaggtgatcgcggatcgcgcgggaggagtacgccttgtcggccaggactaggtctggcctggtgcggggccgtcctcgtcgtcgcggaactcgcagtcgggtcatcacgtgcgtgaaggcgggcgcgtcaccggcctgtccggctgtgaggtagaaggccaaaggccgacagcgggcatcggacgcaagatggatcttcgtgcttagtccgccgcgagaccggccgatggcattgtcgacaggctccccgaccggggcccctttttgcgggctccggccgcgtgctggtgagcgcgcacgatggtggagtcgaccgagatggcccagttgaggtcttcttcggcgtcggcctgcgcaatcagcgcggtgaagacccgctcccaggtgccgtcgatcgcccacatccgtagccggttgtagacgcctcgccagttgccgtacttctccggcaggtggacccactgtgagccggtctggaacttccaggcgatcgcgtcgatcacttcacggtggtctctccatcggccccctcgtctcggcatccggttcgggagcaacggttcgatccgcgcccactgcgcatcagtcaatggcacacccgcccaacgaaggaggcagcccgtccgtcatgcctagtcccaaccgaacgaccaggaagtccgtcccacaaggtccgtggcgtactcggggaacggtgtgggcgggtcatcgacgatgttgttcgcggtcgagagcaggtgctccaaagcgagcaggttcgcgtgttccacgtcaacgggaggtctcgcgaccgatacgtgcagctcgctgccgaacaccgccacgacctgggcgccgaaacggtcctcccagctccgcaggagtgcgcacagcaggggcaatggtgcctctgcggaccagccgatcgaggccagagcgtcgctgccgcgacgggcagggacgagcacgaggcggcactcgtccagcccgaactggcccgcctcgatgagccaggccagcaggctcgtcgccgcctcgggcgtcggatctgcggacgtcgccggcacctgcggcgccaggcccggccactgttcgaagggcggaccgggatcgtgtggccacggctctacaccttcaggcaccggggctggtgtcggatccatccagaagggcagcctcctgcgccggtactcggcgaaatccgcagccaccacctcatccagacggacagcatctacgtcggccaggccgaccggtcttcccatggcatcgggccagcacaggagcggaaccagaccgcaggctgtctgctcgctcaacagacgaggccacaggcgctcaatgtcatgcgggaattcgtccgagacccacacgcgcgcgggaccagaagacaggaaccggccgggaggcagaccatcgggcagggcaaacgacatggtcgcaccatagacagtcgtgctgacagtgcagccatcgcaggacccaggatgcctccgccgccagtgatccaaacgaagcaccctagcgatcacagagctcgcctcaccccgagcgaaccgctccgccgccatcaaccgcaacgcctcacggaaacgctgacgctcggcggtcagcccgcccccttgtggataccgcatgcaccggtgataccgcagcggcgacgaaccgtcagccctcacgacaccacgagttcaacctcagtaggcaccgttctcgttggtgcaggaatttccgggacgctggttacgacgggcgagtagtctctggccatgtccgatgaactgctctctgcgctcataggcttcggaggcgcactggtcggcgctgcggttgcccttgcggcggcattgcttgccgcgcggatgccggtgcgtcagtcggtccgtttgcgacacttagacactcttgctggcatcgtcggaggcggccgagaagccgcagttgctcagaaggtgcacctcgggatcgccgcccgacgtgagctggtccgccggtatgtagctcttgatctctcgcaggagaacgctgctttccagctcgtgaagattgtccatacggcagctctagagagcatgaactcagaacggcagcagcaagggctggaatctctagacctggaggatgtgcatcgactcatcctcgattcgcaatcagcagcacttcagattgcctgggagcgaggcgagcaggtttccctacctcctcggccgccgagctcttgaactgggcaaacccggcaaaagcaatcccagtgcttctcgccagtcctggggggactgataccagtaccgcgtgcttgaccactccgttcggtctgccgcagtcagggcgtcggagtcgtcttcctctttgagagtggttctggtcccggatcatgcggcggatgctactgaacttgaatgcgtgatgtcggcggcttggatcaggtgatcaccgcttgcggttggggctccactcgtaggctcctgtggccgtctcgatgacttcgcggggccaggccagccggacctgttccaggtgcccgcggtgctcggcgatccagtctccctggggccgcgttcccaggaccgtcgtcaggcggtccgggtcgctgacctggatcgacagccagccgtcttcgtgcatgtggatgtcaaggctcaggccacggtctccgccgatgctggctgtctggccgggtcccagattggacagctgctgctcccaggagtccaggtcatgctggaagaggtaaaggtcgagctgggcgtcgacgaaactcgcggaggcgagcacgtccgcgtgcaggatgtcgtggccggtcagcacgcccggctgggaccgtccggtgacgcgcacgatgcagcggtccccgtccggatcggcgaggtggataaggtccatcggagcgggctccgtcatgctgttgctcgctttcgtgcgcgggtgtgggctgcatcgtctcctatcgctggtcgagcgacaccgtcagggcccggcttgaggatcaaaggctcagggggccaggccggtgctggcgagacagccgtcgatcacatccggccgatactggagcctcttaagtccgccggatgcggattcctatgatgggcgacgtagctccttcttgtttgtgttgggcaaatcatgcgtgtctgccatggtgacggcggttccttgcggagagggctgctctctggcgctacaccgggtcgccggcacccgccgacaggccggcctgcagggaacgatgccgacggctcctcgaagcccggcagcaggcgatggtacgagtggagcgacgaccggctgctggtccccgtggtgcggaccatgatgcggcgcgccaaccgcaccgccctgcgccgtctggccgccgagctgacccgttcctgacgcggccccgggtgcccacccccgctgttcccatcaggtgctgctcgtggtggacgactgcaggaccgtgcagcaggaatcccaccaggggagatccgcgcggatctcgtccagccggtgctcggagtagtccggcaggccctcggggattcccgcggcctgcaggagatggaattcggccgctgtgccggagagggaaagctcaccgtccgggaagaggccgatgtccatccgccattccctcctggccaccgagggcacgctgttcatgatggcgaaggggagcagcgtgcgttccagcggctcctcctcccaccggaacgtgtgcagtccgcggaccaccaggagagcggcgttgcccgtgtcgtactgcagggcggtgcgcatgtccaggaggagtcccgcacggcccgtggggggagagacccggcagtccaggaggtgcacctcctgcagcgcggcctcctcccgcagcgggtcccagtcgacggggtccgcccgcgtgaggtcagcggtgccggtgaacagttcttcgatggagatcacgggatcgggatgtggtagtagggatcggacttcgcgatgtcggcccgtccggtcagcgggtgcacggtctgtcccgcggcgttcaagtattccacgtacccgttcgggtactggaacttgcccttcgtgaccggatccatgacccggacgtaggcgaccttgtcgctgagcccgttggcgacggcctcgctcttcttgatctcgtacacccaccccttgaggttgttggccgtcgcgacggccttgcggcccttggggagccacagcttctcacccttgggaccgagcacgtcggcgatcaggcaccggctgttgtggaccagtacgggggtgccgccggccagcacgtagtacgagtgcaggccctcgaccgtgaggttgaaggtccgtgcgaagccgctgtagaaccggctgtcccggaccgtgacggtgtccccgccgtcggtcctgagcgtcatgcccggccggaggtcggccgccgccgtccacttgccctgggacggcgaccagaaggggtgttcctccgtggccgtcagcttctcccggccgcgtggggtggagacgcccagctcggtgaagtacttgtcgtgctcggtgacgatcaggtcggtgaccctgcgcggcccggtcagcccggtcaccgggtccgtggccagcacctggtcgccgacccggacggactcgatggccttcaccgagcggtccgccatgaggaccccggtgcccgcgaggaagcactcggcttgcacttctgggccatgcgcacggcacggctgctgtcgatcgcgccttccacgccctcgaccgacttcttgaggagcctgagcttgccgacgggcaggaagttcatggccgccagggcgcacttgccgagactggggttcttcacgcagtccttggcgtcgttgaggccgaggatctcccaggcgaactccttcatcgtcgggtcgatcgtggggaacacgagttcccggccggccagcgcgcacggcgggaggctgtcctggttgaccgggatgtagcacttgggcttgctctcctcctccttcttgcgccgctccgcggcggcgcgccgcgcttcggcctcctcggcctggcgcttggccaccacgtccttccaggccgcgacggcctccttgccggcctcctcggagctcttcccggcggccaccgcgtcggcctgggcccggtcgctcgcctgcttggcctcgtaggcggaggtgcgcgcgtagtcggcggagaactccgcctgcgcggccgactcctcggccgcggcggcgtcccgggc

SEQ ID NO: 101 - DNA, 16418 bp, Unknown
  Kingdom: Bacteria, Phylum: Actinobacteria, Class: Actinobacteria, Order: Streptomycetales, Family: Streptomycetaceae, Genus: Streptomyces
gccccgactgccggggcgcgggcggctggtgggtcggcggcgccgaccggagatggaggcgtgcggctgctgggcgaaccggcccgagctgcgcgtccggctcctgcccgccccggcctggccggacgacgagcccccgttctgaacgacccgaccccggcacaccggccggggtcggaccgccgggtggccgcgcatcggcaaagggccggccaccccgctccctcaccccttcgagataaggggccgccgacggtggcggatgtggccgctggggcgaggccgtgacggggctgggctgcgtgtctggcccacgtcggccagtaccacctggtcatggctgggcttctcgctctggtgtggctgttcatcccgttgccgctccggcatcgaggaccaggattttgcgctggaggtgtacgcctgccgggcgcgggcccaccgcgtttggctgggggcttccggtgaggccgggacccggcaccccttgcggcgcgcattcttccagcggcgggtcggctaggtgatgactttcggtgaacttcgttatgcggcagccaggttgtgtaggttcaggtcactgctcagcgtgagcgagtcgtcactgcctcccgtcattccggcgggcccttccttggacggtgagcgctcccagcgtgcctacgggccatcaactgggtctgtctcagtgcagtacgtccttgcgactgcgcgaccgcgtcgctgcccccggttctgtgtggggcgtcggcggtgtcgtgggattccggtcccgagcgccgacccacctggcgtgggtcatgtccccgatcaggcggcctccgagaagtgccgcaccacgacacccatggatgatcatgacgattccgctcaccttcgtcgcgcccggcggcgacgaggacgaccacgcccagggcgccgtcggcaagctgacgaccgaacagatcgcctccttcgctcccggcctgctcgacatggagcccgtcccgacccccaccgagctgaaggaactggctaccgtcgcgcaggaccacccgtcggtggtcctgccggccgagatcctccgggcgctgttcgccgggaccacccaccccgacgagctcctcgaccagctcgaccaccccgaggccgtcgcccagcagctgaacacccgccccggccgcagccggcagaagcccaagcgcaaggtctcccggctcggccgcctcgccaggctcagcaccaacaccgggtacgcggcggttgtgcgcagcccgctgcaccaaattgccgggatcatgaccctgccggtcaacccccggttcctcgccgcgatccagcatgccttcaccaagggccgcaccaccgaccccacgatcgagggcagcatccccggactgctggagatccacctgccgaccaagcaggacctggtcggcctgatcaccaccacggtcacccaccacctcctggactacgactggtcggactccatcgcccgcaccggcgtccaggagccgctgacgtgcatggccttgcgcgtgcactacgccgacggcaccagtgaggtcttcgtcgtcgccatcgacgggcagtcccggctgacgtccgcctggcgtaacgtcctgggcatcggcgacaagaagctgaccgccgccaccgcgccctcgtacgccgagaagatcgtgggccgcatgttcgcccacgacgccgtggccgcgtctcgcaaggccgtgaacggggcactgaacgccgcccgcgcgagctcctggaccgccaacgagctggaaaccctgcactcccgcctcgcccccgtcaacctcgtggtcggcacctacacccgcctcggcgagccctgtgaggccaccacctggttcaccgagcacctcacccagatccacctgcgcccccggcactggagcggcggaagcgaccaggagaaggccgtcgccgatgccctgctcgccgccgtccacgccgggaagatcacaccgaccctcgccagcgccctgtcgggacgtctgcacggcctggacttcgcccacgccaccggcctgccccaccaccccgccttcgcccgcgccctgctcttcgagacggtgctctccgctgacgctggcgcgctcatccgctccgccatcgccgagggcctctcgctcgaccccagcagcaaggacttccccgcgaagcttctgaagaccacggcgatcttctccacccgctacctgcgctccgacgccaagacggtcttcccgaacatggtgcatacctgggacaacggcggctcgatcatccgcacgatgtggaaccgccttgccaagggggcggacgccttcaccctgacccggctgcgggacgaccagtgggacgacgacccgtacaagagcgcctccgacctcgtcgagcagctgcggcggcgagccgaggacgacgtccccggcgcccgggacgaactcgccgtactcggcggggacgccctcaccgtcgccgaggccctgggccgcgaccgcgggtccaaggaagatctggtctccgaggagcccgtgaacggcaagaccccctaccgctcccggccgcccggcatcgtcgcggcgctcatcgagaccccggccggccgccttctcctcggggcggccctcagcagctgggtcgaccaggtccccggccaccccgcggactactcccgacagttcaccgttcccgagatcaccaccaccccggacggcacacccgccatcgccaccacccacggaaaccccaggcgggcaaccgagtggcacgtcttcgagctcgcctggccaggcctcccggccccccgccgcgcggtgatcgaggggcggcgcgacgtggcgcggcaggcggcagacgagggcgacaagagccagccgaaggccgcgtccatcaaggccctgcagaccgcggtcgggcggctggagcagaccatcacgtccatcctgacgagctccagccagccgaagttcgcggacggggcgcagcaggaggcactgcagaagctgctgttcaaggccagcctggacatcggcaagatccccgtcgtggtgcccgccagccggaacccgtaccccgaggtcggcgaggcccccgacgggccgactcccggcagcagcgacccctacgccctccccgagggcggcagctgatgagcgcgggatggaccctcggccccgaccttgccgcggacgtcgccgccatccccggccagcgtctggccacgccgcccgagaccctccgggcgtgcgtctacccgctccgcgaggccaacggaagctggaccttccgccacctcccgccctggccgacggcgctctacgttgccctggacgactgctatcgcagcctctacaccggcaaggtgcagcgcggtacggccgagcggcccgacatgaacgccgtccgggaccgcacccgcgagcactaccgcgacaaccagccccccgaggcccgccacacctggcaccacctgtgggtcatcccgatcgagtacggtgtccccggcgccgagcttgaggcgtgggagacccgcgtccgccgctgcacggcatcgccgcagacccgcaagagcgcgctgctgcgctcggcgtagcgaggccactggctggcccggcgatgagccgggccagccactcgtcgttgcaggtggaaggcatagaagccgtgcaccgccgacaggctgtgcgcgatcgtcgccggggcataccccgccgccaggacccgcttgccggtcgtcgggttcaccgacccgggcgggaagccaccctcatggtgcctgtgccgctgcgaattgcgggccgaccgcaactaggcggttttcgtttggatcaccgagccgaccagaggaagatgcccgcgatgtggagtccggccaggtagatggtcgcggtcttctcgtagcgggtggcgataccgcgccactgcttgagacggttgatgcaccgctcgacggtgttgcgttgctcgtatgcctcgcggtcgaaggtgggcggtctgccaccggccggtccgcgccgccgcctgttggtttgctggtcggcccgctccgggatcaccgcgcggatgccgcgactgcgcaggtggtcgcggatctcgcgggaggagtacgccctgtgggccaggaccaccgccggcctggtgcggggccgtcccaagggacggggaatacgcaggcgggccatgacgtcggtgaaggcgggtgcgtcaccggcctgtcctgcggtgaggtggaaggccagcggccggcagcggtcgtcggcaacgaggtggatcttcgtggtctgtccgccgtgggaccggccgatggcgtggtcgtccggttcgccggccggggcccctttttgcgggccccggccgcgtgctggtgagcgcgcacgatggtggagtccacggacacggcccagctggcgtctttgtccgcgtcggcctgggctaccagggcggtgaacacccgctcccaggtgccgtcgacggcccacatccgcagccggttgtagacgccccgcccgttgccgtacttctccggcaggtgcaccactgcgttccggtccggaacttgaaggcgatcgcgtcgatcacctcacgatggtccctccaacggccaccccgcttcggcgtctggtccgggagcaacggctcgatccgcgcccactgcgcatcagtcaacggcacacccgaaccaacgaccgaagggcaggtctggatcggtgccgttcgtcaggtcgcctgccctgcacgcaatcgtcgtacgtcccgcacgagcgcgtacaaggcgctgaggaagatcacggcacctgccacgatccagagagccgatgccccggagcggtactcgcgaacggcgccggcgagcaacaccgtgctggcaagaatgccgaaggccgagatcagagcgctgacgcggttagtcacacggacatcatcaccgacaacctcgctgagcgggagtgatccaaacgaatcggcctagtccaccatcgcggctgcctccgcctctgtggcctgttcccagccgacgtccacggtccacaaaacccggaaccagcgcagcaggtcgtacgcgtaactccgacacgtcaacgggctcacgtcccccagcagacggtcccggagatagctgctgaccggctcgacctcacgacccgcaccatcgaccaccagccacggcaacgacgccgacgtaccagcagcaaccaccccgatccttgacagccgtacacggccgtcaatcagatctcgatgtacacgggagaactcatgcgacaacgacatgcggccaccgagtcgagctgtggcctgagctagtgcagtcaactgaccgcacgtggcaccacggctgggagaccgtcgccgccctcatcgccaccaccaaggcgaccacccggtgactggccggacccgtacgcgactggagcgtgtccgcgcagcggccgggatcgcctcgctggccctccagcagatcgaggacgacctcagcgccgacgacgtcgaccaggaggagctcgccgcgatcctgcgcgagctcatcgaggacaccgacccgcccggcggcttcatggcctgtgtcgcgcagctgctcaccgccgccgcgaagcgagccgagcagatcgagcccgaccgtgacggtgacgccccctgtccgctgcacgaggccgccgcactgatcaccgatgacgccgggcagcgcctcatctgggctgcccgtgccctgcacccgcaaggagatggctgagatggcgagcgagaaggcgacgaacccgccccgggggcagtgcacgcagtgctggttccacgcgtacgccagccgcgaggcccacgccgggctcggtccgcgccaggactgcccgcagtgcgtggaccacatggacaacggccaccccgcccacatgatcgtccgctgacggcgctgcacgaaagccggcctgacgagccggggccggtagggcacccgggacggccgtcggtgtaggaacccagccgtcccggtgccaccccttcagccaccagagcgcaatccgacagaagaaggagcagaacccagcatgcacgcaaccctgccccacttccccgcatttggcgccgagcagtcgttcgacatgacgtttcccgacccgtcgctgatcctcctgatcggcgcggccgggagcggcaagaccacttgggcgcgcacctggccgtccacgcaagccctggaactcgaccgtttccgggcgctggtttcggactgtgccggggaccagggcgccaccgctgacgcggtcaccgccctgcacaccgtgctggaggcccgcctcgcccggaagaagacgaccgtcatcgacgcgacccacaccgagcagcgggtcagggccggcctcctgcgagcggcccgccgccacggtgtccctgccgtcgcattcgtggtccccacgctggccgatgtgtgcgtgcagcgccaggccggccgcagtgcggaacgggccgtgcccgaggacgtcgtacggcgccagcacgccgaggccgtcgccgccttcccgcagctgcacgacgagggtttcgaccacgccgtgttcgcggacagtatccgccgcctggagctgctgctgaagcgggccgccgatacccgccgccgcgagtcgggctgggacgacgacccgggggaagcgctgatccgccgcgtcctgggagcggagctgctgccgctgtggcagtggcgcgacacccccgcgttctccagcggccaccggaccggtgagatccgcctcggtgctgaccggatgatcctcggtctccgagccggtgccctcgacctgctggtcccctgcccgtacgacgacgcatgcaccgcccccgcctggcagcccgtccactcggtaaccgacctgctcgccgcctacaccgcgacccgcccgcaccccgacacctgctgcaccgtccacggcggccccgacgaccaccgacacgaagcggtcgagcggaccgcagcccccgccccgatccggcgctgaccggccgaagacaggcaggcccgggacggccgcaacatcggcagaggtcgaccgtcccgggccgctcccgccgtcagaccggagcacatccagcatgcctgacgtccggcaccgcccggcggcaggcacccctcgccgaggcgcgcctgggccggtttgcctcagacctccagcccaagcgacgggaggacgacgagcacgcctctgatctcacccctgatcgcgagagcacgcagcagcccttgccgcccggcttcaatccgggcggcaagggccgccttttgcgtctacccccgactcaagatcattcttgcccaattgtccaacaacgatcttgtgctcttccatctccgtccggtggcaggggcggagcgtaaaagtgtcccggccgggacacttttacgcgtgtcaggcgtcctctgcctgcgttgcgccctccaactgcttcagctgatgacatcgctgcggcgttcgaccaggaccacgttgcgccgctggtcatgcgctcgcgtgtaccgatgctccggaatccggcccgctcatgcagggccgggttggcctgactggtaggcccgcatgttgagctgtcgcgtattccagcttggacagccctggttggtctctctgggggggggcgtgggacctggtcgtcgcggtcggtggcgatctcgcgaaacagctcgccctcgccgccgccggagccggggtggacaccgcgatcgtcgtcgacaacgaaaccgccgcgcagtccctggaaaagctcctgcgccgcggcgacaaggttctggtcaaggcgtctcgcgcagggatgctctggcaggtgtgccagcgactcctcggtgaagacgtcaccggctggtgacgggcatccgtgaaatgaaccttaaccgccgatatttcggcatgatggctgccgacacacatctgaccgaggggaccgcacgatgcacacgaaacgccttgccgcagcggcaggagccgccctgctgactgccctcgccgtacccgccgacgcccacgccgccgccatcgcctgcggcggcgccgtctccacccagaacatcggcgcacaaggctgcatcagcgccgagcggttcaaggacaacaagatctggtggcgcgacatcaaggcgcacgccgtcatcaccaactcccgcgcccacgcctcctacgtcgactacgaggcgttcatgaacgtccagggctccagtagctggacgaaactcggcaacgggcgctcggtcgttcagcgccgttccacgatcggccccttcgagatcggctccgcaacccgcatctgcggcccggtcaacgcaaaaatcaccatccgcgtccacgtccggccggccggaggcgcctggtcaaactggagcagcgccgcgacgtcgcagtgccagacctgatctcacgtccgacgaagccagtcacggcggccccgacgaccaccggcacggagcggtcgagagggccgcagtccccgccccgatccggtgctgaccggccgaagacaggcaggcccgggccggccgcgccgccaggccggagcaatcccatcatgcccgccgcccccacctacccctgctcaaccccgctatcgtcgagccgaatgctcaactgggcgcctaagaactcctaacgaaatgatcttcgaggtggttggatcattccgggactgatgatccgggggtgtggggtggctcggccgaagccgtgggaggtcgatgacgagttgtgggcggtgatcgagccgcttttgcccaaggtcgagcgtcggacccggcacccggggcgcaagcggcatccggaccggcttgtgttccagggcatcctgttcgtgctgcacaccgggatcgcctgggaacatctgccgcaggaactcggcttcggttcgggcatgacctgctggcggcggctggcggagtggaccgaggtcggtatgtggccccggctgcacgaggtcctcctcgtcaggctccgcagcgcgaacgccctggacttctcccgggcggcggtcgacggctcccacatccgggcgttaaaaggggccccgcgacgggacgaagccccgtcgaccggggtaggacgggcagcaagcatcatctgatcaccgatgccaccggcatcccgctcgccgccaccttgacgggcggcaaccgcaacgacgtcacccagctcattccactcttgcaggctgtgccgccggtgcggggcaagcggggccggccccgttgccgccccgacgtggtgctgggtgatcgcggctacgaccatgacaagtaccgccgtctcgtctggaacctcggcgtgaagccgctgatcgcccgccgcggcaccgagcacggctccggcctgggcaggcaacgctgggttgtggagcgcgcgttcgcccacctgcactggttccgccgactgcggatccgctgggagatccgcgacgacatccacgaagccttcctcaccctcggatgcgcactcatctgctggcggcgactgcgcgctctggcgagcgatgccgtgggctagtcagccgccgctagcaggttgagaacttccttgggggtgaagctccagccgaccaggcgcggaccgctccagttgatgccgatcacgagtccatcccgggcggcatcgggcagtacgtgatcgcaccaggtgtccaagggcatggactcaacgcggagtccatgcccccagatcttcgctgccctctgggctcggggcgaggtcgaccagaaggggagacttcgcgcgccgtccgcggagaggtgagtcgggcttccgtcgtcatcccggacaagccagaccactttgctttggcggacgtcttggaagaatgccgccgcttgcgaaccgctctgactcatgacccccgagcctaccgttccccaacactcatttcgttaggagttctaagagggcatctgatcattgttcacgctgttgtgtgtgggatgtccgtttcaattcgccaggttggtgtggattctcctgtcagttcgcgggtcattttgttagccatggcccagtggatcatcgctcgggatctctgcgggagtgcttcgtagtcccgtgccaggcggcggtgctgcatcagccagccgaaggtgcgctcgatgacccaccgcttcggcagtggctcgaaccctttcgaccgtggtctctgcaccacctccacatcgatgccgaggagggcgccatggttgaagaagctgctctggtaaccgccgtcggcccacactttggtcacgctcgggtgggccgcggccaggtcgtcgagcaggagcttgccgccggcggtgtcgtgcacggacgcggcagtaacgacgacggcgaggaccaggccgagggtgtcggtgatcaggtgacgcttgcgtcctttgatcttcttgccagcgtcgatgccctggctgatctcgggcacgtttatcgaggtcttcacgctctgcgcgtctattacggccgcggtcggctgcgtactgcggccgtgggctcggcgggtcttgtcgcgtaacaggtcgtgaacctgctgcgtagtgccgtcggcttcccacttggcgtagtagtcgtagacggtcttgtacggagggaagtcgtgcggcaggtactcccacgggacgccggtgcggttgacgtagaggatcgcgtcgacgatctcccgcaggtcgtgcacacgggccgccgttccgggcccggttcgtttcgctcgccaggcggtgaagaccggctcgatcagagcccagcgggcatcggacacatcactgcggtacggacgtcggggactcacacaccgtgcaacgaccgccaacgccagcagtcacaaaaacatcccagaacaccaactacctagatcagatgccctcttacgcggagaggaatccagccacttgcagcgcagttgctccgagctcggctcatcttgagtggaggtgagcgggcccctcgagttcggtctgtacggcgcgtagcaccaagggccacgaggccgtggtccgctccctgaatcagtgcgctggtttcaccaccgctccagtcaccgcggcgcggctgacagcccccgtgcattactttcacctgcccagcgggccagtccgagtacgtcaccaacgtcgggttggccgcgtgaatctgaccggccgtctgtcttgccccctgcgccccgcgtacggtggcggacagacccgccaggaggttccggcatgagcgcccagcccgaccacgcccccgtcccgcaggccgccgtggccccaccgcggccgcgcagctgctcgcccggatccgcgccggccgccgcgtcggcacctgggggccggcgttcgagcaggactgggcgcgcgctctggaggacgcccggcacagctacagcctcacccccctgtacgacgtcgtgcgcacctggcaggcccgcctggccgccgcgccggcggtcgacgcgttcctcgcttcgggcatggacgactccgagggcgtggacctggccgacgtcctcgacggcggccaccgccgatgactggcaagccgtggcccgcgcgcctgtcgcccggcgccctggccgtcctggaggacctgcccgagcacgggcgggagatggtccgcgacgtcctggacatcgccggccgcgacccctgggccttcccgccgttcgactcccgcgacccggaaggcgaagacgtccgctccgcctcggtcggccagctcaccgctgtctactggatcaaccgggccaccggacgcctgtacgtcctcgacctcgtctggctcggctgaccgcctggagacaagcaacgcaccttcgcgtgggtctgagctggtccttcgtaagatcggcgggcccaggggttctgggtatgactgtgagcttgtcgccgtttgatggctcgaagaacttggccgcccggagccccgcgacgactcgaccgctgattgggatacgcgactcgatcgctgtgtatggcttcgtaggcgagaagcagcagcgtttgtcagttggttcgagcagtggtcagcgatctcgaggcaggaaaatgttggtgagaggcgagagcggctgtggcagcaggacgcgctatgccgactcggcgaaacccgctactgcggctgcgcgtttcgatgctggtcgcccgcctgctccaaggcggcttcgtaggcgtgcagggcggtgatgaccgtggcgcgttccgcaggggctagaccgcgcatgacgcattcccaggcagaggcgctgccagaaagccattcgccgatcggtgcggcgtaggcgggggcgatggcgatgatgcggcggcggcggtcggcgggatcggcagtgcgctgcaggacgcccagccgtgatagctcgctaaccatgaggctgacggtcgtcggggctacctccagccgggcggccaggtcgttgacgctggtgggaccgtcgtactccaggtgggccaacagcgcgagatgtcgcggtgccaggtccaggccctggagcgccggaggtatgggcaggcgcttggcgcggcctacgagccgtggcatgagcaacagcagggtgcggacggcctcgtcgacggctgggccgtccgattccgtggacacagcgaactctcccaggtacctttgaaaacaaaggctttggatttaaagggaacgaggtccactatgccgcatctgactgtccaccttccagagaacaggctgaccggtaaggaacccatgctcctcgcggcgctgaccgatgcgatcgtcgacgtctatggcgaatgggctcgcgacctcgtaagcgtccgcctggccggagtccccacaggccgtttcgcgcagggcggcaaggccgtggacacaaacgcctcggtgatcttgggcgttcgagctggcgtcttcgaccgccccgaggccgcccagatcaccgcgcgcctcggcgccgcgctcaccgacgcgatcacgcgcgtcgtcggcgatgaccttcgcgccggcaccatggtcgaactcatggcgtcaccgccagaacgaaccttcgtcggcggcgctctcaccgtgtgaacctcatcggggccacatcatgacctgcacttttccaaaagaggcactcagacggctgcttgctgttcggctcgggctcgggtggtagcgagacggtaggagtcggtgccggtctcgatgatgttgccgccgaacaggcatggcgccaggccgacgatcggcaactcgcaggcggtggcaacgtcgtgcgtctccccggcgaggaccacctcgtcggcaccagccgctgcggcgatgttcgcgagttcggcgatcccggcgagcgcgtcctgtcgaccttgagtgggcggactcagatcagcccgaccaactcgccgcgcaccagcggcatcatcagcgggcgcggcacgacccccttgcccagcgatgcggtgtacgtcttcttcgccacgccgaccagtccgttccacatccgcgcttccacgggagcctctgccgtccggtgatccgatcaccgcaccctgccatggggttcgaggccgtgtcagggggatgatcagccagcgtgcggtattcggccaggcccgatggcttcgtgccattcgtcggcaacccggccccgacatcactgaggcccggctacacaaggaggctggggcgacgggctgccgtccctgcgtggtgatgaccggtcgtataggggaggacgggacggttgctgaccatcaacgtgacgctgctgctcgcaatcatcgtgttcttccggctgcggcggcgtacgcaggcccgcagccggaacgaggagaggaccaccgccgtcatcatcctggcgctgggcgtcttgatcgcgcccacccctgcaggccaggggatcgtgaacatcttgggccagcttgcgagtggcgttacccaggccggccgatgaattcgtgcacgcgtacgggccggacggcgcccgcgggtgcgcactgtggggcaccggttgggggagcaggggggtgatggcgctacgtcgacggcgccggcgcttgaagaagctggcgcgcaggcagttgcaggtctggggtgcggtggcggtggtggtcgccgtggcgtgggtggccgggcactggtcggtggtgtggcctgtccttgtagtcgtgctcgctgcggccgtgctgggcggggccggctgggcgctgctgcgggcgcatcgtctggcggtcggccaggaccgcgcgtggcgggcgcaggaggaagcccgggcgcgagagctatcgatggccgaggtcgacgcgttgtcgtggcaggagttcgagacgtacgtcgcggagctgtgccggcgggacggctgcacgaaggtcgtcgtcagcggcaagagcggcgacctgggggcggacgtcgtcggctacctggccgacggccgcaagctagtcgtccagtgcaagaagtatgcgccgcaccggagcgtgtcgtcgcaggacatgcagaagttcgtcggcacggcccgcctcgagcacggcgcggacgtcgcgttgctcgtcaccacctgccgctcgttcacaagggacgcgctgggcctggcactgcgccaggacatcgtggccatgcatcgcgacctgctgggctcctgggtcaagggcgctcacttggagacgctgatcccgctcaacggcagcggcggcggtacccggcggcgaccgcctgcctgaccggccgggcgcctgcggccctgcccggccctgcccggccctcaagtgtgggtagcgccagcgcaggggagaacacaacaacgcgtgagccgcgggaagttggctgaacggggcaaagccagggcgagtggagggtgacaccatgccgaagcgcgttctcacaccgacgaaagcgtgcatgtgacccgagtgcggcacccagacgaaggcgagcctgcgcagcggccgccgctacgagcacgacgctcccgaaggcaccggtccttgcccgaaatcgggggctgtggtcgtggccggttcggagttggtgaacagctacgagtgcgcctgcggcacctgggctcctatcacgagcaagggcacgctcgcccgtcactccatgccggaaggccaggggcgcccgctgtccggataaccgatcgagacgcccgctgcccgtgaacgtccccgtcgcgtcaccgatggcctgctgcggctggtgccgccgacgcccacggaggggtgggcgaagcccgtcacgggcggcagcggctccagtgtttacgcgattcccgccggactgccaggtcacggacgccgccgctagcgagggcggggaggtatcagccggcggggtcggtgattactgaaattcaactcgtggtgtcgcatggttgctcaggtgggtctgatggccagaccggtctccgcaaggcagccgtctatgaggtcgctgcggtactggatgtgccgtaagccccggcggatgcgctggacgaggtgttcgggggtgtggaaggcgacgttggagagccagccgcgccgcagcagtgaccagatcccttcgacggggttgaggtcgggtgcgtagggcggcaggtagtagatggtcagccagtcccggccttcggcgaacttccgcaggtcggcggctttatggacgttgagattgtcccagacgagcacgatcgggccgccgagttgctggtgggcggcaatcaacaggtcccggtagtcgcgccaggagaagctcttgcgtccgtcgcgccgaccgtcgtcccggcgtggccggtagatcagccgagaccggcggccgggtttgtagcaggtcagtgcggcgatggatatccgcctgcgggaccggccccgcacccgcaccaccggggtccggccgcgctgcgaccaggtcgtggcctgcggcggcgtcatggagaaaccggcctcatcctcgaagacgagccaggccccactcaccgccgcgagtcttccgcgcggggccacacctccttgacccacccggccaccgcctcgtcgtcccgctccatggcgcgtcgagccgggacctggcaggaccagccgttgcgcaccagcagcttccgcacaccctggatggtgtaggtcaggtggaagcgccggccgatcaccgtcttgatccgcgcgagcgtccatcgctggtcctcccagccgtgcgcgacaggccccttcgccagctccgcctccagttgcgcgaactgcttctcgctcagcctcggcagcgatgcgggcccctgcgaccgcagagcccgcggacctccctcgtcccacatccgccgccatcgctgcaccgagcgcacgctgacccgcaggtccctagcgatcacagagctcgcctcaccccgagcgaaccgctccgccgccatcaaccgcaactcctcacggaaacgctgacgctcggcggtcagcccgcccccttgtggataccgcatgcaccggtgataccgcagcggcgacgaaccgtcagccctcacgacaccacgagttgaacctcagtagg

SEQ ID NO: 102 - DNA, 2849 bp, Unknown
  Kingdom: Bacteria, Phylum: Actinobacteria, Class: Actinobacteria, Order: Streptomycetales, Family: Streptomycetaceae, Genus: Streptomyces
cggccgtcctccaggacgacctcggcgccggccgcgtcctgttcgtagcccgcgacggcactgctgccgcgcagttcgatcgtgccggcccgccggcaggcgtccagcagcagggagtgcagctcggcgcggtgtacgacgacgtacgggctgccgaagcgctgtcggtaggtggcggtgagcggcatgctcaccacgtgtttgcccgtgcgcccgtccatgaaccgcagttcgtccatgtgcacggcggtggcgcggacccgctcgcccaggccgaggcggtcgagcgcgtggatgccgttcggcgcgatctggatgccggcgccgatctcggcgaagcgctcggcgcgttccaggacctgcacgcggtgtccctgcctggccacggccagggccgtggccaggccgccgatgccgccgccgaccacgaggatccgcgaggtgcgcggtggtcgcgcccggtcagtcatcgtcgtctcccaggtgcagcaggcgggcgagttcgagtcgtttgatcttcgtcgtggcggtctgcggcaggtcttccagccgccgctggaccggttcggccatgggcgcgagaccggctgccgcggccttccaggcggccaggtcgaggggcttgtcgtcccgggtgcacaccacggggaccgccgtaccgtccgtgcctcgtacgatgacgacttcgacgaggtccgccatcctgccgagcagtacgtcctccgcggcgagggtgctgccgaagccttcgatgaggtcgacctcgcggtccagcaggtggacgcagccccagcgggtgcggtagccgacgtcgcccatgcgccaccagccgccctcggagagctgggcggcgtaccgctgcggttctcctagataggtgaggacgcgtccctcgctgcgcacttctatgtagcccgggttcgacttcgtgggcggtttgccgtccctgctgacgacgcggacgccggtcatgccggggaaggggacgccgacacagcgtccgtcggattccagtgagcggcgccggctgaaggtccgtacgacggccgggccgatctcgctctggccgtagagctgtccgaaacgggggttcgcgcgccgtgaggcgtgcagcagccgctgcacggtgcgcgggtggatggcgtcgaaggtgctgctgaagagcttcacgttcgccagcggcgcgcgcgggtcggccgccagttcctcccagtcgacgaaggagttcggatgcgcctccaggatgcccgggcgcaggcgggcgaagaggtcggccacgtgcgcggggcgggcatcggcgagcacgacgatcggcagtccgcgcagcagtgagatcgccagggcggtgaacagccgtgagtgcacgaaggacacgtgcatcgcgacggtctcgcgtcggcgcaggaggggcgcgacggccgatgcctgggggcggtagcgcgcctcgaggctgcggccggtgtgcacggccagtttgggtgtgccggtggtgcccgacgtgtgggtgatcagggcggggcgctccggcggcatggtgacggccggtacgcgctcggcgccggccagggaggacagccggaccgcgtcctcgtggtcaccggaggtgaggaggacgcctctcgtcagagcggggacgtccgagggcagttcgccgacgagtgtggctgcgtcggtcacgaggaagggccgctcggcgcggcgtatcagctccgcggcggtcgcgccgtccagggtgggcgagagcagcacgggtacggcgccgatgcgtgcggcggcgcacgccaacagggtgatgtcgaaggcgtcggacttgtggacgaccacccggtccgcgggccggaccccgtgggcccacagccgggcggcgtagtcgtcgacggtgtccgcggcctcggcgacggtggcccggcggcccggccacggggtgaggtcgaggtcgtggtcgaggatcaggaggttcgcggggtgccgggccgccgcacgctcgaagagcgttcccagccggatgccgcggtttgctatgcgttgcagaagcatggtgccaagctctcgtcgcgtggacaggggcagtcggccgccacgtgccgggcgtccggcgggcaggatggggcggtcgccgtcaacgggcttgctccgcccgtcacttggcttcgatgacggccttgacgcgctccagcgtggtcgcgaggtcacccgcgaccttggctccccactcggcgaagaacctcttcttgtcactgtcgtccatgtcggcggtgatgccgcggatcccttcggtgggcgcgtccatccggaagtggtggaccagtacgcacccttcgccggcgggcaccaggtcgaaaccccacacgctctgctggcgccgtcccgcgctgtcgcgcatggcccagcggaaggtccggccgggttccgccgcgacgacctcggattccgtggtccatgtcccgcggacgacgggtgcccaggagaccacgctctcgtggcggaggttctcgccgcggaacaccgcgccgacggtggccggttctccggagacccatgtgccgcccaggcattccgggctccactcgccactgcgcggaaggtcgctgatcacggcgtagacggcgtgcggggcggccgagagcgctgtctcggcgcgcgcgtcgaagagcggggcccggtcgtggcccgggagggtgacgtcatcattggctgtgggcatggcccgaagcctgcagatggtgcgccgggtcggtcaaaggccgcatcacgggtccgtcaagtcgtgcccggccctctgcggaggtggtgtgcggggcgtgtgcgggcgagttgacggatatgcgtctcctgcgccgcgcgcggcg

SEQ ID NO: 103 - DNA, 6198 bp, Unknown
  Kingdom: Bacteria, Phylum: Actinobacteria, Class: Actinobacteria, Order: Streptomycetales, Family: Streptomycetaceae, Genus: Streptomyces
gggtgtgggcgtgtgccgtcggcacggggatcgccaccgcgtacgacggcccaggcgtgatccacgccatcgggcacggcctcgacctggacgacctccgcgcggcccacgccccccaaggccgtcactcgtgaccgccgcccgactggtccgcaccgcttctgccgccgccctggccgccctcgtcaccgcccatgccgcgcccgtcgtctccaccctcggaccgctgcgcacccgcgccatgccgcgcctctccggccggggccgcccggatcacatcgccctcaccttcgacgacggacccgaccggaggtccaccccgcacttcctgcacctcctcgccgagcgccgactccgcgcgaccttcttcctgttgggccgcgaggcgcaccgctcacccggcctggtccgcgagatcgccgcggcgggtcacgagatcgggatccacggctggctgcaccgcccgctgctgctgcgcggcccgcgtgccacgtacgacgacttcgcgcgcgcccgcgacaccgtcgccgagatcacgggacagcagccggcgctcttccggcccccgtacggcgtcatgtcgaccgccgcgcacctggccgcccaccgcctcggtctcacccccgtgctgtggacctgctggggcgaggactggaccgcccgcgccacgcctgagtccgtccaccgcaccgtcacggccgatctggacggcgggggaaccatcctgctccacgactcggactgcacgtccgctccgggcgcgtggcgctcggccctgggcgcgctcccccgcatcctggacacgtgtgcgcgacgtgggtacgaggtcggccggttgagcgatcacggatggcctcgtccggcctgacacggcgaggtcggcggtccagcgggccggggaacggtggcaccaattcgtgggatgcgcctttgtgacacggtccggtccgatggtccgtcttgcgtgacgctgctcggacacaccgcgggaacggtcctcgttccaccaccgtctacagttcagtagaccgtctactgggttgtagtcattcgtcgggtacccctcggccggctgggccgtgtccgagcgccgtggcccgccggcttcccgagcgatcggctcccggcaggaccgacacggagacggacacggagacggacacggaggcggacacgggctcggcgcgccggacggcagaaccgacgggcagcacagcaggaggccggaccgacacggcacgggaacagacgggcgtggcaccggaacagacgggcgcggcacgagagcagacggacgtggcagagagcagcgagagcagaaggagaatccatgcgccagacggtcttggtcgtcgaggacgatcacgccctgcgtgacgtgctgatgcgcggactgcgcgacgaggacttcgaccccgtgcccgcaccggacggcgccaccgccctgcgactggccaccgccgacgtctccgccgccgtgctcgacatcgggctccccgacgccgacggacgggacgtgtgccaggcgatgcgcgcgaacgggttctcctcccccgtcatcttcctgaccgcccaccaccggctgaccgaccggctgtccgggttctcggccggaggggacgactacctgcccaagccgttccacctcgccgaactcgcggcccgcctgcgggcagccctcaaacgggccgcgccgccgcctgccaccacagcgggggacctggcgctggacgcggtccggcacgcggtcagcgtccgaggggcccccgtagacctgaccccgaccgagttccgtctcctggctgcgctcatggcggcttccggtggcatcgtgcgccgccgcgatctggtccgggcggcctggcccgagggcgcccaggtccacgacaacaccctcgaccagtacctgacccgactgcgccgaaagctgcgcgacgcgggcagcgaccggacgatcgccacggcccgcgggctcggccaccgcctgtcatgagcggcacccgccaccggccgcggcccgacacgacggccttcctccaccggccgcggcccgccatgaccgcattcctccaccgcctggcgccccgtaccctgcgcggccggctctcactcgtggccctcaccacggccgcgctgctgatgctggtcctcaccgtcgccttcaacaccgtcgcccagcaccgcctccagcaccaggcggacgacgaactgcgcacccgtgccgccgccgtcgcgacgaccatcgacaccaccggcacgaccgtacgtgtcctggagacctcccacgacgcactcctcgacgccaacgtgtggatctacgccggcgcacgcctgctggaagcgccgccgaacgccggccccctcacccgcgtcgccgactccctcgccgggcacggcgggcggcgctgcgtcaccgccgacgtgcacggtcccctccggctgtgctcgcagccggtgtccccggacgagagcggggctctggtggtcaccgcgctcgacctctcgccctaccggagttcggccgacaccctgctcgtggggtcgctcgcgctggacgtcgtgatgctcgcctgcacctatgctctgacgcggctggcggtgggccgcgcgctgcgcccggtccgcgagatgaccgaccaggccacccagtggagcgccgtcgcctccggggaacgcttcggccatatgcggcaccccgtcgaactcgcccgcctgggtacgtcgttggacgccatactggaccgcatccgcaccctcctgcgccacgagcgccggctcaccggggaactctcgcacgagctgcgtacacccctgagccggatcatcgccgaactcgactggtggcaggcccgcccccgcaccgccggccagacccacgccacccacaaggtcatcgcggaggccgcccagtccatgcaggccatctgcgacaccctcctcgacgacgcccgcggcggcgcactcaccgctccgggcaccgcggagatcctccccacgctgcgacgcctcaccgaagtcctcgacgcaccgagccacgtggcggtagccgtcgacggcccaccgctggaggccggagtcccccgcgccctcctcgaacgcatcgtcagcccgcttctggacaacgcctgccgctacgcccgctccgaggtcgccgtccgcgcccacctcgcacccggcggcgtacgcgtcgacatcgtcgacgacgggcccggtgtaccgcccccgttcgccggacagctcttcgagcccggtcggcgcgcggatcccggcgacggacacggcggagccggcctcggactgccgctggcgcgacgcctggcccgctccgccggcggcgaggtgacctacgaccccggacacacccccggggcacggttcgtggtcagcctgcctgccgggtgacggcggccgcactcggcgctaccggcctgtcacggcgtgatgccgcgctggacgtccttgcgggagacggccaggtagccgacgaagccgaggatggccaccgtccaggacagcgtgaccggccccaggcccaggccgagtccgcccctgccgtggccgacggccatccagtcggcgacagaggcgccgagcgggcgggtgatgacgtacgcggcccagaacgcggccaccgcgttcaggctcccccaccggtgggcgacggccggaacggcgatcgcggcggcgtacaggacggcggagcccaggtagccgaggccgatcgtggcggtgaggtcgcccgccgccgtgcccagtgcgaacgtggccaacacggcggcccagtagaaggtctcccggcgccgggtgcggatgctgtggatggacagggtgcgctcgacgcggtaccagagggcgaagacggcggccagcgcggccatgaagaacggggtcgagagcgtgtacggcaccccgaggccgacgtgcaggacgtcggcggccatggtgccgaacacgctgaccatgacgatcgccgtccagtagacccaggcgacgtaccggcggacggcgaactgcaccgccagagcggccgccagggccatgccgccgaggccgacagcggggatcgggccgatcaggtgggccaggaagtcggacgccgtctcacccatcccggtggtcagcaccttgatgacccagaagtagacggtcacctccggcaccttgctcgccgcgtgacggatgtggcccgcgggccggttgtgagtgaggtgatcagtcgacatggcaggcaccatgacatggtgcccggctctcctcccagacccctttgccagagttttggtgcttccggtacgggagttgtccgaggcccggccggacctgaaagcaacctgaacgcactgaccgacgcactggtcagcagcgtgcggccggtggtatcggcggtcttgcgcgcgttcgggccgtaccttcgtcgcgggagcggctacgccggcttggagtgcgccagggtgaccgggtcggtggacaaagatcgcgcgggcgacagactggccccatgacatcagatgccaaggctgaccttcacttctatttgcagtccgcccgggatgccctgctgtggaagctcgaagggctcccggagtacgacatccgccgcccgctgacaccgaccgggacgaacctcctgggactggtgaaacacgcggccagtgtggaactgggttacctcggtgacaccttcgggcgaccgtccggcgagccgctgccctggctcgatgacggtgcggagcccaacgcggacatgtgggccaccgccgatgagtcacgcgagtacatcgtggagctttaccggcgggcatgggcgcacgcggacgcgacgatcgacgcactgccgttggacacgaccggcagggtgccgtggtggccccacggcagggacgaggtgacgttgcaccatgccgtggtgcgagtgatcgccgatacgcaccggcacgccgggcacgccgatatcctccgggagctcctggacggtgccgtcgggatgaacaagggcaacgtcagcatgccgccgggcgactcggcgtggtgggagaaccatcggagccgggtggagcacgcggctcgggaagtcggccgagacgcgtgacgtcgcaccaggccgagtaaagcagcgacggcgccggctctgcggctcggtgggtccgcccgcccgacggtgatcggccgggcggcgggcctgcgacgggcatggccggcccggaggtgccgcagacctgcccggccctgcgggagggcggatcgggcgggcttccgtcgtgccccgcgccgctaccgcgccgcgtggtgtccggtcactgggcctcgggcacgtggggccgcccagggacggccagtcgctccagtgggtggacgacgtcttggtgcggacgtaggcggcgcggtcggtgccgatcgtgaattccatcgcgcttgcgtggatacagtgcccgctcggcccgggcagggggcggcccgggccgagccgcagtcctcgccctgctgcaagcggctgacgccgcgctcacgccccctgctgttgttctgctgacggtcagtcaggcggccatcgaatgctccgacatcactcacggtgttcgaatgcggcacgccgccaccggggccgtggatgccgcctccgtgtgtccgtcaggtgtccgagagggcgtccagaccggtcagggcgccgaccgggtcgaggtcgggggtgccccggggccaccagtcctcgcgttccggctcggactcgtacgcgtaccacaggccgtccctgcccagacggagctggagccggccggcggggtgcgtgagccggttgcgccaggggcggaaggcgggcaggtcggcggcgaggagcagtgggcgggcccggtcgaagcggccggccggcggatcccaggactcctccaggacggcgagcccttccgcgccgccctgccgccaggcggccaccgcgcgggccaggtcggccggggtgcggccggtggcggaggcgagcgaggcgtagagggcgcgggtggcggcggtcagcccggagccggggcgggccgcggccaggcggaccgcgtcctgccacagggtcagcccgccgaccgggtcgcggcccgtggtgagcagggcgtgggcgcgtacggcggcgtcggtggccagttggtccagggcgaacgggtccggtccgccgggggccgccgggtaggcggggggctgctcgggatgcgg

SEQ ID NO: 104 - DNA, 658 bp, Unknown
  Kingdom: Bacteria, Phylum: Actinobacteria, Class: Actinobacteria, Order: Streptomycetales, Family: Streptomycetaceae, Genus: Streptomyces
cagcaccgcccgggcgcggcgggcggcggtgctggtcacggcaccggtggggctgtgcttcctgcccgccttcgtcgcggtcggcgtgctgcccgtggtgatcggactggcgggcgggatgtggagaggcggtggcggctgacgggacgtggagtgcgcgcggcgaacgcgcgatcggtgactgaacggacgacaccttacgggggttgagatgaacacggttgagagggacacggtggagacgggtacgaaggcgcgggaacggctgcgtgctctggggcggcgggctctgagccgcctgcgcaaggacgccggaatggtcacgtccgaatacgccatgggcatcatcgcggcggtggcgttcgccgtgctgctgtacgaggtggtgacgagcgggcaggtcaagacggagctgcagaacatcgtgaaacgagccctcagtgcgcgcacgtgagcgacggggcgggcgcggcgccgaccgggggtctcgggcagcggacgaccgggggttcgtgacggcggaggccgccatggtcctgcccgtgctggtgctggtggtgaccgcgttggtgtgggggctgctcgtcgtgctcgcccagatccagtgcgtggacgcggcccgggcgggcgcccgggccgccgcccgccaggatccgga

SEQ ID NO: 105 - DNA, 8256 bp, Unknown
  Kingdom: Bacteria, Phylum: Actinobacteria, Class: Actinobacteria, Order: Streptomycetales, Family: Streptomycetaceae, Genus: Streptomyces
ggcgggggccacggcccggggcagcgcggtcgcggactctgcgcgtggggccggggcgacgtatcgttgccggaagagtgccgctcgtggcgggaagagtgccgcccgatcacaagggagacggccatggccgatcccaagggtttcatgaacacgccccgccgggagtggccccgcaggccggtccgggaacgggtcggcgactgggacgaggtgtacgtcccgggtgcgctgctgccgatcatcagtgagcaggccgaccgctgcatggactgcggagtcccgttctgccacgacgcctgtcccctgggcaatctgatccccgagtggaacgacctggtcgcgagggaggactggcgggcggcgagtgaccggctgcatgccacgaacaacttccccgagttcacggggcggttgtgcccggcgccctgcgaggcgggatgcgtgctcgcgatcaaccagccggccgtcaccatcaagaacgtcgagtgcgccatcgccgaccgcgcgtgggaggaaggtttcgccccgccgcgcccgccggaccggctgtcggggcggaccgtggcggtgatcggctcggggccgaccggactggccgcggcccagcagctgacccgcgcggggcacacggtcgccgtgtacgagagggacgaccggctcggcggcctgatgcggtacggcatcccggagttcaagatggagaaacgccatctggagcgccggctcgagcagatgcgggccgaagggacccggttccgtacgtccacggcggtcgggcgggacgtcggggcggcggagctgcgtgcgcgctacgacgcgatggtgatcgcgacgggggccacggcctggcgcgaactcgatgtaccggggcgcgagttgaccggagtccggcaggcgatggagtacctgccgctggccaaccgggtgtgcgagggcgacctggatgtctcgccgatgtccgccgcgggccgccatgtggtcatcgtgggcggcggtgacacgggcgccgactgcctgggcacggcggtgcgggagggcgccgcctccgtgacccagctggacatctacgcccagcccggcacggagcgcgacgaggacagtgagccgtggccgacctacccgaagatctaccggctctcggccgcgcacgaggaggccggggccctgcggacggcgcccgccgcggacgccgacgcacgtctgttcgctgcgtcgacgctccgcttcaccggcgacgagcaggggcacgtgcgcgagctgcacctgaccgaagtggacgcacggcgccgccccttgccgggcaccgagcgcacactgccggccgatctcgtgctgctggcgctcggtttctccggaccggaccgcgaggacggcctcgtcgacgagctggggatcgaactcgcgcctcgcggcacgatcgtgcggggccccgacttcgcgaccggtgtccccggcgtgttcgcggccggggacgcggcgcgcgggcagtcgctgatcgtgtgggcgatcgcggagggacgggcggtggcggcggcggtcgaccggtatctgacgggcagttcacgactgccggcgccgatcggaccatacgaccgtccgatggcggtgtagaccgagatcaccgaagtccggaacgagcaccggcaggagtaccggcaggggcaccggaacaaggatgggaatgaacaagttcgtaccaaaattaagcagttgagcaagaaaaacggcgcggtccggccgagcggacgccggtcaggagagcaggaagtcggcctcccctgccttggcgccctcgatgaacgcggtcatctcgtcggtggtgtagatgagggccggtccgtccgggtcggtcgactgacgcaccgcgatccggccgtcggccagcttcatcgcctccaggcagttgcccccgttgccgccgctccacggcttgtgccagccctcactgcccagttccctggccggcatgccgttgtagatccgctcgccgcggatccgccggccgtgacggctcggtgagggctgggacgtgatgcgatccattcacaactccttgcggagatcccggaggatctccttcgtgcgatgtgctgtagcggcctgcgccgccatgcggtccatgacctcgaggtgggtcgccacctcgctgcgcgcgtccaggtagacggcgccggtcaggtactcgctgtagaccatgtccggcagttcgggcatggcgaaccggaacagcacgaagggcccgtacgtgccggcgtgcggccccgaggagaacggggcgatctgcagcgtcacgttgggcagcttcgtggcgtcgagcagtctgtcgacctgggcgcgcatcacctccgggccgccgaccgggcggcgcagcgcggtctcgtccaggacgacccagaaccggggcgcgtcggggcgggtgagcaggtcctggcgttgcatgcgcagggcgacatggcgctcgatgtcgtcggggctggtctgccctatggcgcccgaggtgagcactccgcgtgcgtagtcctcggtctggaggagtccgggcacgaagtggggctcgtaggaccggatgagcgcggcggcgccctccaggctgacgtacatcgagaaccagcccggcaggatgtcgtggaaccgctgccaccagccgggcctgttggcgtcctcggccagttgcacgaaggcctcggcctcgtcgtccgggatgccgtacgccttcagcagcagttgcaggtacgggatcttgagggcgacctcggccatctccatcctgcggacggtggcgggggccacgcggaggatgcgagccgcttcctcacgcttgagtcccgcgcgttcccgcaggtcgagcaggcgccggccgagcacgacctgcccgacggtcggcgcggaccgcggttcgctcacactccacctccacctaagagttccaggggctccggcgggtccgcggacccgcgccgggcccggacggccctgaagaatcccgacaggcctgcggcgccattcgaagattcattcgaagatccgacggatcctcggccgatctcaactggcgccgcgcgacatgctgttgcgagcagtgtgccacggcgcttcaccgcgtcatacagcactctgcatttttcatagtgacacttgccaagtgttcacggcggggagatagtggcaagcgtgattccgtccccgcccttaggaacagacgccgccgcgggcctcgcccccggcgccaccacgggagcgggccccaccggggccgttgccgagcgccggttccgtttcgaactggccgcacacccgggttcccccgcacaggccagacgactgaccagacgccggctgaccggctggtcggtgtgcgaggacacctgcgacaccgcggccctggtcgtcaccgaactggtcaccaacgccatcgtgcacaccgcgagcaaccagatcgtctgcgagctgctcgacggcgacgacctggtacgcatatccgtgcgtgacgagggctgcgccccgggtgagccccacccgtcgccgcagcggcccgaggaggagcacggcaggggcctgcttctcgtcgaggccctgtgccgcgcctggggggcgcaggaacagggttccgggctggtggtgtgggcggagctgccccgcacggccgagccgacggacgcgagcggcgccgcgccggacacacggccggcctcggacgcggactgcggcgcggtcccggacccgtacgcggtcccggacccgtacgaagcgcgggacgcacggggaacgcgggatgcacgggaagtgcggggagacctcggctggggggcgcgtccgaagccggcgccggcccggcatccgggccacgaggacgatcctcgggcggcgcgggagacgcgggaggctcagggcggaacgcacgggtcccacatcccgcagtcacctcatgtaccgcacccaccgcacacccacaacagcccgcaccagccgcatgcaccccacgggacacacggaccgcaggcccatggaccgcaggcaccccatgcctcgcacggaccgcacgccgcgcagcattcccacttcccgcacgcaccgcatcttccgcagggaacgcgaccgcaggaacctcatggaacgggggccgtatggctgtgagcggcgcttccagctccggtcaggtactcagtctggacacactcgcacgcctcggacgcgcggcgcgtacgcccggcgcacccggcggtcccggccggtccggtccgccgctccggttggcccttcccgaggggatgaccgtcccgctgggctgtgacgcggtggcggtgcccgcccgcttcggctcccagctgatgccccggctgccgcgcgtgggctgcgtctacgccgacgcgacgcactggtggtggatcgttccgtcggactccgactacgccctccactggccggccccggcgtactacgcgaccggtgcggtcctgcccgacaccgcgcgcgaccggctgcccgccctcatccaccggccggacgggtcggtgccctacacgccgccgatcccgctgtacctggcgctgtgccgggtgacgggcacgaccccggcctggtcccgccccgtcagcgcctgagcgcacaccggcgcaccgtccgcgcactccgcgctctcacgtacctctgccgcacgccccgcgcttccgtgcgccccgcggcgcacgcgccgggttcaggcggtcccgtcaccgccgctctcgccgcgccggacgatcaccaggaacgtgtccgtcgcaaggtccatcacgacctcggcgggcaggccctccagacgtcgcgcatgcgcgaactcctccgccggccacgatccgcgcggaccaccggcgggaaagcgctcgagcaccgttcgcccgttcaccccgcacctccctgtagagctgtactcctagagttaaacgccaagcatggtgtgaatgcctcgcccggtgacggtactgagacgtagttgacacgagttcaacgccaaagtgcgtctcacctcacactttcggcccacttgatcaccttccgcatcacctcgcgcacggttcgtgttcacaccttcgtgtcatccccgagcggcgccgaccgcgtcgccgaggacgcgtccggcctcggtgacggcgtgggtcagcgccgcgggagaggcggtcaggccgccgaggatgccgtcgacgcggctcaggcccgcgcgggcgacgagccccttgtcgttggtggtccactccccccgccccgccagcacggcgtgagccgtctgggtcgcggcgagggcgatcgcgccggcggtctggacgagcgagcccttggccgcgtgtccgtccttcgcgtagccgagcgtggcggtggccaggccgtaccagtgttcaggcgccgtgcggcgcagcttctccgggtacgccgtcggctgccgcagtccgccgcgcagcacccggttgaccgcgagttctgccaccaccaggtagctcgggatcccggcgaggtggaagagcagcggctccacccggaaccggccctcctccgcctcggcccactcgtgttccacgacgtccaggtcgcggtagtggacgtcgacgcggcgcccgtcgacggtcagccacgcgccgccgttgaagacgccgccgccccagtcgccgatcccggagacttcgcccggccagccgacggcacgcaggtcggccgggtcgaagcggtcgcggtagtagacggcgaggtcccagtcgctgtccggccggtgggtgccctgggctcgcgagccgccgagggccacggcccggacaccggggagcgcggcgaggcggtcggcggtggtgtcgaggaagacctcgtccgaaagctccatatgcaccttgttctccgttctccgtcctctactccccgttccgcgccggtctcttccctctccgggaaattcggatgcggcgacagccctgaggcacgcatcatcgtcgggccgaccgtcgcccgacccgtcaaccagtcaccgtgggagccccgttgatccagcgcgtcacagcagcccgcctctttccgcctccccggtacgcgcacgcctccgtagtagaggcgggtaccaggctggcgttcctcgccgggtccgttccgttggacgccgagggcgaactcgtcggggcgggcgatcccgtgcgccaggccgagcaggtgatcgccaatcttacggagcagcttcgcgaggtgggcagcgacctggcgcacgtgctggtgaccgaggtgtacgtcgtcagcgacgagcccgccgtgctgtccgccgtctggaacgtcatcgaggcctccgggctcagtacagggccccattcgtcgacgctgctcggtgtggcctgcctcggatacacggggcagctggtggaggtcacggcgacggctgtcgtcccggagggcacccctgagggaacggaagcgaaggcagagggtgagggatgcggcgcatgagcgtggcggactcggtggagctgcgcagggccggtggggccgatgctctggcggcggccgacgtctggctgcggtccttcgccgccgcgctgccgacggtcgtacggccgcgctccgacgacgaggtgcgcgcctacttccgggacgtggtggtgccctcgcgggagacgtggatcgccgacgaccgcggcgggaccggcgtcgtcggtgtcatggtgctcgacggcgacgagttgtcccagctctacctcgaccccgagtggcgggggcgcgggctgggcgaccggttcgtcgccctggccaaggaacgtgtcccgcgagggctgacgctgtggaccttccaggtcaacgagcccgcccaccgtttctacgagcggcacggcttcactgccgccgagtacaccgacggcagccgcaacgaggaacgggagccggacgtccggtacgtctggctcccgtgaggccgcaccggcggctttgctccgtcagccgccggtgctgtaccggtccgtgctgtaccggtccgtcgccgcgaccagcgcgtcgaccacgcccggcgccgccgcgttgtgcccggcctggtcgacgaccaccaactcgctgcccggccaggctcggtgcaggcgccaggcggtgccgaggaggttgccgaggtcgaggctgccctggacgagagtgccggggacgcccttcagcaggggcgcgtcgcgcagcaccactccctcgtcgttgcccgcgccgaggaagtggtcgttgccgaagtagtgcgtcacggtgcgggcgaaggccatgcggaacgccgggtcctcgtagcgcgcgacggaacgcggcggtgcgggaacgatcgccgtctcccagtcggtccaggcacgcgccgccttctcccgtaccgccgggtcgggcgactcgagcagccggttgaaggcggcggcgaggttccccgtgcggtcggcgtcctcgggcagtgcggcgaggaactgtgcgaacgcctcggggaagatcctgcccaaaccgtgggtcagcagcgccacttcggggttcgaaccggtcgcgatgccggtcaggaccagctcggaaaccacacccggacgcgtctgggcgtaccgcagcgccagcacagacccccacgaggcgccccacaccagccaccgctcgatgcccaggtgccggcgcagcagctccaggtcggccagcacgtgcgccgtcgtgttgacgcgcatgtcggtgtcgtacgcgctcgcgtgcggtgtggagcgtccgcagccgcgctggtcgagcaccacgatccggtagcgggccggatcgcagtaacgccggtggccgggggtgcagccggaacccggtccgccgtgcagcatcagtgccggcttgccgtgcgggttgccgcagacctcccagtacacctggttgccgtcaccgacgtcgagcatgccgtggtcgtacggttcgatctcgggatacaggggcatcggcgcaccctagccgccgggctgcggcccagtcgcctcgttttccgtcgcgtgaccgggcccgtcggccggtgcgggcggcaccggcgcggtcggcagtcccgccgctcctgccgccgtccgcaggacgtcccggagcatcgcgggagtgagcctgccggtgaaggtgttgcgctggctcacgtggaaacagccgaagaggtcgagtccgtccagcggcacgcgtgcgccgtgggcgaaggcggggcgggggcggggcaccgtccagcccgcctcggtgaacgcgggcagcgcggcctgccagccgaacgccccgagcaccaccaccgcc

SEQ ID NO: 106 - DNA, 33234 bp, Unknown
  Kingdom: Bacteria, Phylum: Actinobacteria, Class: Actinobacteria, Order: Streptomycetales, Family: Streptomycetaceae, Genus: Streptomyces
cgacgccgtcgacggcgtcgacaccgtcctcacccgcgaggacgcctgcgcgcggttcgagctgcccgccgaccggatcggcgacctcgtcgtcatcgccgaacgcaacaccgtgctcggcaccaccgcggcccgccacgacatctccgctttcaccgagccgctgcgctcccacggcggcctcaccgaacagcgcgtcccggtcctggtcaaccggccggtcgacctcccggccgggcaccgtctgcgcaacttcgacgcctactggatcggctgccacctggcggcaggggagccgctcaccgcctgagccggcaccgccccacccgatcacggccattcaccgcccctgggaacgcgaacggtgacaccaggggcggcccagtaccggccccggcgcgccgccgaggtgcgcgccggggccgtgccgtacccgccgccgtgcgcgttcgtccccacccgcgccggcgcaccgggccagccccatcccgctctgtgaaggattggacccacaccatggccgacaccgacccacccgtcaccacccgcgaggcgcagcgcaccgtccatccgttcctggtgagccggcggctgcgctggcagatcttcgccgtcacctggatcgcgtacgcgggcttctacttcgtgcggcaggcgttctccgtcgccaagctcggcatcctcgacgacccgctggtgtccaccacgctcaccgaacgcgtcctcggcgtcatcgacgcggtctacctggccgcctacgccgtggggcagttcctgtggggggcgtgggcggaccggttcgggccgcgtgtcgtcgtcatcggcggtatggtcggcgcgatcggcgccgcctgtctgatgggcgcctccagcgccctgctcgtgttcggcgcggccatggtggtgcagggcctcgcccagtccgccgggtgggcgccgctgtgcaagaacatgggggcgttcttccccgtcgcccagcgtgggcgcgtgctcggcatctggtccaccaactacgccttcggcggactggcggcgcccccgttcctcggctggatcgcgtactccgcattcgacagctggcacgccgccttcttcgcgggggccgcgaccctcggtgccgtgctggtcctgttcgtcctcttccagcgcaacgcgcccgagggcccgcgggaaccggcggcccggccgaccgccccgaagcccgagcgcggtctggcgctgtaccgcaggaccctgcgcgaccccatggtcctcaccctgggcgccgcctacttcctgctcaagcccgcccgttacgccattctgctgtggggcccggtgctggtcagccaccgcctgcctgaggtcggcaaggcgggtgacacgttcatccccgtggcgttcggtgccgccggcgtcctcgccccgatcgtcgtgggctgggtctccgaccggctcttccagtcccggcggacgcccgcctgcgtcctgtcgctggccctgctcaccgtggtcctcgcgctgttcatgccgctcaccgcgaccggcagcgtcgccgtcatggtcgccgtcctcgccgtgatcggcctggccgtctacgccgccgactcgatgatctcctgcgtcgcggcggtggacttcggctccgaggagggcgcgggcaccgccgccggtctggtcaacggctgcggctccatcggcgcgatcctcggcggcctgctgcccggattcctgtccggctccgccctgttcacgctcttcgcggtcgccgccgcgctggccggagcggtcatgatcccgcagtggaaccgccgcccgctcccggccgccgcgcggtgatcagcctcccctcccccgcgagcgccacttccccgcacgccacccccgtacccggcacgcccagatccgaaggcagggacacatgaaacgccagcacacggacaccgtcgtcgtcggcgccggcatcgtcggcctcgcgcacgcactcgccgccgcccggctcggccgcaaggtcgtcgtcttcgaacgcgacgacttcgcggtgggagcctccatccgcaacttcggcatgatctgggcggtcgggcagcagcgcggcaaggtctaccagcgggcgctgcgcacccgcgaggtgtggctggagatagccgccaagaccggcctgtgggcccccgagaccggctccctgcacctggcccaccacgacgacgaggtcgcggtgctggaggagttcctccagctgagcaccccggcgcgggaacgcggtgcgcggatgctcaccgcggatgagaccgtggcccgctccggcttcgtgcgccgcgagggcctgcgtgccgcgatgtggagcccgaccgaggtcaacgtcgacccgcgccgcgccatccccgccgtcgccgagtacctggccgccgagtacggcgtggagttccgcttcggcacacacgtgcgcggcatcgcgatgccgtccgtctccaccagcgccggggactgggactgcgagcaggtgtacgtctgttccggcaacgacttcgcctccctctacccggaggtgttcgccggcagcggcctgacccgctgcaagctccagatgatgcgcaccgccccgctggccggcggccgcgcgctcggcccgatgctctgcggcggtctcaccctcctgcactacgcgtcgttcgagggctgcccctcacgcaccgcgctcgccgaacgcatgggccgggagcgggcgttccaccgcgagcacggcatccacgtgctcgtctcgcagaccgccgacggccgcatcaccctcggcgactcgcacgcctacgccgccacccatcccccgttcgcggacgacgcggtcgacgaggcggtcctcgactacctggacaccttcgcggtgcgtccgccggaggcggaggtcaccgaacgctgggtcggctactacccgtccctgcgggacggccgcaccgaactggtcgtggaccccgagccgggtgtcacggtcgtcaacggggtcggcggggccggtatgacgctctccttcggcctggccgaggagaacctggcccgctgagccggcccgcacgggccgaagggccggtgcctctctcgggtgagaggcaccggcccttcggcgtgggcgggacccggtcagtaggagatgcaggccgagtgccactcggtgtagaagtcgaacacctccggcgagcactcgggcggcccgtactggctggccttggacccgatgtgcggcaggtgcgcgtacgctcccacacccggccggttgacgtgcagcatccccgcctcgaagcggtccacggcctcgaaggcccgcgcctgcgaggccgtgaagaccgtcccggacatgccgtacttcaccgagttcgcgatccgcagcgcgtcgtcgaagtccgccgcgtccagcaccgcgaggaccggtccgaacacctcctcctgggccagctcggaatcccacggcacgtcccggatcaccgtcggctgcagatagcagccctcgggcaggtccgcgcgctcctcccggccgccgccgcacaccaccttgccgccgtcccgctgcgcgcccgcgatcgccgccagcgcggcctccatccgggccgtgtcgaccaccgggcacagttcggacgcgtcgtcgaagcccggccccacccgcaggtgtgccacccgtgcgagcagccgttccaggaactcctcgcgcacccggacgtcgaccacggcccggctggtcgccgaacagcgttgcccggcctgtccgaacgcgccgtgcacgaccgcgtccacggccttgtccaggtcggcgtcgtcgcacacgacgaccgcgttcttgccgcccagctccagctgggtacgcagcagccggtgcgcgccgcccgcgtggatcgcggttccgatggccagcgacccggtgaagctgatgcccgccaccgccggatgggcgaccagcgcctcaccggccgccgcgtcgccctgcacgaggttgagcaccccgtcgggcacacccgcctcgcggaacacgtccaccagcagcgcgccggtgagcggtgtcagcggggacggcttgagcaccgccgtgcacccggcgagcagcgccggggccaccttccacatcgggatcgccagggggaagttccacggtgatatcagccccaccacgccgatcggcctgcggaaggtgtacgcgaaggtcctctcctcctccgcgggggccgtcaccccgcccaggcggcgcgcctgcccggccgtgaactccaggacggcgcgggcccgccggacctcaccgcgcgcctcccgcagcagcttgccctgctcgcgcgtgatggcgtacgccaactcctcggaccgctcctccaggacgcgcagcgccttggtgaggaacgcggcgcgtgcgatcggtccacgaccacgccagtcctccagcgcgcgccgtgcctccgcgaccgccaggtccacgtcggcgccgcccgattccgcgaactcgcccaggacgtcggtgaggtcggccgggttcacgtcggcgcgccgctgccccgactgcgcggcggcccactggccgccgatgaggttctccgtcaggtgtcccgccacctcgaaccggatgtcgcccggtgccacagccattccctgctccttcgcagccggtgggatcggtccccgccaccctggcccggtgaacaccgccggaacaacgggtgatctgcgaatgacgcgtatagggggcggctatcgccggttccgggcggccggtgggcccacggcgccggaatgatcggggccacgccgccgagttcactggtcatgggcttggccagcttcggtgtgccggaggcccttgcggccgtcgccgtctcgccggtgccccagaccacggcgtcgtgcgtggcttcgctgccggtcatgtggacggcggtgatgccggggtgctcggtgagtgcggcgcccacctcgggtccgccggtgacggtctcgaccaggccccggtcggtgagcggttcgaagatcgcccggtagacgtcggcgagcgggtcggtggtggggttcagcttgaggacggcggtgcggttctcggcgtacagctggtagagcacgtcaaggggcgggatggagaagatgttgccggcgcccaggacgagggccactcccttggtctgtcgcggtgtccgctgggtgaggccggccgtggcgcgtagctgctcggcggtgatgccgggggacgtccagacctcggcgtggaagccgctcatgagcagcttgtcgtaggtgtcgtagggcaggacctggacggcgagccgaccgcccggcgccggggtgatccgggtgtcgccgaggacgtcggctccctcgtcgaggcggcgcagggttttctggagtgcctggaggtaggtgagcaccgcatacgggccgctcatccattcctctccgaggagcggggaggcggggttcagctgcttgatcccggccgcggtgcggacccactgctcggccacggccgcggtggccgctgccatgtcgaggagcagcccgcgccgttcggcgagggaggtgcgggcccaggctcgttcgctggtggcgagttgcgcgacgagggcgtcgagatcgtgggtggtggcgggtgtggtggtcatggcgggggcctcgctcacgtgtcgggggtcagaagagctcggggaggatctcgtcggcgacgcggtggccggattcggcggctccgtcgatgtagccggcccagcgcgtggcggtctcggtgccggcccagtgcagggggccgaccgggcggcgcagcgcggggccgaagcgggtgagggtgcccggcacggtgaatgctccgtaacagcctcggctgtactcctcctccgcccagtcgcgttcgatgtaggcgaggggcgtgcgggcctgggggccgaagtagccgacgaggtcgtggatcacctgagcgcggcgctcgtcggggctcatgcgtgagccggtgtcggcgtggcggccttcgaggaagccgacgagcacaccgcacgagccgtcgtggggggtgttgtcgaggacggtaccgaacgggcggtgggtgctgttggcctgcccgctgaggccggcgtggcgccagaagggctccccgtaggcgacgttgactttgatgacccggcccatcggcatccgctggacgagctggtcccggtcgccgggcaggcccggggtgtagcggatgcgggcggcgagcggcgggggcacggcgaccacggcccgctgagcgcggaccgtcaggccgctgcgcgtggtgacgcggacgccggaggccgccgcgggctgccagtccacgtcggtgacgggggcttcgaggacgatccggtcgccgagttccttggccagttcgagcgcgatgcgctgcgtcccgcccacgacgcggtcctgctgggccccgccgacgacgttgatcagcgggtcgaggccgccggccgcgccgacgtagaaggcggcccagagcgcggacatgtcctcgggctcgatggagaagaccgcctcggtgaccagccggaagaagtcccggccaccggtggtacgggcggtcctgcgcagccaggtgtcgaaggtctggcggtccagctgctcggcccgaggtgcccgccacgggtcggtcgccgcgacctgccgggcgatccggtccaggcggtactgagcctgcccgatgtcggcaaggaccagcggattcagcttgggaatccggcccgtgtaccgggagcgggcggtgccgaactcgccgatatgctcgccatcggcgtaggtcgggtaggtgctcaggcccagttccccgatcagcttcatggcgtggtgctgggtggggcccacccactgtccgcccacttcgatgggtgagccgccgggcagttcgccgttcaggagccggccgccgacgcggtcgcgggcttccaggaccaggacgtccgccccgttccgtagcaggtcacgggcggccaccagcccggccaccccggctccgacgaccacgatgtccactgacttctccatcacgcccgcccttcatacagagtgaatctgacatacgcaatgtatgtggtatccatactgtatggaaacactgcgcgagaaatacgccgagaacacgcgccgcaccctgctcgacacagggctgcgactgttcagcgagcgggactacgcgagcgtctccgcggaggagctggtgcgtaccgccgggctgacacggggggcgctgtaccaccacttcaacggcaagcccggactcttcgaagccgtcttcgaggagctggaacgacaggccacggaacgcatccgggcggcgatcgcacccgtacccgatccgcgtgagcgcgcctaccggggtgtcgacgcgtttcttgaggtctgcgccgacaacacctatcggcacgtcgtgctccagcagggcccggtcgccctgggctggccgcggtggcgtgagctggatcatctgcacctcggcggcctcgtcctcgacatcgtcaacgccgctctcgtcgccggccggctgcggccccacccggcccccctggtcgcccgcgccttctacggcgcgctcaccgagctgtccatcacgatcacggagaccgatgagccggagcaggctcgcacccaggcggccgccctcgtccgcgacctcatcggcggggtggtgaccgacggcgtcccgccgtcagcgtgacccgccgcgcccccgctgtcgcaagcgagctgaggaaatggccaagtccctgagacaggagcgtggccatctgcgtgagacagaccggaaacagcaggtcaccggctgcgtggaatggcgcgaccgttgagatcccacagcgcctccaccctcggagccctctcctcccgcgggatccagacagccgacgtgcgtacggcgaagccgacgggcggccccgccggcttcgccgtacggtcggagccgcccttgatgtcggccgtcgaagctgagaaggcggtgcgcggttcggggcccacccgcgtccaatgcaagctaggccgttttgttcggatcaccccctcgttcttccggtcttaggtgcggtcgtggcgcgcgatcggcaaatgcgggctcgacttgggccgcgtccgctgcaccactctcatggtcaggtcggtaacagaggcgagaacgctgccctgctaggaagctcgtgcgtcgtggttctcgcgattggcgaggacttgttccatgtgggtctgggcccactgcctgagcccgcgtgtcaggtgatggagtgagaggccgaggtcggtcagctcgtaggtgacggtgacagggaccgtgggtttcacggtgcggacgagcaagccgtcgcgttcgagagcccgtagggtctgagtcaacatcttctggctgacgccagccagtagccgggccagctcggagtaacgcatcgccttcggggcgtgcgacgcgccggactgttcgggtgtgtcaccgcccagtgcacacaggatcaggacgacccacttgtctgagatccggtcgaggagctgacggctggggcacaccgccaggaacgcgttgtactccaccttggcctgcgccttcttgtcggccttcgtcgtcacttgatctcgcctctcaccttctgggctgttacgcacttcagagtgcctacttcccggcaggaagttcctctccaacactggtgcaagggagctggagacaccacccctggcatgaagtgaaaggcaccacgatgaacacaccctccgcacctcttcccggcggaacctggactctgggtgactcgtccgtcacccggttcggctacggtgcgatgcagctcgccggcccgtgggtcatggggccgcccgccgatcacgacggtgctttggccgtgctgcgcgaggcggtcagcctcgggatcacccacatcgacaccagcgacgcctacggaccacgcctcacgaatgagctgatccgtgaagcgctgcatccttacccggagccgctgttcatcgccaccaaggtgggtgcgacgcgcgacgcacagggcggctggcccacagcccggcgtcccgaggacctgcgcaagcaggtccatgagaatctcggatccctcggcgtcgataccctcgacctggtcaacatgcgcatgggcgacgctcagggcccccagcccggctcgatcgccgaagcattcgagacgctcgtggacctccagcaagagggactgatccgccacctcggcgtcagcaatgtcaccggggagcaggtcgctgaggctcgcagcattgccccgatcgtgtgcgtgcagaacatgtacaacctcgcccaccgccacgacgacgacctcgtagatcacctcgccgccgatggcatcgcctacgtgccgttcttccccctgggaggcttcacgccgctacagtccgaggccctctcacaggtcgcgaaccgactggaggcgacgcctatgtcggtcgcgctggcatggctgatgcagcgctcgccgaacatcctgctcatccccggtacttcctccaccgctcacctacgggagaacatcgcaggcgccggcctctccctctcagaggaggatgtggccgaactggacagcataggccactgaagaacaggtcggcggccgagcccgggctatcgggcggaccaaaggaagatgcccgcgatgtgaagtccggcgaggtagatggtggctgtcttctcgtaacgggtggcaatgccgcgccattgcttcaagcgattgacgcaccgctcgacggtgttgcgttgctcgtatgcctcgcggtcgaaggtgggcggtctgccaccggccggtccgcgccgccgcctgttggcttgctggtcggcccgctccgggatcaccgcgcggatgccgcgactgcgcaggtggtcgcggatctcgcgggaggagtacgccctgtgggccaggaccacctccggcctggtgcggggccgtcccaagggacggggaacacgaaggcgggccatgacgtcggtgaaggcgggtgcgtcaccggcctgtcctgcggtgaggtggaaggccagcggccggcagcggtcgtcggcaacgaggtggatcttcgtggtcagtccgccgcgggaccggccgatggcgtggtcgtccggttcgccggccggggcctctttttttgcgggccccggccgcgtgctggtgagcgcgcacgatggtggagtccacggacacggcccagctggcgtcttcgtccgcggcggcctgggctaccagggcggtgaacacccgctcccaggtgccgtcgacggcccacatccgcagccggttgtagacgcctcgcccgttgccgtacttctccggcaggtgcactcactgcgttccggtccggaacttgaaggcgatcgcgtcgatcacctcacgatggtcccgccagcggccaccccgcttcggcgtccggtccgggagcaacggctcgatccgcgcccactgcgcatcagtcaacggcacacccggacccacgaccaactgatccaaacgaaactgcctagtccaatgcaagctagggggccttgagcaacaagtgggtttgccgtcgagggggcagccaggcttctggctgccccctcgacgcagccgtgcgttcaggtggtctcaagcaagcttccgcagtcgcacggtgtggtccttgccgccggggagggcatcgttgccgccactggccagggttttgccgtcggcgctgaacgccagcgatgaggtgggggtggtcagggaggcggtgctgcgctcccggtcgggttccggcccgggatccttcgccggcaccttggtcacctgcagaccggccgccttgccgcgggtgggctgactggtgtcgcaggtcaacagccgcaccgagcgccccgcgagggactgaatggcgaccctctggtcaatgatcacgtctccgacctgtacggagcactccagttgaccacgctgagcacccagttggccgtccccgagtcagaggctgagaggttcatcggtccccgggagtaggtccctcgcctcatgcgcgctttgagcctgctggctaaggtcggcgctcatgcagaccacgggaatcgttcgccgccgggcggcggagcgtaggcgcgacactctggaacggctcgtcgccgagcgggatgtatgggtgtcgacagcacatcccgatcacgggccgcaccaggtgccgctgtggttcatgtgggatgggcgagctgtgtggatgtgcaccagtgccacttccgcgactgcgcggaacgtccgcgaagagccgcgcgtgcgcctggcgctgccggacaccctcgacgtggtgcttctccagggtgagggggaatgcttcctggaccaggatgtgcccagagacgcggccgaggcgttcgccgccaagttcgagtgggacccgcgtgcggaggaaggttcctttctgtatgtgcgcgtggtgccgaagagcgtgcgcgcttggcgcggcgaaccggaactacgcgacagagtcatcatgcgcgacgggacgtggctggaatagcggccgtcgctgaccgacgcccctctcttccccgtcgagtcgacgtcagtgcgtgcgaccgcgcctccggcatcgctgtcgaaggcgcgacctgcccggggcgcgggcctacggggtgcggcaaaccccgaagggacaccgggtgccggggagtgccttcggtctacggcacatagacggcgtcactgccgtacagctccctggtgaacgcggagacatcggcgctgcggtcggagccgtccaggttgtacgtcaggtagacgccgtacccctccgcgaccgtgcggcgggccagggcggcggctgtgctcttcgaggtcccgccgatctcgacggccgccggcgagagcttcgacttgggcagtgccatgccggggacctgccaggtgccgtagtacgggttccaggcgtagtcgaacatggacgagacgtcgacgccgccgtaggacaggcgcgacgcggcagggccgatgttgtagagactgatgatcttgcccggcatgttcgcgcgcagcgccgacaccaggtacacgaaagagctgtcgttgggctggccggtgccgttgttgccgtactcggcgtactcgtcgtcgaagtcgatgccgtcgaggccgtacttggccacagtgtccgagagttgtctcgcgaacgtcgaagccgcctgccgggacgggaagttggcgaacccagcgccctggtggttgccgagcaccgagaggacgaccttgatgcccttctgctgcaacggccgtatctgcgtggccgcgttgtcgaggacgcgttgcacgttctcgttgaagtacagcgtcgccgccttcgtgctcgtgtcgtagttgatgttcgccgcgaagatcacggcgatgtcgaagacgttgccgccgccgttggcgagggtgtacttgcctacgttgagcatgctgttgttgttcacctcgacataagccaccgaggttggtccctgtttcgcgggagcgggggccgctgccgcgccggtcgtgaaggtcgcactgaaggcgagggccgtaacggccaagagcgcgagcgcgaccgtccgcactctgctccgcaccggagtgaacatcgttgatcggtctcccatcgcatggagcggcgcccggcctgtccgcaagcgccgagtgccccgatccttccgcttccgcgacgaaatccccagaaccgcgcgcgagctcttcacgactcccgcaccaacggaagaccaaggggcaccggcatgtcacagggaggtgacccaagaccgttaccggtggtttgccaaatccggcggtaggggtcgatgccgttcccggtggtgaccgcatcgatcagtgaagcgctcccggatcggtggaggctctatgcgtcgactccagccgcccggtcggggcgggtgttgagcgtagtggttgctctctgaggggcgagccgaccggcgtagaggttggagtctgcgaagacaggggcgggttgccgctggtgaagctgaatcgctcgcaaaagttctcgtgcccgctcgcagcgaggaggcacgatgccggctcgcaggaactcctcggcgcggacaggcccgatgctctcgcgcaggagacgatcttccccgttgcggctgcccgggccggagccccgcaggaggaggcgcgctatgcccgtcagacgctgcgctggccgcgcggtagagcgtcgcaccttcgttgcggtcatcataaaactttgcggcaatcgcaaaatgaatccgatcgatgaactggctgccctgcgtcaccccatgccccagccgggcaccgacactcccgaggactgctccgccgatgcctgcgagcaggtgggagagcagcgcaagaacgacgccctcagcctggaggccacaggccaggacctccggacggacccgctgctgctcgcgctcgacgacctcaaggcacagaaggggccgacgcccggagccgccactcccggcctggggacgcgagttcgacagaaaccgcccctacggcctggaggaactcgcccgccgcgccgggtacagcacgtcctgtgtgcgcacggcctacggcgagatgaggaattccgcgcaccggtaggggcccagcggggggctgccgaccggccgcagggtgacctccacgtcatcggccctgacctgcgggacgagcacggactgggtgcgtgccagcgtgcacaccagttgcccggtgccctggtcgtgcccggtccccgcgtaagggccgtcgaggagcagcgtcacgcgggtgccctttccggtcgcggagaagccggggagctcgacgtaggaggtgagaccgccggcctgcccgccgggcgacggccccgccacgaggagtttcaccaccgtggcgaggtccgtgatctccctgtcgcccacgggcaccgcgcgcagtccgccggcggacgcgaagtacaggcgcgcgcccctcgtcagcccggacgcgggttcgcccgcgtccaccactccggtcggcggaaccccgcagccggtgaggacaagggccagcgcaactgccatgcccgccggtcggcgcctcatcgcgtctcctcccccgcacaccgcatcggcagccgcagcgtgaacaccgcaccggcccacggcgcgtcggccacgtcgatcgtgccaccgtgcagccgcgcgttctccagcgcgatcgccatgccgaggccgctgccctgtccgccgtcgtcggccgcaccgcgcgttcgggccgcgtccgccttgtagaaccggtcgaagacccgctcccgggcctccggcggcagcccggggccgtggtcggcgacctccagtgtcacccactcctcgtcaccgccgtccgccgcccgggccgtgccgagggtcacggtcaccggcggggccccgtgccgcagggcgttgcccaccaggttcgcgacgatcacgtcgacacggcggcggtcgatcaccgtccgcagcccctcctgaaggcgtgtctcgacccggtccggccagccgcgcagtgccagtgacgcccgcaccgtgtcggcgaggtccgtctcggtggcgttcagccgtaccgctccggcgtcgaagcgggagatctccatcaggtcctcgaccagccgggacagccgggccgtttccgcgcccacggtgcgggccgcccgcgcggtgtccggcggcagttggtcggcgtcctcctccaggacggtcgccaccatcgtcatcgccgccagaggcgtgcgcagttcgtgcgacacgtccgccgcgaagcggcgcgccttcgcctcctgctcgcgcagttccgcgtcggaggcctggagcgcgtctgcggtctcgttgaacgtacgggccagttcggcgagttcgtcgtgcccggagacggtgacccggctgccgagatgtccggccgcgagttcccgggtggcccggcccagcttccgcaccgggccgaggaccgtgcccgcggccagcagggccaggaccgcggccagcagcaccaccggaacggtgcccgaccgtactgagtccagcagggcggcggtgtcgtcgcgctcggcccgcagctccgtgatcgcgtagacctccagggcggagacgcggcggtcgccgtcggcgtacgtcacgggcatgccgacgaccaggtacggctccccccgccacatcacccgctggaaccgagcgccggctgcggtcatcacggcggcgcgcagttcgaccgtgatccgttcccgcgtgtcggcgagcgggtcggagaccgcgacgaggttctgatagcgggcgaccacgacgcgggcaccgagaccgtcggagaccttcgccgcgaaccgggaaagcgactcctggtccgggggcaggtcgaagtcggtggcgaccgtggtgacccgttcccgcaggccgtccaccgcggcgtcctgggtgcgccggaggaccgcggtgcgggcgtcccggtaggcgagggtggtcgcggtcagcgcgctgacgacggcgacgaggacgaacgtgatgacgagccgggtgcgcagcccgacgacgagccgccaagggtgccgccaggaggcgacgcggcgcgcggatccgccgcacttgtccgtacggttcacagcggcccgaagcggtagccgaagccgcgcaccgtctgtatgtaccggggtttggccggtgtctcctcgattttcgcccgcagcctgccgaccgccgcgtccaccagccgggagtcgcccaggaagctgtggtcccagacggatgcgaggagctgctcccggctgaggacccggcccggtgcggccgacagctccagcagcagtcgcagttcggtgggcggcagcgccacggtggtgccgttcctggtgacggtcagtcccgcgcggtcgatcaccagaccggcgaaatcgttgtccggcgcctgtccggccgacggttccgcccgccgcagcgcggcccggatgcgggcctgcaacacgggtgcggtgacgggcttgacgacgtagtcgtcggcgccggcctccagcccggtcacgatgtcgcagtcgtcgccgcgcgcggtcagcatgatgaccggcagggtcgccgagcccgcgcggatgcggcggcacacctcgaagccgtccatgccgggcaacatcaggtccagtacggccagctcgatccgcgcgccgtgctccccggccagcagggcgagggcctgttctccggtggcggcggtgtccacaccgtacccgtgccggcgcagcacgagctccattccgtcccgtacggacatgtcgtcctcgatgagcagtacatgcggcatgggaccgattatgagcatggccggacttcctccgcctagcccaggcaggtacgaacccgcaggtcgggcgcattgttacgttctcatcatgtggccatggacggttcatcatccgtggtggagagcgtggagcgcatgacatcccccatcaagaccgatcgtcgtgttcctcgtgttcttcgtgcccggctgggcctgaccgtctgcatgtccgtgtccgtgctcgcgctcaccgccgcctgtggcggcgggggcggcgtcgccgacggggcgaagaaggacgacgcgatcgccgacgttccggaagggcaggccgcgaacgacgcgaaggccgggcgggacgcggagagttcgggcggccggtccgcgggaaagagcgagttctacgacgcccagatggaatatgtccggtgcatgcggaccaagggcggctacaaggactttcccgaccccaagctcagcgggcacctcgactgggacaaggtgaacgagatcggcgcccggccgggcgccaacgcgggcatcaagggcggcaaggggggcggttgcgtcaatgagatgaaggccgccatggcggccgagccagcgcgggaccagcagaaggactacgagtcgatgctcgcgcacgccaagtgcatgcgggaccacggggtctccaggttcaccaatcccaccatgagcggcggcaacgtgcagccgggcggcgaccccgacccggcgtcccggtcgatcgactcgaactcgccggcgtacaagcaggcccgcaaggcgtgcgatgcgaagctgctcgacggtctggacggtatgcagtgaagcgccgcaccgccctcctcacgctcggcgccgcagctgtcgccgcggccgtcaccgggggcgtcctgttcctcggcgacggccgtgacggcgcggccgcctccggccggagcggcgatctgccgcccgccaccgcgaccgtcgtacgcaccgacctcgtgcggtccaagacggtcgacggcaagctcgacttcgcccagcgccgcggggtcaagtccgccgtcgagggcaccgtcacggtggccgctcccgaagggaggacactgaccatgggtcagaccctgtacgaactgaacgacaagcccgtcacccttctctacggaccggtcccgatgttccgagagatgaaggccggcgaccggggcagcgacgtgctccaactggagcggaacctgcgtgacctgggctacggggcgaacctgtacgtcgacacgcggtacggcacggacaccgaggccgccgtcaaacggtggcagaagtccctgaaccgcgtcaccaccggcagggtcggccggggcgacgtcgtcttccagcccggcccggtcaaggtcgtctccgccgacgcggccctcgccgaccaggtgggcccggacaagccggtcctgacggtcgcctccaccaggcccgtcgtgcgggcacgactcgaccagagcgacggcccgctcaccgcccgcggcaccagggtcgaggtcaccctgccgagcggcaggaccgtggccggcaacgtcgccgggacggtgcgcccggacgactccgccgctgggggcggcggtggcgccgcgcaggagggcatcaccgtggaggtcgtcctggacggcgcggcgaaggccctgtcccgcgaggacaccacggtgtcggcgagcgtgaagttcgtcagcgaggcgcacaagcaggtcctcgccgtccccgtcgaggcggtcgtcgcgctgcggggccaaaacggcggctacggcctccagatcgtccggggcgccacctcgacgacggtacgggtggagacgggcatgaccgccgacgggctgatcgaggtcagcgggccggacgtgcgcgagggtctgaaggtcggagtggcgaagtcatgacatcggtcccggtgatcgaactgtgcgacgcggccaagtcgtaccccgggggtgtccacgccctgcgcggagtgaacctcaccgtcgacgaaggagaactggtcgccgtggtaggcccgtccggctccgggaagtcgacgatgctcaacatcatgggcaccctcgacaagcccacctccggcaccgtccggatcgccgggtacgacgtgtcccggctctccgacgcccggctctccgcgctccgcgcccgtcacatcggtttcgtgttccagcacttccacctggcggcggggcgcgacgcggtggacaacgtggccgacgggctgctctacgcgggcgtaccgctgaggcagcggcgggcgcgtgcccgggaggccctggccaaggtgcggctggaccaccggtgcgggcacacgcccgacgcgctgtcgggcggcgagaaacagcgtgtggccatcgcgcgcgccctggtggggaacccgcggctgctgctggcggacgagccgaccggggcgctggacaccgcgtccggcgccgttgtcatggagttgctgcacgaactgaacgcggccggcaccaccgtgtgcgtgatcacccatgacaacgagatcgcggacgcgctgccgcgccggatacggttcaaggacggagagatcgtggcggactcgtgtcccggcacgcggggcggcccgggatccaccgcgtgcgccggcgcggaggccaccgcatgctccgaagcgtcctcccgccccggatccgccgcccgtacgggagaggtgatccggtgaagaacgtcctcgttccctctcgtctctccctcgccgacgtcctgcgtgtcggtgcggtcggccttcgcgcgcgccgggcgcgcgtggtgctctcggcgctcggcatcgccatcggcatcgcgaccatggtcgcggtcgtcggcctctccgagtcgagccgcgccgacctgatggcccggctcgaccgcctcggcaccaacctcctcaccgccgaggcgggccaggacgcctcggggcgcaagaccgaactgcccgagaacgtggtcgcgatggtcgagcgcgtcggcccggtgctgcatgccacggccaccgccgatgtcgacgcccggatccgccgcagcgacgtcgtccccgaggaacgcgccgccggcgtcaccacgcaggcggcccgccgggacctgctgtccgcactcggcggggaggtcggcaagggcacctggctggatgcggccggggaacgtcttccggccacggtcctcgggtcggtggcggcggagcgcctcggcatcacccgcaccggtgagacgctcatgatgaacgacatacgtgtggtggtggtcggcatcctcagaccgatcgagctggtgcccgctctggaccgggtggcgatggtcggattccccgccgcacagcgttacttcggtttcgacggccatcccaccaccgtcttcgagcgctccacggacgcctcggtggaggacgtgcgggcggtcctggcccgcaccgtcagccctggtgacgcggccggtgtcaaggtctcgcgcccctcggacgcgctcgccgccaaagcagccaccgacaagggcctgacgaccctgatgctcggtctgggcgcggtggcgctcctggtgggcggtgtgggagtggccaacaccatggtcatctcggtcctggagcgccgtcaggagatcgggctgcgccgttcactgggtgcgacccgcaacgcgatccggctccagttcctgacggagtcgctgctgttgtcggcggcgggcggggcggcgggtgcactgctgggagctgcggcgacgtacggcttcgcgcgagtccagggatgggccgcggtggtcccgccctggtccctggcggggggcctgggcgccacctgcctgatcggcgtgctcgcgggcctctatccggcgatccgcgcctcccggctccatccgacccaggccctgcaagcagcgtgagacatggcggtcgcaacgctcgtcgcggccaccggattccgcccgctccccggaccgaggagggcttcgaaggcgacgccggaccttccgggccggccggacggggctgatcgacagcccggcccggccgaccgacccggcgcaccaccacgacgaggggctgaccggccgtctgcggccgaggcacggtcggtggccaggtgcacacagacgcccccgttcaccggctttggagccggtccatcgattgggctggcctgagtaccctcgactggtggaagatcacgagcagtacgtgaggtatcagcaggaccggacggtgctggcggcggtcggggctcatctcgatgcccagatcagtcggatcagcgttcggttgcctcggcctgtggctgagtcggcggtcgctgcctgggaccgtgaggaactgggtggagtcggcgaggagagccgcgaagagtacgaactgcgtgatgacgctgcagagctggccttgatcggcctggcgatcagctcgcgcggggtgtgggacaccgaggaggtggtcgtcgacctggatgtcgtgcagatcgcggccgcgttgcgggcggcgcggtaggtcgggccgcagctgtgagaggtcgtccgctccagcggatgcctttcgcgctgcgggcacgtgcaggttcacggcgttgcgctgggaggacgtcggggtggcgggcattggcgttgcgccagcgcaggtaggcgtgcagggcccgggtctggacggtgtggttgcgaaggttcgagttggcgatggtgaactgccgcagcggcccgaaatgggcctcgatcgggttcgcccaggaggcgtaggccggtgtgaagcacagctcgacgcggttcttcctggcccggcatcggatcttctcgcccttgtgggcggacaggttgtccaggagcacgtagatcggggcgccgtccgggcgagccgcgcggatggacttcagcgcggtcagagtgttcgcggcacccttcttgcggcggttgacaccccagaaggcgtcgtcgccgaccgagtagcagccgtggaagtaccggacgccgtgggtgcggtggcaggtggccgggtgccgctcggggtgtcctcgtcggcccgcaccagcttcgcgatcagcggcacccggttcccccggccgaggccaacagcgtcatcgcgcgccggaaccgcaccgaactggtgctgccccggcgcaaatctgccggggacaggcatcgagcgcgtgggtaaaagcagccatccgcgcagtcatcggctggtcgtgcctttgcggtcccaacccgtggggcgcggtcgaagagagataccgcgatggcgcggccgcgccgcgggaggggtccctcccgcctgcttccaggggcacggttccctgcctcggctgtgggcagtcgccgggctcacgagctcaagtcgtctgccgacgacgggtggtgactgctcgcggtagttggcgtgtgttcacgaaagagggcgggcggggtcgggtctgtatctggtggccggcgtgcggtggcgggccacggccatgcgcgacagagccagcgtggcggcggtgatcccgggccacagcgcacccatgacgacgtggaggacaccgagccaggcgatctccgcacggctgtagagggcggcctgcgcagccagactcgccaggcacaccaggccgatgcacaccgtcatccaacgatagaaacggtgcagggggtggtgcgaccgccagtgcggtgggccgcccacgacccggttcgccaccaggccggccaggggacggcctgccagcaccgacagcaggcaggccgccgaggacgccgcgggcagcagcatgggcagcaggaagaagccccgtgcctgcccggtaccgaccgccacggccgcgcaggtcaccgccagcagcgcgcccaccgccgcatgctggaggtaccggcgggtccacagaccacaggcgaggaccagtacaccggccactgtggtcgccacgagggctgtccgcagcccgtcggcaccgtaggcggtcacgaacgccagggtcggcgccgccgtagccgcgagcccgggaaggcggtctctcatcgtgccctcgatccggtgtccggggcggcctgcgcatcggcacgctccagggcacggagcgcgagcaggcccccgatgccagggatgatggcgcgcagcgtggcgccggtgctgcgccgcgggtcgcgctgggtggccaggaccccgaaaagccaggcgaccccgtgcacggggccgaacagcgcggcgatctcccgggcgtccccggtggcgatgttgaccaacaacacggcgaggctgaccagttcgatggttgctgaagcgcgcagcggcctgcgtgcgagccgtggcgtgggtacggagttggcggtcatgggtcacactccggtggtggagccggggcggagaatcatcaggacggtgaccgtcgcccagagcaggttgaaggcgccggtcagcatggccaggcgcgcggtctgcgcgcgctcgacggccgccgtcccggccggggactcggccagctgggcgaggaggcgttcctgggtcggcagaaccagcagcgccagcaccagtgcagctgcacccgtcagcgcaatcgacgtgatcagccaggggctgcccaggacgtgcagctcgctcgcggtggcgaagccgagcacgggaacggccaggccgagggcggcgtagacccggcagacgcggtgcagcacccgtaccgtggcgagtgcctcgtgctggtcgggcgcgccggcggcacggcggaccgcggcgggaaacatgctgcccgccacggtcaccgggccgacggcgacgatcgccgcgagcacgtgcaggatgagcaggagcttggtcaccgcggctgctccgcgccagcggcgggggacaccggcaccggcccctggtcgcgccagacgacgccgcggcgctcgtgggcgaacagctgctccaccgcgagcgcgaccttcggcccgacctcccgttccagcagatacaggcccagatcgaggccggaggtgacgccgccggcggtgaccaggtcgccgtcgtcgacgacccgtcccggggtgacgtgcacaccgcccgcacccagcaggtccagaccctggtgatgggtggtggcgtggcggccgtgcacaagcccggccatcgacagcaccagcgaccccccgcagaccgtggccaccgtggtgtccgctgcggccagtgcgccggccagcaatttcgggagctccgtggtcagcgcacggccgaggatcacgggaatctgttcctcggcagagtcgtccgcgccctgcccggggagcctgccggccgcgcccggcacaacgaccaggtccgcgcgatccggggccagaggagcagcggccgtcagcgcgacgccgggtattccgctcggcacctgcctggctccttccgcacaggccagttcgacggtcacccgatcggtgaaggcccgggcggcgctgaagacctcgaacggagcgatgacatccaatgggtcgaacccatcgaagaggacgaactgtgccagcatcggcgactctcatttccctcggttcatgactgccgcgctcacgctaggcggcacgacagaccccgaccatgggctcgaatgacacaactcaacgagttctcgccacttcgctgaccagtgctttcgtgaccctcaacttctggacctgtggggtgtgttacggccggaagtgggcgtagtctgcgcgcatgcacaccgtggcgattcttgcgctggaccagacggtggccttcgacatggccatcccggtcgaggtgttcggacgcgtgcgcctgccggacgggcgccgcccctaccgggtgcgcgtctgtggaacccggccggaggtgccgaccgagacattcaccatccgtgtgccctgggggctggacggcctcgccggggccgacacgatcatcgtgcccgggcgggaggagcacgcggggccgcccccggccgaggctctccaggcactgcgtgacgccgccgccgacggcgcgcgcatcgcctcgatctgcggcggcgccttcaccctggccgccaccggcctgctggacggcctggccgcgaccacccactggatcgccgccggccaactcacccggcagtacccgaaaatcgaagtgcgcccggacgtgctgtatgtggacaacggccaactgctcacctccgccggggcctccgccggcatggacctgtgcctgcacctggtccgccgcgacctgggctcggccgtcgcggcggacgcggcccgactggccgtcacccccctggaacgggagggcggccaggcccagtacatcgtccacgagcccccgccgctgcctcgcggctcactgctggaaccgacactggcctggatccaggaccacctcggcgaggatctcactctggaggccatggctgcccactgcgccatgagcacccgcaccttcagccgccgcttccgcgaacagaccggcacgaccccgctgcagtggctgctccgcgcacgcgtccggcacgcccagtacctgctcgagaacagcgaccatcccgtcgaacgtatcgccgtgcaggccggtttcgggtccgcgaccgccttccgcgaacggttcaagcgcgtcaccggcacgacaccgcagacctaccgggccaccttccgccgttcttgctgaaacccgggtcacgtccactgaggtggtaaatcgacggccactcgatgcctcggtggtgccggccaccccgcgggccggcacccgcgcgccgaccatcatggtggccgagcgcaccgcgcagctcatgcggatcgctgcgccctgaccgcagctgtgccgtggcgatcggccgatcgcagccgcatgtgggtgggtactcatgctgaactcgtggagcccggtggtctgcccgcgtcgccgtccacctcggcggtgcaggaaccggcggcgaatcgctccgcggcctccagccggatccgctcgcgacctgcctgccgttcaggcgtcagcccaccactctgcggatacctcgcacaaccggcatgccgcggcgatcacacctcgtcagccccaacgacatcacaccgcaaaggtcagtgacgcgaacagaacccgccaacaacggtgaacagtcctccggctacctgcgggagcaccagatcccgcccgccgacaatcgcgaacggtcaccgctaccacttcgctcgaccaccagccgtgcatcgccggacggcccgcaacagtcaggacaggctgaaaacgccggtcggacatgcactggtgatcgcaaaccacggcaaggcgtcgccgacgccagttcgacgcgacccgtcccgctgctcccgctggtccgctaggacctgtgtgatgtcgtgatcagtcaggggccttcaggaagtcgtcggtccaaaactttgtggctcggaggtggagaccggcgaggtagcttccgggtgacttgtcgtagcgggtggcgatccctcgccaggcattcagcttgtcgatcagccgctcgacggtgttccgctccttggagagaccggcatcgtggctgacggaccggctgcctctggaacccttgttcttccggggaactgctcaagcccgggtccttgtctatggtagtgcgtggccacaggcgtgcccctggttgcagaggccgccgcatctcaaagggggacgggatgagcgagtcgagcaacgacaacgagggcacaggcatgctgatcgcccttggcatgacggccggcctgtccttggtctgggcctatgtcatcaaggaccaggaagagctgatgacttggggcgccttggtgatggccggagtcaccggcctcgtcgccggaaactacagcaaccacagccagtcggtcgccgtcacctgcgccttggccaccccgctcggcacctacctgggcacgctcctcggcctctgcctgatcgccgtcgctcggtacggaggtgacttcagcgacgcctggcacgtcttcaccagcgacaccagccaggctgcgcgcctgttcaaaacggaggcccgggaccgcgactggctcttcctggtcctgtcggcaccggtggggtacggaacggcgatgctggaggactgacctgaggcaggtccccgcggcggtcacggggacccgtcccgcccgtccctcctccgcgctcgcctcgagaacccctgacacccctacaatgccacgctttggagatcatctcgtttgctgaatcgcagtgaaggtgccccggcgggctgcctcttcagcgctggtgcgacgatgcggggatgcgcaaggtcgatgagctgctcaacgtcggtgatgcagcctggccgctccatctccgggagctgtccgcactgacgtaccagttgaggaggtgctgcccggcgatgccgagacaggccgtgcctcgcttgtgcggctccaggtctcggcccggtcgaatctggatgggattgacttgaataggggcggtctgctggtggacagcggctggttgcggcttttcggaagcccgggtgacgcccacgcctagaggctgccgggcctgacgcagatcaacgcgatgccctcgacgttcgatacggcctggcggccaggggcgggactcgtggttgcgcacgatgtgctgggcggggtgtccgtccgccctcaagtcgcaccgctccgccatcagacgggcgcatggcgcacctggatgactccaaccggtcccacgccaagatccgcgcgctcgtcgaacacgccatggcgaccctcaagtcctggaggctcctgcgcaggctccgctgctccaccacagggatcacagctctcgtccaagccgtccccaccctgcatctggccagctcagaccgatgatggaaaaggctcatgaacgcccgcgggcttctgcacttcgacgcccacctccagaacatcctcaccgacggccgacaactcttcttcaccgactacggcctcgcgatctcctcacgcttcgacctcacacggcacgaggccgacctcttcgaccagcaccgcgcctacgaccagtgctacgccgtcacccacctggtgaactggccggtcttcgctctgcaccggccgtcgggtagcttccgtagccagctgcggtcgacgagtctgaccagctttccgtgcagcggttccagcttggctgtgcatgagcatccgaccctcccgcggacacgcgtgaggcctcgcaccgcgcttctcgctgagccggagctcaagagatgtcacccgtgatgtcgggtgggctggcggtcagggccggtcgacgcagtctggttctcaccaatgcggcattcgacttgtcataagtgcaaccgcaggaggaggcggagcctgctgcgtcacgccggctgacagggctcccaaggaccgttcggcatgccgtcagcgttgcggccctgtgggctgtgccggaccgctaccggcctggcacagtccagacgcggtcgtgagcagaggcggggtgcgggcggcactctcggccagccatgacagcagggcacctcatatctccgccagccggattcggcgggtcctgaggtcgcggtagcagtaggccgcgacgctcagaaagagcgccgtcaggtactcaggcatcgaatggacatgcatggcgcgcgtgtccagagccgcgcccagcacgaaggcggcggcattgaacactgcaaacacgtaccccacgccccgggtcaccctcccggattgcggtgtcagcgctgcggtgaacagaggcagacccagtgccagaaagcgaagaaaccagatctgagcggctaccgaggccgactcgccttcgaggccgaagttccagaagtcgcatgacaggctgacgagcacgaacacggctgccgcaagcccgaaccgctcccactgggcgcggcgcccagccttgatcacgacggcggtagccatgacagcgatcagggggagaacgccgcgcagtgccaggccgatgctcttgtaatcgaagccgaccatgaccgcttgcagggcgaggccggtgccgcctgccgcgatcagccggcggccggctgcgttgggcgaccgcagcatcagcgcgccggcagcaagcgtgaccatctcgagaccgctcagcgccatgtgcgtcggtagctggtagatggtcatgaagctcgcgttgacggcttgctgcaccgcgacgggaatgaccggagcggtcagaacgcacagcagggccagggtcgtgacggcggttgtggtggtctcgcggtgcggcgtcggcgtcgagcggtccccgttcggagctggggcatcccggttcgtccgggcagtcaccggcgctgtgtccggcgccagggtcgccccgttcaccccggggacgggcgacgcggacaggcggggaggggtggccgatgtcgtgaaggggagggtccggtgttctgccggggatccgggctcccctgcgcggtcgagttgtcgtagggcctgggagagatcggccgcactcgggtagcgctgtccggggtccttgtgcagcaggctcagtacgagggcgtcccagatgggcgggatgtccgctgacaccgagctgggtctgggtggttcctgtgtgaggtgagccgtgatgtagcccacggtgtcaggggcctggaagggcagccggcctgtgatcagctcgaagagcaggcagccgagcgcgtacaggtcgctgcgcggctctggaaagcctcgtgcctgctcgggggccatgtacggaggtgtgcccacgatgaagccggtctgggtgagacggtccgcggtcgcataggggtcggccgctctcgccacgccgaaatcgaggactttcgccacaccggaaggcgtgatgaggatgttggacgacttgatgtcccggtgcatgatcccggcgtcgtgcgcgtgtgcaagtgcgtcacagatctgtgcgccccaagcgcctgcgtccggaagggtgacggcgccttggcgcagcatcgtatccaggcccttgcctcggaccagctccatcaccaggaacggggctctgtcgtgtcccgtgccggtctcgccgaggtcgtggatggtgacgatgttggggtgctgtaactgggcggtgatccgtgcctcgcgcaggaaccgggcacgtgcctcatcgcctcggctaccgccgcccgcgagcagagagacgatcttgaccgcgacactccggcccaaggtctcgtcccgcgcctcccagacctgccccataccgccctcgccgagctgccgtaccagccggtaacggccgccgaggagttcgtccttcacgcgccatgcctcccccgcctcgatatgccatttcgcaccaccgaaatcctgctgcgatcacgccgccaccacaaggacctccgtccgatgcctggcgtgcagagcgatcgtcgtcggcgtgccccagccaggacgagcagtgggcggccgacgatcccgacttcacccgcgcagggctccgtccggcgctccgccggtcaccggagcttcacagcggcaccgtagggcggcggcgccagcgggcctcgcgccagcgccccccctcgggggtcacgggtcggccaggggcaaaagggtcggcaggcgcagaacatcgtccgcggctgagcaggatcacgagaacgcagagcggggcggctgtcccgttgggcagccgccctccccatgtactcgcagacacatgcgcctacgacagtggcctttccgcccggtgacgcgttggctacggtgacgcgtgcccgatgatctggtcgccccacgacaggacatcgtgccgtgtgcggccccggcgcccacccggcaccggggccgctgtcgtcggcccggacgacaagcggggcaatgcccgccctctggcccccgccgcggcacgcacacccatcggcgtcacgtggcagtgcttcggccggtgggtcaccatgggaagcacggcttcggggcccagcggcatgaaggggcagctcggcgaccgcccctcggcgcgtcccggcaccggggccgctgccacgggcccggtcgaacaccgatccgatgggcccgaactcaaggaggccccatgtcccagccgcgccaggagcagtccccgcccggcgtcaccagcgagatgactccccggcccgatcacggcgaggagagctaccgcgggtccgggcgcctgaacggcaaggcagcggtcatcaccggtgcggacagcgggatcggccgggccgtggccatcgcctacgcccgtgaaggagcggacgttctggtctcctacctcgacgagcacgacgacgccgccgagacgcggcgctgggtggaggaggccggccgccgctgcgtgctggtccccggcgacgtggccgatcccgcgcactgccgctccatcatcgacaaggcggtcgaggagttcggccgggtggacgtgctggtcaacaacgccgcgttccagatgacgcgggagtccatcgaggacatccccgacgaggagtgggaccacaccctggccaccaacatcagcgccttcttccacctgaccaaagcggccgtcccccacatgcgccccggcgcgtcgatcatcgcgaccacctcggtcaactccgacatgcccccgccgcaattgctctcgtacgacgtcaccaaggcgggcctggcgaacatggtcggtgccctgtcccagatgctggcgtccaagggaatccgcgccaacagtgtcgccccgggccccatctggacgccgctcatcccttccaccatgccgcccgagcaggtcgaaagcttcggctcccagtacccgctcgggcgcgcgggccagccggccgaactcgcaccggtgtacgtcatgctcgcctccgacgaagcgagctacgtctccggcgcacggatcgcggtcaccggtggcaagccgatcctgtgagcgccctcccgcagaccctgtatccactgcggctgaccgtcacggccaagccgctggtgttcggcgggcacgccatcgcccgccgcctgggcaagaccggtatcccggactggagcatcgcggaaacctgggaatgcagcgacgtcaccggcaacatcggcgtggtgaccaacgggccgctcgccggccggcccctgcgccaagtggtcgccgaccatcccgaaacactgatgggcgccggatggaccggccagtacttccccgtcctgaccaagttcatcgacgccaccggcaccctgcccgtgcacctgcacgccgacgacaagaccgcccagcgcctggaaggacagcgcaacggcaagaccgaagcctggcacatcctcgacgccgcccccggcgcgaccgccctgtgcggcgtccaggacggcgtgacggccgaccggctgcgcgccgcgctggaggcgcaggacttcgacgccgtcctgcgccgcctgccggtacgcgcgggagagaccctctacgtacccggcggcaccctgcacagcttcggaccggacaccctggtctacgagatcgagcagacctccgacgtccagcagcacgcgatgcgctggaacatggaggacggctcccccgtagccgacgcggagttcgcctcccacctggacatgctgatgcagcaggtcgacctccacaccagaccggacttcacccccggactcggcatcgccgtcggcgacggggtggagcgggtcttcctgagcgcgggcccgtacttcgccctcgaacgctggcgcgccgggaccgcggagccgttgcggcactccttcgccaccgcgcagatcctcaccaacgtcggcgccccggtgcgggtgcggacaggcgactggaacgaagaactcggccgggcggaaacactgctgctgcccgcggcccgcgctgaggtcgagatcgccgggcccgccgacgtcctgttcggctacctgcccgacctcgaccgtgacgtgcgcggcccactgctcgccgccggctacccgcgcccgctcatcgacaccctggggccggacgccggcgcacaccgcccgagcggacaaaactcatgaacccagccggccaccccatgggacacgaatcccatgcgaacgattccaagccccaacgcctccacgcggacaaggcctacgacgtccctcatctgcggcgatggctacggcgcaaacacaccgggatccacatcgcacgcacgggcatcgagcatcgagtccagcgagcagctgggccgccgacgcgcgctaccccctcccggcggtgtcgttggcgcagcggaaaccgaggttgccgcaggaggactccggtgtgttggaggagcgcgcggccacccggtagcggttgcagtaggagtcgtggcacaggtaggagccgccgcgcatgacccgcgtggtcccggtctccggcccgcgcgggtcggcggagggggagtgggcgtagtaggagggcgagaaccagtcggagcaccactcccacacgttgcccgcgacgttcaacagtccgaagccgttggggcggtaggacttgaccggggcggtggtcaggtagccgtcctcctcggtgttggtgtgggggaagcggccctgccagatgttgcagcgccaccggccgccgggggtgagttcgtccccccagggatagcggcggcccgccagaccgccgcgcgccgcgtactcccactcggcctcggtgggcaggcgcttgccggcccaccgggcgtaggcggtcgcgtcgttccaggagatgtggacgaccgggtggttctgccgaccggtgacgtcggagcgcgcgccctcggggcggcgccagtgggcaccgcggacgttgatccaccacggggttccggcggcctcgccgaggacgtcgcaggagggcgcggcgaccacgaggtggaagaccgccgagctgccgtagcgttcggcgtcggtcacatggcccgtggccttgacgaaggtggcgaactgggcgttggtgacggccgtctcgtcgatgtggaacggcctcaggcgcaccgtgtggacgggggcctcgccgtcggccggatagccctcaccgaaggcgtcgcccatggcgaactcgccgccgggcagcgggatctgcccacgcgtggagcggggacgggcggccgtgccgcccggtaggtggact

SEQ ID NO: 107 - DNA, 13534 bp, Unknown
  Kingdom: Bacteria, Phylum: Actinobacteria, Class: Actinobacteria, Order: Streptomycetales, Family: Streptomycetaceae, Genus: Streptomyces
cgattctcgtcacccgctccatgcagcaggcccaggtcatcgacctgggccttcgcgatgtgtgcagtgccaaaacccccacagggccgcacctgacggtctgctcccgccgctgttcgagaccgcccggcccacgctgtatcggtagtccccacaacggaactgccccaatgtcggggccagaatgaaccgatcacagcaagtgtggagcgcgtttcatggccttcacgtcaaataatatcgcctagcgcaagggccctctccgcactgtcgacaagttctttgtaagtgagaacttcgacccgattcagatgtgatgcgtgaacgcgcagagtctcattgatatccgcctcatcgacttctggctgaccaagcgggtgcccaatgagaatgagtgcgcttgcacgacgcgtatcgacgccgaactccctcaatatgcgttctcgattctcgtccagaccgacaagatagttgatgacctgccccacagcatcatgcacttctcttcttggcacccaggagcctcgatgctccttcaccagcttcactcctgcggctctttttagttcgactacgtgaagagagccatcaccacggatgagcgggatatcaacttcgtccccaggcaccagccttcgttgctgagcctcaccgatgaagtgtccgccgaatatccagcacatccccttcagttcctgctgcagagcgtgttcggtggtagtggcgtcttcggtcagccgacgcagctcacgcaggcgggctgcccggcgctgcagctctgcggcacgcaggaccgtacggccgtcttcgtccgccgcgaggacggccagcgcttcaggggatgacacgatgcggcgcgcagatcccgctgggtctgtcacctctacccgattcttcagcactcgctctgtccatagcgcacgctcagctatcccacgaggtatgtaataacgtgctgaatctcctacgggagcttgcaagaattgagcgtccgcacccaacttgcggatgtgttccagaatatccgaaacaacagcttcaggatggccgacgagatacttctcgacttccgcgcaccagaattcgttgatcatggtcagggttcttgcgatcgaatcaagccccaattggtcacgggggccgcgatccaggtaatgcaatcggtacttctcttcatagtcgggcctgagcagtctcccttctgtataatagagagcatcttgaagggcccgcacaacctcccattcttccgcttgagcggctgagaaacgggccgcaccgaggagttctgtaagtcgctttcctccttttcgctttcctccggttccggactgtacgtggcgcagagttacggtgacagcgctccgtacagtttccgccgtagcggcagagaggatccttgtgaggtggatctcgagagccatgtcggatcgtgtggacatgagcaggagtctgacgcacgggtctgacacgccatccgacggagtttctgttggctgcgcggtagtggtgacccaacgccggcaggctccgcatcagtctccggctgttcggacgtggcccagccactgaactgccggcgggaccgcactccacggtttcgagatctcgccgttgggctcccagccgtaccgccgcatgtgctgagcgtcctccatgcgaccggccgcttccagcagttcgacgtactggcgccaggcgtacgggtcaccggtccgcgagacgcggcggagccaggcaagcgcctcgtccgtgcgacccgcgatgcggagcagctcggccacggcggaccgctgatccgggtggtccttctcgccgtgacggtccgcgcacgacttcagccagtcgaaggtctcgtccggccccgcggctgccgtcatcaagcgagcgagctgcgggatgatctcaggatcaccttctgccgccgcacgccggtaccaggcgagggcctccgacggtcttcccagttgctcgtgcagggcggcgacctgcgccaccgcgtcccgtcgcccggtgtcggcctctttccggtacagcacgagtgcttccgccaggcggccctgatgcctgagcgcctctggcgtgtccgtgtccttgtcccgacagtcgcccttggcgagcccatccacgtaacccagcagtgcgctcaactcgcgccgcgccgcgtcgtcctgaccctcgtcatcgacaaggctccacaatcgggcgcggaggacggcgtccatggccaggtgccggatcaacgcgtgctctgcccaagggatgccgacccagtccttgctgccttcttccgctgcacggaacagcagccacgccaggacggtgagtccgctgtcaccgcgctgccgcatcagggcggccgtctccaccaccgcgtacccaccgcttgcctcggcctcttgctggaggtggacgagtgcttcctccgtccgccccgcttcctgcaacaggtgggccagttctccatgtccaccgtgcacgccggcatcggccgcacgcctgaagcagagctccgcgtccgcgaattctccagccctgcgcaggagcatgccggcgtagagccagccatgagttcctcccgcttcggcggccttcttgtgccaggccactgcaacgtccggccgggtcgcctccatgagaccggccacccggcccatggccgcgacgttcccggcttccgcgagaggcaggcaccacagcagtgcctcgtccggtctctcctcttcctccagagactgagcccctgccacggcggcgcccggcacccccgcttccacccctgccgcgagcagacgcagggcgatcctcaggtgacccctgtccctggccgccccggccaacgcaatgagggaatcccgcgcggcatggtccaccagcgcgtcccacagccccactggcggtgccttggtgcgccttttcttcctgccgtgctggtccaggtagtccgcgagtctgatgtcgtcggtgaggacgcgcggtccgcccggttcacggaaggtgacgggcgtgagggggccccggattccacgcaccggcttgctgagttccgcgagtgcgtgctcgatgtcaccgtcctccaccaagtcgtactggtcggcggagaggtagtgggggatcgacgcttccaggaggatgcgcggaagggacgtgtcgtgcccgagacggcgggcatccatggccgactccatcaaggccctctgaagagccgtggcggtctcgtaccggtcgatgagtgctcgaccgcccgcgaggtactgcgtgatccgccccggctcgccctgttccagcgcttcctggagccggccgtccacagcggcgaggcgccgcagctcgggcacgtccgtgtcctcgaaggtgtccggtacccggaagtgcttcccggtgaggagggcacgggcctgtgcgtgcggatctccgcggtcgccgtcctcgcgcggcttcaccagatccgcccacaggtcgggccaggtcgtgcccagcacgagcagcggtccccgccgcggctcgttgagtacttcttgcaggtgggcagctgcctgctcgccccggtctccgctcaggaaacgggggatctcgtcgagccacaggacggtgcggggagtgatctcggccaatgcggcgatcagtgcttcggcggggctcggtaccagaggaagtacgagccgccagtccggagggagcaggctgagcgcttcccagcacgccctcgtcttgccggtcgatgattcaccgaccaggacggctagtacgccgcccggctgcccggcggaccgcacgacgaggccgttcaccacgtcggccagccaccggtcgtgctgccgttcgacgtagaggggaagcaacggcaaccccgacgcgccaccgccgtcgatggcctcgtgcactgccagcgtgaacggatcggtgaactcacggaccggccgccctgggccggccggcaccgtgcgcaggacccgcaccggctgcgcctgctccagcaggttgcgccaatgacgctcgttgacactttcacccgcccaggaactccacagccgcaccagcgccagaacgtcgtcgctgctcctgtcgctcgggaccttcggttccttgtcccttgtcggtacccagtcgctgatccgctggtcgccgactctcctcccatacggaggcttggcgagcgcctggatcacctcccgccgcgagtaccggcagccggctcggcggcgggcctccagcgcctgttgctccagtgcgcgcagctgctcgtaaagcagtcgcgcctcccgagaccgtgttgtcacccgcgctccccctcctggccgccgcgcccggaccgcccgcagcgggtgcagcgggcacctcgtcggccagcagcgtagaacgggaaacgcccggtcctcccgcccgaccgggcctcttccacgtcaccgcacaaaactcggaccgccagctcgcagcagcgacgagatgaccggaggagatcccgatgagcaagctcacggaacgaaagcggcagcgaaccgttcgtcgtctggggcgcgccgccctgttcgccgccgtacgcggcgtcgccacggctgcgggctctgcggtggtcgggtgcgggctcgtgtggtggcagagccgttgaacgaatcgcgggccggcgcgaagcggcagcgtggtggggaaagcccggtgctccatgagcaccgcacgccgcttccactcggcaggggaaagcgtcgaggcgaccaaggtctccgagccgccccggcgcgtgggagtcggtacgctgagcgcagcgggatcgggcccgccgcgcagtgtccgggaggcgtgtcatgactgccgagatggtggccccggcgtggatgcaccagcagatcacggccgaggagtacgagtcgtggtccgaggaacagtgcgccggcatcgagatcgtggacggaatggtcgtcgtgagccccagcgcatccaagcggcacaatcggctggcccgactcctggcaaacgccctggacgccgcagccggccccgactggaacgccgacacggatttcgacgtccggctccaggacgtcccgctgaccaatcgccgccccgacgtcatcgtctaccgtgcggacacgatcgacatcacacccacccgtccggagcacgtactgctcgtggccgaggtggtgtcgccgggctcggagaccaccgaccggatcgtgaaggtggaccagtacgccaaggccggaatcggcttctactggcggatcgagcaggccgcgacgggcacaccgctggtgtatacctacctgctcgatcccgcgacgaggacgtaccgcgagggggatgtgttcgccggcgccctgaagatcaccgtccctttctcggcggagatcgacctcggccagatctgaaccggccgcagggcagtcagaggggctgctcagcctgcagtggtgcgccgcgcccggcagactcctgcggatgtgcgagcaaccgaggctccctcgagcgagcagagtccggaggcgtagaacccacgcggacgccgccgcacctctggtcggacggcttcaccgtgccgtgcccaccgcgtgcccttcagagcggacaactacggtcaacaggagcatgcgccgaagaagcacaccatcatcgttgagcgtgtatccgcaggtcagcgcgagggcgaccagccgagcgccgtcgcttcccaagctgagagcgcgagttcgattctcgtcacccgctccacgaagaaggcccgggtcaatgacccgggccgcatcgaggccggcggcgacctcctgctgtcgctcgtcgtcggaatgctgagagacgtcgtaccgcgtggggtcggcgccgtagccgaggtgaacctcgcccagggcgcgcagttcgtccaggacctgggggtggatgagttcggggacgtagatcgagggcatgaccggtgcggtgtccgttctgtgtcggtcgccagcggggagtgccaggcgaacaggtggtcggtggaggtgctgttgcggacggcaccgagggcgatggccaggccggccggcccgacaaggccaggtcgtgacccctcgacggacctggccgggccccttcctgcccgagcctgcacgagacgacgtcgacgaaacggtgtgcggcgtcggtacggcggagccgacccacggtccaccggcgagggaaaacccgactcaccggccaccggcccatggacagcaccgccctctctcgggcacacaacgggggcgatcacgttcgttacgatcggtccatgaccgcgaggaaagagccgatcagccgccgggagcggcccgcgaagcccgccttgtcccggcgctggatcgtggacaccgccgtgcgggtcatgcgcgccgaggggctggagaaggtcaccatgcgccgcctggccaaggagctggacaccggtccggcctcgctgtacgtctacgtggccaacaccgcggaactgcacgcggccgtgctcgacgccctgctgggcgaggtcgacctgaccggcggaggcgcggggggtgactggcgcgagcagctccgcgccgtactggcctcctacacctccgtgctgttcgcgcacccccagctcgcccggtccgccttggtggcgcgtcccagcggcgagaactacctgcgcctggtggagcgcgtcctggacctgctgtcccgcagcggcgcctcccgtggccaggtcgcctggggtgtggacaagctgctccaggacgccacggccacggccgccgagcagtcggcgcaggaacacgaccccatggtcgaggacgactggaacgccaccacccgggccctccactcggtggacgagacccatccggccatcaaggcgcacatgcccgccctggtcagcggctcgcccgaggaccgtatgggctggagtttcgacgttctggtcaacggcatcacgcacacccccgtccccggcacgaacggctgaagcctcgccgaccgtccgcccgcgaacgcgcgggcggccagcggctatgccgagaagcagactctggcgaacttgtacgtgacgaacgcgttcgttacggtggaggtgtccggccggatcgcctcgcgttcgggccgttccgtcgccctgcggcgggacgggcggcgcgggctccggacccttcccgagccgcatgcttcccgcgcgctcggtcagtcagtcggaggacccatgagcacccatcaccccgtcgcgatcatcggtggaggtctcggcggtctcaccgccgcccgcgtcctgcacgtcaacggcgtccaggccgccgtcttcgaacgggaggcgtccgccgcggcccgtacccagggcggcatgctcgacatccacgaggagaacggccagaaggcgctgcacgccgccggcctccacgaggacttcctcgagatcgtccacgggggcggccaggagatgcgcctggtcggcccggacgccaccgtccacgtctgcgagaaggacgacggaaccggcgcccgcccggaggtggaccgcggcgacctgcgcgacctgctcctgaactcgctgcccgacggcacggtccactggggcaggaaggccaccgccgtgcgggcgctgggcgacggccgccacgaggtgacgttcgccgacggctccaccctcaccaccgacctcctgatcggcgccgacggggcctggtcccgggtacggccgctgctctccgacgccacgcccgcctacaccggcatctccttcgccgagaccgacctgcacgacgccgacgcccgccacccgcgcagcgccgccctcgtcggaggcggtttcttcatcagcctgggcaaccggcgcggcttcctcgcgcaccacgagaccgacggcagcctccacgtctacgccgcgctgaaggccgacgaaggctggctggacaccatcgacttcaccgatcccgccgccgccaagaccgccgtcctcacccgcttcgaaggctggcacgaggacctgcgcggcctggtcgccgacgcggacacggtcaccccgcgccgcatccacgccctgcccgtcggacaccgctgggaacggaccgcgggtgtgacgctcctcggtgacgccgcccacctcatgtcccccttcgccggcgagggcgccaacctggccatgctcgacggtgccgatctcgccgaggcgatcgccgcccaccccggtgacaccgaggccgcgctcgcctcctacgaacaggccctcttcccgcgcagcgaggcgtccgcggccgagtccgccgccagcctggaaacgatgttcggcgaccggggactggagcagatgatcgagttcttcaccgccggaccggcagcccggtgaccaccgctgacagcaccgccgacaccgtccacgcgacccgggagaaaccatgaccgcgcccgtcccgcgcatcgtcaccgtgcggtccggcctcgacctgaccgtacgggaggccggagagggcggcccggtactcgtcctgcacggcgcacccggccccgccggcatcacgccccttgccgaccacctcgccaccgggcaccgggtcctgacgcccactcatccgggctgggaaggcaccgcgagacccgacgcgctcggctccgtggccgccctcgccgtcacgtaccacgacctgctcgaccagcaagaactggacggcgtcaccgtggtcggcacctccttcggcggctggatcgccgcacggatggccgtggacgaccgcgccggccgcatctcccggctcgtcctcatggacgccatcgggcccgagatcccgggccatcgagtcaacctgcccagtgggccgccccccggtacccgcacgccggcggcacgcagcggtccgcccgcccggatgctcaccgccctgcgcgcctacaccggcccggacatgcacgacccgggactgctggcacgcctgtccgcggtcacctgccccgttctcgtgatctggggcgccgacgacacggtcgtcacccccgacttcggccgcgcctacgcggccgcgtttccctctgggcggttcgaactcatccccggcgcgggacacctgcccatccgcgaggcacccgaggccgtcttcaccgccctcgaccgcttcctcgccgaacccgccgcctgaaccgtccggccagcgcttccctccccccggcgtcgggcatgcatctcccctgccggctgccgtgttcgacgtaccgggcatgcggtgcgcagccacctcaccgtggccgcacccgacggagagccgatccccctggcacccctcccaggggtcggaatgacgaagatcgcgatcattctcagcaacacccgaaccggcagggccggcgccgccgtcacccactgggtcctcgaccaggcaccaggcaccaggcaccaggccacgccgtatacacgcagatcgatctcatcgacatcgatctgccgcaagcgtgatcacgggcaggtccgcgtcgcgggccgccgtcagcggcggacgggtccgtacgcctccgggagtacgcccgtggccttcctgcgcgggacgtccggcaggggccgctctgtgatggtgagggcaccggggccgggacctccgccctgtcgccaccgctttccccgggagggaccgcctccgtgaccaccgcaacgctttcccgcacgagcgcccggcgccgcgacttcggcgctctgaccggcgtgctgtacgtcctgttcttcgtggccagtctcgtcgtcgccggagcgctgggcccgtccggcacggtgacgccgtactccagcgacgccgaagtgcaggcgtaccggctgaaggatccagccgcactggaggatctcttccgcgtcgtcggcctgctccaggggttgtccgccctcgcgttgctggcgttcgtcccctggctgaccgcgttcgtgcgcaggtatggcggggatgcccgggcgggcgcggtccgggcgctggccaccgttgccggggctctcctcctgctctccgcgagcaccagctgggtgctggcccagatcggctccacggcggagctgtccacgtaccgggccgtctcggatctgtcgttcatcaccggtgccggcccggccgtcgccgccctcggcgcggcggtcttcctggccggcgcgacgggacgcgccgggcgtgttctgcccgcctgggtcgcctggagcggcatggtgagcggggcggccggcgtgttgtcgatgagttcgctcgtcgccgagggcggctcggtgttcatcccggccggtcgcttcctcggcttcgtctggttcatcgcgctcagcgtgctgttgtgcggacgtggccgtcgaacggatgatcccagcggttccagcggttccagcggttccagcggttccagcgggccgcgacatccgtgacgttgaagggagcgggctgtcgccgcctgcaccgccgccgtccagtagtccagttcggcctcgtcaggtagcgaaataccaggtcagcggcgtgaagggcttcttcccgagtggatctgtgccgacggccacagcgggccggacgcgcgagggcgcatactgagacatgaccaagcccgcagcgccgaagcgtcacttgcccaccagccccttcaaggcccccgtcgcaccggcccccaagcacttcgccgtgggggatcaggtcacgcacgacatgtacggcctcggccgtgtcatcggtgtcgaggacggtgtcgccgcgctggtggatttcgggtcggaggaggtgcgggtcctgagcccgtacgccaagatgaccaagctgtaggaccgcaggaccgctgtgcccggtcgtggcacgcccaggtctcttaggggcctgtgacggaagagagacctctcatcgaactgatcgaaccgacatcgctgttctccgccctggaggagcagccccgctgctccaccgcggcctcaccgcctccggcgaccgaccccttccaggcacctgaaatcgcccccttccaggcatctgagttcgagggcgaggagaccgtaccgttcgaggatgttgtgcgggagcccgccgcgggcgtgcgtgcggggcgacggaaggccgcccggcgcaggtgagcggctgcgcgccgcgcctgtgtcaggggcggggcttcgtggtcggtggccggtcgggaggtggggcaccgcccaggccctgagggtccgcgcgtgtggcagtgctggtcagggccgtggtgggaagcttgcgggccgtgtcgtccaaggctgcccgagagcgggtgtgcggtgcgccggaagagcgcgggccagtgtgtcgagcagggcgcgcaggcggcggtgcacctggagggagccggcgccgtccaggacggtttcggcgagcgccaggtcgagcagggccggccagtccggacgggggatcgtgaggcggacggtaccgtccgcgtcgcggagggcgacggggcccagcggcggcgcgctctcctcgggcatcggcggtctgccgctgtcggcggccggtggttcagggggtgacgatggcgaagtcggggtccgggtcggccaggtggccgaacagctcggtcagcttgcccgggtcgccggtgatctcggcgcggccctgggcggcgaggccggtgaggtcggcggtgccgagcaggagcgcgcgcaggtcggcgccggtcagggtgatctcggtgtcgggggcgcggccgtccggtgccgtcccggtggtgtggatcaggacgccgttgcgcagccgcaggctgatcgcgtcggcgtcgcgtacccggaagcggatcgcgaggtcggcgtgcccgctgcgggggccgtcgacccggatggccagggagtcgaggagctggtcgagggtgagggcgctcatgagatcgggggacgcggtcacggtcggggtgccgaccgggcccttgcgcagttccagggcgccggtgaggtagaagttgcgccaggtgccgttctcgctgccgtagccgagctgttcgagggcgtctgcctgcagcgcccgggcttcggtgttgccggggtcggcgaagaggacgtggttgacgacctgcacgacccagcggaagtcgccggcggcgtaggagtcgcgggcgcggcgcaggacttcaccggctccgcccatgaactcgacgtagcgggtggcggcctcggccggcgggtgctcccagaggtgggcggggttgccgtcgaaccagcccatgtagtgctggtagaccgccttggtgttgtggctgaccgagccgtagtagccgtgcgtgtgccaggcgcgttccagggccggcggcatctccatggcctcggcgatctccagcggtgtcatgccctggttgagcatgcgcagggtctggtcgtgcaggtaggcgtacaggtcccgctgctgggacaggaaggtgaggacgcgttcacggccccacgtcggccagtggtgcgaggcgaaggccacgtcggcgctgtcgccgaacagctggatggcctcggtgaggtagtgggcccacacgtgcgggtcgcgcacctgggcaccgcgcaaggtgagcaggttgtgcaggttgtgcgtggcgttctcggccatgcacagcgccgcgtggtccgggaagtggatgttcagttcagccggtgcctcggtgcccggggtgagctggaagaccatccggatgccgtcgaccgtctccgtctggcccgtgcgcgtcacatcgagggtgggcgggatgagaccgacggtgccggtggacgtggtctgtccgagtccggcaccgatctgcccgcgttcgccggtgggcagggcggcgccgtacatgtaggcggcgcggcggcccatggccgtaccggcgtatacgttctcgctgaccgcgtgcttcaggaagccctcgggggcgatgaccggcactccgccgtccacctcctcctggccgaccactccccggacgccgccgaagtggtcgacgtggctgtgcgtgtacagcacgccggccaccggccggtccccgcggtggcggcggtagagggcgagggccgccgcggctgtctccgcgctgatgagcgggtcgatcacgaggacgccgctgtcgccctcgacgatcgtcatattcgacaggtcgaagccacggacctggtagatgccctcgaccacttcgaacaggccgtgccgggcgaccaggcggctctgacgccacaggctggggttggcggtgtccgggcagtcctggccgaggaatccgtacgcgtccaggtcccatacggtaccgccgtcggcgccgcgcacggtggggtcgtcggccgtgccgaggaagccgcggctcgcgtcctcgacgtcccgcgtgtcgtcgaaggggcagcgctcacggacctcggcgttgcccgccgcgatgctgggttccgcggcctggggatcgctggtctcggcggtcgcgctggtcgcgctgggctcggccatggtgggtctccctcgctgtgaagggcgcgcggaatccggcccctgccacgcttccccaaggccgcggcgcggaccaccgcatcccggccgttcgggtgccccgggggtcgcggacgcgccactgccgaaccttcctgtccgcccgccgggcggccggcggcccgccg

SEQ ID NO: 108 - DNA, 2758 bp, Unknown
  Kingdom: Bacteria, Phylum: Actinobacteria, Class: Actinobacteria, Order: Streptomycetales, Family: Streptomycetaceae, Genus: Streptomyces
  misc_feature (2645)..(2646): n is a, c, g, or t
cgcccgcgacctggccgcgtccgggctcgacgtggtcgccaccgcgggcgacggcgagcaggcggtgcgccgcgccagggccgtggcgcccgacgtgctcgtcctcgacctcaacctgcccgcgaagcccggcgtccaggtctgcaaggaactcgtcgcgcacgacccggcgttgcgcgtgctggtgctctccgcgagcggtgagcacgccgatgtgctggaggccgtgaagtcgggcgcgacgggctacctgctgaagtcggcctcgacggaggagctgctggacgccgtgcgccggaccgccgtcggcgacccggtgttcacgcccggcctggccggtctggtcctcggcgagtaccggcggctggccgccgagcccgtgtccgcggacgccgccgccgacagcggcccgaaggccccgcggctcaccgaccgcgagacggaggtgctgcgcctggtcgccaagggcctgagctacaagcagatcgccgagcgcctggtcatctcgcaccgcaccgtccagaaccatgtgcagaacaccctcggcaagctccagttgcacaaccgggtggaactggtccgctacgccatcgaacgcggactcgacggcgagtaaacccgcgtacgcggaccacccactctttcgagtggatttgccgtgatcaactgccggacattccaccggaattgacttttccgcccatgtcggagtgacgtgggtcaccattaacgtgcccttcaccaggcaaccgtggcgaagggacatttccatgcgcgtcggagtactgaccggtggcggcgactgccccgggctcaacgccgtcatccggggcgtcgtccgcaagggcgtccaggagtacggctacgacttcgtcggcttccgggacggctggcgcggccccctggagaacgacaccgtccgcctcgacatccccgccgtccgcggcatcctgccccgcggcggcaccatcctcggctcctcgcgcaccaacccgctcaagcaggagaacggcatccggcgcatcaaggacaacctcgccaagcaggaggtcgaggcgctcatcgcgatcggcggcgaggacaccctcggggtggccgcgcggctgagcgacgagtacggcgtgccctgcgtcggcgtaccgaagaccatcgacaacgacctgtccgccaccgactacaccttcggcttcgacaccgccgtcggcatcgccaccgaggccatcgaccggctgcacaccaccgccgagtcccacatgcgggtcctggtctgcgaggtgatgggccgtcacgcgggctggatcgccctgcactccggcctggccggcggcgcgaacgtcatcctcgtccccgagcagcgcttcgacgtcgaccaggtctgcgcctggatcacctcccgcttcaaggcgtcctacgccccgatcgtcgtcgtcgccgagggcgccatgcccaaggacggccagatggtcctcaaggacgagtcgctggactccttcgggcacgtccgcctctccggggtcggcgagtggctggccaaggagatcgagcggcgcaccggcaaggaggcgcggaccaccgtcctcgggcacatccagcgcggcggcacgcccagcgccttcgaccgctggctcgccacccgcttcggcctgcacgccgtcgactgcgtccacgacggcgacttcggcaagatggtcgccctgcgcggcaccgacatcgtccgcgtcccgatcgccgaggccaccgccaagctgaagaccgtggaccccaagctgtacgaggaggccggggtcttcttcggctgaccgcaccgagagcgccggcagggcgcgcggggtatgagccgtacgtcaggatatgcccctgtacatccccgtatattcggctcataccccaccagaacgggagtcgccgtggagatcctggccttcggagtgcaggccgacgagaagcccctgatcgaacacgccttccgggaccaccacgaggtccgctgcctggacgtcttcctcaacgaggacaccgtgcccatcgccgccggctacgagatcgtctccaccagcgtcaacgccgaactcggcgcgcccgtcctggagaccctcgcggccggcggcacccggctggtcgcccagcgctccaccgggttcaacaacatcgacctgcacgccgccgaacggctcggcatgacggtcgcccgggtgtcgtcctactcgccgtacgcggtcgccgagttcgcctgggcgctcgccctcgccgtcaaccggcgcatcgtgcgcgcctccacccgcacccgcgacttcgacttccggctcgacgggctgatgggccgcgacctgcacggccgtaccgccggagtgctcggcaccggcaagatcggcgaggcgttcgcccggatcgcccacggcttcggcatgcggctgctcggctgggacatcgccgagaacccgtcctgcatggaactcggcatgaagtacgtccacaaggaccagctcctcgccgaatccgacctggtctcgctgcacgtcccgctgatgccgcagacccagcacctgatcgacggacgcgccctgaagacgatgaaggacgacgcgatcctcgtgaactccagccgcggcggcctcgtcgacaccgcggccctcgtcgccgaactnnggacgacacgctggcccgcctggtcaccttccccaacgtcctggtcacctcacaccaggcgtactacaccgaggacgccctgcggcagatcgtcgacaccacggtgcgcaac

SEQ ID NO: 109 - DNA, 23129 bp, Unknown
  Kingdom: Bacteria, Phylum: Actinobacteria, Class: Actinobacteria, Order: Streptomycetales, Family: Streptomycetaceae, Genus: Streptomyces
  misc_feature (20228)..(20229): n is a, c, g, or t
ttgatgtcgcggtgcacgatgcccgcgcggtgggccgcggcgagggcccggcacacctgcgcggcggtctccgccgcccgtacgggctccatcggaccgtacgcgtcgaggagttcgcgcagggtgcgcccggacagcagcggcatcaccaggtagggcacgtcgccgtccgcactgtggtcgaagacggggacgatgtaggaactctccagcgcggcggcggcgcgcgcctcgcgggcgaacatgccgaggaaccgcgcccgttcctcaccggccagacccgccggcacgctcagcagcttcaccgcgacctgccggtcgagccgcgcgtccgtggcccgccacacgacgcccatgcctccggcgccgatccgttcacgcagggtgtaacgccctccgaggaccgcgccgttctccatctccgtgctcccccaagcgccgtcgtccgtgcagcctctgccgtcaatctaccccggcgggcgggcgcggtcggcggacgcggggcgggaaccacgggtgcaggacggcctttccggcgacggtgccggactccgccagccgcatcgcgtcggcgacctgtgcgagcggcagcctggcggccacccgcgcggtgatctcgcacgcacagccgtggggcgacgaggagccgtgtctcacgacgagcggaacgaccggacaaccccgggggagcgtcgcccctgtccgtaaggccggtgcaacctgttcgtgatccgtgaccccctgttgcgctacgcgcgttgaccataggctccgcacaacctcaacagccttaactcacacaggggagcccatgacccatccgatccggccgagacgccgcgcccaccggatactcggagccttcgccgctctggccacggccggtgcgctgagcgcggccgccgtgcccgcgcacggaaccgcggcggaccacagccacgggcacggcgggcctacggtcgatgtccaactgctgtcgttcaatgacttccacggaaacctggaaccgccggccggttcctccgggcaggtcaccgagacagagccggacggcacgacgaagaagatcgacgcgggcggcgtcgagtatctggccagctcactgcgtacggcgcggaacgggcacccgtacagcgtcacggccgcggccggtgacctgatcggtgcgagcccgctgctctcgggcctgttccacgacgagccgaccgtggaggcgatgaacaaactcgacctggacgtgacgagcgtcggcaaccacgagttcgacgagggcgcgaccgaactcgcccgcatgcagaacggcggctgccatcccaaggacggctgctacgagcccggacggaccttcaagggcgccgactatccctatctcgccgccaacgtgacggacgagaagaccggcaagccgatcctcgagccgtactgggtgtggaagcacaacggcgtgaagatcggattcatcggcgtgacgctggagggcacgccggacatcgtcaccgcggaaggcgtcaagggactgaagttccacgacgaggtcgcaacggtcaacaagtacgcggacatcctcgacagacagggtgtcaagtcgatcgtcgcgctcatccacgagggaggccagcccgcctccgcctcgtacaactacgactgcgactccccgggcacgggcgacggcatctccggtccgatcgtcgacatcgcccagcacatcacccccaaggtcgacgctctggtcacgggccacacgcaccaggcgtacgtgtgcacgatccccgacccgtcgggccggccgcgcatggtcacctcggcgtcctcgtacggcaagctgtacaccgacaccacgctgacctacgaccgccgcacgcaggacatcgtccgtaccaccgtgaagtccgcgaaccacgtggtgagccgtacgcagccgaaggccgccgacatgacggccctcatctcccgctggaacaagctggccgcgccggtggccgacaagcccgtcggctacatctcgggtgacatcaacggacgcggggcgaccacccccgaatccccgctcggcgacctgatcgcggacgcgcagctcgcacacgcgaagtcgctcgaccccaaggccgtcctggcgctgatgaatcccggcggcatccgctccgacctggtctacaaggcgagcggaagcgagggcgacggcgtcgtgacgtacggcgaggcgttcacggtgcagccgttcagcaacacggtgaacctggtcgacctcacgggcgcgcagttggtcaccgcgctgcaacagcaggtcagcggcccgaacgaagcctcaccgaagattctgcaggtctcacaggggctcacgtacaccctggacctcaccaagtcgggcgcagctcgcgtcgtcgccgactccgtccggctgaacgggacggcgatcgacccggccgccacgtacagggtggccatgaactccttcctcgcgggcggcggcgacggcttcaccgagctcggcaagggcaagagcccgctggtcggcgcggacgacctcaaggcgttcgacgattacttgacggcgaactcctccgcgacgacacccgtcaagccgccggccgccgatcggatcacggtcctgcggtagcgacggcagccgaagggaagcgggcggccagtggcgtccgtcaggggatgcgtccttctcgcaggcgcatcccctgcgtccgtggtgtgccatcgccgctcctgttccgccgtccgcgccagccgtcactcctcctgctgtcgccgtttctgctcggcggctcttgcgtgcgcttggggacgcgaccggcacgcgccggggaaggacggctcagcaccgagcggccccgtgctggttcggtgccgactaaaagccaacgtcgtcacccgttctcgttcctcccctgctgacttggtgctgactacactgcgtagcacccggacgttcagggacgatcgccctccggccgccgcaagcagccgttcagtgccgaggtcccgcgaaggctgtggcgagctggtcgagcaggggtgctgcccaggggtgggggtcgcggcgtggggtgatcgtgtagatgccgcgggccgggggatcgacgagtcccactgtggtgacgtcactccgcagcgcgcacgtcagcaccccgggtatcagcgcgatggcgtggccggttgcgaccagggccagcttgccgagcagatcggccgcggtgagatcgatgcggacgctgactccggcgcgggcggcgtgctggcgcaggagcgctgcggagccgtcgttgtcctcgacccaggtctcgtcggccagcgtctgcatgtgcaccgggccgcccccggcccgcggatgaccgacgggcaggacgacgaccatgtcgtctgtcccgaggaaccgtcggtcgacccgcgggtcatgggggagccctggcggtgcatcggtgacgacggccatgtcgagatcgccgccgagcacgcggttgtgcagttgtgcgctcaggccgggaagcaggctccactggaggggtccggctcgctccagcaggctccgtatggcctcggggacgatccccgcggccagagagggggtcgccccgaccaccaacggccggtcgtacgccccgtcacgaacggctcgtgcggcacgaacggcgcggtcggcctcgttgagcgtgaccagggcgtggcgccggaacacctcgccggcaggcgtcggacgcacaccgcgcgcatggcgctccaccagaggcacgccgagctgccgctcaagcccggcgatctgccgggagacggccgactgcgtgtgattgagctccgcggccgcggccgacagcgacccgagccggcacacggtcacgaaggtccgccacaccgtcagttccatggaaccagtattgaccagccggtatgcgcatcccgcagggctgccctgcgaaatctgcgcttgtcgcagccatggccgtgcaccactctggcacgcatgaccacactgcacacgatcgccgtcctcggcctggggcgcatgggcggcgcgatcgcgacacgactggctgcccaggactgggacgtcgtcggctggacacgctccgggcgtgcagcgggcgccgtcgagatgaccggcgatccgaacgaggccgtggcgaaggccgacctcgtgctcctggcattgttcgacggtccggcctgccagcaggtcctcgacgacgtccgcgactcgctgcgaccggatgcgacggtgctgaacaccagcaccatcgcccccaccgaagcgtcggagctggcccggcgattcggctcgtcctacgtccatgcgccggtgctcggctctgtgccggctgccgccgctggtgccctgcagatcctcgccgccggcgaccaggacgcgctcgatcgggtccgaccggtcctggaaacgctgggcaccgtgcggtgcgtcgacgacgcctccaccgccgccgcgctcaagctgatcgccaacgacagcctcgccggcgccgtcctcgcgctgcgtgactcgctgcggcaggccgacgccctcggcctgccccgtgccgaggtgctggacgtcctcgaactcggccaactgggcgggctggtggcccgtaagcgacccttcctcgtcggccgggcggccgccggcacggccgacttcacgatgggtgcgctggccaaggacttggctctgctggccgccgcgtcgaacacccctctgcgcagcgcggccggcctggccgaggcccctgccgacccggaggccgacatcgcggttgccgccacggtccccgccgttccggacgccgtactcgaaccgctccgcgcctacacccgcggacacgccaccggcgaccccgcccacttccgcgacgcgttcctgcccaccgcccacatcgagggaatccgggacggggcattcgtctcgtggcccctggacgagtactgcgctctcttccagggtcggccggcccctgacgaagcgacccgctcccgccgcatcgacgccctcgacgtccatggcaccgtcgcgaccgcgaccatgacgctctcgcacggccgggacaccttcaccgacatcttcctgctggtccgcgtccacgacacctggcgcatcgccaacaaggcctatcaccgacactcctgagggcggagacgggtgaggcagcccttgagcccgctcaaggccccccggctgtcggcagcaggcaggagggcgaccccgacgtcctcgtcatcgcggacgccggatacgacgcccacccgccccggccctgggatgtccgggtgccgatgacctcatgaccccgcaggccgctcggtcggcttcgacaggggggacttctcgatgtcggcgatcacccatcgccccttctccttgaccaggtcgacactgcggtgctgcgtgtagggcactttcagggcgaacccgcccttcttcaggtaaccggggctgcccgcggtgaactcgatgaccgtgtccatctcgaccttggcggtggtccggtcctggaacacggtcgaccggtaccaggcggtgttgtcctgccgggtggccagcttgttcgtacggaagaaggcagtcgaccgggacgcgtagtcctgagacctgagccgtttggcgaaggcgtcggcgtagaaggtgaactcgtcccgcacgctggtggtgatcgagcggaagtcccggttgtcggtgagggcggagtgcagcgcgaccgccttgcgtacggcggtgacatccggatcgtcgtcgggcagcgccttgatcgtcttcccgtggccgtcgatgagggaccacagggacttggctgccgctcccgtcggcggccctgcgtccggggcgggggacgaggcggcccgggtggaggggggtttctccgccggcggggtggagtcgcagccggtgagcagcaggaccatggcgggagccggaaagcgcctgacccgaaggccaccctcggctcaagcgaggggccggctacttccgcggttcgtctgggcggcggcctgccgcaggcgcgaagccgtgtcgaggagatcgaaggcatccatgacggcatcgacctcggctggaaactggccgcggtcctcacgggtgcgcccgaacgctcctggacacctacgagcgggagcggctgccgatggccgcagccgtcttgggtctttccaaggagctgctgacgcgcttcgcacggttcgaggactccgacctcgatgcgatgtccggcctggggatcacctaccgtggcggcccgctcagcccggcccgggacggcgccggcccacacccgggtgaccgcagccccgacgcgatctgctcctggcccgacgggcgcccggtacggctcttcgagccgcagcgcggcggagacgggacgctctaccgcttcggcggcggctccctgcccgagatcgccggggtcaatgcccactcgatcggtgccgacctgctcgacccgcgtgccgcggtcaggtcggcataccgtgcgcacgacggcgaattcgtcctcgtccgcccggacggtcacctcgggctgcgcaccgaggacgcagccgctgtccagacgtacctggccgccgtgtcggcaagctgatcgggagggctccgaggggatgcccgtgttctgcgggcgggatgtgtcgcctacggggtcggcgccaaggcgcgggcaagttcccacaggtcgggcagtgcggcgctgatgcgttgctcggccccggccggcagttgccgcagggcctccgtgatcgccttgcccaggttctcgttgacttcgccgccggctgtgatcatcttccccgtggggtgcagctctacgtaccgtcggtcgtgtgcgctggggcggcggtcgatgaagccgtcgcgggtcagctgggtgaccagggtgctcacgttgttgggttgcatgctcagggcggtggcgacctcgcggacgctgatccctggtcggctctcgatgaggcgcagaacctccacttgggcgagcgggcggggcggctggccggtcggcggcgtctggcgctggcggagtgcccggtgcagggtccacgaaaggcggaccaggtcatcgggtagctgttcgggctttcgctcgctcacacagccactgtacctctagtcctagagctgtgttgccggtcgagccgggacatggtcccgagtggcttcgcgggaggggagtgagtgactctagtagtagaggtatagctctagatttatacatcccctctctcgcgtctggatgtttcgccttctatgctgaccgataagcaggacatgcatcctctttttcaggactggagtcaccatgggtccctcgactgcttcgaccggccggccggccgaaccgaagatcgaacgctctctcaccctgcatctgcgcggtgactggggcaccgcgaacctgcaccgggtctgcggatggatcgcccaggaactcgcggaccgttgcgggccgcacacgcggatcgccacgtggaacagcaggggcttcagcgacgcggtgcgggccgtgggccggggagaggtacaggtggcactcaccacgccggcggctttcgccgccgcggcgctcgacggtcgcggcgtctacgtggacgagttcttcccggagttgtgcgctcttggtgtggtgccgcagcgggaccgtctggtcgtagccgtgcacaaggacctcggcatcaccactttcgccgaactgcgtcggagcaagcccgccctgcggctcgcgacctccgtccacgacggtgtcaatcacgtggggctggccgcccacgaacttctcacgcgtgcgggcgtcgacgtggtcggctggggtggcgaactgcttgaggacgagcggccgttcgagtcgttggaccatgccgcgcagggacgggcgaacgccatcgtccatgaggcgatcatgctgcccgcgtggcaggagatcggccgtcatttcaccttcctcgaagtcgaggacgacgtcctggacggcctccatgacgacttcggctggcccgcggcggtcgtcgatgacgagtacttccccggccgggcggccttcaggaccctcgacttctcggacttcctcgtgtgtacccgcgccgacctggccgaggacgtggcctacgccatcgcgtgggtgctgggggagacgcggcacatcatcgaagggcagtaccggcacctggctccggaacgcagccccatcacctaccctctcgaccccgtcaccatgggcaggaccacgatccccctgcaccccggggccgcccgctactacgacgccctgcccagcgcatgacacccgctcaggctcgcaggctcgctgtggaggcctcccatgctctggccgtggccggccagggagacatggtctgggggcacgtcgccgtgcgcgacccggacggccgtggcgtctggatcaaagccccgggctggggcctcgaagaagtccgcgacgaccggctgcaactcgtctcgtacgaagccgaggtgctgatcggcgacggggctccgcacaaggagtgccacatccacctggaaatactgcgagcctccccggacctgaactgcaccgtgcacacccacgcggtgtcggccatcgcgttcgcagccctcgacgtgcccctcctgccgctctcccacgagggcgccctgttcgcgggagaggacgtgccgaggttcacggacacgggcgggctcgtcagcagtcccgagctgggcagggcactcggtgcggccctcggcgcggcccccgccgctctcatgcccaagcacgggctcgtcgccgccggacacaccgccgcggcagccgtcatgcacgccgtgctgctcggcagtgcctgcgccctccagctccaggcgcaggcggccgggcgggcggtcgtccactccgacctcacagaggcccgcgccaaacgcgcccagtgctggcccgacagccaactgcgggccggataccgctatctcgtccgacaggccgccaccacgctcgccgccgccggctcctccggcccggcctgacacaggccgcgccgcctttccaccgcttcacatcagctcagcaaaggacacgtgccgtgaacgaccagccccactccgccgcagccacgaccgactggaccaccgtctccaccggggacggaccgatgcgcgtcttcaccgcgcggccggcccggcccgctgaccgggccgtggtcgtcctgcaggaggcgttcggcgtcaacgaccacatccaggacatcgcgcgccgctacgccgcgcgaggcttcctcgccctggccccggacctgttccaccgcaacggtgtcggcaccctcgcctacgaacagcacgccgaagccatgccgctgatcggcgccatcggaccggaggcgatcgtcaccgacctcgaagcggccctgacacacctcgcggagaaggagaacgtgcccgcctcccgcacggcgatccacggcttctgcttcggtggccgcgccgccttcaccgccgcgaccggcatccgcggcctcggcgccaccgtcgtcttctacgggccgggcatcgcggccggcccgcacgcggtcctggaccgggccgcgaacatcgacgcccccatgatgctccacgtcggcgcccaggaccccaccatccccggcgaccaggtcgccgccatcgcggaagccctcaccaccgcgggcgtcaccttcgagagccacgtctatgaaggcgccgggcacgccttcgcctgtgacgcccgcccgcacatgtacgtcaaggacagcgccaagaccgcctggcagcgcacccacgccttcctcgacgagtaccttcccgcagcttcctgatcaccgcttccccgacggaacaaggacgtttcatgggtactgtcaccgaagtcgtcgcagtcgtctgctccgacgagccctcccgcacgatcgagcgggacgagcacctcctgctggcccctccacaccccaatcccttcccggtgaagctctggagggatcacgaacccctgagcgtggtgcacttcccccgcgcgtacgaggccgtgccgttcgccccgccgcgcggcgtctacgagagcgaccgggtccgcgtcgaatggcagacgatggacaaccggcagcccttctaccaccgcaactgcgatgtcgacgagatctcctaccagatagccggcgaacgcaccctgatgacagagctgggcacggtcgagcaccggcccggagagttctcccggctgccccgcggtgtcgcccacgacaactacggtcggcgcgagagtcacctgctcttctacacacccgcccccgtcagggaggaacgcgcccccgcccggcgctccgaagcagtgttcccgcccttccccggctgggaaccgggcgacatcaacgaggcggtcacccagtgcatgggcacgcccggccacgacatcaccgtcgccccgatcgacgaacgacggctcctggaacaggtacacgcagagaaggaacgcctcagcgtcctcaccacaagcgaggacgtcggcatgacctggctgtaccgctccgccggcttccggctggggtccgtccgcctgatgcccgagacccggcgcgtctaccggcgcaccctggacgccgatgagatccagtaccagatcagcggccgccggactctggtcagccagcgcggcatcgtcgagctgggaccgggcgacttcgtccgtattccactcggcatcgcgtccaccagcgtgtgcgacgaggccagcgagcacatcgccctgttctccgaccgtgagcttccgcagatcgccgagacgaccaggaccgccgagccgtacacccccgaacgcctggccgcgctgcagcactgaaacgacgtaggagccgcatctcatgaccgccatgctcgccgcgcgcgcccagaggggctccggcgcgctgcacctgcacaagatcgccgtccccgacccggggccccaggacgtcctggtgaaggtggcctccgccgggctcgcccccgggatgatgaccctgctggcccagggcgccttcagacacctgcccaccacactcgggcacgaggccgccggcaccgtcgccgcggtgggcagcgaggtagagggggtcggtgtcggcacccgcgtgcgggtgcaccccaacctcaactgccgcgcctgcgcatactgccgttccgaccgggacatgatgtgcccgcaacaggcgatgatcggccacgccgccttcggcgacgtgcccatgccgttgtacgaccgctaccacgacggtggtctggccgagtacatccgtgtaccgcactggctcgtcgacactctgcccgacggcgtgtccttcgacgtcggagccaagatccacgacctcgccaacgccgtacgcgccctcaagtgcgccgatctgccgctgggcgccactctcgtggtcaccgccgccaccggcacgatggggacagccaccatcaagctcgcccggcacttcgacgtctcccgtctcatcctggtgggacgcagcgccgagcggctggacgcggtcaggcggctctcgggtgacgtgcacaccgacgtggtggcactcgacgaactgccgacggactgggcggagcaaggcggtctcacccaagccctgcgcgcactggctccgcggggcgcggacgcggtcctcgacttcgtaccggaaggccctgccacttcccaggctctcgccgctctggcaaccggtggcagcctcgtccacatgggcgccaaccgcagcccgctgctgttcccgatgagcgccgtcatggtgaactgctggcgcatcgtgggcacccgcgcctgcacccgcacggatgcccgggaagtgatcaccctgctcgcgcggggcgcactggacgcggaggagctcatcacccaccgctacccactggccggggcgaacgaagccgttgccgcgctgcagagccggacggagccgatctggatggcggtggtcaacccgtgaccgcggctcagctccccgtactcgtcgtcggtggcggtcctgtcggcctgaccgtggcgaacctcctcgcggcccgcggtgtgcccctcgtcctcgtcgagcggaacgcctccaccagcgacgaggccaaggccatcagcctcgacgacgagtccctgcgaaccctgcagacggcaggtctcgcggacaaggtcctcgagatcgtcgtcccggggaccggaacccgctactacgaccgcaaaggccggcccctcttccacgcccgaggcccacagccctaccggctcggcttcccgttcaagaaccagttcgcccagcccgaactggagaagctcctcctggacgagctgaagtcccgccccgaggcggacatccgcttctccaccgaactggtcaccgtgaccgagaatcccgacggcggcggcgccaccgccgtgctccggtcacccggtgacgcggtcacggaagacctccaggccagctgggtcctggcatgtgacgggggccgctccaccgtgcgagaactgcgcggcatcggcatgaccggcaccagccatcaggaggtctggctggtcgcggacaccgtcggcgaccaccacgacgagcgctacggcatgcaccacggcacccccggccggcccacggtgatcgtgcccggccgcggcggccgctgccgctacgagttcctcctgcgccccggggagggcgagaagggcgccagccccgacttcgagactctgcgcggactcgtcgcgccctaccggcccctcaccgaggaccaggtggaacgctgcaccgcgtacaccttcaacgcggtcgtcgccgaccggtggcgcgacgggcacgtcctgctgctcggtgacgccgcgcacatgatgccgcccttcgccggccaggggctcaactccgggatccgggacgccgcgaacgtcgcatggaagatcgacgacgtgtggcacggccgtgctggagagagcctgctggacacctacgaggcggagcggcatccgcacgccaccgcgatggtccgctactcgcaacgactcggcgacgtcgtcatgaccaccgaccggcgccgtgctctcctgcgggacctcgccgcccgcacgctgctgcgcataccaccagggcgccggtacctcaccgagatgcggttccgcccccacgcgcgacaccaggcgggcctggtcgttgcaggccacacactgtcgggcacccagctgccccagccgcgggtcctggtcccgccgagtctgcacccgcagtggttcgaccaggtactcggccggtcctacgcactgctgggcatcgacgtcccggacgccgcctggcagcgcttcgacgccgctcagtggccggacgacaagctcgacatcaagcggatcgacgtgctgctgggagaccggttgccaccggcggcgggaccacgcgaagccgtcgcggacgcggacggccgcctggaggaagctctcgccactgcccgcaaccggttcgtcctggtcaagcccgaccgttacatcgctgccgtcatgggtcccgacgacattcctgccgttgccgaggcattgcgcgggatcacccagtgacccggaccccgacggccacggccgtacgggtccacggacacggcggacctgaacaagtcgtccacgagcagcggccgctgcccgccccgggcccaccggcgtgctggtggccgtcggcatcgccgccgtctcggccctgcacctgaaataccgccccggactgcggcccggcacgagactcccgcgccgcaacccccttcacgcgggacctgaaagcgcgcgggtggccggttcctgccctgacccggccacccgcggttcctcatcgcacgagagaagaagctcttgcccactctcaccaccgtcgcagtggcccgcaccggcgaggacacctttcactgggaaagggccgtcctcgacgaccccggccccggcgaggttctcgtccgcctcgtcgccgccggcctgtgccacaccgacctgtccgtcctggccggacgcctgcccacccctcttcccgccgttctgggccacgagggtgcgggcaccgtcgaagccgtgggacccggtgtggtcgacatcgcccccggggaccacgtcgtgctctccttcaactcctgcggccgctgcgacgcctgccgcaccggccgtcccaccagctgcgcgacgtacttcccgctcaacttccgggccgcgcgtgctgacggcaccacaccgatccacaccgaggacggcgcaccgctgggcggcctgttcttcggacagtcctctctggcccggcatgccgtcgtgtccgcacagagcgtcgtccgggtcgacgtcgcggacgaggaagacctcatcccgctggcacccgtcggctgcgggatccagacgggagccggagcgatcctgaacctgctcaagccccgctacggtgacagcgtggccgtgttcggcgcgggggcggtggggctttcggccgtcatggcggcccgcctcactcccgtccgcaccatcgtggccgtggatgtcgtcccgtcgcggctggctctcgccaccgaactcggcgccacccacatcatcgacagcggcaaggaagacctccggtcccgcctcgccgacctggccggtcccggcggcctgacgtacatcgtggaaaccaccggcgtccccgcactgctggaactcgccgccacggccgtcaccgccgacggcaccgtcgccgtcatcggagccccctccgccggcagcaaggcatccttcgacatcaatgccctcatcgacggccgcaccatccgcggtgtcaccgagggcggcagcgaccgcaccaccttcattcccgccctcatcgatctggcacgccaaggacgcctgccctacgagaggttcgtccgcttctacgcggaagacgagctccaccgagcggtgaccgacgcccgctccggacacaccatcaaaccggtgatccgcttcgacaaccggacgggagaggaaggatgagcctgccgcacgcccgcaacctgatcgacggacagtggcacgacggacacgcgaccggcaccgcctgcgcgccggccaccggacaggccatcggcaccttcgccgatgccggagccgtcagcgcccgccacgccatcgacgcggcccgccgcgccttcagtaacacctcctgggcccacgaccggcaactgagagccagtgccctgacagaactcgccgaccggatgaccgcccgccgcgacgaactggtcgatctgctctccctcgagaacggcaaacgacgagcggatgcggccatggaggtcgacgcagcgatccccaagctgcgctacaacgctgccctcgccctgaccgacaccggccgcgccgcggaaaccagcccgcacagctactcgatgacgatccaccagcccgccggtgtcgccgccgtcatcgtcccgtggaactcgcccgtcatcctggcagtgcgctccttcgccccggccctggccgccggctgcaccgtggtcatgaagatgcccgcccagacagccctgaccaacggcctgctgtacgagatcatcgcagagaccgcctcgcttccggccggcgtcgtcaacgccttcaccgagtcggggaacgagggcgcgcccctcctcgtctccgatcccggcaccgacgtcgtcagctacaccggctcgaccgccgtcggccgcgtcatcatggcgcaggcatcccggcacctgaagggctgctcgctcgaactgggcggaaagtctccgatggtcgtcttcgacgacgccgacctggacacggccgttcccgtgctcaccgctgccgtcaccaccttctccggccagttctgcatggccggcagccgcattctcgtccagcgctctgtggccgaggagctccgcgggcggctgatcaccgctctgcagagggtcccggtcggcccggacgccgatccagggacagccatgggcccggtcatcgaccgggcccaggccctgcgcatcgactccctggtcgccgaatccgccgactacggccggatcctcgtacgaggcgggttgctcacgcccgacggcgacgacgcctacgtgcggccgagcctggtggaagtggacgacctcgcggccccgctgatccagcgtgaggtcttcgggccggtcgccaccttcgaggtgttcgacgacgaggacgacgccgttcatcgggcgaacgccactgagtacggcctcgccgcctcggtctggagccgggacgtcgaccggccactgagggtcgggcggcgactcgacgccggaaccgtctggatcaacggctggggtgtggtccgcgaccagttcgaggaaggcggcttcaagcagagcggcgtcggcaggctcaacggaccccgggcgttggcggagttccaggagatcaagcatctggtccacaccactgtgcccgcggtgggtgggcggagaccgggggacacgcccggttgacctgctgctcaggtcccacatcctgcttttcagtgctgaggcagtgtcccatgcgcgtgcggagctcgacgccagtcggctccgcacggccggcgagcctcaggcccgcgtctcgcggatgcacacgttgcgggtctcgcccaggccctcgatgacggtcctgagggtctggccctccttgaggtagaccttggggtcacgcccgtcaccgacacctcccggcgtgccggaaaggatcacgtcgcccggctgcagcgtgatgatgtcgctgacgtaggccacgatgtccgcgatcccgaacagcaggtccgacgtgcgggagatctgcatcacctcgccgtccacctcgcagcggatctccaggtccggctcccggccgccgaactcgtccgccgtgaccagttcggggcccaggggtgtggtcgcctcgaaggtcttgcccgccaggaactcccgggtgcggcgctggtactcgcgcacggtcacgtcgttggcgacggtgtagccggccacgtggccgagggcctcggtcttggggacgtggcgggcggcccggccgatgacgaaggccagttccgcctcccagtccacggtgtcgctcaccgtgggcagggtgatcgggtcgcccgcgccgatgagggagccgtcgtacttcgcgaacagggtggggtggcgcggggtgtcccgccccatctccttgatgtgcgtggcgtagttcaggccgaggcagatgatcttgttcgggtgcggcgccaccggggcgaagacggcctcggcggcgtcgacgcgctcgcttccggcggcggcgcccgcacgggcccagtcgtcacccgagttcagcaggtcccccacgttcgcgtgggggagcaggacgtaggaatccccgtcacgccgagcggcccgggttccgtcactcgtccgcaaagtcgccagtcgcatgcctggtgcacctcttccttcgttgactgatgccgggaccgatcgtacgctggttgcgaaatgcaggatacatgtcctgctaagtgagacacggaggaagtggcggcatggctatcaccggactcggtcacacgggcctgtgggtctacgacctgccgaagatgcgggacttctatgagcgcgtcatggggttgagcgtgacggacgaggacgagggtctgcagatcgtcttcttcagcgcgcggcccgacgaggagcaccacgagttcgtgctccagtccggacggacctctcccatcggcgacaagcagcagcaccagatctcctggcgggtggcgtcgatcgaggacatccggaccttccaccggcgcttcgaggaggaaggggtcagggtccagcaggaggtgacgcacggcaacgccttcgggatctacttcttcgaccccgaggggaaccgcaatgaggtctacctgcgcatcgaacgggacgtacggcagcccttccggaagagcatcgacttcagcctctcgccggaggcgatctacgcggaggccgagcggctgctgggcgacggcggccccgcctatcagccggtccagtagcccggggccggcccccaccccctgctgggtcgcctgcatgtcaggaacgcgcagcgggaccgcctgagcggcggtagccgcacacggcaccgtacgatgtcctgcatgacaggacgcaagtcagaaacggccactccggcgggcaaggccactccggcgggcaaggccgctccggcgggccagtaccgggaacgcaactcgaccgcagaccgtgcgctcgacatcctggggctgttctcgcaggacaagctgtccctctccggtcaggaggtggcgaccgctctggggacggcccgctcgaccgcgtaccggtacctccagagcctggtcggcagcgggtttctggaagaagaccctcagggcggattccggctcggtctgcgggttctggaactggcgcgcctggcccgtcgggggtacgggctgtcggagatcgctctgccgctgatgcgggagctgtgttccgaggtcggcgagacggtcctgctgacgcgccgtgccgggggcgccgccatctgcgtggagcgatgcgaggcggagcatccggtgcgcatctcgtacgaacgcggcagcgtgctcccgcccaatgccggcgcctccgccctggcgctgctcgcctggttgcccgagcaggagtgccgtgaactgctgggggctcagagactgcagcggttcaccgcgcgcacgatgaccgatgttgacgctctcatggaacggctcgctcagatccgccaggacgggttcatcgtcagccggggggaactcgacgccgacatcctcggtatcgccgccccggtacacgggtcgtccgggggcgtggtggccgcgctgagcatcgccgcactggagcaccgggtgccggaccgacggctcgacgaggtggtcgcagcggtccgccgagccgctgatctcatcagcggccaactggcggtcgtcggggactgacggaaccgggttttcacggagcttgtgcggtaggcgaaggcgcgggaactgatcgagcggttcgtcgccgaggggcgcgtccggagcgctgagccggatggcgacgaggccgaggagcggcgcaccagcgccgacatctcggccgtcgccgaggcgaacagctggccgatgctgcgttcggcgccgggcgcgccgtcagtccccctccggctcaaggccgtggcccgcaagccctcgcgacccgggctgcatcagcgaaccttcgccctgtcgcggtgtgacgcgccgaccgggaacggatcccgatcagcgcatcgcggacaggcggctgtatcagccgaggtgccgggcgaagaaccggaccgcgctgtcggcctcgaaccggggcagctccttgtgcttgcccgagttcacgtgcaacgacttctccttcgaggcgaaggcatcgaacagcgcgagaccctcctcgcgcgagatgtgctcgtcgtcccactgcaagtcgaactcgatcgggatggtgatctgcttcgccttctcggccagggcatcgggccagtgctgaccgaagaccgcggcggtgatcctggactcggccgccacgaacggtacgccgatcgcggtgcccatgttgatgccccagaagccgacaggcccgtcggtgccgatctccggaagttcctgaagggcgtccagcgtcgcccggtactcgggcacggcgagcttcgccaggtggtcgttgtagcgcacgacgatcgggccttccggctctcccgccgccctcgcccggaacagctcggcgatttccgcctcgtcgtgcgccgtgcgcggccggtcgccgtgaccgggcgcgtctatgacggcgacgtggaagccacagccagtcacgaggcgctgggcgcggccggacatcgccgggtgcttcttgtggttgccgccgccgtgggccatcaggaccaggggcgcgcgatcggctgcgctggaggccggcgaccagaggacgccggggacctcgcccagggcgaagtcgcgctcgaccatgccgtccgacgacgactcggcagtgaactggagagagtacataggtgttgcctttcgggagtgccttgttgtcgaggcgctcccggcgacacctgcgtcaatcgccggccgtgacgggaagggggagcacccacgtcgatacagcgttcatgggtctcacctcctcgggcggtgtcacggtcggctgaaagctaccagcccgatgatcaccccttcaactcctttttcccggccacgtgatcagggagaacggctatgcgaagtggtcaagagggcgaaggttgcttgatgcnngcatcaagcaaccttcgccctgtcgcggcggtagcgttacgccggacggcgatctcctaccggcgcatggaggcgatttcatgaaccagcagttgaacctggtgacattgggtgtcgaggacctgaaggccagccgccagttctacagccatggtctgggctggacaccattgctcgacatggaggagatcgtcttctaccagatcggcaaggggctggccctgggactgttccctctggctgaccttggcgctgacaccggacatccagcgaccgccgggacgcccttcaccctcgcccagaacctcggctcgtccgccgaagtggacgaggccatgcagcgggcccgcgcggcaggagcgactgtcctcaaagagccgcaacgtgcggcgttcggcggctaccacggctacttcgccgaccccgacggccaccgctgggaggtgtgccacaaccccggctggtcggtcgcggacgatggcaccgtgacactggcggctgtcgacccgtccgacggagacgactgacgccgcttcagccccttgaccgtcatgctgtgcgggtggcagaaccagtacgcgtccgtcagatcgacgatgacgaggggcagcgcccgctgcggatcatccgcagaggcacgggtcggtggtgacctggcggcgggtccagagggtgctgctgtccgcgcagcatgccggtatcgaagatcgccgaggtgacgttcaccagcgcggaccgggttcgggacgtgggcgtgccggacggcgtcagaggccgaacgctgtggtcacccgctcaccgagatcatcttcggtcatggtggtgtcgacctgaatggtgcgcagtcgcagacgctcagcttcctcctgaaggcggcccgtgaacatgcggtcacgttcggcaaggttgccgccggcctttgccggatcgctggtcttccatacgaacccttcccctggtcccgatcggctccggatggcggcccggcggaaatcaggtgtgggaaggagccagacggcgtgctcaggaacagcaagcagaggcttcacgaggtgcggcagcagccggaagccctcaacgatgatgcacggctcctggggcaggcgaaggaggtcttcgacgatcaagccgaagccttcgcctcgaaaccaagggaatgtctccagcatgacgtccgggggccggttcacccatcgctcgtccatgtccatggccatgaacgtgtgcaggaaaggggcttcctcgggcgtggtccgcccagcgtgatcccgcatcacgtcgtcggtcgcgtagaggcgccagccgtagcggtcggcgaatcgtcgggctgtggtcgacttgcctgctccactcccgccgccgatccagtagacgtgccgcagtcgtgccgaaagctctgcggcgtcggctccctcttcatggtgtccgggctgcatccctctcctctggctgtgttctgggatggcgacctctttgagtacatggtcgggcgcccggggttaccgtcggtgtcggtgtcggtgtcgaacagaagcggaactcgtgattgtagggacgccgaggtcgacggcgcttcggccggcggggcgtcggtcgagtggggtgagtcgagtttctcctccgctccggcgaggcttgcttgcagcccttccatcgcgccgagccatcgctcacgtccggcttcgatgtgcaccgcccgtatcggctacctgatcaggaccgcgcccaccgccggcctcgcacgggcccgcgccgagcaggccgtgcggcggctccggatctcaccaccgccggcctgtccctcgtcccgctcgccgccgccctcggtatggtcgccggcctgcagtccggcggccgactcgcccgtcccgaccgactgttgtcagcacaggcacggcaccacacggcggccgaactcggatggctgaggccggtcggctcagccggcgacgtagacgtcctcgatgtagcggccgtcggtcatcagcgagtcgagccaggcggtggcgtcggcggcttcggcgccgggggtcctgccgaggtagatggcccggaaggcttcgcgcacgcccggggccatccggccgccgtcgccgcagacgtacaccttcgcgccggcgcgcagcagttgccacacctcgtcggcctcggcggcgatccggtgctggacgaacttctggccgtcgaccggtgcctcgctgaaggccgggcgcatccggacggcgccggccagctcggcggcccgcagttcctcgctgtgcaggtagtcggcgtccggtgcgtcgcatccgaagtagcagagtgccggggcgagttcggtgccgtgcacggtcagggcgagccggtcggcgacggcgccccggaagggggccaggccggtaccggccgagatcatgatcaccggggtctcggcgtcgtggtggatccggaaggcgtcccggcacggctggacccgggcgtacacggtgtcgccggggcgcacggtgttcaggtagcccgaaccggtgccgcggaaggtgccccggcccgaccgtgcgggggcctgcagcagggagaccatcaggtcgacgtggtgcgggtcggtggccggggaggaggagaccgagtagtgccgcggccggatcggcggcagcaggtccagcagcaccggccaggtcaggaactcgcccagtgcggggttgtcctcgatgacgtcgagcaggctgcggtggtcggcggcgagggcgtcggcgtcctcggcgagggcctggaggaccttctgctcgggcgggcaggggttgagtgcggcgaggacggccaggtgaccggcggtcgggcggtcctgcagttcgacgtaccgcgtgagcagttcgcgtacggtcacggggcggtcgaccgcgatgccgtcgcgccgcgggcgg

SEQ ID NO: 110 - DNA, 13894 bp, Unknown
  Kingdom: Bacteria, Phylum: Actinobacteria, Class: Actinobacteria, Order: Streptomycetales, Family: Streptomycetaceae, Genus: Streptomyces
tcgcggctcgcggctcgcggcaattgtgtgcttttatcccatttcaacccgattggcaatctttttgtcggtgcaggtggtggacatctcaacgcatgtacgtgtgagcgcagtacacggtaacgaatcacccgcacccgggcgtacggaaagacggagccctgcgggtagccgaggacggtgttgtcacaactcggtcaccaccttcaccaattcctcacgcagaacgtgtcggcgcaggtagcttcacccctcacgtaccgaaacaggggggacctgtgagttaccaccagcctcaaccgccgttccagcctccgcccggcccgccggccgcccgtaccgcacccaagtgggcccgcaaacggttcgtactgccggccctgggcctcgcgttcatcatcggcgtgggcagcgccggcgccgccggtcagaacccggacgcgacgaagccggtggccaacgacaaggtgcagccgacggtcaccgccacggccacggtcaccgcgacagccacggcgacggcgaccgcgaaaccgaagcccgcaccgacggtgacggcgacgaagacggtccaggtgaaggtgaccgtcaccgcgcacgccgccgcggagtcgggaacggacgacgacagttcgtcgtccggcggatcgtcgtccagtggcggatccagctcgtcgggcggctccagctctgacggcggcggcgcgacggcgcggtgcaacgacggcacgtactcgtacgccgcccaccaccagggcgcctgctcgcatcacggaggcgtggccgtcttctaccggtagccgacgcctcaggccggtgctccagctggtggccgagtaggggactgcccgcccactgaaccggggagcccggccctgcacggcatgtgtcagaacccggggccgctttcacccccgcacacggctccgtagcctaagtgaggggcgggcaccctcgggtgcgctggccggcggaatccgattcgctgcgcctgccgtacttcgcccctctggccaagctgtcggcgcccctggacggacggcctggacgcaatcctgggcagccatcacgctgacgacctgatggctcgccctcacggatggaaccgccaccggccttcagaaatgacatccaccttgccgtccctgacgcgaacggctgtctcgtcgtcgatgaagtagatcgggaagtccgcccgcgcagcgatgcgatcagcccaggcgtcgtcccgctcggggaaatccggtgagtacaggtgaggcttgaggtaccagtcgaagaggccgaacggcggctccacggtcgtcgcgccgagcacgtgcaggtccgcggtgtccccgatgacgtcggcggagtgtccggtgagatgacggctgaagatcattgatccggcgctgaaccccacgtagacccggctctccggcgcctccaggaagccgtcggccagaccgttgccggtgatgctgcgcgcgaggtggtagtggctgccgccgcccacatagatgacatcggcgtggaggagccggtcgagcaccatctgccggggaaggccattaagctccaggacgtcgaactcccgccagccgaggccgtgcagccggttcatgtccgcgacgaaccacccgtggtccccgggctcggcgactgatgccgtgggaacgtacacgacgttcgccgatccgaacggcctgcccagcatgtcccgcagcgcatcccgctgagactcgttacgcaggccactcgccgtcaacagaaagttcatcgggcgagccaaacacgactcacgccctcgcaacaaacccaggctcggtcgtcccggtctcgacctactaccgcgtgtggcaggaggctcggctcctggcgcttccgtcggctgtcgcggcctcaccgctcgccagtaggccgtacgaccttcgacactcggcgctgccgacgtggctcaatgccggagtggatcccactgaggttgccgagcgcgccggcaacagcgtcgaggtcctgctgacccgctacgcgaagtgccttgacggacggcaggacgtcgccaacctccgtattgaggacctgctccgcgagtacgagtgataccgcctgaccgtgtccaaggccttcggaatccgtcaacggattccagaagcctcctttgttggcgccgcccatcaacgtgattcggcggcctgggcgcgctccgcggcgattagtcgctcaatgtctctccgtttgctgttgagcgcagcgagcatccgtgtgcgagtctgctcgaactcgggatcgatctcgacgccgaggtcatgtctcagcgtgatcctcagcaggaacacgccatctgacagtgggccgctgaaccatgccttggctcgctgatatgcctcgtcgacgtttgggctgctgggcaactgcctgacgactgagtacccgacttggagtgtcccgttgagtgtcgaggccacgtgcaggacatccttcgcgagaaccatctgtccttgggagtactggtcggcccaggcctccttggctgagtcgaggacagcgggatcgatggtttcaccgcgctcggccgcgtggacagcgtctcgggcggcgatccggtaggcgcgagccgtggtgttcagttgggcatagagatcgcgcttggcttgctgagctcgctctcggcgctcttgctcccggtcacgatccgcacgctcgttctgctcccggttggcgcgctggctgagcactgccccgcctaaagttccgcccagcgttcctccgacgctgatgagtgcgacggcaagcgtggtcacatccacgagatcccccaactcgtccatccctctgtcggcaggctgcggctgagtgcgaaggccgcggcagcccggcctccgaccttgcatccgcggcgcggtcgaagaccgggacgacgatagcgaggaagagcgttccgggcagatgagtctcacgacctacgggactgcttcaaggtcccgtccacggaccccgacatacggccgctccgggcggcatacggctgcacaaacacaaagaccccgcactcagcgtttccgctggtcacggggtctttaggcacctcatacagggtgcccccggcaggattcgaacctgcgcacacggctccggagggcgcgtgaaggccatacaaagtaccagttcagagcctcacggagacgtaggccattcgtttcagtccacgcctggtccacggccagcaccctcgtgcttgcacgggcctggctcgcggttcaggggacaacagcgtgttgagtattaaccctgccgtgccgcagtaagccagggaagttccctaatcgccgaaacggttagatggcggcaactaattctatcgtccagtatttcattcgtaaggggggcgtttagaattttcatgagagcgttgcacgcttttactccgcctttcatgggttttgcaatgagaaggtggttgtcgacggccacctcttcgtcgcccgtaataagaactcccgaagctcgggaggttatgccctcggaagggcgtgaagttctcctgatagccacaaagggaggtttaaaaagacgcccagtgaagtttcgccgtcttgttgggaggcccatgcgtccactagtcgcaaggtcgcgagccacaaggaatggtcgactctcaccctcgtgcgggtctctattgtcaaccacagtgcccacacggacctcgaaaaagtctgctacggtcgcgcctgccggagacctgctccaccaagccacgtcactccgtgccggtacgccggctccgcgaagctgcgcaacaagcagaaaaacatcaatatcagtgtgggcgtcaaagacccccaatcgctcgatgtgagttagcttggcttgcgattcgacaactgctcgccatttagtgaagttcgtgccgctgcgaagtgaatccggcaggatggcgactatgtgtcctgctggtttgatgtgcctcaatgagtcgagaaagaatacggcagcattggaggtcttcccctgcgcccaagcgcactctttagccgcgtgaacgcgagtgaagggagggttcaaaacgacggcatcgacctctgtatgaaactgcgtccgcgcatcacactgttcaatcccgcccagtagctgcaggagatcggttacctgattgaatgtggcgtcagtgaaatcgtgccgcttgatagccgatagcaggatgcgacgacgagctgtctctgtgaactcagcgtgcaggtcccaaccatggagcttcttcccccacatcgtgagtgtctcagcaagagtcgcgccgattggcagggcctcagtagctgccaacaacaggtctcctgcaccgcacgtcggatcgaggaaggactcggccggcaaggtcctcagcacctctgtcactctcgccttgaggttgctgggggtgaagaaggcgcccacctcgcggcggtagtcaagcggtactagacgccggagctccgctgctgagtgaccgtcaaggagtctgtccacctccgcgtgcggcaggtccccgctggtctgcagactcgcaagtactccgtcgatgtgagctgcgtgctctagatactgagcactgcctggccggctgtccacgctgcaactccttggctggggaaggcctgttgaacggcaggtggtaagggtactatccccgctactgcccctcctggggggacgtgtcggcgcagcggtgaggatgtttcgtggcatcaagggctagtctgaggttctccccagagatcttgcgccgcctcggcgaggagcttgttccacaccccgacttgggggtcatcgagctagtacgcaacgcctacgatgccgatgcgccgacttgctccgtggaactgcactccgtggaatctcgcggcggaagaatcgtcgttaccgataccggcgacggcatgaccgaggatgacatcacaagtggctggctgctcctcggtaagtcatcgaagaccgaatcacccttcacgaggaagggtcgccgaaaggtcggagaaaaaggtctggggcgactagctgccctgaggcttggtcgatatgtgacgctgacaacccgcccgcgtgagaatccagggacgcagcatgtcctacagatcgactggcgtacttttgacgccgtagcggcagtcgaggacgtccaactaaccatcacgacaacgccgacggaatctgagccgggcacgcagattgagattgatgatctaaccaccgatttcaagcccaaggatgttgagcgcctcgccagagccttggttttgctgacgggtcctttccctggcccggcagattttcgcgtggacctcaacgctccagagttccagaagctcgcaagtatcgttcaccagtcttttttcgatgatgctgaatatcgcatcgttgccgaactgaatgaagacggtcgcgcctctgctgctctctatgactggcgtggtgaaaagatcgcctcgggcggacattcagaagtgagctcagcaggctccgagcgcggagaatcaccgcttgcttacttcacgccagctgcccagttcgagctctggactttcaacctgagcgccaatgcgtttaccattcgcggctccagccacaaggtctctgaagtacgaaattggctgcgctcggtcggaggcgtgcatctctaccatcggaatctgcgagtgcacccttatggcgacgaggggcacgactggttggatatgaacctgcgtagggtgcggagtccggaactgcgcccgggcacaaatacctctgtcgggcgcgtgagtgtaatagatgaggaacaacgcctcaccccgaagacggaccgtacgggtttccttgaaacacccgaattcattgaactggcgcggttcggacgcaacgttctggactgggccgctaaggagctattgcggcgtcgcgaagcggagaaggggaggaagcaacagcaagcgggcgacaagatcgaaaacgcaatgaataggctgcaagacactgttagcaagctgcctccacagcagcgcagggaggtacttgaagctacgaatttcttgcggtccgctttcgacgagaaggttagagccgtagaggatgatcttctcctctaccggacactgagcacggtggggactacgactgctgtttttgcgcacgagacgcggcaacccgttgacttgatcgaccaggcctctggcgttatcgctcgacgtgcggcgcggctcctgaaggatgactattcgactcaactgtctgagccggtggaaacggtacgacgtgcggcagaatcactgcggacctacgctgacatcccgctacggctattgcagcgcagaaaacggcgcgccaaagtggtagacgttaacgaggtcgctgccgatattgtggagctcttcggaccgcaccttgatggcgcaaacatcaccgtcgagttgcaactggccgagggtggcgcgcctgtaaaggcgactgtcacggcgatagaagccatcctagcgaatttgctggctaacgcgacatacatcttcactcagccgcatgatggaggtacatcagagaggctgatcgtcttgaagaccgaccttagtccggattctgtttttgtcaccgtaatggataacggacccggaattgatacatcgaaactcgctatccaggacatctggttgccgggagcgacgactcgcgaggatgggaccgggcttggtctaaccattgtcaaggatgccacaagtgatctcaagggtgaagtttttgctaaaccgatgggagagatcggtggcgcagaattcaatatccaacttccgcgggcaacgtcaccttcctgacagcaagcactacgtaggtcctgcccctagcagattgcagatcgtaggagtgtcttcatgaacgtgctggatcgtccgctccagcctggcgatcccgtcgcgattatcgaggatgaagctgtaaacaggagaactacagggtggatcgtcgaagaggcggatttcactccggtcccccttactcgaattccggcatcgctagacgagctttttgcggagatcgagggcaaggcagtagccgtactctgtgatcaccggctggggcgtggcggcagtgtgtcttactatggcgccgaagtggtggctaagagcaatcgcaggaaaatcccggcagtattgctgactagttacgccaatagcgacgagaattccactatccggcgatggcgttccgatattccaatgctgctcagtcgtggggcggatagtgacccagaacggctgtcccaggcactatctatggcagaggcagagtgccgtgggatctacacggaggcccgcaagccataccgcgtcatcgttcgtgttcaggattgccggtacggcccggagggagtcgtggcagagtgcgtcgtcaccgcttggcaaccgcgcacgaccgtggacgttcccgcagccatgattactgagtgcctcgatatgccaatcgatcgccttgtgggcaagcggcttagtgccgacgtgaatatttacgcccctgcggctggcgagttgtattttcgcgattttcgaatgggcccgggggtgcctgcgggatggtagcgactaacatggtgaagcccttggaggtcgtcatcatggatgtggggcacgggaattgtgccatcgtccgcgacggtctcaggagcgcaatagtcgatgctccgcgcggtaaacccgttgtcagtgcacttgtggacaataagtgtcagcaaatcgagcacctgctgttatcccaccccgatgaggaccacatcggtggagcggcacgtctgttggcggatccagatgtctccatagctaacttctggtgcaacccgagcgcaattcaagacactgagacctatctcgaccttttggaacaggcagcgttgcgagaggatcagcgaagtacgcgctaccgaagcaaccttaatgtgggtgctcgtgatgacctcaacttcgagcgtgtgtcaatcgaggtgcttcatccagatgtacgtctagccggagtggggcaagcgtcacgaaaacataagcgaggcgaaattccgagtaaccgcatgtcggccgtcttgcgggtaagtcttgcgggcaacccggctgtccttcttgccgcagatattgacgacaggggttttgactcgatcgtgagtcgtggtgtgaacctggaagcaccagttctcgtatttccccatcacggtggctcggcgaagggtgggaacgaccgagatttcgccagaagggtatgcgaggaggtgaagcctcgacttgtcgtcttctctctcgggcgaaataagtacaggaacccgctgctagaagtcttggctggtgttcgcgatgctgtcccaacagctcacattgcgtgtactcagataagtaaacattgtcactccagggagctaactcttggcagtgcggggcacttgtcatccaagtggccgtctgcgggtatggccaagggagcctcctgcgccggcacggttgtcgtccgggctgccgaggacgggactatcgcctacggcccatcccaggctcaccacagccagttcgtgatccaaaacgttgacgcgcccaaatgccttaacctgaccagatgaggtcggtggagcggctttggggtggcgctgctttggcgcgagtgatcatggccccgtaagcttccggcgcgtcgggcagtctgtggacctgcccggtaaagcacgacgttggggccatgatcttcgaggctcgcgccaaagtggctccgtaaagccgtggagccgaccgccccagccacgacgtactccttctctggcatcaggcggctgattgttttgagcgcggcacgggcaccggccgggctggagaggggcggagacaggagcgcaggcccggccgggggccgggccgcgcgcggtgagcggagcgagccgccttgaacccgtagagaaagttgtaactcactctgtcgggtggggcttgaagtcgtaagcacacgtcggtagttcggccgcctggcggtgcgcgagtggcaggaagagtacgggtcggatcgtccaggtgatgcgggtgctggcgtgggtcactgacaccgtgcacgactcggcacgaagcagggctcgtcgtgtctcgatgcggccctcgtacagccactcccaggccgcgtctgaggcgtccgcgtccagggccggtgagatcatccgaagtgcgaccgctacccagcggtctgcctggggtgccgagtaggcgtcgaacgacgcctgcagggtcggctgccatccctcggtcaggtcctccgtccagcactcgcaccagtagccccgctgcggtggcttcagcatgggtggcctcccagtcgggcgtctgcgtagagctccgcggtgaccgtgtggccctggtcgctgtcgtggacgacgactcggtgggcgatgacgctgaccatgcccaggccccggccgtgctcggcgtcctggtcctggggctcgaccttgggggccgtggccgtgcctccgtcgtcggtgaccgagactgcgaccacttgagcggagaccgcgacggccaggtggaagctgccgtactcccggccgctggccgtgtggaggatcgcgttcgcgctcagctcgctcacgatcagttcggcgtcttcggctaaaggggagccgcgcaggatgtcgcgggtccagcggcgggcccggctcacttcttcggggaatcctgggcaactcagcccccacacccgggctgtactcgtatactcgtgcatacaagttccttcgtgctggtaggccgccatgtgcagcgggttcgggctagacgagtttcacgccgtcgtgggcgcgtatggccggcggggacgccgcgtcgagtgcgtcaaggacgcggatcgcgtaggcctcgtcggaaagctcggtgacctcttcgcgggtggcccagcgcagtgcgcgggtctcgtcaccggtggtggggctgccgtcggcggcttcacagcggaagaccagcgagacgatcaggcccttcatgttcttgtagacgccggtcaatgtcgcgggaagtgcgatcttgatgccggtctcttcgaggacttcgcgctggagggcttccgggatggtctcctcgcgttcgaggacaccgcccggcggttcccagtggccgttgtcccggcgctggatcaggagggcccggccgtggtcgtcgacgacgactccggcgacgctcacggagtgcgggcgttctgtgctcacgttcctcggccctctcggctggctaggctctccaccgtagcaacaccactcgcccactcgtctagatacctaaaggagtacacgtgagccctcttccttcgggcctgctcggtgatctcgaccccacgagcgatcgtgcggtcttccggcagatcgccgaccagctgcgtgaggccatcgaccgtgggcgattccgcgagggcgagaagctgccctccgaagccgaccttgtcgaccactacggagtttcccggatgaccgtccgcaactccttctccattctccagggtgagggcctggtgcacgccgagcacggcaggggagtcttcgtacgaccacgaccgcccgtcaggcggctcgcctcggaccgcttcgcccggcggcaccgggagcagggcaagtccgcgttcatcgtggaggccgacgcggccggcagtcacccccaggtggacagcctggaggtcaaggaggagaaagccggtcaggacatctccacccgcctcgggtccgtgcggcgtgtattggcccggcgccgccggtacctcctcgacgggcggcctgtcgagttcgccacctcctacctccccctcgacatcgcccgcgggactcccatcgccgaacccaaccccggccccggcggcatctatgcccgcctcgaggagctgggccaccgcctggaccatttcgaggaggagatccgtgcccggatgccctcgcctgccgaggtcaagacgctgcggctggccgccggtgtgccggtcatccacctgatccgcaccgccttcgataccgaggggcgggcggtggaggtctgcgacacggtgatggcggcggacgcctacgtgctgtcgtaccagctcccggccacctgatcgcatgggcggcggaggagagtcggtggccgtggagagctggcggctcatgcagggagaccaggtcgtggggacgctgcggctggatgaggccgacatgttctggacggactgtggtttcgatcctggccctgggtggtcggcgttccgcccactgttcgaggcctcgcgtgaggcctgggtggcgcatgacgtgaatgccgcgttggccgcagacgagcgcatctgccaagcgggcctcgtcctcatcccggatggggagggggagccggtgagggacttcgtggtccggatccagggagaccgcgcccggctgaagtggtgacggcagaggcactcctgtgctggcggttatgaactcgtacaccccaacacgcttgctcgtatagacgagtgggcaagtggtgtggcaaggtgattgcgcgatcccgatcaaggggctcgcaggacgcatcttgtatagacgagtagataggagtgtgccttgcgcaccatccgagtggagacctccggcgcgacgatcctcctcaccgaggcccctgagccgaaggtccgggaccggcagaccggcgagatcgccaaggacgccaacagcggtgaggcgctgatgaccatcggcgtggtctacatcgaggacggcgagtcgtcgctgttcaaggtcaccgttccggagggcggcatctccgaggggctgacgcttggggcgccggtctcgctgccgggtcttgtcgcccggccgtgggagtccgtcttcaacggccagcagcgccacggcatcgccttccgggccgccgccgtcaccccggccgccttcccggccgcttccggggctgctgcctgatgtccgacctgacgacgcttctggaggtgggtggtcctgtcgccgcgctcggcggcggggccgcctacgcccgggccaagcacccggcggcgtactggtccacggtcggcctgccgatatccacggtccggctgctcggctcgtacggctcggtcatggaggcctgcgggctgaccgttgcaccgtcccggctgcgggtcctcgccgtgaaggccatgacgcggcgcgaggtacggcccgtaccgccgcgccggggcctcatccggcccaccacgaccggactgcggcttcgcctccgcctggcgccgggacaggaacccgccgacgtcgccgcctccgccgaacggctgcggcacgcctggggcgttcacgccgtgtacgtcaccaccatcaagccaggagtcgtcgaactgcggctcgtcggctacgacgtcttacggcgggtccgcatgccgcgcaaggtcgcggacggcttcctcaaggtgccggtcgcactgcgagaggacgccacacccttcgtacgcgactaccgcaccattccgcatcaactcacgctcggcgccactctgtcgggtaagtccatgtacctgcgccacctcatcgccggactcgcccctcagcccgtcgccctggtcggcatcgactgcaagcgcggcgttgagctcgcgcccttcgccgcccggctctcggtgctggccaccgacccggaacaggcggccgagctgctgcccgtactggtcagggagatggaggaccgatacgacctgatcaagacccggcagggcattgccccgggcacgccggacgaggagatcacctccgatgtctgggggctgcctgagcatgaacggccggtgcccgttgtgctgttcgtggacgaggtagccgaactcttcctcgtcgccacgaagaaggacgaggaacgccgcgacgagatggtcacccagctcatccgcctcgcccagctcggccgcgcggccggcatctacctggaggtgtgcgggcagcgcttcggcgccgaactcggcaagggcgccaccatgctccgcgcccagctgaccggccgcgtctgccaccgcgtcaacgacgaagcctccgcaaagatggccctcggcgacatcgcgcccgaagcggtcttcgccgcctgtgccatcgcccccgaacggcccgggctggccgtggcgggcgacacctccggcggctggtcccgcatccgcacgccgtacctctccctgggtgatgctgccgagacctgccgcgagtcggcttacctggtgcccgaccttcccgcgctgaagcccttccggcccgacgtgccggtacgcccggccgaaagcgctgccccggtcgttctgccccacccggtgaccgactgaccttcccctgaccgactccggaaggagccgcctcatgcgcgcccgtctggcccgcgtcgacgcggtgctcgtccaagcgctcatcgccgccgcgctgtccttcgcccacctgcacgatgtcgccgtggcggccggacaggacggatggaaagcgtgggcctaccctgtctccgtcgacctgctgctcgtcgccgcctggcgtcgactgcgctccggcaacggcaaggcggcggcctggtgctggttcgtcatcgcgctcaccgcctccctcggcgccaacgtcgccaccgccggcctcctcgacctcggcgacgtcccggcctggctgcgcatcctcgtcgcgggctggcccgccatcgccttcctcggcggaaccctcctcgcccacgccatgcccacgacagaccctgacactgacgccatcgaggaccaggagcacgagcccgaaaccgcatccgaaccactcgcacaacccgccatcgaggcaccgccccaacacccgcccgtgcccgtcccgtccgccctggtcgtccacgcccgcaagatcgccgccgaacatcacgcccgtaccggcaccccgatcgacaccccgaccctccgcacc

SEQ ID NO: 111 - DNA, 25253 bp, Unknown
  Kingdom: Bacteria, Phylum: Actinobacteria, Class: Actinobacteria, Order: Streptomycetales, Family: Streptomycetaceae, Genus: Streptomyces
gctgacccgccgcggcgacgggccgcccaccgccgcctcccgccagcgccgcaccgtcgccgtgcaggctgacctctccggttccggcaaggcgctcggcacctcggtcgagcgcggcgtccggctggcggtggaacagcacaacgcgcgcgcggaccgtcgcttcgacctggtcctcacggtcctcgacgacgcgggagacgcggaccgggccaagaacgtggcccagcgcctggtcacggacggccgagtgtgcgcggtgatcgggccgacgtccgacgccacggccctcgcggccgaggaccggtacaagagggcgttgctgccgatggtgacggcctgggcgggctcagacgccctctacgccgccgtggacatgaagaaccccacgtcgtccgtcttccagctgcgcccctccgacaccgcgatcggcacgcccctggtccgctatctcaccagccttcgcccggcccgccgcacctttctcgtcgaggaccaggcggccccggactacagctggctggtcgcccacaacctggttgaggaccttccggcccacagcacgatcacccggcaccaggtcgccgccggcaccggcgacttcggccccgccgtcgccgcggccctcgcggcacgcgcacaggccgtcatctactgcggtgactccccgcggcgcgccgcctcctgcgcacgggcgctacgggcggccgggttcaccggcactcccgcggcgacgcaagccgtcctcacacccgagttcctgcgagcggcgggtgcggcggccgaggggtgggtcttctcggcgacgttcgtggacccgtcccgtctgacgccggccgccgctttcgtacggtcgttcaagaagcggtacggcgtgcggagcgtcggttggggcgcggccgaagcctacgacgccctcggtctcgtcgcgcacgtcctcgccatcatggcggcgggccctgtggaccggagcaacctcacccaccggctgcgggcggtgtcgtaccgggggatcacccggacgatcgccttccgaacaaacactggagaggtggcggaggaacgcgggctgttcctgtggcgggtagagcacgggacgccgctcttcctgggccagtaccaggaggcgagggtccagcctccccgtttcgcttcgagtggttgagctgaggtggcggcggaggactggtgctgccagccccgggtcgttgagggggcatggcttgggcccgacgctcgggccggggtctccaacgggttctcggtggcgggcggggcagcgccgcaggtcaggtagccggtcgcggcggccggccgcaaccgtactggccacagtggcagggccgcggcctctcagcgcaggctgcggcacccgccttcgacgcagggttgctgggtggcccgtggatgtccgcggcccatgccatggtccggcccaggagtaccgagccgtggtgtaggtctggtggagcagggacgagtgaaggctgtggtcgcccagtcggtttggcggaaccgtccagcagccgtcggtcaggggagcgtggtggcggtacggcggccacctgtgacgcgaagaaggtccagcttccccgcgtcgctgcttccggtcgctgccgtgtaggtgaccatgcgcaggtccgcgccggggacgatgaggacgtcgcagtcgagcaggatgtcgccgatctccggatgccggatcgtcttgcggtcggtcgtgtggggggcggcggtcgtctgcgtggcccagtgatgagcgaaggcgtcggatatttgtagcagttcctgcacgagccggtcgagctgggcgtccgtgggatagcgcagcacggcgtccttgaggtcggcgacgatcgacgcctcgaaggcgtctggtccgcgctcggaccggatgggaagcatcgaggcgtgtgcggcgccgttgccgaagagcgcgcgggcaaggttccgttcggcggccgggatgacggcggggtcgccgtgcagggcgctccacgtggtgttccaccacaccagggtccagtcggcggtgaacactccgaccgggacgtcgttcaggcgcgctgcgagccgttggatccccgcggggacgtgggtgctgaccgtcccgtcctggggcggcagaagcctggcgcttcggtatagctggtcgcgctcggcgcgggagagctgaagggcccgggcgagggcgcccacgacctgggccgaggggctggtcgcgcgtccctgttccaggcgcaggacgtagtcgacggagagcccggccagctgcgccagctcctcgcggcgcagtcccggggcacgacggacgccggtcacggtgaagccggcgtcggccggggagaggcggtcgcgccaggcgtgcaggagtgcggcgaaatcggagcgggaggcagccatgggttcattctcgccgtgcggcgccgcgacagcctgggtactgccggtcctagtgacgcagacggcgctggctggcggtggagcaagcggcgaacgtggggctgcgcccaagccgggcgacatcggctgaccagtgaaggagccttccatgaagcacaccgtcgtgatgacaggcgcgagccaggggatcggccgcgtcgccgcggagcacatcctgcgccggtcgccggacgtgcatctcctcgtcgtcgcccgcggatcctccggcggacagctcgctgcggaactcgccactggcgggaacgcggtctcgcacgtctcggcggacctcggctcgctggacagcgtccgctcggccgccaccgagatccgcgaccggctcgatggcggtgacctgccgccgctgcgcggcttcgtgggcaacgcgggcattcagtacacgaacgcgctcaccgagggacccgacgggttcgagtccaccttcacggtcaacgtgctcgccaaccacctgttcgtccgcctgctccaggaccgcttcgccgctcccgcccggatcgtgatcaccaccagtgacacccacttcggcgacttcaagcacaacatgggcatggtgcccggcccggcctggaagtccccggacgtcctcgcccgcaccggcgcctttcccaagccggacaccgtggccgccgggcgcaccgcgtactcgacgagcaagctggccgccatctacctcgtgcacgagtacgcgcgccgcctgccggccgggatcgacgccgtcgcctacaacccgggcttcgtacccggcaccggcctcgcccgcaacgcagaccccgtctcccgcttcgcgatgcggcgcgtcctgccgttgatgaccctcaccccgttcgccaccagccgcaacgaggcgggccgctgcctcgccgacgtcgtcctcggcacgacccaggcgccgaccggctcctacgtcgaccgcagccgtgcggagcgctcgtcacaggagtcctacgacccgcggcgcgaaggcgaactctgggacgccgctgaacggttcaccgcggcctgagcagccagcgcggatgctctctcacgcgactccgccggccgccacctgggggcccggaccggctggacgtcttcgccgagggacacgagcaccccttcggcacctcgaccgtcgcgcgggcggactgggtgtcgatgatcaccagggacgggtcctctgatcgtctggaccgctcccgcacctggcgtcgcaagatctcctggatccgctggtcaagaccgtcctggcgccacagggtgaaggaggagaacacggccgaccaggtcgggaggtcatgtggcaggagccgccactgacagcccgcccggttctggtggagcagcgcgttcacgacctcacgcaggtcgcaggatcccgggtccccggtcgccgaccgcgccacccgttcctgcttcaacgcggtgaccagcggctagatcaacgcccactgtccgtcggacaagtcggttgcgtacggcatccgttcgatgcgcggccattctgtgcacgacacgagccgagggcggaaccgtcccatcacgcacgaacgggcgacaccgcatcaccatgaatgggacttgacgccctctcagagggtgagggtggggttttcgaggtcggtccagacggcaaggtccagggtgcgttcgaggccgttgcgctcgccggtggtgatgtccccgggtgcggcggcggtgatctgccgcagccgggtgcggtcgaggaggccgagggccgggctgttgtccgccgacagcagttcgcggacctgggtctgcagtttcgtcacgtaagcggggtcctgagtggagggataggggcttttgacgcgctccgcgacggactgcggcaggagttccgaggtggctgccctcaaaaggctcttctcgcggccgtcgaaggtcttcatcgaccacggagtgttgaagacgtactcgaccaggcggtggtcgcagaacgggacgcggacctccagaccggtggccatgctgagacggtccttgcggtccaggagcatgcggacgaagcgggtcaggtggaggtagcacacttcccgcatccggcgttccagggggtccttctcactgtccaggcgcggtacctggaccatggcctcctcgtaccgctgggcgaggtatccgggcaggtccagtcgttcccgcaactcgggatcgagcagcgaactgccgccccggccatgctggcgttccagcgccgccagccaggggaaggtgccggcgtcccgcgcggcggggtcgtggaaccacgcgtagccgccgaagacctcgtcggcggactccccggacagggccactgtggagtgcctgcggatcgcccggaacaacagcagcagcgactggtccaagtcgcccaggccaaggggcaggtcacgggcgcgtacggcggcggcgcggacgttcggatccgcgaggtcctcgggatcgaggacgatgtcctggtgatcggttcccgtgtgccggacgacgtcatggacatacggcgtgtccggcgtcgcgcgcaggtcgtcggggatgaagttctcgctctggccgacgaagtcgacggcaaagctgcggacggtttcctttccgcggagttgccgggccgccagtgcggtgatggcgctggagtccagaccaccggagagcaggacgcaccgcggtacgtctgagaccagctggcggcggacggtatcctccaacagttcgcgtacccgtgcgatggtgtcctgccggctgtcggtgtgctcggcggctctgagctgccagtacgggcgggtgcgcgggcccgcgcgctcgacggtcaccaccgtgccaggctccacttcccgcattcccgcccagatggcgtggcccggggtctttgccatggagaacagttcgcgcagtccgtcgaggtcgacggtccggggtacgagggggttggccaggatggctttgggctcggagccgaacagtacgccgtcgtcggtggcgaagtagtacaggggcttgatgcccatgcggtcgcggatcagcagcagctggtcggtgcgtccgtcccagagggcgaaggcgaacatgccgttgaggtgttcggggaggtcggctccccactccaggtagccgcgcaacacgacctcggtgtcgctgtcggtgtggaaggtgtggccgcggtggcgcagttcgctacgcaactcagtgtagttgtacgcctctcctgagtacaccagcacgacatcgccgtccggggtgtgctcgctcatcggctggacgccgccgggcaggtcgatgatggcgagccggcggtggcccagagcggcgtgtgtgtcgagccagaggccctgtgcgtccggtccgcggcaggccatcgtggcgttcatggcttcggccgtggagcgttcggatctcaggtcacgctggtaggacacccaaccggagattccgcacatggggtggcactccttgccgtggagaaacatccagcaccgcgaacggcacccactacaggaccgtaacaaggaccgccgaccggcgcagctcacagtggtcgcgcggcacgggacacacgtccttcgaccgcaacggcagcgttcaccacgtctgcgacggcgcctgcgccggccgagcagtgcatgagcagcaccatggccgtcgacctgatcgccgcccgctccctcggccgcgaggagtggctgcacactcccgaggcggtcgagcgggccctctcggccaccaccgacctcgacgccctgctgatgtggccggcccgccacgttgacgagctggtgcgggacagcggatgaggcgtcgtgcctggcaggtggaatgatccggctgcggcgatcatggtcgatcgggcagtgctggcgcatcgactgcgctgtgacgtcccctggggtgatgacctcacttgtcgtcgaccaccgctgacggcgctgcgttgtagcgggccaggagggttcgcagggttcggatctcttggggggccagccttcggtacgggcgcccacctcgtgatgcatgcgggcgttggcgagggtcaggagctcgcggccgtggtcacgggggtgcagcaactggacgcgggggttgccggggtcgggctcgcgggtgatcaggccggaccggtgcagagcggtcacctggcggctgatcgtggacttgttcaggccgtacagcccgacgagatctcccgcgcggaccccgttctacttcgaactcgacgccgaggcggtggagcccgcggcaacggggcccggcaccgtcgtggctgccgacgtacagttgttcaccgaaaccggcgagtgccgtggcgaggttctggtcttcgtgcaaggcggctacctctcatggctggaggtctgctcttggagcgaggacgtcaatgtgaatctcgctgcggcgcggcgctggctacagccatcgtcctgagcccgagtcggcagcatccggcggtttcggaccctgacgccgccaccacgagctgaccgacatcacgagttcaagttcggtaacccgccgaagtcagcagtagcgggactctggactcccacgaggagcggctactcacggcaggtcaacgccaaggtcgtcgactggggtcagcactcagaacggggcgttgagctcccgtcggcccgactatggtcgggtgagtgccgcgtgggcctgtgccgcggcttcgatgacgcctggccacagggcgtgtcgcaggtaggtggaatcgtccgcctcgggatccagggcgtcgatgatctcgttgaggcggtcggcgaggcattgcatcgtctgtgcctccgcggcgctgcggagtgtggtgcctatcgccgcggaagggtcttccagtacggcggtgtcgtcgtagaggatgttgacgttcagcgtgaggtcgtcgaagtagcccgggtgcgggtactgtcgctcgatccagacgcgacgctggtggcctgggtcggcgagtgcctggagggccgagacgatctgctcgcgcatctccggcaggctcaccgagggtgtctggctcacggtttgttccattccttccagcggagccattccttcaacgggatgtgggccatgagctttccgttgcggccgatgaccttacccccccccgagttgatgaatgatccttttcaaactcgcccggaagcagcgcagttacacgtcggcttccttgatgagttcgatcgagtgctgcgtcgcaccgaagactcagccggactgcgtgggacaaggacatatggccgaccgcacacggaccgcgcatacgccagggaaggcagggatggctgggggaccgcacgatcggtgccgctggcctgggcaggtacttccggttcagggacccgcaagggatgatcacggggttccgtgcacccgcccggtccggctcgcgctcatcgggggatcccatgtaccgccgcacccgccgtacgaccacggctctggccgccgtcgcactcctgacagccgtggcaccggcctgctccggctcggccgagacgccaagggcttcctcgtcgaagaagacgaccgccagcactccggccgcatccgctgcacagagggtgtcccggcccgaccatgagcggctcgacaacaaggcccgccgcctgctcggcagcgccggccgtccgagcatggacggcgacgacttcatagcgtccgggacgctcgcgatccccggacagaacctggacgagaccatcgagtccggcaccgcgctacgtgtggaggtggcctgcgcaggagagggcacagtcacgttcacggccgaatccggcaccgccagggccgtcaggcgcgtcgactgcacgcagccggtgacgaagggtttccgcctcaccacggcagcgccgcgcctcgcggtccgggcggactccgccacaccagaaacggtcggcaccgcctacgtggtgcgccgcgtcggctgaggtcggatcccgcaacccggcccgcccgcccgggcatggcgaagtgcgcgttgtcctggtgaaacgacgtgtatggcgcccctggatcagccgtatgtctccgcctcgcccagcactggcccgggaccggcgagatcaccgccgctctcgagcggctcacgtttctgcctccccccggctgaccagcaacttcaactatcccgacggcagcaccactcgatctcgggcagcggaacccggcgcccacccgactcgacaagcggggcgcaggcctgccaacgatcagctcggggaagcgaaggggcccaccgactccatcggtggaccctcacgaaagatcgaggctagacaggcgggctgcccttgccgacgggacgtcgcggtgcaactgggcgtggtccgcttgtctttggcggcggtcagcagaagccgttgagaccccacccgcctcctgccaggaggctgttgccctgcccctggtaggtgaacagccagccggcgttgccggcgtagccttcgatcgtgttcttggtgttggtcacggcggcgagatcggggcgcccgtcgccggagacgtcgccgacggcgatgaggttcgccatgccgttccagccgcccttgccgaccaagacgcgtccgctgagggcagcggaacggccgggacagagccagagtttgcctgtagacgcctcgcgggcgtagaggtcggggcggccgtcgccgttcatgtcgcccactccggccagtgcgttcatggcgttccagccaccggtgccgatgagcttgggtgagcccagcgtgccggtggaggtgcccgggtacaggtacagcttgcccgtggccctctcgaccgcgatcagatccccgcggccttggtgcggaagacgccgactgtgccgaacgcttcgaggacttggtccgggtgtccgtgccggccgacatgtgagttcacgacgctgacgccgaccatccgcggtgccgcatcgacggcggcttgcgacatcttcagcggtttcatctgtgtggtgggcgccgccagccgtctgcccggtctcctcctcgctgccggtttcggtcgccggtggtcgtagggccggtcagtgggcggtccatccgccgtccaccgggaggacggcacccgtgagataggacgctgcggggctggccaggagcagcgcggcgcccgatagctcggtgggctctgcccagcgagcagcgggcacttggtggtcgaggaagttccgtacctgcggatcgctgtcgatgccggtgttcagtggcgtgcggaacgggccaggtgcaagggcgttgacacagatccccgtgcccgcaagctccacggcaaggcttcgggtcatctggaccacggcccccttgctggcggcgtaaccgctgcgccccgccgctccgacgagccccaaggcgctggcgagggtgatgatgcgcccgtatcctgcagcgcgcatcacgggcacggcggcctgacaggccaagaaggtgccgatcacgttgacctccaggcagcgccggagagtggtgacgtcgagatcggcgatctcgccgcgcgcctgaacgccggcgctggtcaccagtacgtccaatcggccgtagcggctgacgacttcccggatgagttcgcctacggcgtgctcgttgctgacgtcgcaggccaggcccagcgccggtcggccagtctcggcggtgatccgtcgagcggcatcaccgcatgcctcctggcgccggctggcgaccaccgtggtggctcccgcgcgggcgagggcaagcgcaatggccagaccgagcccagcggaaccgcccgtcaccactgccacctgtcccgtcaggtgcaagccgtaatccttaagggaagccccctcggccacaggatctgtacctccacggtccggcagtgtgaatgcctccatgatgccaagcaatcccgagtgatgagcggtactggtcgatttcacagagcgccgtcagcgacgctacgggcacagcccgcccgagcagacagtcggccgagagggcagcgatcgcggtgacgacgagggccatcacgacaaccgcatcccgatcgcggacagctgcttctgtccaggagtgttctatgtgatcggtcgtggtgcgatgacctgggctggtcagatcggggactgctgggttacgggtagcgcgtgtggcgacgagggtgggtgggcggagagtggaggcgactggtggattgctctggcctgcaggtttgtcaggttgcgtgtcggctggccaggtagagctggtttgtgtcggagggtggtcaggtcgggtggtgatgggtgtgccggcgggcggtccgccccggaccaagtggcggtgaccggtgggggattacaggttgttggcccatgaggggggcggggagcgctcaccacccgcagtccgttcccgggtatcccgcagcgcgggaccgatacgaagatcacggctcgtttcgtgaccttcaagggagagttccccgtgcgtcttgcccgtaccgctgccatggcggtggcaagcaggccgctgcgccgcgggggcgcgggcgggcgcggacatgagcctccctcggggatgcgcgggaggggcacaggcctccccgcggcgcgactggcgccgcggggagccggaccgagtgtcggagagtgcgtcagagggtgccggcgagggagaccgcgccgagcgttccggtgatgcctcgggcggcgaccggcgcggtcgggccccaggtgcgatcgatgtggcggatcgtatgcacgatccggtcgtctacggtcgtcaccgccacctggagctcgccgtcgatggtgccggcggccacggacttggccgtcacggtgccgaggtagtccttcaggtcggcgaagggcgcccaggtggcgttcccgtaccggatggagtggtactggcgggtgccgttgtcggtcgcgatgacgatgtgggcgtcgctgcccgcaccggccatggccacagaagtgatcggacctgtggcgccggccgcccgggccacgtcgccccagacggtccactgcccgttggtgtggcggacggagtggtaggccttgccgccggacacggcaacgatctgaagctcgccgccgacgctggcggtggcgacggaggtgacggcgccgatcgagccgaccgcgccggcgacgtcgccgaacggggtccaggttcccttcgccccgctgcggaccgtgtggaacaccttgccgcccgcgacgaccacgacgtgcaggtcggcgccgatcgacacggtggacacctgcgtgatgtcgctcagcgcgccggccgcggtgttcacgtcaccgaacgtgctccatgtaccgtccgccttgcggatggtgtgccaaagacggccgttgccgccgagcgccacgacgtgggtgtcgccgttgatgccggccacggctgccgtgcgcaccccgccgatgttcccggccttggactggacgtctgtgaatcccgtccacgagccgtcggccagccggatgccctggtacaacgtggagccggcctggaccagcatctcgcccttccagcccggggtcagggcccgtaccgactggatccagtcggtcagatcgtcggtgcgcacgctgatggcacccgtacgggtctccgtgtccgggcttccgaggcaaccgccctgccaggagcgtgagttgataccgaccagttcgccggcggagttgaggagcgggccgccggtgtcgcccttgcagatcgcgtcggtccccttgccggtaatggcgtacgtcgtcgcgtcggcggtgtcgagggtgaaggagccggtgtggagtttgtccgtgacccattcggtcttggtgcggccgaacccggccgccgtcagctcggcgcccgcggccggggcggcggtggctcgcttgacgcccgagatcccggcagcaggcgtggcgaggcgggcgaggaccaggtcgcggtcggtgcgcgactcgaggtcgaccacctcgatggccttgccgtcgctgagggtcgcggtgctcttcagcgcgggcttgccggacgggaccggggtgccgggggtggcggcgaagcagctggacgccgtcgcgacccagttctggtcgacgaggacgccggtgcaggcacgggagttcgcctcatctccgatgttcaacttgacgacggaggagagctgtccggcaccggcctcggggccggtgagcgcgtgggccgggaccgcggagatgaggcccgcggagaccgccgtggccgacacgaggagaccggtgatccgcggggtgtgcggacgggagacagacatggaatttccttcgaatgagcgattgcgtgggaaatcgactgagggtgccgccgtgaattccgcccggcgcgcgcgaagacgctgtggccgggttccgcgggaccacgggcgtgacgggctcgtggcgcgaggccgcagtgtggtcgggagacggccggaatcggcgcacggcacatcggaagcggcacaccggcgaagaacgcagggctgcccgatgtgttacttggtggtgcggatttccatgagcatgaattcgcgacccttgtcgtcggcgctttcacccaccggtgtccacgcgttcttgttcacgtcgaacgacttttcctcggcgcccgtggtcatgtcgacctgggccgagtagctgttgcccttgacggcatacaccgaggggatctcaagggtcaggtaaccggcgtttccggtgacgcggaagcagatcttgtcgttcgctcgggcccacacctccatcaggtcggtggcgctcgtgcaatccgcgagaaggatgtgcccgtcgccgcgcttcagggtgatgccgcgttcggcgaggatcttgtcggcgttcgggtagccgaagtcctcgatggcgtaaccagggccttcctccgcgatcgacttgatcgcaggggagtccgccacggatccagcggtcccgccgacggtgatcgcgcaccatgccagagcgcccgcgccaagcgccgcgccaaccgtgcggagcatcgtcttgcgtgccttcatcactgtcctgtcgtcggttcgggagaaacccgaagcatgtgtcaacgcggaggtgaaggctgctgtccagccgaagggaaatgaaccgaacccgggttcaccgcctcgtggaagccccccactccccgaaagagcgtaactgtcggcccgatatgtcatctccttgggaaaagacaggagcgcggcacacggcggtgaggccgatccccgccgggccttccgtatagaaacaccggagtatgaatccagtcaacgggtgacgcgtgatatatgtcacgccggactaaggtttcccgtgttgcctggactatcgcatttcctttccgtttgccggaatgctggattccatattcgaccgggtgtggacgatcacctcgctcgctgcgcccttgccgggccgcttcctcggtgctgcccccgtgccgccttcgcggaagcgggcggcgggaagcaggccgcgaagaaggcggcggagaagaaggcggtgccgctgccgcgagtgccccggcccgctcgtagcgctcggctgctcacggcggcttgccgtcggcgccggcgatccaccagcggccgggccaggcgaagtcggcggtgtaggtgagctggtcggcggccggggtccggcggccgggctgggaacggtgaactgacgggagtggtcggatagggagcggtcggcgatgttgtcgtccagaccgcgcgtcaactccttgtcccgcagggccttcagcaggcgtcgacgggctccggccagggcgtggcggcgcgtgaaggtgccgcgcaccgtggagaggcccgcgacgacgccgacggcggcgagcgccgcaatcactaccgggtccaccgagcccggatcgccgcacccgctacccggcagcgctgaagaagcccgtcggtcatctgcgtgccgaacttcaggagcgcggacgcccgccaccacgcgggcagccgcttcaaaagggcgtggcgtcttcttctcggggcgggtatcctgcgccgcccgacagacaacgccctggcgggcacgctcgccaggcagccgcccgtgcttctccgcccactggtaggtgaggctcaaggatgtcctcgatccgctgacggcgggtcgggggctcctgcctgagagaggtgcagacccgcatgtccggctacattgatgccccgttcgatagggaggatcagatgatcgatttcgcgttcgagccgcgccaggacgacgactcctggtccccggactggcatcccgatcatccgaccctgaacagttcggacttctgtctcgaatacttcaaggcagaccgacggctcatcatccacggtgtagacctcagcgtgcgcctgctgggcgaacccgtggtcgacttcgcattgatgctggactacgccacccgggaactcgcgcagcggaccagcgtctcagtcgaagccagcttgacccagcacctgtactcgttcattcggaaagaacaggttgtcaccctgtcgtcaacatggccgccggggacagtggcgcggctgtcctggtcagagttgcaggagctgaccgaaagagcaaaaggcgaagcggtgcgattgatcaccaccgcacacccggaactccggggcaacgcatggctgaggcagaccgtggggcaatcgcccgctgcctaactgatcgtttcagaacgcggtgcgtagtcgcctcaagcagatgacggagcaggctacgtggcgcccgagcggtggcagggcgccgaaccgggcccccggcggccgatctcttcgctcttggagtggccctgtacgaggcggtcgagggcgagccgccttacccgcggcagaatccggtcgcggccctgaccgaggagccccggccgcccctgcacgcggggcgactcggctcgctcctgctgcacctgctggagaagacccccgcccagcgcccccatgccgccgccgcccgcgccctgctccgaaccgaacagcctcacggtcagcccccgcgggctgaccgtgaccggcgagcaagcggccgtgcacaagtgggttgatctgaaggacgtgaggctcgatcgatccggcggcaccgtgacactggtcgccactatccgcccggaacgcctgtcagatgcgaaacggcgagagagacacccggccaagagcgaaaaaggcggcagggccaaggtgttcgtcggccgcgggatccccgccagcgaagccggtcgcgtgatgaccgcgctctcgtaccacgccgggaacctgtacggaggcccgtccagcctgccctgacccacgtcaacccttgcggagcgcattccggctgaccggtcagccggcaggcgcggcgggggtgaaccgtgcggagcgttccaggacgcggtacacggtcgcccggctgacggagaaccggcacccgaagggcccgcacccggacttcccatctggcagccctgcggccggctgggtagagctcgtgcgctgagcacttcccttcgttcctctgggaagacggtccagagaattctcactcaggtcgtccggcgaagaagtccgcaagggaagatgcgagcgcttctggggcctcttcggctacgtgatgcccggagtcgatgccgtggccgcgtacgtccggtgcccactgtcgccagatcttcaccgggtccccgtacaggtcctcgaggtcgtcccggagcgaccagaggatcagcgccgggcactggatccgtgtcccgcccgcgcggtcaccctcctcgtgccgccggtcgatggtgagaccggcccggtagtcctccagcatcgcccgcaccacgtcggggtttctcgtggccgcgcgccactcgtcatagttctcctgccccatgctccggggtcaccgcggtaccaactgtccggatcggcgttgatgacccgctcgggaatatccggctgggcaaagaagaaccagtgccaccactgcgtagcgaactcggccgtgatgcgggacaggtgctcggtgaggggcagacagtcgatcagcgccacccgcgagaccacgtcggggtgatcgagcgcaagacgcagcgcgacactgcctccgcggtcgtgcccggcgagcgcgaaccggtcatggccgagggagcgcatcacctggaccacgtcaccagcgacggcccgcttggagtatcccgcgtggtctgcggtaggcgccggaccggtggaccggccgtacccccggagatcgggacagaccacggtgaaaccacgtcggacgaggagcggggcgacgcgatgccaggtcgcagatgtccgagggtggccgtgcagcagcaccaccggtggcccttccccgccgtggcgaaggagaatcgatgcttcatcgacctgaacccgcctggtctcaaagccctcgaacaaggcccgaacctcctgccctcgttgacgcgccaccacggcgcttatcggcccaggacagccgcgtactcgcacccgaggaccaccgggccaacaggctgcgcaagctggccccctttgccgacgagtgctgaaccgacacagccgtcctcctacccccgcggatcccgtggacacaactgactgattcgccaacagcgtcgccgcaatgcccgggtgcgactgagcgcttcagttggccagttgaggacagccccgagcagtggtggcgcctcgcggccgtccggaggggatggcccgcggtcgccggtcatgcttgcaccgcacaagcgactgccgattgaatttgctgccgcagcatgtgatgaccgggcactggaggggcggacgtggacgacgaggagaagattgcgcgaggagtggcccggggcattgcccgccatgaggccgcacgagcggaggcacagagtcggcagatgctcggctgcctgctgctgttcgcgcttttcggtgtcggcttcatactgctcgtcacatacggtagctgagtgggacgcaccagctacttgagcctggtgtgcgatctgggattcagtggccggcccgggaccgagacgctcaaccgggtcagctcgctcgctcactggcccactgaagcgctcagtcacacgcagattcatagcaggtccggaattcggccgggtcagaaccggaaggatatcgacgaaacggccgtgaaatccgcgcgcaggccatcagcccgcgtacccattccgtgagctacgactccgtgatggcctccgcgacgagcggatgcaggccctcttccgtcgcgccagcctcctgtagctccaggatccgcttcgcgtaggtgggcgagatgtccgtggtgatctggcgctcgctgccgtcgtccgagctaccggtagcaggtgaatccgaagtgcgccgtcacctccaccatcatgcccctggaagtcgacgcctgtgcgcgtgcctgtgctctgacctgcggtcgccactcggattcggtcgcttccgccaaggcggcctgcagccgcttctgtggcttcttcagcttcccggcacggtagcgctcgatcgtgcgagtcgatgtgcccacgcgttccgccaggctcctcgccgaccccttcatccgcgtgaggaggaatttcacctgaacccttgcggatttcggcgcggggcgggtgaacatccctcgctccgcccccgcgagggcctccagaaccttgccgcggcgcggggccgactgctgctgctcgtcatcgctcatgcggcgagtccgccatgggcagcctgtggacagaggccggtgcccgcgcaggtcgggccgggtcgtcgctgtcccggcgtccgtccgtacggtggaagtgtgacgacgtcctccgcccccgagcggggaccaggaggtcgtcgcccacctgtggtcccggcgccaggcgcccggcggtggaggtacgaggttggtcaccggcgtaccgcaacggccctggggcctcggtggagcctgccgagtaccgggtctgggtgcgcacttcggaccacgtgcggtccgtggacggcgtctcctacgacgccgtgcccaccgagtacgtgaagccgtcctcgcctgtccaggaggcgccgggaccgcggcggccctccggctgggtgctggcgaaggccgacggccgcgggcccggccggggcggagtcgtgcacgccgtcgactgcgaagaggcgccgtccggcgtgccggtgctgccgctggaccgggtgctggacgccgcggagcagccgggtgttccgacagggggaggagagccactcgggcagtgggatcgagagccacgttgctccctccgtggtggggatggacgcgacagaagcccatgatcggcaacgagattgagagccaccccgatcggccgtcctcccgcctgtctctgcctggatcagcggcacagcgccgtgtcgacgacagcctccacccgctgggaggccgcacccgtcggggcggtggttaccgcgatggcggcggcacgtccgtcctctgtgacgcctcctcgcgtccggtatcccagggcggttcccccgtgaccccagtagacgccgccgcatgacagcggcgtgctggtcaggcccagtccgtagcggacgccggggcctcgtgcctctgcggggacggtggtgcgcatctgggcgagctgggccgggggcaggagtctgccgccgaggagggcggtgtagaagcggttgaggtcgctgttggtggaaaccagagcacccgcagcccacgccatggacatgtccatggtggtgtagtcgatcagaggtccgtcggccgcctcccgttcgtagccctcggggtgcggctcgtggatagtcgtctcgccgggggtggggaagtaggtgtggcgcagtccgatgcggtcgatgatgcgccgcttgatctcctcgcctatggggcggccggtgaccttctggatgatcaggcccgcgaccaggtagttggtgttgctgtactcccacttcgcgcccggggagaagtgggccttctgcgcgagggcgccgtcaagcagctcgcgcggctcgaagtaccggtaccggacggcgggaaagtcgtcgaagacgggggactccaggtattcgggcaggccgctggtgtgctggaggagttggcggatggtgatgtggcgtccgtcgatcccctcgccgcgcagcaggccgggcaggtaggtgtcgaccggggcgtccagggcgagcttcttctcggcgaccagctgcagcgcgaccacggctgtgaatgccttggtgttgctgcccgcgcgcacctgcccgtccttgggtactttcgccccggtcttgaggtctccgacacccgcggtgtagttgcgcgtccggccctcgcggtccacgacgctggccagcgcagcgggcatccggtcgtcggccaccaaggcgttcaggctgctttgaacggtgtccggcctggcggcggaggccgcggacgggaacagcgcaccggtggtcatgacggccccggtgagcacggacacggccagcaaggccttacgccggccaccccgcggaagaaggggacggaacctcggcgatacacgcgcgtgcatggaacaactcctgtcggtagggaacaacgtcagtgggtcagggagaggtggtcgtggtgcgacgggcctgccggtggctcgtcctcgtctgtgatggtcgcggggcagggaggaacggccctcctctcgtgcccccgcccgaggacggggagtacgggtgaggcgggacctggttccgctacgtgatgcgaggagacctgcggcggcgcagcagccggcgggcgggcagcatgacggccgccgtgcccgagaggaacaccgtgccgagtacggccgcgcagaccgagggcgacaccgacaccgcggacagaccggtcaccgcgccgccgaaggtcagcagcgtcaccgccgcgaccaggaagccgacggcggcccccgtgccgagtacgaggcaggtctccagccgcagcatcgccagaacctggccgcgggtcgcgccgacgagccggagcagcgccagttcacgacggcgggaggcggtggcgacggccagcgtggtcaccacgccgatcagggtgaacagggcgatcgccgcgactgcgagcagtccgggcaggctctcctggcgtgccttctcggtgagggccgcactgtactgtccggcggacgtggcacgggtcccggggaaacggtcgagcaccggtcgaaggtcggccgctcccttcaccaggaggtagtcgtcgtggcccgcgtcggtggcgtgggcggcgaccacgtcgtgaggcagcaggacgtccccgaagccctgtccgcggtcgtagacggccaccacctctgggcggatcacggtgccgtccccgagccagagtgacaccgtcgaaccgaccttggccgcgctggccacgttcgaactgagcgcgaccgtgttcttgccgcgcagacccttcagccggcccgccttcacgcccgggtccagattggacagtgcgcccttcacgccttgggtgggcagggactggagctgggccgcgaccgacatcaccacggtggtgcgtttcaccgcggtcacggtccccggtccggccgtcctttccgccgccctgtacatggcctggggcacgcccggcccgttcgagacgaggacctggtccgcgtgcagccccgcggctgcctgcgtccgggtggcgttgaccgcggtggtctgcacgaacagctggctggcgccgaaggagagcgccagcgcgatcggcgtgatcaccgacgcgagtcgcacggccgcggcggtggccgtgtcggtggcgagccggcccgggaccgggaacaggaggcgcatgacggggctgaggacgacgattccccctcgggcgatcgagggacccaggagggccgccgcccagatgagggagagtacgagtccgcccatggccgcggtcgccacctgcccgccgaacgcgaacgcggtggcggccgaagcgagaccgacgaccaggagcaccaggccggtgatcacgcgccagcgcggtagccgagtcggttcggcggaggtctcgctcacggcctgggccggccggatccgggatacgcggcgtgccgcgagccaggcggaaccgaccgcggtgagcaccgtgagcgccagggcaccgacgacgggaaacggtcccagagcgagccccagcccctggggcaggaccccctgctcggccatgaagcggtgcagcagggtgccgagcccgagcgacagcagaccgcccaggagcgacgccggtaccgcgaccttgagcgtctcgcggacgatcaccctgcggacctgccggggggtggcaccgatggcgcgcaggacggcgagttcgcgggtccggtcccgtacggacgtgtccaggagaccggtcacgatcagcagtaccaccaggagggcgactccgccgatcgacgcacagacgccgatcaggtcgagtcgtgccgccgccacctccgggttctcgacgtcgccacggcccgcgccggtcgcgacgacgagaccgggggcggctgcccgcagcgtctgggcggacgtctccttcgtgccgagcacgaccagcgcgtccgcgcgctcgggatgaccgctgaggacctgtgccgtgtgctggccgaaccagacatcgcggcgtgcgccggacccgccgaccaccagagcgctgacgcggtagggttccggcgccttgccgccgacctggagacggacggtgtccccgactgctctgccgctgccggagtccaccgcgacttcgtgttccgcctgcggggcccggccggcgcgcagttcgaccccggtgagcgcggtcgcgtcccagccgcggccggtccgcacggccccgtccgcggtgaccaccggcacagagacgtccgcgaccacctcggtgacccccggtgccgtgcgtagccggtccgccaccgataccggtacccgggcccgttccaccagcggtctgacatcagtctggtcgtccttgacgacctcgacgcgctggctcgcggcgacgacggccacggcgcgctcatagcggtcggccgatccgtgcgcccgcagtgcggactccagcaggaccccgaacgcgcccgtcagcatggccgcgcacaccagtgccaccgccactccggcggcgataccgcgcctcacagcgtcccccagtgggccaggacggttgcggcggagggagccgtcagttcgtcgacgatcctgccctcgctcaggaagacgacactgtcggcccaggccgccgccaccggatcgtgggtgaccagcacgaccgtctgccccatctcgtcgaccgcgtcacgcagcagtttcaggacgtgctcggccgacttcgggtcgagcgcggccgtcggctcgtcggcgaagatgatctccgggcgggtgacgagggcccgggcgaccgccacacgctgctgctggccaccggacagacatgcgggaagccggcccaggtgatcggccacccccacccggtggacgacttcgtccagccactgccggtccgcctggcggccaccgagggacagcggcagggtgatgttgcgctcgacgtccatcgagggcatgaggttgtagccctggaagacgaacccgatccgttcacggcgcagccgggtcagctccgtctcgccgagcccgcccatgtccagatccccgagccgcaccgttccactgctgggccggtcgagaccggaggcgcagtgcaggaaggtgctcttgcccgatccggacgggcccatgatcgcggtgagactgcccttgcggaacccccagctgaccccgtccagcgcggtcacctcgccgtaggactgggtgacctcctccagtgacacggcgaacggtgcggcccgggtcggcgtcatcggttgcatgatgggtccttcggttccctcgatcggtcagaacgagtaccgaaagtaatcgcgcaagccgagccgacggcagcggtctctctcccgaaccgagggtgtagcaggctccacctgccaggtgtagcgcagccctgtgacaagggaagacgcgtaaagtaccgtcttactccatggacctgaaggcacgtgcactcgacagcctacgatccacgcggtacctgctgggtggcctgactaccgcgctgccttcgctggccggttactgtctgttgccgctggtctgcttcgcgttgctcttcgcgccgatcctgccgtgggcggtgcggccgttgcgcgctttgaccgatgccgaacgccgacgcgccgaaggcgttctcggccgccccgtgcgccggccctacccggtgcccgaaggcaatgcctaccagcggacgctccaactgctgcggtccccgggtacccgcaaggacgtgacatggatgctggttcacggcaccgtgggactcgtccttcccgtcgtcgtcctgggagtgctgttcagtctgctgctgacgatctccatcccgctgtggtggtggacccttcccggcggaaccctcaccctcctcgcggcccccctcaccacctggatgcaggcgatcgtcctgtccgcggtgtgtgcctgggtcctcagcgtcctcttcttctggctggcccccgccaccgtgaagctggagacgtggatcgcggaggtcatgctcggcacctggaccggcgccggccggcggatcgaggaactgaccgcctcgcgcgcgggagccctccaggcacacgaggcggaactccggcggatcgaacgcgacctccacgacggcacccaggcgcaactggtggcggtggccatgcgactggccctggccgagcgccggttcgacaaggacccgcagagttccagggaaatggtgctcgcggccaggaccaccgtggacgaagcacttgtccagctgcgcaccgtcatccgcggtatccacccgccgattctctccgaccggggactgaacggagccatccgctccctggccgcgggccggccgatccccaccaccctggatctgcccgagaccgaccaccgccccccggccgccgtcgaggcagccgcctacttcgtggtcgccgaggcgctgaccaacatcgcccggcacagcgacgcgagccatgcccaggtgtcgctccggtacgacggccccacgctgcgcgtcgtcgtacgggacgacgggtgcggcggggccgcacccggctccgcctccggcagcggactcgccggggtgcgccgacgggtcgccgccctggacggtacgacgagaatcgacagccctgtcggttccggaacgacgattgaggtggtgctgccgtgcggatcgtgatcgcggaggacaacgtccttctccgcgagggcttgattctgctcctggaggatgtcgggcacgagatcgtggccgtcgtgggaagcgggcccgagattgtccccaccctgctcgaacaccggccggacgtcgccgtcctggacgtccggctgccgcccggcttccgcgacgaggggctgcgagccgccatcgaggcccggaaaatcattcctggccagccgctcctggtgctctcccagtacgtcgaggagagctacgccgccgaactgctcggacagggtgcctcggggatcggctacctgctcaaggaccgggtggggcacatcgaggaattccaggacgcgctggagcgcgtcgccgcgggcgggacggcactggaccccgaggtcgtctcccagctgatgagccgccgggacccgctcgacgcactgtccccccgggaacgtgaggttctcgggctgatggcgcagggcctggacaatcccacgatcgccacgaccctgttcatcaccgaacgttccgtcagcaaacacatcggcagcatcctcgccaagctgaacctgccgccgagcgacagcggccaccgccgggtcctcgcggtgctcgcctacctgaacgc

SEQ ID NO: 112 - DNA, 14318 bp, Unknown
  Kingdom: Bacteria, Phylum: Actinobacteria, Class: Actinobacteria, Order: Streptomycetales, Family: Streptomycetaceae, Genus: Streptomyces
  misc_feature (14049)..(14095): n is a, c, g, or t
ccagttcctcgccctggtagaggtacgccgagccgggcagcgccagcatcagcagcgtcgccgcccgggcccggcgcagaccacgcgcctcgtccccttccgcgaggcgcgtggagtgccgtacgacgtcgtggttggagagcacccaggtggcgggcgcgtgcacggcgttcatggcgcgcagcgagcggtcgatgacgtcccgcagctcggccgcgtcccaacccgtcgtgaggtaggagaagttgaacgcctggtgcagctcgtcggggcgcaggtacagggcgctgcgctcgacggtcggcgtccacgcctcggcgaccgcgatccgcccacccgtcgcccgccaccgcccttctgaggaaggcccttcgggccctgattcgtcttcggcgtactcctccaggatccggcgccagctgcggtagatctcgtgcacgccgtcctggtcgaagtacgggacggcctgcgtgccgagcagcttgacctgctcgtcgtggccgatgtcgggcagcccggccgccttgaccaggccgtgcgccacgtcgatgcggaagccgtcgatgcccaggtccagccagaaccgcaggatggagcggaactcgtcgtgcacggccgggtggtcccagttgaagtcgggctgctcgggcgcgaacaggtgcaggtaccactggcccggggtgccgtccggctcggtgacccgggtccaggccgggccgccgaagatggactcccagtcgttcggcggcagttcgccgctctcgcccttgccggcgcggaagtggaagcggtcgcgcagcggcgagccggggccctcgcgcagcgcctgcttgaaccactcgtgctggtcggagcagtggttggggacgacgtcgacgatgacccgaaggcccagcgcgtgggcgtcgcggaccaggtcgtcggcgtcggtgagggtgccgaacatcgggtcgatggcccggtagtcggcgacgtcgtacccggcgtcggcctgcggggaggcgtagaacggcgagagccagacggcgtcgaccccgagcttcctcaggtacggcaggcgggcgcggatgccgggcaggtcgcccatgccgtcgccgttgccgtcggcgaaactgcgcgggtagacctggtagatgaccgcgtcgcgccaccactcccggcgcccggaggcggcggcggaggcttcggtggggactgtgtcggtgacgtgctgggtcatggattcccttaggggtacgaggggaacgacgaaggcgctggtccggcgggcggggccggggtcacggccgggagccgggggacggccgcggggccgtcccagggccggccggggagccgggtgcgctcaggacttggtgccgccggccgtcagcccggagaccaggctgcgctggacgagcatgaacacgagggccgccgggatggtgatgatgatggcggtggcggaggtccacgcccagtcggggcgctggtcctgcgcgaaggtgcggatgccgacggcgagcgtgtagtggtcggactgcatgaactgcgtcgcgtaggcgacctcgccccaggcggtgaggaagctgtagaacgcggtcaccgccaggcccggcttggccagcggcacgatcagccgccagaacgtgccgatcggcgtgagcccgtccacccggcccgcctcgtctatctccttggggatggtgtcgaagtagcccttcatcatccaggcgcagaacggcaccgccgtggtcgcgtacgccaggatcagcccgaaatagttgtcgagcaggtgcaactcggacatcagcaggtacagcggcacgatcagtacgatactggggaacatctgggtgaccaggaacgtccacatcagctgccggctgccggggaacttcatccgggacacggcgtaccccgcggtcgaggcgaggaagacgccgagcacggtggtgccgcccgccacgatgacggtgttcaggaaccacttcgccaggtccgaatgggccagtacgtcactgtagttgtgcaggctgaagtgcttgagcacctgccccggctcctgccaggcgttcttcgggccgagcgagatgaacaggatccacaccacggggaacgcggcgatcacggtggcgaggatcagcgtgcagtgcaggacgacggaggcccagaggctgcgttcctcccggccgcgcaccttgcgcgggcgcgcggcggcggggcgggcgggggcggcagcgggcgcggcggcgccggtctcgtgtgttgctgcggtcatggcgatggctccttacgcctgctcggacttcagggtgccgcggcggtagaaggtcgagaaggccagcaggagagcgaggatgatgatgccgtaggtggccgctcccgcgtagtccgagatcccgttgaacgccttgtggaaggcgaaggtgacgaggatgtcggtgtcgccggtggtgttgttgcccagcagcaggtagatgacgttgaacatgttgaacgtccagatgcagcccagcaggatcaccgtgctggagaccggcttgaggccgggcagcgtgacgttgacgaagcgctgccagggggaagcgccgtccatctcggcggcctcgtacagctccttgggtatcgactggagtccgccgagcagcgcgaccatgttgaaagggatgccgatccagacgttcaccatgatgacggcgatcttctgggccagcggggtgccgagccagttctgcgccggcaggccgaaggccgtgatgatgtcgttgaagacgccgtactgggagttgagcatcagccgccaggcgaagacgccgatgaacgacgggacggcccacggcaggatcagcatcgcgcggtagaagccccgcagccgcatcttgcggttgagcagcaccgcgagcgccatgcccaggccgacctggagcaccacgcaggagacggtccacacgaccgtccacaccaggcgcgggtagaagtcgccgtccgcgcccgacaggacgtgccagtagttgtcgaggccgacgaagacgtaggtcgccgggcggtggaaggcgccgatggtggtggcgacgttcgactcgttggcgttcgtcagcgactggtagaagccgtaccccagcggatacaggaccagcagggtgatgacgatggcgaccggggccaccatggcccaggcgtaccagtacttgtcccaggatcgcctgagcgccgaggcacgtgcggggcgcggggacctgtcgccgctcgctgtcttgtcggtctgtccggtgctcgctgcggtcgtcatactcatcggctctttcgcggacgaagtcgggtggttccgcagccccggggagccccggtcggggcggcagcggggaggtcctttccccggggctgcgtgtccttcggtcgccgtacggctacggcgcttgcggtcgccgtacggctacggcacggcctgcggcctggcgccgatcagccgatggagaagccgggcaggagcttctggaactccttggcggtggcgtcgaggccgctcttgaccgactggtcgccctgcaggatcttcacgtagttctgctgcagcggcgtgaagagcgaaccgacctgcggcagggccacgcgcgggcgggcggtctgctccaggatcggcttgaagccggcgaccttggcgttcgcggtgacctcgccggtgtacgccgacttgcgggtcggcagggtgccggtgcccttggcgatggcgatctggctctcggtggaggtcatgaactgcgtgaacaggtagctggcgtccaggttgccggagccctggtagaccgtcaggttgtggccgccggtcggggcctgcgccttgccgccggcgccggccgggacgttcgcgaagcccaggttggcctcgtcgcccttgaacgccgagccggtcaggtcgtcactgaccgaccaggggccctggatcagcatggcgaccttgccgttcttgaacgcggtctgcatgttctggtacgcgttcgcgaagtcgaccttcatcgacgcctcgtcgttgatcttcttcgcggtggtgagcgcggtgacggcggcgtcgttgctgatggtgatcttcttgccggacgggtcggccaggtccgcgccgttgctgtagagcagcgggagcaggaagtaggagtccgggttgacgtaggtgccgtaggccccggtcttctgcttgatggtcttggagtccgcgatgaactcgtcccaggtggccggcggctcggcgatgccggcctgcttgagcagcttcttgttgtagagcaggccgagcgtgtcggtgaccgacgggacgccgtacgtcttgccgttgtacttggcggtgttcagcggcgtcgcgttgaagtcggaggtgtccttgagggcgggggtgccgtccagcggggcgatgtagcccagcgaggcgtactcggccatcaggcccacgtcggtgcggaccacgtcgggcgcgcccttgccgctcttggcggccgacttgaacttctgctcgacatcggtgaacggaacgctctggtagttcaccttgatcttcgggtacttggcctcgaactgcttgaccagggccttgtacgtcggggcttcggtcgccgcgtccgaggtgtcccagtacgtgatcgtcccggagatgtccttggggtccttcggcttgctcgacgagtcgctgcccgacccgccgcaggccgaggcggccagcgcgaccacggtgaccgcggcggcgatcgatatgccacgtcgcatatgaactccctagatatgggtgcccggatcatcccttgggaggaccgcgggtgccgtctgtcacgatcgacggccgccgggcgcgggaggaacgtagcaaggctgcaatcccttgcgaaagatgttgcaagaaattttccgcaagcccctgcaagcgtgacgttttcgttaccgctgggtgtcgtggtctgtcgcgggcggtgacgtgtcgcgtcgcacgatagcgggcggcgggccgggcggggagggggcgcggcgcgtccgcctccgcttttgtcagagcgcctgcgccgccgggccgtcgcggtccggcgtgcgctgtgcgggagcgcgcgggaggtgcgggccgtgttgccggacggcccgtcaggacgcgttgccgcgctgctctgtcgggcagtcggagccgcgacccgggaggcgggcgagtctggggcctccggcgtgaaatttcttgccacggttttcaagacccttgctgtaagcgattcgtcagggatacggtcacgcccggcgtccggccacgaagccgaaccgcggcgcgggcacggacccgatcgagccgtcatcgcaaggagttcacgctcgtgatacccagatggccggcgcctcccgggcgccgcttccaccagggcggacggggcagacgcgtcgcggcgctcgccctcgccgcactcgccgccaccctcgtccagccgcagccctcccaggccgccgccgcatccgccgcgccccccgcaccgccttccgacgcgcggctcgccgccgtgcccgcccggcacgaggccacgcgcgagcagttctacttcgtcatgcccgaccgcttcgccgacggcgaccggtccaacgaccgcggcggactgaccggttcgcgcctcgccaccggctacgaccccaccgacaagggcttctaccagggcggcgacctcaagggcctgacccagcggctcgactacatcaagggcctgggcaccaccgccatctggctggcgcccatcttcaagaaccggcccgtgcagggcaccggcagcgccgcctccgccgggtaccacggctactggatcaccgacttcacccaggtcgacccgcacttcggcaccaacgaggacctgagcaccctcatcgccaaggcgcacgccaagggcatgaaggtcttcttcgacgtcatcaccaaccacaccgccgacgtcctcaccaccaccgaccagtcccacgcgtacctgtccaagggcgccttcccgtacctgacgaaggacggccggcccttcgacgacagcgactacgcggacggcgggaggaagttccccgccgtgggcgcggcctccgtcccgcaccccccggccgtcgcccccgccgagaagaacctcaaggtccccgcctggctcaacgacccggcgatgtaccacaaccgcggcgactccaccttcgtcggcgagagcgccctctacggcgaccacacgggcctggacgacctgtggaccgagcgccccgaggtcgtcagcggcatggagaagatctacgaacgctgggtgcgggacttcgccgtcgacggtttccgcatcgacaccgtcaagcaggtcggcatggacttctggacccagtgggccacggcactggacgcctacgccgcccgccacggccgcccggacttcttcatgttcggcgaggtgctctccgccgacgcctccgtgacctccccgtacgtcacccagggccgcctggacgccaccctcgacttccccttccaggacgcggcccgcgcctacgcctcccagggcggcagcgcgcggaagctcgcctcggtcttcggtgacgactacaagtacacgaccgacaaggccaacgcctacgagcaggtcaccttcctcggcaaccacgacatgggccgcatcgggtccttcctcaagcaggacgacccgaaggcctccgacgccgaactgctgcgcagggaccggctcgccaacgagctgatgttcctcagccgcggcaacccggtcgtctactacggcgacgaacagggcttcaccggtgccggcggcgacaaggacgcccgccagaccatgttcgcctcccaggtccccgactacctcgccgacgacgagatcggcaccgaccgcacccacgccagcgactcctacgaccccaccgcgccgctctaccggcagatcgccgaactgtccaggctccgcagggccaacccggccctcgcggacggcgtccagaccgagcggtacgcggccgacggcgcgggcgtctacgccttcacgcgcacggacgcgaagagcggcgccgagtacgtcgtcgccttcaacaacgccggcgaggcgaagaccgcgaccttcgccaccggttcggccggcatgacctaccgcggcatctacggcaccggcgccaccgtgacctccggcgccgaccgccacgtcaccgtcaccgtcccggccggctccgccgtcgtcctcaaggcggccggacggctcgacgcgcccgccgccgggcccgccgtcaccttgaccgcccccgccgcgggcgccaccggcaccgtcgatctgagcgcggatgtcaccggcggacagctcgaccgggtcgtcttcgccgcccaggtcggtaacggcccctggaaggtgctcggttcggccgaccacgcgccgtacaaggtgacccagacccttggcaaggacgtaccggccgggaccgcgctgcgctacaaggcggtcgccgtcgacaccgccgggcacaccgcgggcaccaccgccgtctccgccaccggcaccccgcgggcccccgaggtccccaccgcctcctcgcgcgactacgcggtcgtccactacaagcgcgccgacggcgactacgcgaactggggcctgtacgcctggggcgacctcgccgacggcgaggcgaccacctggcccgccacccacccgttcaccggccgcgacgcctacggcgccttcgcctacgtcagactgaagccgggcgccgccggagtcggtttcctcgtcatcgacaaggacggcgacaaggacgtcgccgccgaccggaccatcgacgtcaccaagaccggtgaggtctggatcgagcagggcaaggacaccgtacggaccgagcggcccaccgccgactacccggcgcaggaccagaccaaggcggtcatccactaccaccgcgcggacggcgactacaccggctggggcctgcacgcctggaccggcgccgcgcacccgcccgagtggaacgaccccatccggccggtcggccaggactccttcggcctcgtcttcgacgtcccgctgaccgcccacgcgaactcgctgagttacatcctgcacaagaaggaggagaaggacgtccccgtcgacgaggccctggatttctccctgtacgggcacgaggtgtggcgggtggcaggcgacccggcctacctggagccctcactctccggcgcgttcggcctggacctcaccgcctccgccgcgacctggctcgacgacaccaccgtcgtctggcagggcaccggcacgggcgtcgcgagccagcagctcgtctacgccccgcagggcggcatcaccgtccaggacggcgcactgtccgacgagggccactggctgcgcctgacccccaccaccctgaccgacgcacaacgggccgcgtatccgcagtacgcggaccaccaggccttcaccgtcgacccgcgcgaccgcgaccgcatcgccgacgcacgggccgccgcccagctcatcgccacccagcgggccgacgacggcgccctgctcgccgccaccacggtccgccgcccctgaccccacggtccgccgcccctgaccccgctcagccaccggcggtggtgacgccgggcggccggtgcgggttgcctccgcaggtactcaagctctccgcgggtactcaggctctgctgagtacccgcgcccatgcgccgggcgggaccctcggcgaggctgtggcggagcctttcggttctctccggttcactacggttcacttcggttcacttcggttttcggtcccagaggagacaccagacatgcggaacgtccggcggggtgcggcgctggccgcggtcggggccatggccttcgccatgctcacggcctgctcgatggaggaggcggtctgcggcggcggcgagtacccggtccaggcggtgggcagcacaggcagcgcctgtaccccgaagggcaaggagccgccggcgggctacgtccgctatcccgagggcaagactccgaagacggtcggtgacaagtgggaggagtactggaacacccacgtgatcgacaagaacggcaacgtcagcgaggcgaaggagggcgagtagcgccgggcgcccggccgctgccggcctgcgcggggcgctactcgccgtcgggctcaggcccagcagccgttcacggtcgcggccaggccgtccatcgcgtccttggtgtcgctgggactggccgtcgcaccgttctcgatgaacgagaagacccgccactcgccgctcgcggtccgggtcagaccgctcagggcgatggctccggtgagggtgcccgtcttcgcctgcaccttgccgacggcgcactgcgagtgcgggtcgtcgaagcggccccattccggaccgagcgtgctgccggcctcgccggcgacgggcaggccctccaggatggagccgagggtgtgcgcgtagcggtgttcggtgagcagttcgaggatctgcgcgagggtggcggccggtatgcggtcggcgcgtgagaggccgctgccgtcgtggatctcgaagttctgcagcgacacgccgtagtgccggctcagcacgtggcgcacgacctcggtgccgccctcgaaggtggccgggcgtcccgccttcagcgcggtcatccgcagcagggtctcggcgatgttgttgtcgctggtcttgagcatcttcttgacgacgtcggccagcggggccgaggtgtggcgggcgaccggcacgtcggtgcggtcggccgtggcgcgggtgacgtcgccgtccacggtgacgccctgcgcggcgatcagtttcgcgaacgcctgcccggcgtcgacggaggtgtcctggacgccgtggccgtcgacgacgagggcgcggaccggtgcgacggtgtccgggtagtagccgtcgttccacccttgggccagggcgggttcggggaacaggctgtcgtccacggcgaccttcaccgaggacaggcccgccttcttgagcccggcgaccgccgtccgtgccagctcggcgaggtcgtcgccggtgagggtgcggtcgccgcctccgacgagcttcagcgtgccgtcgccgtagacgaccttcgtggtgaaccggtgctgcgggcccatgacggtcagggccgccgtcgccgtggcgagtttgacgttggaggcgggcatcagcgcggtggaggcgtggtggtcccacagcgtgctgtcggagtcggcgtcgaggaccacaccgctgacgtcggagcccaggcgctggtcgagcacgcgggcgtccaggttcgcggccatctgctggtcgctgctgccgtcaccgtcgacccggcccgccgtggtgttcccggccgtcgtcgcggtgccgttgcccgcggcgaaagccgaggtgcccgcgagcgcggccgaggccatgggcaccgccatcgcgagcaccacggcccgccggactcctgtcccgccctgtctcgtcttccggtgccggcgccggccgcccggggcgaacgtgctcataggtgtttctgctgccgcatcactcatggatatccagatttcgagatttcgagtacggggacgtctggtagggggcgatcggcgcgcacgctaccacccgtcagatacggcaagtgcgaggcgaacggccggaggtgagggcagggtgaaaggtctggtgaagtgctggatcaggtgtgaagaaggcatggcaggaccgacggagaagccctgcggaagcgcgcccggaggtgcctgggtgtgaggtgttccggggcagtcggagaggcgctgcagggcagctcggcgggtgtttcgaggcggtccgcaagggtgtttgcgggcaggtgaacaggtatgtgtgtggtcggtgggggcacgctcggaggtgtgcgtagactgacgcaggtttctcgctcgggggagggtacaggtccgctccgcaccgtctctccggcgcacacaccttcaagcggatgcggagaggtggaggctgccgctgatgggttccgcgcgccggggagccgtgtggcccgccgcatgcacctggcccgtcgtggccgtgctggccgtcgcggcatgctggttcttcggccgggacggtgagccggaggccggtgtcgaccgggtggccgtcggccgcgtgtgccgctcctcgctcccgcgggacatggaactgtcctgcggtacgtacgggttcggcgacgtgcgctacgtctgccccgccgggagcgggggaggggagcggtgcgtgcggacatcgacggtgacggtgcgcaactcgggctcctcccgggtgtacgtcacgtacatcgcgggccgtgggcagggcgcgcgcgagcagggcccgcagcgggcggtccggccgggccgcgaggtgaccctccgtcccggacagggacggctgctgttcgacgtcacgctgcgcagcgcggacggcggaccgagcagcctggaagtggtcggcctgcgatgacggacgcggggcgcaggtcctgaccatccgtgcccgcgacctggtcattcagctcataccgactcaaagcgccgaacacgcgagcgagttgcccggtccctcgtaagctgcgcggtgcccctcggctcgaaccgtcgtgcgattcgccgccgagaggcgcggctccggccgccgaccgcggccggggacaccgcccaggcgtgcgcacacgcgccgcgaagcgagacgacacgaggtggaacatgccgggatcgtggaacatgccgggaccgaggacgtggggagtggccgccgcctccgcggtgctgctgctctgcacggcacaggcctcacccgcgggcgcggccacgaccgcgctgccgctctgcccgacggtcttcgggcacggcggctatcccacgggcgccgacccctgggaccgagaccaggtgcggcagccgaacaaccccaagggtctcgcccagcagaagagctggggagcgggcggggtcgaggccgacctccagctcacccgggacgggaccaagggcgtcatgtggcacaacaccacgaccaacggcctgaccggcacccgcaagcccatcacggaactgtggtgggccaccggagccgaccagctcaagggccgtacgatcacccgtggcccgtacaccggcgagaccgtctacaccttccgcgaatggctcgacagtgccaagtccaagaacctgacacccctggtggaactcaagggcgaggccaagcagtcgctgctcaacagtgactccgccatccgtgagcgggcctgggccgaggtgatagcgcccatatcggagcgcatagcctcgcagaagatcatgatctacacgcacgactccgcgctgaagcccgaactcgacaagcgcgtcaaggcggccggcctcgcggccacgctcaccggccaccccagctggatcgacggcataggctgggaggagccaccgccggccgcctccggcaactacgcctcctggcaggcggcctggacccggctgggctcgaccacgacctcggtgcccatcgccacctcgtggaccaaggacctcacgacatggctcaacggcaagtgcgtgtgaccctccttggagccgtgtaccgttccacgcatcgcccgcccggagccggcggagggaccgaagggactcggcccgggagttgaccgcgggagagcgggttacgacgggagaaccggttaccacggggagagccggtcacctcgggtgagtgagttacggcgggtgagcgagtcgcggcccgggccggcccgtggatcgcgggccggcgcggtcagatccgggtggcgagcggcacggtgacctccttcagccacgtaccggaggcgaagtcccgcgccttgacgaccacccggtcgcggtacacctcgacctggagaccctggttgaacgcgccgtcgacggcgttctcgccgccctgcccgttgtcggtgaaaccggtctgcacggcacccgtgttgaggaccgcgaaaccgtcgaggttggccgtcccgggcaccacacggcgcacgtaccagtcggacaggcccaggtcccagtgcgtgtgtccgctgaagaggaacacgtcacggtggcggccgagcaggccgagcagccggtcggactggaggtagtcgctcatgtagagcttgttgcgggtaccggagacggtgttcggcagcgggtggtgcgtgatcaccatgacaggcctgcgccggcgcgcccagtacgccaggcgctcctccagccaccgcaactgcgcctcgctcagccacacttcgtcccacagcttcgggtcgtggtagtgcatgtagcgctcggtgccgatcgtgagcaccggtatgccgccgaacgccgtctccgcgtagaccctgccgcgttcggcgaaccggtagaagctgcggaacaaggagtcctcggtggtgccgttgggccaggtggcctgggccagcgtgtccggatcggcccacttcggcacgtagaactcgtggttgccgatggcccaggcgatctcgcgcggatgcggattgcgcgcgaacacccgctggacctcggcgtattcggcgtcgtagccgcgcggtgtgatgtccccggccacggccagtcccgagctgtgcgggttggtggcgcgcatgtcctgcagcgcgacggcgagatcgccgaggtcaccctggatgtcactgatgacgttgaagctggtcagcggcgcaccgccgcgccgcggggcggcttcggcgggtgcctcggcgagcgtaccgagcgcgacggcaccggccgtcgcggcgatcagggatctgcgttccacggaggaaatcctttacgactgggatgtgggcttcggcgcgggacggtggcccggcctcgcgctctggaccagacccgttactcatacgcgatcaacgcggccacggggtgaacaccgggcgacatcggccccggtcggccgccgcctcacctgcctcgcctgcatgcgcctcgcggccacgctgctgcgccgcgtgacgcatcatgagggcgcgatggggaggagctcacgagtgacgactgaaagtgcgcgtgtgcctgcggctgtgcctgtgcccgtgcccgtgcctgtgcctgtgcctgtgnnnnnnnnnnnnnnnnnnnnnnnnnnnnnnnnnnnnnnnnnnnnnnnctgtgcctgtgcctgtgcctgcggccgtgggcgggcggcggctggaatggtgggcggttccggcgggggtgcggagcctcctggaggaacgcctcgggtcagccgtggagagcgcggtgacccaggccggcggcttctcgcccggagccgccgcgcgcgtacgcctcgccgacggccgacgggtcttcctgaaggcggcgggccccgaacccaaccccgacac

SEQ ID NO: 113 - DNA, 6697 bp, Unknown
  Kingdom: Bacteria, Phylum: Actinobacteria, Class: Actinobacteria, Order: Streptomycetales, Family: Streptomycetaceae, Genus: Streptomyces
gcctcgatcagcggcgcgggcagcggcgcgatctcgccggccgcgatgcggggcgccagccagtcggcgaaccccgacagcctcgcctcctgcgtctcctgcacctgccgcccgtggcgcatggcctcgcgcgaggtgccggaggagtgcaggaacagggccgcctcccggtgctcctgaatgaacgtcaagtacgccgctgtcagggcccggagcccggtgtgcagggtgcgggtgggctccagcgccgtcagcaggctgtccagcagccgggagttccagcgggcgtggagcgcgttcgccaggccctcgatgctgccgaagtggtggtacaggctgcccatgctcaccccgctgagcgcggtgaccgcggtgacggtgaggccgtgctcgcccgcgacggcgtgcacgcgcagcgcggcatccaggagcaggtcggcggtggcctccccgcgttgctgcttggggctcatgggaacgagtctaactttctggaaaacgcttccaattcaccgctcgcgtcggtcaggcggaacagcgggacctgcccgtcgggttcctccgcaacgccggtcgaaggcctgagaccggcgtcacgctccccgccacgccgtcgttccggcatggggcggtcgcgggcgccgcgtccgcctcggcgatactggaccccatggcttacgacgatcttcgctccctgctcagggcgctggagcgcgagggcgacctcaagcgcatcaaggccgaggtcgacccgtacctggaggtcggtgagatcgtcgaccgggtgcagaagtccggcggccccgcgctgctcttcgagaacgtgaaaggctcggcgatgccgctggccatgaacgtcttcggcaccgaccggcgcctcctgaaggcgctcggcctcacgtcgtacgcggagatcagcgaccggatcggcgggctgctgcggcccgaactgccgcacgggttcgtgggcgtgcgcgaggcgttcggcaagctcggcgcgatggcgcacgtaccgccgcgcaaggtgaaggaggccccggtccaggaggtcgtcctgcgcggtgacgacgtcgacctcgacgcgctgcccgcgctgttcacctggccgcaggacggcggctccttcttcaacctcgggctcacccacaccaaggaccccgagacgggcgtccgcaacctcggcctgtaccgcctccagcgccacgaccggcgcaccatcggcatgcactggcagatccacaaggacagccgcaaccactaccaggtggcggcccggcggggcgagcggctgccggtcgcgatcgccttcggctgcccgcccgccgtgacctacgcctccaccgcgccgctgcccggcgacatcgacgagtacctgttcgccggcttcatcgcgggcaagcggatcgagatggtcgactgcaagaccgtcccgctccaggtcccggcgcaggccgaggtcgtcctggagggctggctggagccggggaagacgctgcccgagggccccttcggcgaccacaccggtttctacaccccgcaggagcccttcccggcgctcaccatcgactgcgtgacgatgcgcaggcgcccgctgctccagtcgatcgtcgtcggccgccccccgacggaggacgggccgctcggccgcgccacggaacgcttcttcctcccgctcctgaagatcatcgtcccggacatcgtggactaccacctgcccgaggcgggcggcttccacaactgcgcgatcgtctccatcgacaagaagtacccgaagcacgcccagaaggtgatgcacgcgatctggggcgcgcacatgatgtcgctgaccaagctgatcgtggtcgtcgacgccgactgcgacgtgcacgacctgcacgaggtcgcctggcgagccctcggaaacacggactacgctcgtgatctcacggtcgtcgaaggcccggtcgaccacctcgaccacgcctcctaccagcagttctggggcggcaaggcgggcatcgacgcgaccaggaaactgccggaggagggctacacccgcgacggcggctggccggagatggtggtctccgacccagagacggcggcgaaagtcgaccgccgttggaaggagtacggcctgtgagcagcgcctccgcagccatcccgcagcccggacgcaccaaggcgttcctccggctcgtcatgatcgagcactcggtcttcgcgctgcccttcgcctacatcgcctcgctcaccgcgatgtacgagtgggacgagaacatccactgggcgcggctgctcctggtgaccgtctgcatggtggggctgcgcaccttcgccatggcggtgaaccggatcatcgaccgtgagatcgacgcccgcaacccccgtacggcccaccgcgagctggtcaccggcgcgatgtccgtacggcacgcctggaccggcgcgctgatcgccgtcgtcgtcttcctgggcgccgcggcgctgctcaacccgctctgcctggccctcgcgcccatcgcggtgatcccgatggtggtctacccctacggcaagcggttcacgaacttcccgcaggccatcctgggcctggcccaggcgatgggcccgatcggcggctggctggccatcagcggcgagtggtcctggaaggcggtcgtcctcggcctggccgtgggcatctggatcggcggtttcgacctgatctacgcctgccaggacgtcgagaccgaccggaaggtcggcgtccgctcggtcccggcccgcttcggcatcccggccgcgatctggggtgcccgcgcctgtcacacggtcaccacggccctgttcgtctggttcgccctcgccacccacgccggagccttcttctggctgggcctggtggtcgtcgccggtgccttcctctacgagcacaccctcgtccgcccgcacgacctgtcccgcctgaaccgggcgttcttcagcgtcaacggattcatcggcatcgccctgttcgtgtgcgcgctgctggatctgctggtgcgggggctcacggtctaggtaggactgagctgaggacctggcaggcgaccggggccccaaacaccggcgcgcaccgcccgactcacaaggagtgggaggtgcgcgccgtttcgtacggggtcaggacgacgacttggaaccggttcgtgcctcttccccggccagttcctcggcgagcccggcggcctgcatgttcgccttcatgcggtccacgcgctcggcgacctggacggacgcccggtcgcgctccttgcgcaggacgacgaagctgatcggggccgagatcaccagagcgaggagcgggatccacaggctgttggagccgttgcggccactcggcacgattccggcgtagacgaggccccagacgaccaccaggcagcccacgaagatcccgaggcgcatcagcgtgtagcggagcatctcaatccactcttccgttccgatccgttccgaacaaggccaaagggctccgtccagtgaagcacggcccggccgggatcttgcagcggggccgtcaagggccggggtggcgcgggtctcagccgagcggcagcagcatgatcacgtcgtcgcggtcgtcgtccggcgccacccggatcgccgccggcacccggccgacctccttgtacccgcaggaggcgtagaaccgctccaggccgaggccgccccggcaggtcagccggatcgcctcgatgccgtcgatgccgcgggccgcgtcggccgccgcggcgagcaggtcgcgcccgtaccccttgccctggtggctcgggtgcaccatcaccgtgtacagccacagccagtgggtcatcagccggtgggtgttgagggtgaggaaagccgtcgcggcgaccctgccctcctcgtcgtggccgaccagcagccgcgagcggccctcggccatcgccacgaactgcctcaccagctccgggcgtatctcctcccgcgaggcgggcgccacgaaaccgaccgctccgcccgcgtccgtcacgtcggtccacaggtcgaggatgccgtcgcgcagcgttcggtcgacggaggggtccagggtgaaagtaagaggcatgtggcgagtttacctattaccgcagcactccggcagccactttcaggtccgagaccagtccccggtacgcgccctcgcggtcgtccgcgcgcagcacggaggaagggtgcacggtcggcaccagccgttccggacggccgtggatctcccgctccagcacagtgccgcgcacctcggtcacccggaacgacgaaccgagcagcgccttgcccgcggtggcacccagcaccacgatcagctcgggttcgacgagcgccagctcggccgccagccacgggccgcacgcggtcatctcacgcaggttcggcgccttgtggatacggcgcttgcgcggctcggaccgggtgaacttgaagtgcttgaccgcgttggtgacgtaggcctcgcccgggtcgatgcccgcgtcggacagcgcccggtccaggagcttgccggccggtccgacgaacggcctgccctgccggtcctcctggtcgccgggctgctcgccgacgagcatcacccgggcgtggccggcaccctcgccgaacacggtctgcgtggcgtcccggtgcagggggcagccccggcagtgcgccgcgccgagatcggcgccgtccgggacgaagggttcggcggtgtaggcgtcctcgggcgccgccgcggacgccttcgccttggtggtggccatgcgggccgggtacccgtccggcacccggcctcacggcgcacgcctcacggcacccggcctcacggcacccggcctcacggcacccggcctcacggctcgctacgggagcggggtcagacccgcatgggctgcggcgactcgcggcggccggcgtccgggccgtcgtactcccggatgatctcgtagcgcgtgttgcgctcgaccgggcggaagcccgcgtcccggatcagctccagcaggtcgtcgcgggtgagcttgttcggcgtgccgaagtcgtccgcgtcgtgcgtgatcttgtactcgacgaccgagccgtccatgtcgtccgcgccgtgctggagcgcgagctgggcggtccgcaccccgtgcatcacccagaacaccttgacgtgcgggatgttgtcgaacagcagccgggagacggcgaaggtcttcagcgcctccgcgccggtcgccatcgtcgtacgcgcctggaggcggttgcggaccttgccgtccttcaggtcgacgaagtcgtgctggtagcgcagcgggatgaagacctggaaaccgccggtctcgtcctgcagttcacgcagcctgagcacgtggtcgacgcggtggcggggctcctcgatgtgcccgtagagcatggtgcacggggtcttcaggcccttctcgtgcgccagccggtggatgcgggaccagtcctcccagtgggtgcggtggtccacgatgtgctgccggacctcccagtcgaagatctcggcgccgccgccggtcagcgactccaggccggcgtcgatcagctcgtccaggatctcgctcgcgctcagcccggagatcgtctcgaagtggtggatctcggtggccgtgaacgccttcagcgacacgttcggcagcgcggccttcagctccctgagcgagcgcgggtagtagcgccagggcaggttagggtgcaggccgttgacgatgtgcagctcggtgaggttgtccgcctccatcgccttggcgagcttgacggcctcctcgatgcgcatcgtgtacgcgtccttctcgcccggcttgcgctggaaggagcagtaggcgcaggacgcggtgcacacgttcgtcatgttgaggtgccggttgacgttgaagtggacggcgtcgccgttcttccgcgtccgcacctcgtgcgcgagtccgcccagccaggccaggtcgtccgactcgtacagcgcgatgccgtcctcgcgggtcaggcgaacgcccgccctcaccttctcctccagctcgcgcttgagcccgacgtccatacccctacctctttctccgacagattcgcgacagattccgtaaaccgtacgcctggaccgtcacacctcttcgggcagctcacccacccggttctcccacttcgtggacagcacgatggtggtacgggtgcgggagacgcccttggtgcccgacagccgccggatgatcctctccagtccgtcgacgtccgcggcgcgcaccttgagcatgaaggagtcgtcgcccgcgatgaaccagcagtcctcgatctcgggcaggtccttcagccgctgcgcgacgtcctcgtggtcggcggcgtcggagagcgagatgccgatcagggcggtcacgccgaggccgagcgaggcggagtccacggtggcccggtagccggtgatgaccccggcggcctccagccggttgatgcggtcggtgacgctcggccccgacaggccgacgaggcgccccagctcggcgtaggaggcccgtccgttctccctcagggcctggatgagctgcctgtccaccgcgtccatgcgatcgaagccttccgctgaaagaagttcctgaagttctgaagtatcgagtggtgctggtgctgctggtacttgctggtactgctggtcagtactactggtcactgccggtcggtactaacggtcgcggtcggtcgttactaccggtcgcggtcgcggtcgcgg

SEQ ID NO: 114 - DNA, 6014 bp, Unknown
  Kingdom: Bacteria, Phylum: Actinobacteria, Class: Actinobacteria, Order: Streptomycetales, Family: Streptomycetaceae, Genus: Streptomyces
gtgccgccgggccgcggccggtcaggtcccccggccgcggcccggcggcaccgtcgccccggccgccttgaggcggacgctcgggctgcatctccggctgacccacccggcactccctactggctggtgacgttctgccccttcctacccccgggcgggtggcggaaaggagggaagcaccgcttttccgcccggaagaggggcttgatcaggtataggactcacccggaactcactcgaaagagtggcggcgcgccgcccgcccggagcacgtaggctcgtgccagcggggaatcgccggacgcgccggcggacggaccccgcccggacacccggaccaccctccggggcgcccggacacgccgtacgaaaacaggagccgatcgtgattcccggtggtggccagcccaacatgcagcagctgctccagcaggcccagaagatgcagcaggacctggcgcgggcccaggaggaactggcgcagaccgaggtcgagggacaggcgggcggcggcctggtgcgggccaccgtcaccggcgccggtgagctgcgcgccctgaagatcgacccgaaggccgtcgaccccgaggacaccgagaccctcgcggacctggtcgtcgccgcggtccaggcggccaacgagaacgcccagaccctccagcagcagaagctcggcccgctcgcccagggtctcggcggcggcagcggcatccccgggttgcctttctaggcggcccgcgggcaactaccgtacgtaccgaagcaccactcaggaaggacggcagtccggtgtacgaaggcgtggtccaggacctcatcgacgaactggggcggctgcccggcgtcggtcccaagagcgcgcagcggatcgccttccacatcctgcaggcggagccggcggacgtgcggcgcctcgcccaggccctgacggaggtgaaggcgaaggtccgcttctgcgccgtctgcggcaacgtggcgcagcaggagctgtgcggcatctgccgcgacagccgccgcgaccaggccgtcatctgcgtcgtcgaggagcccaaggacgtcgtcgcgatcgagcggacgcgcgagttccggggccgttaccacgtcctcggcggagcgatcagcccgatcgagggcgtgggcccggacgacctgcgcatcagggagctgctggcccgcctcgcggacggcacggtcacggaactcatcctggccacggaccccaacctcgagggcgaggcgacggcgacgtacctcgcccgcatgatcaagcccatgggcctgaaggtcacccgcctggccagcggcctcccggtgggcggcgacctggaatacgcggacgaggtcaccctcggccgcgccttcgaggggagacgactcctagatgtctgacgccacgctgcacgcgaccagccagaaccccgacgacttcgcggtccagatcgccgaccagatcgagagcttcctggtcgccgtcaccgaggtcgccaagggcgacgagccggactccgcggtgcccttcctcctcctggaggtgtcccagatcctgctggccggcggccggctcggcgcgcacgaggacatcgtccccgacgagcgctacgagcccgacccgggccccgagcaggacgtggacatcctccgcgagaacctggcccgcctgctggagcccatcgacgtctactccgaggtcttcgacccctacgagccgcgccgcgccccggtcccggcccgtatctccgacgacctcgccgacgtcgtcaccgacctgcgccacggcatggcccactaccgggccggccgcaccacggaagcgctgtggtggtggcagttctcgtacttctccaactggggcggcaccgcgtcggcggcgctgcgcgccctgcagtccctggtcgcgcacgtccgcctcaaccagcccctggaagaactcgacggcctggacaccgaccagggcgtgggcgacgagaccctggagttcgaggcgggccgggtcatggcggaggagatcggcggacctctggggatgcgcggggcgcagtagagcggcctgcgtgccccgtccggcgaggcgacggcggctgtgacgccgcccacgttccgcgtgccggtccgtaccctgggcatgagccgtcctgggaagcgggcgccgggggtctcagcatgcggtatcgcagaggggaatttcggacgctcgatagactgagtcgaccgcaccgcacctgcgcgggtgcggcagacatggactgagcgaggagcgcacgtgggccttgtcgtgcagaagtacggaggctcctccgtagccgatgccgagggcatcaagcgcgtcgccaagcggatcgtggaagccaagaagaacggcaaccaggtggttgtcgtggtctccgcgatgggcgacacgacggacgagctgatcgatctcgccgagcaggtatctccgatgccggccggccgggagttcgacatgctgctgaccgccggggagcggatctcgatggccctgctggccatggcgatcaagaacctgggccacgaggcccagtcgttcaccggcagccaggcaggtgtcatcaccgactcggtccacaacaaagcccggatcatcgatgtcaccccgggccgcatccggaccgcgctggacgagggcaacatcgccatcgtcgccggtttccagggcgtgagccaggacaagaaggacatcaccacgctggggcgcggcgggtccgacaccacggccgtggcgctggccgccgccctcgacgccgaggtgtgcgagatctacaccgacgtggacggcgtgttcaccgccgacccgcgcgtggtgaagaaggcccggaagatcgagtggatctcgttcgaggacatgctcgaactggccgcgtccgggtccaaggtgctgctccaccgctgtgtggagtacgcccgccggtacaacatcccgatccacgtccgttcctccttcagcgggctgcagggcacgtgggtcagcagcgagccgattcggcagccgagtgagcaaggggaacagcaggtggagcaggccatcatctccggtgtcgcgcacgacacctccgaggccaagatcacggtcgtcggtgtcccggacaagcccggcgaggccgcctccatcttccggacgatcgccgatgccgagatcaacatcgacatggtcgtgcagaacgtgtccgccgcctccaccggcctgacggacatctccttcacgctgcccaaggccgagggccgcaaggccatcgacgcgctggagaagaaccgctccggcatcggcttcgactcgctgcgctacgacgaccagatcggcaagatctccctggtcggcgccggtatgaagaccaaccccggcgtcacggccgacttcttcaccgcgctgtccgacgcgggcgtgaacatcgagctgatctcgacatccgagatccgtatctcggtggtcacccgcaaggacgacgtcccggaggccgtgcgcgccgtgcacaccgccttcgggctcgactccgacagcgacgaggccgtcgtctacggcggcagcggacgatgaccgtccaccgccgggcccgccggtacggaggcgtacgacgatgaccgtacgaccgacgctcgcggtcgtgggagcgaccggagccgtcggctcggtgctgctccggatcctgtcccagcgcgcggacatctggggcgagatccgcctgatcgcctccccgcgctcggccggccgcaagctggccgtgcgcggcgaggagaccgaggtcctcgcgctgggcgaggacgtcttcgacggggtggacatcgccctgttcgacgtacccgccgaggtcgccgcccagtgggtgccggtggccgccgcccggggcgcggtcgtcgtggacaactccggtgccttccgcgccgaccccgacgtgccgctcgtcgtccccgaggtcaacgcgcacgccctgcggcgccgcccgcgctccgtcgtcgccagccccgactgcaccacgctgacgatgatcgtggcgctgggcgcgctgcacgccgagttcgggctgcgcgagctggtggtctcctcgtaccaggcggtgagccaggccgggcaggagggcgtgcggacactgcgccgccagctgtccctggtcgccggtacggagctgggcaccggccccggtgatgtacggcgggccgtcggggacgacaccgggcccttcccggaaccggtcgcgctgaacgtggtgccgtggaccggggcgctgtgcgacgacggctggtcctcgcaggagatggcgctgcgcgacgagtcccgcaggatcctcggcctgccgcagctgccggtcgccgtcacctgcgtacgcgtcccggtgatcaccacgcactcgctgaccgtgcacgcccgcttcgagggcgaggtcaccgtcgacaaggcccgcgagatcatcgccaccgctcccggggtggtgctctacgacgatcccgccgcgggcgagttcccgacgcccgccgacgtggtcggcaccgatcccacctgggtcggccgggtgcggcgcgcgctcgacgaccccacggcgctcgaactcttcgtctgcggcgacaaccagcgcaagggcgccgcgctcaacatggcgcagatcgccgaactggtggccgccgaggcggaatgattcccggagtgagtctccgtcacggacggaaaagccctggccacagccgggtccctttgtaggatctgtgtaagaggtgtggaccacatgttgatccttgccacttgaaccgtgctgcctcggcgtccgaagattctccctgtcgccctccgcaaccgcgcgcagggcgacaggcgtctttgcgggcgcctgccgggcgcgtggggacgccgaggggcgcgggggcgcgccccggtcgcttcgcgggatgccgcgacaaagggaagagcgggacgcatgagggcatgtggggcaccggtcgttgtgctgcctgacgcgagaacgtcgtcggacgcgccaccgggcccgtccggcgcaaaagtgacgtccggcgcgtacaacccccgagggggcaggcgtgtccaactggcgtggcagaggtactcgacttcagtgcggcgacccgcggcgccgctctgcggccgccccgcgcggcgctccgaccgcgtaggcccgggatccccggcatcccgggccgtcccggtgtgtccggtcagcccggcgcgtcccgcccctccggcgtgcccggcccgtccggtggcatgccggtgatcgcccccatgcccgccgcgcggcccgcccgcataccgaaccagcgtgaagccgccgacgacaccgtcgcggccggcaccaccgtcgacctcctcaccgagacctaccgcgcccactaccgctccctgctgggtcttgcggcgctcctcctcgacgacacggcctcctgcgaggacgtcgtccaggaggcgttcatccgcgtccactccgcgcgcaaacgcgtccgcgaaccggagaagacgctcgcctacctgcgccagacggtcgtcaacctgtcccgttcggcgctgcgccgccgcatcctcggcctgaagctgctgtccaagccgatgccggacatggccagcgcggaggagggcgcctacgaccagctggagcgcgactcgctgatcaaggcgatgaagggcctgcagcgccggcagcgcgaggtgctggtgctgcgctacttcgcggacatgaccgaagcacaggtcgccgagaccctcgggatatccctcgggtcggtgaaggcgtacggctcgcgcggcatcgccgcgctccggatcgccatggaggcacgggcatgagggagaacgccgaggggcgcgactcgcacgagcgccacgagccctacgcgtggcacgagccgacgcgtccggagcagcaacacgacacgccgacgcacgctgggaacggaaccgtgaacgacagccctgacgcaaagggcggcccggaccccgagggcgacgcgcccgcagagaacccgacggagacctccgaagagaacccgacggagacctc

SEQ ID NO: 115 - DNA, 1228 bp, Unknown
  Kingdom: Bacteria, Phylum: Actinobacteria, Class: Actinobacteria, Order: Streptomycetales, Family: Streptomycetaceae, Genus: Streptomyces
gcccgccctcgaccgggcccgcgccgacctgcgccgggcgatgcgggccggcgagccggtcagcgacgagatggtcgcctccctcatcctcccgctggtcgacaaggcggtcccggaatggcaggccgcgctggacgtcttcctgtcgctgcccgagatcggcggtccggtcgggtactcggggggagtgatctccatcggcatccggctggcggtggtcgagccgcgcatcgccgccgccggtctgttcgcggggagtcttgtgcctcgcgtcatgttcgaggaagcccggcaggtcaccattccgctgcatgtcctgctccagtgggacgacgaaggcaacgaccggcaggcggccctggacctgttcgacgccttcggttccaaggagaaatccctgcacgccaatatgggcggccacaccggcgtcccgcagttcgcgggggacgcggcggcccagttcttcacacggcacctgaagtcgggccgggccgtcagagcggcagcagacggcagctgatgtcggcggcgtaccgctcatcgaggacaggtcccggccctccgtgaccgtccacaccgtgggcccctgctgaactctcggcaggggccccgtgctgcctgagccagggccgacggtcgcggtgaggccggggaagacgaagaagcatcgaccgcggcaggtccgctccgcccctgctgcgcgtgggcagttgatgcgctggtggggccggcggccctcttgccggaccgcgaagaaggcgagggggcggacccggtcccgccccgtgcatggccgcccgtgccggacggatgctggacgtggctgctgcgcgcgagacactggtcaagatccacccggtcacgggtctgttccagcgtgcggtggtcttcggcaggcggaaaggggcgtgtccggtggtggccgcggtgtgccccggcgcgcgtgtaacagggctgcatcagggggcggtcgcgggaacggctcgccctggctgaccagtcctgttggtcagaaaggctcgctggtaccgactccaccgactcgtgcggaggcgtgcaggacggtaccgaacggccggtccccacaaccgatccgaggaaaagacgatgcgcgttcacaagctgaccctcgccgctctggccgtcaccgcgagcctctcgctcaccgcctgtcagaacgacggcggcggcacgacgggacagagcgacccgtcggccgccgccgtcg

SEQ ID NO: 116 - DNA, 1330 bp, Unknown
  Kingdom: Bacteria, Phylum: Actinobacteria, Class: Actinobacteria, Order: Streptomycetales, Family: Streptomycetaceae, Genus: Streptomyces
acgaggagggtgcggtggctgcggcgcgacagcggcagcagccggccctcgttgaccagcagggtcgtggtccgctcggcgatgcggtcggccgccgccaggtgctcgcgggtgccgacctggtgcgccacctggcgctcggatacgtacgggtcgtcgaagaggcccctgcgcgccttcatccgcagaatgcgcaggatcgattcgtcgagccgggcctcggtcagctcgccgccgcgcacggcgtccaggaccgcgtgccaggcgacgtccaggtccggcgggttgagcaactggtccacgccggccttcagcgcgagcacgggcacccggtcgtcgccgtacttggtgcgcacgccctgcatgccgagcgagtcggtgatcaccacgccgtcgtagcccagctcgccgcgcaggatgccggtgaggatggggtgggagagcgtggccgggtctccggagtcgtcgagcgccgggaactggatgtgcgccgtcatgatcgagtcgatcccggccctgatcgccgcccggaacggcaccgcgtccagcgtctcccacacctcacggctgtgcgtgatgaccgggaagccgtagtggctgtccacggccgtgtcgccgtggcccgggaagtgcttggccgtcgccgcgacccgcgcgccctgataacccttcacctcggccgccaccaggtgggccaccgcctccgggtcggcgccgaaggagcgcaccccgatgaccgggttggccgggttgacgttcacgtcggcgtcgggcgagtagtcctggttgatgcccatcgcgcgcagctcggtcccggagatccggcccagggtgcgggcgtcggagacggaacccgaggcaccgacggccatggcgcccgggaagagcgtggcgggcttgcccacccggcagacgatgccgtgctcctggtcggtggcgaccagcacgggcagaccgcgcggctgctggagggaggcccgctggatgccgttggacagggcggcgatctgctgcgggtcacgggtgttgtgggcccaggtgaagtagatgatgccgccgacgcggtacttcgcgaccagctccgcggcggtgcggacgccgatctccttgaggttggcgtcgatgtcggcctggtcggggtcggtggccgagtggccgtagacccgcatcacgaacagctgcccgaccttctcctcgagcgtcatccgcgagaggaggtcgcgcagccgccgctcgtccgggcgggcggcggcggcctccgcggtgccggtgcctacggcgagggcggcggtgagggtggcggtggcggcgaggacggtgcgtctggagg

SEQ ID NO: 117 - DNA, 7829 bp, Unknown
  Kingdom: Bacteria, Phylum: Actinobacteria, Class: Actinobacteria, Order: Streptomycetales, Family: Streptomycetaceae, Genus: Streptomyces
acgacgaggccccgcctgccccagacggccggacaagccggtagcgggacctgtcggccccgcacgggccgacaggccggtaagcggcccggcagacccgctcccgggccgccaggccccggccccgacgcccggcccgcagcccgaaagcccagccccaccccaaaaccctgccccggacaaacgcccgccccgaacccgaagggccgggcacccatacggtgcccggcccttctccgtgtgccgctccctcaggagccggtctcacttcttgcggcggcggccgcccttcgcctgcttgcggcgctccgcgcgcgtgaggccgtcggactcggagcgcaccggctcgtcgtcgctggcgaactcgccctcgacgacgccgccctccccgtccacggtcggcgccgagaagtgcaggtcacgccgctgcggcgcgtccaggcccttcgcgcggatctccggacgcgcccccgcctgcgcgggcaccgcgtcctgcggcgccttctccagggacggcgcctcgtcctcgaccgggacctcctcgacctgctgctcgacctggacctccaggttgaacaggtagccgacagactcctccttgatgccgtccatcatcgcggagaacatgtcgaagccctcgcgctggtactcgaccagcgggtccttctgggccatcgcgcgcaggccgatgccctcctggaggtagtccatctcgtagaggtgctcgcgccacttgcggtcgagcacggacagcaccacccggcgctccagctcacgcatgatctccgagccgaggtgcgtctcacgcgcctcgtactgctcgcggatgtcgtccttgatggagtcgccgatgaactcggccgtcagacccgcgcggtccccggccgcctcctccagctcctcgacggtgaccttcaccgggtagagctgcttgaaggcgccccacagccggtcgaggtcccagtcctccgggaagccctcggccgtctccgcctggacgtaggcgtcgatcgtgtcgtccatgaagtgctgcacctgctcgtgcaggtcctcgccctccaggacgcggcgccgctcgccgtagatgacctcgcgctggcggttgaggacctcgtcgtacttcaggacgttcttgcgggtctcgaagttctgctgctcgacctgcgactgggcggaggcgatcgcgcgggtgaccatcttgttctcgatgggcacgtcgtccggcacgttcgccatggacatcacgcgctcgaccatctgggccttgaacagacgcatcaggtcgtcgcccagcgagaggtagaagcgggactcgcccgggtcgccctgacggccggagcggccgcgcagctggttgtcgatccggcgcgactcgtgccgctcggtaccgaggacgtagagcccgccgagattcttgacctcctcgaactccgccttgacggcctgctcggccttctccagcgcggtgggcagggccgccgaccactcctcgatgtgctcctcggggtcgaggccgcgctgacgcagctccgcctcggcgaggtcctcggggttgccgccgagcttgatgtccgtaccacggccggccatgttcgtcgcgaccgtcacggcgcccttgcggccggcctgggcgacgatgctcgcctcgcgctcgtggtgcttggcgttgagcacctcgtgctggatgccgcgcttgctgagctgctgcgagaggtactcggacttctcgaccgaggtggtgccgaccaggatcggctggcccttctcgtgcttctcggcgatgtcgtcgacgaccgcctcgaacttggcgacctcggtgcggtagatcaggtccgactggtccttgcggatcatcggcctgttcgtcgggatcgggaccacgccgagcttgtagatctggtggaactcggcggcctcggtcatcgccgtaccggtcatgccggagagcttgttgtagaggcggaagaagttctgcagggtgatcgtggcgagcgtctggttctcgtccttgatgtccaccccttccttcgcctcgatcgcctggtgcatgccctcgttgtagcggcggccggcgaggatacggccggtgtgctcgtcgacgatcatgacctcgccgtcgatgacgacgtagtccttgtccttcttgaacagttccttggccttgatggcgttgttcaggtagccgacgagcggcgtgttcaccgactcgtagaggttgtcgatgcccagccagtcctcgaccttggagacgccggcctcgtggatggcgaccgtgcgcttcttctcgtcgacgtcgtagtcgccggtctcctcgagacccttgagcgggttgcccgcctcgcccttcttcaggcgggtgaccagcttggcgaagtcgccgtaccacttggtggcctggtcggccgggccggagatgatcagcggcgtacgggcctcgtcgacgaggatggagtcgacctcgtcgacgatggcgaagttgtggccgcgctggaccagttcgtccttcgaccaggccatgttgtcgcgcaggtagtcgaagccgaactcgttgttcgtgccgtaggtgatgtcgcaggcgtactgctcgcggcgctgggccggcgtcatgttggcgaggatgcagccgacgtccaggcccaggaacttgtggacgcggcccatcatctcggagtcgcgctcggccaggtagtcgttgaccgtgacgatgtggacgccgtctccggaaagggcgttgagataggcgggcagggtgccgacgagcgtcttgccctcaccggtcttcatctcggcgacataccccatgtgcagggcggccccgcccatcagctgcacgtcgtagtgccgctggcccaggacgcgcttggccgcctcgcgaacggtggcgaacgcctcgggcagcaggtcgtccaggctctcaccatcggcgtaccgctgcttgtactcatcggtgagggcccgcagctcggcgtcggagaggtcgacgaagtcctcttcgatggagttgacctggcccgcgatgcggtgcagcttgcgcaggatcttgccttcgcctgcacgcatgatcttcgagaggacggacacgggggttggtctccttgccggtcgggcctgggacggtcgggtttccatttgacttgactgagcaacggccatcgtatgcgaggaccccgcccagccgggagtgcctgccgcgaggccactcctgcactgcgcttcgcgtcgccttcgaagggaacaacggccgagggtcacggatggtgccgcgttctccgcgcgaattgcgcgaagggtgatcacttgctcacgcacggagaaacaagatggcgtccggcgcggtccttgagcagaatcagccgatggaacccgtgacgctcaccaccggccgcctcgtcctgcgcaccgtcggtccgaaggacaccgacctggtgtacggcgccgtgcaggaccccgacatccagcgctggacgacgatcccctccccttatctgtacgagcacgcgcgcagcttcaccgagcagatggtgcccgacggctggagcgacggctcgatgttcaccttcggcctcttcctgcccgaccccgcgaacgacctcgtgggcatgctgggcatcacccggcgctccctgggcgtggccgagatcggcttctggggcaccaaggagcaccgcggccacggctacgtcaccgaggcgtcccgtgccgccgcccgctgggctttcaccgacctcgccgtggaccggctggagtggcgggccgaggtcggcaacaccgcctcccgcgcggtcgccgaacgggcgggcttcacgatcgagggcacgctgcgctcggccatcgacaacaagggagtacgacgggactgctgggtgggctccctgctcccctccgacctggaactggcgtcgacggcgccctacctgcccgcgcgtccctagggcctgtccggcggatcatgccgcagacgcggggtgtggctcctactcccccgagctcttcgagcagggccccccagcggcgttgtcgtcggttgccgactccccacgcccggcttcgctcgcgcgggagggcccccatcgcgtcgacgccctcctccgccttgcagccgcacgcaccacaccccgctcacctgggcacacagggcgccgtgcctttcctgcgacttgatccgccggacaggccccgggctccgtcgccccctcggctcctccgtcgaacgcccaggtcgggccgcgctgtcagtgcccgcccctatcgtgccgagcatgacgaccgtcccgcgccccaccgccgacctgtcggcggacgaagcccgccgtatcgccctgcgcgcccaaggcctcctcggcgcccccgaccggaagtccggtgtgcgcggcgtactgcgccacctcggggcggtccagctggacaccatctcggtcctcgcccgctcccacgaactcatcccctacgcccgtctcggcgcggtcggccgcccgagagtcgagcaggcctactggagcggcacgcacgccttcgagtactggtcgcacgccgcctgcgtgctgcccatcgaggagtggccccacttcgccttccgccgccgcgcctaccgcaaccgcccgcactggaaccaccagctccccgacggcacctacgaccaggtgatcaaacagctgaccaccgaaggcccgctgacggcgacggagttgggcggcgccaagcggaccagtgaatggtgggactggtccgggaccaaggtcgccgtcgagcgcgccctgatgtacggcgaggtggtctgcgtcgagcgccgcggctggaagcgggtgtacgacctggccgagcgcgccgtcccgccggcgttgctgcacgacgagctggacgacaccgagtgcctgcgccgcctggtccggctggccggccagtccctcggtgtgggcacgcgcgcggacatcgccgactaccaccgcctcaagggcgagcaggtcgaggcggtgatcgccgactccgggctggtcccggtcacggtcgagggctggtccaagcccgcctgggcggaccctgcggccctggagacagccccgcgcgggcgtcaccgcaccacgctgctgtccccgttcgactccctgatctgggaccgggcccgcaccgaacggatcttcggcttcacccaccgcctggaggcctacgtccccaggcccaagcgggtccacggctacttcgcgatgccggtgctggcgggcggccggctggtcggccgggtcgacccggcccggcagggaagcaccctggtggccaagcaggtcaccctggaggatccgaaggcggtccccgcggtggcgcaggccctggtcgaggcggcgagctgggtggggatcacggacgtgcgcgtggagcgcgtagatgcaccgggcctgcgcgagccgctcacccgggaggtgacccgggcgctgaccgcggcgctgcgctgagcgggcccgcccgccgagtcggctgggccggctcacggcagggctcagcggatctcgaggatcttctcccgcatcgcgtacaccaccgcctccatcctggagtgcaactgcagcttctccaggatgttgcggacgtggttcttcacggtgttctcggagatgaacagctccttggcgatgtcccggttgttcatccccgtcgcgacgagcttgagcacctccagttcccggtcggtcagccggggagcgggcaggaggcggcgctcgtcggtgcgctggatcatcgacttgaactcggtgagcagcttcgacgccatggaggggctgatctgcgactggccgtcggccacggcgcgaatggcggtggacacctcgtcggtggagatctccttgaggaggtaaccggtcgcgcccgccttgatcgcgtcgtagaggtcggcctcctcgtcactgatcgtcagcatgatgatcttcgcgctgggggcgacctccttgatcgaggtgcacgcctcgatcccgccgcgccggggcatccgtacgtccatcagcacgatgtcgggcagcaggtcggctgccttgtccacggcctccgcgccgtcgcccgcctctccgacgacctcgatgtcctcctcggcggcgagcacgatctccagaccgcggcggaagagggcgtggtcgtccacgaccaggaccctgatcggctccgcgcgggacgcgcccgcgtccgggaccatgccggcgacaccgcggccggcgtcatggtcccgcatcggtccgaagctgtccgtcatcgttgttcctccccctgaggctgtggcccggtgtgcggtgacgcggccaacccgaggcaacggcccagccgttggaccgttgcggccatgattccatgtccggccgccaccgcggtggccaagcggtgcgcgaaggggtcgcacaccggtgcccccgggggcgcacccgcgcactccgggggcaccggctcggccgccggccgccgaccgggtcgtcagccgcccagggtgccgcccgcctcgggagagttctcctgcgccaccatcgtgtccgtcctgaggtggatcacgccgtagtcgtaggcgtgccgccggtagacgacgctgggttccttggtctcggagtcgacgaacaggtagaagtcgtgcccgaccagctccatctcgtacagagcctggtcgagggtcatcggagaggcgacgtgggtcttctcgcggacgaccagggggccgtccccctgcacctccagcgatccgaccttcttcgtgggcacctggcccgcagcttcttccgcggcggtcagcccgttgccgttcagcgtggccgcgcccgggacgtggtcgggaacctccgccgccgagatgcggcgcgcgccccggcgtgagaatcgcttgtcgtgctgcttgcgcagccgggcccccagcttctccgcggcgaggtcgagcgccgcgtacggatcgctggccgctgcctccgcccggatcaccggaccgcgggagcggagcgtgatctccactcggtcgcagcggtcggcctgccgggggttgggctccttggacacctcgacgtcgaggctcatcaccttgccgtcgagcttctggatcttctccaggttcagcttctcggccacgtgcttgcggaaccgctcgggcacctctgtcttgcggcccttgacgacgatgtccacgcagaactccgttcccggatcgctccgcttcgccggcggagcatctccctttcgcacccggttccggtcaggtccggaacctcggactcggtgacgtccacctccccttccccgccgggcgagatctccaccctgccggtacgggtgattgcgaaaagcttgcaacccgcggcacggcattcggttatgacgggaacggcctgcacctttccctcaccacccgaacatatctcgcgaggcgggacggcgtcaccctctaccgcggcgtacctccgtccaggtgaattatccccctcattacctgcaacgacgcatgtccactgtcagttccggtttatttcgaaggaatccggagaagctgcgacgacggccgcacagatcacttcaccggcgccgccggctcccgccaattccgatgcgctgtacaccgagttcccctccttccgtcgtgttaccggctttcgttcccccatcccttcccgcgcctgcgccgcgtacacggccgacctcaccgcacgcgccgcctccgccagtgaggcacccgtcgtcatcaggtcgtcgaccagcacgacggacccctcccgcagcagccgcgcaccgcccgcggccacctgcagtgcaccggcgaggttctccagccgctgccgggaacccagcgtcgactggtcggccacggcgcgccg

SEQ ID NO: 118 - DNA, 952 bp, Unknown
  Kingdom: Bacteria, Phylum: Actinobacteria, Class: Actinobacteria, Order: Streptomycetales, Family: Streptomycetaceae, Genus: Streptomyces
aggcacgactggagcgcggcgagaccggtgttggccgcggccacctcggcggccagcgcctcgtccgcgccgccgcgccgggccaggaccgccaggaagcccttgtccacctgggaccgcccggagtgcaggtcgagatggccggccgccagcttggacagtttggcgaaaccgccgcagatcgtgagccggggcacgggatgacggcgtacgtacttcagcaccgcgcccgcgaagtcgcccatgtcgagcagcgcgtcctcggggaggcggtactctgcgacgaccgtcttctccgaggtcgacccggtgcacccggcgacgtgcgtacgccccgccgcccgcgccacgtccacgcccctgcggatggagtcgatccacgccgagcacgagtacggcacgacgatgcccgtcgtaccgaggatggacagaccgccgatgatgccgagccgtgggttccacgtggagcgggcgatctcctcgccgtggtcgacggagaccgtgatctccacgtcaccgccgcctccgtgccgggcggcgacctcggcgacgtgatcggacatcatccggcgcgggacgggattgacggccgcctcaccgaccggcagcggcaggccgggccgtgtgacggtgccgacaccgggaccggccctgaacacgacccccgaaccggcgggcagcgcccggaccgtggcgcgcaccagcgccccgtgcgtgacgtccgggtcgtcgccggcgtccttgacgaccccggccatggcctgcgcaccggtcagctcctcggccgccagcgcgaacgacggcgtctggcccttgggcagggtgatggtcaccgggtcggggaactcgcccgtcagcagcgcggtgtacgcggcggtcgcggccgccgtcgcacaggcacccgtggtccagccgggccgcagcccgctgtgctccaactgccctcgccgcc

SEQ ID NO: 119 - DNA, 10238 bp, Unknown
  Kingdom: Bacteria, Phylum: Actinobacteria, Class: Actinobacteria, Order: Streptomycetales, Family: Streptomycetaceae, Genus: Streptomyces
gtgtccgaggggggacttgaacccccacgcccgataaagggcactagcacctcaagctagcgcgtctgccattccgccacccggacaaggtgtctgtcgtgcggggtttccctcgcggcgacgacgtaaacattaccaggctttccggcgtgcccgatcacccccggccgcaccggccgccacccccggtcgcagccgccgccacccccggccggtccgcctccgcatcacgcgtgaacgcagtgtgacgggccgggaccactcttgggcggagcccggcagggagggaggatgagtggaccaccggcacacgaggtggcccaccagcacaccagcgggaggaagcagcgtgagcgagacggacacggccaggggcgtcaccggcgaggacgaggtcgtggacctctgccgtgagctgatccagatcgacaccagcaactacggcgaccactcgggcccgggcgagcgcaaggccgccgagtacgtcgccgagaagctcgccgaggtgggcctggagccgcagatcttcgagtcgcaccccggccgcgcctccaccgtggcccgcatcgagggcgaggacccgtcgcggcccgcgctgctcatccacggccacaccgacgtcgtaccggccaacgccgacgactggacccaccaccccttctccggcgaggtcgcggacggctgcgtgtgggggcgcggcgcggtcgacatgaaggacatggacgcgatgacgctggccgtcgtgcgcgaccggctgcgcagcggacgcaggcccccgcgggacatcgtgctcgccttcctcgccgacgaggaggcgggcggcacgtacggcgcccggcacctggtcgaccgccacccggacctcttcgagggcgtcaccgaggcgatcagcgaggtcggcggcttctccttcacggtcagcgagcagcggcggctctatctgatccagacggccgagaagggcatgcactggatgaagctgaccgtggccggcacggcgggccacggctcgatggtccaccgggacaacgcgatcaccgagctgtcggaggccgtcgcacgcctcggacgccacaagttcccggtgcgggtgaccaagaccacccgcgccttcctcgacgaactcggcgacgcgctcggcaccgaactggacccggaggacatggagggcacgatcgccaagctcggcggcatcgccaagctgatcggcgcgaccctcagcaacaccgccaacccgacccagctgggcgccggttacaaggtgaacgtcatcccgggcgaggccacggcccacgtcgacggacgcttcctgcccggcttcgaggaggagttcctcgccgacctcgaccggatcctcggccccaaggtcaagcgcgaggacgtgcacgccgacaaggccgtcgagaccaccttcgacggggacctggtggcggccatgcagtccgcgctgctggcggaggacccggccgcgaaggcgatcccgtacatgctctccggcggcaccgacgccaagtccttcgacgacctcggcatccgcggcttcggcttcgcgccgctgaagctgccgccggagctggacttcgccggcatgttccacggcgtcgacgagcgggtgcccgtggacggcctgaagttcggcgtgcgcgtgctggaccgcttcatcgacgcgtcctgaccgccgtcagtttccgcttgaccccgataatcggccgcgtgtgcggacatgactgagaagagtgaatgcgacgataagctcgtagctccattactccctcctcgttacaggtaatgcgatcagcaacacggatcgcttttgccaactaggaggaataatgatcaagaaggtcgtcgctgccgcggttgccaccggtggactggtcctcgcgggcgcgggcctggccgtcgccgactccggagcccagggtgccgccgtgcagtccccgggcgtcgtctccggcaacgtcatccaggtgcccgtcgacctcgatctgaacctgtgcggcaactcgatcaacgtgatcggtctgctgaaccccaccgccgggaactcgtgctcgaacaagtagccgctcctccgcgcggcgggatgcgccccggcccaccggggcacgcccgacgaacgagccgtgccaccgcgaaggtggcacggctcgttcgtgtcctgccccgctgcgcaggcgccgtgcgaggcggtcaggagttcggcgaaggacccggaggccgggctacgcgccgctcgccttcagcatgtcctcgcgctcgacgatcttcacgcgctcccggccctgcggctcgccgagggccttctccgcggcgtcgaggcggtaccagccctcccaggtggtgaacctgacctcgcgctcggcgaggaaggcgtccacggcctccggttcgggcgaggacggggtgtgcagccggccggacgcgtagtcgtccagcaggttggcgaccgtctcgttggcgtcgcccttggtgtggccgatcaggcccaccgggccgcgccggatccagccggtcacgtacgccgactgcacgtgctcgccggtctcgccgatgatccggccgccctcgtccgggacggtgcccgagtcgtcgtcccagggcagcttcggcagccggtcggagaggtagcccacggcccggtagacggccgtgacgtcccagtccttgaaggtgccggtgcccttgacgttgcccgtgccgtccagctcggtgcgctccgtgcgcaggccggtcaccttgccgtcctcgccgaggatctcggccggggactcgaagaagtgcaggaacagcttgtgcggacggtcgccggcgtcccggatcgcccagttctccagcgtcttggcgaccatgtcggcctgcttgttgccgcgccgggtggcgatcgagccctcgtcgtagtcgatgtcctcgggatcgacgatgacctcgatgttgggggagtggtccagctcccgcagctccatcgggctgaacttcgcctgcgccgggccgcggcggccgaacacgtggatctccagcgccttgttggccttcaggccgtcgtacacgttcggcgggatctccgtcggcagcagctcgtcggcggtcttggcgaggatccgcgccacgtcgagggcgacgttgccgacgccgaggacggcgaccttctccgcctcgagcggccaggtgcgtggcacgtccgggtgcccgtcgtaccaggagacgaagtcggcggcgccgtaggaaccgtccaggccgatgccgggtatggacagcgcccggtcggcggtggcgccggtggagaagatcaccgcgtcgtagaaggcacgcaggtcgtccaggctgatgtcgccggggtagtcgacgttgccgaacaggcggatctgcggcttgtccagcacctggtggagcgccgtgacgatgcccttgatccgggggtggtccggggcgacgccgtagcggatcaggccgaacggcgccggcatccgttcgaagaggtcgatggacacgccaggctcggcggccacgccggacttgagcagggcgtcggcggcgtagataccggcggggccggcaccgacgatggctacccgcagggggcgcggcatgatcaggttcccttcgagcggtgaaacgacgactcgacggcaaccctaagctaaggcaagcctaagtgagtacacgggtccggtctatgaggtcataaggcgtgcttatggggacgccaaggtgtggtgatgggtggccgcggggcctgagcctgggcgtcaggtcctgatccccggcgtcgcggcaggacgggacgccgtccgtcgggcatggtggagctgtgatcgggctggccgtgttcttcgccgtcatgggcgccgcgagcaacgccgtgggcaccgccttccagcggaaggccgccgccaccgtgcccaccggcggcggcttgcggctgctcctcgcgctggcgcggcggccggtctggctggcgggcatctgcggggtcgtcgcctccgccatgttccaggcgctggccctggtcaacgggccgatggcgctggtccagccgctgttcatcatggaactgcccttcgccctgctcatcgccggctccctcatgcaccgcggcctgcccgccgcgggctggtgggccgtcgcggcggtggtcggcgggctggcgctcgtcctggtctcggccgctccgtccggctcgcacgaccaggcgcccatggtgcgctggatccccgctctgatcatctgcctgggcgcgatggcgggcgcggtcgccctggcccgccccggccgtcccccgctgctgcgggccgcggtcctggccgtcgccgccgccatcggcaacgcgctgacggccgccatgctgaagtcggccagcggcatcctggacgccgacggcctcgtcgtcttcctcaccacctggcagacctacggcttcgccgtcgtcggggtcagctcgctgctgctcctggagaacgcgctgcaggccggctcgctggccgcttcccagcccgcgctgaccatcggcgacgcgacggtgagtctgctgctgggcgtcaccctgttcggcgagcacgtccgcacgggggtgtggctcctgcccgagctggcgggaaccgggttcatcgtctggggcgtcctccgcctgatccgcgtcgtcccgcacgcccagcagaccctggccggcgagtccgcctccggcgacgccgtccgcccggcgcgccacggcccgccgggtcccgcggacggctgaccccggcagggggtcccccctcggcgcggcgcgcgcgggtgagcgtgccgaacgggctaacaccgaccgtgaagctgtcgtgacggtgcgaaggtgagcgtatccgcgtgtatgcgagcaagccgggcatccgtcggtgcgtggccgggccgccgcccgctgtgccggacggcgctgcgtggcccggcccgctgagcggcgcgggatcgagtcgacgtcttaagccgaaagccgaaggagtccacgggcatgacggacgtatccagcagggggcccgccccgggcgacgaccggaaggtcctcaccaaccggcagggccatcccgtctacgacaaccagaaccagcggaccgtcggcgcccggggcccggccacgctggagaactaccagttcctggagaagatcagccacttcgaccgcgagcgcatcccggagcgggtggtgcacgcccgcggcgtgaccgcctacggctacttcgaggcgtacggcgcctggggcgaggagccgatcggccgccacacgcgggccgcgctcttccaggagcgcggcaagcgcaccgacgtcgccgtccgcttctccacggtcatcggcggccgggactcctccgagaccgcccgcgacccgcgcggcttcgccgtgaagttctacaccgaggacggcaactgggacctcgtcggcaacaacctcggcgtcttcttcatccgggacgccatcaagttccccgacgtcatccacgccctcaaacccgacccggtgaccttcgagcagcagccccggcggatcttcgacttcatgtcgcagacgcccgagtccatgcacatgctggtcaacgtcttcagcccgcgcggcatccccgccgactaccgccacatgcagggcttcggcgtcaacacctacaagtgggtcaacgacgacggccacaccgtcctcgtgaagtaccactggatgcccaagcagggtgtgcgcagcatgaccgaggaggacgcggccaacgtccaggcggactccctcggccacgcgaccaaggacctgtacgaggcgatcgggcgcggcgagtaccccgagtgggagctgctcgtgcagatgatggacgacaacgaccaccccgagctggacttcgaccccctcgacgacaccaagacctggcccgaacaggacttcccgccccgtcccgtgggccgcatggtgctcgaccggatgccgcaggacttcttcgccgagaacgagcagatctccttcggcaccggcgtcctcgtcgacggcctcgacttctccgacgacaagatgctggtcgggcgcaccttctcctacagcgacacccagcgctaccgggtcggccccaactacctccagctcccggtcaaccagccgaagaacgccccggtgcgcaccaaccagcgcgacgggcagatgacgtaccacatcgacggcggcggggcgaacccgatcgtcaactacgagccgtcgatcaccggcggactgcacgaggcgacgtaccccgcgcacgaggagcaggggcccgagatccgcggccggctgacccgtgcgcgcatcccgcgcgccaacgactacctccaggccggccagcgctatctgctgatggagcagtgggagcgcgacgacctggtgaagaacttcgtcaaccagctgtcccagtgcgaccggccggtccaggaacgcatggtgtggcacttcctgctggtggagaacgagctggggctcagggtcggcgaggggctgggcatctctcccgaggacgtggcacggctggagccgctggccggccaggatctcacggacgaggaccgcaagcggctgtccagcctgggcaagaacccgccgcgcgacgtcgagggcctgacgatgacccactgcgtccccgacgagcggcacacggtgacccgctgaggacacacgaagggccggacaccaccgccccgggagggcggccgtgtccggcccctgtgaccttaggggtcccgcgtttcagcggaccgtcagcagtccctgccgcagccgcgccagcagccggttgagcaggcgggacacgtgcatctgggagataccgagccgctcgccgatctgcgcctgggtgagttcctcgacgaaccgcatgtggatgatctggcggtcccgctcgtccagctccgccagcagcggagcgaggctgtggaggtcctccaccagctccatgctcatgtcctcggcgccgatgaagtcggccaggacgctctcgccgtcctcgctgctgctgacggcggcgtccagggacgcggacgtgtagccgttggaggcgacccgggcgtcgatgacctcctgctcgggcaggttcatcagctccgccagctccgtggtggtgggcttgcggccgaggcggctgctcagctcctccgtggccttggccagctcgacccgggcctcctgcagccggcgcggcacgtgcaccgcccacgtggtgtcacggaagaaacgcttgatctcgccgacgatgtagggcacggcgaaggacgtgaactccacctcgcgggccagttcgaaccggtcgatcgccttgatcaggccgatcatgccgacctggacgatgtcctccatctcctgcgggcccctgctgcggaagcggccggccgcgtagcgcaccagggacatgttcatctcgatcagcgtgttgcgcgcgtactggtactcgtgcgtgccctcttccaggtgcgccagccggtcgaagaacacccgggacagggcacgcgcgtcggtcggtgcgacctgcgaggggtcgggcacctccggcagctccgtgcgagctccagccgccttcgcctccatggtcaccgccatcgtgcgccctccctttcagccgatgtccttgccgatcgtgaccgccctgttgcacagcggcggactccgcagcgtctacccggccgtaaaagcctcacacccattatttctccgacgggctcgttccacccgtcgggacccggcccgcggtggccacccgcagccgggcgccctgccggcccagctcctgctggaccagggcgtggggcacctcccgcgggctccgtcccagccgggtcgccagcgccgcgcagacaccggccgcctgcccggtggccatggcgatgggcatcacccggtacgacgagtgcgcgacgtgcgacccggagatgcaccgcccggcgaccagcagccggtccgtcccggcgggcagcaggcagcgcagcgggatgtcgtagaagtgcccgcgcgggacgcgccggatgacggtgccgctgccctccgggttgtggatgtcgatggggtaggcgccgtgcgcgacgacgtccgggaaggcgcgcgcgtccaggatgtcgtagccggtcagccggtagtcccccatgacgcggcgggtctcgcgcaccccgatctgggtgccgctctgcacggcgtacgccttgtcgaagccgggcacgcgcgagcgcaggaaccggtcgatctcggccatctgccgccgggccgtccactcggcccggctcaggtcccacacgtcgatgccgagggcgccggtgacccgcgtgctgttgacggagagttcgtgcgggtgcggggtgccgaagaacagcatgtcctcgcgcggcagccgcagctcgcccgcctccgtggcctcgcggacgaggtcccacagcccgtgcacgccccgccactggtcggggtgggcccggacgtactcggcgaagcgcggcccggcgaagtcggccatccggaacatcagggtcatcggctggacccggccgtcctccgagcgccccacctcgaacggcgcaccgcaggacgcggccacgtcaccgtcgcccgtgccgtccacgacgacccccgcgtcgatcaccacaggacccgacttggtctcgaacaccacccgccagccgtcatccaggggcagcgcggccgacgcgaaggagtggaacagcatccgcaccccggcctcgtccagcatgtccagcaggaccagcttgaacagctccgggtcgaacgggacggtgtagcccgtctccagggacggcggcacacagccgccgcacgcggtgagccggtcgagcagccgccacaggaacccggcgaccaccggctcgccctccccgtggtcggtgggcagcagccggtccccggcgccgtcctcgacgaagaccgcctgccggtgctcgttgtggaaggacatcagcggcatcacgagggcgacggtggcgttgccgcccaggaaggcgtaacgctcgaccagggtcacctcggcgcccgcgtcggccgccgcgtacgccgccgccgtgccggcggggcctccgcccaccaccagcacgtccgtgcgtccgccgtgcagggccgagcgcgcggggacggtgacggtccgcggctcctcgggccggtgcaggacgggcatcacgcctcctgtccggcaccgtggctggtcaccgtgccgtcctgcggcccggggccgagcaggcgcagaccgtgcggcccggccgtgcccgcctcgcgctccggacccgccggatccctctggtccgcgccgtcccggtccatgccgccctgaaccctctggtccgtgccaccctgatccatctggcctatgccgccccggtctactccaccttgaccaatctgttccatatcgtcccggtctccgccatcctgacccatctggtccacgccgtcccggcccagggcgtcccggtccatggcgtcgagcagggccccgcagcgtgcgcaggtctccgccgcgagttcgcgcagtgccccgacccgggcggtgaggtccacccggcgctgcgggaactcgtcccacagccggtccacctccgccagcagcagcccgacctgctcgcgcgccacaccgaccagtgccggcgcgcccagcctgcgcgcgaagtcgaagaccttcccggcgtacggcagcggcagcacgggcagccccgagagcgccgcgaagatcaggaagtgcaggcgcatcccgacgaccaggtccagatggctcatcagtcccagcacctggcccggcgtgtacgcgctgtgcaggatccggccccggtcgggggcggtcatccgggagagcacggcgtgggcgtgccggacgtcgtggcgctccatcggcatgaacaccacatgcgcgtccaggcggcgcaccaggaagtcggcgacgtcggcgagcagcgcgtggtagtcgccctcgtccagtttctccgccgcccggcccggctcgcgcaccgacatcccgaccagccgcgcgttcgccggcaccccctcctgccgcatcatctcggcggtgaacggctccggcggcagcaacagcgccggatccgcggtgacgaccaggtcccgttcgacgcccacctcctccaggaccagccgggactcctggtcgcgcaccaccacctcgtccatgtccgccagcacggtgcgcaccttcgcctacgcggtcggcgcgggcccgctgcacgagagcgacgaccgggaggccgtgcgcaccgtgctggcggac

SEQ ID NO: 120 - DNA, 4376 bp, Unknown
  Kingdom: Bacteria, Phylum: Actinobacteria, Class: Actinobacteria, Order: Streptomycetales, Family: Streptomycetaceae, Genus: Streptomyces
ccggtgcctgcgggcgtacacggcgcacgacacggcggccgtgccggccgccgcggccagcccgaagtcacccatgatcagggcgagttcgtgcgatccccagtcgcatgcggaaccgacggcgtaccccgcgcacacgagtgcgagcaggagctgggaggccagagcgccgaagccgccggccgcggcaggccgccgggaggggcgtgcttgcgagcagggcgggatccggcgcgcgccgtcgagcgcggtcacggtgggagtgggcgggctcaccgggacctcccggtcagggccgcagcgtccctcgcgctccggtgcgcgtgcctcctgcgggcgccgggcccgcggtggcgatgccggtgccggtactgctgggagtcgggccggtcgcggtggccgggccggtcgccgtgctgaccgctcctgcgagcggccgtgtgccagggcctccggcggctccgccgcgtcggatcgttcgtccataggccgtgcatcgcccgtcgcccccctcacagtccgaaatgtccatccccggcgccgaacggtgcgcggcgcagcccctgtcggggacgatacaccagtctcgtcactcagggacatacttcctctacgctccgtgacgaccagcgcatatgcggatacaccccgcgtccagggggtcgcggacggtgcgcggggcggggctagctgtccgccgcgcccgtcgtcaggaccacgttcgcgagcggctcctggttcacgaagcggtgcaactggccgatcagcagacgctccgcacgcggccggaacgccgaggtggggccaccgacgtgggggctgatcagcaccccgggcgcgtgccacagcggatggccctcgggcagcggctcggggtcggtgacgtcgagggcggcggtgatccggccgctctccagctcggccagcagcgccttggtgtccacgacgcctccgcgcgcgacgttcaccaggagcgcgccgtccttcatccgggcgaggaaacccgcgttgaccaggccgcgcgtggcctcggtcaagggcgtggacaggatgacgacgtcggcgtccggcagcagagcgggcagatcggtgagcgggtgcacgggaccgcgcgccgtggtgcgcgcggagcgcgccacgcgcgccacccgcgcgacctcgaacggcacgagccggtcctcgatggccgcgccgatggctccgtaacccacgatgaggacgttcttgtcggcgagcgcggggtggaaaccgccgcgccaccgctcgcggtcctggtcccggacgaagccggggacaccgcgcagggaggcgaggacgagcgtcagggtcagctcggcggtgctcgcctcgtgcaccccgcgcgcgttgcacagcagcacgcccggcggcaggtgcctcaggccgggctccacgttgtcggtgccggcggacagcgtctgcacgacccgtaccgagcgcatgcggtccagcgggcgcacggcgagcccggcgggcctcatgtacggcacgacgtagaaggcgcagtcggccggatcgccgggaaacgcctgctcaccgtcgtctcccccgtcccagaacagatagttcggcccctcggggagcccctcgatctcctccggcgggatcggcagccacacgtcagcagtcatggtcaggaggctatgccaggtgcgcgcggacgcagaggttaggttgggagccgaggagagggagggttacggcgaggtggagcgcaggacgatcggcgcggcgggactcgcggtgggggccgtaggacttggctgcatgccgatgagctgggcctacagcgcgtcccggcggcgtggggaggagtcgttgcgggccgcgcaccgggcgctggacctgggctcgacgctgctggacaccgccgacatgtacggccccttcaccaacgaactgctgctggggcgggtgctgaaggagcggcgcgcggacgccttcgtctcgaccaaggtcgggctgctggcgggcgatcagcacatcgtggccaacggccgccccgggtatgtgcggcgggcctgtgacgcgtcgctgcggcggctgcagacggacgtcatcgacctctaccagctgcaccgggccgaccccgaggtgccggtggaggagacctggggggcgatggcggatctggtgcgggccgggaaggtgcgggcgctcggcctgtgcgcggtgggggtgcgcggcggacgccggtcccgggagcggctgtatgacggaacgatccggcagctggagcgggtgcagcaggtgttcccggtgagcgcggtgcaggccgagctgtcggtgtggtcgccgcaggccctggagtacctgctgccgtggtgtgcggcccggggcgtcggcctgctggccgcgatgccgctgggcaacggcttcctgaccggcacgctcacccccggcgagggtttcgaaccggacgacctgcgggcccgtcatccccgtttcaccgccgagatgatggccgccaaccagccgatcgtcgccgggctgcggcgcgtggcggcccggcacggcgacggcgtgacaccggcccaggtggccctggcctgggtgctcgcccaggggcggcacgtgatcccggtgccgggcacgaagcgggaacgctgggtcaccgagaacgccgccgccgtggagctgcgcctgaccgagcgggacctgacggaactgggacggcttccggcggcacgggggtcgtgggactgaacgcgacggcggtgaaccggggcgcagccgtagctggtgcgcgggccggcggaccggggcgaggggcgaccgggggtgcgtgggttccgggcgatcgggaacctgggaggcgcgggcggtgtatgagaaggagcaaccgccgcgtcgaagggacaagatcgtgcaggctcaggctcgggccgtgaccggcatgctggccgctgccgcgctgctgttgaccgccggatgctcctccggcggaccgccgcccggcgtccgcggggcgccgtcgagcgcgacggtggggtccgcgtccgcttcccccgggcggcccgccgcggagagcgccccacccgccaagggctccgtgaaagtgctgcgcacggtcgcggagggtctgaactccccgtggggcctggccccgctcccgggcggcggcggcctcctcgtctcctcccgtgaccgggcgacgatcacccgcgtcgacgagaggacgggccggaagacggagctgggcaccgtctcgggagtggcaccgcagggcgagggcggcctcctgggcatcgcgctctcgccggactacgcctccgaccacatggtctacgcctacttcacctccgcctcggacaaccgcatcgtccggatgctgtacgacgcgaagaagcccgccggagaacaactgggcgcacccgacacgatcttcaagggcatccccaagggcgtcatccacaacggcggccggatcgccttcggcccggacggcatgctgtacgcgggcaccggggagaacggcgagcgcggccgggcgcaggacacgaagtccctggccggcaagatcctgcgcctgaccccggacggtgaaccggccccgggcaatcccttccccgactccccggtgtactcctacggccaccgcaatgtgcagggcctcgcctgggacaccaagcagcggctgttcgcctccgagttcggccaggacacctgggacgagctgaacgcgatcgcccccggcggcaactacggctggcccgacgcggagggcaggacgggcgacgcgcggttccgcaaccccgtcgcccagtggcacaccgaccaggcctcccccagcggcatcgcctacgccgagggctcggtgtggatggcggggctgaagggcgagcgcctgtggcgggtacccctgaagggcacggtggcctccgccgcgccccaggccttcctcaccggcgagtacggccggctgcgcacggtcgcctcggcgggcggcgacaggctctggctggtcacgagcaacaccgacgggcggggcacaccgaagaagggggacgaccggatcctggagctggaggtgaggtgagcgacggcgctcactgcccgccgggcccgcccccggctgggggtccggcgtccgcttcggacgccttctcgctcctcggcggccgtacgacgacctttcccgaggcgaggtcgatcggtccccggccgggatcgttgtccccgacgtcctcacgggtcagttccagtcgcttccgctcgtcccgggtgtggctccgccccggggcgaacagttcctcgaagacgttgaacacggcccctcccctgccggtcgtgcctccaccgtacggctcaaccggcggcccgggcggcgagcgggtcgccggttgagccgtacggtg

SEQ ID NO: 121 - DNA, 6855 bp, Unknown
  Kingdom: Bacteria, Phylum: Actinobacteria, Class: Actinobacteria, Order: Streptomycetales, Family: Streptomycetaceae, Genus: Streptomyces
  misc_feature (619)..(620): n is a, c, g, or t
cggcgtgagggcctggatgccgtactcgccgaacgcgaccgtcgtaccgcccttggcctgaccacggcgcttcgggtggtgctgcttgcggtgcttgaccctacgggggatcagcatgtcggtcaggcctccgttccggtgctctcagccggagcggcagcggccggagcctcggccttgggggcctcggcggccggagcctgctgctgctgcggcttgcgaccgcgccgctcgccaccgcggccaccacgggccgggcggtcggcaccaccgcgggccgggcggttacccgcacgggccgcagcgttctcggcgcggacctcggcgatgttcttcacgtcgcccttgtagatccagaccttcacaccgatgcggccgaaggtcgtcttggcctcgaagaagccgtagtccacgttcgcgcggagcgtgtgcaggggcacacggccctcgcggtagaactccgagcgggacatctcggcgccaccgaggcggccaccgcactggatcttgatgcccttggcgccggccttcatcgccgactgcatgctcttgcgcatggcacggcggaaggagacgcgggaggagagctgctcggcgacggcctgggcaaccagctganncctgcttgccggtgagcttctcgaggtcgccgcggatgcggtcggcctcggcgccacggcggccgatgacgatgcccggacgagcggtgtggatgtccacacgcacgcggtcacgggtgcgctcgatctcgaccttggagatgccggcgcgctccatgccggacgtcatcatccgacggatggcgacgtcttccttgacgtagtccttgtacagcttgtcggcgtaccaacgcgacttgaagtcggtcgtgacaccgagccggaacccgtgcgggtttaccttctggcccattaccgggttccttccttgctgctgacgaccacggtgatgtggctggtccgcttgcggatccggtaggcgcggccctgggcacgcggacggaaccgcttcagggtcgggccctcgtcgacgtaggcctcggagatgtagaggctgtcggcgtcggtgtggtcgtagttgtgcgcggcgttggcgatggcactgtccagcaccttgccgaccggcacgctcgcggcctgcggggcgaaacgcaggaccgcctgagcctccgtggcgttcatgccacggatgaggtccaccacgcggcgggccttcatgggcgtgacgcggatgtaccgcgcctgggccctggcttccatggttgtcccttcagtgtttgtcatggtctttcacaccccgctgactagcggcgcttcgacttccggtcgtccttgacgtgaccccggaaggtgcgcgtcggcgagaactcgccgagcttgtggccgaccatcgactcggtgacaaacaccgggatgtgggtcttgccgttgtgcaccgcgatcgtgtggccgagcatcgccgggacgatcatcgagcggcgggaccaggtcttgatgacgttcttggtgccggcttcgttctgtacgtccaccttcttgatcaggtggtcgtcgacgaaaggccccttcttcaagctacgaggcatctcaacccgtccttagcgcttcttgttcgtcttgcggcggcggacgatgtacttgttgctcgccttcttgggagaacgagtacgaccttccttctgaccccaggggctgaccgggtggcggccacccgaggtcttgccctcaccaccaccgtgggggtggtcaaccgggttcatcgccacaccgcgaacggtcgggcggacgcccagccagcgcttgcggccggccttgccccagttgatgttgctctgctcggcgttgccgacctcgccgaccgtggcgcggcagcgctggtcgaccaggcggatctcaccggacggcatacgaaggtgggccatcgtgccctccttcgccagcagctgcacagaggcaccggcggagcgggcgaacttggcaccgccaccggggcggagctcgatcgcgtggatcgtggtaccgaccgggatgttgcggagggccaggttgttgcccggcttgatgtcggccccgggaccgttctccacgcggtcgccctgctgcaggttgcgcggggcgaggatgtagcgcttctcgccgtcggcgtagtgcagcagcgcgatgcgcgcggtgcggttggggtcgtactcgatgtgcgcgaccttcgccggcacgccgtccttgtcgtgacgacggaagtcgatcacgcggtaggcgcgcttgtgtccgccaccctggtggcgaacggtcacacgaccggaattgttacggccgcccttgctgtgcaggggacggaccagcgacttctccggcgtggaccgcgtgacctcgacgaagtcggcgacgctggagccacgacggcccggagtcgtcggcttgtacttgcggatacccatttctcagtcctcgtccgatatcggacgatccggaccgccgtcaggcggtcggaccgccgaagatgtcgatacggtcgccctcggcgagggtcacgatcgcgcgcttggtggcggcacgctggccgaagcccgtgcgggtccgcttgcgcttgccctggcggttgaccgtgttgaccccggtgaccttgacctcgaagaccgcctggacggcctgcttgatctgggtcttgttggcgttcgggtcgacgatgaacgtgtacttgttctcgtcgaggagcgcgtagctcttctccgagacgaccggcttgatcaggacgtcacgggggtccgtgtacgacttgctcagcggggtctcgacggtgttcttgccctcggcggcgtggcggcgcgccttggcgacgcgcgcggccttggcggccttggctgccttcgaggcgatggaggggtgacgcgtagccatcaggcctcgctcccttcggtgtcgttggccttgttcgggccggcgacgaaggactcgaaagcggccttggtgaagaccacgtcgtccgagacgagaacgtcgtacgtgttcagctggcccggctccaggatgtggacctggggcaggttgcgggcggacagccacgcggcctcgtcggcgcggtcgacgaccaggagcaggttcttgcgctccgagatcttgccgaacagcgtccgagcggccttggtggaggcggtcgcaccctcgaccacgccggagacgacgtggatgcggttgtggcgggcccggtcggtgagggcgtggcgcagggccgcggccttcatcttcttcggggtccgctgcgagtagtcgcgcggcacgggaccgtgcacgacgccaccaccggcgaactgcggcgcgcgggtcgaaccctgacgggcgcgaccggtgcccttctggcggtacggcttcttgccgccgccgcggacctcgccacgggtcttgaccttgtgcgtgccctgacgggccgcggccagctgcgcgacgacgacctggtggatcagcgggacgctgaccttctcaacgccgaagatctccgcggggagctcgacggtaccggccttctcgcccgccggcgaaaggatgtcaacagtgctcatcggttacctcaggcccccttggccgcggtgcggaccaggacgaggccgccgttcggaccgggaaccgcgcccttgatgagcagcagacccttctccgcgtcaacggcgtggacggtcaggttctgggtggtgacccgctcgttgcccatgcgacccgccatgcggaggcccttgaacacgcggcccggggtggcgcagccaccgatggaaccgggcgagcggtgcttgcgctgggtgccgtgtccggcgccgaggcccttgaagttgtgacgcttcatgacaccggcgaagcccttgcccttgctcttgccggtgacgtcgaccttcacgcccgcctcgaagacctcagcggtgacttcctggccgagggtgtactcggaggcgtccgcggtgcggatctcgacgaggtggcggcgcggggtgacgtcggccttggcgaagtgacccttgaggggcttgttcaccttgcgcgggtcgatctcgccgaaggcgatctggaccgactcgtagccgtcgatgtcgttcgtacgcacctgggtgacgacgttggggccggccttgacgacggtgaccggaacaacacggttgttctcgtcccacacctgcgtcatgccgagcttctcgcccaggatgcccttgatctgcttggtcatctctcagatcaccggcctcagagcttgatctcgatgtcgacaccggccgggaggtcgagtcgcatcagagagtcaacggtcttgggcgtcgggtcgaggatgtcgatcaggcgcttgtgcgtgcgcatctcgaagtgctcgcgcgagtccttgtacttgtgcggcgacttgatgacgcagtacacgttcttctcagtgggcagcggcaccgggcccgcgaccgacgcaccagtgcgggtcaccgtctcgacgatcttcttcgccgaggagtcgatgacctcgtggtcgtaggccttgagccggatgcggatcttctgtcccgccatggctacttcgtagtcctgtctcttcttacgctctggaacccggtggttcccttggtttccctggttcttcgccgacccacgcggtcgggcgtgtcgccctcccgctgacacagatgtcccttgttcgaacatccctgcgggaatgcgcacggccctgccggtaccgcggaccggggatcgaagacccaccgggtgcctggccggtgccgcgcccacgcttcccggaagattcccgtacgtccgccccagcgctgccgtgaggcagttagggcgacgagtactgtgggactcgcttccggtcctcccggcgggaggcgcgcagcatcaacactcgaccgagcaactcggacagtctgccatacgcgacggcagcctggccaatcgagccgaagagattaccccgaaggtgacgcaggtcaaaccggcgggcggtggaggcgggctgcgccgcccggaccccgggggcggaaagcccggtgcgacgctgctggcacggccccgacgccgcacttcgcctgcaccactgcgagtgccggtccgtaggctcccaccgatccgctccggcccttggccgcgatgcccggacccgtggacgactccggcccgccccgaaggccccgcccaggccgtcctgcctgatcgtctccagccggtacacggggtggtccctctcccccgcgatgtcgcacgtacggaccgggccgtccgtgcccggtgtgatctaggcgctgtgcgaggcgtgcgtgacgaagtcggcccaggcggccgggctgacggcgagccgggggccgtcggtgttcttggagtcgcggatgtggatggtggtgggggtgggggcgacttccaggcagtcgttgccgttgctgctgctgctgtaactgctcttgaaccaggtcagggccacttcgacgcagtcgccgggttcgttgctgctgctgtagctgctcttgaaccagtggagttctgcggtgctcatagtctccccagcgctcgctcgatgaaagcctgcgactccctaggcgtgagagcctgcgcccggatcatgccatagcgcagttcaaggatccgaagatccttggggcttgagaccggacggccgttgaacgcgccgtcggagcgcccgatcgccgtgccgtcggcgaacttcaacacctcgaccaggcccgccgctcccgcgtgctcctcacggtcggtcggcatgacctggagcgtgacgttcctcaacttcgatacctccaagaggtgttcgagttgccgacgcagcaccatcttcccaccgtaggggcgttcgagcgtcacctgttcctggacgaagctgagcgtcggggcgggctcccggtcgaagacgaccctgcgagccatacgcgcggcggtttcccgctccacgacgtctacagggagcgcgggctgtctcatctcgtacatcgctcgcgcgtactcctgtgtctgcaacagcccgtggatgttgtggttgctgtacagcagcatctccaccgaccgttcctccagctcggccagctgccgcaccttcttcggataccgggccttcctcatgtcctccatgaaggccctcaggtgcccctgcgccctcaggagctggtccgcccggtccaggaactcggggcgggggatacgagcaccccgctcgatcttgcggatcatgtcctcgccgtagcccatggcctcggccagctcgggcaccgtcaggccggccgcctcacggcagaccttgagcagccgccccaccgcctggaccaggggctcgatctcgtcgcccggttcgacgtcccagcccgcctcgtccacaccctcgcccatggctcctcctccgccgcgcagtcgtacccgtaccaacgcccgggacagccgagacagccgagacaaataccgggacagtgacggtacgtgcaggcgttgtcactgacgtacgtaagcagaggcggccacgctgagtgatgtgaatcaagaactgcgtgcccctgaaaaccaccccggctcccccgtgcggaacttcagcctcctgctgtcccccacgccccgcggcgcccgcctcggccgcctgctcgcggtcgagcaactgcacagctgggggctgccgtcgcatccggcggagcacatcgtcgccgagctggcggccaacgccgccacgcacggacgcgtccccgggcgggacttccggctgctgatgtacgtcgtcggcgacaccctccgcatcgaggtcaccgacacgcacggcgaacgtctgccgcacctcgaacacgccgccgacgacgccgagtcgggccctgggctgcttctggtggacgccctcgccgaccgctgg

SEQ ID NO: 122 - DNA, 6754 bp, Unknown
  Kingdom: Bacteria, Phylum: Actinobacteria, Class: Actinobacteria, Order: Streptomycetales, Family: Streptomycetaceae, Genus: Streptomyces
  misc_feature (246)..(284): n is a, c, g, or t
gcccggtcgcgggcggcctgcgcgttgtccttgtccttgctcgcggcgtacgccgcgttcgaggcgcggctcgctgcctcggccgccgccgccgccgcgttcgcggtctgcgccgcggccagtcagctgggccgtctcggtggactccacggtcgtgcgggctcaccagcatgcggccggggctcgcaacaaggggctccggtcggtgagccggccgatcacgctatcggccggtcccgcggcggnnnnnnnnnnnnnnnnnnnnnnnnnnnnnnnnnnnnnnnctgaccacgaagatccacctcgcggccgacggccagtgtcggccacttgcattcatcctgaccgccggccaggccggagacgcacccgccttcagggatgtcatggcccgcctgcgcgttccccgccctttcggacggccccgcaccaggccagacctggtcttggccgacaaggcgtattcctcccgcgcgatccgcgaccacctacgcggacgcggtatccgggcggtgatcccggagcgggccgaccagcaggccaaccggcggcggcgcggacaggcaggcggtagaccgccggccttcgaccgcgaagcatacaagcagcgcaacaccgtcgagcggtgcatcaaccgcctcaaacagtggagaggcatcgccactcgctacgagaagaccgccgccatctacctggccggactccacgtcgcgggtatcttcctctggtctgctcggtgactcgaacgcgactgcctattgccgcggacgggccgtcaccgtttcgggagtgcgcttctcgccgcgctcttgccggggggtggagggggacggcttctgcgtgaagacggcagcgcacaggatcagggccaccgcgacgatcgtgacggcgtggagcggttcgccgaggagtccgacaccaatgatgatcgccacgacaggcgggatgtaggtcgcggtcgacgcggtcagtgcgccgaggccggccacggcgacgtagtagcagacgaaggcgaatccggtgccgccgacgccgagcccgagggtgacgccgagcagcgccgtcgggtcttgcgcgatggcggtgatgccggacaggtcggtgaccatggtcaggccgagcacggccaggagcatctggtaggaggccgccgcggctgcggggattcccagcgggctgatgaaccggcgggtgtagccgaacgacgctcccaggctggcggagcccagcagcatccacctcaggccggccatgtcgacctcatcggccgcccaggggcgtgccagcgccgctaccccgaccgcccccactaccaccgctgtcgccttgcgcgccgtgagcggctccgtgcggaagaccaggacggcggcggcggtggcgaacagcgggatcgatccgctcagcgcccccgcgatgccgctgtccagccgggccgtgccggccgcgtaggcgtagtagtagaggcccgcggccagcaccgcttggacggcgaagtggtggaagtgacgcagatgccgccatgccagagaccgcgtcgccagggcgaagaccaggacggggacggcgccgaacgccacacgcagcagcgtcgtctgcgccgggctgatgaacggtgcggccatgtgcatgaacaggaagctgaagccccagatcatgcccaaagcgatgtaggccgccacggcggtccggcgttgtgtggtcatggcagcgtgatgacctccccggtcgaggcgccctcgaccgccttctggaatccgcgtgcgacatcggccacatcgaccgggatgaatccggggaagaagtcgccgaagtcgtccaggctctcggtgaacaccgacgggctgatcacgttgatccgccggggggcgatctcgatcgccgccgcgcggacgaatgcctcgatggcgccgttgactgtcgccgcggcagccccggagacgatcggatcgcgcgagggaatcccgctgatcagcgtgaacgagccgcgttcggacacgtggtccaagccggtacggacgagattgatctgcgcgagcgccttctgctgccacgccgactcaaagtcttcgacgccgagctcgaccagcggcgcatagggcacctcgcccgctgccgagaccacggcgtcgacctgcccgacccgctcccacatctccaccagctgcgacgggtcggagatgtcgcagcggacatccccggacgtccggccgacgctgacgatctcgtgaccccgaccacccatcagctcgtggacggcccggcccgcttttcctgctgcacctacaagaatgattcgcataccccgacgctagataccgggccccctcggagggaaaacgcggatacatcatgtgttatacgcttggcgtatgaatgtggagttgcggcatctgcgcgccctggccgccctggccgagtcgaacacgttcaccaccgcagccgccgtgctgggcacgacacagccgaccctgtcgcgcacgatcacccagctggaggagatcacgggggtacggctggtcgaacgcaccacccgggagatgtccctcaccccggccggacgccgattctccgcgaccgcgcgagaactgctcgcgtcgctcaacaccgcactggacgaactgggccacatcgaggcccccgtgcggctcggctgggcctgggctggcttcggccgccacaccgtgccgctgctccaggagtggaagcggacccacgcaggagcggtcgaactcagccgcccgcccgaccctgtagcggaactccggcgcggcgccatcgacgccgccctcgtccgcaggacatcaccctcgccggaaccgctgcccgacctggcgacggccacgctgttcacggagaggctggtcgcggcgatcgcggtgcaggacccccgtgcggcaaagaccagtgtcacgctgcccgagctggcggacggcccggtcgccgtctgcgcgaccgcgcccacggtgaccgaccatctttgggaccacaccggccacactccgcacacgatcagtgtggccaacaccgacgaatggctgacccggatctccgtcggcgacgccgtgggcgtgaccgcagaagccaccgcctacaaccaccaggctcccgacgtggcctaccggcccatcgaggactctccgcctgtggaggtgaccctcgcctggagggccaccgatccgcatccgcaagcccacgccttcgcacagttcgcacgcgactacttcgcccggctcctcgacaccagcaccccgcccttcagcctcaaccacggccaaaacgctgaggaatcgaaggccccgtgagcaccagccactcacgctccggaccgaccgcgagcagctcatagacacatccaggggcttcatccgcgcccaaagtgtcaggcaacggcgtaccccggccaacggtcggatgatccaaacgaaactgcctagtccctccccgagggcgtcggtgcgggactcgtcgcctgttcgcttcgccgcagcatcggccttgctctccgcgtagcttccgtacgcgctcgaatacggtacggtcgccctctcttccgccggtccctccagcgactcaagtgctgttggtcctgtctcagcgaagttagagtaatcgtcaagacctgtggatcggttgatctcactttcgttcaggtgagttgatcgcgacgagttcgacttcgaacccgtcgtcgttctccaggtaggccgcgtagtgctgtccgccaccggcgtatggatgccgttcggggaacatcaggtgccagccgtgctgggtggcgtcggccgccagcttctcgaccgtcgtggcgtcttcgacgtggaaggccaggtggttcagtcctgggcggcagcggtcgtactcttcggcggtgagggccggcgactgctcgatgaccaggtaggtcggcccgagccgccagctgcggccgccgtcccagctctggaagagggcataccccagcgcctccagcagccagccgagcgaggcgagcgcgcgatgcaggtccggcacccacagctcgacgtgatgcagcgtgccgtgcgacggccggctcatgcggcgaccgcctcggcgcgttcgacgagctggccgcgttcgaagcgagctccggcccggacgagggcgacgaggtggggtgcgttcaccgcgcgccaacttgctgggcggactcgacgagcttgaagaccatgacgagggccgcagtggcagtgcgggagccggcaccgcgggtgaccctggtccgcagtcggacggtggagaacgtggactcaatggggttcgtggtccgcaggtggatccagtgctcggccgggaagccgaagaacgccagcagttgctcctggtcatcagtgatcttcttgacggccttggggaacttcgcgccgtagagccggacgaacgtcttgatcgccgcctcggcgtggtcgcggtcctcggcgttgtagatgccctggatcgccttcttcgcgcctggctgcgcagacttcggcatggcgtccaggacattggccgttttatgaacccagcacctttgctcgcgggtttccgggaacacctcggccagggccttccagaagcccagggcgccgtccccgaccgcgaggacgggggcgcgcatgccccggcgggcgcagtcccgcagcaggtcagcccacgactcgcccgactcgcggtagccgtccttgagggcgaccagctccttggagccgtcggcgcggaccccgatgagcaccaggacgcacgccttggccccctccaggcggacgttgaggtggatgccgtcggcccacacgtacacgtagtcgacctccgacaggtcgcggtccatgaacgcggcgtggtcggcctgccactgctgcgtgagccgggtgaccgtggccggggagagccccgccgcgctgccgaggaactgctccagggcaggcacgaagtcgccggaggacagaccgtgcaggtagagcagcggcagcacctcgctgatctccggcgacttgcggcaccacggcggcaggatcgcggaggagaaccgcttgcgctcgccggtggcttcgtcgatgcgcttgtcgttcacccgcggggccttcacctccactgccccggccgcggtggtgaccttccggggctggtggtagccgttgcggaccacgagccgccggccggtctcgtcgcgctggtcggccaactcggctatgtaggcgttgacttcggcttccagcgcggcggccagcatcctgcttgcgccttcacggacgatctcgtcgatcaaagaggagccgttggcggtggtgccgtcgtcgttgactacgctgagcacgggcgtgccttcccgaccggtgctgcgaacaccggcctactcgatgaccatcaatcgatcactcgggaaggtacgcccttcgtatgctccccgagctcgatccacaggtcttgagcattgctcgcgaagttagtcgtccgcatgacggtgacctgcgtgggctgagttgggtgagacaggtcgattcggttcggtgagacgaaaggccggagccggcctgtggggactcagaggacatctcactgggggctcgctcacgcgaggccccagtacgggatcagagggtgaggacgagcttgccctggaggtgaccgccgtcgagaagccggtgggcgtcggcgacgcgctcgaacgggaacgtctcctgcacgtggacccggagcctgccctgttcgacgagatcgacgagacctcgcaggccgacgggatcggggtcgaccgcgatgccgctgaagcgcatgccggccgcctcgaacttggcgatgagttccgaatcctcctcggcgaccgccgtcaccaggtgaccccctgggcggagcacgtcgagcgaccgctcgacggtgtcgccgccgatcgtgtcgagcacgatgtcgacatcgcggaccgcctcagtgaagtcgaccgccgtgtagtcgatcacctcgtcggcgccaaacccctcgacgaacgtccgtttgctcccgctggcggtcgcgatcacgtgcgcgccgaacgctttcgcgatctggatcgcgacgtggccgaccccgccaccaccgccgtggaccaggacgcggtcaccctcgctcacgccgccgaggtcgacgaggccctgccacgctgtcagtccgacgaccggcagcgccgacgcctcgacgtgcgtgagcgacgccggcttgcgtgccaggtggaacgccggcgccgacacgacctcggcgtacgcgctcgccgcctgcgggaacagcggtatcccgaacacctcgtcgccgggcctgaaccgccacgtctgcggcgcctcctcgaccacgccgctgatgtcccagccgaggatgaacggcggctggccgatcagcgggaactcgccggcgcgcaggcgcgcctccagcgggttcagcccgattgccttgacgcggacaacgacctcgcccggcaggggctggggctcgggcatgtccacgatggtgagcacctcggggccgccgagcgtgtgctgggtgatgactcgcatgactctcctggctttggaaggggagagaaccgaggctacgtttccgataggaaccagcaggtgcccttggcgcaggtaccttggcgccatgagcggtttcggtcccggtgatccttttctcgctgactgcccggcgcgtctggcggtcgagctgatcgccgataagtggacggtggtcgtgctctacggcctcagcaagggcccggtgcgccatggcgagctgatcgggctga

SEQ ID NO: 123 - DNA, 8303 bp, Unknown
  Kingdom: Bacteria, Phylum: Actinobacteria, Class: Actinobacteria, Order: Streptomycetales, Family: Streptomycetaceae, Genus: Streptomyces
cccaccggttctgccgacggcacccgcgaaccgcgtcaccacggccgtcggcagaaccggtggggagagcgcctcggggcttgagctcgtcgaggactccgaggatgtcgttcccggactgctggatggacgcctcgatctggcgcttctgcatctgccgggcccggacagtgacggcgggctggcggcggtgccctggcttcgctatccgctcgccgtcgccgtgcgggccgacgaccccctcgcgggcagggaaagcatctctctggcagagctgagtgaccgcacactcgtcgagccggccattccgccgagggtcaccaacgccatgcggagagtgtcgaccatgctgaagaacgcgcgtgtcacgcgtaccgagaaggtacagggagctcttggcggggtcgagatctcccgcgaggtgctgcttcgcggcctggtgaccctcgtccccgatctgcccgggtcgccgctgccgtcgctgctctcaccgcccgccttcgccaccgttccggtcgaggacgagggtttcggcatggacgtggggcttgtgtggtgcgcgggccaggccgggcgctgccccgacagggcacgccgtatcgaggagacggtggaggcgctcaccggggcgccgccttcggtcggcgccccggtggcatgacggctactcgccgtccgggccgaggagttcagtgatgcgcggatgctcctgaaggaccccggccgcgagcagttcgtcgacggccgcgtcgtcgagcccgagcagacgtcgtgcgatctcccgcgtgtgctgtccgaggagcggggccggcttcagttcggggtccggaacattggcgaagaggccaccgggcaggttctcgttgggcatgacccgctcgatcagcgggtgcgaggccacgcggtacgtgcgacgggcgacgaggtgcgggttctcggggaactcggtgatccgcatcatcttggcggcgggaacaccggcctcctgcagtcgggccatggcctcctcgggggcgcgcccgctggtccaggctcccacctccttgtcgatctcctcgcggtgtgacacccgcgaggcggagtccgggaagcgtgcggcgtcgatgccggatatcgccgccagacggcgccactggtcgtcaccctggacgtcgacgaccagccactcgtcgtcacccgccgccgggtagacgccgcgcggggcgtcacccggaccgacgttgccgacggggaccgtggtgcccggcgccagcgactcggcggcgaagacatgcgcgtgctggccgagcacgacctcggtctgtgccaggtgaacggtgccgccgactccggtcttccggcgctcgacgagcttggccaaggtggcgaacaccccgacgcgtgccgcgacatggtccgggaagatggtggtgtcgtcctggaagcggtgtccgtcctcgggatagtgccacagtccgctgacgccggtcgcgctgcggaccagcgggccgtaccctgggttgccggcccaggggccggtgtggccgtaggcggacgactccaggaccacgatccctgggttgacctccttcaagtgctcgtaggagatgccgagtttgccgagcgtgcccggcttgaagttgctgaggacgacgtcggcctgctcggcgagcttcaggaagaggccgtgtccgcgggggtcccggaggtcgaggccgaggccgagcttgttgcggttgccccaggcgaacaccgggctcagcacatccccctgggtggactgacgggctccgtcgggcgcgtggacattctccaccttcagtacctcggcaccgaggtcggcgaagaggcggcccgcctcggcgcccgcgacgatgatccccaggtcgagtacgcgcagtccttcgaagggccgacgccctacggtggaggacggttccgggcgggaccgctgctcctcgatcccggcgaggacctcggccgtgtcgcggccgatcgccggggccgggacgcggtggcccgtccgcgccccgtccacctccacgaagccgtccaccacgtccacttcgcgaccggaggcgacagcggcccgggtgaacacccgccgcgcggcgaagtgctcgttggccgcgacctcctgaggggtcagcacggcggctacggcaaccccgtatcgcggtgcctcccgcacgatctggtcgcgggtcttcggcctcagcagttcgccgatggccggatagatgacgtgagcctccttgaaccggaccgcgaggctgttgaagcgctcgtcggcgaactgctcggggccgcccatccaggcgaacatcccctgccattgccgcgcgctgagtatggtcagccggaccgcgccgtcggcgcaggcgaagaaggggtacttgtggctgtcgtcgatccttccgcgcgggccgtccgccgccgggacgccgccggtggccgaaccggccatgccccagcccgggtcgaagccctggattacgcattcgaagacggagatgtccaccgcgtcacccacgccggtctccagccggttccagtaggccagcagtgccgcccacgccgccgagatgcttgcggtctgcagcgcgatgtccagcggcggaagcagcggctcacggcctgggtcacccgagcgggagaggacgccgcccatcgccaggtgcgtccactcggttcccgtccagtcgcggtacgggccggtgaggccgaagtcggtcagggagagggccaccagagcggggttgtgcccgaggagcgctgccggctcgatgccgagcgcggcctgctcggccggggagaggctcgtgaagcagatgtcggcatgcggcagcaggcggtcgaagaacacggcgcggtcctcgggcctggccaggtcgagtgtcacggaccgcttgttggcgttgaagacctcgtgatagaggctgaccccgtcgacgtgggggccctgggcacggctcctgtcggtgccggcggactcgacgcgtatgacgtcggcgcccaggtcggcgaacaggcggctgcccagttcgccctttccgttcgtgaggtcgaggaccctgaccccggcgagggggagtgcgttgtcggccacgttgccttctccacagcattgtgccggggcgggtgcaggcgcccggctgccctgttacgggcacaccgtggcaccgggatcctggctccgtacatcgctgattgcgcgccgtgttcatgtcgccaaaggacatgtgtacggcgcgcgatccccatgcggggactggaggccgccgcggccggccggacctcaggcggacggtgttcccacaagcaccgaggcgaggacgaagtcgacgaaccgctcggcgtactcgcccgcagcctcgacgagccccgcccggagttcgggcggcgtggtgagggcgtggttcatcgcaccgccgcacagcgcgtcgagcaggaaggtcaccgaggtgtcttcgggcagctcgccccggcggataccgcgccggacgatggcgcgcgccgcgaggatctgggcctgggcgagctcctcgtaccgctcggccagtctgggaatggtgcgcgcctccatggtcaggcgcagcacggccctgctgtgttcgcccgcgtactgctgcagcagctgccggaccagggcgaccaggtccccccggacggcgccggtgtcgacgtcggtgacgcccgcgagacgcatggtcagggcctgtgccaggagttcttccttgctgtcccagcgcaggtagacggatgccttgccgacgccggcacggcgcgccaccgcctcgatgctgaaggacttccagccgtgttcgccgaacagctcgacggcggcgtccgcgacacgccggtccacgtcattgtcgcgtgggcggccggcggaggatctcgggtgctgcgtcataccccacatgatcccccacaggcccactggaatctattactgaacgctatcagtccgattcggattcggcggtggcgggttgccgggtcagcggttcttccactgggggcggcgcttctgggcgaaagccgtcacgccctcgatggcgtcctggctgacggtcaggttgtccagcgcggacgaggggtgctcgacggcgtccacggtgtccgcgatgccttcggtttccgccatgatctggagcgaggcgcggaccgaggtgggggagccctcgaggatctccgcggcgagcgcgcgggccccttccagggcggtgccggccgggacgacccggttgaccaggcccaggccgagcgcctcgtcggcggtgacctggcggccggtgaggatcatctcggtggcgatcttccgcggaacggcgcgcggcaggcgcaccaggccgccggcccctgccaccaggcccactctgacctcgctcagggcgaagcgggcggtctcgtcggcgacggtcaggtggcaggccagtgcgatctcacagccgccgcccatggcgaagccgttgaccgccgcgatgaccggcttggtcatgttccggcgcgacgtcaggcccgcgaagccgttcttgggcacccacatcggcttgcgcgaggccgagtacttgaggtcgttgcccgcgctgaaggacttgtcaccggctccggtgaggatggccacccacaggtccgggtcggcgaagtaggcgtcgaagacctcgtcgagttcgtcgttggccatggggtggaggctgttgcgtgcctccggccggttgatggtgacctcgagcaggtggccgtcacggcggacggtgacgaactcgtagtcgtcccgcaggaccggcgtgcggcgggggaaaagggcgtccatccgctcctcgctcgtggtcacgcggttgccgaaaccgaaggagcggacgaagacgcgctgtccgacgggctccccctcggacagcaggccgagggtctcctcgtcgccctggtgggtcatggcgatgaagcggcggtcgtccgcctcgaggcgtccgatcaccacgcccgtacgggccccgtcgcggccgtacgtgaccgtgtaggtctccaccgtggcccagccgtcggcgcggcgggcctcgaccggggcttcccaggcgtcgatctcggcctggagcctggcggagtcgtccgtccgccaggccgtgggggtggtggagtagacgccgacggagtacttgctcagcacgccgccgttggcaccgacgaagccgtaggagccgggggcggtacgggcgcgctgcacggtctcggcgatggcgtgcagggagtagttgttgcccgcaccgccgaagaagggcagaccgcccgtgagggtgagaccgcgcgggtcgtcggcggccagaccgaggccgtcggcgacattgaagacggcgatggggaagcagctgtacaggtcgaccgtctccagttcgccaacgccgatgccggccacctccagcgcgtgcttcgcggccatcaccgcggccgggctgcggctgaggtcggagcgctccatcaggttccgttcccgcaggtcggcgtggccgtgcaggaacacccacttctcctccggcacacccagccggcgcgcggtgctcaccgacacgaccagggcggccgcgccctggttgaccttgtcccgggctacgacgtaccgcgggtaggggtcggcgatcatccggttcttgtcggtcacggtgaccagttcctcggcggagcggcgcaccggggccgacgcgtgcgggttcttcgccgcgacgtcggtgaacggcgcgaacagcgcgcccattgtggccgcgtactcctcgcgcgactgaccgaggcgtgctcggcgggcgttgtcgaagagggcgtactggctgggggcgccggtcagcccgtgcgctgcctgatgcgtcgagaccaggccctcgagcccccagccccggtcctccagctgcccgcccacttcttcggtgaagtcgggacggtcctcggccttggccagggcctgggtggtggagatggcctcggagccgaagatgagtgccgcctgggcctcgccgcgcgcgatggtcgcggccatctcgttgagcaggtgctggggcgactggccgccggcgacctcgaggatcgcccgggcggggtcggcgccgacgcgccgggcgaccgagcgggggtagttgtcggatttgcccaagggggcgcgggcgccgggcgaggagatctcgaactgcgggacgccggcgaccgtgtcgatcacggacgccacggtcgcggtgtcggcaccggtgtcggcgagcgcctcgagcgccgccgccgcggccagctccacggcggacatccgccggtagccggggtcgtcgagccgctcggaggactggccgacaccgaccaccacgggggtgttcggatccaggccggagaggtcgggggtctcggaagtcatggtggtgcctttccttaccgcgagagaagagggggagtggcttggtcgggagccgtggtcgtcgtacgtcaggccccgggcgcccggctgaggcggaccgggcgctcgtgctcgccggaccggacgagaagtcccaggtcgacgaggtggtccgcgtgggcctcggtctcggccagggcggcgacacgcatcgctccgacctggtcccaggggcgggaccaggagaggtgggcggtcacctcccagacggtcggccggccgagtgcgtccacgaccgccaggagatcgtccagtcgctccgcatggtgctcgcgcaactgcgtggtgcgggccgcgagtccccggaaccggtactcgtgggcgggcagcgcctcgtggtcgtcccagtccgcgagacgttcgagggaggagaggaagtcggcgagcggtgcctgccccggttgccggccgtgcaggccgatgttgggagtgatacggggcagaacgtggtcgccggtgaggacgacccgcgcggcgggctcggccagacagaggtgacccggcgtgtgaccgggcgtccacagggcgacgagctcccgcccgtcgagcggcacccggtccttgtcgtcgagcagcaggtcgggctccgccatgcggaaggcgtgtgccgggttctccgcctccggagggccgaacagttcttgtacgtcgctttccggggccccggcgtccagcagccaggtgcggcccgagtggctggacgaccgtccgagccggggctgccggtgggggaggctgtcgcgttccgcggggtgcatggccacccacgcgtcgctcgccgccttgagccgggccgtcatgccgtggtggtcgaagtggacgtgggtcgcgacgatgccggtgacatcggcgggcgtggctccggcttcggccagcccctggcacagggcgtcccagccttccgcgctgtcccagcccggatcgacgacgaccagccccgagtcgccgggcaccagataactgagcgtgtagcgcagcggattgtccggtatcggtaccggcaccgaccagatgtcgccggccaggtgctcgaccggtggcaggacgcgcgccgcccaggccgccttctgcagaccgcccgtcacgacgatgggcgtggcggtgtcgctcgtggcgcggtcaccgggtgcgtgcaatgttcgtgcctctcgctttgttcggccggggacgctgttgtccggggcgagtccgtcctgtgaggtcagcccttgcgggtcttgatctcctcggtgagctgggggacgacgtcgaagaggtcgccgacgacgccgtagtcgaccaggtcgaagatcggggcctcggggtccttgttgaccgcgacgatggtcttcgaggtctgcatcccggcccggtgctggatggcgccggagatgccgttggcgatgtagagctgcggggagacggacttgccggtctggccgacctggttggtgtgcgggtaccagcccgcgtccaccgcggcacgcgaggcgccgacggccgcgccgagcgagtcggccagggcctcgatgagcgcgaagttctccgcgccgttgacgccacggccaccggagaccacgatcgcggcctcggtcagctccggacggcccgtcgactcacgcggcgtccggccggtgaccttcgtgcccgtcgcctggtcggagaaggtcacgtccagggcctcgaccgcgccggcggccgcagcggcctccacggcggcactgttgggcttgaccgtgatgaccggcgtgcccttgcagacacgggacctggtggtgaacgaggcggcgaacaccgactgggtggccaccggaccctccgcgccggcctccaggtcgacggcgtcggtgatgacgcccgacccgatgcgcagcgccagacgcgcggcgatctccttgccctccgcggaggacgg

SEQ ID NO: 124 - DNA, 1066 bp, Unknown
  Kingdom: Bacteria, Phylum: Actinobacteria, Class: Actinobacteria, Order: Streptomycetales, Family: Streptomycetaceae, Genus: Streptomyces
ccgtgcctgccgcactcggtgggtgtcagctcacgtcgtgtgcagcgtcagcccgtaccgtcccaggatctcgttcaccggctggaaccacgtctcgccgcccgagctgcagttgccccacccgccggacgtgacgccctgggcctggtcgccgctgatgaacgagccgccggagtcgccgggttcggcgcagacgttggtcttcgtcatctggtggacggcgccctcgctgtagttcaccgtctcgttcttggcgaggacggtgccgcagtgccagtgcgaggtcgagcccgaacggcagatcgaggcgccgatcggcgcctcggccgagccgcggaccagctggtccgagacggtcccccagccgagcacgaccggtacggtccaccagccgctgcccacgctgacccaggcgtagtcgttgtcggggaacgacgaaccctggaaggtgccgacgtaggagtggtcccagccgctcacccccatgccgggccggccgcagtgcccggccgtgacgaagccgccgtacacggagaagccgatggaacagcggacgttgcccgtgtagtacgggtcgccgcccacggttccggcggccagcgtacgcggagcctgacccgtctcctccacggtcaccggaccggccgcgcgggcgcgggtcaggaactgcttgacatcgttgtcgtccttgtccgcgctgaccacggtgacggtgaccgcgccggcgcgcgggtccacgtgccagccactgacgcccttcggggcacgcaacgcgtccaacttcgctttggcggcgttcagttggcgttccgtgtgccgtgtgcgcacggtccgggctccggcggcctccaccgccgagcggtgcgtgtcgtcggtgagggcgaccaccagcgcgtcgcgcttcgggtcgaaccacgagccgccgtacgtcgctccggcggccttgcgcgcggcctgttcgaccgtgcgcgccgaggcttccgcggcgaggcgggccttcgcctgctgttccgtcaggtgcaggtcgtgctggagggcggagacgagggccgccgacgccggggcg

SEQ ID NO: 125 - DNA, 3719 bp, Unknown
  Kingdom: Bacteria, Phylum: Actinobacteria, Class: Actinobacteria, Order: Streptomycetales, Family: Streptomycetaceae, Genus: Streptomyces
cgtacgtgaacgccttctgggacggctcccagatgacgtacggcgacggccagggcaacgcccgcccgctggtcgaactcgacgtcgccggccacgagatgagccacggcgtcagcggcgccctcaccggctgggacgagacgggcgagaccggcggcatgaacgagggcaccagcgacatcttcggcaccatggtcgagttctacgcgaacaaccccgtggacacgcccgactacaccatgggcgaactcatcaacatcaacggcgacaaccgcccgctgcgctacatgtacaacccgtccctcgacggccagtcgcccaactgctggaacagcggcaacggcagcctcgacccgcactactcgatgggtccgctcaaccactggttcttcctgctggccgtcggcagcggcgaccacggctacggcaacagccccacctgcgacaactccacggtcaacggcatcggcaacgacaaggccgccaagatctggtacaaggcgctggcctcctacgccaacagcagcgaggactaccaccaggcccgcatcgactcgctgaaggccgccgccgacctgtacggcgcgcactgcaccgagtacaacaccgtcgcggccgcctgggcggcggtcagcgtcaccggcgccgaccccgtacccggccccggcaactgcggcggccagccgggctcgccgtcggtgaccaacccgggcagccagaacggcaccgtcggcaccgccgtctccctgcagatccaggcgaccgatcccggcggtgagaagctcacctacagcgcgaccggcctgcccgccgggctgtcgatcgactccgccaccggacgcgtcacggggacgccgacgacggccggcacctcgtccgtgaccgtcacggcgaagaacaccgacaacgccaccggctccgcctccttcacctggaccatcaccggcggcggcaccccgccgggcggctgcggaggcctgccggcctggagcgcgaccaccggctacacaccgggcgaccaggtctcgtacaacggccacaagtggtcctcgcagtggtactcgaccggcgcggagccgggcgcgccgggctcctgggccgtctggacggacgagggcgcctgctgacccgtaacgcgtcaactcgcgtgtgcggccgggccgttgatcaccccatcagcggcccgtcccgcatgcctgctgcctgtccggccgccagtacccgacggttctcattggtcttgacctttcgccgacggcggtcctacattcggcgcggcgcgtgaaggacaggttcatgcctcgggtccgcgtgcccgacgccccggggtatgaacgaggctgtgtccggaagggccccgatgaccgagccgaccacctttccgacccccctgccgagcaccttgcccgtcaccctcgcggtggacggcccggcacgttcagggccgcccgccgtcggacgcgacgccctctgcgacaccgtacggtcccacctcaccggcggaggcggtgtcctgctcaccggcccggccggcatcggcaggaccacggtcgtggcccagctgatcgcgcaggcgggcgcccgaggccatcacgtgctgcgctgctcgccctcgcccgccgaccgcgacagcccctacctcggtctcatcgacctgctggccccggtgggtgacgacgtcctcgccgtactggccgcccacgaacgcgccgtactcgaagcggccctgctgcgcagcgcaccgcccgcgggccccgaaccggccaccggacgcgacgcgttggtcctgcggatcgccgtcggcagactcctcgcccatctgggccgcgcgcgcccgctcctgctcgtcgtcgacgacgcccagtggctcgaccggccgacggcggacgtcctcgccttcctcgcccgccggttccccggccgcccccgccgcgcgggacccggcccggacggcagcccctcggtgctcgtcgcgctgcgtacggagcccaccacggacggacccgagacacaggcggggcaggggccgtgccacggacccgaggcgcaggggccatgccacggacctgaggcgcaggagccgtgccacggacccgaggcgcaggagccatgccacaggcccgaggcacaggagctgtgcccgccgccggtccgccgtatcccggtcccgcccctgaccgcccacgagacggccgagctgctcgacgcgcacgaccatcccacctggccccgcccgctcctcgcacgcctgcaccgggcgagcggcggaaacccccgcaccgcgctcgaactcagcgccgccctcgaccagcgcgtccgcgtcgagggcacggacccgcccgattccaccgaaccgctccccgtgcccgacacgctgcgccgcccgatcctcgaccggatcgacgccctgcccccgagcgcccggcacaccctggtcaccgcgggcgccgccgcccgccccacggtggacctgctgcgccgcgccggatgccaccaggccgccgccgacgtggacgcctgcgtacggcacggcctcctgcaccctccccaggcctccgaccacgggatcatcaggttccaggacccgctgacgccgatggtgctccgcgccgtgaccccgtacgaacacctgacgcgcgcccaccgcgccctcgcggacgcctccgacgacccggtcgagcgcgcccaccacatcgcccggctcgccgcgggccccgatccggccgtggcgtcccggctcgccgacgccgcccgcgccgcccgccgccgcggcgcccccgcgaccgccgcgagactgggccgtatggccgccgagtacacgcccgccggccagacccaggtcgacatcgaccgccggctcaccgcggcagaggacggcatcgaggccggcgacttcgacttcgcccggcaactcgcccacgaagtcctcggcgaggccgaccggcccgccgaccgcgtccgggcctggaacgtggtcatcgactcctgcggccaggcgatggccgagatcaccgacgtcttcccggaagccgtacgcgacgccggacgggaccccggcctgctggcccagctgcactaccggatgagctggcgcgcctggatggtcggcggctccgcggcacgcgcccacgaccacgccgtacgctccgcccgcctcgcggcccgcaccggcgaccgccgcaccgaactcatggcactgacccagcaggctgccctcgaactcttcctgggcctcccgcaggccgagaccaccctggccgccgcgctcgccgccccgcacgacgtgcacgccatgacccaccacaacggccccctctacctcaagcaccgcttccacctggtccgcgacgaactcgacgaggcccgcgccgaactgcgtgccctcgtctacacgctgcggcagcgcggctcggccgacagcctcagccagtgcctcaacggcctcgcccaggtcgagatcgcgcgcggccgctgccgcccggccctgaccatcgcccggcagagcctgcgcatcaccgaacaggcaggcctcagccaaggccccgcctggtacaccgtggccctcgcggagacggcgggcggcagcctgggccaggcgctcaccgcggccgagaccgcccgccggcacagcgaggacgacgacgaccgcctcttcctgccccgagcgctgcacgccgagggacggatcagactgttcgccggacagccccaccaggcgg

SEQ ID NO: 126 - DNA, 19262 bp, Unknown
  Kingdom: Bacteria, Phylum: Actinobacteria, Class: Actinobacteria, Order: Streptomycetales, Family: Streptomycetaceae, Genus: Streptomyces
ggcctcgcctgcgccgacgtccctccagggcgggccagggcggcaggcaagcggcccgtccgaggcggaggcgctggctggccttttggagcgcctcgccaaagaggtgaacctccaaagcggaatggcggacggcgacgaggagggggacgtgctcacccgtctcgtccgatgccggaacggcgagcccgagaccaggccggtggtggtccgggggtggcgcgagtccgcgccatccgccaccggccatctcctgcgccgcatggtggcggtgacgaaggaggccggtctgccgccgggccgcggcccacgggctttggcggtcgccaccaccgacgacctgccgcccggcctgcccggccagctcgttcgcgaggacgtggcggtccactggtggtggggcgtcaccggccgcctggacaccgccacagtggtcgccctctcccgccccccactcgactccccccttgcccgcaggcagctctacgaagcggtcgcccaagccaccatcacggagatctgcggccccttcctcgacgtcgcgtcggccttggccgcgcggtgggccgatggtcgcccggagaccctgccggacgtcctgcgcgaggtgatcgaggccggatctgcccccgaggcgtccctcctgtccgaccagaacctcgcccgcggtccgggcgcccaccccgacgaaaccctgctgcccgcctggaacgcggctgccgtggagagctgggacggccggcttcgccgtcacccggcccatttcctggacaacgagcacgcaatggcagcccaggtgtggctggcccagaaccacgtgttgctccccttgctggacacctcacgcgagcgcttcgcggacgtcgttcgggccaacgcgcgcatccccctgcagcgcctcgccgagcagtacggatcacgccgtgacctagacgagggcggcgtgccgccgagcaccctcatcgagaccatggaggtgggcgcgatgtggggggccttccgcgacggcgccattgccctgacccaacacgaccgccgtcacctccgcattctccgcgatgcccgcaaccggctcgcccaccgcacaccgttggacggggaggggctgcagaagctgctcaaggaactgtgccggtagaaacgcctgccccgacacaagacctgaaggcgcaggatagttcgtacgcagccgcaatttggcaccgaaggtctgctgtcccggctcgggtcaggcccttcggggcacccgccctctctcggtaggccgcccgagcctcgtgcccgtcaggacggaaaaccacggtcgacaggggtgcaatccaacccacaggaccgctccaaggacctggtatacgcgctggtcaaagccctggagcccgcgcaggcaccgtcgcttcccaagctgatgtcctgcccgatgcccttgccgcgcctggtcctgtttcccggacggaacggtcgctgcgcgggctgacccgtcgcttgaggcgaaaccgctccgtgtcacgaggcgcgcttcgctgcccgcgggactgtcccgagagcgccgagagcggcgtgccccccgtccgcgtggttttgcgatgtgctggtcatccacagcccacgcccgtcgttggatcgaagtgggagattcgcggtggagccgcggccgccgtgccggcggtgcagggcagggccgacagtggggaaacacaacgatgacgcagccgaccatcaccgacctcgacaccgtgctggacgccggccaggtcgacgccgtgctctgcgccgcctgggaggcgttcgacgtcgtgggccgactggccgacgccctcgccctcgacgagggcagcgacgagatgcaggccatgctcaccggcatcaagtgcatggacgggcgtcgcctgctgccgcctcctgagaacgggcggcccctggtaactccgactccaagccccggccgggccgggctcgagccgtacggggcgctgctgcggcacgtcggtacggcgctccgtcggctggctcgcgtaccggaatgcgcggaggacgcggagcagctcgatctcgtggccgctcacgcggcggccgccgccgacctcctcatgaccgtccggcaggatcgcggcggggcctcatgaccgtcacgctcggagagctctacgacgtcgttcaccgtcggcttgaacacgtcacgtccgcgagcctcagggacgatcccttcgcgcaggccctcgccgtcagacagctcgacacactggtcgagcacgtgcagctcctggtgcgccggccgggggaacgcggcgatgcatccgacgatgcgtcccgccacctccaccacgcccggcgggcgctcggtggcgccgcccgctggctgccaccggtcacccctgacgccgcggtgaacgacggcccgctcggctccgcggtggaggccagcggcgcggtcatcgacctgatccgcggtcaccgcgacagcagcggcgctcccatgaccccgtacgcgctggccttcaccacacgctccgcacgggcgtaccacctgcgtcacgcctccgggattctccactccgcgagccggatcacgcacatcgtgagccaaggactcgacaaccagaacgcctcggtcaggctccagaccgccgaggtctccctgcagtacgcctccgtccgggcccagcacaccagcaccgacgcgaatgaggcgctggcggcccttccgcaggccctgccactcaccccggtccccgcacttcccaccgatccgctcacccgggccgccgaccggatccgggacgactgcgaacagctctcccgcgccgcctacgagaccctccacggccgctgcgcccggcctctgagcggatccgacctgcagctgatcatccggtggcggtcccttggcaccctgctcgccgggcggctcctgctgcagggcgccaccgaagcgccgaacgaggcgggcgcctcgctcaagaactgcgcggaccgcttcagaaccgccgcccgcgcctggagaaacgtccaggagcgctgggaacgcgtcgtcgacgtcgacgaccccagcatccgtccccgcctgccccggccgagctacgacatggtgcgccgaggccaggtctcccgcatgccgcgggaaacggtcccgcatccggccgtggagatcgcacgggcatcagcccttcgcgcgggacggttactgttcggcggcgagtgggaccccgactccgcaagcggcccgccccggacaaggccggcaccggacatcgtggccgactccgggggcgtcgccgaactggttcagaccgcctaccgcctcaccgtcgccgactggcgcatcgcggtggccgcgccccgcgccgtgacggccatcgagcaccgcctggtcaccgacatccccgaacactgcccagccggccacccgtaccgcttctaccagctccacgaccaccagctcgagcgcatccgcacctcgttccaccaggtctgcaccgctcaacaggcagcggcccaaagtctgctggccaccgctccccagatcggcatggacacccgccgtgccctcctcgacgcggccgctcaccagcacatcaccgcccggacgacctgggccccgccgcccgccctcgatcccgccgcgcgcagcgcgaccgcgcgggggcccatcgttcctccgccggccacgctcgggagaggcgtccgcgcctgagcctggagctgcccgccatgtgcatggaagcgaggcgttgggcctgttcgtcccgctttcgggtcgagttccaggagtgtgcaagcggacggatgcgtctttcgagctcaccggacgcggtgctgtgcgcggaccggccgttgaagaccctggtcgagctgtccctggtggccgaacacctttgaggtgccccgagttccgcagagtccgtcgaggtcgagcagcaacgtcgtatcgttgagcaaaaccgtggctcctgcgtgatcgttctgcgtcgggaatagaaatgatcactcagccctgcatccgggccaccaaccccttcactgacagtgaccaaacgtcagccacccagacgaaacgcaccgctcatgaacgaagacccgtgttgggagttcgactctcagcggcgccccaaaaagggctaatatcgccttagcctcggcgggggagggaattgtggcaggcgaatccgatgatcattccactgccaagttgtgggcgctgatcggcggaatcgcatccgtgctgtcgatcctgacctggctgggcgtgagcaacgctggagagctgaaggatctgttggccgactctcacccatccagttccagcccagcccggtacacgccttcgccgaccgtccatacccccggcaacgctgacaccagtgaggggagcgctgacaggcccgaccgcgagccgtcgacacccactccggatcgcaccgaagaggcgttcaaagccgtctcggtcggcgactgcctggcggtctacgacaccggccgcaggggcaccaccagcatcgactggagcgtcgatgttccgccgaaccccgtgtcctgcgccagtgagcaggcgctggtccaggtgaccgccaccgacacggcttgccccaccagctacgggaagtcgtactggagctatcggtccgccaccaccggcaacaccagaaagctctgcctcacccgcatctaccacgccaactactgcatgctcggtcagcagtccggctactcgatctccctcggcatgatgacgtccgtgaactgccgacgcgagccggtgcccgtcccctacaaccagatcatgaacatcacaggcgtctaccgcgccccggcgggcgccaacgtgaacgactgccgccgggtggcaggtgaccagacgcgctactgggccgtccttgtggacaacggcgccacgctgctgtgcaccacgatctaccagggcacctgacccacaacgcctccacccccgctcgagtgcgcttgccaaagtaacctgatcaagcccgcctggagcgcgttgaagggccgcttgttcgcacccagagcggcggtctatgcctacgcgcccggctggggcgtgcccaactacggttcccgaaatgcgggtggcaccggtgctggccctgcggacgcgccgatccgccactccggcccctggacacggggcgacatcggtcgaggcgcctacgggaagaggcctgtgcaccaccttggccacgacatcgaaatccaccacgcagaccagatgccgggttcgcctattcatgaactcgatgagaaggtccaccgtgggccagcgacggacctactcggcaacgactgggatcagggtgtgaccgatgagatgagaaaggaggacacgaagctccactggtggtgccggtcgcaagagcagggatggggcgtttaccaccctggcctatagttcgaaaagcggcctgatgatgtggccgacgcagtagaggacctgcgcaggcgccccagatggaactgggtgcccatcggttccagacttgccattttagagaaatcatggatttcgaccaacttgaattgcatatcagccaaatcctggatcgccatcagcgtcttgggttaccggaagaggcggcaccggttcaatgccttcgagcctcggacgaggagatcggtcgcgttgaagcggcgctgagcgttcgacttccggatcagtacaaggagttcttgcgtcgcattggcggaggggaattcgcagcgctggttctcctgccggttgcctcagcagaggactttgaaatcgacctgatctcagtcaatgcgagagaagagagctttgcggttcccttcgtcgcagtggctcccgtgggggccggtgactggtggggcttccgggtgagtgacaagcagtgccacgatcaggtgagtttctactcgtttgaggatcgcacagcacgggaaaaatatccggattctctgaaattcgccgccagggaaggccttccggtcgaggattcgtgaggcttcacacgtcatggatgcttcgaaatggctgaccgaacccgctcatcgcgagttgacggtcgcttcgcgcttttcacaccgcgttcattccgtgggaggagcctgatgcaggttcggctttcgacggccgctcgctcggccggggccgacacaggctgcccgcggcgggatgaaaccgcggacctcgcatgggaaactggaccaccggcctgaacgccgggtctcaccgtcgccgaggggagtggcagtgccgggggcttccacgtcatggttttccgcgaagaagtgcgagcgcgcctgggccgaggcggtggggttgctccgtgcggggagggccgaggccgccgcacggcggttcgaagaggcactgcggaacgacccgaccgccgccgacgcatggctggggctgcatgctgcgggataccagcaggacgaggccgtcgctcggatgatgcagaacatcgggaccttcggagcgttgcgaacaaagctcgacatcccgcttcagtcccgtttcgatctcggggtctacgtctcgttccggctggagttccagcgtgacctctggctggccggcatgtcccgcctcctggcgcagcgacggctcgacgaagcctggcagcacctggagagcgcacagctggactgcgatgagacgcggttcgtctgtgcgagatacgcgttcctcaagcaggagtggccgctcgtgctgactttcgcgcgggggataaccgacccgttcctgcatgatgagtcacaactctacgtagggcgcgcgctcgtggagcagggagtccaccaagaggctttgaacgtactggaaccactgcccgggcgtatcggcaaaggcacgaagttcgacgccgaggtcgcctacgccaggggcctcgccagggaagcactcggacaggacgaggaggcgctgcggcagttccagtacgcgttccggtacttcccacggctggccgacgtcgccgtacgggcgggagcatcggtaccccgggccggggtcgccgtgaccgggggagccccggaggaatccacgggcccgcacgtgccgcccgctgtacgggccgagccggcccggtcggtcgatgcgggcgacgccgcggacctggacggccaggaggaggcggcccgagcgagggaagacgatctcgcggaagcggtcacgctgctggacggcatggtcggtctcgcacccgtcaaacgccaactgcactcgctggcggctcagttgcgcatgtctgtgatccgcagggagcagggactgccgtcgaccgcctctccccagcacttcgtgttcgccggtccgcccggaaccggaaagaccacagtcgcccgcatcgtcggaaaggtcttcgccgggctcggcctgctggagaaggggcaggtcgtcgaggcgcagcgagcggacctcgtgggccagcacctgggagagaccgccatcaagacgagcaaggtgatcgactcggccctcgacggcgtcctgttcatcgacgaggcctacgcactgtgcaacagcggctactccggcggtgacgccttcggcaacgaggcgctgcaggtgctgctgaagcgggccgaggacgaccgcgacaggctcgtggtggtgctggccggctacccgcacgagatcaacgagctgctgaccaccaaccccgggctcgcctcccgcttcacgacacgcgtggacttcccctcctactcggcctccgaactcacggacatcggccgcggcatcgtgcaggcccagggagacgtgctggacgaggacgccgctctggcgctggagttctcctgtcaggaggcggtcggcgacggactgatcgaccggctcggcaatggccgcttcgtgcgtgagctctgccgaaaggcctccgcgctgcgggacctgcgcctgtacgaggcctacggcggcgccggtaccccgccgctggaagacatcaccactcttcggctggaggacgtcacgatcgcctaccgggaactgcgcgagggcgtcgcggagaactgatcgcatggcgagatctcgtcccggatgtagtcgatggtgcgccgttccaaggcgttcgcgacctcgctgaagccactgaccgcgcccttgaagtgctgcgtgaccgcgggccgaaggcctgcgcggtgatgtggcgcgcgtttaccgcgcggccgtcagggctctgggcgaggtaggtggcgaccagaacgccttgctcgtcgaggcgggagcgcctgcgggggtgggccgcggtgccgaccgtcggggtgtcgtcggcgaacgtcgccaggtacagccagtgcggctgggccatgtacgccgccagggcgtcggggacgtggccgccggagtggaaccggtgggcgaaacgacgtcgactgaccgcacgggtaggccccgcccattcggcacgggggaagcaggaggcgacgatggcgccgggtcgccgcacggcaccggccgtcacaccttccgcgtgcgtacgaagccgagtgaagccagcccttcggcgcggcacaggcggtcagaggcgccgccgacctccgtctgaagaagttggtagtcggcgccgtggcactggccccagtgcatggctgcacgccaaagcagacggcccagccccctgccgcgggcctcgggcagaacggcgaagtactgcggcatgagctgccggtagccgaccgcgtcggggcggatctccatggggccgatggctcctaggacgcggccctcgaggacggcggtgaagaccgggccgcaacctcccgcctgtatctgggcgtagaggaaggccaggccgtcagcggccatggcctgggcgtacggttcgaacgtgccccgcaccgcggccggccactcggtgaactcctgtacggggccgccggggtcctcgcaggggcgtccggtgaagtccttcagctggatcctgaccccgtcggcgggcgtggcttcaggaccgagcgggcgtaccaggcgcgcgccggccacgccatgctcagcggcgagtttcgcggcgagttcggcggcatggtcgaggatgccggcctggtggccgtaggcgaagaccttgcaggcgccccggccgcgggtcgacagggtgggaatcagggtgcggtcgggccggtggacgatgccatcggtgagcacggtctcgtccttctcggtgctccagcgccggtccttgtcgtaggagaggaagtaccggcccatggcggccgcggtgcgggtgtcctcgaagaggtcgaccgtgagcgcgtgggggtggacagggccgagggtgggcacgatcggggcggtgagcaccggtcgcagccagtcccagcggaagaacatggtggcaccttactggtctcgggaacggctctggccctgacgggagcccgtcagggccagagcggcgtcagtcgatctgccgtcgatgactagtgggggttgtcgtcaccggcgtcacaggagcactcggcgctctcgacgatctcgtccagatcggcgacggcggtgatggacgcggcggccaccggcggagccgcgcgacgcgcgcccgtgggcacgccgggcaggatctgcaccggtacgggtcgaggtgtcatgacgtgactgtctccttcttgtctccgtgttggcagtagctgtgcagcggcgccttcgcctcctggtagtgcttggccagggggcggcagacccggcaggtgccggacagggcgcagccctcgcaccctccggtgcgaagcatcaggcggtcggcgatcgcgccgagccgcagcagtccgtccgcgccttctgccatgaggtcgatctggtcgtcgcggccgaccttgcagatcgagaccaggccgtgcgggtcggcgtggaagaaggtgtggccggcgttgcatccggcgaacggcttgcgccggcgcaggtgggcggcggactgggcgagcagtggttcgccgccgccgttgatcgtcggggtcatgttcgtgtacgcgtggtgctcgaccccccagtcctcggcgagggcggccatcggttccgcctcgtgcgcgttggcttcggtgacgacgaggttcagtcgcagcggcaggcccgcggcgcgggcagcggccatgccgcgctggaacgccttccaggagccgcggcgctgggtcaccttctcgtagctgtcctcgctcgcgccgtagagactgatgacgagccggtagggcgggcagtcgccgaacagccgcagcaggtccgggcgccacagcagggagccgttcgtggagatcgtgagcatcatcccggcgagccaggcgtaccggtaggcgccctcgaagtcgcgatccatggtgggctcaccgccggtgatctggagccacaggacgccggcctcccgcatgatgtcgagcagccgggccttgtcctcccagccgagcccggcgactggccgctcgccgaggtagcagtgcgggcagccgtagttgcagccgagattgatctcccaggaggcccggcagtagccgtaagcggacggctcacgcaccaggaccgtgccgtgcaggggaagacctgcgacatcgaggccccacgtgctggccgcggtgtcggccacccactgggggacggtgtgcccggcggcggccgcacggagctgctcgtagtggtcagccgggatgcgcgtgccggacctggcgcccgggcggagcagcaggtgaccgtcgaggaacgggctggcgatcagctggtgcggcatgatgccatctcccgtcccgagcgcagcgggcccggcgtcagcgcggggcgggcctgccggggtgcggcgcagtagatctcgccgagcccgttgcatgcgccgcagctttcgccggtcctggggttggcgccgctgccgctgcagtccgggcacgtcccagcgcaccccgggtcggggcgcctggtcgtcaatgggggtgcgggtgtcaacacacgaactccttggtctggctgaccccatccggggttcctgctccgggcggagtgtcgaagccccgccccgccggaggcttgcgcacctcccgcgggacgggtcccgcctcaccaggtcttgcgggacaccggcgagacgggggtctttgatgcggccctgtcccgaagcggccgccgtggggccccgtgacgccggggcgggcggggtgccgcgcgtcagggacagcgcgcggtgcgggcgcagacagcgtgcacacggccgggctgcgctgggcctccggtgaggccggcctgctggtagggctcccaggcctcggtgtcctcgatcggtctgtcgcacagcaggcacatccgcacgccggagagggcgtcgaaatggccgcacagcgagatcacggaccgggcgagccacttcactctctccacctcgccctgcaaccctgccgctccgggctcgacgagccgccggcgcgcctccccgacaccggccagggccgctttccggggcatgtcgtcggccgggaggtccgcggccagctgctcgatgtggggcatcagctgttccagcgtctgccggaagtccgcctcgaaggccttcacggtgccgtgacggggcagcgtcggctggtcgaggaaccagctcgccgcggcgcgcaccgcgaccggggcgacgggcacctcctcggtctggggccgggttccgttcaccgggtcacccctgcctggcggtggatcgggcaggtgcagggcggcagcgccgagctcatcggggtgggcgcgggcttgtggctgtggggcacggtcacggtggcgcgcggcgcggtcttcacgccgtcgctggtcaccgtgtacacccggatggtcatcttggcgcccactgggcgctgtagacccgggacggtagcgttcttcatgtcgacgctccttcgaagcgttggccacgcccccgggccgttcgccgcggtcgcgggggtctgtcgtctcgctgcggtgctcacgcggcggccgctcgggatcggcagccgcatgtgacgatgtgccacacgcgcgagctgccttggaccacgacctgcccggcctcgcgcagggtcttgttcacggccccgcagtcgaagcaggcctcaccgtgcaggcggacgatgctcacacgcccttcgatgaccgtgggcgcgagtgcgtcgggcatgcccaacccccatctgctcggtttctgcgcgtgagacagatggtgggggctgccggaggcaacaagtaccccagcaaggggtacttgggggtggttcgctcaggtggcggagcaccactccgcgaagttcgtcagcgtctccgagtcggcgcgcttgagtcgacgcagcgtggaagcgtcttcccggacccaggggtgctcccgggtgtgctgaggggcgatgcggcgggcgaccttcagcgactcgaacgcgtcatccgaaagcccggaccacagttgggctcgtgcgagttcgatgtagaagccggagcgccgctcggccggcagctccttgggcggcttccactcgcttgcgacgtcgagggcccggccgatgtgatcgccgccgagactgacggctacggagacttcgtgggtgcgcacggagtcggggccgaaggcggtgccgcagtagacgtcttcgcgcactctgtgggccagggctcgcgcctcgccgaggtgggtgtccgcggccgagctgtcgcgggcccgtccggccacgaccgcggcccgcatatgcagtgcgccccgtgctgcgatgtcctgcggagtgatcggggaccggtcccgcatcgagtgcctgtcgcagggcccgtaggccggcgctgtgggcgcgcgcggcaaagaaggtttcggtacgtacgtatgcgaccgccgaggtgagcagcggatcatccgcctcggggactgcccaccgcatcaggtcgacgagccgtgcggacaggtcacgggcgccgaacttgtatgcaacggcatcggcagatcggtaggcctggacaaggagaccggccaggtcggcccggtccccgttcggggccgcgtgataggcgcgcgcgagttccgtcaccaggtcaggaagcttgcggacgatacgcgtgtactgagctgccaggcgccaccgggcagcctctgcgacggcggcgcgcagttcgtgaaggggccgcacggggccgtcttcggggaggtcgtacgtggcgatcgctgcggagagcgcggggagcgcctcatggacccgagtctgggcggccacacggtctgtgcgcagccgcgcggagtcgacgcccagggcatcggcgatggcttccagcgtggcagtggtgacgccacgctcaccacgctcgatcttgcggatggtgccgagcgccacgcacgccgcatccgcgagctgctgctgcgtcatcttcgggcggacgacgctgcggtagtaggcaatccgcctgcccacgccgtcactgatctgtgcgggcatactggcccacgttcgataagtccactccggaccgtacccgcccagcggcgcggcgtgtacgcgaacggccccaacagcccgagttgatgaggctctacggtcacctttcgatgataccggcgagctgggcaaggttgtcgatgctccagtccgccgcctgtacgacctccgggacatccgcccacaggtgcccccaggggccccggcggatatgcgccgcgcgcagtcctgccgccttggccgggaaaacgtcgttggccggatggtcaccgacgtacagcgtccggcagggtgccgcctgcgccacctcgatcacgcgcgcgaagaactcaggctgtggcttcgccacaccccactccccggacgtgacgatcaggtccgccggcaagtcgagatcacgcaacagctcaccagctcgcggtgtctggttgcccgcgatgatgacccgtactccgcgctcacgcagcgccgacagggctggtcgcacatcgtcgtaaaggtcgctctcgtccagctgctcgccccggccggcgagttcacgggcgtgatactcggcagccacgtcgatcccggggcgcgcgagccgcagcgcttcggcgttgtcctgcccctgcgctacgacggcccccaccagtgcggagagcgtgtgtctcgggaccttcagccagtcggcccaggaagcccagtagcggtcatcacgggtgatcgtctcgccgacgtcgaacacgatggtctcaatcaccccgcgagcctacggggctgccacgctcaccgagcgaggcggatgccacgccactggccaggctcccgctggatcgcgcctacgcgatgtgtccgccgtcagcgaccgagggctgtccggctccgtatgaatggaggctgaagccctgcacagttcatgcgaagaaacgcccccttcgtgcgggcggcgagcagcggcgtcagttcgcctccgtcacgtccgtgaccttgccggtgatcttcgtgcgggaactcgaggtggacagggacgaggggtagtactccatcgacgtcccgttggtcaggctgatcgtctcgatgaccggcccgctttcgtcaccgtcgatctggtacgtgatctcgtacgccttgtccgggtcgagggggaggatgccgccgtaggacagatccggctccacgtccgcgttgcacccggccgagccgaagcagtgcttccgcttgatggtgagcttcatcgtgaagtcggaggcgctcgggtcggcgtatgccgggctttccgtggtcgggtccgacgccggcttcggggagatggtcggcgcagaggcggcggcggacggggtggtggcatgcggggcggcggtgcaggcggcaccgagggggagagcggtcagggctatggcggcgagcagcttacgagcggtcacgtgtgatcctctccaggggtgcggtatgtgccgcgaaattcgtccgtgctacggatttgcgatgcggtggtggtcccggtcgagatcacgcggcccgtcggcaacgcgcgcgccaccgtccgcagaagacgccccgaaccaagccgatgactcggtgatctccggcggcgtaggttgtcggctgtgcgtcaggcggccatggaacggcggtagtcggtgagggcgcccgtggcccagagcggtaccaggcgcgggagttcggcgcgagggacggtgccgcgtacgcagcgcaggccgagcttggccagggagtcggcggcctcgttgagggggtggccgacgtgggccttctcgtggacgaaggtcaggtgcggggtgtactcggcgagcatctgcagcttcaccaggctgggcttgcggccctgagagcgcaggtgggtgtcgtatcccgcgggcatgtccgcatcgccctgctgccagttgtgcaggtatcgcagcgcctggaggttgtccacgcggacctcgaccggtcggccggggtgggcgcccaggaccgtcctgaggccccagtacacggcacgcagctcggtgacgaccacgcgggcgtgggggcgaacgaggtactcggggtagaggtgggcgcgcagtccggtgtggccggtggtggccaggtagccggaggcgacccggtccggggcgaccgaggcgtcggtggccagcacgatcgatccggcgacggccttgaccttgtcgttcacgaacacctggcggcaggcggacctggtggtgcggggtgcgtgggcgaggggggaacggcgacccatgacagttgttgcctccttgtcttccttctctgccttgtcttcgcaacggagcagcgggagagggcgggcgcgcgggacgcccgacgagcgtggtcgtgcgggtcaggggccatcactgtcttgcgacggcccctggaatccgccggatgcggaggggctccggtgctggcggcgggtcagatggcggcgggggccttcttgtaccagcccgtgatcaccttggtcaggtgcacgatgttctgctggcgcatgatcggggcggaggcgttcggctcgaagtcctcgtccgcgttcgtggtgcgccagatgctgtcctcggtgaccggggcggccatgtgccggtcgagccgcttgaagaactcctggatgtcaccgtcctcggctccgtcctcccgcaggttgcggtagacgccgcccaggacgcggagcatgcccaccgagcccaggagcgaggactcgcgcagcgccatggccttggtgggaggcgccggcggctcgttcttcttcttgtcggagagcgaggggtcgtagttgtccacgtcctcctcggtgatctccgcgagcacggtgaaggcgacggagatgacgtccaggaagccgcggacgctctcgatgacctcgttgtcggtcagcgactcgaccttcttgttgacgcggccaccgggaccggcgatgacggcccgcgtgatgtcggcgacgtgcttggcgcccgtcaggttgcggttggccagggtcatccggtcccgctcgatgtcgatcttgcccaggaagagcgggtgggtgacgatgtcgctgagcgtgcggttggcgatgcgcgaggtgtcgaagcgggcccggacggcgccggagatgcccttggcgttgtccgcgacgtcgacgaacatctgctggccctggacgccgtcgggctccacgtagatgtcgatgccgacgaactcgtccttgagccgctgcatccggccgagcagagcctcgcggtcctgctccagcttcgccttcttggcctcgttggcgcggtggagctcccggtcgatgcgggagacctcctccgtgatccgcttcttctccaggtggacgccgaggatgcggtgctggccgtcgatcgtgatcagccgtccgatgccgccgatggaccacggaacggtgaggtagccgaccgagccgtcctcgctgatcggctcgaaacggcagccaccggtgtcacggacgaggagggccggagccacccagccggggttgtcggcgaggtactgaccgaagcccttggcgtggttgatgtccaccttgcggttgtccgggtccggcttggccgggtcggggatggtgaggatgaccgagaggtcggcgagcgggatgcgcagcgtgtagacggtccggccgccctggctggtgcggatcgccaggtaggtggactcctcacgcaccagggagagacgggacgagtcgacggtgatggtcatggatgacttccttccgagcaggtagccctcgggggcagcgggggagacggtgggcagtgcgtgctgccgccctctggggtgggcatgcaggtcagatgccgccggccttcggcgggtggacttgtccgcaggtgctgaggaaccggtccagggcggcgtgaccggaggagagccggttgcgcccggccgggacgggccttcgtatggccgccctttgtcgtaactgccgccttgggcgggccacccgccgtgcgggcagctcccggcagaggtgggtcggtggcggtggcaggagaggggaactgccgggtgcggcaggcaggttcggaacgccgcgggctccggctacggcatcagtagttaccgttgctcaggatttcgccgtcagcgttgtagacggtgacaaggccgttcttgctggccttgccccggtcggcctggaagtccgtgaaggccgaggcgagcagcttggcgttgcccgcatccgcgctgaccatgtctccggtgtagtccgtgtagatgtcggccgcgtccagaatgtcgttcttcttgtcggcgccctggatcttggtgacgtgtgtcgcggcatcccgcgtcttcgccgactcgtgcttcttcacgtacgccttgaaggcatcgacggtggactgctggggcgcggcggccttggaggagccggtggtcttggaggacccgttggtcttcgcggagccggtggcttcggaagaaccggcagacgcgccggaggacacggcaccggacgaggagtcgcccgaaccggaccccactgcggacgcgatgccgccgatcacgatcacggccagaacgccgaggcagcccagcttggccttggaccgcttcttcggcggcgcaggaggctgcgggtatcccggctgctgctgaaagccggggtgctgcgggggctgggtggtcatctgggtgcctcctgttgcgatgagggatcggatacgcggcgcggacgtgcagcgccttcggccgtcgcttccactcggaagcaacattagataagcacaatgctgaaagcatcgtcaatcaagcttcggggcttgacgtccgctgtaaggtgttaaccgtccactgcccgactggcccgagaggtgcggaaccccacgccatgccccagcagccatcagcccaactggcgcccccggcgcacgtgacagccgcagagatctcccgcatcgcaggggttacgcgcgccaccgtgagcaactggcgccgccgccacgacgacttcccggccccgagcgcaggcacggaaaccagcccgctctacgacctgacggccgtccaggcatggctgcggggacgcgggcacacctccacggcctcgccgaccgaggagctgcgtacggcactacggctgctgggacccggttcgggtgttgccgcgcgactgttcccgctggtggccgccgcttcccaccgcaccccggaggagatggccgagctcgccgccctgcccgacgaccagctgatcgccaaagcggagaagtccgcgggcgatctccctgccgccgtgcccgaggccgagcaggtccgctatggtccggacgacgcgggcgtgctccgcgccctactgggctgcgtccgtgaggcgggggcacaggccgccgccgacgttctcgccgaacgcgaactggacgagggcgccgccagcggcgtctaccagaccccggagggcctggccctgctcatggcacggctcctgcccgccggcacgtcccgcgtcctcgaccccgcctgcggcagcggcacgctcctcgccgccgccgcccggcagggcgcacaggagctgttcgggcaggactcgctccccgtccagggccaacgcaccgcgatccgactgctgctcgccgcccgcggagccgagacggcggtccgcgtcggcgacagcctgcgcgccgacgccttccccgacgtcaccgtggacgccgtcctctgcaacccgccgttcggcgaccgcgactggggtcacgacgaactggcctacgacccgagatgggcgtacgggctcccgccgcgcttcgaatccgaactggcctgggtgcagcacgccctcgcccacctggagcccggcggccacgcggtcatgctgctgccgcccgcgctcgccttccgctcctccggccgccgcatccgcgcggaactcatccgcagcggggccctgcgcgccg

SEQ ID NO: 127 - DNA, 8038 bp, Unknown
  Kingdom: Bacteria, Phylum: Actinobacteria, Class: Actinobacteria, Order: Streptomycetales, Family: Streptomycetaceae, Genus: Streptomyces
acgaggccggagcccggcggcaggtcggcgccgccttccgaccggcggcccgggggcgcccgacggcagaccgaccccgccccccgacctgccgccgggctccggcctcgttcctctcgccacggcttcggcgcggtcggccgggagtgccggatgggcctcgttgacaggtccggcacaggcatccgcgtccgcgaggggccgctcgcgtcagcggatgctgagttcgacccgtaccggccggtggtcggaggccgtcgtgtccaggacctccgcccgccgcgcctgaacgcccgacgaggcgaacacgtagtcgatccgctcctgcggattcaccgagtcgtacgtgaacccgtcgcccttcccggccaccggccaggtgtcggtcagccgcttggtcaccgaggcgatctcctcgctgtccggtgtcgtgttgaggtcgccgaccatgaccgtggggagccgggagccgtcgacgatcgcgttgatcgccgccacctgcggcagccgctcggcctgcgaggtgtactccaggtgtgtgttcaggaagcgcagtttcctgccccgcaccacgaggtcggcctccagcaggccgcgctgctcacccgtctcggaacggggcaggaacgtgttccgggagtgcgtgatcgggtagcgcgacaggatcgccgtcccgtactggcgccgcggctcgcccggatgctccgggtccaggtccaggttcacgccgtaggccacgtgcaggcccagctttttggcgagccaccccgcctggtctgcgaagtcgctgcgcgcaccgaagtgccggtccacctcctgcaggccgaccacatcggcccccgattgccgtaccacctcggcgacatgttcgaggttcagcacgtcctccggatccgcgccgtgatggatgttgtacgtcaccacggtcacgtcgcgtccgggcgccgccgcccaggacgccggtgccaaccccacggcagccgtggccatcaccgcgaccaccgcgcatctgcccgccgcgtatctgcccaccgcgcatctgccccacacacgagacacaccacacctccgaatcgaacagacccgagagccaacacacagctcctcgaaggtggttgaacataacggcactcggtcaaacactcaacaggaagctttacccggattgtcaggttcccgcgctcctgccgcgccgacggcaccggaggcccggaactcccccgcacagatcccttgacggcgcggcccctcgcccccaacatatccaaagtcctttaattaaaagggctttacttactccggaggcgaactctgtgaccgagtcgttcctgcccccggccgactcccgacgccatgccgagcgaggcctggcacgggtgtccgcacgtcggcagccgcccgaacggaccaaggcgagcacgctggacagcagggtccacaaccgcgcgctggtcctggcgacgctgtaccaccagggcgcgatgagcaggtcggagatcgcgcggaccctcggtctcaccgcgcccacggtctccgcgctcgtcgccgacctggagagcgacgggttcgtcgtcgacacgggtccccgcaagggcaaccggctgggcaagccggcgaacgtgatgcggatcgacgacgacgccgcccacatcctcgccctggacctgtccggcaacgggcacttcagcggcgcggtcctcaacctccgcggtgacgtggtcgagcgggccgacacgcactacggcgacgccaccggtgaacgcgccgccggcctggtcctccagctcgtctccgaactggccggtctcgcaccagggcgcgttctcggcatcggggtcggctcacccggcatcgtgggcgacgcgggagtcatccatcacgccgcccacctgggctggagcgaactgcctctcgccgcccggctctccgaacgcttcggcgtgccggcctacgtcggcaacgacgtgaacgtcgccgcgctcgccgtactgcacttccgcttccgcgacaccagaacgcagaatctcatggtcatcaccatcgagcacggtgtcggcgcgggcctgatagtgggcggtgaactcgtcgagggcgagcagttcgccgccggcgagatcgggcacgtgaccgtcgacgaggcgggcgaaccatgtgtctgcgggcatcgcggatgcctggagccgctgatcgacgcggccgaactgcgcaagcgggtggcaggacgcgaccgggccggacgtgacggcgtactcgccgacgcgggccgggccctgggcaccgtcctcgccccgatcagcagcgtgctcaacctcaacgagatcgccctgctgggcccgccggacctggtcgagggcgcgttcctcgacgcggcgtccgcgacggtgcgggcccgcacgtacgcacccatcagtgcctcgctgtccatgcgggcactgagcggcgacccgaatctggtcctgctcggcggagcgagtctcgtcctctccggcgagctgggcgtgtggtgacccgcctcctggcccctcaagccatcggccccgccgctcacttggcttcttcacctctcccacctcgtccccaggagtttccatgacacgtagaggcatacggcagcgcgcgctggtggccgtcgccctggccacggctctcggcgcgggtgcctgttcgggctcggcgggcagggacgcgggccgcgacgcgaaaccccgggccgtccccgtcgtcaagggcgagggcaagacgctgaccgtgtgggtgatggacggcgactactccgaccccaccctgaaggcgatgaaggacgagttcacccggcagaccggcgccgaggcgaaggtggaggtccagaactgggacggcatcaccaccaagatcaccacagcgctcgcgacctcgacgccgccggacgtcatcgacatcggcaacacgcaggtggccagtttcgccgccagcggcggactgatggacctgactccgtacgccaaggacctcaggcagggccagtcctggctgaccggtctggaagagcccgcgacggtggacgggcggctctacgccgtgccctcgttcgcgggcgcccgcgcggtgatctacaacaagaagacatgggccgcggcaggtgtgaagtccgctcccgccaccttcgacgaactcaccagcgatctgcgcaaggtccgggcggccaaccccgcgcccgacttctcgcccttctacctcccgggccggtactggcacaccggtgtgcagttcgtgtgggacgcgggcggcgccatcgcggtgaagcagggctcggcgtggaagggggcgctcggcagcgcggcggcccagcgcggcctgaacgagtacaggcagttccagaacgagttctccgcaccgtccacgcgtaccatcgacaccctcaacccggaccagacgcgggtcttcgcggacggcaaggcgtcggcgatcagtgcgaccaacgtgacgatcgccctcatcaagaaggccaaccccgccatcaaggacgccgacctgggcaccttccccttccccggcaggtccggcaagccgcagcccgtgatgctcggcggctccgactggggcatcgccgccaggagcgccgactccggcctcgccctgcagtgggtgaagatcgcgaccgcgccgtcggtgcagaagcagtgggtcgccggccatgacggctggatcccgaacagcacgggcgcggtcaccgccgcccgggacgaggccgcgccgctgctccgcgggttcttcgacgcggccctgcgctcgcaggcgacgccggccgccgccgagtgggcggagctggagggcaacaaggacatcgacaaggtgttctcctccatcgcctccggatcccgcagcccgcagcaggcggccggctccttcgacgcgacggcgggcaaggtgctcaatgcccggcactgagcagcgggttcgcggcggccgtgagccggaccggagaacgggcgggaagccgggccggaattcggaccgcaggacgaaccggaagccgggccggaaggcagacctggcagcgggccgggagtccggcttcccgcctgccaccgcctccgggggcgcggccggtgccgtaccgcggcggcggctgggcggcacccgggctcggcccgtgtccgccgggcaccgcgggccgtgggtggcgtggtggctgctgaccccggccgggctggtgatgctggccgtcacggtcgccccgatcgtgttcctcgtctggacctcgttcaccgactacgaccaacgctccctgttcaccggtgcgttcgacatggtcggcacccgccagtacaccgatctgctggccgatccggagttctggagcgccctgggccggaccgtcgtgttcaccgcggccatggtggcggggagcgtcgccgtgggagcgggcgtcgcccagctcctgacccggttgggcgcggtgatgcgtacggccgtcaccctcgtcctcatcctcgcctgggcgatgcccacggtcgcctcctccctcgtgtggaagtggctcttccagcccggatacggcgtggtcaactggctgctcacccagaccggcctgttcggcgacatgaccgacaccgactggtccaacagcgccccgctggcctatgcgtccatctggctgctcatcgtctggcaggccgtgccgttcatcgcgctcgccctgtacgcggcgctgatccagatgccggccgaactgcaggaggccgcccggatcgacggtgcccgcgagtggcgcgtgtggtggtcggtcaccctgccgttcctgcggccgacgctgaccctgctcaccttgatgtcggtgatctgggacttcaacgtcttcaaccagatctggctcgtctcggccggaggacccgactccgcgacgaccacgctcggggtcttcgcgtaccggaccgccttcgtggcgttccgggtcggtcagggcgcggcgctgtccgtcgtcacgaccgtcctgctgctcgccgtcaccgcgctgtacgtgcgccgcctgctgcgctccggggaggacctgtgaccatgctccgcgcacgcggtgcccgctcggccgccggccgggccgggctgctcggcaacggcctcgcggtcgtgttctgcctggtgtggctgttcccggtgtactggatgatcaacacggcgttcaagccgcgctcggaggcgacgacggcgacaccgcgcttctggcccggctcgcccaccctgcacaacttcgacatcgcgctgaaccggaccggtttctggacgaacctgcgcaacagcctgatcgtggtcggcgggacggtcctggtcgccgtcgtgctcggcatgttcgcggcggcagcgctgtcccggttccgcttccgcggccggcgtaccgtcctggtcgcgatcctcgtcgcgcagatgctgccggggacggcgctgctgatccccacgttcctcctcttcaacgaggccgggctgctgggtacttacacggggctggtcctcgcctacctcgcgctggtgctgccgttctcgatctggatgatgcggggcttcttcgtcgccgtgcccttcgagatcgaggaggccgcgcggatcgacggcgcctcgacctggcaggtgctctggaagatcctgttcccgctggtgatgccgggtgtggtcgcgtcgagcgtcttcgcgttcatcaccgcctggaacgactacctgatcgcgtacacgttcatgaaggaccgcggccagtacacgctgccggtgtggctggcgtccttcaccaacccggccaccgggaccgactacagcgcgcagatggccggttcggtcgtcttctcgctgccggtggtcgtgttcttcctcctcattcagcgcaagttggtctccggcatgtcggccggagcagtgaaaggatgacccgcccgatggccctcccgatgctcctgccccgccccgcttcggtacgccccggcgacggccacttcctgctcgacgccgctaccgcgatcggcgccgcacccgagctgcgccccacggcccgctggctgcagtcggtgctacggccttccaccggcctggacctgcccctcctggccggggcgcgacgcgcgatcgagctgcggctggacgagcgtctcggcaaggaggcgtaccggctcgacgtcaccgccgacacggcggtcgtcgagggcggtgaccgcgccggtgtgttctacgggtgccagagtctgctccagttgctgccggccgccgtccaccgtcgtgccgaggcggccggggtgcggtgggcggtggcggccgtgcgggtcgaggacgcgccgcggttcgcgtggcgcggcacgatgctggacgtggcacggcacttcatgcccaagcacgatgtgctgcgcttcctcgacctgatggccatgcaccgtctcaacacgctgcacctgcacctcaccgacgaccagggctggcgcgtggagatcctgcgcagtccgcggctcacccaggccggtgcgtggcgccgtgagtcgcagctgggtgcggcgccggacgcggcgggcgacggacgcccgcacggcggcttctacacccaggacgacatccgcgagatcgtcgcctacgcggcacagcggcacatcaccgtcgtccccgaggtggacgtgccggggcattcgggcgccgcgatcgcggcctatcccgaactgggtgtgtccggcgagcagtcggaggtgtggacgcgttggggcgtgaacccccgcgtgctgaacgccgaggagtcgaccgtcgccttcttccgcggcgtcctggacgagatcatagacctcttccccgggccggtgatcggggtcggcggcgacgagtgtccgacggacgagtggcgcgaggacgcgcgcacgcaggagctgatgcgcctgcgcgggctgcgccacgagaacgagctgcggtcctggttcgtacggcagctcggcacccatgtgatgtcgcgcgggcggcggctgctgggctgggacgacctgctggcggacgaggtgccggcgggcaccgtgatcgcctcgtggcggggcatgaccggcgccgtcgccgcggcgcgcaggggcctggaggtgatctcctgcccggacgaccaggtgtacctcgactaccggcagtccgaacggcccgacgagccgatccccgtggcggtgccggtgacggtggagaccgcgtacgccttcgacccggtgccgcccgagctgactgaggacgagcgcgcacacgtcctgggcggtcaggccaacatctggaccgagcacatggactcgccgcggaccgtggactacttcgcgttcccccgcctgtgcgccgtcgcggaggcgctgtggagcaccggcgaacgcgggtacgaggagttccgcggacggcttgaccatcatctggcccggctggacgccgtgggcgtcgagtaccgccgcgagagcggccctctgccgtggcagacccggccgggtgtcacgggccggccgtcgaccgtggccgagcgggaggcgttcatcgacacactcgtgtccgacatcgacacctcaccgcagcgctgagggcaggtgtttccacgggcggaacctcgatcgagtagtcgctagtcttctgagtcgggaattctgttcagataactggcgaggcgtttcaggatctcgtccgcggtcttggtccagacgtagggcttggggtcagtgttccaggcggcgatccaggtgcggatgtccttctccagggcctggacgcttttgtggaccccgcgtcctatctgcttgtttgtcagctcggcgaaccaccgctcgaccaggttgagccaggaggatccggtgggtgtgaagtgcaggtggaagcgggggtgggccagcagccaggttttgatggcgggggtcttgtgggtggcgtagttgtccaggaccaggtggacgtccaggcccgccggtatctcctggtcgagtctgatcaggaacttcttgaactcctcggcccggtgccggcggtgcagggagccgatcaccttccccgtggccacctccagtgcggcgaacaacgtggtggtgcc

SEQ ID NO: 128 - DNA, 10675 bp, Unknown
  Kingdom: Bacteria, Phylum: Actinobacteria, Class: Actinobacteria, Order: Streptomycetales, Family: Streptomycetaceae, Genus: Streptomyces
acgcggtccggcgcctgaccgcgttgcacactcccgcccattccacatggtcggttcgagaaaggtgtgagtatgagattcgatcttatgcacgtgttgtcgaatcgcggacggaagcggccgtggggcgacctgctcgacgattcccggcgccgtgccgagctgggcgacgagctgggcttcaccggattgtggctgggggagcaccacttcgacgcggagggcagcgaccagctgcccaaccccgtgatgctcctggccgacctggccgcgcgcaccacccggatgcggctgggtatcgccgcgatcggactgcccctgtggcacccggtccggctcgccgaggacctggccatgctcgaccacttcagccgtggccgggtcgacgtcgccttcagccgcggcatcctgcgcggcgagatcgtcaacctcaaccccgaggccgaccgccgcaacgaggagaagagccgcgcgatcttcgccgagaacctggagatcgtcaagcgggcctggacccaggacccgttccgctggcacggcgagcggtaccggatcccctggcccgagacctcctggggcggcgacgccttgaaggactacgaggacgagaacggccacctcaccgggctccccgtcatccctcagcccgtgcagaggcccatgccgccgctgtacgccgtctcccagcagaccgagggcttccggctcgcggcacgccagggcatgggcgtcatcagctcccacccggccgggaagaagctgcgcgccctcaacgccgcctacgacgaggaggcggccgaggtgggacgcccggcccatgtgtccaaggtggcccccgcggtccgcgagttcttcgtcgccgagaccgagcaggaggcgcgcaaggagatcgaggagttcgtcaacggccgcttcgaggtcatcaagcgggtgcgcggcctcggcgcctggctcgacgtcgacgaggacccggacgacccggcgctgcaggcgatgacgggcttcgacctgatgatggagcgcgactacctgttcgtcggcaccccggactcggtggccgaacgcatggtgcgcctgcacgacgaggagggctgggaccacttcatgctcggcctggggcatgctccggccgacgccatcgaccgcagcatgcggctgatggccgaggaggtcgtcccgcgggtccttcgggccaccggcaacgaggcccagctcgacaacagcggatcggcacagtgagggcggggacgaacatggcggtcgaggagcagggcgagccgggaaccaccttcctggtcgcgccgacagcggaccgggagatgatgggcaagctggggctcggcggtgccgcgctggtcggtgagaagttgttcgccggctcgatggcgatcgacctcgcgacgctctcccgcgtcgaggaggccaagaccgtcgcggacgagacccggatctgcttcgacgcggtgaagacgaccctggagcgcgggggcggcacgctgcgcgacatcgcgaagatggtctgctacgtctccgacaagcagtacatcgaggagacgtggcgggccctggacgagatcttcgggccgggccccggcccgaagcgcatcaccctggtcgccggcatcgccggcgactgcagggtcgagttcgagatcctggccgtgctgccgcaggaggacgggcgatgaaggaactgatcagacccaacccgaacgggccgtccgccggcgcggtgacggatcacttcgtcttcaccgcggcatcggccatcgacccggccaccatgcgccgggtgcccgaggccgagacgctgcacgacgaggtgcgtgtgtgcctgcggcgcatcgagaagaccctcgccgaagcggggctcgccctgacggacctggccaaggtcacctgctgggtgagcgaggagaagcaccgcctggagttcgcctacgcctaccgcgacctgctcgcgccgggcccctacccgtcgcgcgggctgttcgtcatcgggctgcccggcgactgccgggtccagatcgacgccatcgccgcccggcggaagccggcctgatcaccgctcgcgccgcgacagcggtgccggtgaccgagcacccttcccccctcacgacgacgggacaaagatgaagacattcctgtccggccccttcgagcaccgatcggtcggcttctcggcgggcgtcgacgtcggcgacctcgtctacgccgacgcctccgccctcgacctgccacggctggagcgcgtggccgaagcgacgaccatcgccgacgagacacgtgtgtgcctggagcggctccggcagacgctggccgatgccgggtgcacgctcgccgacatcgtcaaggtgaactgctacctgaccgacgactcctaccgcaccgagttctggcggaccttcgacgacgcactcgcgccgggcccctaccccgtccgcatcacccaggtgggcggcctcgccggcgaagcccgggtgctgctcgacgccgtggcggcccgctgacaccgtacgcggcgagaggggggcggcaccggctcggtgccgcccccctctcgcacgatccgctccgcgtgccgtactcagttcaggttgaccgagaccagcttgagctcggtgtagacgtcctccatggggtagcggccgaggatcttgccggtcccgctcagcttgcccgccctgcccccgaacggaaggtgcaactccgtgtcgccgggccgggcgttcacgctgaccatgccggagggtgcctgctcggcgaacttcagtccgcgtgccaggtccctcgtgtagacggccgcgcacagcccgtacggcgacttgtgcatgaggtcgagagcttcggcctcggaggagatgcgctgcagcggtgcgatggggccgaaggtctcctccacggcgacggccatggcctccgtgacgtccgcgagcaccgtgggctgccagtacaggtccgtcgggaagcccttggcgcggccgccaccggtcagcagcacggcccccgcgtccagtgccgtgtcgacatgccggtcgagcttctcggccagcggggcgttgttgacggggcccatggtggtggtgtcgtcgaagggcaggcccagcctgatgtcgcgctggacggcctcggtgagacggcgggcgaactcgtcgtggacggcgtcgtgcacgaggaaccggccggaggcggtgcaggactggcctgccgcaccgtaggtcgaggccagcgcgtccgggaccacgacgtcgaggtcggcgtcgtccaggacgaccacggggccgttgccgccgagttcgatgagctgtgccttgccgctggcccgtgcggcgacgcgctgtcccgtggcgaccgaaccggtgaacgccaccacctggaccccgggatgcgccgacatcgcgtcgcccacgacggaaccctgacccgtcaccaggttgaagacgcccggggggaagccggccgcctcgaagcagcgggcccactcgtactcgatcagggtggtggacggcgccgggagcgccaccacggtgttgccggtggccagcgccggcgcgatctgtgccgacgccgtgcccagcgggaagttccacggctggatcgtggcgacgacaccgcgcgggacgcggtacaggaaggcgcgcttgcggggatccgacagctggggcatcgcgccctcgaggtacttcgccagctcgacggccacgcggatgttcgcgatggtctcgtcgatctcgggcagcgcctccagccggtacggcttgccctgttccagggcgagcagccgggccagttcctcccggcggttgcggatctcctcgatcagccgctccaggaaccggcatcggtcgaacacggtgagcgacgaccatgcggggaaggcgtcgcgcgccgcggagacggcccggtcgacgtcggcggggacgcccagcgcgaagctgcccaccacctgtccggtcgccgggctgacggcgtcctgtcgttcctgtccggccgactccacgaacctgccgccgatgaacgggccggcgtgtaccggcgtgtgtggctcgttcctgatcaacgtgacaccccttctgcagcctcaactggtggtggtgaacggggcggatggcgcacacgcagcccggtctcggggacggcgggaagacacgcggtcgcggtgggttgctcacaagctgaccggctgttccatccaaccggtcggaatgttatgggggcttttcacggagtgtcaacgctgcttcactgggcacgggacgcctggcctcatgcgccgtgtgcggtgcgatcgagttcgtcccgacctcttgacgggtgcgcggaccgttcagatactcgcctcttagataccaaccggtttgtaggtagcccggcgatgagggccgcatccggtccaggtggaggaaacatgtccctgaagcttgcaaggcgcctggccggtgccctggtcgctgccgtggccctgggggcgtcgggctgttcggtgtcgacgtccgatccgggtgcaccggcccatgacgcgacgaacaacgcgtcagcggcccggctgccggcgaacatcaagagcaagggcgcgatcgacgtgggagtgtacgttccctacgcgcccctcacatatgtggagaacggcaaggtggtgggcacggaaccgaccttgttcaatgccgccgcggacaagctcggagtgcgggtgcgctaccacaccctggcgttcgaatcgatgatcccgtccatcgtcaacggccgcaacgacgtcctgatcggcatgttccaggacaccgccgagcgccgtcagcaggtcgacttcctcgacatcgcccgcagcggaatgcgcgcggtggtactcaagggcaacccgaggcacgtcgaccccagggccgtgtgcgggctgacggacggcgaggtggccggcagctaccagctgaccgtcgcccagtacctggcacagcagtgtgtgaaacagggcaggcccaagctcacggtcctcaccttcaccgaccccggccaggccttcctgtcgctggagaacggccgtacggacttcaccttgcaggagcccacgatcgcgacgtacacggcccggcagaacgacaagctcgaggtgctgccgcccttggtgaccctgcccgggaagaacgacgagggctgggtcctgcccaagggcaacccggggctgcgcacggccctcgtcggagcgatccaggacctggtcaaggaggggcgctggcagcagctcatgaaggagacgggcatcggcgacgcggcgctcatcccgcccttggtcgacaccgggcaggcaggcgtccggtgaacccgcccacgggacatgggacaaccgccggggacaaccggtgaggccgcacgggaagcaggcggcgcggcggctccgcgtgggaccggcggccggcgccctggcgggtgctctggcgctgctgacctccgcttgttcggtctcgcccgcggacccgggcgcccccggccgcggctcctccgcgatccacctgccggacgacgtgcggaagaagggcgccatcgacgtgggagccttcttcaactacccgccgtacacggtcgtcgagggcggccggctggagggcatcgaacccgagctgatccgggccgtcgcggacaagctgggcgtgcaggcccggttccacgacctgtcgttcgaggcgatgatcccgtcggtggtcaacaggcgcagcgacctgttgatcggcatgttcgccgacaccgcggcacgtcgtgagcaagtcggcttcgtggacgtgatgcgcagctcgatgcgcgccctgacgctcaagggcaaccccaggcatgtcgacccgtcggcaccgtgcgggcacacggtcagcgagtcggcgggcagctaccaggagggcttcgtcaagggcgtggccgcccggtgcgccaaggagagcaagccggccctgaagatgctcaccttccccgaccccggcaccagcttcctcgcggtgatcaacggacgtaccgacttcacgttgcaggaacccgcgctcgcccggtacacggccgagcacaacaaggcgcttcaggtgctggacacgcccgtggaagagcggggcggtcccgtgcagggatggatcttcgccaaggacgacaccggcctgcgcacggctttcgtcaaggccgccgacgagctgatcaaggaggggaagtggcagaagatcatggatcggtcgggtatcggagacgcggcgctcaacccgcccacggtcgacacccggccggtgaccacacggtgaccgccgaggggacacctgccggcgggaccggggcgcgcgagtggcgcaaggacgccgcggacctgccggtcgtaccgcgccgctacccgtggcggtgggcgagcgccggcgtggtggtgctgctgctcgcctggatggcctgggtgctggcgaccacgcagacgatggagtggagcaccgtcgggcactacctgttcagcccggaggtgctcgccggggtgaagaacaccgtcatcatgacggtgctgagcatggcggccggcatggtgctgggcaccgtcgtcgccgtgatgcgcctgtcgcccaacccggtcctgacgggtgtggcctcgctgtaccagtggttcttccgcggcacgccgacgctcgtccagctcatcttctggttcaacctgtcgtccatcttcccgcggttccagatcgccggcgtgggtgtcgtgaacaccaacagcgtgatgaccccgttcctcgcctcggtgctcgggctcggcctgaacttcgcggcgtactactcggagatcgtgcgcgcgggcatcctctccgtcgacgagggccagtcggacgcggcgaccgcctacggcctcagccggttcgggacgctgcgccacatcgtgctcccgcaggcgatgcgggtgatcatcccgccgaccggcaacgagctgatcgggatgctgaagttcacgtccctggcgagcgtggtgtcctacgcggagctgctgcgcaacgtcagtgacatctacaaccgcacctaccaggtcatcccgctgctcatcgtcgccgcgatctggtacctgttcatgaccaccctgctcagtaccggacagtacttcctggagcagcacttcgcgcgcggcgcccagcgcaccacccaggtgtccctgggcgagcggatcgtcgccggccttcgcggaaggagggccaggcgcccatgacgcccatgatctccgcacagtcggtgagcaagcactacggacacacccgggtgctggaggacatcacactcgacgtggccccgggcgaggtgtgctgtctgatcggcccgtccggggccggcaagagcaccttcctgcgctgcgtcaaccacctggaacgcatcgacggcggccgcctcctggtcgacggggaaccggtcggctacgccgagcgcggcggcaagctgcacgagatgcacggccgtgagctgagccggcagcgctcctcgatcggcatggtcttccagcacttcaacctctactcgcacatgaccgcggagcagaacgtgagcttcgcccctgtggccgtgcacaggcgcgcccggtccgcggcgcgcgagcgcagcagggaactcctcgcccgtgtcgggctcgcggacaaggccgacaagtacccccgtcagctctccggcggtgaacagcagcgggtggccatcgcgcgggcactcgcgatcgacccgaacgtcatcctcttcgacgagccgacgagtgccctcgaccccgaactggtcggagaggtcctggaggtgatccgcggcgtcgccgaacaggggatgacgatgctgatcgtcacccatgagatcgagttcgcccggcacgtcggcgaccgggtcgtcttcatggacggcggcgtcatcgtcgaacaggggccgcccgcggaggtcctggagaacccgcgtgaggaacgcacacgtacgttcctgcggcgcgtgctccagtcacacaccgaccacgactgacggaccgacagaccggaacactgagacggaggagtggaatgcgacttcagacgaccgaatggggcgacccgtcgggacgcccgctggtctgtgtgcacggtgtcggcggacaccacggcaacttccagcacgtggcgcaggaccgctggggcaagcacttccgggtcatcgccttcgacctgcggggccacggagagtccggctggacgccgccgtggacccacgccacctacgtcgacgacatcatcgagaccatcgacgcgctcggaatccagcagccggactgggtcggcgtctccttcggcggccggctcgtgctcgaactgatcgcccggtatccggagcgggtgcgccgcgcggcggtgctcgaaccggtcatccagatcacgcccgaactggccatgcaccgggcggaacaggaacggctgggcggcgtctgggagtcgatggaggcgttcgtcgccggccgcgagaacaccggcgacatcgacaccgaacgctacatcgcggatctggaggggcacttcgagaccctggaggacggacgtgtacggcggcggaccaaccagtgcgccatcgtgtccgtcttcagcgagttcgccgcgccggcgccgcctcccgagacgatcaccgtgccgacgatgatgctgtacgccccggccttcggcctggtcacccccgagcagcggcaggcgtacgagccgcacctggcccaggtcgtcgaggtgcccggtctgcacgcggtgctgacctcggcctacgaggagaccgcgaccgcggtggaggacttcctgctcgcaccggacagcggtccgcgcggctgagcgagccgcacaccctcttccgccgcgaccggcacccgcgcgaaggaggacgtgaatgaccgagcggctcccgctcgtggtacgggccaccgaggacgggttacgtcgacacggcccactgggtccccgatggtcccgtcgttctggactccagggacgagaccctcacgcagaccctcctgagccgggcttcggccggctccaccgacctgctgttcgccgtcgcccgggtgctgcccggcatgcaccacatccggcaccaccacccgtacggcggcgagacctactacatcaccaagggctcgtgcaccgtcttccccgacgacgaggagatcaccgcgacccctgggaccgccctctgcattcacccgaagtgcgtgcacggcgaccgcaacgacaccggcgaggtgtgcgagatggccgtggtgtgcagcacaccggagtacgcctccctcggcctcgtccacgacgaatagccggggtctcccgcaccgaaagcggcccaccaggcgtgtgagaccgaccggtcagtctatacgaaggagtggcatccatgaccaaccgtccccctggcaggcgcaagggcgtgagggccgacgtcttgcgggggccgttcgacccgggcggtcagccgctggtcaagcgcgagaaccacctgcacctctccctgttcgcctggaacgtccgcaacggactctccgccagcaaggccgtgctcagcgacccgcagaggcaccaggacttctggcagtggccgacggcttcgcggctgctgaaggaggcggagcgggccgggttcgacagccagctgcagtacggcatgtggagcggctacggcggagccaccgggtggaacgacgcccagctcgacttcgcgaccgccgcgaccggctccgccgtcatcaccgaccgcctcggcatctacacgaccatccacgtcggttacgggttccacccggtgctcatcggcaagatgaccgcgaccatcgaccacatgtcggccggccggctgggcgtcaacatcgtcgcggggtcgaacgcggcggactacgcgcagttcggactcgagggcccgccgtcccagcaggtccgttacgcgatcgccgacgagttcacgacggcgctgaagtacctgtggacctccgacgaaccggtggacttcgagggcgagtacttcaccatgtacggcgcccaggtcaacccgcgcgccaccagccggccccggcccctgctgatcgcggccgccggttccgacatcggcctggactacgcgacccggcagtgcgacgcgctgttcatcacctcccaggacaacgacctggagggcttcgccaagcgggcaaagaagatccacgacatggcggcctcgcacggcaggcgggcgcgcgtgtgcgccatgtgctacgtcgtgatggaggagtccgacgccaaggcgctggagaccgtcgagtggatgaagggccagatcgacgacggggccctgcagacctggctcctgcgcgccggccacgtcctcaacagcgagcggcagcaactggaccccggccaggtgggggccacgcgcaccgaggaggccaagaaggacccgtacctcggcatcgggcaggacttctacgagagcctcggcctgggcatgggggcgtaccggctgttcggatcgtacgagacggtcgcgaaccagctgatcgacctgtacgaggccggcgtggagcaggtggcgctgtgcttcttcgaccccctcaagggcgtgcggcagatgcgtgagcacgtggtgccgctgctgcgggcccgcggctaccaccagaacccggtgtaggccgcggcccctgccgacgaggaggccacccgtccccgcgacgccgccgtgcccgccg

SEQ ID NO: 129 - DNA, 1496 bp, Unknown
  Kingdom: Bacteria, Phylum: Actinobacteria, Class: Actinobacteria, Order: Streptomycetales, Family: Streptomycetaceae, Genus: Streptomyces
cgccgccgcgaccggcaggatccgggtcggcaccggcggggtcatgctccccaaccaccgccccctggtcgtcgccgagcagttcggcgtcctggagtcgctgtaccccggccgcatcgacatgggcctcggccgttccgtcggcttcacggacggcgtacgccgggcgctgggccgcgacaagggcgacgcggaggacttcgcggcccagttggcggaactgctgggctggttcgagggcacgtccgcgacgggagcgcacgcgcggcccgccgaggggctgcgcgtgccgccgttcgtgctggccatgggcgagggcgccgagatcgccgcccgtgcgggcctgccgatggtcatcggtgatctgcgcgaccgcgagaagatgctgcgcggcatcgaccgctaccgcaccggcttccgcccctccgcctgggcgcacgaaccgtacgtcgtcatctccggcacgatcgcggtggccgccgccgaagagcgggcccgccgaatcctggtcccggaggcctggtccatggctcacgcccgcacccacggcacgttcccaccgcttccgcccgccgaaggcgtcgaggcagcaccgatgaccgccaaggagcgcgacctgttcgagaccggcctgaccggacacctggccggcacggcggaccaggtcgcggacgagctggagacggtactgaaggagacgggcgcccaggaggtgctggtcaccacgagcacgtacgaccgcgaggcgctgctcgactcgtaccgtcggctggcggggctcttccgggcttgaccctcgacctggtcgaggcatgagggttcctcgcgtggagaacgacatgtacagcatcggggagatggcccgcaccagcgggctcagcgtgagcgcgctgcggttctacgaccgtgccggcgtgctggtccccgcctgggtggacccggtgagcggctaccgctggtacgccgccgagcagtgcgccgaggccgccgtgctggcccggttgcgccgggccggcatgccgctcgccgacatccgtctggtgctggccggctggtccagtgccgacacggacttggtgcagggcctgctgcagacgcacctgcgccgcctcgaagcgggcctgtccgacgcacgccgcgagttctccgcgctccggacccacctcgaccacagggagaacccgatgacctcgccgcgcaccgccaccgtccggctgacccttcccgcgccggacctggccgccgcgctggacgcggtccgcttcgcggcgggcaccggcccggaactgccgatgctctccggagtcctgttcgacatcgacggcgggacgcttcgcgtcgtggccaccgaccgctaccggatggccgtcgcgcaggcacgcaccaccggtcacgaaggcccccgcacccaggtcatcgcgcccctccccctcgtggacgcgatgcgtgcgctgctcggcggcggcgaacccgcccacctcggcgtggacgcgggc

SEQ ID NO: 130 - DNA, 10500 bp, Unknown
  Kingdom: Bacteria, Phylum: Actinobacteria, Class: Actinobacteria, Order: Streptomycetales, Family: Streptomycetaceae, Genus: Streptomyces
ccgcgaggccatccaggctgccggacccgacgaacgcgccgaagcgctcgccaaggccctgagcctggacgggtacgctgctacggcgcgcagcgcaccggtcggcgagcagctctgccagcaccactgccccgtcgcccacgtcgcggaacagttcccgcagctgtgcgaggcggagacggagatcttcgccgagctgctgggtactcacgtccagcgactggcgaccatcgcccacggcgacggcgtctgcacgacgttcatccccaggatttcccagacagacaacgcatccgctagcacggccgggaggaaccccgcatgactctccccacggagactgcccaccccgaactcgagggcctgggcaagtacgaatacggctgggccgactccgacgaggccggcgcctccgcgcggcgcggtctgaacgaggacgtggtcaaggacatctcctcgaagaagtccgagccggagtggatgaccaagctccgcctcaagggcctcaagctcttcgagaagaagcccatgccgaactggggctcggacctgtcggggatcgacttcgacaacatcaagtacttcgtgcgctccacggagaagcaggcggagtcctgggaggacctgcccgaggacatcaagaacacctacgacaagctgggcatcccggaggccgagaagcagcgcctggtcgccggcgtggccgcccagtacgagtcggaggtcgtctaccaccagatccgcgaggacctggaggagcagggcgtcatcttcctggacaccgacaccgccctgaaggagcacccggagctcttcaaggagtacttcggcacggtcatcccggccggtgacaacaagttcgccgcgctgaacaccgccgtgtggtccggcggctccttcatctacgtgccgaagggcgtgcacgtggagatcccgctgcaggcctacttccggatcaacacggagaacatgggtcagttcgagcggaccctgatcatcgtcgacgagggtgcctacgtgcactacgtcgagggctgcaccgctccgatctacaagtcggactcgctgcacagcgcggtcgtcgagatcatcgtcaagaagaacgcccgctgccgctacacgaccatccagaactggtcgaacaacgtctacaacctggtcaccaagcgcgccgtcgcctacgagggcgcgaccatggagtggatcgacggcaacatcggctccaaggtgacgatgaagtacccggccgtctacctgatgggcgagcacgccaagggcgagacgctgtccatcgccttcgcgggcgagggccagcaccaggacgccggttccaagatggtccacatggcgccgaacacgtcctccaacatcgtctccaagtcggtggcgcgcggcggtggccgtacctcctaccgcggcctggtggagatcggtgagggcgccgcgggctccaagtccaacgtgctgtgcgacgcgctgctcgtcgacaccatctcccgctccgacacctacccctacgtggacgtccgcgaggacgacgtgtccatgggccacgaggcgaccgtctccaaggtctccgaggaccagctcttctacctgatgagccgcggtctgaccgagttcgaggcgatggcgatgatcgtgcgcggcttcgtcgagccgatcgccaaggaactccccatggagtacgcgctggagctgaaccggctgatcgagctgcagatggaaggcgcggtcggctgacgaccgcccgccgagacagccagcgaacactgacgtaggaagagagcagaccgacagccatggctgaggcccagaacatcccggtgggatccactaccgccggccagatcgcggtggccgcggagtcgaccgtcgccacgcgcatgagcgcgcccccgtccttcgacgtggcggacttcccggtcccgcacggccgcgaggaggagtggcggttcaccccgctggagcggctgcgcggcctgcacgacggcaccgcgaccgccaccggcaccggcgtgaaggtggacgtccaggcccccgagggcgtgaccgtggagagcgtcggccgcgacgacgcgcggctcggcaaggccggcatgccggtcgaccgcgtcgccgcccaggcctactccgccttcgagcaggcctcggtcgtgaccgttcccaaggagaccgtcctgaccgagccgatccgcatcgcggtgcacggcgagggcggggtcgcctacggccaccaggtcatcgagctgggcgccttcgccgaggccgtcgtcgtcatcgaccacaccggtgacgcggtcctcgccgcgaacgtcgactacctcctgggcgacggcgccaagctcaccgtcgtctccgtccaggactgggacgacaaggccgtccacgtcggccagcacaacgcgctggtcggccgcgacgccaccttcaagtcggtcgtcgtcaccttcggcggcgacgtggtccggctgcacccgcgcgtgacgtacgccggcgccggcggcgaggtcgagatgctcggcctgtacttcaccgacacgggtcagcaccaggagcaccgcctcttcgtcgaccacgacgcgccgcactgcaagtcgaacgtcgtctacaagggcgcgctccagggcgaggcagcgcacgccgtgtggatcggtgacgtgctcatcgaggccagggccgagggcaccgacacctacgagatgaaccgcaacctggttctcacggacggcgcccgcgtcgactccgtgccgaacctggagatcgagaccggcgagatcgtcggcgccggtcacgcctccgccaccggccgcttcgacgacgagcagctcttctacctgatggcccgcggcatcccggagcacgaggcccgccgcctcgtcgtccgtggcttcttcgccgaactggtccagcagatcggtgtcaaggacatcgaggagcgcctgctcggcaagatcgaggaggagctggaggcgtccgtcgcatgagcggtgcctttgtacgcgtgtgcgcgctgagcgagctggaggaggacaccccgaagcgggtggaactcgacggcacgcccatctccgtggtgcacaccgagggcgaggtgttcgcgatccacgacatctgctcgcacgcgaacgtctcgctcgccgagggcgaggtcgacgactgccacatcgagtgctggctgcacggctcgcgcttcgacctccgttccggcaagcccgacagtcttccggcgacgcgtcccgtccccgtataccccgtaaagatcgaaggggacgacgtgctcgtctccctctcccaggagtcctgaggcatccatggcaacgcttgaaatccgagacctgcacgtcaccgtcgaggccgacaacgccacgaaggagatcctcaagggcgtcgacctcaccgtgaagcagggcgagacgcacgccatcatgggccccaacggctccggcaagtcgaccctcgcctactcgctcgcgggtcacccgaagtacacgatcaccggcggcaccgtcaccctcgacggcgaggacgtcctggagatgtccgtcgacgagcgcgcccgcgccggcctcttcctggcgatgcagtacccggtcgaggtccccggcgtctcggtctccaacttcctgcgcacctccgccaccgccatccgcggcgaggcccccaagctgcgcacctgggtgaaggaggtcaaggagaccatggagcggctccacatggacccctccttcgccgagcgcaacgtcaacgagggcttctccggcggtgagaagaagcgccacgagatcctccagctcgaactgctcaagccgaaggtcgcgatcctcgacgagaccgactccggcctggacgtcgacgcgctgcggatcgtctccgagggcgtgaaccgcgtccgcgagacgggcgaggtcggcacgctgctgatcacgcactacacgcgcatcctgcgctacatcaagcccgacttcgtgcacgtgttcgccgacggccgcatcgccgagtccggcggcgccgagctggccgacaagctggagaacgagggctacgaggcatacgtgaagggtggccccgtgagcggagcgaactcagtgggaggcgtcgcgtgacacagctgccgggcctcctcgacaccgaggcgatccgcaaggacttccccgtgctggaccgactggtccacgacggcaagaagctcgtgtacctggacaacgcggcgacctcgcagaccccgcgccaggtgctcgacgtgctgtccgagtactacgaacagcacaacgccaacgtgcaccgcggtgtgcacgtgctcgccgaggaggccacggcgctgtacgagggcgcccgcgacaaggtcgcggcgttcatcaacgcgccgagccgcgacgaggtgatcttcacgaagaacgcctccgagtcgctcaacctcgtggcgaacatgctcggctgggccgacgagccctaccgggtggaccacgacaccgagatcgtcatcaccgagatggagcaccactccaacatcgtgccgtggcagctgctggcgcagcgcacgggcgcgaagctgaagtggttcggcctgaccgacgacggccgcctggacctgtcgaacatcgacgaggtcatcacggagaagacgaagatcgtctccttcgtgctggtctccaacatcctcggcaccctcaacccggtcgaggcgatagtgcgccgcgcccaggaggtcggcgccctggtctgcgtcgacgcctcgcaggccgccccgcacatgccgctggacgtacaggccctgcaggccgacttcgtggccttcaccggccacaagatgtgcggcccgaccggcatcggcgtgctctggggccgccaggaactcctggaggacctgcctccgttcctcggcggcggcgagatgatcgagacggtgtcgatgcactcctcgacctacgcccccgccccgcacaagttcgaggccggcaccccgccgatctcgcaggccatcggcctgggtgcggcgatcgactacctgaacgcgatcggcatggacaaggtcctcgcgcacgagcacgcgctcaccgagtacgcggtgaagcggctcgcggaggtccccgacctgcgcatcatcggcccgaccacggccgaggaccgcggcgccgcgatctccttcacgctcggcgacatccacccgcacgacgtgggccaggtcctcgacgagcagggcatcgccgtccgggtcggccaccactgcgcccggccggtctgcctgcgctacggaattcctgcgaccacgcgagcgtcgttctatctgtactccacgccggccgagatcgacgccctggtggacggcctggagcacgtacggaacttcttcggatgaggggctgaggcgtgaagctggactccatgtaccaggacgtcatcctggaccactacaagcacccgcacgggcgtggtctcagggacggcgacgccgaggtgcaccacgtgaacccgacgtgcggtgacgagatcacgctccgcgtgaagtacgccggcaccacgatcgaggacgtctcctacgagggccagggctgctccatcagccaggcctcggcctccgtgctgaacgacctcctggtcggcaaggacctggccgaggcgcagaagatccaggagaccttcctggagctgatgcagtccaaggggaagatcgagcccgacgacgcgatggaggagatcctggaggacgcggtcgcgttcgccggggtgtccaagtatccggcccgggtcaagtgcgccctgctgagctggatggcctggaaggacgcgacggcccaggcgctggacggcgccgacgccgaaaggaagaccgcatgagcgagaccgtggagatgaagccggcctcggaggaggagctccgcgaggccctgatggacgtcgtcgaccccgaactgggcatcgacgtcgtcaacctgggcctcatctacggcatccacgtcgacgaggcgaacatcgcgaccgtcgacatgaccctgacgtcggcggcctgcccgctcaccgacgtcatcgaggaccaggccaagtccgccacggacggcctcgtcaacgagctgcgcatcaactgggtctggatgccgccgtggggcccggacaagatcacggacgacgggcgcgagcagctgcgggcgctcggcttcaacgtctgagagaccctgcgcccgtgcgccctgctccgccgacggcgcaacggcgtaacggcgtcccggaacggcggtacctgcgggtgccgccgttccgctgttttccgaggccccgttacgtacgctcgtacacatgggatacctgttcttggccggagccatcgccgccgaggtcgctggcaccaccgccatgaagtacagcgagggcttcagcaggctggggccctcggtgctgaccgcgctcggctacctgatctccttcgcgctgctcgcccagaccctcaagaccctcaacgtgggcaccgcgtacgcgatctggtccggcataggcaccgcggccatcgccaccatcggggtcgccttcctgggcgagggcatgaccctcaccaaggccgccggggtcgcgctgatcatcgtcggcgtggtggtgctcaacctcggcggagcccactgatgccccggcgctacgacccggaccggcgccagcggatcatcgacgcggcgatcagggtcgtgggggccaagggcatcgccgggctcagtcaccgcaccgtcgccgccgaggccgatgtgccgctcggctccacgacgtaccacttcgccaccctcgacgacctgctcgtcgcagccctgcgccaggccaacgagggcttcgccgaggcggtcgccgcacgcggtgcgctggccgccccgcaccccgacctggcgcgggaactcgccgccgcgatgggggagtggctcgccggcgaacgcaccggggtcgagctggagtacgagctgtatctggccgcgctgcgccgccccgccctgcgtccggtcgccgccgagtgggccgacggcctcgccgccctcctcgcccgccacaccgacccggtcaccgcccgcgccctggtcgccctggtggacggcatctgcctccaggtgctgctgacgggcggttcgtacgacgaggagtacgcccgcgacgtgctggctcgggtgatcccaccgaggtcgcccggcacgtgagacagggttcgctcccgcacccgcccccacgttaggttttccccatgaccgacactgctccccgcaccaccggcgccgtcgccgccggactcgccacgatcgccgccgacggcaccgttctcgacacctggttccccgctcccgaactgacggacgagcccggcccggccggcaccgagcggctgtccgccgagcgcgccgccgaactgctcggcggcggcgccaccgcggcgaccggtccggacgcccgccggggcgtcgaggtggtcgcggtccgcacggtcatcgcctcgctcgacgagaagccgatcgacgcgcacgacgtctacctgcgcctgcacctgctctcccaccgcctggtcaagccgcacgggctgagcctggacggcatgttcggcttcctcgccaacgtcgcctggacctcgctgggcccggtcgccgtcgacgacgtcgagaaggtgcggctcaacgcccgcgccgagggcctgcacctccaggtcacctccatcgacaagttcccgcgcatgacggactacgtggcccccaagggcgtccgcatcgccgacgccgaccgggtccggctcggcgcgcacctctccgagggcaccaccgtgatgcacgagggcttcgtgaacttcaacgcgggcaccctgggcacctccatggtcgagggccgcatctccgcgggtgtcgtggtcggcgacggctcggacatcggcggcggcgcctccacgatgggcacgctctccggcggcggcaacgtgatcatctccatcggcgagcgctgcctgatcggcgccgaggcgggcgtgggcatcgcgctcggcgacgagtgcgtcgtcgaggccggcctctacgtcaccgccggcacccgcgtcaccatgcccgacgggcagatcgtcaaggcccgcgaactctccggcgcctcgaacatcctcttccgccgcaactcggtcaccggcgccgtcgaggcccgcccgaacaacgcggtgtggggcggcctcaacgagatcctgcacagccacaactgacgcgcggcgagcgacagagcgcacgaggcgcccacccactgccgggtgggcgcctcgccccgtctacggcgacaccgaggccgcgaaccgcgcgagggccgtgaagtcgctctcgcgcaggcccacgcggggatcgacgtggtgcaggagggccgggccggggtgtccggcccgcacgtactccgtgtccgcgggggtctgttcgtcgtccacccaggcgaacgggcggcccgccgcgtacgccacgatcgcctccgtcttccagtggaccccgtcggggcgcagcgcgaacaggccggcgccgaagtcgacgtacggcagctcgggcagtcggacgaccggggcgatccagcggttcgcggcgtccatccaggtggtggcccagcacaggtcgtagccgaggccgagcagggccgggccgtgcgccgggttcagccagacgcgcagcgcccggcccgggtgcagggacacccggatcgtggtgtagccctcgggacgccgttccggctcggccgcccaggggttgagggggccgtcgacgtcgaggaacagcagcgggcggctcacacggccagcgtacggctcagggcgcggacgcggtgagccgttcgtaggccgccagcaggccgtcgaccgccgcctggccggcggcccgcagcggtgcgcggaccgggccggcgggcagcccgagcgcaccgagcagggccttcacggtgaccgcgccgggcaggcccgcggacatcgtcaactcgatgagttccgtggcctgttgctggagccgggccgcccgcgcggtgtcgcccgcgtcgaacgcgtccaggacggcgcgcagtcggcccgggacggcgttcgcgaccgtgctgacgtaaccggcgccgccgaccgcgtagagggcgaggttgtgctcgtcgcagcccgcgtagaacgccaagtccgtgcgcgccagcagcttctggacgccgaggaagtcgtaggagcagtcctttacggcgacgatccgggggtgctcggccagccgcagcagggtgtcgggctcgatgcgggtgccggtgcgggccgggatgtcgtagagcacgacgggcaggccggaggcgtccgcgaccgtgcggaagtgcgcctcgaccgcgtcctgagggggccggctgtagtacggcgtcacgaccagcaccgcgtcggcaccggccttcccggccgcccgggcgagttctacggtgtgccgcgtgtcggccgtgcccacgcccgcgaccagcgcggcgcgctccccgaccgcctcccggacggcccggaccagctcggccttctcggcgtccgtggtggtcggcgactcgccggtcgtgccgctcagcacgaggccgtcgcagccctcgctcaccaggcggtccgccagccgctgcgcgccgtcgaggtcgagggcgcccgatgcggtgaagggcgtgaccatggcgcacagggcgcggccgaaggggcgggcggcactcccggcactcggtgcgctcttcgcggtcgtcgtcatgggggtagtctcggcggcacctccgtgaagctccacttaattcttctacgggatattggtaagcagtgctggaatgatggtgtgctgtgtgcaaagtcggcggtatgggtcaccatgggggtgaaggtcactgaccggcagctcatgggaggcgtcatgaagctcggcaaggcactggccaccggggtcgcggaggagaaggagcagccgcggaccgccgaggaggagacccccgtaccggccgtggaggttccggaggagtcaccggccgccaccgcgtccgaagaggtcccggccgcccgatgaggctgcggctgccgacggaacacccgacggagccgccgaccggttacaagatcgcccacccggtgctgtcgcgggacggcacccgggccgggttcaccggagtgtcgctcggcggtgcgctgccgtacggcgtcgtcgcggaggccggctgcgtctacgggcgccggcaccggtcgcccgcccggctgtgcgactgcggcttccactgcgtgcacgaacgcgccgccgccgaggaactgttgtgcacggccgagcaccgggccgcggtgctcctggaggtctcggtcctcggcgcctacatccgcttcgaacgcgggtaccgctatgcccgccagcgggtgcggacgatgacggtcggaccgtgcgcgtgcggcatgcccgccgccgcgctggccgacgcgggctggggtcggcccggccggcaggtcctggccgcagcctgtgcgggctgcgtgcgggggcgtacggcgctgaccttcgc

SEQ ID NO: 131 - DNA, 3438 bp, Unknown
  Kingdom: Bacteria, Phylum: Actinobacteria, Class: Actinobacteria, Order: Streptomycetales, Family: Streptomycetaceae, Genus: Streptomyces
gggcatcgtggtgacccgggggcgcggcgggacggtggtggcgcccgcgcccgcggtggcgtcgcgccggccgccgaaggtgccgcgggggctgcgggacctggcgggcgggcatccggatccggcgttcctgcccggcctcgtaccgccgtcgcgtctgtcgcccggggcgcggtcgcaccgctcgaccccgcgcctgccacggctggaggagaccgtgcgggactggctgcggcccgacggcgtgccggtggagcacgtgacgttcgcgcacggtgcgctggacctggtggggcgcctgctctccgtcgagctgcggccgggggacgcggtcgcgatggaggacccgggctaccaccacctgctggacctggtgaccgcgctgggactgcgcggtgtcgcggtggcggtggacgacgaggggatgcggcccgacgccctgcggcgggcgctgcgggcgggtgcacgggccgtggtgtgcagtccccgggggcagaatccgtacggcggctgtttctcggaggaacgccgcgcgtcgctggtcgacgtcgtgcgggaggagccggacgtgctggtcgtggagaacgaccacgcctcggcggtggcggacgtgccgctgcgcacgctcacctccggcgctctggcccggtgggtgcacgtgcggacggtgagcaagttcctgggcgccgacctgcgctgggcggcggcggcctgcgacgccaccaccctggcccggcacgacgggcggctgctgctgacctcgggctgggtcagccacctgctccaggagacggtccaaggactgatgacggacgagggcacgcgcgcgctggtgtcccgcgcgcgtgagacgtacgccgttcgccgtaccgcgctgctgcgggagctggcggccaggggtgtcggggcgcacggggcgagcgggatgaacgtctgggtgccggtgtccgacgagtccgccgtggtgaacgggttgcggtcctacggctggtgggtcgcggcgggggcccggttccgtctgtcgtcaccgccgggtgtgcggatctccgtggccgacctggaaccggccgacgcggcccggctggcctccgacttcgccgtggtgctcggcgagtcggaggccacctacggcggctgaaaccgggggcggcccgctcccctcaggtgcgcttgcgggccagttcctcgtagaagcgcagcaggccgagatcgtcgacggagccggggttgacggccttttccagcggggtgccctggagcaggcgcttgaccgggacctcgatgcgtttgccggtgagggtgtgcgggacgcccgggacctcgatgacctcgtcggggacatggcgcggggagagctgttcgcggatggtgcgcttgatgcggtccaggagcgcgtcgtccaggacagcgcccggggccagctgcacgaagaggggcatccagtacccgccgtcgggctgttcgacgccgatgacgagggattccttgatctcggggagccgttcgacggcctcgtagatgtcggcggagcccatgcgcacgccctggcggttgagcgtggagtcggagcggccgtggatgatcacggagccgcgggaggtgagcgtgatccagtcgccgtgccgccacacgccggggtacacggcgaagtagctgtcgtggtagcggctgccgtccgggtcgttccagaagtggaccggcatggagggcatggggttggtgacgaccagttcgccgacctcgtcgaccagtggtgccccgctggggtcccaggactgcaggtcggtgcccaggcagggggcctggagttcgccgatgtggaccggcagggtcggtacggctccggcgaagcaggagcagacgtccgtgccgccgctgacggaggcgatccacaggtcctcgccgacctcgtcgtgcagccagcggaacccgtcgggcgggagcggtgatccggtggtgccgacgcactcgagccgggagaggtcgtagtcgcgcgccgggtgcacgtccgccttgcggcaggccatgacgtacgcggcggaggtgccgaagagggtggctccggtgcgctcggcgacgcgccactgggcgcccgtgtcggggtacccggggcttccgtcgtacaggacgatcgtcgtacccgtcagcagtccggagacgaggaagttccacatcatccagccggtcgacgtgtaccagaagaagcggtcctcggggcccaggtcgcagtgcaggccgagctgcttgaggtgctccacgaggatgccgccctgcgactgcacgatggccttgggcaggcccgtggtgcccgaggagtacagcacccacaggggatggtcgaagggcacctgttcgaagacgggttccacatcggcggcggtcaggtccggccaggcgagggcgccctcgggggcggcgctgccgagcagggggatgtggacgacggcgcgcagggtgggcagttcgcggcgcagttcggtgacgacgtcgcggcggtcgtgctccttgccgccgtagcggtagccgtcgacggcgaagaggacgaccggttcgacctgctggaagcggtcgagcacgctgcgggcgccgaagtcgggggcgcaggacgtccacaccgcgccgacggcggccgtcgcgagcagggcgacgacggcctcggggatgttcggcaggtacccgctgacgcggtctcccgggcgtacgccgagggcgcgcagttcggcggcgagggagccgacctggcggcgcagtgcggaccaggtcaccgggcgcggttcgtggctctcgtcgacgtggaggagggcgggctcgtccgggcgggtggcggcggcgcgcagggcgtgttcggcgtagttgagggtggcgccggggaaccactgcgcgccgggcatcgtgcggtcgcccagcacgcgcgcgcaggggctggagaaccgtacgtcgaaccactccgtgacggccttccagaaggtgtccaggtggtcgacggaccagcggtgcagggccgggtagccgccctcggcgggggcaccgtggtgttcggccgcccaggcctggaacttcgtgatctgtgcctgggcgatccgctgcggatcgggctgccagagcggcagggggttcacggtcgacatgggcggctcccggacttcgcgcgtcgtgtgcgtcggtccgcgcacgtgcgggggtgtgcgcgtgacgcggctgacacggacgatgccacgtgatcgacttccgcaccagggctggccccacatagtccctgtcgtgaagatgtggtccgggcctggatgaacggcagttgaacagaacacgcgtcagggcctgtcaatggcagggtgagctgcatgaacggtcgtgacctggtgcgttcggtgaaggcggtcggctccgcgggggcggcccagggggtgcgcaccccacgggccgcccccgcggagccga

SEQ ID NO: 132 - DNA, 6481 bp, Unknown
  Kingdom: Bacteria, Phylum: Actinobacteria, Class: Actinobacteria, Order: Streptomycetales, Family: Streptomycetaceae, Genus: Streptomyces
  misc_feature (6234)..(6296): n is a, c, g, or t
gcagcaccggcagcaccggcaacgctctcaggcctgcccgccgctttctctgccgtcttcgccgtctctgccgtcttcgccgtctcctcctccgacggcgactgtgctgacgccccggtcatcccttcgacactcccctcccgcgcccgccacccctgtccttcggatcatgccacggcccactgacaacgcctgaggggttttcatccctgggcgggcagcccgagttgggggtggacctccaggagccggcccggggccgcctggcgccaggagtcggcgaggatgtcgcgcagttcgtcctcgtcctccagcgcggcgaggcggaccctcacccaggcgaactgcgcctcgtgaccggcgatccagaacttccccggctccgccaggacgagttcgtcgcgctcctccttgggacagcgcacggcgatggacgtctcgtcctccgggagcgtggcgaacatcttgcccgcgacccggaacgtgggcatgttccaggcggtcttctccgtcgtgtccggcagggacagggcgatacggcgtacgtcttcggcatcctgcatgtccggcacgctaaccgctcccactgacatcgacagcggtacgcggatcccggcgcccggcctctgcagccggccgactcccggcagggccgagctagggcctggccgcctctcccagcgcgtccagcaccgggcggatcagcgggtgcccctcggctccccggcgtaccgcggcgaagacccggcgcgtgggggcaacgccgtccacggggcgcacgaccacgcccgtgaggtccatgccgcgcagcgcggagcgcgggacgagggccacgcccgcgtcggccgcggcgagcgcgacgaccgcgcggaagtcgtcggaggaatgttcgagacgaggttggaagccggcgctctcgcaggccagcacgaccacgtcgtggcacggattgccggggtacgggccgatccaggggtccttcgccagttcggcgagcgggacctcggggctgccggccatgcggtgggtgaccgggacgaccgcgtcgaaggcctcggcgtagagcgggacgtgggtgaggcgggggtcgtcggcgggcggtgctccgcggtactccacggcgaccgccacgtcgacctgccggtccagcaccatcggcaggctcgcgtcgccctcggcgtcctggacgcggatccggatgccgggcgccgtccgggccaggcgggccaccgcgggcgcgacggcctcggcgatgccggtggcgaaggaggcgacggtgacggtgccggcctcgcccgagccgtaggcggccagctcggcctccgcgcgctccagctgggccagcaccgcgttggtgtggctcagcaggatctcaccggccggggtaagccgtacgcccttggcgccgcgttccaccagccggtggccggtctcctgctccagggccgtgagctgctgggagaccgccgagggggtcaggtagagcgcggcggccgccgccgtcaccgtacggtggtcggccaccgcccgcaggatgtgcagccgccgcgcctcgatcatgcaccgattatcgcaagctcaccggtcaccggacacgcgggaccgcgcagccgcccggccccgacccagccgctcggcccgccgaccgagcaggctcagccctcaagctccgcgcgggccgcgacgaacgcgtccaccgcgcggttcacgtcggcggtcgagtgcgcggcggagagctgcacgcggatacgggcctgcccctgcggcaccaccgggtacgagaagccgatcacgtacacgccgcgctccagcagcagctccgccatccgtcccgccttcgccgcgtcgccgatcatcacgggcgcgatggcgtggtcgccgggaaggatgtcgaagcccgcctcggtcatccgggagcggaacagcgcggtgttctccgccagccggacgcgcaggtcgtcggccgactccagcaggtcgaggaccttcagggaggccgccgcgatgaccggcgcgagggtgttggagaagaggtacggccgcgaacgctggcgcagcagggcgacgatctcggcgcgggccgcgacgtagccgccggacgcgccgccgagcgccttgccgagggtgccggtgatgatgtcgacgcggtccatgacgccgtgcagttcgggggtgccgcgtccgccggggccgacgaagccgacggcgtgcgagtcgtcgaccatgaccatggcgccgtaccggtcggcgaggtcgcagatctcgcgcagcggggccacgtagccgtccatggagaagacgccgtcggtgacgacgagcttgcggcgcgctccgccctcgtccgcctccttcaactggcgttccaggtcggccatgtcgcggttggcgtagcggaagcggcgggccttggacaggcggatgccgtcgatgatggaggcgtggttgagggcgtcggagatgaccgcgtcctccgcgccgagcagcgtctcgaagacgccgccgttggcgtcgaagcaggaggagtacaggatcgtgtcctcctggccgaggaaggccgacagccgcgcctccagttccttgtgcacctcctgcgtgccgcagatgaagcgcacggacgccatgccgtagccccagcggtccagggcctggtgggcggcggcgacgacctcggggtggtcggcgaggcccaggtagttgttggcgcagaagttgaggacctcgccgggccggccgccggccgtgacggcgacggtcgcggactgcggggtgccgatgacgcgctcgggcttgtgcagaccggcggctcggatctcgtcgagggtggcgcgcaggtcgtcgcgcacggaggtgaacatgtggtgatctcctgtgagtgcagagggcgagtgagccgaagaggcgcgtgagtcgagagggccagtgagccgaaggggcgcgccccggcggcggaccgagccagaaatcaagcagcccagtcgaggatgaccttgccgcccttgccgctcgcggcgtcggcgaaggccgcctcgaagtcggcgtagccgtaccggccggtgatcaccggggcgaggtcgaggccgccctccagcagcaccgacatggcgtaccaggtctcgaacatctcgcggccgtagatgcccttgacggtgatcatcgaggtgacgatgcgggcccagtcgaccgggaactcctcggacggcaggccgagcatggcgatccggccgccgtgcgtcatgttggcgatcatgtcgcgcatcgcctcgggacggccggacatctccagcccgatgtcgaagccctcgcgcaggccgagcgtgcgctggccctcggcgatcgtggtcccggagacatccagcgcgaggctgacgccgatcttgcgggccagttccaggcgctcctcgctcacgtcggtgatcacgacgttgcgcgcgccggcgtgccgtgcgaccgccgccgccatcagaccgatgggtccggcaccggtgatcagcacgtcctcgccgaccagcgggaaggacagcgcggtgtgcacggcgttgccgaacgggtcgaagatcgcggcgacgtcgaggtcgacggggacgcggtgcacccacacgttgccggccggcagggcgacgtactcggcgaaggcgccgtcacggcccacgcccagaccgacggtggcccggcacaggtggcggcgcccggccaggcagttgcggcacttgccgcacaccaggtggccctcgccgctgacccggtcgccggtcttgatctcggtgacgtcgcggccggtggccacgacctcgccgacgaactcgtgaccgaccacgagcggggtgcggatcgcctgctgcgcccagccgtcccaggcccggatgtgcaggtcggtaccgcagataccggtccgcaggaccttgatcagtacgtcaccgggtccgacggcgggctcgggcacgtccgcgagccacagcccgggctccgccttttccttgaccagcgccttcaacgcaacggctcctgtggatcgggcccgggccgggttcggggcatgcgccgggtcgaaggcatgccggaaggacccgcatccggggtgagaggtggattcacctggcaatctgccctacgggggacgtgccggtccatcgaggatttcttaagcacggccacaggtttccttcacgcgagccgatgtacgccccttacgccccgcacgcgcccctctctcacctccgctccgctcgcccctccccaccggggacgccctccgtcaccgtctcgcgccggcgcagccgccggctcagttcggccgccgcggccttgatggtgtcgagcccttcccggccccacggccgcggttcgacgtcgacgacgcacaccgtgcccagcaccatgcccgcgctgtcgacgagcggggcgccgaggtaggaccggatgccgaactcgtcgaccaccgcgttgcacgcgaaccgcggatagtcgcggacgtcctccagcaccaaggctttgccccgcgccacgacatgagggcagaagccgtggtcgcgcgcgaggcgacggcccagttcccgccgggtggcctcgccgtcggccgggtcgccgtaaccggccggtcggggcggtccgaccgctcctacccgtccggcgggtgcgggcgtgtccacgtccaggacgtcacgggacggccggtgcagcccggcgaagaactgcccttgctcgccggggaagttgaccatggcgtacggcgcgcgggtgcggtcggcgagccggtcggcgaaggcgtcgagatccggttcggcccgctcgccaaggcccagtcggcgcaaccgccgcacccgggcgggtgcttccttgtcctcgggggtgagcagcagccggccggccgggcgcggcgggtcgtaggtcatgaccggactccggggctgtgactcggggcgggcgtgggcgtggccgcgggcgcgtgggcgatgaggtgccgtacgagggtcagcagggtctggacgcccgaactggagatgcgggcgtcgcagcgcacgacggggatctccggggcgaggtcgagggcggcgcggacctcctcgggggcgtaacggtgggcgccgtcgaactcgttgacggcgacgatgaaggcgagaccgcgctgttcgaagaagtcgacggcggcgaagcactcctccaggcggcgggtgtcggcgaggatcaccgcgccgagggcgccctccgacagctcgtcccacatgaaccagaaccgctgctgaccgggcgtgccgaacaggtacagcacgtgccgcgggtcgagggtgatgcggccgaagtccatcgccacggtcgtctcgaccttgttctcgatgccgtcgaggtcgtccgtgtccgcgccggccgtcgtgagcagttcctccgtgctgagcggcgcgatctcgctcacggcgccgacgaaggtcgtcttgcccaccccgaacccgcccgccaccaggatcttcagtgcggtggggaagggatcggcgcggccggcgcggccgtcgtcgtagtcagagctgtcgtcgtagtccatcgagcactgcctccagaagggcccggtcggtgggatggtggtgggtgacgggcggtttggtggtcagcgcgccgcagtcgacgaggtcggagagcagcactttggccaccgccgccggcagcttcaggtgggcggccacctcggccaccgaggccgggccgagacacaggtcgagtgcctgcccgtgctcgggtccgaggtagccgagcggcgtcaccccggtcgccatcacctgcgacatgaggtcgagcgcgacgctgggccgggtgcggccgttgctgaccgtgaaggggcgtaccagccgcccggccgcgtcgtcgagccagggcccgtcaccggccgccgtcacgctcaaggcctcaacgccgctgaatcggcggagtgttgccggggcgcggtcatgaggtacggccggacgctcttgaccagcatggccatctcgtacccgagcaccgccgcgtcggcctcgcggccggcgagcacggcgaggcaggtgcccgagccggcggtggtgacgaacagcagggtcgagtcgagttcgacgacgacctgccgtacgtcgccgccgtcaccgaagcggatgccggcgctgcggccgagggagtacagcccggaggccagcgcggccatgtggtcggcgctgtcggggtcgagaccgtgcacggacttgaccagcccgtcgcaggacagcaggaccgcgnnnnnnnnnnnnnnnnnnnnnnnnnnnnnnnnnnnnnnnnnnnnnnnnnnnnnnnnnnnnnnntcgcaggacagcaggaccgcgctgttcgtgtgcggtacgcgctgcacgaggccgctcatcagccagtcgaggtcggaagcatggccggtcggcgcatcgctcgccatggtggatcgactccttggggtacgaaggtctgcgggagcgctgggcgtgggaagggccgcagaggtgggggtgtgggt

SEQ ID NO: 133 - DNA, 2668 bp, Unknown
  Kingdom: Bacteria, Phylum: Actinobacteria, Class: Actinobacteria, Order: Streptomycetales, Family: Streptomycetaceae, Genus: Streptomyces
caccgtggtgcccgcgggcacggcgccgctgcccggcgtgccggccgtggtgacgacccggccgcccctgaccgtcacctcgtaggtgtccgtactgcacggagcgccacggtccgtgtccgtgccgcacacggtccgggcccgggagagaccaccccatccggaggtgtacgcgccgatcgaaccgaccggcagcgcgtactggttgaacccgccgagcctcagctccccctcgggtgtggtcaccgagcccgacagggccagccggtccaggcgggccgtgcggtccgtgccgacgccgagcacgtcctcggtggtcgtgccggacggcagcgcgggcccgaagcgctgcgcgcgcggtacggcggccttgagcgccttgccgtccgcgatctccgggccgaccgaggagccggtcgccgggacgcccggatgctggtcctcggtgatgtcgaagaagtcgccgttgacacccgcgagcgccccctgcgcgtcggcgagccgggacacggtgctgcgggccgccacggcccccggatgcagcaggccgacgcggacgtgcctgtcgctcagatcgacgctgaccagatgcgcgcggaccttcccgtgggccgcggagaggtcgatgtcgcggtactcgacacccggcgcgatctcctcggcgcggccgggcgggccgtgcccgcgtgggctgtttccgcgtgcgccgttcccgcgtgggccgttcccgtcagtgcgccaccggcgagaaggacggtcagtgccgccgcgaaccgaccggcgcgacgcctcgccccaactcccgctgtgctcaccctgccccctgatgcctcgtcaactccgtgcggactcagggaagtgcagcagaagccggtgcccggggcggcgaccggccgccgacgacgcgggaacggacgggaaaacgcactccttcgggtgtcttcagcggtgcccgagcacgttcacgacgcggccgttgggatcccggacgaagaaccggcgtacgccccactcctcgtcggtgagcggatgcacgatctccgcgccgcgctcgcgcagcatggcgtaggcggcgtcgacgtcgtcgacctcgacgctcaggtcgggcgcgacgggagccgtccggtcctcgcccatgaaactgatctgcgcggcggggttcaccgcggacgcgagcgtccggatccagccgtggttcatgacctcctcgaagcccaggagtgcgtagaagtccgcactctcctccagggcttcggaacggacgttggggacgacacggcggacctgcatcgggcggctccggtgctcgctcggactccgcgtgccgcgaggcgcatccgcaggaggggagacggtcccgtgcacgccgacggatgcggtcagcgtagcgaagcggcgcgggtgtcagtggtcgccgggcagggactgctcggcccacacggtcttgcccgccgccgtgtaccgcacgccccagtgctgggccagttgggcggcgatgaacaggccgcgtccgccctcgtcggcggtccgggcgtggcgcaggtgcggggcggcctggcccgcgtcgcgcacctcgcaggtgagcgtacggtcgtggatcagccggagttcgatgggcgcgctcccgtaccgcagggcgttggtgaccagttcgctgacgatgatctgggtgtggtgggcggtctcctcgtccacgccccactcggtgagctgcttgcgcgcgcgggcacgagccgttcccaccgacgcgtagtcgtcgtcgagccgccagcaggcgaacgcgtcggccgggaaggaccgggtgcgcgcgacgatcaccgcggcgtcgccggctcccagaccgtccgggagcgcgtagacgacggcgtcgcacaggtcctgcaacggccgctcggcgtagtccggggccgcccgcagctgccgcgaggagtccgcgaggtaggcggtgaccagggggtcgctggtgaacaccagcacgctcccggcgggcacgtcgaactcggcggtcgcgaacggcgcgtcctccgcgacgcccagcggcggtcctgccggagtgtcggggacgctgacggtgtggtcggggcggatcacgacgggcgccagatcaccggccgccgccgtcacgcaggtgcccgtcagcggatcatggatggcgtacacgcagttggccgtgagcgcctcccggcgcaggggatcgcccaccggcaggttcgcccgctcgagggccagctccgccgccgtgtcgtgcaggcgggccagcagctcgtcgggaggcaggtcgaacgccgacagtgacctcagcaccgtgcgcagctggcccatgctggccgccgcgttcacaccccgccccgagacgttcccgacgacgagcgcggtgcgggcgccggacagggcgatggtgtcgtaccaggcgccggggtcggcaccggtgaccgacagataggcggtctccagcgacgcgtgggactcggggcgtcggggcagcagctgacgctggaccgtggcggcgatggcgtgctcgcggatgaaacgccgggcgttgtcgacgcacagggccgtgtgcgcggccacctcgaccgccagccggcggtcgcccgtgtcgaacggcggcgattcgccggaccggtacagactgaccaggcccagtgccgcgtcgcgcagggccagg

SEQ ID NO: 134 - DNA, 7662 bp, Unknown
  Kingdom: Bacteria, Phylum: Actinobacteria, Class: Actinobacteria, Order: Streptomycetales, Family: Streptomycetaceae, Genus: Streptomyces
gggtggcctcgcgtgcggcgctgctctttcagcttcgcctcgtacaggtggtccgcgcccgcgaccagcgccttccgggcctgggcctcaatgtccttgaacggctggtagtaagtggcgttgcaggcctcgatgatctggaacgtccagtgccccgggatcacgttgcggcccaggatctcccgcagcaccctctccgcccacccatggtggccggcctcccccagcagcgccaccgcacggtccaaagtgaagtcggccccaccggtgagctggtggaaggcatagaggtgaccgcgggcgcgttcggtcgtctccagcgcctccgacaacgcccccagggcctgcacaagagtgtccgagacacccagcggccgcaggtgcgcaccgtccgggccgtcatggtgagcgctcatgccctcacccatcccccggcccggcggttttcgcgcccctgtcccacgctctgggcagccgcggccactcgcgcagcgcggacatccggccctcttcgcaccgtacgacgtggctcatcccgcggcggcccccagattcgccggacgggtcgctcctgcgcgagacggcacggtgggcggtcccccgagacggatgcccgctgcgtacggtgggaacgtgacgccccctgactctgctgcgcccggaagcggtggtcagacacgctcccaggatggcaggccggctccgcgctgcgcgctgcccttgccgccaccgcccaggggggtcctctccaccggctccccggtgaccgtcttcccgccagcgggcccggtggcggtcacgtcgaccagctccaccgccgtgccccacagcggggcatggccaggccggacgcggcgcagcagtcgctgcgcctggtcggagtcggcctcactctgtgacggtagcgccggatattggaactctcggaatgcccggaggtttgccacagttcgtccttccaatcgagttcctgcgccgggccgggctggacgaggctcagccgggccgcgttctcggcgatgcggggtgatcaggccggtgccgcggtagttatacgccggacacccacggacgcaagactgggccacacggtaactgtggggctctgtgcctagtctggtggggtggacaggcagcaggagatcagggactttttggtgtcgcggcgtggccgggtctcgccgcggcaagcggggttgcctgcgctgggcgaccaccgcagggtcccggggctgcgcagggaggaggtcgctctcctggccggcgtgagcgtcgactactacgtgcgcctggagcgcggtcaccttgcaggagcctcggattccgtgctggacgcggtggccgatgcgctgcatctcaatgtggcggagcggtcccatctttttgatcttgcgcgtgcgagccgtggcggtgggcttgagacacgggatgacggtgcgccggaggggattcagcgggtgctggaggcgatgcccctggtgcccgcattcgtgtggaaccggcgcttggacctgatggcggcgaaccacctcggatacgccctgcacgcgccgctgtttgaggaacgggttgcggggccggtgaacatcgcgcggttccagtttctcgatcctgcggcgcgctcgttcttttacgactgggagacgtcgatccggaacacggtcgcgctgctgcggatgggggccgggatgatgcccgacgaccagggcatgaaggatctggtccaggagctgtcggaggccagtgagctgttagcccggtgttggcgcgatcacgatgtgcggctgcactggagcggggtgaaggagtacgagcacccgacggtggggcgtctgagcctgccgttcgagacgctgacgatgccagggcggccggatctgatgctgtcggtcctgacgccggatcctggcagcccgtcagcggagggggtgcggcagttggccgactgggcagatacgcagcattcgctctatgcgaatgtcgaccggaactgagatgagctgcgccgtcgcgccgaggcgagctgccggtcaggggcgggaggcgtcctggtgggcctggtccgggcttgttgcggcccaggaggcgagcaggcgtagcgcgtcgtggtcgggcgtgccgagttcggcgctgtacgcggtcagcgttaggccggggtgggcgggcagttccatggcgtcgaagtcgagggtgatctcaccgatcgccgggtggcggaagggcttgcggccggtgtggtgcaggcgcacgttgtgcttggcccaggccgcccggaactcgtcgctgcgggtgacgagttcgccgatcaggcccgtcagttcggtgtcgcccggggctcggccggcttcggtgcgcagcagggagacggtggtgttgacggaggcgttccagtcggggaagaagtcgcggctggtggggtcgaggaactggaagcgggcgatgttgaccgggcgcgccgagccggtgaacaggggggcgtagagggcacgcccgagtgggttgacggcgaggatgtcgaggcgaccgttgcggataaaggccggggcgtcggtcatggagtccagaacgcgggtgaggctggccgagacgggcgtcttggccttgcgggcggcgcggcgcggcgggcggtgacgctgggcggcgaccagatcgtgcaggtgggcgcgttcggcctcgtcgagctggagggcccggctgagggcattgaggacctcctcggaggcgccggcgagctgaccgcgctccaggcgggcgtagtagtcgatgctgacaccggcgagcatcgcgacttcctcgcggcgcagcccgggcactctgcggttcgcgccgccgaaggccggcagaccggcctggtgcggggtgatcttggcgcggcgcgtggcgaggaactctcggatctcgtgggcggtgtccatccgtccaggctaggccgggtggaacagccctggggggtcctgtcagtacctgtaacggcagtgccttccccacggctgtgagctgcggtttcctcgatggtggcagcggatgtggtccgcgtccgcgaggcgggagaaccctcctgcggatgcccgccggcctcttctggccgacagtgagcagcgccgcgtcctcgtgttcacacctttgcagggagtcgccatatggcacagcagtccgcgcctcaggaactggccggcatcgcgccgaagctggtcgaggtcaccaacgaagtcctctttaaggatgtgtgggagcgtcccgggctcgccccgcgggaccgcagcctggtcacggtcagcgtgctggccgcgctgtaccgcagcgagcagttgccctatcacctgggcgtggcgctggacaacggactcacggtggaggagctgtctgaggcgatcacgcatctcgccttctacgccggatggcccaacgccatgaccgcgatcacgcagctgaagaagaccgccgacgagcgctccgcctgaccaccggcacgcgcagcgcagcaaagccccgcgcggtcagcggggcggattgagacagaggaaagaacggaatggctgacaacggattcgatcagatcttcccgctcggggagaagaacgacgcctttgcgcagtacttcatcgggcagagctacctggctccgctcgcctcggggagcgtccccgtcagcaacgtctccttcgagccgggctgccgtaacaactggcacatccaccacggcacggacggtggcggggaccagatcctgctgtgcacggcgggcagcggctggtaccaggccgagggcgaggaacccgtcagcatggagcccggcacggtgatccgggttccggcgggcaccaagcactggcacggcgcgaaggccgactcgtggttctcccacgtcgccttcatcacgccgggcgagggcgtcagcaacgaatggctcgagccggtcaccgacgaggtgtacggcaagctgccgaagaacggagcgcacgcatgaccatcctggacgagacctacgccctctccaacggcgtcgagatccccaagctgggactgggcacgtggttcatcgacgacgacaaggcggccgaggcggtccgcgcagccgtggagatcggctaccgcaacatcgacaccgcccaggcgtacggcaacgaacgcggcgtcggcgaaggcgtacgcggcgccgcagtgccccgcgacgagctgttcgtctcgaccaagctcgcggcggagatcaaggactacgagcaggcggtcgccgcgatcgacggctctctgcgaacgctcagcctggatcacatcgacctgatgctgatccacagcccgcagccgtgggacgacttccgcggcggcgactacaccgaaggcaaccgcgcggcctggcgcgcgcttgaggaggcccaccaggccggaaagatccgctgcatcggggtgtccaacttcgagcagcaggacctggagaacctcctgcagggcgcgagtgtcgtgccgcacgtgaaccagctgctcgtgcacgcgggcaacactccctccgacctcctggcctactgcgaggccaagcagatcctcgtcgaggcttactcgccgatcgctcacggcgccatcctggacaacgccgaggtcaagtcgatggccgagcgctacggcgtgtccgtcccgcagctgtgcatccgctacaccctccagcttggcgccgtgtccctgccgaagacggcgaaccccgaccacatgcgctccaacgccgcggtcgacttcgagatctccgacgaggacatgaatgtcctgcgaaaccttcgcgacgtggactacggcgaacacagcgccttccctgtctacagcggcaagtgaccccagacgggcgccatcccgtgacggcctcacgctacgaactggctggagccgggtcaccgaccagcagttcaaggcggccctgaccgtcccacgccgctgacgcagcctccctcttcccgcgacgtccgaccccgcccccgtgtgggggccgggcaccttgagggactggatcggacgtggcgctacccgctaacagcggccagcgacgttcggcgccgtggtggcaaccacacgtcggctgcgggggctcgacgcacgtgaccggccacgacccatcgagcgcgcgggagcaggtcgagcagggcgtgctgaccctgcgggcaccggcatcttcctctccgaacgggcgcccccaccgcaggctggagcaaggcggcgtgcacggacgcctggtcccggcactccccgcccgctcgtgatcgggagcccacgcagggaagccctgtccaccgcgtgcagctgtccgctcgtctaggtccgcgcacctacgtattgccctcggcgctcggcgccggggcgaggagaaacgatgaaccccacgtacgacttcacaggccagatcgccctggtcaccggtgccgcctccggtatgggcctggccaccgcccgtgccttcgcccgcgccggcgcggccgtggtgctggcagacctcgaccgcccggcggccgaggcagcggcgaagagcctcatcgacgacggccatcaggccctcggggtcggctgtgacgtcgcggacgaggatcaggcccaggccatggtcgagcgcacggtacagaccttcggacgcctggacatggcgttcaacaacgccggcatccaggttccgccgagcgacgccgccgaggagcgggcagaggacttcgaccgcgtcaacgcggtcaacctgcgcggcatctggacgtgccagaagcacgaactgcgccagatgcgcacccagggctcgggcgcgatcgtcaactgctcctccctgggcggcctgatcggtctgcccgaacgcgccgcctaccacgcctccaagcacggtgtgatcggcctgacgcgcagcgcggccgtcgagtatgccgcccggggcattcgaatcaacgcggtgtgcccgggcacgatcgacactccgatggtcgccagcatgctcgaaggccaggccgaggctatggccgagatcatgaagcagcagccgatcggccggctgggcaccgccgaggagatcgccaacgccgttctgtggctgtgcagccccgccgccgcgttcgtcatcggcgtcgccctgcccgtcgacggcggattcacggcccactgaaaccgccggggctctcccaggcgccctgcgctcgcactcgcagggcgcctgggaggcactgccagtacctggcacgacggtgccttccccgcgctcgcgggcggcggttccctggaaacaaccacccaccggaggcggcccgcgcatcaagaccgggccccggccggtcccggcccaccccggtacggctgtccttcacctgctcctggagctgcaccccatgtccctgcctgcttccccgtcccgcagcggcggtctcagcgcgcccgagcggcgggggcacccggcggccgcgctggcctcggccctgctgggcttcttcgtgatcactctcgacgcgctggtcgtcaacgtcgccctgcccgcgatccgcagcgacctgggcggcggcatcacgggcctgcagtgggtcctggacggctacaccctgatgttcgcagcgctgctgctgtcggccggctccctgtcggaccgcataggcgcccgccgcgcattcggcctgggactggccgtgttcatcacagcctccatcgcctgcggcctggcgcccaccctcccggtgctgatcgccgctcgcctcgtgcagggcgccggcgccgccgccatgatgcccaccagcctggcgctgatccgcgaggcgtacaccgaccctgtcaagcgggcacgcgccgtcgccctgtgggcggtgggaggtgctgtggcctcggcggccggcccggtcgccggcggcgcggccagcctgatcagctggcgaatgatcttcttcatcaacctgccgatcggcttgatcgcattgttgcttctcgcgcgcgccggccgttcgccgcgccgcccggtccccttcgacctgaccggacaggccaccgccgtcctcgccatgggagcgctgaccttcggcgccatcgaggccggcgaacgcggcatcaccgcccccgtcgtctggatcgcggccctgatcaccctggtggccgccgccgtgttcctgcgcgcgcaggcccgcggccgacacccgatggtccctctgcccctgctgcgccaccgcaccgtggtgatctcctgcgcggccgggttcgcgttcatggccggcttctacggcatggtgttcctcttcagcctctacctgcagcagcggggtttgtccccactggccaccggagcggcgttcgtgccgatgacagcgctgtcggcgttcatcaacccgctctccgcgcgggccgccgaacgcttcggcccccgcgtgcccatcatctgcggcctgctgctgatgacagccgggctggtcacgctggctctggtacccgaggcgacgccgacctgggcactggccctgctgatgcttccggtcggcctgggcggtccgctcgccatgccgcccaccaccgccctgctcgtcaacagcgtgcccccgcagcagaccggcacggccagcggcgtcttcaacacctccccgccagctcggcggcgccctggccgtcgcggtcttcggcgctctgctggccggccaaacccacatgctgaccggcgtgcgcaccagcctgctg

SEQ ID NO: 135 - DNA, 1633 bp, Unknown
  Kingdom: Bacteria, Phylum: Actinobacteria, Class: Actinobacteria, Order: Streptomycetales, Family: Streptomycetaceae, Genus: Streptomyces
cccggcggggggcggggccggggtctgctcgtcgaggatgtcgttcaggacgcggcgtaccgccaggcgtatcgccgcgaccgcaggatggggacccatgtccggttcccttcacggaagtttttcggggggtgagcccgagatcggtcactcagagtgtgtcgatggtgacagaaacgggccgttccccgagcattgcacgcctatccctcgctcacggtccctcggacgggtgattgaaggggcgttcgcctgccgtcggccggattcggttcactccgtccgcgccgggttcacgactcggccttgcggtgcacccgcgcgacccagtccgccggtttggcgatctccgccttggtggggagggtgttcggtgaggtccagacgcggttgaagccgtccatgccgacctggtcgacgaccgcgcggacgaaccgctcgccgtcacggtactggcgcagcttggcgtccaggcccagcagcttgcgcagggccgagtccagccgggaggcgcccttggcgcggcgctgctggaacttctcgcggatctccgccacggacggcacgacctcgggtcccacgccgtccatcacgtagtcggcgtggccctccaggagggacatcacggcggtgagccggccgaggatctcccgctgggcgggggtctgcaccagctcgacgagggagcgcccgccgtcgtcctcctcgccctcgggccgcccgccgacgagcgactgcgcggcctcccggatgcgctccaggaaggccatggggtcgacgtcggtctccgacaggaaagactggatttcaccctcgaggtggtcgcgcagccagggcaccgcggtgaactgcgtgcggtgcgtctcctcgtgcaggcacacccagaggcggaagtcgtgcggctgtacgtcgagttcgcgttcgacgtggacgatgttcggggcgacgagcagcagccgtccgccgccgttcgcccccgcgggcaggtcccgggcggccggggcgaaggtctcgtactggccgaggacgcgggaggcgaggaacgacagcagcatgcccagttccacgccggtgaccttgccgccgacggcgccgagcaccgcgttgccggggctgctgccgcgccgttcctgcatcttgtccagcaggggcttgagcagttcccggaatccggcgacgttcgcccggatccagccggggcggtcgacgaccagcaccggtgtgtcgtgggtgtcctccgtgcccaggcgggtgaacgcccgtacgtgctcctcggagaccttggcgtgccggcgcagttcggcgacgacggcgcgcgcgtcgtcacggctcacctcggggcccggccggaccagccgggtcgcggtcgccaccgcgagattccagtcgaccatcccgggacttgcggcaccaccgatgctcgtcatgtgtcaacggtacgtgagcgccgccgctgggggcagagcggcggcacggcggtcggggcaggacggctgcgcggcacccgtaaccgaacccgccccggctcccgcggcccgggcccggccgccgggcgccgccaccggccccggcagcggccggccgcccctgcccggcccgcaccggccgcccggaggccccggtcggcgccgta

SEQ ID NO: 136 - DNA, 13769 bp, Unknown
  Kingdom: Bacteria, Phylum: Actinobacteria, Class: Actinobacteria, Order: Streptomycetales, Family: Streptomycetaceae, Genus: Streptomyces
cgccggcgggcgcggaagcccccgcggtccgggcgactccggcgccggtgacctcgtacgacacggcccgcgagacccgcacgcccatcaagggcgtccgcaaggccacggcggcggcgatggtcagctccgcgttcaccgcaccgcacgtcacggagttcgtgacggtggacgtgacgcgcaccatgaagctggtcgaggagctgaagcaggacaaggagttcacgggcctgcgcgtgaacccgctgctgctcatcgccaaggccctcctggtcgccgtcaagcgcaacccggacatcaacgcctcctgggacgaggcgaaccaggagatcgtcctcaagcactacgtcaacctgggcatcgccgcggccaccccccgtggtctgatcgtcccgaacatcaaggacgcccacgcccagacgctgccgcaactggccgcgtccctgggcgagctggtctccacggcacgcgaggggaagacctccccggcggcgatgcagggcggcacgatcacgatcaccaacgtcggcgtcttcggcgtcgacaccggcacgccgatcctcaaccccggcgagtccgcgatcctcgcgatcggcgcgatcaagctccagccctgggtccacaagggcaaggtcaagccgcgacaggtcaccaccctcgccctctccttcgaccaccgcctggtcgacggcgagctgggctccaaggtcctggcggacgtggccgcgatcctggaacagccgaagcggctgatcacctgggcctgacggctgagatccgctagtctcggcgacctggaggggtcggccgcaacttcgtcttgcgaccggcccctccgctcgcgtccggctcaggcgccaggttcacgcctggccgaggacgtacacgggagcgccgtccttcgccgcgccgcgcgaacggatgcaggcgtgcttgcgcagcatccgcaggcattcgttgacccggcgcaccggcagacccgtgcgcgccgcgatcgattccagcggctggcgcagttcgcccttctcgacgagcaccggtgcgatcaccacggccaccgtccacacgtcctcggtcacggacaaccgccgtcgccagtcggccagcacggactcggtggtggggcgtacgccggtggtgtgcgccggcgtgggccgctggagggccagggtgtcgagccggtccgcgatgcgtcccatggcctcggccatggcctgttgcgcggcgagcgcggcctgctgggtggccagcgaggcctgctggacggtgagcagggactgctgcgtggtcagcatctccttgtgcaccgcgagcgattcacgctgtgcggtcgcgatctcctcgtccacctgaaggttgtgcgcctccagccgcacgatggcgtcggcgacctgctccggcatggcgtacgcgatcggcgctcccggcgcggccggctgcacctcggcctcctccaggctgtaggacccctcccgctgaacggtctcgatcacctccgcgacccactgcttgaagggcgcgcaggcgggtttcgtgcaggcgttgacgaggaggatcagaccctggagatcgatgagattcaggtctcggcgccactgcctgcctgcgggaacgctgagaccgtaagctccggtgacggtctcgagactctctcggtgctctccgggaacgtggtcggagagggcctgcctcgaattgctgtgccccaaccgcttgcacacgtccaccgccgggaaccagtgactgccgtcgggcatggtcagccgtcggacgcgctcgcccgtcgccgcgtacacgaagtcgctgatgtcgatcgcctcgtgcgggtgggccggctgggacttcttgctgggttcgttcatgtgaaccacctccgctgcggaaggtagagcgcggaaatccgcatatgccagcccagatcatgatgttcacgattgcgaggggtgttccccgattccgctgcggggggcggccggagtatgcatggccgggatgcgaaaggggggcccgccgctgttccgcagcggcgggccccccttggtgcgtgcgcggcctgctcagccgaggcgggagaagccgtagttcaggatccgggtcgcgtccgtggcgcgctggttgacggaggtggaggccaggaccgtgccgatgacggtcttgttgcccttggtggcggcgaagacgaggcagtacttggcctcggggccggagccggtcttcacaccgatggcgccccggtagctgccgagcagcgtgttggtgttcgtccacgtcgccatcgtgcgggtgctgcccgtcttggtgatggtcttggcgcggtacgacttggtcttgacgatcgagcggaacgtggagttgcgcatggcgctgctggcgatcttcgtcaggtcgcgcggcgtcgagtagttgttgccccggccgatgccgtcgaacgagtcgaagtgcgtgttcttcagcttgaggtccttcgcggcggcgttcatcttgccgacgaaggacttcacgcgggcgtcacgggtgctgcccgagccgaacttgtcggccagcgcgtaggcggcgtcgcagcccgagggcagcatcagcccgtacaggagctggcggacggtcaccttgtcgccgacgatcaggtgcgcctgcgaggcgttgttgcgcacgacgtagtcgctgtacgccttctggatggtgaccttggcgttgaggtcgaggttccgctgcgccagcacgaccttggcggtcatgatcttcgtcgtggagccggtggacagccgggtgtcggccttcttcgcgtacagcgtcgagctgttcgcgttgttcatcgcgtagccgcccttcgccgcgatcgacggtgcggcggcggcctgggcgggcgcggcggtcaaggctccggcggcgagcacggccccggtggtcagggcgacggctgcggctctgcggaggcggttggcctggatgccggttttcaagtgagataccccgattatgtcgaatggccctacggtgcggccgagttgagtgcccatgaaatggggagccgcgtctataggacacgtaagtagcacagttggttgtccgcggggtgcgggaaattccgtgaaggccggggtccggctgcggttctgccgggttccgtccgcatgctggacagggctcatcatgcgtacgtgttgtatctatgctgtcggcatgagcctggcagtgaaacagccccccgccgccgaccgcgtgtacacccacgtcaagcaagcagtcctggaccgccgctacgagggcggcaccctcctgaccgagggcgagctggccgaagccgtcggcgtgtcgcgcaccccggtgcgcgaggcgctgctgcggctggaggtcgaggggctcctcaagctctacccgaagaagggagcgctcgtcctgccggtctccgcccaggagatcgcggacgtcgtcgagacccgccagctcgtcgaggagcacgccgcgcgcaaggccgtacccgcaccgcccgcactcatcgcacggctggaggaactgctggagcagcagaagcagcaggcggcggccggggacttcaccgcggcctccgtcaccgaccgctgcttccacgcggagatcgtccgcagcgggggcaacgagatcctctcccgcctctacgaccagctgcgcgaccgccagctgcgcatgggcgtcgccgtgatgcacgcccatcccgaccgggtcgccaagacgctcgccgagcacgaggagatcctggacgcgctgcgctccggcgacgcggaggcggccgtcggcctcgtccaccggcacgtcagctggttctcccacctggcgcggggggagctgcgatgagttcctcgtccacctcgacggctcccgtgacgctgcccggcgatccgcccggcggacggcgggccgccgccgtctggagcatcggcgtcgccgtctacttcgtcgccgtcatcttccgcacgtcgctgggcgtcgccggactcgacgccgccgaccgcttccacgtgggcgcctccgcgctgtccacgttctcgatcctccagctgctcgtctacgccggcatgcagatacccgtcggcctgctcgtcgaccggctcggcaccaagaaggtgctgggcatcggcgtggtgctgttcacggccggtcagctcgggttcgccttctcaccgtcgtacggcaccgcgctggcctcccgggcgctgctcggctgcggtgacgccatgaccttcatcagcgtgctgcggctgggcacccgttggttccccgcccggcgcgggccgctggtggcgcagctcgccgggctcgtcggcatggcgggcaacctggtctccacgctggtgctggcccggctgctgcactcggtcggctggacggcggccttcgcgggcagcgcgctggccggtgtggtggtggcggtactgctggtcctcttcctcaaggaccaccccgagggccacgagccggcgcccgcggcgcaccagggcgccgcctacatgcgcgggcagatcgccgcctcctggcgcgagccgggcacacggctcggcatgtgggtccacttcaccacccagttcccggcgatggtcttcctgctgctgtggggcctgccgttcctggtggaggcgcagggcctctcgcgcgggacggccggctcactgctcacgctcgtcgtcctgtcgaacatggccgtcggtctcgtctacgggcagatcgtcgcccggcaccacgcggcccggctgccgctggcgctcggcacggtcgcggcgacggcggcgatgtgggcggcgacgctgctgtatcccggcgagcgggcgccgatgtggctgcttgtggtgctgtgcacggtgctcggcgcgtgcgggcccgcctcgatgatcgggttcgacttcgctcggccggcgaacccggccgagcggcagggcaccgcctccggcatcaccaacatgggcggcttcatcgcctcgatgacgacgctgctggcgatcggcgtgctgctggacgccaccggggacgactacacggtcgccttctccgccgtgttcgtgctccaggcgctcggggtgagccagatcctgcggctgcgcgggcgggcggctcgccgggagagggagcggctgatggcgagccgggtggagacggtgcacgtgcccgcgtgaggcgcgggccggcccggactgtggttccgggagggccccggcgttctcagcgcgtcaccgtgaagttcttgaggatcgccgccgtcagctccgggtcgccctccgtcttcacccggtccgccaccgcctcggcggtgacccggccgcaggccaggcggacgtacgtctcccagtcgagggtgagggacgccgccgggcccagcgcgggcgccgtctccagggtgccgcggccctggatgtcgacgcggatcgtgcgcaggaactccaccggcccgtgcacgtcgaagacgatcgccgaactgcgcggcgcgtccgccctgaccgcgacgacgtccggcagggcgtcgagcaggtggtcgcgggcgacgtacgcgcccggcgagtcgaggttgccggggcggccgagggcggcgcgcaggtcctgctcgtgcacccagatgtcgaacgcccggtagcgcatcgactcctccagggtgatctccgcgccgagcgggccgcgcaccttggtgcccgggtcccgggactcgttgcgcagctgccggttgcggcggatgaccgtgtactccagctcggacgtcatctccggcgccgtgtggtggcggcggacgtcgacctgcatctccatgtagcgctggtgctggtcggtgacgtggaacaggtcgcgcggcagggagtggatggggcgcgggtcgccgagcgcctcgcagtccatcccgatgacgtgcgagacgacgtcgcggacggaccagccggggcacggggtccgccggttccactcgccctccgcgagcggctgcaccagctcggatatcgcctccacggagtgggtccaggcatcggcgtagggctggagggtgggatgcagactcacggaacgggacccctcggcggtcggtacacggtcaggttgtggcggcattgccagtggggagtggcggcgggcggcggacggcttgggactcccccgaactctcgctccgcttcgagcaggggggatccccaagttacgctgctgtgaggcaccccggcagtgctttcgtgtgacgatcgtaggcccgccgggacaactcgaatgccaggacggtggtagtgtgcgcgcctcgctgatccagatcgccgtggacgagggcgaatcggtcgtgtcgcggcggcggcgggcggccgctctggtgcgcgagcaggccggcgccgacctcgtcgtcctgccggagctgtggaccaccggtgccttcgccttcgaggcgttcgacggtgcggccgagccgctggacgggccgacgtacgaggcgatggccaaggcggccggcggggcgggcgtgtggctgcacgccggatcgatcccggagcgggccgccgacggcaccctctacaacacgtctctcgtcttctccccctccggtgacctggccgccgcctaccgcaagatccaccgcttcggcttcgacaagggcgaggcggtgctgatgggcgcgggacgcgagctggtgacggtccggctgccggacacgaccctgggcgtggccacctgttacgacctccgtttccccgagctgttccgcggtctcgtcgacgcgggcgccgagaccctggtgatcccggcgggctggccggaacgccgccgggcgcactggacgctgctggcccgcgcgcgggcggtggagaaccaggctttcgtgctcgcctgtggaacggccgggacgcacgcgggagttccgcaggccggtcactcgatcgtggtggacccgtggggcgaggtgctggcggaggccggggcgggcgaggaggtcctggacgtcgagatcgaccccggcagggtcgcgacgacccgcgaacagttccccgccctcaaggaccgcgtcctgtgaggtagccctccgcattgcccgaaggcggccgggttcaggcctcgtcccgttccttctccgccaggtggatcacgcacaccgccaccgcgatcagcagcgccgggtccgcgtcgtcccgtacgacgtcgacgccgtaggtgtccaccaggctcagccaccgccgggagatcacggccaccagctcaccgtcgtactcgacggcgaactcccggtcgaggatcttgccgctgacgtccagctcggtgccgtcgaccagggagacccggtagtggttgcgcagcagcgagagccgcttgcgccggatcttcgccagggcctccccgtcccgctcgatcaccatcgtctcccgcagggagagcatcttctggtggatgtcgatcaggacccggccgcgggcgtccttcagctcgaaggtgtcccgcagccgcatcgccttgccgtcgacgaggaagaccttgtctccgtgctcgtcctcgatccagtagtcgtcaccgatgccgaggatccggtcgcgtacgaggaatctcatgcccttaccgcttccccggccgggcccgcgcgtaccgcggggcctgggtataccgcccggtgcggttcagctcgtaccgtccggtgcggttcagggcggaccgccggagacgtgcgtaccgcccgcggcggctcacacgccgtagccgtcggtgtagccgtcccgggggccgtggtggtggcgttcctcctcgacgaccgtcgtggagggcgggaccatcacgcggcggcgccgggcgatgctgctgaacgtcgtgacgccgatgacgcccacgatcatcaggatgacgccgaccatgtgcaggttgaccccctgcatgtgccagtcggtcgcgaacgtgaggatggctcccacggcgatgaggatgatgcacccgccgaggcccatgagtgtcgcctcctaatccggtgtcaggtccgggggttccggcccgtccggccccttcccgtcaactccgggtacccgcaagccgggtgggcatgcggcagcggcggcccatgggcccgcgtgatcagccctccaggaacgccaccagcgcgttggccagcaggaacgggtcgtcggcggcgcacagttcgcgggcgctgtgcatggacaggatggccacgccgatgtcgacggtcctgatgccgtgccgggccgcggtgatcggaccgatcgtggtgccgcacggcatggagttgttggagacgaaggactggaacgggacgtccgccttctcgcaggccgccgcgaacaccgcccggcccgtaccgtccgtggcgtagcgattgttgacgttgaccttgaggatcggtccgccgcccgcgcgcgggtggtgcgtcgggtcgtgccgctcggcgtagttggggtgcacggcgtggcccgtgtcggaggagaggcagacggtgcccgcgaaggcgcgcgcccggtcctcgtacgacccgccgcgcgcgaacaccgaacgctccaggacgccgccgagcagcgggccgtccgcgccggtgtcggactgggagccgttctcctcgtggtcgaaggcggcaaggaccgggatgtacggcaggtcctggccggaggtcgccacggcggccagggcggcggtgcccgcgtgcacggagagcaggttgtccatgcgcggcccggccaccagctcgcggtcgcggcccaggtaggcgggaggttccacggagtgcgtcatcaggtcccagccggtgacctcgccggccggcaggcccgcctcctgctccaggaaggcgatgaggtcgccgtcgcggacgtcgtcgccgaggccccacaccggctgcaggtggcgctgcttgtccagcttgagcccctcggtggacaccgaacggtcgaggtggatggcgagctgggggacgcggagcagcgggcggtcgacgtcgaccaggcgggtggagccgtcgcggagggtgagccgtccggcgaggcccaggtcgcggtcgagccaggagttcatcagcgggccgccgtagatctccacggcgatctggcgccagccgtgcgccccggtgtcgggcagcggcttgacgcgcaggttcggcgagtcggtgtgcgcgccgacgatacggaacggggtgtgcggggcggcgccctccgggacgtaccaggcgatgatcgcgccgccgcgcagcacgaacctgccgcccgtcgtgccgtcccaggcgtccgtctcggcgacctgccggaagccggccttctccaggcgctcggcggcgttcgccacggcgtggtacggcgacgggctcgccgccaggaaggacatcaggtcgtcggtgtggccgcggtcgaagggccggttcgtactcatggcttcaccttaacgaggcccgggttcacctcgacgacgacgaagggcccgctcccggcggcgggagcggacccttctgagaaggcaggacggccgggcggggactagaacgcggcctcgtccagctccatcaggtccaggtcgacgttctgggccagcttgcgggccagggtgacgccgggcaggacgttggccgcgaagaacttcgccgccgcgatcttgccggtgtagaaggcccggtccttggcggaggcggtctccagcttctcggcggcgatcgccgcgcccttgagcagcaggtagccgacgaccacgtcaccggaggccatcagcaggcgggtggtgttcaggcccaccttgtagatgttcttgacgtcctgctcggtggcggcgaggtcggtcagcagcaggccgacgacggcctccagctcgacggcggccttggccaggtgctcgcgggcaccggccagctcctcgccgccggtggccagcgccaggaacttcttgatgtcctcggcgagcgagttcagcgcggcgccctggttgcggacgatcttccggaagaagaagtcctgcccctggatcgccgtggtgccctcgtacagggtgtcgatcttggcgtcgcggatgtactgctcgatcgggtactcctgcaggaagccggagccgccgaacgtctgcagggactgggcgagctgctcgtagcccttctcggagccgtagcccttgacgatgggcaggagcaggtcgttcagcgcgtgctcggccttggcgtcctcgccgttcgcctccttgaccgcgatggtgtcctggatggaggcggtgtagaggacgagggcgcgcatgccctccgcgtacgccttctgcgtcatcagcgagcggcgcacgtcggggtggtgcgtgatggtgaccttgggcgcggtcttgtccatgaagttcgccaggtcggggccctggacgcgctccttggcgtactccagcgcgttgaggtagccggtggagagggtggagatcgccttcgtgccgaccatcatgcgggcgaactcgatgatgcggaacatctggcggatgccgtcgtgcttgtcgccgatcagccagcccttggcggggtggcggtcgccgaaggtcatctcgcaggtgttggaggctttcaggcccatcttgtgctcgacgttggtggcgtagacgccgttgcgctcgcccagctcgccggtctcgaagtcgaagaggtacttcgggacgaggaagagggacaggcccttggtgccgggtcccgctccctcggggcgggcgaggacgtagtggaggatgttctcctccatgtcgtgctcaccggaggtgatgaagcgcttcacgccctcgatgtgccaggagccgtcctcctgctggacggccttggtgcggccggcgcccacgtcggagcccgcgtcgggctcggtgagcaccatcgtggagccccaggtcttctcgaccgcgatcttggcggccttcttctgctcctcggtgccctcctcgaagaggatgcgggcgaacgccggaccggaggagtacatccagatggccgggttggcgccgaggatcagctccgcgtaggcccagatcagggacggcggggcggtggtgccgccgatctcctcgggcaggcccaggcgccagtactcggagtccatgaaggccttgtagctcttcttgaaggaggccgggaccggcgcggtgctggtctccgggtcgaagaccggcgggttgcggtcggcgtcggcgaaggactccgccagctcgttctccgcgaggcgggtcagctcctcgaggatggacttggcggtctcggtgtccatctcctcgaacggtccgctgccgtacagcttgtcgcgcccgagcacttcgaagaggttgaactcgatgtcacggagattcgacttgtagtgccccatggcgacggctcccgttgaggactcggcgaggcactggctcctcgcatccggttcacgtaccaactagtaactccgatgatgctacccgtcggtaataagaagcaaccccgagcgggtcatctgtgactcagtactcttgcgtccatgtacggctacgaccagagcgcgggcgcgggtgcacagcagggatacgtcccgccgcagcagcagatgcccacaggcggcggcggatacggccagcagccgccgctgtatccggagccgtctcctccgtcgctggccgacgcggtgcgcgccttcaccaccgggcagatggccgccgaggacttccagcagatcttcgccacctccaaggtctactgcccgcgcggtgacacccccggcttcctcgcgctgcacaacacccagcagcccgtgatcccgatgttcacctcgctgaaggagctgcgccgctacgccggcaaggagtcgaagtacttcgtgatcaccggcgccgaggtgatcgacctgctgcccacggggtacggcttcgtgctcgacatggagggcgagcaccggatggtcttcgacgcgaaggcggtcgagcagatggtcgacttcgcgatgcgccgcatgtacggctgaacccctccttccgcctcggggcgctcctggagtgcccccgtgacggtctcctccgcacaccgcgccgccggtcccgcagggacggcggcgcggtgctgcacggcccggctccgcggtgagcttcggccggctctcccgcgttccggtggtccgggaatgtcctcccgcctccctctgttgtggctggcagaaagttgaacgctcaactagagtgagcgcacaaggaggtaccgacatgcctgcagtgaccgtcgagaacccgctggcgctgccccgtgtggccgcgccggccgacgccgtggcacgtcccgtgctcgccgtcacgaccgcgccgagcggtttcgagggcgagggcttcccggtgcgccgggcgttcgccgggatcaactaccgccatctcgacccgttcatcatgatggaccagatgggcgaggtggagtacgcgcccggcgagcccaagggcaccccctggcatccgcaccgcggcttcgagaccgtcacctacatcatcgacgggatcttcgaccaccaggactccaacggcggtggcggcaccatcaccaacggcgacacgcagtggatgacggcgggcagcggcctgctgcacatcgaggcgccgccggagtccctggtcatgtccggcggcctcttccacggcctgcagctgtgggtgaacctgccggccaaggacaagatgatggccccgcggtaccaggacatccgcggtggcagcgtccagttgctgacgtcccaggacggcggcgcgctgctgcgggtcatcgccggtgagctggacggccatgccggtcccggcatcacgcacacgccgatcaccatgatccacgcgacgctcgcgccgggcgcggaggtcaccctgccctggcgggaggacttcaacgggctggcctacgtcctcgccgggcgcggcacggtgggcgccgagcgccggccggtccacgtcggtcaggccgcggtgttcggcgccggttcctcgctgaccgtccgcgcggacgagaagcaggactcccacacgccggacctggaggtcgtcctcctcggcggacagccgatccgtgagcccatggcgcactacggcccgttcgtcatgaacaccaaggacgaactcatgcaggcgttcgaggacttccagaaggggcgcctgggctccgttccggccgtccacggcatgaccggcagcggcccgcagggctgatccgccggccccggaaaaggtcacccgggcgggccgtccgcgcaggacagcccgcccggtgcgtggtccgctggtggggtgcgactgctgcccgagcctgtccggcgtcttgccgcctggtgtgccgtcgcgctgctcgtgtccggcgtggtgtggatcgtggtgcggctgtgcgtggcgttccggacgacggtcacgccggtgctgctcgcgctgctcggggccgcactgctgcggccgctgttcctgcggctggcgcgggccggggtcaaccgttcgctggcggccgggatcacctgtgccgccgtcctggtcgtcgtcggcggcgtcggctacatcgtggcgctcgcgctgatcgacagctggcagcagatcgtctcctcgctggagagcgcggcgaagtcgctcgccgcgcacttcggtgcggccggcacctcgctcaaggacctggccgcccacggcagggagctgctgtcgaagttcggcgggacggcggtctccaacgtgatcagcggggtcagcgtggtcgccgagtacctggcgatggcggtgctggcgctgctgctggtcttcttcttcctgcgggacgcggacaaggccctcgccgcgctgcgctcgctcgcgcccggcgagagcgagcgcagcgcggcgag

SEQ ID NO: 137 - DNA, 10805 bp, Unknown
  Kingdom: Bacteria, Phylum: Actinobacteria, Class: Actinobacteria, Order: Streptomycetales, Family: Streptomycetaceae, Genus: Streptomyces
ctttgaagacggaccctagttgggaccagcggcaccacaggtgccgccgactcctttcctacgcggaccaacacgccgccagctaccagacagacgtggccaacgggcaatcagacgaatgacgacgtgaccctgaacacggtttgctcagggttgtacggggcgagatgacggttcgataaagccagcccctggacaccggtactgccggccgctccagtcgcggcccgcagcccgagcaccggttgggtgctggccgtggcgttcagccccgacggcaaagccctggccagcggcggcaacgatgccctcgccggcggcaaggaccacaccgtgcgactgtggaagcttgcttgagaccacctgaacgcacggctgcgtcgagggggcagccagaagcctggctgccccctcgacggcaaacccacttgttgctcacggcccccacctccacccgcaggctcgactcgcgccgcgttgccggcggcggccacgtccacgacgatgaggccgggttctgacacgtgtacttggctcacctctcacacgaccaacccggcacccccggcgacccgtgagggcccgcacctggacccgggacatcaggccggggcgatgtcgcacaaggtgctgccgggcggtgccgccccgccagtcacaggatcgggcagggcctggggtatcccctttgctcgtagtccgcgatcatgtcgtcggtctccggccgatcaccgcgacctctggggcgagacggcgtccactccccacactgtcgaccacccgggccgggacgccgccctgaccccggcgcagcgggccgccgccgtccaggcccaccagcaggccgcgatgcccgaggagtacctggaggaccgcacgaccgacctggcgacgtggctgcgcagaccgaagagcctggaccgtctcgccgtcttcacccgcgccgccgacacccgccgccgcgccatggaggaccgaaaggccccggccgccgacccggccagtccggtagaccagcaccgccaggagcacggcagcagcgccagcagcctgaccccggccaaggccagggcctccggccgtgacgcgccgtacggcccgcacggcgagacggacgatgaagtcacggcgccaggcgccgggacgcgaccggcggccgcccacccccgaagccacccgggagcggggagggtgccagggaacgccccctcaagtacggaggcccccatggttgccccgaccccgccgcacctttcgccagagcagcgcgagtgcttggagcagctcgccgacgcggcccggctgcgcatggcgctgtacccgtcgccgacgccgcccgctcgcgctcacggcagtaccccggcggccgtcaaacccgtggcgtaccgcgcggggccgccgccgggggtgaggggacacggcggactccaccacaggcccgtgcacggcggggagtggagaccacggtggtgcggatcgggcggcccactcggtgcgctccacccggtgggggagtgagcttccaccaacttggagtcgcaggttaaggggctggcgtggtgatcgtccgaggtgctcacgctgatcgtgggcggggagactgtgaagtaggtcatctgtcagaagctgtgtcgcatcactcttccgcggatcaccgcgccatgaggagtctggggggcggcattgcctgtcagggaaaccagggggcagtacggaagcggtggttggtacgggggaggcgtgatggactcggtgcggcggtcgtcatcgggcttgctccggaacgccgttgctgacctcgtcgcgggccgcgggcgccgcgcccttccgctggtcggcgggcctggcactgcgcaggccgaaggcggagaccgccgcccccagcaacaccatgaccaccgggacaacgagcgcggtgcggtaggcgtccagcaccgcgcccggtgcgtcatcggagccggccgcggcgattccgtacaccgcggtcaccgcggagatcccgaccgccgagccgaactgggtgaacgtgtacagcagcccgccggccaggccctgctcctccttcgccacgctgtcggtcgccgcgatggtcagcggaccgtaggcgagggcgaaggcgatacccgagaggagcaggcccgggaacatcgccgcgtaggaccagtccctccccaacggcaggaagaagccataggccacgatcgccagcaggaagccgccgaagatcacccgactgttgccgaagcggttcgccaggcgcggggtgaggatgggcgccagcacggcgtcgcagcccatgacaatcagcgccatcgcggtctgcagggaggaccagccgcgcagctcctgcaggtaaagcgtgacgatgaactggaagccgaagaacgcgcccatgaagagcagcgcggcgaggtcggcccgcaccatcgtggccttgcggaagatccccagccggacgagcggcgccttggcacgtcgttcgatcaggatgaacgccgccaccagcgccagcccggcggcgagcgcgccgagggccagcccgagccgtgcaccgccgtgctcgagccggacaatgccgtaggccagcagcagcatcgcggcggcggcgctggccgcgcccggcaggtcgtagccgcgcggtgcgagctcggggcggctctcagccggcagcagcctgagcgccgcgagcaagagggcgccggccaggaacaccggggcgaagaagacccaacgccagccgagttcggtcagcagcccgccgatgacgaggcccacagagaagccgccggcgccgacaccggcgaaggtgagcagggccttgtcgcgctgcggcccctccggatatgaggtcgtgatgatcgacatagcggcgggggtcatgaaggccgccgccacgccggtgacgaaccgggcaacgaccagcatccagccgtcggtcgcgaagccccccagcatggagaagaccaggaagacgcccagccaggtgaggaacatccgccgcctgcccagcagatcggcagcccggccgccgagcagggtgaaacccgcgtagcccagcacgtagccgctcatgacccacgccgtggtgccggtggtcagaccgaggtcggcgcggatggtggggactgcaacggccagcatggcgacgtcgctgccctcgaggaagatcgtgccgcacaggacgagcagcagggcccaggctcgtccgctcttgcgggccgcagggatggtggacacggatgcgctcctcacccgttgagccgcttggtcacttccgggtcaaccgcgaccggcgctgtccgtcgcggaagctgcacggaccctgccacgtcgcccgtgcccgcacgttgaatcatccatcccggagcctccaccatcgccatggccgcgaccgtaccgagcagccggcgaccgaggccacacctttgcctgtacccggaggttcgcgtggtggccagtggagaagttaaagaaaaagctcagcggttgacttcgaggttggtcaggacgagcagggcgcgcaggaggcgtgtcgcgcgagcggggtcggtgcggagcttggtgagggttggccagttcttgaggtgggcgaaaccgtgttcgaccggtgcacgttcgacggcaaggacccggttggcggtcttctggctcggggtgagcttgtgaacgcggctggctgtgaagccggtgacgatcgcggggttgcgcacgtcgttgcccagaccgcggaagccgaggtccgccagcgccccgaggctggcggcgcgcaggtgggccaggatgtggtcgtggcgggcggcggtgttgtcgtgtgtgcggccgggccgggcggcgggtatgcagatcagccgataccggatcgtagaaggccgcccggccgcagcgagcaggaactggtgaaccggaccgctccgccagacgatctacggtgcagactgccgtccacgaccagcgtgagcactccggcagatcggcacaccagccctttgacctgtgacttcaagtgggcagaggctcagtggacacggtggactccaccgcgcgccccgtgcacggaggggagtcgaaaccacggagctgcggatcgtgcggtccactcggtgcgctccacccggtgggggagtgcagagcatcccgacatccggtgcgctcggtgcggtgcatcggcgcaccggtgtgcacgccgacgatgccgtgcactcccacccaccgcaccaccgcactggtgcaccgcacccaccgcactggcgcgccgcgtcccaccgcacgctccaatcccgaattccagcaaagggtgcacctatgctcagctcatcgcagggtggccagcgtcccccagcacggggtctacggccatggccgtacgttgcgggcgctgcacagcgacctcgcccaagggctcgcactcgtcggcgtcaccgccgagatcacgctcgtccccatcagcccggagctggaacagctgcggcgtgccgaagccgcttacgaagcggccctgtcggacgctgtgactacgttggccgcccacggcggcacaccacgcgacatcgctgacgcgacgggcgtgacgaccacccgggtggcagcccttcgcagcacaaaggctcggcgtccgcggaagtaggactcggctccagtcggcctgcccgaccccggccccccgctgtgtggcggggggccgggggtgtgggggcgctccagggtgccgagccggacgaaggcgtaggtggcgacgaccagcatcgccttcataccccgatggcgctggacctgctcgccgcgtcccacacactgggtgaagttccgtccctgtgaggcggtcccccgggcgacctggctttttgtcgcagtggcgtcgggcacacgcgtaccgggtggtggtttatcgttcaactagatagtttatgcttcaaccgaagtcggagctcgtgctccggcctcgcacttcctggaaccaagcaagtcaaccgaaagcaccagcatgggcttcttccgccgcaaccaggccaacgcccctcaaggatcggagacaaccgtcatggcttcccccgtcaagctcgctgtcatctactactcctcgaccggcttctccgccgagatcgccagggaaatcagcgaggcggccgagaaggcaggggccgaggtgcggctgttgaaggccgctgagctggcccccggggccgccatcgcctccaacgaggcctgggccgcccacgccgccgccagcgcgggaatccccgaggccaccgcggccgacgtcgagtgggccgacgcggtgatcttcggcaccccgacccgtttcggcaacatctcctcccagctcaagcagttcatcgacacgctcggtgggctctgggcccagggcaagctcgcggacaaggtctacagcgggttcgtcaccaccgccacgacccatggcgggcaggagtccaccctcctggcgctgtacaactccatccaccacttcggtggtctgatcgtgtcccccggctacaccgacccggtcaagttcatcgacggaaacccctacggcacctcccacgtcgacgcccagggcaacaacgcgatcggcgaccagacccgcaacgcggcccgtcaccaggccgagcgcgtcgtgcggatcgccgccgcgctcaagcacggtctgtccgtctgaaccggtcgggggaacccggtcgtggctggcgccgtgccgtaacggggccgaccacgcgtgccgagcggccctggatgccatatcccggcaaccggggccgcggggttgcgagggtggggcgtcggccagccgtgcggtcgtggctgcactggtggtgtcgcgaggttgggggtggagggtgtagttccagtcgccgtgaaagcggtggcggtgcgcgccagcccggcccggggcacgctgggaggcgtgagcagcgcgccgatcgtcgtgcaccgggctgccccatccaggggccggagagccaccgtgcacaggcacggccaagacaagttccttggcaccgcctacagcgaccacgacctggtcgtgttcctcgaagccgccggcgttgccgatcccgaggccatcctggacgatcctcagtgggtggagtggcgcggcggccccgcccacgatttcagttgtgcctgacgtccgagcggcggcggccgggcagaagggcctgcccggccgcggtgccgccacctggggcccggaccggctggacgtcttcgccaagggacacgagcaccagatcctccaccgcttctggaacggcagccagtggagcgcctggatcgatctggggatcaccggcaccgacgacaacctggccgcggtctcccgtaaggcgggcaacatcgaactgttcgtccggggctgtgacaacaagctctaccaccgcacctccaccgccgacgccgacgaggtcaacgaccaaggcggcgtccccgacgcctcctgaagcgatgaacaacctgatcgaggccgtagagcagaccgagtgccggccgccctcgtgagacgagccccactacgcggtggaagcggagttcctccaagaccagcccaccgtgcacacctggacgtacgagagccaggacgacggggacaccggcggccgcgtggtgcgccttgtcggtcacaccgcacgggacgacggcctcgtcggatggttcgcgggacggcccggactgggcggtgacccgtttgcaatgccgtggtcggaggccggccgggccgtctctccattctccgtgacggtcaggtcgttcaccagggccgccacgtcctgtcccgaccggacacggccgggccaggacgtgaccacggcggtgggagcggacggcttcgcgcactccacaaccggccgattcccgacacagcccggagcgtcaggcctgccgtgtgccgtcaagcagcagcgacgttgcggcgccactgccccgctgcatcgtcccagtggatagtcacggtgccgccgctcctgtcaggagcggaaagtgcttcgaggtcggcagaagccaaagcggtgagtgccgcgtcggacaggctcggcggaacgatgaagcgcagtccggctgcggtctcttccacgacaatcgtcgggcgaccggaatgaatggcgggggccagatctgctctacggccgatcacgcggcgcaaggtcgcgcgagcgacttcgaacgagcgctggcccgcctgtgtggccattgcctgcaagaagggcaggaccgcggccgtcacggtcactcccgagaccgcagccaccccggtcatgatcccgcaattgccggtagacgagcacacgagcacgcggaacacttcgtgggtggcgagctcgcgccactctgaacccgcatcagaggccgacaggtagcccctgagttcctgcagaagaagagtgctctcggtgttccgtggctcgccagcatccttcgcccggtccagccacttccgcacttcagcagggctaggcgagcccgtcagccactccttgcagatcgcaagtactttcccggcttcagcctgagccctctgtcggctcgtcatgggtccctccccgtgtcctgcgtcgaggcccattctgtccaccagtgctgtctgcggtgggagtttcatctcatcgaccgcccccggccgttggcgtaggcgtggccgtttcgagctctcgcgctgaacgcctgccggagcggctgctgcgccgcgtccggcccggtcatgccccgctgtgtgtcacggcggttgatctggtcgacgtggccgccaccgggtccgctggcgggaagacggtcacctgggagccggtggagaggatctctctgggcggtgggggcaagggcagcgcgcagtgtggagccggtctgccatccggggagcgtgtctgaccagtgtttccacctcaccctgaccgttgcgggtcgcccggccgcgcatggctggtgggcgagtgaacggctcgtatctcgtagcgggtccgcaggcgttcgaactggtggagccaggcgaaggtgcggtgtgaaccccgtttcagagcccgagcatgcgagccgttgattgccgcgtcgtccacgtccaccaagcgcgttcgtacggagttctctgacagtgcgtgtgaggctcttcctgaagtgccatgatcgaggggctccggcgaagacgcacagatgagtccacgatgggggcgcggtggaggatcagcttctgggaggccggtaccggttggtccggcagctcggcgagggcggcatgggcgaagtctgggaggcgcgggacgagacgctggatcggcaggtggctgtgaaagtgatctcgctgctcgctggcggtggaagccgtggggacgaggctcgcgcacgctttctgcgcgaagcgcggatcacggccaggctgcagcatgcgcacgtcgtgaccgtccatgatctcggcgagagcagtacgcagagaggcacggcgcccttcctggtcatggagttggtgcgcggtgaaggactcgatgtcaagattcgcgaaagatccgtcgatttggcggaggcagcccgctggggtgctcagatttgtgacgcgttgagtgacgcacacgctcacggcgtcatgcaccgggacatcaaaccgtccaacattctcgtcacgcctgccggaactgtgaaagtgctcgacttcggtgtcgcgcgcgccgccgacccctacgcgaccgcggaccggctcactcagaccgggttcatcgtgggtacacccccttacatggcgccggagcaggcgcgcggctacccggaaccgaggagcgatctgtacgcgctgggctgtctgctcttcgagctggtcaccggcaggctgccgttccaggccccggacagcgtcggctatctgacggcgcacctgagccagcagccgcccgcgccgagttccgtggccgcgggtgtgccagaggcatgggatgctctgctgctcaagctgttgagcaaagatcccgcagagcggtacgcgaacgccgccgacgccgcccgcgccctgcgcaagctcgcggacgcgcccgatcccgtgccggcggccaccgtgctgctgccagatgctctggcgtcgccgctcccagccgactcgactcccgggaagcctgctatgacgcgctcctggatcgcagttgcggtctggttcctcatcacgctggtggccgccacggtgaccgcggtcaatatcaacggagtctttgacggtcgcgacatagccagcggcgccggtgcggtcgccgccgccaccgggggcctgatcgtgtggttcgccgtgcaggcacgaccccattggcgggcacacatggccctgccgctccgattcctcccgccgttgctcctcttctgcctctacgccgtgatggtcgcggtcgccgccaccgccgacgcacccttcggcgggatcgactggggttactggctggccgccggcgggatctctacgctcgcgttggtgggcctcctggccgtgaccgcggcgctcacccctcgggcgaagcgccgaatccgcagggtcggctacggccttgtcagcgtcaacgccgtcgcggttctcggcacgttcacggaattggtggcagggcaacagctctggcttcaatatgtctggttcgactcgctgcaatgggcccccctcgccgtgggcgtgtcggccatcgtgctgtactgcacacgcgagatcacgacgcgccgggcgggttcggcatcggtgcctgcccggaccgtgactcacacacctaggtagttggtgttcctccgccgcctacgaacctcattctgaaacgatcagcgaggaggcggggcgggtcaagggcatccgatgatggggctcgttgaatttccccaccccgtgctaagggacgggacagacctgttcacagagattccccatccacagttccctgcgtttcgacagcggcgtcagggcggaaccttcctgctgtgaacccctcgccgtcctggaactcgatcagcactccactgtcgatgaggtagatccagcattcaggagagcactccaacaccgcttctgcctggactgctgcaagcgcggcaggcagagcgacggacggcactgcgagattgctccagaacacgactgcgagttcgtccgccgcagcgcacgaagccaacagcctgcgcagttcgtccgcgtcgaacaactcacaccgctcgatcacttcggcccctgcccagtccagccgagtcgatcccacggccccaaagcgccccacgctgagtgcggcgaagtcgcggtcctcctggaacgacagcaccatcgctgcttcgccgacggcttccagcagcgctgagatctgctctgggtgcgttccgtacatcttgccaacgctcaaagtggtcccctgacttgcctcaacgatgtgccgtgtggcagcaggttacgtcccggcagacaggcagatcgatcaccggtgtacgggcagggaactgaggaacgaagagcgaacctggggaatttcccagatccccatcaccgatgggtgggcgggtacggcggcctgccacgtgctcgcgtctgcttggtcgatgagaccaccggcgcgtgctggcggcctggcccgagccgtcgtgaccgcctgcatcgacgcgagcaaggacggcactcgcccgccggcagcccccaggcctacgcggagggatccggctcttcgccggtgtggtcgaaaccgcgcacagcggcgtgacctcctgcgcgcacccgcacagagtgcacaaggtcgtcgccgggttctccgcgacgtccagggcgcgctccaggtcgagcaccggggcgtcgtgcggcgcctcggcgcagtccggcg

SEQ ID NO: 138 - DNA, 4119 bp, Unknown
  Kingdom: Bacteria, Phylum: Actinobacteria, Class: Actinobacteria, Order: Streptomycetales, Family: Streptomycetaceae, Genus: Streptomyces
ccggcgcgctggccgtgaccgtcggcgtcggtgccgcgctgttcgacgaccggttcggcctgggcacgctgcgcccgcgccggctcaaggccatgccgtccttccccgacgacgacctcagtcccgactggtgccacggcgacctcagtctgcacctgcacgccgacgacccggacaccgttctgcacgcgctgcgcgacatcgcccggcacacccgcggcggcctccaggtgcgctggcgcctggacggtttcgcgagcccgccccgccccgtcggcaccccacgcaacctgctgggtttcaaggacggcaccgcgaacccggactccggtgacgcccgggagatgaaccgcctggtgtgggtgggcgagggcggcggcgagccgggctgggcggtcggcggcagctaccaggtggtccggctgatccgcatgctggtggagttctgggaccgggtctccctcaccgaacaggaacgcatggtcggccgggcccgggagtccggcgcgcccctggacggcgacttcgagcacgacacaccgcacttcgcggacgatcccaagggcgacgtcatcccactggacgcccacatccgccgcgccaacccgcgcaccaccgccaccgccgaccagcgcatcctgcgccgcgcctacaactacgaccgcggcatggacgccaacggcaacctcgacatgggtctgctcttctgctgctaccagcaggatctcgtccgccagttcgaaaccgtgcagaaacgtctcgaaggcgagccgctcaccgactacatcaagccgttcggcggcggatacttcttcgccctgcccggcgtccgcgacgcgcaggactggtacggacgtgcactcctgagctgaaccctgatcggttagtcgtgatttgctccctagtttggtcaatacagggtcaagaattgtcttgggttacctgacccggtgttcatgtccgcgtcatcatggctcctccgccgcgccgccggcccggcggagcatcccggcccgtagaccgcagccacgatcctgcccggaaggtggacccacatggccagcaggggaagacgagcaacgatgcggagcctgggggcgctggccggcgccgcagcgctcaccgttctgggcggagccgcccccggctgggccgccgtgcccgccggacaccacgggcacggctcgacggcgacgcccatcgagcacgtcgtcgtcctcttcgacgagaacatctccttcgaccactacttcgccacgtatccgaaggccgccaacaccgacggcacgaagttcaccgcgtcgaagcggaccccgaaggacatcgacaccctggcccacgccggtctgctggagcacaaccccaaccagtacgcgcccaaacggctcacccccgagcaggccgtgacctgcgaccagaaccactcctacgggcccgagcagtacgcctacaacggcggcaaggccgaccagttcgtgcagaacaccgaggtcgacaagtgcagcggcggcctgttcggcgagccgggcctggtcatggactactacgacggcaacaccgtcaccgccatgtggaactacgcccagcactacgccctgagcgaccgctccttcggctcgaactacggcccctccacacccggtgccatcaacctggcctccggccagacgcacggcatcatctccgtcgacccggcttccggcacggagaacccgaagcagacggccacgcccgacccgtacaccgtcaagtcgccggacgcgaacggcgtcggcacgatggtcaacgacccggaccccgccttcgacgactgcgccggcaagaaccacaccagccacaacccgctcggcgtgatgaccggccgcaacatcggcgacctcctcaaccgcgagcacgtcagctggggctggttccagggcggcttccggccgtccaccgcgtggagcggcgagcagggcgagtacgccaagtgcgagacggcgcacgccaacgtcggcggtgcccagtccgtcgactacagcccgcaccacaacccgttcgcgtactacaagtcgacggccaacccgcaccacctgccgccgaaggacgtcgccgagatcgggcacgacggccgggccaaccacaactacgacctgaccgacctctccgcggcgctgaaggcgggccggctcccggccgtcagcttcgtcaaggccccctcctaccaggacgggcacgccgggtactccgacccgatcgacgaacagcacttcctggtcgaccagatcaacgcgatccagagttcgccgcagtggaagtccaccgcgatcgtcatcgcctacgacgactccgacggctggtacgaccacgcctacgcccaggtgcgcaacggctcgacggacacctcggccggctccaacggcaaggccaccgacagcccagcctgccaggccggccccaaggcggccggcggctacctggaccggtgcggccccggcacgcgtcagccgctgctggtcatctccccgtacagcaaggtcaacaaggtcgaccacacccagaccgaccaggcgtcgatcatccgcttcatcgaggacaactggcacaccgggcgcatcggtgaccactccttcgacgcgaccgcgggctcgctcgcgggcatgttcgacttccgtcaccccaacggcaagcaggtcctgctgaacagcgacggctcggtcaggtcggtcggaccgatccgctccgtggcaccggtggccacgtccatcacccccggccccgccttcgagagcgcggccgccgccaccgacacctcctcctccaccacggtcctcgcggtgggtgtcggcgcgggcgcgctgctggccgtcggcgccacgggtacgtacctctccctgcgccgcaggagccgcagcaccctctgacccgcgagcggcgtccgcacggaccgggccgcccccgtcatcgacgggggcggccctttcgccgtggtctgccgggcgtgccggggcggtcagggctgtacgggcatcgtgaggcagttggacggggccggcttgccggacaggcggtcggtgagccaggagacggcggtgccctggtcggcgaggagcggaccgaagtggttgagcagcgggctgacgacgttcgggagcacgaccggtgcgtagctgacgtcggcgcccttgcggcaccagtcgacggcgagctgccgcgcctggccgtgcggcacgaggtcgtcgctgacaccggtggccacgcggaccggtccggccggcttcagcctgccgatgcgctgggtgtcgaggaaggccttgagcgtggggttggcttggatgatgtcgctcagggactgcccgtcggtcgtccacttggtgctcttggcgtagccgtagtgcaggatcgcgtcgcccacgcacatggtcgacagatcggccagagcggccttcccggcggtgttgaggtgagcctccgcgatcgggcgcagctccgggtcggtctgcaggaagccgttgagcgaccagccgagggcgccggccagttcgctgccgtcgatgcccttggtgacctcggtcaggtcggcgggcggtgcgccggagtaggtgccggcgagcgggacgtccggggcgtaggagggctggagttcggcggctgcggcggtcgcgccgccgccctggctgtaaccgaagagtcccacgcgtgaggcggcggtgaccgacgctccctcgacggtgcgtgcggcgcgggcggcgtcgaggacggcgtgggcgccgtcgacgcggttgacgtaggtgtgcagccggtccgtggcgccgaggcccacgtagtcggtgacgacgaccgcggtgccctgggcgaggagccggtagaccgacaggtcctcgtagccgacggacacggtctggccgttgagggacagcgggtgttccaggcccagcgaggccgcgcactggtcgccctggcccatggtgccgggcgcgacgacgaccagggggcgtgctccgccgcccttccagggcgccgtgggttcgatgtaggcgccggtgacggcgacgggagcgccgccggcgtcggtcgacttgtacatcaggcgggtggcgcggcccggcagcggaccgtgcaggctgggcaggctcaggg

SEQ ID NO: 139 - DNA, 8538 bp, Unknown
  Kingdom: Bacteria, Phylum: Actinobacteria, Class: Actinobacteria, Order: Streptomycetales, Family: Streptomycetaceae, Genus: Streptomyces
ccagttcctcgccctggtagacgtagacggcgccgggcagggccagcgagagcagggccgcggcgcgggcacggcgggtgccgagggccaggtcggtgggggtgccgaaggccttggtggcgaagtcgaagccggtgtcggcgcggccgtagcgggtgacggtgcgggtgatgtcgtggttgcacagcacccaggtggcgggggcgcccacgggcgcgtgctcggccagggtctcgtcgatggaggtgcgcagccgggcggcgtcccaggggcaggacatgaaggagaagttgaaggcggagtgcagttcgtcggggcgcaggtagcgggcgaagcgctcgctgtcggggagccacacctcgccgacgaagacaccgtcgtacgcgtcggcgacgcgtcgccaggagcggtagatgtcgtggagttcgtcgcggtcgacgtacgggtgcgggtcgcggccgtccgcgaggtcgggcaggcgggggtccttggcgggcagggcggcggagtcgatacggacgcccgcgacgccccgctcgaaccagaaccgcaggatgtcctcgtgttcctggcgcaccgccgggtgcgcccagttgaggtcgggctgctcgggcgcgaacaggtggaggtaccaggcgccgtcgggcagccgggtccaggccgggccgccgaactcggacgtccagtcgttgggcgggagttcaccgtccgggccgcgtccggggcggaagtggaagaggtcgcgctcggccccgccggccagtgcggcccggaaccaggggtgctggtcggagacgtggttgggcacgatgtcgacgatcgtgcggatgcccagctcgcgtgcctcggcgatgagtttctcggcctcggcgagggtgccgaaggcggggtcgatggcccggtagtcggcgacgtcgtagccgccgtccttcatcggggacaggtaccaggggttgaaccacagggcgtccacgccgagttcggcgaggtagggaaggcgggcgcggacgccggcgaggtcgccggtgccgtcgccgtcaccgtcggcgaagctgcggacgtagacctggtagatcacggcggagcgccaccaggcgtcgtcggcgcggccgtttcgggcaggggtgggctgtcccacggtgcgtgcctttctgggtcggtggaaagggtggggcgggcggtgtcagcccttggtgctgcccgcgctgatcccggcgatgatgtgccgctggaagacgaggaagagcgcgaccatcgggatgctggcgatcaccatcgcggcgacgagcacggtcagctggatgttctgcgagagctggacgagggccacgctgatgggctgtttgccggtgtcggagaagaccatcagcggccacaggaagtcctgccagacggcgacgagcgcgaagatggacaccacgccgagcacgggccgtgacatgggcagcacgatcgaccacagggtgcgcagttttcctgcgccgtcgatctcggcggcctccagcacgtcgcgcggtatctggtcgaagaaccgcttgagcaggtacaggttgaaggcgttggcggcggccgggagccagatcgcgagggggtcgttgagcaggctggtgtggatcagcggcaggtcggcgacggtcaggtacttcggaacgaccagggcctgcgcgggcaccatcagggtggcgaggatgccgccgaggatcaccttgccgaaggcgggtctcagccgggacagggcgtaggcggctgccgtgcagaacaccagctggcaggcccaggcgccggccgcctggacgaaggtgttccacaggtgctgcggcagctgcatcaggtcccaggcgtcggtgtaggcgctcaggtgccagtgctcgggcacgagggtgggcggggtctgcgccacctcgtcgggtgacttcagcgcgccggtcaccatccagtagaccgggaagaggaaggcgagcgtgaacagcagcaccacgccggtgaagacggtccagtagacggccctgccgcgcgggcggcccagcgtcgccggggagacgagggtacgggtgctgctcatgcgtcctcctggccggagccggagcgggtcagccgcaggtagccggccgagaacaggccgagcagcacgagcagcatgacgctgagcgcgcaggcgccgccgaagtcgttgtagaggaaggcgtacttgtagatgaggtagaggacggtgaccgtggcgctctcggggccgccgccggtgatcacgaacggttcggtgaagacctgcatggtcgcgatgatctggagcagcatcagcatcaggatcacgaaccgggtctgcgggacggtgacgtgccggatgcgctggagcaggttcgcgccgtcgagttcggcggcctcgtacagttcgccggggatggactgcagggcggccaggtagatcaggacggtgccgccgaggttggcccaggtggcgacgaggaccagggagaccagggcggtgtcggcgccgttggtccagttcgaggtgggcaggtgcagggcgcgcagcgcctcgttggccaggcccgctccggggtcgtagaaccacttccacagcagggcgctgaccaccggcgggatcatcaccggcaggtagacgacgacgcggaagaaggctttggcgtgccgcagttcgttgaggacgagggccagggcgaacgggacggcgaagccgatcagcagggcgagcgcggtgaaggtgagggtgttgcgccaggcggcgccgaactcggggtcgtgcaggacgtgggtgaagttggcggtgccgacccactggggtgcctggcccggggtgtacttctggaaggcgatcacgaccgcgcggatcgccgggtaccaggagaacagggcgaagcagatcaggccgccgaggaggaaggcgtaggcgcgggcctgttcggcgaggcggcgccgcctgcgctcgcgggcgcggggcggcgccggtaccgggtggacggcgatcgcccgggcgggccgccgctcggccgtcttggtcatggcgggtcagctccgtgccaggatgccgtcgatcttgccggaggcgtcctcgaggagctggtcgatgtcggcgtccttcttggtgaggacggcggagaccacgccgtcgaggacggagtagatctgctgcgcgttgggcggctccaccttcagctggaggctctggttgccgtccaggaaggactggtagttctccacgggcacgttggcgttggccttcttgacctgctggtcggtggcgtcggcggcgccggtgaacagacggggttcgggcaggccgacgggtgcgttgttcttcttggcacgggcgtagtcgccgaggaagcccttgccgggggtgaggaacatgtggtcgagccacttcagaccggcccggatctgggcgggcgtgtccttcttgttgaacatgtagccgtcgccgccgacgagggtgcccttgccgccgggcatgggggcgagggcgaggtccttgtagttgccgcccttctccttgaccaggatcgggatgttgtcgggggcggagaggtacatgccgagcttgccggagcccatcatctgctggacgtcgttgatgacgaggagctgcttgctgcccatggagtcgtcgctccagcgcatgtcgtgcaggttctgcagcacggcacggccctccggggtgtcgacctgcgccttcttgccgtcggcgctgacgacgtcgccgccctgggagtacagctcggcggtgaagtgccagccgccctggttctgggcgctgtagtcggcgtagccgacggtgccgccgccgagcgcggcgatcttcttggcgtcggcgcggacctcttcccaggtcgccggcggcttgtcggggtcgagtccggccttccggaagagcgccctgttgtagatcaggcccatcgagtagccggtgcgcgggatgccgtagatcttgccgtcgacggtgtagatgtcgcgcagctgcttctggagcgtgccgtagctcttcaactccttgacgtacggggtgaggtcggcggcctgaccggtggagacgacgtgcttgacgtcggtgaagtaggtgtagaagacgtcctccatctgaccgccggccagcttcgcgtcgaacgtcttggggtcctcgcaggggaacgcgtcgtgcgtgacgacgtcgatgtccgggtgctgcttctcgaaggacgccacgtcctggtcgaagaacgaccggtcggtcctggcgctcttgggcggctcgcagttgaccgtgatgcgggtcttgccgttcgcggacgcgtcgtcgccggaaccgcacgacgtcacggccagggcaagggagcagacgccgatcgcggcgacggcatggcggaacccggtgcttctcatcggtggacccctcaggacaggagcggtgggtgtcgcacactcaagcaccggcgacagcccttcgcaatatgtcgcgcggaatctgaaattatttgacagcacatcggttcggcgggaccaaggcggcgttgctcgccgggtccgtcactcgcggggcgcctgcgcggtggatccgcggaccaccagctccggttcgaacagaagctcgtcggccggtacggcgctgccgccgatctgcgcgttgagcagttccacggcggccttgcccatggactcgatgggctggcggacggtggtcagcggcggctcggtgcagttcatcagcgcggagtcgtcgtagcccacgaccgagatccggcaggggacgtcgagtccgcgccggcgcgcggcccgtacgacgccgagggcgagcgggtcgctggcgcagatgaacccggtgacaccgcggtcgatgagcttggccgccgccgcgtggccgccctcgatggagaagatggaccgggcgacgaactcgtcgggcagctcggcgccgagcgcgcgggccgccgccagcttgcgggcggagggcacgtggtcgccgggcccgaggacgagcccgatccgctcgtgccccagggaggccaggtggcgccacgcctgctccacggccaccgcgtcgtcgcaggagaccgccgggaagccgaggtgttcgatgcccgcgttgaccagcacgacggggatgttgcggtcggcgaggagccggtagtggtcgtggggcgcgtccgactgggcgtagaggccgccggcgaagacgacaccggagacctgctgttgcagcagcagctccacgtagtccgcctcggagacgccgcccttggtctgcgtgcacagcacgggggtgaggccgagctgggccagggcaccgccgatgacctcggcgaacgccgggaagatggggttctgcagctcgggcaggaccagtccgaccagccgggcgcgctcgccgcgcagttgcgtcgggcgctcgtagccgagcacgtccagcgcggacaggaccgcctgccgggtggcttcggagaccccgggtttgccgttgagcacccggctgaccgtggcctcgctgaccccgaccttcttcgccacttccgcaagtcgtcgcgtcatgcacgcaagcctagcgcaagaatcgcaagtgacttgcgtaaagattccggccaccgggaccggggcgatcaggccggccgccttcccgccgccgccggacgaccgcggtgcgcgcggctacacccggctcgtcgtcgccgtgtcggaggacagccgctgggcgaggtagatcggggcgacggagagcaggaccaggacggccgccacgacgttgaccacgggcgcctggcgcggcctggtcatgttcccgaagatccagatgggcagcgtctcgacaccgggtccggcggtgaacgtggtgaccacgatctcgtcgaaggacagcgcgaaggacagcagcgcgcccgcgagcagcgccgagcgcaccagtgggaaggtgacgtcggcgaaggcgcggaaggtgtgggcgccgaggtccatcgccgcctcctcgtaggaggtggaggtgcggcgcagccgggcgacgacgttgttgaagacgacgacgacacagaacgtggcgtgtccgacgacgaccgtgaagaggccgagtccgacgccgagcggcgcgagcaccgtggagaaggcggagttgagggcgatgccggtgacgatgccgggcagcgcgatcggcagcacgacgacgaaggagaccgcgccgcggccgaagaagcggtaccgggcgaccgcgaaggcgatgagcgtgccgaggaccagggcgatcgcggtggcgccgagtccggccttcacggacacccacagggcggcgcgcgcaccggagttgtgccaggcgaccgaccaccagcgcagggtcagtcccgggggcggccagctcgcgctgcggtcggggttgaacgagttgacgaggaccagcagcagcgggacgtagatcaccgcgaagccgagagcggcggcgacgcggagcgcgatgcgcgcccggcgggagagctgcatgacgtgggaccccctgggacggcggttcacaggctgctgagggcgccggtgcggcgcatcgcgagcaggtagaggacgatgacgacgacggggacggtgccgagcgcggcggccatcggcaggtcgagttcgatgtcggagtagacgacgttgccgatcagctgggtcttgccgccgacgatctgcacggtgatgtagtcgccgaggctgagcgagaaggtgaacaccgacccggcggcgacggacggcagcaccatgggcagcaccaccgaccggaaggtccgccacggacgcgcgccgaggtcggcggaggcgtcgagcagtcccgcgggcagccgctccagcgcggtgtgcacgggcaggatcatgtacggcagccacaggtacgtcagggtcagcaccgtcgcgggcagcccgaacccggggccgctcagcccgaacggcttcagcacccagtcggcgaggccgccctgggagaggatcagccgccaggcgtacaccttgacgaggtaactcgcccacagcggcgtcaggatcgccaccacgagcagcggacgccacctgggccgggcgacgcgcgcggtgtagaacgcgagcgggaaggcgatcaccgcgcacagggcggtgaccgcgagggcgacaccgatgctgcgcacgacgacctgccggtagaccggtgtggtcagcagggcgtggaagttgtcggcggaccagaccttgacgaccgcggaggtgaaggtgtccgtcgtccagaaggcggagacgaacagcacgctcagggagccgaggtagagcacggtgagccacagcagcggggcggtgagcagcagcgagagccgcaggcgggggcggcggtgcagcgcgccggccagccgccgggcggctttgggcccggcctggcgtgccgcggtctgtgcggtggcggtcacgaggtctcagcccttgatctcggtccaggcccgcacccactgggcgtagggcacgcacgtgacgtcggtgcggccgtccaggcactgctcgatgggggtgttccagaaggcgatccgcttccagtacgccgtgtcggcggcgtggtaggtggtgcagaagttgcggtcgctggtgtgctcgcaggcggcggcgttggagggtgcctcgccgaagtactcggcgacctgggcgttgaccttgggcgagacgatccagtcgagccacttgtaggcgcagttggggtgcttggccttggcggagaccatccaggtgtcggaccagccggtcgagccctccttcgggacgaacgccttgaccttggcgccctcggaggcggcgaggttggcgatgacctgccaggtggtgccgatcacggagtcgccgctcttgaaggcggagacctccttgaggtagtcgccccagtactcgccgacgctggagttctgcttcttcagcagggcgaccgccgcgtcgaactgcttctggtccagggcgtaggggtccttgatcttcagtgcgggccgggtggccttgaggtagagggcggcgtcggcgatgtagatgggcgagtcgtaggcggtgacgtggcccttgtacgccgccgcgccgtcgaagacggccgaccaggaggtgggcgccggtttgaccttgccggtgttgtacatgagcaggttggcgccgcggccgtgcgggatgccgtacgccttgcccttgacggagttccagggctgcatcttcaggtcggggaagatgccgctgtagttgggtacgagcgcggtgttgacgggggcggcgtcgccggaggcgatcaggcgcagggaggcgtccccggaggccgagacggcgtcgtactggcccgtcttcatgagcttgaccatctcgtcggagctggcggccaccttggagcggacctggcagccggtctgccgttcgaagccgctgacccagtcggccttcgggtcgttggagccgtcctcgacgtatccggcccaggcgatcaggtcgacctggccctcggtgcggcccaggtgggcgggtgccttgaggtcgggcgggttgaggccgcctgcggctcctccggcgaaggcggctccgccgcaggcggcctcggcccgc

SEQ ID NO: 140 - DNA, 6623 bp, Unknown
  Kingdom: Bacteria, Phylum: Actinobacteria, Class: Actinobacteria, Order: Streptomycetales, Family: Streptomycetaceae, Genus: Streptomyces
caggggcgcggggaaccgcgcacccagcccccacagccccgcacacggcacacgaccccgagaacccgccgttacggccgagcgcggcggcatggcaggcttggggcatggccgtgcagatcaaccccagcatcctgtccgccgacttcgcgcgcctcgccgaggaggcgaaggcggtcgaaggggccgactggctccacgtcgacgtgatggacaaccacttcgtcccgaacctcacgctcggcgtgccggtcgtggagtccctggcgcgcgcgacggacaccccgctggactgccacctgatgatcgaggacgcggaccgctgggccccgcagtacgtcgaggcgggcgcctcctcggtgaccttccacgtcgaggccgccgcggcgccggtgcggctggcccgcgagatccgggccaagggcgcccgcgcgtcgatggcgctgaagcccgccacgcccatcgagccgtacgaggacctgctccccgagctggacatgctcctgatcatgacggtggagcccggcttcggcgggcaggcgttcctcgacatcatgctgccgaagatccgccgcacaagggagctgatcagcaagcacggcctgcagctgtggctccaggtcgacggcggcgtctcggcctcgacgatcgagcggtgcgcggacgccggcgccgacgtcttcgtcgcgggctccgcggtctacggcgccgacgacccggccgaggcggtccgtgccctgcgcgcacaggcgcagacggccacatcccgggcatcctgggcgtgcggccactgagtatcagcgcgtcctgggcgtgcgaccacggagcaccagggcgtcccggacgtgcaaccactgggcatcaggtacgtgaacggctctcatcagggctgatcaacagcgccggatctgcaaggatgaacggcgaatccagagtgtgaacagcagtgaggagatcgccgtgtcgggtatgtcggcgggccggtcagcagtgcggatgggacccgctgagctggtgcaggcggcggccatggcccgccgcttctacctcgagggcaagtccaagatccagatcgccgaggagttcggcgtcagccgcttcaaggtggcccgggtcctggagaccgctctcgaacgggatctcgtacgcatcgagatccgtgtaccggccgagctggacgcggagcgctccgacgcgctccgcgcccgctacggcctcaggcacgccgtcgtggtcgagtccccggccgaggccgaggagacgcccgacccggagaacctcggcgaggtcgcggccgacctgctcggagagctggtcgacgagggtgacgtcctgggcatggcctggggccgttccaccatccacatggcggcggccctcgaccggctgcccccgtgcacggtggtgcagctgacgggcgtgtacgacgccggtacgtccgagcgtggctcggtggaggccgtacgccgcgccgcccaggtctccggcggcgacgcgcaccccatctacgcgccgatgctgctgccggacgcggccaccgcggcggcgctgcgcaaccagaccgggatcgcgcgggccttcgagtacttcgacaaggtcaccgtcgcctgtgtatcgatcggctcgtgggagccgggcatctccacggtgcacgacatgctcagcgacgaggagcgcgcccactacgcctcgctcggcgtcgccgccgagatggccgcgcacctcttcgacgccgagggccgccggatcgggcgcgacctgggggagcggtgcatcacggtcaaggccgaccagctccgccggatcccggaggtcgtcgccatcgcgggcggtcagcgcaaggccgccgcgatcgacgcggtgctgcgctcggggctggtcaccagcctggtcacggacacctcggccgccgactacctgatgacggccggaccggcccccaagtccgcactgaaccgggcggacccggacgggtcctgacagcgggcggccggcggacgggcgtggggacaccggacgcgtcggtggacggccgtgggaacggcgagccgccggtggacggccgtgggagcatcgtcggcatgctgctgcggtccgtcccccgtgcgttcgcgggtctcctcgtctgcctcgccgtcctgctggcgggctgctccgccgggggctccgccccgggcggttccagtacaggcagggcgacgcccggagcctccgcgtcggccggcgccgccacgcccgcctgggcccggggcatgcccaccgtgcgggagtcccgactgccggccgaggcccgccgcaccctcgccctcatcgaccggggcggcccctacccgtactcccaggacggcgtggtgttcggcaacttcgagaaacggctgccgaagcacgcccggggctactaccacgagtacacggtcaagaccccgggctcgcgcgaccgaggcgcccggcgcctcgtcaccggacgggacggggagatctactacaccgacgaccactacgacacgttccgggcggtgctgagatgagcgaagacctggccggccggctcgtggtcgcgttggacctcgacggggtcacggacaaggcggccctgatggaccgtgccgcgcgggccctcgcgctgcccgactggttcggccgcaactgggacgcgctggccgattccctcgctgacccttccgtgtggccgaaagacgccgccgagcacgggctgctgctcgtcgtccggggctggcgggggtacgccggggcccgtcccgaggagtggcgcatcgccgaggacgtgttcgccgaggcggccgaccgcaccccgcgactggccatcgccctggaccttggagcatcctcctaaggccccgctgaccagcctggatgttgtgacagggcatgacaggccatccggcatgggagaatgaagtacgtgctctttccccctggctgacctgtccgggggccacctctgatcgactgggatgtgcagcacgtgcgtttcctcaacgacatccagcccgcgtacgacctgacgtacgacgacgtcttcatggtgccgagccgcagcgcggtcggctcgcgtcagggcgtggacctcagctccccggacggcacgggcaccaccatcccgctcgtcgtcgccaacatgaccgcgatcgccggccgccgcatggccgagaccgtggcccggcgcggcggcctggtggtcatcccgcaggacatcccgatcgatgtcgtcaccgaggtaatctcctgggtcaagggccgccaccacgtcctggacaccccgatcgtgctggccccgcaccagacggtcgctgacgccctcgccctgctgcccaagcgcgcgcacaacgccggcgtggtcgtcgacgagggccaccggcccgtcggcgtggtcaccgaccaggacctgaccggcgtggaccgcttcacccagctcgaagtggtcatgagccgggacctggtgctcctggacgcggacatcgacccgcgcgaggcgttcaaccggctcgacgccgccaaccgccgctacgcgcccgccgtggacaaggacggccgcctcgccggcatcctcacccgcaagggcgccctgcgcgccacgctctacaccccggccaccgacgcgcagggcaggctccgtgtcgccgccgccgtcggcatcaacggcgacgtggcgggcaaggccaagcaactcctcgacgcgggcgtcgacaccctcgtgatcgacacggcgcacggccaccaggagtcgatgatcagcgcgatcaagctggtccgcgacctcgacccgcaggtgccgatcgtggccggcaacatcgtctccgccgagggcgtcaaggacctgatcgacgcgggcgcggacatcatcaaggtcggcgtgggccccggcgcgatgtgcaccacccggatgatgaccggcgtcggccggccgcagttctccgccgtgctcgagtgcgcggccgaggcgaagaagtacggcaagcacgtgtgggccgacggtggcgtccgtcacccccgtgacgtggccatggccctcgcggccggcgcgtccaacgtgatgatcggctcctggttcgccggcacgtacgagtcgccgggcgacctccagcaggacgcgaacggccgcctctacaaggagtccttcggcatggcctccgcccgcgcggtgcgcaaccgcacctcggaggagtcgtcctacgaccgggcccgcaaggggctgttcgaggagggcatctccacctcccggatgttcctcgacccggcccgcccgggcgtcgaggacctgatcgactcgatcatcgcgggcgtccgctcctcctgcacctacgccggcgccaactccctggaggagttcgccgcgaacgcgatcgtcggcatccagagcgcggccggctacgccgagggcaagccgctgcacgccagctggagctgacccccgcccgccccgcccgaggcccgggcggagcgctctccacacggcccccgccgccccgtccccgggacggcgggggccgtcggcgttcccgtgccccggcgggcacaccgggacactcccacccgtcccacgcgcaacggtcgaaagcgcccgcgcaacgaacacccgcgcagggccccggaacgcaacgatcatgcggcgagacgcaaggttgctgcattacgcttgtgaagcgcagcctcgtagggtctgcgctgtacgtggcgtggcagggaccccgctcggtgggtccccacgggacgtggtgccaccggtccccgccgctcgaagaaatcgcagcgacaaggagccgcgcgtgctcgaccaaggcgcaccgccgaaccgcaccctcaccgtcccctcgtccttcggtgcgcgcctcatgcgtcgcaagcccgtggaacgcctggtcgcggagggcggccagggtgaaggaggcagcctcaggcggtccatggggctgtggcagctcaccatgatcagcatcggtgccaccctgggcaccggtatcttcgtggtcctcggcgaggccgtccccaaggccggtcccgccgtcacggtctccttcgtgatcgccggtctcacggcgctcttctcggccctgtcctacgcggagctggccggcaccatcccggtctccggatcctcgtactcgtacgcatacgcaacgatgggcgagctgatcgcctgggtctgcggctggtgcctggtcctggagtacggcgtgtcggtggccgccgtcgccgtcggctggggcgagtacctcaacgagctgctcaagggcacgatcggcgtgaccatacccgcggccctgtcggcgccgcccggcgacggcggtgtcttcaacctgcccgcgctgatcgtcgtcctgctggcgatgaccttcctgctcggcggcgccaaggagtccgcgcgcgccaacacggtcatggtgtgcgtgaagatcgccgcgctgatcctgttctgcgccatcggcgtccagggcttccgctccggcaactactcccacttcatgccgctcggcatgggcggtgtcagcgcggccggcgcgacgctcttcttctcgtacatcggcttcgacgccgcctccaccgcgggcgaggaggcgaagaacgcgcagcgcgacctgccgcgcgcgatcatgctgtccctggtgatcgtcaccgcgctgtacgtcctggtcgccgcggtcgccgtgggggccaagccctggcggcagttcaacgactcggaggcggccctcgcccagatcatgcgcgaggtcacgggccagagcttctgggggaccctgctcgccttctgcgcggtcatcgccatcgccagcgtcgtgctgaccgtgctgtacggccagacccgcatcctgttcgcgatgtcccgcgacggcctcgtgcccaaggcgttctcccgcgtccacaagaagtcgggcgccccccgcgtgaacacggtcatcgtgtcgctgttctgcggtgtgctggccgccgccatcccgctcggacagctcgccgacgccaccagcatcggcaccctgttcgccttcgccctggtcaacgtggccgtcgtggtcctgcgccggacccgcccgaccatgcaccgcaccttccgggtgccgctgtcgccggtgctgcccgcgatcggcttcgtgctgtgcgtgtggatgatgggcagcctgtccaccgtcacctgggtggtcttcgggatctggatggccgtcgggctcgtgatctacttcgcgtacggccaccgccgttcccgtctcgcggccgatcccggccccgcgacggcagcgaactagcccgcagacccggcccgagcccgaagaagtgacccacaccccgtgctgaacgatctcgacgaacgcatcgtgcacgccctcgccgaggacgcccgccgctcctacgcggacatcgggcagctgatcggcctgtccgcgcccgccgtcaaacggcgcgtggaccggctgcgtgccaccggtgccatcaccggtttcaccgtccgcgtcgatccggcggcactcggctggcacaccgagggttacgtggagatctactgccggcgcaacacgtcgccggagaccatccagcgcggcctggagcgctaccaggaggtcgtgtccgcgtccaccgtcaccggtgacgcggacgcgacctcctgg

SEQ ID NO: 141 - DNA, 9473 bp, Unknown
  Kingdom: Bacteria, Phylum: Actinobacteria, Class: Actinobacteria, Order: Streptomycetales, Family: Streptomycetaceae, Genus: Streptomyces
gcgggcgcgggcggcgacgacgtcggtggtgaagggccgggttccgcaaccatctcccacctcatcgaaaggtacacgcagggtctgacaacgggcacggaccgtgacagcggcgaggcctggcccgcactcaccgactgctcccagcagatggtggaggccgcctcgatcgcgctcggcctgcacgagacccgcccgtggatctgggaccggctcgatgtccgggtccaggaacgggtcgtcgactggttctccgggttcgtcggcgccaagacctgggacaacaactggcgcctgttccaggtggtgtcggagcagttcctcgcctcggtgggcgcgccgtacagccaggccgacatcgacgccgggctcgaccggggcgacggctggtacaccgacggcgacggccgcaacttcgactactacatcggctgggccatgcacctgtacccgctgctgtgggcccgcatggcagggccggacggtgacggcggacgcggcgccgtctaccgggagcggctggcccagttcctcaccacgtacccgcagttcttcggcgccgacggcgcgccggtgcaccagggccggtcgctgacgtaccgcatcgcggcgacggctccggtgtggctgggcgcgctcaccgactgcacaccgctcgcccctggtctgacccggcgcctcgcctccggcgcggcccggcacttcgcggagcgcggggtgccggacgagcgggggctgctgccgctgggctggtacggcacgttcctgccggccacccaggcgtactcgggccccgcgtcaccgtactgggcgagcaaggggttcctcgggctcctgctgcccgccgaccacccggtgtggacggaccgcgaactgccgctgcccgtcgagcagtccacccagtacacggcgctgcccgcgcccggctggctgctgcacggcaccccgcacgacggtgtcgtccgcctggtcaaccacggcagcgaccacaacccgccgaccggcccggcgagcgacgacccgcactacgccaagctcgcgtactccacggccaccgcgccggagtccgcgccgcacgcctgggcgcgcgcggtcgacaaccacatcgctctgctcaccgccgacggcagcgcctcgcgccgccgccgtatccaccccctcacctgcgagggacgtcgcgcttcgtcccgtcacgacgtacgacttccggaccgtgacgacgagttcccgatcgagtcgacgagcgtgctgcacggtccgtgggagctgcgcgtgcaccgggtgcgggcccccgagggcgtgagggtgcgcgagggtgggtacgccgtcgccgacgtgctgcgtccgcaggcggagcgcgggcccggctgggcgctgacccgcaccgaggcggggctgaccagcgccgtggtggcactgtacgggtgggacgaggagacgggcgtcgcgcgcgaggtcgaggcgaacgcctacggcccgcactcggcgacgccgtacctgagcaccgcgcgccatccgggcggggagagcgtccacgtcagcctggtggtactcacccgggacgtcgtccacccccgcgcgctgcgcgagtcgatcacctgcgcgtgcgaggacgccgggcgggtgcgcgtcacgttcgcggacggcgagacggtgacggtctgaacggtctgaacgggctgaacggtctgaacggtctgaacgggctgaacggtctgagcagacgcgtccgtgtccacgtgcccggccgcgtccgcccgaatcacacgtcggccgactggcccgggtcagccgacccgcccgggtcagccggcggacccccgaccggcggacccgcgccggcctgtgtgctcggcaggtagctcgcgaggccgcgcaggatgatctccaggccgacgtcgaacctctcgtcggaggagtccgtcaccatcaggccggacagcgcacgcaggtgggggaagtcgctcgcgggcagggacgcgaagcggttctgcatctcctgcgccagctcgttccagtcgggtccggccgggccggagccgtcgcccgcgggacgggcggtccgctcccgccacatgtcctcgcccaggacgaacccgtctatgtaggtggagatgaggtccccggcctccgccgcgatgcggtcgggcaggccggccgtccgcaggaggccgaggaacgcctcgacgtgcggcagcagttcggtggtgaagggcatgtgggccatggagatcctggccatgtcccggtgggcgagcaggcgctgccgtccggcgcgggcgtagtcccgcagttgttcctgccaccgctcgggctcgggctcgggcatctcggcgccgtcgaacagccgggcgtacatcagctgcatgaggtcgtccttggagctgacgtgggcgtagaggcggagaccgtgacccccagctcagccgccacctgccgcatcgacagcccgtcgagcccctgccggtccagcacggtgaaggcggcctccacgatgcgttcgcgtgacaggggggtgcgcgcgggcgtgaggcgggcgcgcgcccggcgcccgcgctcccacgggggcggcggaggaggtgtgggggtgccggcggcctcgtcgttcatgaggacagtctaggcgtccggagaacagtgttctctgtcgagcagcggcattctcacccgggtgaccagggcacgagcactggcaacgcgatatatcttgaccacgcgccgagccttgcgctatatcttgatgaacattgttctcccggggggagtatggtggtgaacactgttcggtgaacactgttctccgcagtgctccgctgcccttccgcggccaccccacacgtccgcccgtcgccgcacctccaaccgtcacacgtccgttcgtcacacgttccatccgtcccctcgcgcccgcgggtcgtccccgcggcgcgtccagtccgcgaggagtactaccgatgtccaccaccggcgtggcgtccgccgagacgcacaccgagtcaccggcgccgccctaccgttggcgctgggccgcgctcttcgtgatcctcgcggccgaggtgatggatctcctcgacgccgtcgtcacgaacatcgccggcccctccatcagggccgatgtcggcggcggcgcctccaccctgcagtggctcgccgccgcgtacaccctgtcgatggccgtcggcctcgtcaccggagggcggctcggagacatacacggccgccgacggatgttcctggtgggcgccgccggcttcaccttgggatcgctgctgtgcgccgtctccatgtcgccgcagatgctgatcaccgcacgcgtcgtgcagggactgttcggcgcggtgatgctgccgcagggcctcggcatgatcaaggagatgttcccgccgaaggagtcccagaaggccttcggcatgttcggcccggtcatggggctgtcggcggtctgcgggccgatcctggccggctggctcgtggacgccgactacttcggcaccggctggcggatgatcttcttgatcaacctgccgctgggggccgcggccctcctcggcgccctgcgctacctgccgaagacccgggcggccgacaaaccgcgcctggacatcccgggcatgctcctggtctccctggcggcgctcctgatcatcttcccgctggtccagggccgtgagtacgactggcccgtgtggacgttcctgatgatgggcgcctcggtgatcgtcttcgtcgccttcggggcctacgagtcgcggcgcagcaaggccgggcaggacccgctggtcatccccagcctcttccgcaagcgcgggttcagcggcggcatgaccctcggactggtcttcttctcgaccatgcagggcttcatgctggtcttcaacctctacacccagatcggcctcggctactcgcccctcaaggcgggactcgtgatggtgccctggtcgggcggcatgatcatcggcttcggactcgcccagggcgtcgcccggttcgggcgggccgtgctgcaggcgggcacgctggtcatggcggccggtgtgttcggcgtgtggctgaccctcgacatcgcgggcagcggcgtcggcccctggcagctcctgccggcgctgctcgtcaccggcatcgggatgggcctgctcatggcgccgttcttcgacatcgtgctcgccagcgtcgagcagcacgagacgggctcggcgtccggcacgatgaccgcggtccagcagctcggcggcgccttcggcgtggcgctgctcggcaccgtcttcttcggcctgctgggcggcgggatggcgaacgccgtcgaccaccactccgacggcctgcgcgggcagttgaccgccgcgcacgtcgcgcccgccgctcaggagcggatcgtgacggacctgcgcacctgctcctcggaccgcgccgtggccaaggacccggaggcgacgccggcttcctgcgcacgcctggagaaggacacccggtcggccgtgacatcgccgcaggacgccgcccggatacccgccgctctgcaggacacggcgacgtcggccttccgcagcggtttcggcaccgtcatgcagacggtgctgtggatcgtggacggcatgctcgtgctgaccttcctgctcgcgttcctcctgccccgccatgcccgccccgagggcacggcagcgcactgagcccggccggaccgccgcacggctttcacgccctggcgtagcagcaggccagggcgtgaggaggcttcatgctcatccgtgtgaggtctcggccacgtcgacagcttcggagccttcgcgacgcatccgctcaaccccccaggcgccgagcggcccgagcgcttgattgagcgtgtgcccgtgctcagtcagggagtactccacccgcggcggcacctcggcatacacctcccggtgcacgagaccgtcctcctccatctcccgcaggtgctgcgtcagcatcttctcgctcacgcccggcagaccgcggcgcagttcggcgaagcggcgtacgcgatgggcgtcgagttcccagaggatcagtcccttccacttgccgctcaccacgtcgagcgcagcgtcgatgccgcagatgtaaggcccgcgtctcggcgccttggccatcactggtcccccttacgaaaaggtaagtaccgcagaaaatagtaggtacttccgagactagtgacactctccgagcatggaggggtgaacgaacaacagaagcacaccaccaggcagaacagcgctgtcaccgtgatcgggctcggtccgatgggccaggcgatgacccgcgccctcctcgccgccggccactcggtcaccgtctggaaccgcaccgccagccgggccgacggcgtcgtcaccgacggagcaaccctcgcggcgacccccggcgaagcggtcgaagcgagtgacctcgtgatcctcagcctcaccgactaccaggcgatgtacgacatcctcgacagcgccaccgcatcgctcgccggccggacgctggtcaacctgagctcggacactcccgaccgttcacgcgaggcagcgacctgggcagcgggccacgacgccaccttcatcaccggtggggtcatggtccccgcgccgatggtcggcacgcaggcggcccacgtctactacagcggccccggcgaggtgatggagaaccaccgggcggtgctgacactgctcggcacgccaaagtacctgggcgaggacccgggcctcgcccagatgatgtaccaagcccaactcgccgtgttcctcaccacgttgtccgcactgatgcacgccaccgcgatgctgggcaccgcaggcatgaaggccagggaagcactgccggagctgctctcctccgccgactcgatcggcgacatcctgagggccggtgaaaagaaccccggcaccgcactcgacgccggagagcaccccggcgacctcagcacggtcaccatgatgggcgcgacgtccgaccacatcgtcgagaccagcacgtcactcggcctcgacctcgcgctcccccttgccgtgcaggcccactaccggcgcgcgatcgagaacggacacggcagcgacaactggacccgcatcatcgacagcatccgaggaccgcgctgaccgaatccagaggaccgcgctggccagatgcgggaccgatgaacccgtacggtgccgtggtctcctccatgcggcggcctccccttctcttagggctaagatttcagcgggtgcgcgggtacggagcccgcgtctcgcgacgggacgagccgcgaggggatgacatgacgcagcgcaaggcggtgcggcgaccggacgccgtggcggggatcgtcgaggactgggcacgcgaacggcccggtctggacaccgcgccgctggaggtgctggcacggctgcaccgtgcgtatctccagtaccactcgcggctcaccgcgcagatcgagcggcacggtctgtccgtcgccggcttcgacgtgctgacggcgctgcgccgctccggagcgccgtaccggctcaccgccgggcaactggcggcgtccggcctgatctcctccgcaggcgtcacgctgcgcctggaccggctggagaaggacgggctgctggtccgggaacgcgatgccgacgaccgccgcgtcgtctactcacgtctgaccgagaccgggctgcggaaggtcgacgaggtgttcgccgcccacctggagaacgaacggcgcatgctcggcgggatgtcgcccgccgagcggcgccaacttgcccggctgctctccaaattggagcactcgatcgtcgagtccgacgacgcggaagaggagccggcgggggaagaggcggaggccggctgagggcacggcggcgtccggcccgcccgagggcgggcgcgccggacgcgtaccggaaagaaaggaaacagggacaggacagggacaggaaacggggacaggaaaccaggcgccgtcgccgtcacgcccccggcgcgcccgtgcccgccttggactgctccttggacggctccttggactgctccctcgactgctccttcgcctgagcctggtagaggcgccgcaggcgtaccacgccgaggtcgtgctggtagaggttctcctgctgatcggcgtcggtgggcatggcctccagcatgacccggtcctgttccagcacctcccagtgtcgttcctcgatgagggtcttgtagaggaagtgccaggtgtcgcgctgccagccggagaccttccggtagcgccagaagaagacaccggtgcgcccggcgtccaccgggcaggccatgccgacgatgccgaaggggccgccggggccggccgacggcgggtacgggatggacaggtcgacccagtcgacgccggtgcggcacagctcgacccagtcgaagttgacgccgcgttggtcggtcttctcgaagaagtaaccgcgctcggtctcgcggatgcggaacttggccgtggtgtcaccgtcgtacatggtgtgcgactcgtggtgcaggaaggcgccgtgcatcgggtcgaggaggttctccatggcgtagcgccagggcacgttccactcggcgtagcagaggatggcggaggtgtcggggtcggtgaggggttcgggcagggtcagggcggccggctcggggtgctcctcgtcgccgaagtacgcgaggatcgcgccgccgacctcgcggacgggcagcgaggtgacgagtgtcttgccctccaggttgcagccgggcaggccgggcacggaggtgacggtgccggagccgtcgatctcgacgccgtggtaccagcaggcgatccggtcgccgaggtgcttgccgagggagagcggggcgccgcggtgcgggcagcggtcggcgagcatcgacagcgtgccgtcggcccggcggaacagcagccagttctcgccgagcgcggtgaccttgcgcaggccgccgggcttgacgaagtcggagggcaccacggggtgccactggttgcgcaggccgtgggcgtagatgtgggccgcgctgtcgcgggtggagagggtcatgtcaggctcccaggcggtgcatctcggcgcggaaggtgtcctcggtccacggctcgccgccgggggtgtggatctggcgggcgttcaacccggccacgacgtcggtcagttcgtggccgtcgcgggtgaagatctcctccagggtgcgggcgagcttcagctcgtagggggtgggttcgtggtcgcggctctggtgcgggtcgaggtacggccaggcggtggcgtcgtcgatggtcatcatgtgtgtgtctcgctctccatgggggtcacaggtccggaggtcacaggtccgggagtcacagatccggaggtcacaggcccgggaatcacaggtccggaggtcacaggcccgggaatcacaggtccggaggtcacaggtccgggagtcacaggtccggaggtcacaggtggggggtcacaggtcgaggacgaggcggtcggaggcgcagcgggagacgcagatcatcatcgtctcgccggcggcgtgctcggcctcgctgagcaggtggtcgcggtggtcgggggtgccggcgaggacgcgggtctcgcaggagccgcagatgccgtcgcggcaggaggaggtgacggccaggcccgcgttctcggcggcttcgaggacggaggtggtggcgttgacggtcagggtcacacccgaggcgcggcactcgacctcgaaggcggtgtcgtcgccgtcgcgtgcgggggtggcgggtgcggcgaaccgttcgaggcgcagccggccggcggggcaggcctcttcggcggccttgagcaggggttctggtccgcagcagtacaccagggcgtcggcgggcaggtccttcagagcggccgtcaggtcgatgtggccctgctcgtcctgcggtacgaggctcacctcgccgccggtcagcgcggtcagctcggcgccgaacgccatggtggcgcgggaccggccgccgtggacgagccggtagggcaccccgtcccgctcggcctgtcgggccatcgccaggatcggggtgatgccgatgccgccggcgaggaagacgtagaacgcggcgggttccagggcgaagtggttgcgcgggccggccacgcggacgctctggccggggcgcagcttgctgtgcacgtgccgtgaaccgccgcgcgaggacggttcgtcgaggatgccgaggcggtacgtggccgggtcggcggggtcgccgcacaggctgtactggcgtacgtgtccgcccaggtgcaggtcgaggtgggcgcccggagtccaggcgggcagcggtttgccgtccgggtggaccaggtcgacggagaggacgccgtccgcctcccaggtcatgcggcggacgagaaggtcgagttcgtgctcgcggtcggcggtcatggcgatggcctccctacgccgtggggatcgtgacgggcggggtgaacgggttcttcatcgggccgagcgcgtcgaggtcgacctcgacg

SEQ ID NO: 142 - DNA, 4927 bp, Unknown
  Kingdom: Bacteria, Phylum: Actinobacteria, Class: Actinobacteria, Order: Streptomycetales, Family: Streptomycetaceae, Genus: Streptomyces
aactcggacaggtcgggcgggccgagggcgccgtcgagggccgggccccgcccgacctgtccgagttgcagctcctgcggatctagaggcacccgcacggcatcccgctcgcttcggggtggcgtgctgcggtcccgcacctgatccgccgttcccgcgcgcccgcgcgcgggcgttccaaggagctgtatcaccgatggcagttcgccgtacccgtacccgtacccgtacccgttcccttcccgtcgccgtcctccgccgcgtgcccccgcgccgccccgcagtccgacgtggtgccgcactcgtcgcggcagtgaccgccgccgtggtcctgaccgcctgtggcggcggcagtgacacctcctcgtcggccggctccggtcacggcgccgggtccaccgctcacccctccgccgctccctcggcgggccggggcggccacaacgcgcaggacgtggcgttcgcgcaggagatgatcccgcaccaccggcaggcggtggccatggccgccctcgcgccggcccgcgccgcgtcgcagcaggtcaaggacctcgccgaaaggatcaggaaggcccaggatccggagatcgcgaccatgaccggctggctgagggcctggggcgccaccgtcccgtccgccgacgcgacgggcatggaaggcatgcccggcatggaccacccgggctccggtcactccgcctccccgatgcccggcatgatgtcggacaccgacatgagcgagttggcgaagctctccgggaaggccttcgaccgggcgttcctgcggatgatggtcggccatcacgagggcgccgtctccatggcgcgcacggagcgggacaagggcgccgacggcgcggccaccgcactggcgaagtcggtcatcacctcgcagtccgccgagatcgaggagatgaacaaggcgctcggcgcccggtagaccggggcccgcacacccctccggggcggccggcggccgacggccacgaccgtcggccgccccggtgtgggaataccccctgggggtatggtgttcctgtcttgcacagccttatcggcagacaggcgacaggggagtgacgatggaacaccactcggcacacacgcagcacccggcgcactcggagcacgggcacgcccaccaccacgccacggcagggcccaccgaccacacctcctggcgcatggccgcgcaagcgaccctgcactgcctgaccggctgcgccatcggcgaggtgctcggcatggtcatcggtaccgccgccggcctgcacaacggcgccaccgtcgtcgtctccatcgcgctggccttcgtcttcggctacgcgctgaccatgcgcggggtgctgcacgcgggtctgcccgtccggcaggcgctcaaggtcgcgctggccgccgacaccgtgtccatcgcggtcatggagctgatcgacaacaccgtcatggtcggcgtgcccggcgccatggacgccggtctggccgacgcgctgttctgggtctcgctggtcctctccctcgtcctcgccttcctgctgaccacccccgtcaaccggtggatgatcggccggggcaagggccacgcggtggtgcacgcctaccactgacccggatacgggtcacggatagcggcggtcgtccggacgcgtcgtcccgctcaccgggccggtgtcgctccggccgccgccgtaccgcgcgacgcggtggctgtgccggtgatgcgccgacgcggcggtcagcaggtacaggccgaggcagaagagcagagcgagggcgagtccggcgctgaagatcgcgagggtgttcagcgtgacgatgtcgttgccgaggaccgacaccgtgtagtgggggccgccggccaggttgccggcgatggccagaccggtgaacgcgcccgtggccgcgaggaggagcaggccgatgagcagcatgggagtcatctcctcaggaagtgccgtcacggctcgggtacccgcatcctcagcgggccaacgaccgcacgcgggccggtgaaatcgcctccggcagacgggcgcggcaggtgcggtgcggctctggtcgggtacccggccggagcagtgcggtgaacggcatcgcaggatccgacgaagggaggcgtcatggctcagcacgtacgcgacatcatgaccagccgactggtgacggtggagccgcaggcctcggtcacggcggtggcccagaagatgcgggacgaggacatcgggatcgtcctggtcaccgagggcgaggaactgcgcggcctggtcagcgaccgcgacctcgtggtgcgctcgctggcggagggcggcgaccaggagcagcggacggtcgcctccgcgtgcagcggcgacctcttcaccgtgggccccgacgaggacgtcgaccacgcggtggagctgatgcgggagcactccgtgcgccgtgtcccggtcgtcgaccacggtcacccggtggggatcgtgtccatcggcgacctggccatcgaacgggacccgggctccgcgctcggtgacatcagcgcggcacggcccaacgagtagcgcggcgcggcccgacgcgcagggccccgacgacacctgggggcgccccgagcggggcgcccccagccgtgcctgccctcaggaggcggccagcaccttctccaaggagcccagcgcggagcgcagttcgtcctcggtgacggtcagcggcggcgccagccggatcgtggagccgtgggtgtccttgaccaggatcccctcccgcatcagccgctcactgatctcgcgcccggtgccgatggccgggtccacgtcgacgccggcccacaggccgcgggagcggaagcccaccacgcccttgccgaccaggtcggtcagcccgtcgcgcaggaccacgccgaggccggcggcccggcgctggaactcgcccgtctccagcagttcgaccaccgccgtgccgaccgccgcggccagcggattgccgccgaacgtcgacccgtgctcgccgggccgcagtacaccgagcacctcccggctgcccacgacggccgacaccggcacgatcccgccgcccagcgccttgccgagcagcacgacgtccggcaccacgccctcgtgctccacggcgagcgtgcgcccggtgcggcccagacccgactggatctcgtcggcgacgaacaggcagcccgcccggcgggtcagctcgcgcaccccggcgaggtagccctcaccgggcacgatcacgcccgcctcgccctggatcggctcgatcagcacggcggccgtggtctcgtcgacggccgcctccatcgccgccaggtcgtcgtaggggacgacgcggaagcccggcgtgaacggcccgaagcccgagcgtgccgtctcgtccgtggagaagccgacgatggtcgtcgtccggccgtggaagttgtccgcggcgaccacgatcgtggcgcggtcggcggggacgcccttgacctcgtaggcccacttgcgggccaccttgatgccgctctccaccgcctcggcgccggtgttcatgggcagcaccatgtcctgcccggtcagcgccgccagccgctcggcgaactcggcgagccggtcgttgtggaaggcccgggaggtgagggtcagccggtcgagctggtcgcgggccgcctcgatcagcgcggggtggcggtggccgaagttgagcgccgagtaacccgcgagcatgtcgaggtagcggcggccctcgacgtcctccacccaggcgccctcggcccgggcgacgaccacgggcagcgggtggtagttgtgcgcgagcaccggctcctccgcccggatcagctcgtcggaggtgcgggtgtctgcgggtgcggtcatgagcggatctcctgggtgcagcacttgatcccgccgccggccttgtggaactccgacaggtcgacgggaacgggcaggtaaccgaggctcgcgagccggtcggcgagggcgctcgcgccgggcgagatgaacacgtgcaggccgtcggagacggagttgagcccgaaggccgccgcgtcctcctcggtggcgatcaccgcgtccgggtacagccgggccagcacctcgcggctgccgggcgagaacgccggcgggtagtaggcgatgttctcgtcgtcgaggacgaacaacgccgtgtccagatggtagaagtacgggtccaccagggtcaggccgatcaccggcacacccaggaactcctgggcctcccgatgggcgtcacgggtggtgcggaagccggtgccggcgagcagccagcgcccggccggcacgaagtcgccctcgccctcgcacaccgactcgggccggtggacgacgaagccggccgacttgaaccaggtgtcgtagggcagggactccgggcgccgctcgggcgccttgaagagggaaccgaagacacggccgccgacgacgaccgccgcgttggcggcgaagaccatgtccgggaggccggggacgggcggcaccgtctcgacggtgtgaccgtgggcgcggtaggcgtcggtcagcgcctgccactgcacctgggcgagtccggtgtccacgggacggtccggatgcatccacgggttgatcgcgtactgcacggcgaagtgtctgggttcgcagacgaggaagcgccgccggcgcggcacacgggtttcgggcacagaggggttcctccgcttcctggggtgtcgactgagggttgacaccacggtagaaagcgacggatacgcccgacaaggaacgaaacctgcgtcttcacgcagcaatgctgcgtcttagcggcgctcagcgcacgtctggtgcgtcctcgggagcgggctggctggcccccgcctccgggctgtccgggagcaggtgggagagcaccatcacgctgatcgtcttgcggatgaacggctcgacccggatccgctccagcacctcctcgaagtgctgcacgt

SEQ ID NO: 143 - DNA, 21250 bp, Unknown
  Kingdom: Bacteria, Phylum: Actinobacteria, Class: Actinobacteria, Order: Streptomycetales, Family: Streptomycetaceae, Genus: Streptomyces
ggtttgaagacggaccctagtcgccggtcgtgccgtcgagcatctcgcgcaggatgtccaggtggccgttgtggcgggccgtctcctctatgaggtggaggagaatccagcgcagatcgacgtggaggccgttgcggacggctcgctgggcctgcctgtccaggccgttcccggcgaccagttcgcggtagcgggcgctctgttcagcgtattcgtcgagcaactgcgtgagtgggaagtcgacggcgatgcgcatctcgcggtcggggtcctcctcggtccaggggccccggtcttcctcgccgaggaagaccacttggaaccagtagtactcgacccagcggaggtggttgatcactccgctcatggtcatcagcggtgagcccggcagcagcgccttgcgtgcgttctccgcagagacgccatcgcacttggcgcgggcggtgtcacgtgcgtagtcgagaaacgtggtgagctgggtgcgctcgtcccacgcggacggcgtgtcgtcgattctggtcatcgagcgaagcgtccccgatcgccacgaccgatgtcgaggtatttatcgacggacccaacctgctgcccgcccgccgccgcggtgtccagcagttccccgcgggcgacgctcaccaggaaggcgccgtccttcagcagcagtgccggctccgccgcgccgaacatgccgcagcggggccggtactcacaccccgacgcctgacggccgggcacctcgccgagtaccaagaggttggccgcctgggggggcgggtacgacctgcggggcgggaacgaccggggcaccatgaacttcctggccccggccgaaacatgttccgcctcaaccacaacgttccgccacgccccgcgtgagtcggcggcccctcgtccgccccgcgtgagtcggcggccctcatccgccccgcgtgaagacggcggtctgccgtcccctcgcctgggacggcagaccctcgcccgccccgcgtcaggcctccgtgcgccgcggcagccgccagttgggccgcgggaagtggcaggtgtagccgtccgggtagcgctggaggtagtcctggtgctccggctcggcctcccagaagggacccgcgggcacgacctcggtcaccaccggacccggccacagccccgacgcgttcacgtcggcgatggtgtcctcggcgacccgccgctgctcctcgtcgaggtagaagatggcggagcggtagctgtcgccgatgtcgttgccctggcggttcttcgtcgtcgggtcgtggatctggaagaagaactccaggatggctcggtagtcggtcgcggtcgggtcgaacgtgatctcgatcgactcggcgtggccgtcgtggcggcggtaggtcgggttcgccagctcacccccgctgtatccgacacgcgtgcccaccacgcccgggaggttccggatcagctcctgcatgccccagaagcagcctccggccagcagggccctctcctcgacgtctgtcatgacatctcgcctttctttccacatctcttcttctcgaacagcctcgcacatggcctgcgccccctcacaccgctggtgagcggcactggacgcaaatatgtcaccgattcggaaggtgacgatatcgtgccgcgcccacgcatcaccggtcaagacagtgacgctcagcctctgtcgctgttgcgacatgtcccacctgtgccagggaaggccagtgacagccgcctcacagccatcggattctgtccagcgcgtgaactccgctcacccccgagtcccgagggaaggcatggcaccgatgagacacatccgcctgatggcggcgaccgccgcgggtttcgccctggccgcaggaaccgtgacgccggtttccgccacgcccggcgcgcagccggcgggcacaccacgggcgcacccggcagccgcgtccgcgaacagcgcggcgacggtccgactgatcacgggtgacagcgtcaccgtggcgagagggccggacggccaccaggccgccacagtgcaacccggtcccggacgcgagggcatcgtcttccagacgttcgaacaggacggccacatctcggtgttgccctccgacgcgcaacccctcgtctccgcgggtcggttggacaagtcactgttcgacgtcaccgctctcctcgctcagaagtacgacaccgcccacacggacaccctccccctgctggtcagcgcctccggcggcgcggcgggcccggccgaacgcaggctcaccgcgttcgccgagaagtccaagcagccgaacgggccggagaattccccgaactccgccagcctcccgaagtccggcactgacagtaggtccggtgcgtccgtgaaatccgggccaaacggtaagtccggtaagcccgctcccactcccaccctggccagcatccacgcccgcgccctccgcgtcgcgcagagcgacctgggccgcttctggggcgaactggccccggcctcagcctcggtcgagggcacgtcgcggacgtcctccgcgctcgccgccgtcccccgggtgtggctggacggccgggtccacgccgtactcgaccgcagcaccgcccagatcaacgcgcccgccgtctggcagaagggcgaccgcggcgacggcgtcaaggtcgccgtgctcgacaccggcgcggaccagtcccaccccgacctggccggacggatctcccaggccgcggacttctccggcagttcgagcacgggtgacgtcttcgggcacggcacgcacgtcgcatccatcgtcggcggcagcggcgcggcctccggcagcacccgcaagggggtggcacccgcagccgacctgctgatcggcaaggtcctcggcgacgacgggttcggcaccgagtcccaggtgatcgcgggcatggagtgggccgccgcccagggcgccaaggtcgtcaacatgagcctcggttccgatgaaggcagtgacggcaccgacgcgatgagcctggcgctgaacgaactgagccgcagcaccggcacgttgttcgtggccgccgcgggcaacagcggcgagaacggcgagatcacggtcggctcccccggcgcggccgatgccgccctcaccgtcggtgccgtggaccgcgacgactcgctggccgccttctccagccgcggcccccgggccggtgacggcgccgtcaagccggacgtgaccgcgccgggcgtcggcatcgtggcggcccgcgcctcgggcaccaccatgggcgacccggtggaccggtactacacgtccgcctccggcacctcgatggcaaccccgcacgtggccggtgccgccgccctcgtcgcccagcggcaccccgactggaccggtgcgcagctcaaggacgccctgatcagcaccgcccgcacgatcgaggggcagaagaccaccgaacagggcggcggacgcatcgacgccgccgccgctgccctcggcccggtcaccgcgacgggcagcgtcaccctcggctccttccagcccggggacggaccccgcaccaccaccctccactacaccaacacctccggcacggacgtcaccctcgccctttccccgcacctgaccgacgtgcacggccgttccgtgccgcccgccgcgctcggcctcgcggcctcggtgcgtgtgcccgcgcacgcgacggcggacgtccccctgaccgtgcgccccgcgaaggccccccggggcacgtactacggctacgtcaccggcatcgccgccggcgcctccgtgcccaccctccacacgaccctcgacctgaccgtgcacggtcccgtgcaccggctcacggtggtgtcgtacgacgagaagggcgaccgcgtacccctccagccggtcatctggggccccggcggcttcgtggcgtacacggacttcgagcacgcggtcgccgaggtggaggaaggcacgtaccaggtcagccacaccttcacggtcaccgcgcacgacggcgaggaaatgcgcgaggtcctgctccccgaggtgaaggtcaccaaggacaccaccgtcaccgtggacgcccgcgccaccacgcccatcgagatccgcaccccgaagcccgccgagcagcgcggcgcgatcagcttccagacgtaccgcgagatcgacggccgcagcctcacccagggcacgatgtacttcgacctcgccaagcgcgtctacgccagccccactcccccggtccaggacggcacgttcgagttcgcctcccgctggcagctcgtcgcccccctgctggaggcacgggccgccgggatgcccggcaagctggacgcctactacatgcccgcgtccccgctgttcgacgagcgcggcgccgccctgaccgccgtcgacgcgggcgatgcctcggcccccgcattcgcccaggtccggggccggatcgccgtcctcaccaacaccacgttcgtgagtgaacccgccgtcatcgcgcaggccgcggccgcgggcgccaaggcagtgctcctggtcgactcctcggacatcgcctggacccgctggcggccggacggcgaccgctgggccctgcccaccatccgcatcggcgcctccgccggagcccggctgctggggctcatccaccggcacaccgaacgcatgaccttccacggcaccgcccgcagcccctatctctacgacgtgatgcaagtcagcaggcagagcatcccgcgccacatcacctacaccgcctccgaccgcaccaccgccgccgtccgcaccacgtacgccgacaccaccggcggcaccggctggacctccgaacagcgcttcgcccggcgcccgtaccagcggacgtcctggaaccagtacaaccgctacgtacccaccggcttcacccgcaccgagtacgtcagcgccgacgacaccgtctggcagcacctggtgcaccacaccacggccttcgacccggaccaggtgctggccgtgggtctgcgggacgatccgcgcacctaccgggcgggcacccggacctcggagacctggcagggtgccgtggtccgcccgtcgatcccggccggcaccacgacaccgacggtacggtcgggcgacgtactgcacctgtggataccggagttcacggactcccagcccggtcactggtcacggccggtggggagcgacacggccacggcggtgctgtaccgcaacgggaagaagtacgcggacctgggcaccgcctgggtcgacgccgaagtccccgccgacaaggccgactaccgcctggacatgaccacctcccgtacctcctctacctggcgctacgccactgccaccagcacctcgtggtcgttccgttcgcagcacaccgagcaggccgtggcgctgcccctgctgcaactcgactacgacataccggtcgacgcgcggaacacggtcaggacggcggggccgtacggcgtcggcgtcaccgtccgcgcccaggacggcgcacccgtcccgcacggcgtcaccctccgggtcgagacctcatacgacgacggacacacctggcgcacggcccgcccgggccaccgcaccggcaacaccttccaggccaccgtcgcccccgccggcggccacggcaccgcctacgtgaccctccgcgtcacggccgaggacgccgcgggcaaccgcgtccagcaaaccgtccaacgcgcctgggctcagcaccagtagggcattcaggccctgtcacaggaacggaagggcgagcgggtcagccgaccgctcgcccttccgtcacccctcccacctcttcatgacgatcacccccatcccctcttgccatacagtcttcaaccagcaccgacggcaagcggggagggcgtgcgggatgctggaagccgctggagtctcacaagtgcaggaatccgtctaccgcgtgctcgtgatgtccgaccgggccacggtcgacgacatcgcccggcgcaccgcactgccccacgccgacaccgcgcggatcctcgacgccctggtcgcaacaggcctggccacccccaccgacggctccccacggctgtaccgcgccgtgcctccggacgtggccctgctcccccgcatcaagaagaacgcggaggccctcgacctggcccggacggaagccgcccggctgatcgagacgcaccgcgagacggtacgccgccacgacgcgggccaactgctcgaagtcatcaccggggccgaggcactgcgccagcacctgaagcagatccagaccaacacgcgcgaggagatgctctggttctgcaaggcccagtacgtggccatgccgtccggcagcaacgcggaggagtacgaggccctggcccggggcgtgcgctaccgcgtcctgtacgagcaggcgttcttcgacgacgacggcgccgtggacaacgttgccacaggcatgcgagcgggagagatcgcacgttccgttcccagcctcccgctgcgcctcgccgtcgccgaccgctcggtcgccctcttcccgctggtccccggcggcccccacggcagccccgacgagccgaccaccgcgctggtgcgcgacagcaacctgctgagcgccctggtggcactgttcgagagctactgggagaacgccgtccccctgcacctcacggacaacgagggctcctcccccgcgctggacgcggaggacacggacccgcgcactcacctgtcaccgaccgacagcaagctcctgtccctgctcgtcgcgggagtggccgacaaggcgatcgcctcccacctgggtctgagccggagaaccgtccagcgccgcatccagggcctgatggagcgcgccggggccgcgacgcggatgcagctggcctggcaggccgcccggcgcgactggctgtgagacacatgtcttccccaggtgtctcggtgtcacggcaccgctcaccagcgcaaaagggcctacccggccgcggccgtaccggtcaccgccaccgcccggccgagccggtcgagtggttcgtccacgcccctcgccgagacgggcagcggcaacgcggtgccgctcacggtgggcgcgacggctctggtggcagtgggcgccggggcgttcgtggtcgcccggcggcgacggtcagcacaggagggctgacgacacacacgtttccgcgaccaggttaagtctcgtgtgaatccgggttccgacttaccatggatagcggcaaaggcggaaccgggctgcggccgaaacgttcccgcccgagcgggcccgccacgagcaaggttggctgggtctcggcttagacgaaggaaagtacatggcaagcggcaccgtgaagtggttcaactccgaaaagggcttcggtttcatcgcccaggacggcggacctgacgtcttcgcgcactactccaacatcgcgggcaacggctaccgcgagctggtcgagggcgagcacgtcacttttgacgtcacccagggccagaagggcccgcaggcagagaacatcgtccgcggctgaccgttcgcgcacacagggctctgtcccggagaatcgttctgagcgaagaatcgaacagatcgaacaagctccgggacattgaccagacagcaggaaagacgtcctgcggatcgcacctcatgtacgtcacgtcaatgagggacgatctgcaggacgtcttctgtttcctcggaggaggccgcctccggccgcctccgggacgggccccggtttcccgggcggtcgggatcaggtcgcgcggcggagcggaacgacgacccgcgcccccagccgacccggaacgatccggtagtacttgatgtgaccgatcttctcggtctcttccagccagcccagaccgatcacctgcttacgcgtccgcgagaacacgggcggcgccatccccaccagctgcgccagctgcgccgcggtctccagtacggcaccggagcggtccgtcgggtgcagggcgtacagcatgacgacgagacgctggttggcggtcatgccggccgttgcctccagcagcttgaggttctgctgcttgtcgtcactggtcactttgcctcccaccgtgctggagtgttctcgtcgaagcccgggatgtccggcggattgcacgtcctcaccgcttctcgctgctccagccctgttccatggaaggcaatgtacgggctgatgcggtagaagttgtagttgccgatgcgacctcggacgatcagaacccgatgcttggccaactttctgttgatctttccgaccgcgtccgtcgacatccccacgcgcttggcgatgtccgctcccgtggcccgcagcggctccatgccttcgggcgacacaccgatccaccacagaacgaggaacttctggctgggcgtgaaggcctttgactccgtgatggcctccacccgcgccttgtccacctgtgtatgcctgccggagaaggcataaggcgcgtaggggaccggctcgccggtgtcggcgtcgaccagtctgcgtactgctcccaacaggccctccatgcgtggggcattgatgcactgttcatccagggcgaccctcaggccgaccacatgaacctaacgtacatgagcaggaagtcaatcaactccgctcgtcgaccgtgtcgcttgtcctccacgcagggcaccggcggtccacctcatggccctcccccagccgagacatgtacgtgacgtcaatctgccgctgtcctggaacagtggtgcccagatccctcggacgtactggcagttcctgaggaccgtgtggcagatcggcgaacagcgctgacagatcaaggaaaccgggtactcagtccgaggaaaccgggtgcccggttctctcagccgcccacagcgatcgcccgaactgcctgccagtccggaggatcttggtccggtcctgcatctccgcaggtcagaggcggtttccgcagaggccgctctcttacttcgtccaacccgccgtgggctgccacctgacctcaccggcactgatgcgaaccccactgttcctgtaccacggaaagtcagccactacgcgcccgcgggggacgactcaggcgcgcgtgtgcctccagcaacccggacggggctcagccacgccgctggaggaactgccctgacgcacctgcacccgccgaagcacccccgacacggtggtgccgacgcgtggtgtgggcagcctctcggagagccccgccgcagagacagccccagtacgagagtcagccccagtacgagagacggccccagcccgagaggcaccgcctccggggagtcagccctcgtctgggggacggctgccgctcccctcccctattacgccgtaataaggccgtccccctattacggcgtaatagggggacggcctgtgtgacggtctgcgctcagcgggtgctgctgggggactccagacgctcctgctgatgcttgttgaggatgaccagcatccggtcgaactccgtgacgctcatcttgcggatgaggtgcatggcgaggaaggcgccgttgtcgtagggcagtcggcgggccgcagaaccgttgacatcggtgaggtcctggtcgggaacggtagcccggttggaccggggctcgggcacggtctccggagcggaagtggaccgtgcggcctccgacggaaccgtgtcgaccggctccgccgaccgggccggctcaccctgcccgtccagcccgtccagctcctcctcgtcgaccgggtcggcctcgtgctgttcctccagggcctccagtgcctccaggctctccggagtcaccgggctcttcgaggccgctacgttctccggttcctcatcctcgtacccttcggtcccttcgtccgtctccgggtcggcgaccgccggggccactggcggcgccggggtcatcgcagcgacggctgccgccttgcggtccgcttccttgcgaagccgctcggccttcagctcctccagggcggcctcctgccgctccagcggttccttggccacggcccggagcagttcgacgggctccgcaccgaccgctgcctggagttggggggacaggttcagcagggcgagacgctgggacacccagccctgagacttgcgcaggcgcttggcgagcttgacctgtgagccgtggatggccaggagccgctgcagtgcgcgggcctcgtcgagcggatccaggtcgttacggtggatgttggcgacgagtgcggattcgaggatggcgtcgccgtcactcccctgctcgtcgtcgaccatcacatgaagatgggtgaggccggcctcccgggcggcggcgaggcggctgctgccgtcgacgacgacgtgcgtcgtgtcgggctccaggtccttctcgcggtcggggttggccttgaggtaggcatcgcggttcatgaccgtgatggcctgcttctgaccgtgctccttgaggctgcccgcgagttcgctcagatcgccgagggtggtgcgcgggttctcggggttggggctgatgcgtgcgacgggcagacgggccggcggggaaaccccctcggtggggacgccggtggccgcaccgatcgcagcgcgtcgggcgctgaccggccgggcgcctcctccgaagcgccccgctccgagctgatcggccttgctcatgagatctcccgtgccagtgcccgcataccgatggcctgctgcgaggagggggcgtaactgagcaggggctgcttcatgcgcacggcttccttctgttccttcaggtcgctgatgagaccgacgacccgcggatcctttatgtcgatccagccctggagcgaggaggtggcgatgtagccacggcggccgtcgtagaggttgacgacgatccccaggtagtcgatgtcgagaccgaggtcgttgcggaggtcctcgatctggttggtgagcaggtcgtaggcgtcggcggaactgtcctccgcctggacgacgatgagcgcgccggactggccggggcgctcgccgtcgcggcggcgtccgtagtaggccgccgcgtccatgctgaggccgaggctcggcgggcagtcgacgaggatcacgtcgtaatcggcttccagcggagtcagcgctcgttccagggcggcctcccgtgcgcgcacggcggacaggcgcacgtccagcaggaaggcgtcatggcaggcgggcaacaggtgcagccgaccgccgaagtggtcctcgtcgatggagacgatcagatcccgcagctcgcccttggggtcccctgccatgtggttggtgaggctgtcgccgttcatcggcaggggcgccgccccgagttggttggtcaggtggcactgggggtcgaagtcgaccagcagaacccgaagaccgcggccggggagcttctcgatgtcgagggggtcactgttgctctcgcccgggtcgccgttctcgtcgcccgccctgagggcggcggccaaggccttggcgacgcgtacgggatacaggcggttggagtcctccgacagcgcctcacccacaccggccgtgatggcggtcttgcccacaccgcccttctggttgcagacgacgatgcggcgggtgatgtccgggcgctggacgtcgggcgccgggttcgtgtcgagccagagctgaacggactgggcgagtccctgaatgagggagacccggcggtcctccgagatcccgcggaactcctcccactgcccggggggcaggaaggtggagaaggactcggccccggcggtgtcgaccggggccgtcgccgaggccaggccgcaccaggccgcgatgccctgctcgacggcggtctggatctcgatcccgagctgggcagttctgaccttgaggctctgccggagccatcccggcagtttggagacgaccttcacccggtcgttcgaggtggctggcatactcatggcgctaccttactaacgcccttgatcaactgcagcaccgacacgttagttagtgcgacttggtgttgcgtcagccgcagcacccgtcccgcacccctattacggcgtaatagccgggacccgttgacaccggccgtctcgtctctcctcatgatgcgtgcagtccacgggtctgaagctattacggcgtaatagcttccgtctgcgcagccttgaggaactcggcagcggccgtcagcgcgagacgtgcctcatcggtgagggccgcgggtctggccgtctgctgctcctgcttggccagggcacggacggccgcgtccaggtagcggtggaggctcaccatctggagtggggtgcggcagtgcgggagcaccgcctcgatctcctcgaaccagtagtccgcgtcctcgtcggcggccaagccgtcacgctggttcaggaggcggtccgcgacagggaccagaagttcgtggcgtttctccgcctcttcctgggcccggcgctccgctgcctgttcgagggcgatccgccgctccgcttcgagtacggcctccggagtgcggcgtaccggatgtgcttgcggggtctcgtcggtgagtgtgctcgccctcagcctcttcgccttgttgtaggccgcgctcggggcgttcaccgccagcgcgggggccaactgctcccagtgggctcctgcctcccgggcatcgttcaccgcccgtgcctggtgcggttcgctctgctcccgcaggtactcccacaaccggacccgcttgagggccgctgcctgccgcacttcaaggggctgggcgcgcagcgcgtccgtgtgcttctccgcgtacagcagtgctccgtacaactcgtcgtcggccggcatgcgctcgacgtccgggtcctcggcgttctcatgcatctgcctcagctccccgaccagcgcgaccgcatccagggacccaatccgtacaggtggtttgaccaggggttttgtgggccggacgggcttccgtacgcgcttcgccatggagagattgtgccgtctcccccggcgattcacagaatgtgaaacaacgtgggggagtacctgagtgcttgagcgtccgcgcgccaggagctgccccggcagctcgcctgacaagccgtggagagccggtggggagggacttgagccgggcgcagggaccgaacgcgggtattacggcgtaatagccgaggcctcggcagggaccgaagcggtccccgagggcctgaagggactcatgacaggaagacgagcgcagggactgaaaggttcagggctcctccggacattccgggatgtcggcggggccagggacgtcaggcacggcccggcggagggaccgagcgagagaggggccggaggggaggggctgaagcagggccggtcccttttggtccctgcccttcagtccctggtgttttcgcaggtcagaggggttctacccagctagacagggactgtagggactgaaagtcgcaattatgacgtagacaagacatgtgattcgtatacgcgggcgcgtatgtaacccatatccatgtacagctcataattgccgagttcagtccctacagtccctgatgaaggggatgcaagcctctgacctgcgaaaacacccagggactcaacagggtccctgggccctgtcggcccctggccgttggtccctggggtgctccggaccctccggccccccgattcagcccgcttccaggtgctggcttatatgacaatcatcagtcccttcagcccctagggtgggaactggctggtccctgccccgccgcgagggaccgacccccggactggcacagggaccgccgcaggccggggcgcaccggagactcacccaggagggactcagggactcaagggaccaggaaaactgatagaaacggcacgcggcccagaacagccccacttttcggacgatgacctctagactctttttcgcactagagtcccttcggtccctgatggcgcgtcactgccagccaggtgtccgtgcagtgagccaacgatgagacgtgacgaggacgatccccgtgccgcgcgaaggtgagaaccgcgaaagtgcagcccgagtcgggcccgtggctccgcatgccgtcgcacggtggtgtgccgcccagggctggccggtccaccccctggctcccgggcgcaagacgcccgccgggaactgtcctgactgccgcacgcaccggcacgaccccgccgactgcccctgcctgcccgcaggccgcccctgccacggcttccacgcggcgaccaccgacccggcccgcatcgaccgctggtggaccgacaagccctcgtcgggcgtcggcgtcgcctgcgcccccgcgcagctggtcgtcatcgacatcgatgcccacgcggccccggtggccgaccgctcgcgcctgctgcccggcatcccgatccccgagcaggtgagcctggccgggctggcctccggtttcgacacgctggcgctgctcgccgcttaccggggcgagcccgaccccgcctcggacgagacgacgctacgggtccgtaccccctcggggggactgcacgtctggtacctcaaccccgacccctcgacacggttccgctgctccaccgggtccgggcggaacgcggcgctggcctggcaggtcgatgtccgtgccgacggcggctacatcgtggcgcccggcacccggaccccgcagggcgtctaccgcgccgagggagcggcccggctcccggcgcccctgccgggctggctcagggacgaactcacccgcacgggacatgtcgtgactccgaggcccctcacgcccttctccgagcctttcaggccctcgcctgaggattccccctctcaggggcccgtaaccgcctcagaagccgctccagccccttccgtggccgttcgtccgggccgccgggaggcgggcgcgctgcggatcctggatccgctgatccagcaggtcgccgggtgcgccgtggcccgcgaggggacgagtttcaccgagaagctcaaccgggccgcctacaccgccggcgggctggtgggcgcggggcacctccaacacgcggacgtccgggaccggctcgtccgggtcgcccagtacgcccgtccctggcagcagaccagaaatgaaacgatcgtcgacgacgcccttgccgtagggtctgcccgccctctccacctcaaaggacgtccatgagcagcagtgccggaagctcaccgcgcttcgacccgcaggctgccgctcagcagatgctcgacctggaggcggccggtccgtccggagcggccctgttgcccgcccagacggcccctgaggccgtgtcaggggcgtcgccgctcccgccgccgggcgccttcggcgcgccccccctgccgccgtccctgtccgaccgggggaacgcgcggctcttcgtgcagatgcaccgcgaccagttccggcacgtggaggggctgggctggttcgcctgggacggctaccggtggaagcgcacgggcggcgagaaggccgcgctgtgggcggcgggggagatggccgaggacatgccggacaccgatccgcgcggcatcttcagcaaccgtgagatcgcccagcacaagcggcgcaccctgtccaccacaggcatgaaggccctgctcacccaggcgaaggcgtctcccgacctctcggtggacccggactgcctggacggggatccgtacgcgctgtgcacgccggcgggcgtggtcgacctgcacaacggccacctgcgcaaggccgaccccacccgggacttccactcccgggcgacgagcgtggccccgcagcgcatggacacgccccgctggcaccgcttcctcgtggacaccttcggcagcgatcccgagggcgaggagatgatcgacttcctccacctgctgctggggtactcgatcaccggtgacgtgggcgcccaggtgctgcccttcctgcacggtgagggcaagaacggcaagtccgtcctgctggacatcatgatccagatcctgggcgactacgccgacgccgccccgcccggcttcctcatggaccgcggggcgttctctgagcactcgaccgagctgaccgaactgcatggccgccgcctcgtggtgtgcagcgaactgaagccgaacgacaagttcgacgaggccagggtgcggctgctgaccggcggcgacaagatcaaggcacgccggatgcggcaggactacttctctttcacaccgacccaccacctgtggctgctgggcaaccaccgcccggaggtctccacgggcggcttcgccttctggcgccgcatccgcctgctgcccttcacccggaccgtccccgccgaacgcaggatcgacaacctcgccttcgagctagtacgggatgaaggccccgggatcctgcactggctcatcgagggcgcccagcgctacctggccacccgcgaccccctggaaggccccgaccgcgtccgcatcgccaccaccgcctacgccaccaccgaggaccacatcggccggttcctggccgagtgctgcacccgggacggcggcgaggccgggcgggacctgcgggtggaacagggcctgctgtacacggagtacagctcctggtgcaacgcgggggagggaatcaggcccgcgaccccgagggccttcgccaaccgggtccgccaggaggtcggagtggcctccccggccgacatgatcaagtcgaacgggcgcaagtactacccgggcatcgccctgctggagcacccgtgaggcggccaggagttcggccgtactcagcggtcggcctgcaccccggccgccgggcgctctacgatggagggcaggacccgcatgcggtggctcccaccaaaggccccgccgctggccggagcgcgggccggagcgacatgttcacatgcctggccacgtcccccttggtggggagcacgccgacgaaggaggggctgcagccatgagctcgctactgaccgagagcgacctcatccacgaggaagaggtggtgtggctggagaaccccgaaaagctggactacgtccgccaggcgctggacaagaccaagcgccgcaacaccaagcccccctacgcccgcgacgggcgcatggtgggctacgcgctgctcgacgagcaggcctcgcccgaccccgacagcggcctgtacaagcgccgggtcttcttcctgctgccgcacgaccgggacagcctgcccgacggcctctaccgcgaaggggcccccggcgaggccgtcgacccccgcaccatcgcgccgaggaagccgggcgcgaagacgccccggtcgcagtgcggctcgctgccgatagcgacgtcggcgccctgagcgcgcggtccgggcacggcgtaccgctcgctcaggagaagtacacgaggacgcggccggagttctgggcgtcgacctcacggcggacgtagagcttgcggatgtgctgctggtccaggaaggccaggacccgtgcccggagccgccccgaccccttgccgggaatgatctccgcgaccggcacgccggcgtgggaggcccggaagaggaactgacgcatcgcgagttcgatgtcccggttgttgcggaacaccgggtgcaggtcgagcgtcatcatgggagccctcctccgggcagggtgcggtggtcctactggctacggtcggaggctacggccttgctcatccggcgtcacgcgccgtctcccgtacgaaggcgagcacgggggagaggccctcgtccagccccgagatgaacgtcgcccggatcgcgtcccgcaacggggccggctcctcctcgttctcccaggagcgggcgaagtacgagggcagcacgccccggggccaccgccacggtgtcttccaaagaggttctggaaggcggaggcgtgcggagctattacgccgtaatagggggggcgtcgcctcgcgagggcgagcatcgcggcggcagggctattacgccgtaataggtcgaggggacgtcgcggtggatgggaccacacgtccgggctattacggcgtaataggttgcggtccctggcgcggcaggcagcggtcccgcccgaagctattacgccgtaatagccaggcaggttctgccgggcaggttctgcccggcaggcagcgtctgcgcccggcgccgcaatccacgcggttcaggccgccgggagttcccgcctcgcggcgggacgcgtcgcgtggtagaggcgcggctcgttgatacccgccttcgagattcatgagccatgatccaggcgcctcgagcgggcagtgatccggagcgtccggcggattgaccaggtccatctcccacacgaccagcgaccggccggcgacgacgtgccgggggcgctggtggaccctggacgacaggccggaatccatgcccacccgcatcagtccgacgccaccgagccggtgcccgccgctgagcagcgacagatcgggggagtagcggcccttggccaccttgccgaacgccgaactcctcgcgctcggccgccgcgagtttctcgtgcgccgcctgccagctggcctcggtacggcgtgcggcgtcggcgtggccggagggggaggtttccgcgagggtctggtcgagcaagcggcgtgccttccaggcccagtccccagggagtgccggtccaacagtcgctcggcgaggcgcagtcggaagctacggacatctcgtccacgggctcggtgcgctgggactcgcgcagcagggaccggcaggcgttgcgcacctcgtgcgcagccacggtcccacggcctgcgggtcacgggcgtcggcgatacggcgcagggcgaccagcgccgcttcttgcacgacggcgtcgacatcgggaccgaggcccagcaggctcaggaccaccgcgcccattcccgggcggcggcgctccaacagcgttcccagagctgccgcttcgccccgctgcgccgcacgtatcaggagcgcgtcctcggctcgcgagatgccatcggtgccgtatccatgcgtggcccccggccctggtcggtgctgagccgaggatacgcaagggtgagaaccggccagataggggtgaccgtcacccggcgaacaccatggacgcagcggaaacacccgcggtgatgtgtctcataccggtggtgcgctgacgagttcctgagaagtgttcgagatgcttggggcatggcctcaccgagcaagcacaccccccgagggcgccacccggtcccgacggcgggtgcccagatcttcaccacgttgtcccgggcaggcggacgcctgccgctgacggccgccgccctggtggtcgcggtcaccgtcaccggttgcggggcgagtggagcggaggagtcccacgacgcgtcggcggcagtctccgcggacggcccaacagccgccgcgccctccgcgcgggacgatgcgcgtccgatgtccggagtcgacaacgtggctcccgaactacccacgcgactgcccggggtgggtcccaagacgctgtcgcgagttccggcggggacccgccaggtcgtcctggtcaccggccggggcaagaactccaaccgctccggggtcgtgctgtaccagcgcaccgctgacggctggaaggcgggtgcgacctgggccgcgcacaacgcgctgaagggctggaccgacgaccaccgcgtcgatgacctccggtcgcccatcggcgtgttcaccctcagcgacgccgggggccggctgtccgaccccggctcacgtctgccgtacacccgctcctccgccgattacaccgtcggcggcctcggcttcaacggcgaaccgctggcaggggcgttcgactacgtcatcgctatcgactacaaccacaagaagggcacgcccccgctggactggacgcgcccgctgggcgcggacaagggcggcgggatctggctgcacgtcgaccacggcggccccacccacgggtgcgtcagcatcgccgagcggcacatgaaggagttgctgcgtaccctcgacccggcacagcacccggtggtcgtgatgggggacgccggatcgctcagcagatgaggtgttccggctgccggagcgcctggtcggccaccagtggttcgcaggctgtggtcggaaaggcctcggaaaggtttgccggcgcgctccctgctcgtggagggcacgtgtgcggatcagtgtgtggcctgtgcgggaccgcgggatcgtcccttgtctggtgtgcgagccggggcgggacgacgaagtgtgagccggagaggtgctccgacctgtggagggccctgttcgggtggcgacggcggagctggtcccgggcggctggacccggtcgccaggtcatgcccgtacgtgagccgtggtgtcggctgcccgggaccggctactcggccgactcgacgagggagtacatcaccgatcgcttctgcttgtgccgacggatccggcccttggcgacgagtgcttccagggtgttgcgcaccacctgcggagtcgggttccggtccgggtgcttctccagcagttcgtcgcgcagctccttcgcgaggcgcggctcatcgtaggcgctgaggaggtctttgagcaggtcaccgaggaggggctgacgcgacttccccttcgcggcagtcttcgcggcgctcttcgcgggtcgggcacccgcgcccgtggccgtctccttggtgcgtcggggcgccttaccggcggcgggcgccgcaggtgtgaccacaggttccccctgagcctgctcgggcaggcgtgagggctccgaagacgcttcgtaacgctccgcgaggctcaggatgtcgaccaggagtgcttcctcctgcttcaacacctccatcttctcggcaagttcctgctgccgtcggcgattttcctccaggtccgacgcggcctgtccgacgtaccgcgatcggagggtgccggctgattggctggtcacaaccgttcactcccttgtaattgatgacattgcgcatggtacccacgccggaggacctgcgctgaggagtgtgaacataggcgacgggagaaggccatgccgactgggcgaaacgttgctgtggcggccggaccgtgtgcgtcggacggtgttgcggcacgtgctcacctcgtggtgaacgagtgttctgagaacaaggtgccctggtgtcgatcaaggcgcaccacgtcgcaggcgcccgccaggccgctggaaggctgctgccgaccgtgcgtgaacctggccggggaggtgacggcgagggcgcgtgcaatctccgagcccgccttgagcgggtgcggggtgttcagagggacggtggagaagtcacccgagcgcagggtgtaggtgtccggcccggaggcgaggcacacacgtatctcccctgccggaactgagaagagcgtccgccgggtcagggcgggagccgcccggcccgggccggg

SEQ ID NO: 144 - DNA, 18666 bp, Unknown
  Kingdom: Bacteria, Phylum: Actinobacteria, Class: Actinobacteria, Order: Streptomycetales, Family: Streptomycetaceae, Genus: Streptomyces
cggcgcccgcggatcggcggactcggcgcgcgcgaccagcttgtagaccatcgagcaggtcgggtgcccggacccggtgaccagctgggtgccgacgccgtacgcgtccacgggcgccgcggcgagcgaggcgatggcgtactcgtcgaggtccgaggtcacgacgatcttcgtgtcccgggcgcccagctcgtccagctgctggcgcacccggtgcgcgaccagcagcaggtcaccggagtcgatgcggaccgcgcccagctcgggcccggccacctccacggccgtacggacggcctcggcgacgtcgtaggtgtccaccagcagcgtcgtgtcccggcccagcgagtccacctgggcctggaaggcgtcgcgctcgttgtcgtgcagcagggtgaaggcgtgggccgaggtgccgacggtggggatgttgtagcggaagccggcggccaggtcggaggtggtggcgaagccgccgacgtaggcggcgcgggaggcggcgaccgcggccagctcgtgggtgcggcgggcgcccatctcgatcagcgggcgctcacctgcggccgaggacatccgggaggcggcggcggcgatcgcggagtcgtggttgaggatggagaggatcacggtctccaggagcacgcactcgccgaaggacccctccacccgcaggatcggcgagccggggaagtagacctcgccctcggggtagccccagatgtcgccgctgaagcggtagccggccagccactgcagggtcggctcgtccacgacccgccgctcgcgcaggaagccgaggacgtcggcgtcgaagcggaagttctccaccgcgtccagcacccggccggttccggccacgacgccgtagcggcggccttcgggcaggcgcctggtgaagacctcgaagacactgcgccgctcggccgttccggcccgcagggcggcctgcagcatcgtcagctcgtagtggtcggtgaagagcgccgtcgagggaacgtccaccggcagcccaaggtccgctgtgttcatgaccgagaatcgtactctcatttcgtcagtctgacgatttacggtcgcggcccgcgcgatgcgcgcgcgatgcctccgtgcggcctgctcatttgtgctcccacccccctgtagtggcagcatgggccatgtgacggcagccgcacccatcgagatcgagaagaccgagccggcggaagaggtcttcgccgtacccgagccggacgtcccctgggtgacgatcgtccacaacgatcccgtcaatctgatgagctacgtcacctatgtcttccagacgtacttcgggtactcgaaggacaaggccaccaagctcatgctcgacgtccaccacaagggccgggcggtcgtctccagcggcacccgcgaggagatggaacgggacgttcaggccatgcacggctacggtctgtgggccactctccagcaggaccgcaagtagccacgcagcaggccggcgcgtacggcgccgcgtctgacgacaagcccggaccggaagcagcgaatcctctccatgcctggacacttcgaaccgctccccggcggcggcgcggccgtcgccctcgacgacgtcgagatctcgatcatccgctcgctggccgtgcagctcctggagctgatcgggccgggcccggccgaggacgagaagtccgccgacccgctcgccgagctgttcgccgagggccccagcgagccgcccgccgacccggtgctcagaaggctcttcccggacgcctacggcgatcccgagcagccgcccgccagcggtgaggaggccgccgagcagcgcgcgcacgcctcggagttccgccgctacaccgagaacgacctgcgcgcgggcaagcgcgagaacgccctcgcggtgatccactcgctcaacgagctgtcggccgccggtgagggcggggccgtgctgaagctgtcgcaggaggagtcccggcgctggctcggcgccctgaacgacctgcgcctggccatcgcctcgcggctggagatcggcgacgaggacgacgccgacgacctctaccggctgcccgacgaggacccgcgcaagccgatggtgatggcgtacctgtggctgggcggcctccaggagaccctcgtctccacgctgatgccctgacgtcctgatgtcctgtcccgatgtcctgatgtcctgatgtcctgcttctgacggtccgtgcggattgtgtgtccgctcagaggacgctcaaatccggataacgatcgcgtcaatacggcccagcggtatgacccgatcgagtgcgctttgtccggttcttgctgtgccatgtgccacagctcaccctgcgatcagtgttgcggccgtgataaatcttcacgaccgcccggcgaacaccacccacgttcgcccgggtgcgccaccgagccggcaaccgccggccaggcatcactccatttcagtccggggggatcgagacccgatccggggccgccgaacggcccgggtcggcatggagaaaggcgcacgacacatgacctcagcgcaggtcgagcaagaacacgacggcaaagaggccgtgcaggacggcgagggataccagcgcgggctcggcgcccggcagatccagatgatcgccatcggcggcgccatcggcaccggtctgttcctcggtgcgggcaagggcatctccaaggccgggcccagcctgatcctggcctacgcggtggccggattcgtcatcttcctcatcatgcgggcgctcggcgagctgctgatgtaccgcccggtctccggatccttctccgagtacgcgcgtgagttcatcggccccttcgcgggcttcgtgaccggctggacgtactggctcttctgggtcgtcaccggcatcaccgaggtcaccgccgcggcggcctacatgacctactggttctcgatcccgcaatgggtgtcggcactggtcttcaccgtcgtcctctacggcgccaacctgatctccgtgaagctcttcggtgagctggagttctggttctccatggtcaaggtcaccgcgatcatcggcatgatcctgatctgcgtcggcgtcctgacgatcggcttctccgacgccggccacaccgcgtccgtggcgcacctgtggaaccagggcggcttcttcccgcacggcgtcggcaacacgctgatgacgctgcagatggtcatgttcgccttcctcgccgtcgagctggtcggcgtcaccgcgggcgagtccaaggacccgaggaaggtgctgccccgggccatcaacaccgtgccgtggcgcatcgccgtcttctacatcggcgcgctgatcatgatcctgtcggtcgtgccgtggaccggcttccacgccggcgagagccccttcgtggtcgccttccagaagatgggtctgcccgcgggcgccggcatcgtcaacttcgtcgtcctgaccgccgcgctgtcctcctgcaactccggcatgtactccaccggccgcatgctgcgcgacctcgcgctcaacagccagggcccgcagttcttcaccaagctgacccgcagcggcaccccgctcatcggcacgacgttctccgccgcgctgatgctggtcggcgtgtggatcaactaccagtggccgggcaaggcgttcgactacgtcgtctccttcgccaccatctcgggtatgtgggcctggatcgtcatcctgatctgccagatccgctaccgcgccaagtccgaccgcggcgagctgcccaagtcggagttccgcgccccgggcgccccgtacgccagctggttcgcgctcgccttcatcggcatggtgatcgtgctgatgggcatcgacaaggacgcccgcgtctcgctgtactgcgcgccgctgtggggcctggtcctcgccgtcgcctacctggtgctcaagcgccgcaacccggaggccgccgccttccgcaggcgctgaccggtgtcgtagcccggacgtccggccggagcggattctcgtgggacccgctccggcagccgctcaggatgtccggcatgtgggccgttccgtaccactccccggtacggaacgtcccacccgtcgcccaccaccaccctgcctgacgcgcttcgcgcggccccttttgattccctgcttatcctttggcccatgctgaccatcacccagtcgctctacgaccagatcgtcgcccacgcccgcgcggaccaccccgacgaggcgtgcggcgtggtcgccggacccgtcggcgccggccgccccgagcggttcatcccgatgctgaacgcggcccgctcgcccacgttctacgagttcgactcgcaggacctgctcaagctctaccgcgagatggacgaccgcgacgaggagccggtgatcatctaccactcccacacggcgaccgaggcccatccctcccgcaccgacatctcctacgccaacgagcccggcgcccactacgtcctggtgtccaccgccgacaccgacggcgcgggcgagttccagttccgctcgttccgcatcgtggagggcgaggtcacggaggaggaggtcaaggtcgtagaggcgtactgaaacgcgggccgagcgggcctccgtctcgcagcgcggatggaaaccgtccgaaggctgagatcacattccaggaagcggaccgggaatcgatacgatgagcccatggttcttcacgacgtgagcgacgacatcccgggcatgctgctcgtggcgcggctgcacgtcgacctgtgcaggttgaacagcgccatctgttgacgttccctgccgccgccgtacggccgtgagccgcggcgctcccccaggagccaacgcctgggggccctcacgacgcgcgccccccgatccgacgacatcttcctgacaggagcccgcaaccatggccatcgaggtccgcatcccgaccatcctccgcacctacaccgacggacagaaggcggtggagggcaacggggacacgctcgccgcgctcttcgccgacctcgaggcccgccacccgggcatccaggcccgcatcgtggacggtgagcagctgcgccgcttcgtcaacgtctacctgaacgacgaggacgtccgcttcctggacggcatcgacaccaagctcgccgacggcgacaacgtgacgatcctgccggccgtcgccggcggcatgcgctgatcggccgctgagcagcgatgcgctacgactccccgctggccgcggtgggcaacacccctctggtgcgcctgccgcggctgtcgccgtccgccgacgtccgcatctgggccaagctggaggaccgcaatccgaccggctcggtcaaggaccgccccgccctgcacatgatcgagcaggcggagaaggacggccgcctcacgccgggctgcacgatcctcgaaccgaccagcggcaacaccggcatctcgctcgccatggcggccaagctcaagggctaccgcatggtgtgcgtgatgcccgagaacacctcccaggagcgccgggacctgctcggcatgtggggcgcggagatcatctcctcgccggccgcgggcggttcgaacacggctgtccgcgtcgccaaggaactctccgccgagcaccccgactgggtgatgctctaccagtacggcaacccggacaacgccggcgcgcactacgccaccaccggcccggagatcctcgccgacctgccctccgtgacccacttcgtggcgggcctgggcaccaccggcacgctgatgggcgtaggacgctatctgcgcgagcacaagccggacgtgaagatcgtcgccgccgagccgcgctacgacgacctggtgtacggcctgcgcaacctcgacgagggcttcgtccccgagctgtacgacgcctccgtcctcaccacccgctactcggtcggttccgccgacgcggtcacccgcacccgcgaactcctgcagcaggagggcatcttcgcgggcgtctccacgggcgccgcgctgcacgccgcgatcggcgtcggccgcaaggccgtgacggcgggggagagcgccgacatcgtcttcgtcgtcgccgacggcggctggaagtacctctccaccggcgtctacacggcggccaccaccgaggaggccatcaagacgctccagggccagctctgggcctgacgtcccccggccccgtcccgtggagggggccggcccgcctcaagcgcgtcccagccccctctcacgagggggccaatctcatcctatggaggggcaaagaattcactccggtactgccgcccccgggcggcccggggctacgttcctggcgcaccctgtcatgtcacgaacacgtgatgtgcgtgcggtgcaagtgtcatgctcatgactgcgcggtggccgccgctacgcgcgtcacgggctgcccgaccagtgcgcatccccacgtcaacggaggcagtaccgtcatgcgtgagtcacgcccgagcagccggagacggagtctgcgcagactcctcgccgtcgccttccccgccctcgccctcacggtcaccgggttcgtcgcggcaccgaccgccggggcggcccagaccgccaccgccccccacaccaccaagaccgcccagaacgcacacgccctcaccgcccccgagcggcagaccttccacgccaccggcaaggccggccagaaggtccccaccacccggctgtgcgccgacgcccgccccggcgaggccacctgcttcgcccagcgccgcaccgacatcaagcagcggctcgcctccgcgctcgccgccgccgcgccctccggcctctccccggccaacctgcacagcgcctacaacctgcccagcacgggcggctccggcctgaccgtcgcggtcgtcgacgcctacaacgaccccaacgccgagtccgacctggccacctaccgctccacctacggcctgtccgcctgcaccaaggccaacggctgcttcaagcaggtcagccagaccggctccaccacctccctgccgaccaacgacagcggctgggccggtgaggaagcgctcgacatcgacatggtcagcgcggtctgcccgaactgcagcatcatcctggtcgaggccaactccgcgaccgactccgacctcggcaccgccgagaacgaggccgtcgccctcggcgccaagttcgtctccaacagctggggcggctccgaggcgtcctcccagaccagtgaggacacccagtacttcaagcaccccggcgtcgccatcaccgtctccgccggcgactccggctacggcgccgaatacccggcgacctcccagtacgtgaccgccgtcggcggcaccgccctcaccaccgcctccaactcccgcggctggagcgagtcggtgtggaacaccaactccaccgagggcaccggctccggctgctccgcctacgacccgaagccgagctggcagaccgacaccggctgcgccaaccgcatggaggccgacgtctccgccgtcgccgacccggccaccggcgtcgccgtctacgacacctacggcggcagcggctgggccgtctacggcggcaccagcgcctcctccccgatcatcgccggcgtctacgccctcgccggcacccccggctccggtgactacccggcgaagtacccctacacccacaccagcaacctgtacgacgtgaccagcggctccaacggctcctgctccaccgcctacttctgcaaggcggccaccggctacgacggcccgaccggctggggcaccccgaacggcaccaccgccttcacctccggcggcggcagcaccggcaacaccgtcaccgtcaccaaccccggcagccagtcgaccaccaccggcggctcggccagcctccagatcaacgccaccgacagcgcgggcgcggccctcacctaccgcgccaccggcctgcccaccggcctgaccatcaacagctccaccggcctgatcaccggcaccgcctccaccgccggcacctaccaggtcaccgtcaccgcgaccgactccaccggcgcgtccggctccacgtcgttcacctggaccgtcggcaccggcgggggcggcacctgcaccgcctcccagctgctggccaacccgggcttcgagtccggcagcgcctcctggaccgcgtccagcggcgtcatcaccaccgacagcggcgaacccgcccacagcggctcctacaaggcgtggctcgacggctacggcacctcgcacaccgacaccctgtcccagtcggtgaccatcccggccggctgcaaggccaccctcaccttctacctgcacatcgacaccgccgagagcggcagcaccgcctacgacaagctgacggtgaccgccggatcgaagaccctggcgacgtactccaacgccaacgcggcctccggctacgcccagaagtccctcgacctgtcctccctggcgggctccaccgtcacgctgaagttcagcggcaccgaggactcctccctgcagaccagcttcgtcgtcgacgacaccgccgtgacgaccggctgacccgccccgacaaccccgcacgacccgcgaccccggccacgacacaccggccggggtcccggcgtgcgcgggcacggggatcctgatgtgctggaggaacgtcacatcggcaccagggcaccgggcaccgggcaccaaggcaccggccacacggagcaccgggcatccggaacgggacagcagaaaggcggccgccccatgcgccgtacgacgctccaccgcaccaccgccgcgaccaccgccgcgacggccgccgccctgctcctgctcggctgcggcacacagcaggacggcaagggcgccggcggatccccggcatcgacgccatcgacggcatcgacgacttccgcgagcaggggcacgccctccccgtcggcctcgcggccgtccccgcccggctgcagcggtcacgccgacctcaccgccgccgactccggccgcaccgtctgcgtcaccgtcggcggctacctgcgcctgaccctggacggcaccaaggaacgcccctggaccccggtcaaggccaccggcaccgtcctcaaaggcgccgacgccggcatcgtgatcctccccggcgacgccctcgccgcctacaccgccaccgcccccggcacggcccgcctcacctcgtcccgcccgctctgcgcgcaagcccccggcaggatctcctgcaagggcatccaggagtggacggtcaccgtgaaggtgacggagccatgagaggcgcacgaggcgcacgaggcgccggaggcctgggagacgtacgagccggtcccctcggcgtacggacggccgccgccggccgcctcacccggccaggtaccgcacctggtcccagagcaccgggtccacgacccccacccggcgccggaagtcccacaccggcacctcccgcacctcatcggtctccaggaaactcgtccgcccctgcgcgtcccccaccgaacccggcggcagtgggatcaccccggcccgctcgtcgtggtacctgctggtgatcttcgcgaccctcgcacgcttgccgtgcaccgacagcaccagacacggccggtccttcgacccgggaccctcctcgtagggcacgttcgcccaccagatctccgccggctgcggacgcgccacggcaccccggaccccgcgcccctccggacgccccggcggacgcgtccggcgcccagcgggacggcggccccggccccacccgtcgacgagcgtggcgacgagcgccaacagcaccaccgccgcgagcgccagccaccaggacgtgtccataaggacgacgttaccggcgcacgaccgccagtgcgcgccctcttccacacctcatgcgccccacgtccagccgaaccggtgacaccacaggtgagttcgcccacaaccgaccttgccgaaggagcgacccgccgtttcgcgccttacgctcgacggaccgcacgacccccgtcaccttctgtatctttcccgccagcggaggtttctgctccatgaagctcaccgtcgtcggctgctcggggtcgttcccgtccgcggaatcggcctgctcgagctacctcgtagaggccgacggcttccggctgctcctcgacatgggcaacggcgccctcggcgagctgcagcgccactgcggtctctacgacctcgacgcgatcttcctgagccacctgcacgccgaccactgcatcgacatgtgcgcctatttcgtcgcgcgctactaccggcacgacggcggacgctgcgccccgctgccggtccacggccccgagggcaccgagcaccggctgaccacggcctacgccgacacgcccacggcctcctcgatgagcgaggtcttcgacttccacacggtcaagccgggcaccttcgacatcggccccttcaccgtgcacaccgagcgggtggcccaccccgtggaggcgtacgccatccgcctcgaacacggcggccggacgctgacgtactcgggcgacaccggcaccagcgaggcgctggaggaactcgcccgggacgccgacctgttcctgtgcgaggccgccttcacggacggcaaggagaacatccccgacctccacctcaacggccgcgaggccggtgaggccgccgcccgcgcccgcgcccgccgcctggtcctcacccacatccccccgtggaccgacccccagatcaacctcaccgacgcccgtgcggtctacgacggcccggtggagctggcggcgcccggagcgacgtacgagatctgagcgacccggccgtacgagaacgcacgacgaggccccccgagccattggcggctcggggggcatcgtcgtgtcgcggttcgcgggggagggctcacgccttggtgaggtcctccacctcctcctcgggctcgcggcccggggtggggaggttgaacttgatgatggcgaagcggaaggtcacgtagtagatgaccgcgaagaccagtccgatcgggatgatcagccacggcttcgtcgccaggtgccagttcagcgcgtagtcgatgaagccggcggagaagttgaagccgtcgtgcacgcccaggccccaggtgatggccatcgacgcggcggtgagcacggcgtgcagcacgtacaggaccggcgcgatgaacatgaaggagaactcgatcggctcggtgacaccggtgacgaacgaggtcgcggccagcgagagcatcatgccgagcacgaccttgcggcgctcgggacgggcgcagtgcgcgatggcgagcgcggcggccggcaggccgaacatcatgatcgggaagaagccggactggaagagaccggcggacgggtcaccgtgcatgaagcgcgggatgtcgccctgccagacctggccggcggcgtcggtgaagctgccgagctggaaccaggagatcgtgttcacgaactggtgcatgccgaccgggatcagggcgcggttcacgccgccgaagagagcggcgccgcccgagccgagaccggtcatccagttgccgaagtcgctgatgccggtgccgatcggcttccagatcagggcgaagacgacacccaccacgatgccgacgaaggccatgatgatcggcaccagacggcggccgttgaagaagccgagccagtccaccagcttcgtgcggtggaagcgctgccacagcacggcggccagcagacccatgatgatgccgccgagcacccccgggttgttgtagctggcctcgacgatcttccccttctcgatgtgctgctcggtgagggggaaggcctcgaggaccttgctgtagacgaggaagcccaccaccgcggccagcgcggtcgaaccgtccgacttcttggcgaaaccgatggccacaccgatgcagaagaggatcggcagggagccggtcagcgcgccgcccgcgttgttgaacacagcggcgaccttgtcccagcccaggccgtccttgccgaagatgtcatcctggcccagccggaccatgatgccggccgccggcagcacggcgatcggaagctgcaggcttcggccgaccttctgcaggccctggaaaaggcctgatccccgcttcttcgcgggtgccgccgtcgtctcggcggtggcggtgctcataacgtccgtcctccatcgggtggtggtctacaccactcagtggtgtagacctgttgtagcacgatgaaggtggcgtaaggaacccgcgaaaatgcgaccgaaccactacacgccgtgcgggctctcgggagccgtcacctgccgctttcgcaccggtatgggcctcaggccttcgtggtgtcctcgacctcgtccgcaggctcccgcccaggagtcttcagatcgaacttcgtgatggcaaatcggaacaccacgtaatagacgacggcgaggcacaacccgatcgggatgatcgcccacggccgggtcgccaggttccagttgatgacgtagtcgatcagccccgccgagaaactgaacccgtcgtgcacgcccagcgcccacgtcaccgccatcgacacccccgtcagcaccgcgtgcaccgcgtacagcaccggagcgatgaacaggaacgagtactccagcggctccgtgatcccggtgacgaacgacgtcagcgccaccgacagcatcagcccgccgacctccttgcgccgccccggccgcgccgtgtgcgtgatcgccagcgccgccgcgggcaacgcgaacatcatgatcgggaagaaacccgaggtgaactgccccgcgtgcggatcacccgccaggaacatgttgatgtcaccgtgcaccaccgtcccgtccggcttggtgtaactgccgaactggaaccagaccggcacgttcaggaactggtgcagcccgatcaccagcagtgcccggttcgccagcccgaagacacccgcacccgacgcccccgcatcgctcagccagttgccgaacccctccagaccccggccgacgggcggccagatccacaggcacagggccgcgaacaggatcgccacgaacgccatgacgatcggcaccagccgccgcccgttgaagaagccgagccagtccaccagcttcgtacggtggaaacgccgccagaagatagcggacaacagccccagcacgatcccgccgaagattcccggattctggaacgtgaacgccgtcaccgtcccgtccgcggcctggcaccccgtcgcgatcacctccgcccccgccggacagcgcatcgggaactggtgcagcacgttgtagtagacgaggaagcccgccaccgccgccagcgccgtcgaaccgtccgccttcttcgccatcccgatggccacacccacacagaacagcagcggcagccccagctcaccgtcgagcagcgcgccacccgcccccgccatcaccttcgagacgtcggtccagcccagcccgtccttgccgaacacatccggctgacccagccggttcaggatccccgccgccggcagcaccgcgatcggcaactgcagactgcggcccatcttctgcaagccctggaacagcgtgttccagcgctcccgcaagggcgagaccctgacttccgcgccaccggcgctgtcggcactcatggcgtcctcccggggccccgctccgtcgtgcggcgccccgtttggccaccgcgccaacggtggtgtagaccagttgacggacggttccgctgtcgtgaacgccatcatggggcacccacgacacggccgctcgcgaagatgggccaactgtgggttactgcgacaaagcggttcggatcagggagacagaacatggccagcaaggctgagaagatcgttgccgggctcggcggcatcgacaacatcgaagaggtcgagggctgcatcacccgcctgcgcaccgaggtcatcgaccccagcaaggtcgacgaagccgccctcaaggccgccggcgcccacggcgtcgtcaagatgggcaacgccatccaggtcgtcatcggcaccgacgccgacccgatcgccgcggacatcgaagacatgatgtgacccgcggtcccgcccagggacccgcagactcacccccaaggggctcttcccggcacgggaagagccccttgtccgtggggcactaggctcgacccatgtctcgaatcgacggccgcacccccgaacagctccgccccgtcaccatcgaacgcggctggagcaagcacgccgaaggctccgtcctcgtctccttcggcgacaccaaggtcctctgcaccgcctccgtcaccgaaggcgtcccccgctggcgcaagggcagcggcgagggctgggtcaccgccgaatacgccatgctgccccgcgccaccaacacccgcggcgaccgcgaatccgtcaagggccgcatcggcggccgcacccacgagatcagccgcctcatcggccgctcgctgcgcgccgtcatcgactacaaggccctcggcgagaacaccatcgtcctggactgcgacgtcctgcaggccgacggcggcacccgcaccgccgccatcaccggcgcctacgtcgccctcgccgacgccgtcgcctgggcccagggccgcaagctgatcaaggccggccgccagcccctgaccggcaccgtcagcgccgtctccgtcggcatcgtcggcggcgtccccctcctcgacctctgctacgaggaagacgtccgcgccgacaccgacatgaacgtcgtctgcaccggcgacggccgcttcgtcgaggtccagggcaccgccgaggccgaacccttcgcccgcgacgaactgggcgccctcctcgacctcgccgtcgtcggctgcaccgacctcgccgcgatccagcgggcagcgctcgaaaagtaacgcgacagcacccgaccgggtaaagcgcacgccaagaaagggagccgccgggacgcaacccgcgtcccgagtccgacgtccctaccggtacgggcgtacggcacggacaccgtgcacgaccacgtacgcccggccaccgaacggggaggggacccagccatggccgccagccgccgccgacgacccggccgcaccaccgccatcgccgccaccacggccgccatcgcactcaccgtcaccgccctcaccggctgcgacgccgtcggcaaagccctcgactgcgtccagagcgccgacgccatcgccgacagcgtcaccaacctccagcaggccgtacagaacgccgcggacgaccccaccaaaaccgacgacgccctgcgcgccatagaggacaacctcgagaaaatcggcgacaagaccgacaacacggacgtcaacaaggccgtcgacgacctcgacaaggccgtcgggaacgtccgcaccgccctcaagaacggcgacgacacccccgacctcacccccgtcaccgacgccgccggcgaactgaccaaggtctgcacaccctgacccgcccccgatactggtgagcatgacccgcttgatcctcgccacccgcaaccccggaaagatcaccgaactgagggcgatcctcaccgacgcaggactgccccacgaactcgtcggcaccgacgcctaccccgagatccccgacgtcaaggagaccggcgtcaccttcgccgagaacgccctgctgaaggcccacgccctggcccaggccaccggcctccccgcggtcgccgacgactccggcctctgcgtcgacgtcctcggcggcgcccccggcatcttctccgcccgctgggccggccgccacggcgacgacaaggccaacctcgacctcctcctcgcccagctctccgacatcgccgaggagcaccgcgcggcccacttcgcctgcgccgcggccctcgccctgcccgacggcacggaacgcgtggtggaaggccagctccgaggcaccctgcgcctcgcccccgccggcgcgaacggcttcggctacgacccgatcctccagcccgacggcgagacccgcacctgcgcggaactgtccccggaggagaagaacgagatcagccaccgcggcaaggcgttccgggcactggtgccggtggtacgggagctggtgggctgagacacgcaaacggcctgcggagatctttcgatccgcaggccgttcccgtgcggcggaagggattcgaaccctcaagcccgatcaagggccacagatcctaagtctgctgcgtcgccactgcgccaccgccgctggttgcttgtcatggtaccgggagtcgctttccgccttgcgcctccccggcgccaggtgctggtgatcgcgtggcagttcgggcacagcaaccgcaggttctccagccggttgtcacgccagtccccgttgaggtggtcgacctccagcgtcatgggcttcccgagccccacggggccgacaccacacctggcgccctgctccggaatgccgacctcgcgcagcgcgcggcgtagccgccaggtctggatccgatgcttgctgccgcggcgcagaatctcctcgggaagccgggagttgggaggccgccttccttgctggtgcgccttccccaggaagtggagggtcgaaagcccttcgtccgcgagccatttccgaagactggcgcggcctcagcaacgcctccgacagcgtccgggccccgcgcgcggcctcctccagccgttccttcgtgtacgcactggcccccatcgagcccctccgttcggatctcggccatgtgttcatggcccgtacggagtgacgaaccggttatcggacagtcatgcacggaaagcggagcggcccgtaccgggggtgccggtacgggccgctcggaaggcgggggcctcccgcctcagatccccagatccttgatgatcttggctacgtggccggtggccttgacgttgtacagggctcgttcgaccttgccggactcgtcgacgatgaccgtggagcggatgactccggtgaccgtcttgccgtagagcttcttctcgccgaaggcgccgtaggactccaggaccttcttgtcggggtcggcgaggagggtgaccttcagggactcggtgtcccggaacttcgcgagcttctcgggcttgtcgggggagatgccgatgacgtcgtagcccgcgccggccagcaggtcgaggttgtcggtgaagtcgcaggcctgcttcgtgcagccgggggtgagggcggccgggtagaagtagacgatgaccttgcggccctggcggtcggccagcgacacctcgttgccgtcggcgtcgggaagggtgaaggcgggggccgtgtcgccgggctggagtcgctcgctcatcgaaggtcttctcctcgtgcgtgtcctcgtaggtgccaataccgtgtgggtccgagggtaaccgggggtgccgacagtgcggtcgcggcgatagctgacagactgtgctgaacacgcagcagttgacttcggaggcgctacggtggcggacacggtggacaccagaaccccggctgagatcgaggcggacatcaggcgtcgccgcgagacgctggccgagaccctcgacgagatcggcgtgcgcgtgcacccgaagaccatcgtcggcgacgccaaggccaaggtcgcctcccacgtcgaccacaccctcggacgggcgtacgtccaggccaaccgggtggtgagcgaggtgcgggggcagttcgtggacgaggcgggcgcgccccggctggagcggatcgtgccggtcgcgctgctcaccgtgggcgtcgtcggcctgctcgcgctgagcgggcgccggcgccgggactgacccactccgtacggacatggccgaggcaggtaggtttcaggcgtgagcgccaacagaaacgagcacagcacccaccacgacaagctgcccatccggatgctgcacgaccgggtgctcgtccggcaggacacgagcgagggcgagcggcggtcgggcggcgggatcctgattcccgcgacggcggcggtgggccgtcgcctggcctgggcggaggtcgtcgcggtcgggcagaacgtgcggaccgtggagcccggtgaccgggtgctgttcgacccggaggaccgggcggaggtcgaggtgcggggcaccgcgtacgtgctgatgcgtgagcgcgacctgcacgcggtggccgcggaccgtttcgaggggtcggaggactccaccggcctgtacctctgagagcacggcccaaggggctggtgaccgttgtcaccggcccctttgtcgtttctttgctaacctcggaaggagcccgacgagacgcgccgtaccgggtcgaaggcaaagacgacgcacctggtgtccgtcgcaacgcccggtcgaaggaccggggttgccgtcgtctcggaggtgcccgtcgtggcctgggttctgcttgtcgtcgccggtctgctggaagtgggctggtcgatcggaatgaagtacagcgagggtttcacgcggctggtgcccagcgtcctcaccggcgccggcatcgtcgcgagcatgctgctgctgtcctacgccgctcgttcgctgcccatcggtacggcctacggcgtgtgggtgggcatcggtgcggccggtgcggcggtgctcggcatggtggtgctcggtgagccggtgaccgccgcccggatcttcttcgtctgtctgctgctggtgtccgtggtgggcctgaaggccacctcggggcactgagcccgggtggcccaggggctgaaccccgggggggctactgctgtcgtgcggcggtgaggtgctggtggccggttcccgtggtggtgccggtgttcgtgccggt

SEQ ID NO: 145 - DNA, 4157 bp, Unknown
  Kingdom: Bacteria, Phylum: Actinobacteria, Class: Actinobacteria, Order: Streptomycetales, Family: Streptomycetaceae, Genus: Streptomyces
gtaaggttaggtttgcctcaacgagaagtcggggcggcaccactgatcgatcccggcgggaggtgagcgaagcgtgttcgtctgcagttgcttcggcatcaccgagcagcaggtcaagcagcacgcggagaacggcgcctgcacgccccgccagatcgcctcggcctgcaaggcgggcacggactgcggcggctgcgtccgccgcatccaggccctgctcggccgcggcgcgtgcccgcgccgcgaactgatcgagcggcgcgccccggcgttcgcccagcttcccacgcagagcggcgacgccgcccccggacaactgggcgacgccgcttgaggagcccgtccggcaggggtcgcccgctcagtgggcggagaagccgctggtgccgggacccgaggagtccggctggctctgctcgatgaccgtcgagaggtacagcgcctcgcccagcttgtcgacgagttccagctgggtgtccaggtagtcgatgtggtgctcctcgtcggccaggatcgcctcgaagacgttcgccgaggtgatgtcgcccttctcgcgcatcacgtccacgccccggcgcagccggtcgatggcctcgacctcgatctgccggtcggcccggaacatctcggtcaccgtctgcccgacctgcacgtggaagagccgctggtagttcggcaggccgtccaggagcaggatgcggtcggtcaggatctccgcgtgccgcatctcgtcgaaggactcggcccgggtgtactccgcgagcttcgaccaccccttgtggtcctggagcttggcgtgcaggaagtactggttgatcgcggtcagctcggcggtgagctgctcgttgagcagttcgatgacctcggggtcgccttgcatgcggggaactccttactgggctgacggggctgatgagcctgatggcgctgatggcggggctgacggggctgaaaggggacggtacgggccggtacagtccgattacagtccgatagcgccgcatgattgcaccggcacatacagtcgtccagtaagtgcacgcttagtgcgagttgtcccgtattggtgcggggctggtcatgtgcaccccgtcccgtctgtcaggatggaggcatgggtcagccggtggaacgcgcgtccggggaggcgtcgggaacagggccgggagcagcggcgcagccggagcttccgccgggacagcggctgcagcggggctggccggtcacgcactacggaccggtgcccaagttccggcccgaacgctgggagttccgggtcttcggcgccaccgccgacggcgagaagcactgctggacccacgacgagttcacggccctgccctacaccaccgtggtcgccgacctgcactgcgtgacgaagttcagcatgctcggcgcggagtggggcggcatcccggcccgtacgatcctggacatcgccccgcccgcgccgaacgtcacccatgtgatggtctgggcggagtacggcttcagctccaacctgcgcctgacggacttcaccgccgagaggaccctgttcgccacccacaaggacggcgagctgctcaccgccgagcacggcttcccgctccgcctgatcgtcccggacctgtacgcctggaagggccccaagtgggtccgcggcgtggagtacatgaccacggaccgccgtggcttctgggaggaacgcggctaccacaacgtcggcgacccctggaaggaacagcgctactcctaccaggaggaaccgggcgacggcccggggctgtgagggcgggaagggctccgagagctgtgggggctccgggagccgtgggggtccggctcagccgtccctgagccgcttcaggcgggccacgtccgccgcgtgcccctccttgccgccgggcgtctcgatgaccagcggcacgcccgcggtcgccgggtgggccatcagggcgcggaacggctcctcgcctatgtggcccgcgccgatgttctcgtgccggtccttgtgggcgcccgccacatccttggagtcgttggcgtggatcagcttcagccgtccctcgccgacggtgtccaccagcaggtccagtgtctggcgcatcccgtccgggcccgtcaggtcgtgcccggcggcgaagatgtggcaggtgtccaggcacacgcccagcttcgggtgggcgtccagcgcctcgaagtacggcccgaagtcccaggtgcgcgagcacagcgacgcgccctgcccggcggtcgactcgagcagcaggtacggatcgtcgtcgtgggtcagctcgtccagcagcggcagcatgtgctcccgtacctgcttcagcgccaccgcacggtcccggccgcccgtcgcgctcccggtgtggaccacgacgcccagcgcgccgatctcccggccgcgccgcagcgaatgccgcagcgactccacggaccgctccacggtcgcctcggtgtgcgagccgaagttgatcaggtacggcgcgtggacgtacgcgggaaccgactcctcggcgcagaccgcgcggaacgcctcgtcctggcgcggatcaccggcgggcgtggcccagccgcgcgggttggcgacgaagacctgcacggtctcggccgccagctcacgggcgtaggacaggcccacgcggtggagcccgccggccacgggcacgtggccgccgacgggattgcgcgcggcgccggtgagggagggggaggcggaagcgggtgactgctgactgctcacccgttcagggtgtcatgcggtccgcggccggtgaccgcgggccgtcgtgatccccgtctcgtcatccccgcctcgtcatccccgtcccgtcacctgatggtgatcttgatcgtggagcccttgggcgcctgctcgccgccctgcaccgactgcttcttgacggtgtccccgaacagaccgaggagcccgcggtcctcctcgaccttgaaacccgcgtcctggagcgccttcttcgcgtcgtcgacgctgtcgccggtcacgtcggggacgtcgaccatctccgggcccttggacagcgtcagcgtgaccgtgtcgccctcggccgccttgctgtcggcccccggggtctgctgcgcgacctggcccttgtcgaactcggagttgacctgctcggacgcgatcgtcaccttcagaccggcgtcctccaggtcggacttcgcctggtccaggtcctcacccgtgacgtccggcacgtccaccgggcggcccttgctgaccacgagcgcgatcgccgagcccgcgtgccgcgcggtgcccgcctcggggtccgtgctgatcaccgagcccgcggtgacgtcctcgctgaacgcgcggctcaccatgcccggctccagcccggccttcttcagctcgttctgggcggcgtccagcgggcggcctttcaggtccggcaccttcacggtctccgggccgtcggagaccgtgagggtcaccgaatcgtggctgcggatccgggcgcccgccgcgggatccgtactgatgaccgtgccccgcttcacggtgtcgctgtaggcgtgctggacgtccttgacgtcgagaccggcctccgtgagccgctcccgggcctgcggctcggtcttcgcgagcagcggcggcaccttcgtgaactggccggagttgatgtaccagacgccgccgccgacaccgaggaccagcaggacggcggcgacgacggtcagtaccagccgccggggccgccgccccgggcgccgggacgcgagggccgcgggcgcctccagacggctggtgcggtggaagccggccccggcggcctcgtcgtcctcgttgacgggcagcgggcgcggcaccgtcagcgcgcgcgggatcacgctcgtacggtcctgcgcgttgtcgtgctccgcgctgcgggcctgcggcggcagggcgtcgagctgctgcgtgctgagcgccgcgcgggcctcgcggacccgcgcgagcagcgccaccgcgaccagctcgtccagcgccgccggcagcccggggaccgcggcggacggggccggcacgtcctcgtgcaggtgctggtacagcacctgggcgggactgtcgccgtggtggggcttggcgccggtcagcatctcgtacagcacgacaccgcacgcgtacacgtcgacccgggggtcggcgtgtacgcgtgcggtgtcgt

SEQ ID NO: 146 - DNA, 1169 bp, Unknown
  Kingdom: Bacteria, Phylum: Actinobacteria, Class: Actinobacteria, Order: Streptomycetales, Family: Streptomycetaceae, Genus: Streptomyces
cggccccctgcgcagtgccggacccgtgcggcgcaggccggcactgcgcagggggccggatccgtgcagggtgcccgtctgccggtcagatgcgtggggggcgggcctcgtacggggtcgacaggaccactgtggtccgggtcgaaactcctgccagggtccgcacgcgggccagcagctcctccagttcgtgcggcgtggcgacgcgcactttgaggatgtagttctcgtcaccggccacgctgtggcaggcctcgatctcgggtacgcccgcgagccggtccgcgatgtcgtcgggtgcgctggggtcgaagggtttgaccgagatgaaggcggtcatgggcagcccgacggcctcggcgtcgacgaccgcggcatagccgcggatgacgccacgctgctccagccgccgcacccgctggtgcacggcagacgtggacaggcccgtggccttgcccaggtcggtgtagctcatccgcccgtccttgacgagcagctgcacgatctgtcggtccagctcctccatggcgcaagaacctacagtgcgcttgatctcctcggatacctcggcagcccaggtcatgccccgttcgtgcggagcccggcgaccgccggtcggccacctgggggacaaaccggtcgcgacgggcacctgcgagcggcatgtgaccaacgccacagcacccggtagcccttcgtgatgttctcgtgattaccgccgagaccggacgggaagtgcttgctgtggtcgaggccgcagtgccttcacggcccagccttagggggagaatcccatgcagagtcttaagcgccctggtcgttctgtgcccaagcggcagcagccggtcgtcgagccccagccggagggcgtcgaacccgacgagttcgacgagggcaccgacgcctacgacaccttcgagatgttccgggtcatctgcccggagtgcgcgcagcccatcgcgctgctggcggacgaggagatcctgccggagcacgcgctgtgcgcctcgccgtggaacccgttcggactcaccgtctgcgccggcaccggccgcaaggccgccgaggcccggccggcggacgagttcgacggcccccaggagcagcagacggccctgctgctgacgctcccccaggggctcgactggcgcacgcagcccttctcgcac

SEQ ID NO: 147 - DNA, 24741 bp, Unknown
  Kingdom: Bacteria, Phylum: Actinobacteria, Class: Actinobacteria, Order: Streptomycetales, Family: Streptomycetaceae, Genus: Streptomyces
cggctcgaccggctcgaccggtacaacgtccaccccggccccgccgtacgggcgctgctcaacctcctgcccggccgcctcgccgccggagacgacccggcggagctggcggaccgtctgatggcgccgccgacctcgacctggccggacgcaggcctactacgtcatggacttcgcgctgtcgggcaccgcgtccggacagccggccacggccggactgactctgcgcgcggccagcaaccggctcgccgcggccgtgggcgcgctgacggtggacgccatcaagctgcaaccggtctccagggtccgagcggtatatcgtttacatgttcgattctaggatgtccagtggcgatcacggtgagggaccgctcgtcacgcttcctccaaagcctccccgaaatcgcgtagcaccttgccgcgacgacttcgagctagttcgtgcccgacacctatggccagcgcgaccggccattcgatgagttccagggcggtcagaacgccgagccccgcgagaaacgcgagctggtcccttggcggcagctcaagtcgcaagtcacccacgtggacagtcatcgaatcattcgaaacgacccgctcagctgcagcgcgaggcccgtgagaactcacgacggaaaccggcgcgctcgaagccgcagcatcgggacctgtcttgtttgcttgagcggtcatggctcagcccgtttcatcggtcctgcgggcatctgctcgacgtcctccttccacgctagcccgatatggcctggcaccccactccgggcggggaagcgctggcgcagcgccacccagtcacccgcaccgcgcagccccagtagcgccggtcgatcctcttctgatgtcgcaggcagcggaggtggacaaggggtggtgcacggcccatcaccagcagtgaagctccgtcctcttgaagtggctggtcagcagggtggcgtgcctcgtgccggggtggctcgtgctggtcgtgggcggcagtctgtggtgcagaccgtccggcggggtggttttgccgatgagttcaccgtcctcgaaccgtctatccagtgacacgaccgttctctacaggagtgccatgtccaccatccagccagtgatcgtgactgccgacctggaggttctgctcggcttctatacgaaattgttcggcgctgaggagattttccgggtgccggcggaaggcccggccttctacctcggcttgcgtatcggcgacaccgacctcggactggtgtataaagcggcgtcgggggccggggcggcgtcgcggatcctgctcagcgtcggtgtcgacgacgtcgacgaggccctcggccgggtggaggcgctgggcggctcggtccgcagcggccccaacgacatgccgtggggacagcgcgtcgcccacgtccaggaccccgacggcaacccggtgaacctcactcagccgatcccggtccggtgacgctgttccgcggcgtgtgctggtcgtgggctacctgcggtagagatcaattaccggtagtggcctcgatgttcgtcaggacgagcagcgggtgaaacacgtgggtggcgcgggcggggtcagtacggagcttggtcaggaacctccgattctcccggtgggcgaggcctcgttcgacggggacgcgtcccggcggccaggacccggttggcctccttctcggcgggttcgagcttgcgggcgcgcttgaccagccgacctacggctggctgatgctccaccgacgggactcgatctccatcgtgtttcccactccggacggaggccaggcgctccgaagtgacgctggcgtagaaggtgaagccgaaatcacacggcacacggtggtatctcctgtcaccgggacaggagataccaccgttttgttttcaggagaggggctcgtagaacgggccgtcaggcgcgaagtcgccagaaaacaacgtcacgttcctccctctgagataggccagcaaccattcactgaacgtcatctcgtacagggtccaggccggactgtcgaactcctggaccacgacgcgccacggcgaggaggcttcatcgggaacgcgaaggaataccgcctctcccgtcgcggccgtcgccaccggtatcaatcccccggggttcggccctaccggactgggcaggaactctgccatgtcctcctcgcgccacagttcgagatctcccctgatggtttctcccagactgtgcagaagatgggtggcggggtgctccagatacaactgcccgttgatctcgatcgagccgtaggcatcgagaatctcgcggaagtccgcaggaaattcgataccgagttcctgctccagttcgatccatggcatcggatccgaccagttgaaccggggttcacccaacaaggcttggatctccgggagcgttgccactactatgccccttctagcacatcgagccgggccactcttgaagttgaccacggtgcacgagaaactgttcagggccccctgggcccgtatacggtcattcccacctgaacgttgccggaacggctgaatgaggatccccgcgcgcggagatgaccgacacgatcaggtcgttgttcccgttcaaggaattccacccgaaggcttccgccttcctccccattcttgcgttttgccccgccatgcaaagccaccggctttcggacatactggccgatgcccttaccccagtaacctatcaggcggccggcttgcggcttcccttctcctgcttcgatttcttccacgccgtccggattgacggacggttcgcattcggggcacttcggcacaccgccggctccggtgcgcgaccctgcggtcgcgagccggcccgaggccgtcgacgtcgcgctctacaccaccgcctccggcgacgccgtcgtcccccgcccaccccgaggtcgactgggagcgaccaccagccccctccggagaggcgcagccggcggaggcgacggctccgcgcagagcgccgtggcgtacgtcgctccgtttttgctgtgaactccgttgcttcgcaacggagtcgggagctggggcggcactttcctgatcgtcgtggaatggctgaaaatcgcgggaccacggtccggcgccgtgtcggccgcgggaacgtcggggatactcctgctcccgaaggacatgtcgcggcgtgtgtcgaacggggaatctctatgcaacggctcaggtacgtcctcgctggagtggtcacagcgggtctgctcagcgcttgcgtcggcggctccgggcacggtgacggaacgggagagacccgcaagcccccggtcggcgcagggaagaccggatccgtgccccacggtcagtccgcgccccatgaccgcctgtccgtgcccagcgtgtacgacacctcccacggctgggaatcggacatgctggggacccatctcttcctcccgcactccgcggccgtcgccgtcttccagccggccgcgaacaacggcgatttcaccgtcatggacgcggccacgggcgcaacgaggtggacgaggaaggtcaaaggcgtcggcctgatgtcggccctcgtgacgaccgtacagggccaggactatctcgtggccacgtcgtccggcacgacgggcgaggacgcggtcaaaaagggccgggacgtcacgaccctcgacatcttcaggaccaaggacgcggactccggagctgtcacgctggcgcaccatctcgaactgccgggcgaaggcgccgtcaccgacgggggcggcggcctgctggtgcggttcggcgacgaggccatcgcgacggtggatccggccaccggggcgacgaagtccttcgacctgacgaagatgaagcccccggccggcgagtgccatctgtgcttcgcgtcgaccaaggcggtcgcggtgacctcgcgtggaccgctgctcgccacggaccagcagcccaaggcccactactgggttcccggcgtctggtcgggcggcgccctgaccaccgattccgagaacaagctcttcatgaccccggtcggcaccgccctgttcgccctgtggcacgacgagggggccacgcaggacaccctcgccgtcctggatcccgcgaccggcaaggtgcgggcgaaggtgaactgcaggacggacgcgttccaacggaacaaggacgccgccaagagcgcgtcgctgtccgcgaacgggcgctacctcgtccaggacaacgccgccttcgacctggagaagggcaccggccgctgcttcggggacacggcgcagaccaaggccgtcgacttcgacggcgtgaccgacgacggcaccgccttcggcagcaccctcccggtggacgacgcggagcaacgatccccggtggtcgtggacatcgccaccggagcggtcagggccgaccggtacgaggtgacgccgttcgctgacttcgccggctacggcctcttcctctacaacgccgacggcgcggacacggacctggagaactacaaggtggtcgcctaccggcacgcccggtgagctgaccgggccgagcgaggtgcagccgacctccatgcacgcctcggtgacggtccgggcgtgcaccccagcaacgccttcgcccgctcgatgtggcggtcatcaggtagctgtaggacgtctcgccgtgcggcggggaactggcgggcgaagtgtgcgggcgacacagggcggcccgcaccgtggcgggcacgtcgagcggttcggcgtactcgcggtccatgaggtcgcgggcgcggcgcgaccgagcgagatcctccggtgtcatccgcggagcatacggcccgtgactcccggaggggcgctcagcgcctcgtctcgtacctggtcaggatcacgccgcagggaaacgtccgcgtctccaccaggttcaggttcacccagctgttcagcccggtgaagaacggcgtgccgccgcccaccaggaccggcgcggtggccagcacgtactcgtcaatcagcccggcccgcatggccgccccggcgagggtcgcgccgccgatgtccatcgggccgccgtcctcggccttgagccggctgatctcggcgaccgcgtcgtcggcgaccaggcgggtgttccagtcgaccttgtcgatcgtcgaggagaacaccaccttcgacatgtcccgccagcggcgcgcgaactcgatctccgccggggtggcgttgggctgctggtcgccggtcggccagtaggagctcatcgtctgccacagcttgcgcccgtacagcgacaggtcggtcgcctgcaactggtcggaccagaactggaacagctcgtcgctcggcacgctccagccgatgtcgtcgccgggcgcggcgatgtagccgtccaggctcaggttcatgccgtagatcaatttccgcacggtgccagccctccgtgagtcggtctcacgcgtacagaccggcgcggcgcgggaaactcatcggtgcgcgatctcagctcgtctgcagtcctcgtgctcggtggctcagccccagactcatcgttccgccgaggaaatggcatagatccgagactgatctcggggacatcgcggtgagacaacagagaaccggcaggccacagaagatcgaaagatcgacacgtcatcggcggcgagaccgtacagcacctccacccgaggagccctctcctcccccagcatccagcagccgacggccacgggaggtaccggatctgtcccacggcgctggcctgtcctggtctgcttcatggccgacccggccgtcgccgtggtcgggccgtgctcaggcgacgaccgcggccgtcccagctccggccggcggaagccggtgaccgcgccacggcatgtacgtcctcgtgctcgccgttctcccttgatcactggggtcagctcatgcagcgcgggcggccactctccctgggatgcggtgcccctcgccgatcgccacgaacgcctggcaggggccggctggtggactgatcacgtgactgtgacgttccatcgaggctcatgaggggtttccgggcgcagcttcagtgcgcccgtccccttcttcgccctggggcctgctgtcagccgtatgcggaggtcttgtcggagtgctgtccgtagacgttctgatagcggtcgaagagctggccgatgtccgacggtgcgatggcgaccggctcacccagctgccgcgcgatgtggactgtgcgtgcgacgtcctcacacatcacagcggctttgaccgcgtccttcgcatccgtgccaatggtgaaaacgccgtggttctgcatgaggacggcgcgtgacgcatgcccggtgagtgtctgcacgatgcctcggccgatcgagtcgtccccgatgagtgcgaagggcccgacggggatggggccgccgaactcatcggccatggccgtgatcacgcaggggatctcctcggcacgggaggcccaagcggtggcgtacgtcgagtgggtgtggaccacaccgccgacgtccggcatgttgcggtagacgtaggcgtgtgcggccgtgtccgagctcggggcatgcgtatttccccacccgtcggccggaagaccgtcgagggtgcagacgacctggttctgcggagtgaggtcctccgaagcgacgccggagggcttgatgacgaagaggtccgcgccgggcacccgtgcggagacgttcccgcctgtccagaccaccaggctgtagcggacgagttctccgtgcaggcgtgcgacctgttcgcgggtcgccgtcacggccgtgtggacgtcggtggtcatggtggtcatcgggcagtctccttgtggttgtcgctgagatccggtgttgcctcggcggcggcccgttgaagagccagccccttgcggtaccggtccaggtagtcggcgaagccggtgacgtcccgcgggctcggctccaggacgcgtgtggcggagttcttggactcgtgctcggccaggaactccgccaggctcaggcgatcggcgtgttccaggtaggaggccaggacggcgatgccccaggcgccaccctcaccggcggtacgctccgtggccacagggactcccagcgcggccgcgaggacttgctgagcagcgccgggagtacggaagagcccgccgtgggcgagcatccggtcgacctgcacgtcctcctgcgccaggatcgccatgccgagcgacagggtggcaaaggccccgagcagttcggcgcggaccaggttgccgagagtgaaccggctcgtcggcgtccgcagcagcaggggccggccctcggtcacgcgggtgaggggttcaccggcgaggtagttgtacgagagcactccccccgcgtcggggtcggcgagggcggcctccccgagcagggtggagtacaccgtgtcgatttccacggggttcccgcaggcttcggcgaagcgttggaagatccttgcccaggccccgatctcgttcgccccgttgttgcagtgcaccatcgccaccggatcgccggcgggagtcgtcaggagatcaatctcctcgtggcgaccgccgagctcgtgttccaggaccaccatcgcgaagatgctggtgcccacgctcacgttgccggtccgcggggagaccgtgttggtcgcgaccatgccggtgccggcgtcaccttccggtgggcacagcgggatgccgtggcgcagggtcccgctgggatcgaggagtgccgccccggcaggggtcaggctcccggcatcctgtccggcgaccagcacgtcggggagcaggtcagccagttgcaggtcgtccctgccggcgtcgaggaggtgctgggcggccgcgagcctggcgcggtcgtagtcgcgggtcgtcgggtcgaccgggaacattcccgacgcgtcaccgacaccgagcacgttccgtccggtgagcctgcggtgcacgtagccggcgagcgtggtgaggccgtcgaggtccgcgagatgcggttcctcctccaggacggcctggtagaggtgcgcgacggaccagcgcagcgggacggcgaagtccagcgcctcggtgagggcggccgcggccggcccggtggaggtgtcacgccacgtccggaagggcaccagcagccgctcggagcggtcgaaggcaaagtagccgtgcatcatcgccgagacaccgatcgcccggaacgcagtggggcggaccgagaacttcgtctccagaccgttgagcagagcggcgtacgcgtggcgcagcccctcttcgatcgcgtcgagcgagtaggtccagtggccgtcgaccatctcgctctgccactcgtgggtgcccgtggccatctgaaggtgacggtcgtcgatcacgcacatcttgatccgggtggagccgagctcgattcccagcgcagcccgcccctcggcgagcaggcgcctggagtcctctagggtcgtcatcgggcttcctctctggcgctgagtcggcgttgagcagcgctgaacgaggaacctaactctataggatctgacgtcgcaatcccggcttaccgtggccatcaccacccgcgctcgggtattgaccttgaatcctatagattctagtcttgcggcgtcgatgctgccgggcggcttccgctccggttggtcacggcgaatcgtctgcttgtcgggcctcgacccgacagcgctccgtcccggcgacgtggctggcacgccttgtgctcacagcgacgtgcccccgcagcaatgcacgatcaacggagatttgcatgatgtcctcaacccgggctgtcccccgctccactgtccggcgcgtcgtcgtcgcgacctcgatcggcacagtcatcgagtacttcgacttcgccctctacggcgctgccacagcgctcgtcttcggaccgctgttcttcccgaacgagaacccggtgatcagcaccatggcgtccttcggtgttttcgccgcggcgttcgtggtccgcccgatcgggggagtcatcgccagcaacatcggcgaccggatcgggcgcaggcccatcctcatcgccaccatcaccctcatgggcctggcgactgtcatcacgggcctcctgccgacctacgagtcgatcggcgtctgggcacccatccttctgatctgcacacgcgtcctgcagggactgggagccggcgccgagtacgcgggcgccgcgaccatggtgagtgagtacgctccgcgcaagcacatggcgttcctgaccagcttcgggcaggcgtcacagggcctggccctggcctccgcgacggggctcttcgccctgctgagcctgttgccgcggcacacgctgcacgactgggcctggcgcatccccttcctggccagctcgatcatcttcgtcgtcgcgatctacatccgccggcacgtcgaggagaccccggagttcaacaaggaacacgacctggagaagcactccgacagggcggcggtcaaggtcccggtgctcgaggccttgcgccaggtgccgggccgtgtggtcgccggtctgctctgcggttccggcatcaacgtctcgggctacctcatcaacaccttcgccatcagctacgtcgtgaacgacctcggtatgtcagcactcaccggcacggtcgccgtggtctgcggtaccgggctggcggtcttcacgatcccgctcttcggagctctcgcggaccgggtcggcgtccccaagctcttcgtggcctcggccgtggcgatgatgatctacatcgtcccgatgttcgccatgatccgcagcgagcggccaggtctggtgatcctggccctgacgctcggatacggcgtggtgcaggccggagcgctcgcctgccaggcggcgttcatggccgacctcttcccgacccattaccggttctccggcatcgcgatcggccgcgagctgaacgtggccctgctggggggcaccacccccctcatcgcgacggcgctcatctccagcggcgacggatcgcccacgccggtcatcgccttcgtcgtggcggtgcaggtcctcaccgtgatcggagtgatctggggaaccgtcctgcgcggacgcaagagccacgaggaactggccgccaagacctacggcctcacagacgtccctcagtcggacacggctgcggaacgctccacagtgaaaggaatccactcctgatgcgcaccgctgagaactggcccatcgcggcaaacctgggacagatcggtaaccagtccaaggacggggggcacatcagggacgcccccgccgcggaatgggccggcaccctgcgcgccctgcgcaagctgggcatcgaccagatcgacccgacggacatgtgggttccgctgtcggaactgtccgatgtccggctcaaggagttcaagcaggtcctggaggacgaaggcctgaccatgccggccatctccctgaccaggtactccatcgtcaatccggcgcgcggcgaggacaacttggcccgggctcaccgctacctcgacctcgcccccgaactgggtgccgcagtggtgaacctcggcttcatggaagccctgaagcccgcccagctcgaggcgctgtggttctggctcgccgacgggcaccgagacgacccggaactgcgtccgcaggccgtcgagcgggtccgtgaactcgccgagcacgcgcagcgcaacgggctgcagctcagccttgagctgtacgaggacaccttcctcgggacggtggacgaggccgtcgccttcgtgcacgacgtcgaccacccgtccgtcgggctcaatcccgacctcggcaacttcgtccgcctccaccaggagatcgaggacgtgtacgccatgttcgacaaggtgctgccgctgtcgaacttctggcacatcaagaactactcgcgtgactacgacccggcgacgggggcctacgcgaccgccccgacccctctgaagtacgggttcatcaactaccgcaaggtcatcggccgcgcgctcgaactcgggttcgacggtgcgttctgctgcgagcactacgggtccgactcgctcggtgtcgtcgcggagaacatcgcgtacgtccgcgatgtgctgaactactggacgtgatctcgtgacatacgtcgtcaacctgtccaccctctacggtgcgctgccgctgaccgaacgcgcggccgctgccgcagccgacgggcaccacgaggtggaatcgtggtgggacttcgactccgcggtcccgccccgtgcagaggtcgaggctttcgcggcgtcgatcgaggcggcaggcgtacggttggtcgccctgaactcgcacggcggcgaccgcgcggccggcgagcgcggtctcgcctcgctgcccgaccggcagaccgagttccgggacagcatcgccagtgtcgccgcagtcgccgagcggctcggtgtgcgtctgttcaacgtggccatgggcaaccgggacacccggttttgcgaggccgatcagcgggcagtcgccgccgagaactaccggcacgcgtgcaccgtgctcgcgggagtcggggggacggtgctgatcgaacccctcaccgccgaggccaatccgggctatccgttccgcaccggctacgacgtggtggacttcctcgaggaagccggtctgacggaacggaacgccggtctcctcttcgacaccttccacctcgtcagcaacggggtcgacctcaccacggggtggcgcgacctctgcccgcacgtcaggcacatccagctcgccgacgcccccgggaggggagcgccgggcaccggcacgatcgacttctcggcattcctcgccgaggtcgaggcctccggctacgccggcgacatcagcctcgaatacctgccccgatagaccgcacgaccaccagaggacagcagcatgcgcgcaatcatcaagccccaggccggccccggcgccgagttcgtgaaggacttcaaggaaccgacggtggggaagaacgacatcctcctggagatcaaggcggcttcggtctgcgggtcggaccgagagttctacgaatggggcgaggctgccaagaacttccccatgcagttcccgcgcgttctgggccacgaaggatccggagtggtgctggaggtcgggcccgcagtcacccgggtcaaggtcggcgaccgcgtcgcgctggactcccacgcggcctgcggcaactgtttcatgtgcagcactgggcggccgagcaactgcatggatatgaggctgctggccaacgacatggacggagtcttcgccgagcgagtggcggtccccgagagcctggcgttcaagatcccggactccatgtccttcgagaccgcgaccctcctggagccctccggcgtggcgtggcacgccatccagcgcagcggcaaggacatccccgccaacgctgtcctggtctcgggctgcggccccatcggcctgctgatcatcaagttcgctctgatgctgggagcgaccgaggtcatcgcgatcgagcccaacgcctaccggcgcaagctcgccgaggagatcggcgccacgaccttcgtgcccggcgcggaagtgctggagtacgtccggtcgaagcacgcgcaccgaggtggagtcgacatcgccttcgaggtctccggcgtggcagcggcctaccctgccctcttcgacgcggtccgccgcaatgggcaggtcatctccgtcggacacgcgggaacaccgatctcgctcaacatctcgcagtacatcaacaagaaggagatcaccctccgcggcatctacggccgtgcgctctgggacacctgggaggagatttcctccctcatcgaggcgggccggatcgatcttgaatggctgatcacgcaccggatgcccctcggtgagctcggcccggtcatcgacctgctgagcggcgaggcgaacaaggtcatcatgtaccccggccagaccgcctgagccaccgcagtcaccactcagccccagggcgggctctggccccaggagtacgacagggttgtgaaaggatgggccagggccttcgggcgccagcccatcggctgcgttcggggcggtgggccgggaagttcttcgaggagcacatggtgggcaagcgtcaagtccttcgggacgaggttcacactctgatccttgagcaactgaccgaaggacggtggcagcccggtgagcggctcagcatcgaaggccttgcccgcgaactcgatgtgtccgcgacccccgtccgcgaagtcctcgcgtcactcgaacagtccgggctgatcaaataccacgctcaccgcggttacgtcgtcgccccgttcctcagcgctgagcagttcagtgaactcatcgacgcgcgacagcttctggagtgtgacgcgctcagccgctccttcggccagtggagctcgctcgtcgaggacctccgcgcctgccacgccgtgcacgccgagtcagtggaggcactccggcgggaaccggaggccgaataccccgccgtcctccactacttcaacgccgacgccgagttccacagcgccttcttccggcacgcccagaaccggtacctcgtcgacatgcgcaagagtctcgtctgggacgcacaccgaatgcggcagacgctgtcggagcgggccgaaagggtggacgcggaagaagccctccaggagcatgcacggattctggcgaaagtcgaagagcgcaatcacgacggcgcactcaacgccctccgccagcacctcgaaaacgtgcggcagcgctcagccggcaccgcccggaagtgagcctcccggcgggaccgaagccgtgcgtgcgcatctgctccgggacgccgtcgatcaacgagtgcgagaaccagcacgccggtggccgtgctcagcccggtgacgaggtcggcacgcagcccgccggcgagctgcgggtggctctcgtcgccgaacagcgactacagcccgccgaacgcgtgcccgatcgtgtcacaggcgggccggttcgccagcgggccggtggggccgaagccggtgaccgaaccgtagacgaggtccgggcgcagagtccggcagtcatggggccccaggcccatcgcggcggccttgccggtcggaggttctccagcaccacgtcgaagcgcgggaccagcgccttcaccagcctgatcccctcctcggccttgaggtcgaccgacagactgcgcttgcgcgcgttgtactggcggaagtacgggctctggtcgttcatccggcgacggtagtcctcaatctggtgcagccaagcgttgactccgctgacgcgatggctcggcgccctcgatgcggccggctcaggggagccgggtggccttccggatccgccgtatcaggagcgctgtccgcgggtcgggctgccgggtccgggagaggaacgcccgggcgacgccgcgggcggtggtgcgcagggccgtcaggaggtccgacggcgtggtggagaacgggaccgtgacggacagcgcggcgaaggcggtgccgtcgtccgcgaggaccgggacggcgatcccggtggcgtcgggagacaaccagcctcgcgcgatcgcgtatccgaggcggcgcgtctcgcgcacggcccgcttcagttcctcgcggtcggccacggtgtgctcggtgaaccgggtgatcttggcggtttcgaggatgtggtcgcgcaccagcggctgcgcgaacgcgacgagggcgagaccgggggacgaggacagcgcgggcagccggacgccgggctgcgtgacattcgtggcacccggcggccgcggcgacaaggtgtcgacgttcagcacgtcgtcgtggtcgaggacggacagcagcgtgggcgcgtcgaccaccgcgcgcaggtcctccaggaacgggcgcgcgatctcgcggagcgtgagcgcgccggaggaccgggccacgatctcccacagtcgcattccgatccggagccggcggtctccatcacggtcgaggatgcccagatcgacgagttcggacacgatgcggtgcgcggacggcaccgggataccggtccgccgcgcgacatcggatgccgtcagcgacccgtcggcgcccctgaacgtctcgagcacgcgcaccacgcgttcgatcatcgactcgccacgcggggacattctcccggtcctccctccggccgagcggactcttccctggctggttcacggggacgtcatccgacggggcgcccccgctccggcccccgcgagcccccggccgccgtcggctcactcgtcgacccaggtcaccacctcgtccagcggggcccgtgcggtgcggtagctgttcgcggggtggtcggagtcggcatagccgaacgcgatcccgaccaggatcctgcgatcgtccgggacggcgaagtggcggcggatcagggctgcgtgcccggccagcgcggcctgcgggaccgcgcccagcccgaggctgcgggccgcgagcaggaaggtgccgacgtagagcccgctgtccaccgcgccgtacacgtcgtgcaccgcgtcggtggtcacgatcgccacgtgcggcgcgccgaagaagcggaagttctccagcgcctggcgggccgaagccgcccggtcgccgcgcgtcacgccgactgcctcgtacagctgccacccgctcgcgcggcgtcgctcccggtacacgccccggtactcgcctggcgggtcgaagtcgaactcggggctgtgctcgcgcgcccaggcggtcatcgcgtcccggaagcgttcggtgccttcgccgctggtcacgatcacctcccagggctgcgtgttgcaccaggacgcggagcgctgcgcgagcgtcagcagccgttcgacgaccggcttggggacctgccgctcctggaaggcgcggcaactccaccgcgtggtcaagaggtgctcgagcacggcggcttcgtgcgccggctcggcggtgatgtcggctgacggcgtcatgaacatagcgtagtcctaatataaaatattttgcgccctgcggcctacggccacgtcagcactcgatgccccccttgccccgggtctgctgatcgaactcgccgtggtcgacgtgcgcggccgctgtggagaaggtcagatccgcagcagtgccgcgaattcggtcgccggctggtcgaggtcgccggcggtgatggcctgcagcagggcggcggcgcgctcctcgctgagcgcggaggcggtcacgtcgcggaacttcgcgtccaggtcctcctgcgacatcgggttctcggcggtgccggtgggatcgtcgacgaagacactgtccgtgctgccgtcctggtaggtcaccgtgatgtcggcgacccagcggcccggacagtcctcgtccagctccggcttgacctcgatcttcaccttccgcgccagcgcggcgacgtcgctgccctccccgatgtcgagctgcccggccaggtacgcctggtgggtggcgaagccgttgccgcggcccagcatcgacagcgcgaactggaacggcaggctgtactgcaggtgctcgatgttccccggggcataggcatgcgcgttctgggtgccgatcaccacgtcgccgccggtctggatgcccagcagcaccgagtcgacctccgcggcccgcgcggagagccggcgcgccccgtcgatgtacgcgtggttgatgccgcagcagcagtacggcttcacccacacgcgggtgatctcgtaggtctggtcgagcgcgaagttcgccgcggcgacgtcgtcgaccgggcggccggcgaacgtgcggaagaagcccttgccgccggtgaggaaaccgatcggaccggtgatgccggcggcggccatctgcgccgcccggataccgttgcgggtgccgatgccggagtgcacacgtttgatcgaaccacccgacgagctgtactcggtggtgcccgaggcgtggctgagcgcgatggacagggcgtgcgcggtggtgtcgaggtcgaacccgcgcatcttggcgaccaccgcggcggcaccgaaggccgacagcaggccgtgcgggtggaaaccgcgcacgagcaggtcggggttggccagggtgccgatccgggtgtaggcctcgtagcccgcgacgatgccggtgatcacctcgcgcatcgtggcgccgagttcctcgccgacggcgagcgcggccgacaccacgcagctgcccggatgcgacgagctcgcgcggtgcgcgtcgtcgtactcgaagccgtggccgaacgtcgcgttgacgaaggcggcgtccgcggcgctcatcgcgtcgccgctcgcggtcacgtgcgcggcgcccggaacgtgcgcggcgcgggtcatctccagcacggcctggctccacggcagcgccgcactgccgacctgcagcgccagctggtcctgcatcagccggcgcgcaccggccagcgcctcggcggggatcacgtcgaacgtgagctcggtgacaagccgagcgaccgcttcttcgaccggggggaggttgcccacgatggtccgcctttcggaggttgggtcaggagagggagccgagggcctcggcaggcagcccgtaggacttgagctcgacgtaggcgtcgaagccctcgggacctgcttcacggccgatgccgctgttcttgaagccgccgatcggtgcggtgaaacccgcggggttgccgttgacctcgacggtaccggtgcggatctgccgggcgaccgacaacgcgtgctcggtgtcggcggcgaacacggacccgttgaggccgtattcggagttgttggcgatgtcgatcgcctcgtcctcggtgtcaaacgtgtgcacggtgaggaccggcccgaagatctcctcctgggcgatcttcgcgttcgggtccacgtcggtgaagaccgtgggcgcgacgtaccagccgcgctccagtccctccggacggccgccgccgaccagcagcgaggcgcccgaggccttgccgtcggcgacgtagccctcgacgcgggtgcgctgggtcgcgctggccatcgggccgatctcggtggccggatcgaaggggtcgcccaccggcatggacttgatcaggtccacgaggcggtcgtgcagttcgtcccgccgggagcgggccaccacgatgcgcgtcttgttgctgcacacctggccgctgttgcgcagcgagaccgcgcggacggcggcgatcgcggtgtcgaggtcggcgtcggcgagcagtacggcggccgacttgccgcccagttcgagcgtgacgcgtcgcagatcctgaccgcacagggaagcgatgcgccggcccgcagccgtggaaccggtgaacgacaccttgtcgacaccgcggtggcgtacgagatactcgctgacctcgcgctgggcgggaacgatgttcacgacgccctcgggcagaccggacttctcgagcaggtggccgagcagatacgcgtcgagcggagtctccggggagggcttgatgatcatggtgcaccccgcgagcaacgccggagcgagcttgatcatggtgatgagcaacggcgcgttccacggcacgatgcccgcgactaccccgacgggctcccgggtgaccagcgcgcttccggtcaccgactgccgggtggcggaccacggataggtgggggccaggtcgaggaaggcgtccagcagcagccgcggaccggcggactgcatcttcgtcgacagcgtgatcgggcagcccatttcggcgctgaccagccgtgccgcgtcggcctcgtgcgcggcgagttcggcgctgagcctgccgagggtcgcgatgcgctcctccagcggcagccggggccacggccccttgtcgaacgcttcccgggccgcggccaccgctgcgtcgacgtcggcctcgacaccctccggcacccgggtcagcagttcctccgtcgccggcgagatcacttcgaagacgcggtcggaggccggccgcacccaccggccgccgatgaagagcttgtcgtaggggccccgccaaaggcctgtgtgggcactcatcgtgtcgctccttggtccgcctcggctgcgggaccgaagccatggctcgacgctgaaaatataaaattttccggagcacgggaagacttcttctcgatagccgagaaagtcctgtccggcggactgcgcatggtcgggcgcggcgagcacaccgacgcgggtgcggacctcgtacccgcggctggacacctgggacggacccggcttgccacgggatccgtgcgtccgacacatgcatcttcatggcggccgacaagcccggtgagcgcgtccgtcaactggcgagactggttcgccgggtggtgcacatgacgtcaggcgaaatcccagccaggaagtgctcaggacgttgcccgcccgcatctcatcgtggctccgccgggggccgatgctgcccctctttcgccctgcggggtggtcgccttgacgaccaccccgcaggatggtggtagcccgccgttccgcgcctaccggccgtctcctacagcaagtcgcagccgccgcccggccgttgtcctcacacggccgtcgcctttctgtgcctagaggttttccttgaagaacggtgtgatcttctcgaatgcctggttgacggcgtcgggcttgtcgtacaggtcgtagtggctgacgcccttgacgaccaggatgtccttcttctcggagcgggcccggttgaagagctcgaagccgtcccggtaggagccgaaggcacccggcacgtcaccgacgatgacctgcaggggctgcgtgagcagcacctcggccaggtggaaggcgtcgaagccgaccgccgccccgagcccggagaagcgcagcttgttcggcgagttggggtgctgtccccggggcgtgcggtagtactcgactgcgttgacgaggtcgatgtccgtgagcccggccttctcccgctcgtcgggagaatcgggggcgtaggtggtgatcagcggttccgcgccgcgtgcctccgccgtgcgctgcctgccgatcgcctcgagggtctcgacggccgcgtcgggtgtcaggttgccctcgcgcatgagccggccgtagttggcggcgacgacggtgacgagtgccttgatgcggtgctcggtcatcgtggcgttgacggcgtagccgcctccgccgcagatgccgagggcgccgatgcggtcctcgtcgacgtagtcgagggtcacgaggtagtccacggcgcatcggaagtcctcgacgcgggtggcggggtcctcgagatggcggggctcaccgccgctctgtccctggtgcgaggcgtcgaacgcgagggtcacatagccctgcgcggtcagccgttcggcgtagatgctgccggaggtctgctccttgcagctgctgatcgggtgggcgcagatgatcgccgggtacttcttcgccgggtcgaagccttccggcaggcgaagatctgccgcgacgtcccaggtccggttcttgaaacgtaccgattccatttttctgctctcctcgttctccggtccgccgtgcggtggcagcggcgggtccgggcggctcaggcggtgaggtgggtgcggaagaagccggtgagcttggcgacggcgggggtgacgtgctcgtccttgtcgtacagcgagacgtgggtggcgccgtcgacgaagaagagttccttgggttccttcgcctgctcgatcgcctcgcggctgaagtaggcggtgtccgcctcggagccgacgatcatcagcagcgggcgcggtgcgatgagctcgatcatcgcgaaggggtcgaactgggcgatgtggtcgatgctgcgcagcggccactcgttggtggagttgcagtgcccgccgcgcggggtgcggtagtagtcctgcgcctctcggtacagggtaggggcctccgccaggccctcggggctctcgggggcccagttcagaacggccggtgccgcgcccttggcttcggctgtgcgcagggcgccggcctggtcgagcagggactgcaggacctcggggccctgagtgcggccgaggccctcgaccagcaggctgcggatgtccacggcgctgacggcggcgacggccttgatccggtggtcggtctgggcggcgaagggcacgtagccgccggaggcgcagatgccgagggcgccgatgcggttcgggtcgatgtcgtcgcgggtggtgaggtgggtgacggcggcgcggacgtcctcggcccgctggaaggggttctccaggccgcgcggggtgccctcgctctcgccctggtaggccgcgtcgaagacgagcgcggcgaagccctcacgggccaggcgctcggcgtagatgctcgccgtctgctccttcacacccccgcccgggtgggagacgaccaccgccggcaggggttcgccggtgtggccgtcgggggtgaagaggatgccggccagagacaggccggcgctggggaaggtgacgttggccttcatgtgctcaggtgtttccttggttcagctgggggatggctgtcagggcgcggagtccggggcagccctggagagggcttctgcagccggctccggcggccacaccaggaaggtttccacgctccgtgtgccggcaaaatgggcggattccagcccgggacagcactgtcctgggacagggctgtcccccctgacagtcgtggtgtccactgcgacacaggctgcatgagcagcgacgcgcaccgcaacgagctgggctgccttcctcaaggcccgccgcagggaaactcagccggtgctcgtcacccgggtgcaggcgcccgcccgagagcgctgaccggctgagggccgccggccctcatgggtgcgactcatggcgcggccccatcgcctcgaatgtcagcctcagtcgctcccggcgccaggccggcagctggcccgtctacgcatggctcttccttcaggtgccgcccagcaccaccgacaccatcagcaggagcggtatgacgtgccgtgagggttcaatcggcgacgcagcgtcagtatcccgatgtctgggtcaacgacacggccgacggcgacggcccggtcggggacgcctgtccaccggtgcagaccgagacacgggtggcgatctgcgtcctgttgaccactcccagcttggacatgatgttgtcgacgtgcttctccgcggtgcgtacggagatgaccagtcgcgacgcgatctcacggttggtcaggccctcggccaccaactcgctgacctcgcgctcccgcctggtcagcgggtcggcctcccgctccggcgcgtcttcggtgggatcccggatctcgtcgagtgcccaggagaccgccgcatcgggggacatcgccgcaccggacgcataggcgctgccgaagcgctgcgccgtcacgcgccggcgagcgtcgtcctcacccttgaggtgatacgcccacaactgcggaataccctccaacggcatgcccacggtccgcagcagcgcgtccgccgcgcccagcaggagcgccgcccgctccgcctcgccgtcggacgcggcgatccaggacatcgcctccaggcacacgcccataccgagcctgtcgtcgagccggcgcttgagccgaaggctctcccgctccagttcggcggccgtgacggtgtcgccctggcgccacctctcgacgccgtacgcccacagggagtacgaatgccaccacgactcccccaccgccgacgtcccccgccggcagcggcgatgccatgccgaggcgcgccggctctccccggcgaaactcagcgcgagacccacctcgaacgtggagtggatctcgcccgtgcggtgccccagccgcgcgaactcggccacggatgcttcgaggcgctcggtggcgaagcccaggtcgccttggaacaacgccagcagtccccaggtctgtcgggcgaaggcccccagcagcgcgtcacctgtcccggcggcgataccgtcagcctcctccagcagcgccgccgccacgtcgtagtcgctctgcaggatggccatccacgcgctcagcctgacggcacgcccccggtccgcggtcggctcggcagccgcggcgagcaactggccgagccagtgccgggcctcgctgaggaagccgcgggcgagccagaagttctcgatcgagcaggccagccgcatcccgctgtggggatcctcggccagacaggagtgcagtgccgcgcgcaggttcgcgtactccccgcgcagccgttccagccactcgatctgacgcggtcccgaccagtcggcgtcggcctgctcggccagtgccacgaaccactcccggtgccgtcggctcagggcggccgactcggcctcgtccagccgctcggcgccgtactgccggatggtctcgagcatgtggtaccgcggctggttggagtccatgaccctcgtgaggatcgacttgtccaccagcccggcgaccaggtcgaacaccgactcgcgggcgatgtcgccctcggacgcgacggcttcggcggcgtcgagcccgaagtctccctggaacacggacagccggctccacaacgtctgttcggccggcgagcacagctcgaaggtccagtcgatcgacgcccgcagcgtctggtgccgggcaggtgccgtacggctgccctgggtcagcaactggtaccggtcgcccatgcgggtcaccagctcgggcaggggcagcacgcggagccggaccgccgcgagctggatcgccagcgggatcccgtcgagcagccggcacaactcggcgacctggacctcgttctgcggggtcagcgcgaacccgggtaccgcggcgcaggcgcggtcgacgaagagactgaccgcctcgctctcggcgatcacctcctgtgtgagcgcgtgctgcgggtcgggcgtcgacaacggtggcacggggaccgccgcctcgccgtcgatgttcagcgcccggcggctggtcgccagaatcgtcactcgctcgcaccggcgcagcagcgcgtcggccaggcttgcggcctcctcgaccaggtgctcgcagttgtcgagcaccagcagcatgtgctggtcccgcaggtgcgccacgagggtgtccagctgccagtgtgccgaggtctcacggatcccgactgcggtgttgaccgtgtgacccagcagtgccggatcctgcaggtccgcgaacccgatgaaccgtacgccgtctgcgaacacccgtgagagttctccggccagtcgcacggcgagtcgggtcttgcccactcccccggtccccgtcagggtgacgaggcgcgccccctccagcgcacggcgcgtgagcgccagttcccgtcggcgaccgatgaaccgcgtgagctccagcggcagcgctcccgcgttctcggacgtgccgctctcggctcctggataccggaccacgccggtagtttccatcaccttgtcgcgcatcgcgatgctcgtgcagtgaccatcacgttgcgtcgctgtgccgccggttctcagcaccctgcgtggcgtcgttccgagtgcgatcgatccctcagtcaggggagagcagcaggcccccggggccgaccgccacgtgcgccgcgtccgcggccgtcggcgggggcccacggggagcgaccggtgcggcgtctgccctggtgaacggcgccggctccgcccagggcggggccgggcggccaggacacagccggccgtaccgccgacgacgccgacgacgcagtcgtatgtggacacggccggcacctcagagcgagaccacgacggtcttcagttccaggtactcgtccaggttctccttgcaggtctcccgtccccacccggactgcttgtacccgccgaacggcagggctgcgtcgacggcctgatagcagttcacccagacctggccggattcgagtgcggccgcga

SEQ ID NO: 148 - DNA, 7012 bp, Unknown
  Kingdom: Bacteria, Phylum: Actinobacteria, Class: Actinobacteria, Order: Streptomycetales, Family: Streptomycetaceae, Genus: Streptomyces
ggtgagctgctgggcggcggccaccgggaccaccatgagcgcggagacgagcagcagcccgaccacgcgcatcgcgaccgtcaccgtcaccgccgccgtgacggcggtcagcaggttcagcgcgcgcaccggcagtcctgtcacccgggcgaactcctcgtcctggctgaccgcgaacaactggcggcgcaggcccagcgtgacgaggaccacgaaggccgccagcaggcagatcgccacgacgtcggactgcgagaccgtggagagcgagccgaagaggtacgaggtcaggttggcgttggaaccgccgggggcgaggttgatgaacatgacaccgcccgccatgccgccgtagaagagcatcgcgagggcgatgtcgccgcgggtgcggccgtaccagcggatcagctccatcaggatggcgccgagcacggagacggccgtcgccatccacaccggggaggcggacagcaggaagccgaggccgacgccggtcatcgcgacgtggccgatgccgtcgcccatgagggcctggcggcgctggacgaggtagatgccgacggcgggcgcggtgatgccgaccagcacggcggccagcagcgcccgctgcatgaaggcgtagtcgaggaggtccatcagctcagcagtcccgtacggatcggcgcggcgcctgcggcggcgtcgtgcgggtggacgtggtcgtggcccggcagggcatgctgccccagggccttcgggggcgggccgtcgtgctggacgcagccgtcgcgcaggacgaccgcgcggtcgatcagcggctccagcgggcccagctcgtgcagcaccagcagcaccgtcgtaccggcggcgacctgcttctccagcgtcccggccagcacctcctggctggccaggtcgacgcccgccatcggctcgtccatgatcagcagctcgggagcggcggcgagcgcgcgggcgatcagtacccgctggtgctggccgccggagagggcgtcgaccgagtccttggcgcggtccgccatgccgaccaggtccagcgcgcggcgcacggcctcccggtcggccgcgcggaagacgccgaagcgggtgcgggagagccggccggaggagacgatctcggtgaccgtcgccgggacgccgcccgcggcggtggtgcgctgcggtacgtagccgacgcgcgcccagtcgcggaagcggcggcgcggggtgccgaacagctcgatctcgccgccgctgagcggcacctgtccgatgatgctgcgcaccgccgtcgacttgccggagccgttggcgccgagcagcgcgacgacctcgccgcggcgcacggtgacgtcgatgccgcgcaggacggggcgcgcgccgaggtcggccctgacccggcgcagggctatgacgggttcgccggtggtccccatggtctgcatggtctgctccctggtgtcggtcactgggcgcccagggcctgctggagtgccttgaggttggcctcctggaccgcgaggtagtcggtgccccgggacttgtcggtgatgccctcgatcgggtccagcacgtcggtcttcagcccggcgtcccgcgcgacggtcctggcggtcttgtcgctgacgagggtctcgtagaagacggtggtgacgccgtcggccttcgccatcttctccaggtccctgacccgggcggcgctgggctcggagtccgggtcgaggccgttgatggcctcctcggtcaggccgtagcgctcggcgaggtagccgaaggcggcgtgcgtggtgacgaagaccttggacctggtctgcgcgaggccgtccttgaagcgggtgttcagctcgtcgagctgcttgaccagggccgcggtgttcttgcggtagtcggccgcgtgcccggggtcgcccttctcgaaggccttgccgacgccctcggcgatctgcgcgtagcgcaccgggtcgagccagacgtgcgggtcctcgccgccggactcctcgccctggtgggtgtcgtgcgcggcggcgtggccgccgacctcgttgccgtgctcctccagggtggtcagggcggcggcgtcgatcttggtcttgatctccgactggccgatggccttgtccacggagggctgcaggcccttgaggtagagggcggcgtcggactcctggagccgggcggtctgcttggcgctgatctccaggtcgtgcggctcctggccgggctgggtgaggctcgtgacgtggacgtggtcgccgccgatgcgctcggcgaggaaggccatcggatagaaggacgcgacgacgtcgtacttcccgctgccgccggccgcgtcggcggaggagcaggcggtcagggttccgaggccgagggcgcaggaggcggcgagggcggtcccggatatgaggtgacggcgagcgttcatgacagtcattttcaacagaaatggaaaccgttgtcaacaaaccctcgtcgagggccccgtacggccctgaccgggccgctgtccggcaccgatttgattgaggggcagcccccgccggtaccctgaagcattcgctctgaagcgtctctcgcttctcgaagcgcagccgtcgcttcgtcgcccgtcgtcgtaatgaagagagcaccgtggccgccgacaagatcgacaccatcgtcagcctgagcaagcgccgtggcttcgtattcccctgcagtgagatctacggcggccagcgcgccgcctgggactacgggccgctgggcgtcgagctgaaggagaacctcaagcgccagtggtggcgctacatggtgacgtcgcgcgaggacgtggtcggtatcgactcgtccgtcatcctggccaccgaggtctgggtcgcctccggccacgtcgccaccttcacggacccgctgaccgagtgcaccgcctgtcacaagcggttccgcgcggaccacctggaggaggcctacgaggccaagcacaagcgcctcccggagaacggcctggccgacgtcaactgccccaactgcggcaacaagggccagttcaccgagcccaagcagttctccggcctgctctccacccacctcggccccacccaggacaccggctccgtcgcctacctgcgccccgagaccgcccagggcatcttcaccaacttcgcccaggtgcagaccacctcgcgccgcaagccgccgttcggcatcgcccagatgggcaagtcgttccgcaacgagatcacgccgggcaacttcatcttccgcacccgcgagttcgagcagatggagatggagttcttcgtcaagccgggcgaggacgagaagtggcacgagtactggatggagcagcgctggaactggtacaccggcctcggcctgcgtgaagagaacatgcgctggtacgagcaccccaaggagaagctctcccactactccaagcgcaccgccgacatcgagtaccgcttccagttcggcggcaacgagtggggcgagctggagggtgtcgccaaccgcaccgactacgacctcggcgcccacgccaaggcctccggccaggacctcgcctactacgaccaggaggccggcgagcgctggacgccgtacgtcatcgagcccgcggccggtgtcggccgcgcgatgctggcgttcctgctcgacgcctacgtcgaggacgaggcgcccaacgccaagggcaagatggagaagcgcaccgtgctgcgcctcgaccaccgcctcgccccggtgaaggccgcggtgctgccgctctcccgcaacccggagctgtccccgaaggccaaggggctcgcccaggcgctgcgccagcactggaacatcgagttcgacgacgccggcgccatcggccgccgctaccgccgccaggacgagatcggcacgccgtactgcgtgacggtcgacttcgacaccctggacgacaacgcggtcaccgtccgcgagcgggactccatgaagcaggagcgggtctccctggaccagatcgagggctacctggccgcccgcctgatcggctgctgacacccttcttccgctgaacgccgtacggccgccggatcatccggcggccgtacggcgtctcgcgttcccggggcggggtctcaacggccctggagcgccttcacgttgtcgccgaaggtccagttcttcgagccgtcccagttgagcgaccaggtcatcaggcccttgagcccgttgccgtagtggctccaggcctgggagaccagcgacggggacaggtagccgccgccggcgcccggctgtgcgggcaggccggggacctgcttgtcgtaggggaccttgaccgtggtgccctgcaccaccaggcccttgttcaggcagtcggtctgcgcggtgaagccctgcaccgtgcccgccgggtaggagtcgcccgagcagccgtacatgctgccgttgtagtactgcatgttcagccaccacaggcggccgttgtcggcgtacttcttgatgaccggcaggtacgcgccccagatcgagccgtaggtgatgctgccgccggtgacgtaggcggtctccggggccatggtcaggccgaagttcgagggcatctgggcgaggacgccgtcgatgatgcggatcaggttggactgcgaggcggagagctggttgatgttcccgctgccggtcagaccggtctcgatgtcgatgtcgatgccgtcgaagttgtacttcttcaggatcggcacgatcgtcgcgacgaaccggtccgccaccgcctgcgagttcaggtcgatgccggccgccgcgccgccgatggagagcaggacggtctgcccggacgccttcgccgcgcacatctcctcgggcgtggccaccttcacgcccgagtccatgccgtcctcccacttggccgtcccgtcggacaggatgaccgggaaggccgcgtcgagcacgttgtagccgtgcgcggcgatacgggagtcggtgaccggggtccagccgaagggcgggtggacgccgttggaggagccgtcccagttctcccagtagccctggagcaccttgccggcgggccgggacttcacggcgcaggtggcggcgtccgccgcggtcggggcggcggaggcggcgggggacgacagggtcagggcgagcggtgcgaggcaggcggtggccagcgcggcggtgagcaggcggggtgtccggcggatccgtcggatcatgtgcggcctcccggtggggtgcggtgaggtggcggggtgtgggggtgcggtgcggcatgcatgtgtcgcagacatgacaggcacgggcgcagacatgacggtcctatggtccagacctttcgtcaagaggcccggaccgctgacgaaaatggcatgacagatattgaaatctgtcatctgtcatgccagtctggtggcatgacgatgcacacccgcaccctcggaaccaccggcccccaggtctccgccctcggcctcggctgcatgggcatgtccgcgctgtacggcgacgcggaccggagcgagtcggtcgccaccgtccacgcggccctcgacgccggcgtgaccctgctcgacaccggcgacttctacgccatgggccacaacgagatgctgatcggcgaggccctgcgcaccgcacccgccgcctcgcgcgaacgggccctgaccagcgtcaagttcggcgccctgcgcgacccggagggcaactggagcggctacgacggccgccccgccgccgtgaagaacttcgccgcctactcgctccagcgcctcggcgtcgaccacatcgacgtctaccggctcgcccgcctcgactcggacgtaccgatcgaggagaccgtcggcgccatcgccgaactggtcgagaaggggtacgtgcgccacatcggcctcagtgaggtcggcgccgacaccatccgccgggccgccgccaccgcgccgatcgccgacctccagatcgagtactcgctgatctcccgcggcgtcgaggaccggatcctgcccgtcacccgcgaactgggcatcgcgatcaccgcgtacggcgtcctgtcgcgcggcctgatctccgggcgcctcacccgcgaccaccgtttcgcccccggcgacttccgcgccttctcgccccgcttccagggggagaacctcgcgcgcaacctggacctcgtcgaggcgctgcggaagatcgccgagggcaagggcgtcacggtcgcgcagaccgccatcgcctgggtgctctcccggggcgaggacatcgtgccgctcatcggcgcccgcacccgtgagcgcctcaccgaggccctgggcgcgctcgacgtcatcctggacgcggcggacctggcggcgatcgaggaggccgtaccggcggacgcggcggccggcacccgctacccggaggcgctgatggcggacctggacagcgagcactgatcgccgtgccggacggccgtttgggtacggtctaggcatgtcacccgctgctgagaccctgaccgccgagcgcatcatcgcggcgacggaggaagtactgcgccgccacggaccggccaaggccaccgtggtggacgtggcccgcgcgctcggggtcagtcacggcagcgtctaccggcacttccgcaccaaggcggcgctgcgggaagcggtgacgaagcggtggctcgaccggacgcacgacgtcctgtccaaggtcgcggccgaggacggactcgctgcgcccgagcggctgcgcgcctggttccaggcgctgttcgaagccaagcgccgcaaggcgggcgacgacccggagctgttcgccacgtactcggtgctggccgcggagaacgtcgcggcggtcgagcagcacgtcgccgagctggccgcccagttgaccgggatcgtcgaggcgggcgtggccgccggtgccttcaccgccgccgacccggcgacgacggcccgcgccctcttccacgccaccggccgcttccacgacccgtgttacgcgggagagtgggagcggccgggtgtccaggaggagttcgacctcctcctggacctgctgctgcgcggtctgcggccctgaggccgcgaacggcgttccgggc

SEQ ID NO: 149 - DNA, 6496 bp, Unknown
  Kingdom: Bacteria, Phylum: Actinobacteria, Class: Actinobacteria, Order: Streptomycetales, Family: Streptomycetaceae, Genus: Streptomyces
gggtacctggccggacgcggctgccggacggccgggtcggccgaccgtaccccgcgccccggcctcggccgacccagccgtccggcagccgcgtccggccaggtaccccgccgcgcccggccctgcgccggtcggcgttcggctcagtggccgttctgggccaggcgcaggaggtggtccgccagggcctggcctcccgtcggattgcggctgatcaggagcagggtgtcgtcgccggcgatggtgccgaggatgtcctggagttcggcctggtcgatggcggacgccaggaactgcgcggcacccggcggggtgcgcaggaccacgaggttcgccgacgcctccgccgagatcagcagctcctgggagagccgccgcatccgctcctccttggcggactcgcccagcggcgcgcgcggggtgcggaagccgccctcgctggggaccgcgtagatgaggtcgccgtcgttgttgcggatcttgaccgcgttcagctcgtcgaggtcgcgcgagagcgtcgcctgcgtgacgctcagcccgtcgtcggccagcagcttcgccaactggctctgcgagcgcaccggttgccggttgaggatgtccacgatccggcggtggcgggcggtgcgggtctgcggcagggcgggcccggcggctgagccgtcactgtgctcgtggtcctgtgcctgactcatggtcgtcgtcccatttctatggatcatccctccccgtcggccccacgggccccgtccaggatgccgggcagtgccccgaggaacgcgtccacgtcgtcgtcgccgaggttcagcggcggcatgagccggataacgtcgggagcgggcgcgttcacgaggaagccggcctcctgggccgcctgttgcgcctgtggcgcgtgcggcccggtgagcacgatacccaggagcaggcccgccccccggacgtggtcgacgagcgggtgacccagggactcgatgccctcgcgcagccgttcgctctgccgcttgacgttgtccagcaggccctcgcccgcgatggtgtccaggacggcgagaccggcggcgcaggcgaccgggttgccgccgaaggtggtgccgtgctggccgggctggagcaggtcggcggcgcggccgaacgcgaccgtcgcgcccagcggcagcccgccgccgagtcccttggcgagggtgacgatgtccggcaggacgccgtcgtgggcctggtactcgaaccagtgcccggtgcggccgatgccggtctgcacctcgtccaggacgagcagcgcgccggtggcggcggtgatggcgcgggccgccttcaggtagccggccggcgggacgacgacgccgttctcgccctggatcggctcgatgaccaccagggccgtgtcctcggtgacggcggcggccagcgcctgcgcgtcgccgtagggcacgtgggtgacgtcgccgggcagcggcaggaagggctcctgcttgccgggctggccggtgagggccagggcgcccatggtgcggccgtggaaaccgccctgggtggcgaccatgtgggtgcgcccggtgagccggccgatcttgaaggcgccctcgttggcctcggcgccggagttgcagaagaacaccttgccgtcgcggccgaagtgctgcagcagccgttcggcgagggcgacgggcggctcggcgacgaacaggttggagacgtggccgagggaggcgatctgccggctcacggcgtcgacgaccgccgggtgcgcgtggccgagcgcgttgaccgcgataccgccgacgaagtcgaggtactgcttgccgtcggcgtcccagagccttgtgccctcaccgcgggccaggggcaggcgcggcgtgccgtagttgttcatcagcgcgccctgccaccgggcggtcagttcggcgttgctcacgactccccctcttcgtccggcacgaccatcgtgccgatgccttcgtccgtgaagatctccagcaggatcgagtgctggacccggccgtcgatgacgcgggcggtgttcaccccgccgcgcacggcgtgcaggcagccctgcatcttcggcaccatgcccgaggacaggtccggcagcagtttctccagctggctagcagtgaggcggctgatcacctcgtcggagttcggccagtcctcgtagaggccctcgacgtcggtgaggaccatgagggtctcggcgcccagtgccgcagcgagtgccgcagccgccgtatcagcattgacgttgtagacatgtccgtcgtcctgggagcgggcgatcgaggagatgaccgggatgcggccgtcggcgagcagggcttcgatcgcgccggtgtcgatcgcggtgatctcgccgacgcgtccgatgtcgaccggttcgccgtcgatctcggggaggtgcttggtggcggtgatggtgtgcgcgtcctcgccggtgaggccgacggcgagcgggccgtgctggttgagcagcccgaccagttcgcgctggacctgcccggccagcaccatccgtacgacgtccatggcgtcctcggtggtgacccgcaggcccgccttgaactcgctgacgatgccgtgcttgtcgagggcggcgctgatctgcgggccgccgccgtgcacgacgaccggcttgagtccggcgtgccgcaggaagacgacgtcctgcgcgaaggccgccttcagctcctcgtcgatcatggcgttgccgccgaacttgatgacgacggtcctgccgtggtggcgggtgagccagggcagggcctcgacgaggatctgggccttgggcagtgccgtgtgtttccgcgtcgtggtcatgaggagtacgcgctgttctcgtggacgtagtcggcggtgaggtcgttggtccagatggtggcggtctcggagccggcggcgaggtcggcgacgatgtggacctcgcggtagcgcatgtcgaccttctcgcggtcctcgccgaccgagccgttcttgcagacccagacgccgttgatggcgacgttgagccggtccggctcgaaggcggcctgggtggtgccgatcgcggacaggacgcggccccagttggggtcctcgccgtggatggcgcacttgaggaggttgttgcgggcgatggagcggcccacctcgactgcgtcggcctcggtcgccgcgcccaccacctcgacctggatgtccttgctggcgccctcggcgtcgccgatgagctggcggccgaggtcggcgcagacctgccgtacggcctcggcgaactcctcgtagccgggcgtcacttcgcaggcgccggaggcgagcagcagcacggtgtcgttggtggacatgcagccgtcggagtcgacgcggtcgaaggtgacctcggtggcggcgcgcagcgccttgtcgaggacgtcggcttcgaggtcggcgtcggtggtgaggacgacgagcatggtggccaggcccggggcgagcatgccggcgcccttggccatgccgccgacggtccagccgtttccggtgacgaccgaggtcttgtggacggtgtcggtggtcttgatggcgatggcggccttctcgccgccgtgctcgctcagcgccgcggcggccgtctcgacgcccgtaagcagcttgtccatcggcagcagggtgccgatcaggccggtggagcagacggcgacctcgacggcgccgactccgagcacgtcggcggccttctcggcggtggcgtgggtgtcctggaagcccttggcgcccgtacaggcgttggcgccaccggagttgaggacgacggcggagagccggccggtcttcaggacctgctcggaccactgcaccggcgcggccttgacgcggttggaggtgaagacgcccgcggcggcgcggcggggcccggtgttgaccacgagggccaggtcggggttgccgttctccttgatcccggctgcgatgcccgcagccgtgaatccctttgcggccgtgacactcacggtgcgactccgatcgtggaaagtccggtggtctcgtcgagtccgagggcgatgttcatgctctgcaccgcgccgccggcggtgcccttggtcaggttgtcgatggcgctgatcacgatgacgcggtgcgcggcgctgtcgtacgccacctgcagctggacggcgttggagccgtggacggcgccggtggcgggccactgcccctcgggcagcacgtggacgaagggctcgtcggcgtacgccttctcgtaggcggcgcgcacggtctcggcggtgacgcccgcgcgggccttggcgctgcacgtggcgaggatgccgcggggcatcggggcgagggtgggcgtgaaggagacggtgaccggctcgccggccgccgcgccgaggttctgcatcatctcgggggtgtgccggtggccgccgccgacgccgtagggggacatggaacccatgacctcggagccgagcaggtggggcttggccgccttgcccgcgccggaggtgccggaggcggcgacgatcaccgcctcgttctcgacgagcgaggccgcgtaggcggggacgagggcgagggagacggcggtcgggtagcaaccgggcaccgcgatgcgcttggacccctccagggctgcgcggccacccggaagttcgggcaggccgtacggccaggtgccggcgtgcggggagccgtagaacttctcccagtcggccgggtccttcagccggaagtcggcgcccatgtcgatgacgaggacgtcgtccccgagctgctcggccacggccgcggactggccgtgcgggagggcgaggaacacgacgtcgtgcccggcgagcacctccggggtggtctcctgcaggaccctgtcggccagcggcagcaggtgcggctggagcgcgccgagccgctggccggcgttggagttgccggtcagggcgccgatctcgacctcggggtgcgccagcagcagccgcagcaactctccgcccgcgtatccgctggcaccggcgatcgccacacgtacagccatgagccctcctccttgatggcatgactatacgtacgaatgcacgtttatgcaatcctaggcggggtccgccttcggcagcatgatccagcgggagacgacgaaggtcaccgggatcgccgccgcggacgcgagcagcggcgcgaaccggctgcccgcgtgcagcacgtcgacgatcacgtacacgccggccgtggtgatcaggaaattggcggcgttcgtcagcgggaacagcaggaatttccgccaggtcggccgggtccggtaggtgaatcgcgcgttcaggaagaaggagccgatcatgctgaggaagaaggccagcacgtgcgcgaggagatacggcaaacgcgtgaggaacaacaggtaaagcacgtagtacgtcgccgtgttgagaacgccgaccacggcgaaggtgacgatctgcctcgtcatcgggttacgcatcagggaatgagatccttcgttcgctccacgttgctctccttcaccaggaagtgcgggcgccccttcacctcgtagtagatccggcccgtgtactcgccgatgacaccgagcatgaccatctgcacgcccgcgagcgcggtgacggccgtgatgatcgtgacataaccgggagtctgcacgccgttgacgagggcggcgcccacgatccacgccgtgtacagcccggcgcacagcagcagccacatgccgaggtggagggcggcgcgcagcggcctgttgttgaacgagagcagtccgtcgaggccgtagttgagcagggacttcagggtccaggagctgctgccgtgctcgcgtacggcgttctcgtactcgaaggtggtggtcgggaagccgacccaggcgaacaggcccttggagaagcggttgtactcggtcagcgccagcaccgcatcgaccacgcgccgcgacagcagccggaagtcgcccacgccgtccttgagttccacgtcgacgagccggttgacgagccggtagtacaggcgggcggtgagggtgcgggtgaggcggtcgccgctgcggctgcggcgggccagcacctggtcgtagcccttctcgcgcagctcgaccatgcgccggatcagctccggcgggtgctggagatcggcgtccatgacgaccacggagtctcccgaggcgtggcgcaggccggcgagcagggcggcctccttgccgaagttgcggctgaacgaaacgtaccgcacccgtgcgtcggcggcggccagtcgctggagcagcgtcagcgtacggtcgcggctgccgtcgtcgacgtacacgaactccacgtcgtggccgagcggcagcaggtcctcggcgacccgctggaccgcctcgtggaagcgctcgatgacgtcttcctcgttgtagcagggcgcgacgatcgagatgagcatgatggttctccccgggggcgcggtcagagagcgctggtcgtgcgctcgcgcgggcgtgtgggtgtgcggtgcggggcgcgacggccggcggcggcccgtcggcggcggacggcgccgaggg

SEQ ID NO: 150 - DNA, 5041 bp, Unknown
  Kingdom: Bacteria, Phylum: Actinobacteria, Class: Actinobacteria, Order: Streptomycetales, Family: Streptomycetaceae, Genus: Streptomyces
cgtcctccgcgcgcgcggcgaaccacagcgcctcctccgccagacccgagccgccgccccagtcaccggagatgcggcctatcgcggggaagcgggccgtgcggccgtccgggcgcatgccgacgcagttgatgcccgcaccgcacaccaccgccaccccgcgcggttcggccacgcccgcgcgcaggatggcgaacgtgtcgttgcggacctccaccgtcgtgccccacgcgcgcgcgtgcagggccgacgccagctgttcctcctccaccggcaggtcggcgttggccagacacgccgagacgtgcgcgaccgaggtgacgccggcttcggcgaaggcgcgcccgacggcgtccgcgaggacgtccaccgccgtctccacccccacggtcggcggccggaacccgccgccgcgggccgtggcgaggacgttcccgtcggccgccacgaccgcgacgtcggtcttgctgttgcccgcgtcgatggcgaggacgcttgcggtcaggcccacgcgaggtgctcccggttgtgtgcgatcagctggtcggtgagggtctcggcgtacgcgtactggccgaccagggggtgggcgagcagcgcgcggaagacccgctcccggccgccgtgcagcgccgccttgagggccaggtcctcgtacgccgtcacgttcgcgaccaggcccgcgtagagcgggtccacgggggccacgggcagcggggtggcgcccttggggccgaccgccgcctgcacctcgatcaccgcgtcgtccggcaggaacggcagcgtgccccggttgtaggtgttgaccacctggtacgggctgccgcccgcccgtcgcccgccaccacccttgcccgagggccctgcgggcccgctgtcctgattgcccagcagggccgcggccaggtccacggcggcctccgagtagaaggcgccgccgcgcttggcgagcagggccggcttctcgtccagggccgggtcgccgtacatctccagcaggtcgcgctccatcgcggccacctcggcggcccgggacggcttggcgcgcagttcctcgacgacctggtcgtgcgcgtagtagtagcgcaggtagtacgaggggatcacgccgagacggtccaggaccgtgcggtccaggcgcaggtcggaggcgacggcgtcgccgtgctcggccagcagccggggcaggacgtcctcgccctccgggccgcccaggcgcaccccggtctcccaggtgaggtggttcaggcccacatggtccaggtggatgtcgtggggtgccacgtcgagcagcgcggcgaacttccgctggaagccgatcgccacgttgcacaggccgaccgcgcggtgcccggcctccagcagggcgcgggtgacgatgccgaccgggttggtgaagtcgatgatccaggcgtcgggattggtgcgccgcacccgctcggcgatgtccaggaccaccgggaccgtgcgcagcgccttggcgaggccgccggcgccggtcgtctcctggccgacgcagccgcactccagcggccaggtctcgtcctgctggcgtgcggcctggccgccgacgcgcagctggagcagcacggcgtcggcgccctccacgcccgcgtccaggtcggaggtggtgacgatccggccggggtggccctgcttggcgaagatgcgtcgggccaggccgccgaccagttcgagccggtcggccgccgggtccaccaggaccagctcctcgaccgggagggtgtccctgagccgggcgaagccgtcgatgagttcgggcgtgtaggtcgaaccgccgccgaccacggtgagtttcatgtctgtcaaccctttactccggtgagcgtgacgccctcgacgaacgccttctgcgcgaagaagaacacgaggatcacgggggccatgaccagcacggtggcggccatggtgaggttccagtcggtgtggcgggcgcccttgaaggactccaggccgtaggacagggtccaggcggccgggttctccgaggcgtagatctgcgggccgaagtagtcgttccaggcgtagaacaactggaagagggccacggccgcgatgcccggcttggccatcggcagcaccacccgcaccagggtgcgcaggtcgccgcagccgtcgaccttcgccgcgtccaggtactcgttcgggatggtcgtcaggaactgccgcagcaggaagatggagaacgcgtcgccgaacgccatcgggatgatcagcggccacagcgtgccggacaggtccagctgcttcgcccagaacaggtacatcgggatgatgatgacctgcgggggcagcatcatcatcgagatcaccagcatgagcgacaggttgcggccccggaagcggaacttggccagcgcgtaggccaccgggatcgaggacacgacggtgaggacggtgcccgcgccggcgtacaggagggtgttgcgccaccaggtgaggaagcccggggtgtcgaagaccttcttgtagttgccccactcccacgtgtgcgggatcaggtcgcggctcagtgcctggctgtcgctcatcagcgaggtcaggaacacgaacacgaacgggagtatgaagaagagagcggtggccacgccgagcgcgtggacggcgatccactccaggagcgccttgcggcgggcggtgcgctcggccggcgaggcgggcgccttcttcagggcggccggatggtcaaggacctgggtcatcgtcagtcacctgcctgcatgagaccgccgcggcgccgcatcaggagcgcggtgaacgccatcgagagggcgaacagcaccagcgccaccacacaggccgagccgtagtcgaaacgctggaagccgaggttgtacacgagctgcgggagggtcagcgtggacttgtccgggtagccgggctcgaacatcgtgcccgcgccctggatgacgcccgaggcgaccttcccggcgatcagcggctgcgtgtagtactgcatggtctggatcaccccggtgaccacggcgaacatcacgatcggcgagatgttcggcagggtgacgtaccggaagcgctgccagggcgaggcgccgtccagttcggcggcctcgtactgctcggtgggcacgtccaggagcgcggccatgaagatgaccatcaggtcgccgacaccccacagggcgagcagggtcagggccggcttggaccaggtggggtcgttgaaccagccgggcgcggggatgcccgtcttctccagcagggagttgaccgggcccgtgcccgggttgagcaggaaggcgaaggccatggtcgcggcgaccggcggggccaggtagggcaggtagaacagggtgcggaagacgcccgtgcccgtcttgatcttggtgatcagcaggcccacgcccaggccgaaggcgacccgcagcgtgaccatgatgaccaccagccacagggtgttgcgcagggccggccagaacagcgggtagttctggaagacgtacgtccagttcttcgcgccgctgaacgtcggcgcgttgaacccgtcgtagtgcatgaacgagaagtagacggtggagatcagcggatacgcgaagaagaccgcgaatccgatcagccagggcgacatgaaggcgagggtcttcagtgccgcgcggcggcgtttggacgccagggtgaaagtggtcatcgctcttctactccgcctgcgcgatgtccgtgtcgatctggtgcgccgccttctccaggccggccttcaggtccttctgcttgccgctctcgtagtcgtagccgagctgctggatcgtcaccaggtactggccgccgttgatcgaggcgggcgtggtcgtcgagttcgtgtcgcccgcgatgtcaaggaacgtcttgaaacgcgggtcgtacttcagcttcggggacttcagggcggcgagcgtcgagggcacgttgtggatgtcgttggcgaatccgaccaccgcgtcggtgtccgtggagatgtacttcacgaattcccaggccgcgttctgcttgtggctggtggcggcgataccggtgatggtgccggtgatgtaccccttgccgtactggctcacctggtcgtccgggacgggcagcggcgccacgccgatctcgaacttcggcttggcctcctcggccatgcccaggcgccactcgccgtcgagctgcatggccacctggccggtgtggaaggggtgcttgggaccccactcgtcaccgagggtggcgcggaacttctccagcttctggaacccgccgagttcgtcgacgagtttcttctggaaggtgtaacccttttcgaaggcagggtccttggcgacgttcgacttgccgttcgcgtcgaagtacttcggcgagaactgcgcgaagaggtgctcggtcgtggattcccagccgtggtagtccggcatgaaaccgagctgcttgtaaccgtccccgtcgggcaccgtcagcttcttggcgtccgcctcgaactcggaccaggtcttcggggcctgtgtgatccccgccttgtcgaaggcggtcttgttgtagtagagcccgtacgcgtcaccgaggagcggcgccgtgcaccgcttcccgtcgaactgcgtgtactcgttcatcgccttcggaaaggtcttctccgggtctatcgccgccttcttgaagaaggggttgaggtcgaccagtgcgcccgacgagcagaacttgcccacgttgttggtggtgaaggaggagatcacgtccggcgccttgtcgccgccggtgcgcagcgcctggttcatcttgtcgtccgtcatgttgccgacgacgttgacgtggatgttggggtgcgccttctcgaagccggcgatcagcgactggacggccttcacctcgttcggcgcgctccaggcgtgccagaagttgatcgtcgtgtctttcgaggcgtcgtcgttcgcgccggagtccggctggccggtacaggcggtggcgaacagcgcgatggaggcggaggcggcgagcgcgaggaccgctttccgggacacttcgggcatgacgggatctccctgggacgggcggggcg

SEQ ID NO: 151 - DNA, 4187 bp, Unknown
  Kingdom: Bacteria, Phylum: Actinobacteria, Class: Actinobacteria, Order: Streptomycetales, Family: Streptomycetaceae, Genus: Streptomyces
gtcgtcgggggcggaccggccgctccagacgaccggccggcggtgggcggtcccggaccggcccggcgtaccggcggcggggacgcggacggtggcgtcggtgacgcccggatgccgggcgatccgcggggacagggtgcgccgtgaggcggcgcccaactgcacgcggaagctggcgtgagtgacgatgacctgcgccggatcgctcggcaccttcaccatgctcagcgcgggagcgtcgtcgtatcccgacgagcggtcccccgtgggtgtgcggggtgttctggtgtccacactcatctaaccgagtgatggggagttaggacactgccttgacccgccggatctgtccgggccgcgtcaagcttgccccgaacgaggggatatgcccgaccgggtgaccacgcgaactcccgttcgggcgcagcctgggcgtgtccggccgggcaccaccgtcacagcgtcacctgcgcctgcgcgccgcctcgtagagcacgatgccggccgcgacaccggcgttcagcgactccgcgccgccgggcatcgggatccgcacccgcacgtcgcaggtctcgccgacgagccgggacaggcccttgccctcgctgccgacgacgatgacgacgggcccgtccagggcgtccaggtcgccgagttccgcctcgccgtccgcggccaggccgacgaccgtgatgcccgccttctggtacgcctccagggcgcgcgtcaggttggtggcgcgggcgaccggcgtacgggcggccgtgcccgccgacgtcttccaggcaccggcggtcatgccggccgcgcgccgctcggggacgaccacgccgtgcccgccgaaggcggagacggaacggacgacggcgccgaggttgcgcgggtcggtgacgccgtcgagcgcgacgatcagcgggtcctcgcccgcgtccgcggcggcgtcggccaggtcctcggggtgcgcgtactcgtacggcgggacctggaggacgaggccctggtggttgaggccgttcgtcatgcggtccagctcggggcgcggggcctccatgaggttgatgccgccgcgctcggcggcgagctggagcgcctcgcggacccgctcgtcgttgtcgatgaactgctggacgtagagcgtggtggcgggcacgccctcgcgcagtgcctcgacgaccgggttgcggccgacgaccagttcggaggcggagcggccggacccgcggcgctgcggcggacggccctgcgtactacggcgcgtcttcgcctgggcggcgcgctgcttggcgtgtcccttgcgcatctcggcggggggcgtggggcccttgccctccaggccgcggcgccgcttgccgccgctgccgacctgcgcgcccttcttgccggacatgcggcggttgttagcggccatgacctacctgtctgttctgtcgagagcgtcggcgtgcgcctgccgcgcacgccttctacgtctatggagcacttcttgaagcacgtctgtgaagtgcgtttgtgaagtacgtctgtgaagtacgtctatgaagttacgggtcagcgggggccgaggctccagcgcgggccctgcgggctgtcctcgacgaccaggccggactggccgagctggtcgcgcagggcgtccgcggtggcccagtccttgcgggcacgggcggcctcgcgctggtcgaggaccatacggaccagggtgtccacgacgccgtgcaggtcctcgccgcgctcgccggcctcgcccgcccagtgctcgtccagcgggtcgagaccgaggacgccgagcatggcccgcacctcggcgagccgggccacggcggcctccttgtcgtcggccgcgagcgcgctgttgccctgccggacggtggtgtgcacgacggccagcgcctgcgggacgccgaggtcgtcgtccatcgcctcggcgaaggcgggcggcacctcggcggacggctcgaccgggccggccttctccaccacgcgctggatgaagccctcgatccgggcgaacgccgactcggcctcgcgcagggcctcctcgctgtactcgatggtcgagcggtagtgcggggtgcccaggtagtaccggagcacgatcggccgccactgcttgaccatctccgagaccagcacggagttgccgagcgacttcgacatcttctcgccgctcatggtgacccaggcgttgtgcacccagtaccgggcgaactcgtcgccgaacgccttggactgggcgatctcgttctcgtggtgcgggaagatcaggtccaggccgccgccgtggatgtcgaacgcgctgcccaggtacttgtgcgccatggccgagcactccaggtgccagcccggccggccctcgccccacggcgtgggccaggtcggctcgcccggcttggccgccttccacatcgcgaagtcgcgcgggtcgcgcttaccggtctcgctgtcggcggcgggctggcgcaggttgtccagctcctgccgggacagctccaggtagccggggaaggagcgcacgtcgaagtagacgttgccgtcggcggcgtaggcgtgcccgcgctcgatgagcgtgcgcatcatctcgatcatctccggcacgtggccggtggcacggggctcgtaggtgggcggcaggcagccgagcgcggtgtaaccgtcgttgaacgcgcgctcgttgtcgtagccgatcgaccaccaggggcggcgctgctcgtgcgacttcgcgatgatcttgtcgtcgatgtcggtgacgttgcggatgaacgtgacgtcgtagccgcggtgggtgaaccagcggcgcatgatgtcgaagttcagccccgaccggatgtgcccgatgtgcggggccgcctgcaccgtggcaccacacaggtagatcgagacgcaacccggctggagcggggtgaagtcacggatctgccgggcgctggtgtcgtacaggcgaatagtcaccactccagggtagtgggccgggggcagtgcctcgcgccccttcccgcaagcggcgcccctttcgtgaccggggggggcacaccggcggggcggggatcagatgctgccgacgaccttgcgggcgctgatgcggacgaccacccgctgggagtcctgggcggaggccgggttgaactcggcgtacttcttgccggtgtacttcacggacagctcgtcgatgaggtcctggccgccctcggtggtcagctcggcggtaccgcggatctcggcgtactcgtacggcgatgccgggtcctggacgatgacgctgacgcgggcgtcgcgctgcaggttcttcgtcttgcggcggtcgacggtggtggagacgaggaggtcgtcgccgtcccgcttcacccagaccggcgacagctgggggctgccgtcgggctggacggtgccgacgacgacgaagacggggccgtcgaggaggttcttgagacggtcggacagtacggcggacatggggcaccctccgggacctcggtcactggcgactcgacgcgacgggactcgacgcgactcagcgccgccgagcgatgacgttccggtcaccttcgcacgtgctcagcccacccgcaccacgagcgccgtggcgaccgccatcaggccctcgtcgcggcccgggaagccgagtccgtcggtggtggcgccggagacggacaccggtgcgccggccgcctcggaaaggatcttctgcgcctcctcgcggcgcttgccgatcttcgggcggcccccgacgacctgcacggcgacgttcccgatccggaaaccggccgcccgtacgatccgcgccgcctccgtcagcagcgtgaccccggacgcgcccgaccactcgggccgcccggtgccgaagtgctgaccgaggtcgccgaggccggcggccgagaacagcgcgttgcacgcggcgtgcgcgacgacgtccgcgtcggagtgcccggccagccccggcccctcgccctcccacttcagtccggcgcaccacagctcgcggccgtcctcgaaggcgtggatgtcggtgccgatgccgacctggggcagcggcggcaggacctgcgagggcgtgggggtgatctcagaagccatcgttgagcctccggcgggccaggaccgcttcggcgagcacgaggtcgagcgggcgggtgaccttgaaggcctcctcgtggccgggcacggccacgacccgctcgccgagctgttcg

SEQ ID NO: 152 - DNA, 6944 bp, Unknown
  Kingdom: Bacteria, Phylum: Actinobacteria, Class: Actinobacteria, Order: Streptomycetales, Family: Streptomycetaceae, Genus: Streptomyces
acctcctcctcggcggcggtgagtccggcgaggatgccgccggcgtgccgcaccagggcctcgccggcctcggtgagccgcatctcccggccggtgcgcacgagcagcggggtgccggccgacccctccagggccttcatctgctggctgacggcgggctgggtgcagcccagctcgcgggccgccgcggagaaggaaccggtggcggcgacggcgcgcaggacgcgcagatgacgggcctcgatcacccttcaagcataagcgaagcttgggcgagacgccggaaaacgcgtcgacactttgacatcgggtcctctaccgttccgggcatgaagcttctctccgtcaatctgggccgccccgtggccgtgccgtacaccgaccagccggagggtgtcaccgggatcgacaagcggccggtggcccacccggtgcgcatcgcggcgcccggccccaagggcgtcggcgcgagcgggctggccggggacgcggtgtgcgacacgcggcaccacggcggcgacgaccaggcggtgtacgccatggcgcgcgaggacatggacgcctgggagcgcgagctgggccggacactgcccaacggctcgttcggcgagaacctgacgaccacgggcatcgacatatccggcgcgcggatcggcgagcgctggcgcatcgggtcgccggacggtccggcggtggtgctggaggtcacctgcgggcggattccgtgtcggaccttccagggccatctgggggaacaggggtgggtcaggaggttcacgcggaagggtgcgcctggtgcctacctgcgggtgatcgagcccggtgagatccgcggcggcgaccccgtggagatcgtgcaccgcccggaccacgacgtgaccgtggcgctggcgttcagggcgggcaccacggagcgctcgctgctgccgcgcctgctggcggcgggcacggcactgcacccggagtcgctggccgcggcgcggaagtacgtggcggagaacggcgcggggcacggcggggaggacggtgctgtccagaacgcgggctgacggcccgggcggcgcgggcacaccggtccgggcacactggtccgtcactgatcggcaggccctgtgcagagatcgggaaggtggggtccggcccactagcctttcgccatgacaacggctctgattacgggatcgaccgcgggcatcggcgccgcgttcgcgcgacggctggcggcggacggccacaacctcgtcctggtggcgcgtgacacggggcggctgaccgagcaggcgaccgaactgcacgaccggcacggcatcgaggccgaggtcctgaccgccgacctcgcgacggacgagggcatcgagaaggtcgccgcccggctgggcgaccggaagaacccggtcgacctcctggtcaacaacgccggcttcggcagcaagggccgttacctcgacgtggagatggccgacgagctgcggatgctcaaggtgcacatcgaggcggtgctgcggctgacgtcggcggcgaccgaggcgatgcgcgagcgcggccggggcggtgtggtgaacgtggcgtcggtggcggcgttcgtgccgcgcggcacctacggcgcgtcgaaggcgtgggtcgtgcagttcacccagggcgtggcacgggacctggcgggcacgggcgtccggctgatggcgctgtgccccggcttcgtgcgcaccgagttccacgagcgggccgggatgggcacggacaacatccccggctggatgtggctggacgcggacaaactggtcgcggcggccctcgcggacctggcccgcggccggacggtgtcgatcccggacccccgctacaaggcgctgatgggcctggtcaaggtcacgccgcgcggcctgctgggcggcgtcacctccaagacgggacgcaagtacggcccgcagtgaccgcggggcggcgacgtcgtcgccccggccgggaaccggtgcgaaaatggcctggtacggaacgggccagggggcgtaaggcggcggcgtcatgaccttcgtacagctcatcgagtgcaggacgagccggttcgacgagatgaaccggctgctggacacctgggtcgcccggaccggcggaaaacggaccgcgacccacgcgctggtcggcaaggaccgctcggacggttcgcacatcgtcgagctggtcgagttcccgtcgtacgaggaggcgatgcggaactcgaacctcccggagaccgacgaggtcttccgcggcctggtcgccctgtgcgacgagatgcccaccttcatggacctggaggtcgtacgcgacgagcggctctacgagaacgccgtgcgccgtttcttcgacacgctcgagggtgcgggcgaactgccgccgctcaacgacctgatcggcgaggactgccacagctacgacccgatcaacccgcaggccaccatcggcctggacgccatccgccgcgagtaccgcatgtggcgggacgccttcgacttcgccttcaccgtcgaggaactgatcacccaggacgaccggatctgcgcccgctggacctggaacgccacgcacaagggcgagttcctcggcatcgccgccacgggcaggcgggtcacgatgaccggcatgaccgacttccacttcggcgacgacggcaaactcacccggatctggtggcagcacgaccagctgggcctgctgcaacagctgggcgcgctcgacgagttggagaactagacaagcggccaggaggcggaacgccaggtgcccagccccccgaggggagctgggcaccgtcggctcagggaaggcctcagtgggagtggccgtggccgtggcccgcggcggccggctcttcctcttccttcttctcgacgaccagggtctcggtcgtcagcaggagggaggcgatggaggcggcgttctccagggcggagcgggtgaccttgaccgggtcgatgacgccggccttgaccaggtcgccgtactcgcccgtggcggcgttgtagccgctgcccttctccagctcggcgaccttggagacgatgacgtagccctccaggccggcgttctccgcgatccagcgcagcggctcgacggcggcgcggcggacgaccgagacaccggtggcctcgtcgccggtcttgtcgaggttgccctcgaggaccttcacggcgtggaccagagcggagccaccaccggagacgatgccctcctcgaccgcggcgcgggtcgcggagatggcgtcctccagacggtgcttcttctccttcagctccacctcggtggcggcgccgaccttgatcacgcacacgccgccggccagcttcgcgaggcgctcctggagcttctcgcggtcccagtcggagtcggtggactcgatctcggccttgatctgcgcgacgcggccctggacgtccgacttgttgccggcgccgtcgacgatcgtggtgtcgtccttggtgacggtgacgcggcgggcggagccgaggacgtccagaccgacctggtcgagcttgaggccgacctcctcggagatgacggtggcgccggtgaggacggccatgtcctggagcatcgccttgcggcggtcaccgaagccgggggccttcacggcggtggcgttgaaggtgccgcggatcttgttgacgacgagggtggagagggcctcgccctcgacgtcctcggcgatgatcagcagcggcttcgaggcgttcgcctggatgatcttctccaggagcggcagcaggtccgcgatggaggagatcttgccctggttgatcaggatgtacgggtcgtcgaggacggcctccatacgctcctggtcggtgacgaagtacggcgagaggtagcccttgtcgaaggccatgccctcggtgaagtccagctccagaccgaaggtgttggactcctcgacggtgatgacgccgtccttgccgaccttgtccatcgcctcggcgatcagctcgccgacctgctggtcctgggcggacagcgcggccacggcggcgatgtcggacttctcgtcgatcgggcgggccgaggcgagcaggtcgtcggagacggccttgaccgcggcgtcgatgcccttcttgagcagcgccggggaggcacccgcggcgacgttcttcaggccctcgcgcaccagcgcctgggcgagcacggtggcggtggtggtgccgtcacccgcgatgtcgttggtcttggtcgccacctccttcaccagctgggcgccgaggttctcgtacgggtcctcgacctccacctcgcgggcgatggtgacgccgtcgttggtgatggtcggggcgccgaacttcttgtcgatgacgacgttgcggcccttgggaccgatcgtcaccttgaccgtgtcggcgagcttgttgacgccgcgctcgagggcgcgacgggcgtcctcgtcgaacttcaggatcttcgccatggcagcgggagccctctcggaaatcttgggtgaaaaagaaactgcgccccgggcgcccggcttcttatcggtcgcgggggccaggggcgcagctcacagcaggaatgctgaggtgacttacttctcgatgatcgcgaggacgtcgcgagccgagaggacgaggtactcctcgttgttgtacttcacctcggtgccgccgtacttgctgtagagcacgacgtcgccgaccttgacgtcgagcggaagacggttgccgtcctcgaagcggcccgggcccacggccaggacgacgccctcctggggcttctccttcgcggtgtccgggatgaccaggccagaggccgtggtctgctcggcgtcgagcggctggaccacgatgcggtcctcgagcggcttgatggcaaccttggagctggcggtcgtcacgatccgacctcccccttcggagatctcacggggttaactgtctgaggtggcgaccaggtcgatccgtcgtcgcgggtgccggacctgcccgtcgctgtgttggcactctccggtggggagtgccagagccgagactatgaccgcgattagcactcggtcaagcggagtgccaattgccgtgcggcgcgtcggaggagggcgcgttgttcaggggcggtcgcgcgggtgccgtccggctcggtgggcggccccgggagccgccccgagacccccgctttcggcctgaacggcctcgtcccgtcctcggactcccccaagctcttcgagcagggtgagccccagacgggctgagtcgtcacaggtagtcctgcagccttccgaccgtcaggccgtccgcctcgatggtgcgcagcagggccgtcgtgcgttcgcgcagggtcggcccgtccaggtcgtcgtcgtccgaggtgaccaggaggatgtcgccggggcgcagggtgatgacggtggagatgtactggacgaggaagaccgggtcgaacagcagcgtgccggtgtcgtcgcgctgcatgacttcgccgtcgacggtcgtcttcacttcgagcgcggggcggacgccgccggcctcgtcgggggtgacgacgtaggggccgacgggggtggtggcctcccagatcttgccctgggtccactcgatggtgcggaactgccagtcgcgcacggagatgtcgttcatgacggtgaagccggcgatggcctcggcggcctgccgttcgtcggcgcggcgcacccgcttgccgatgacgacggccagttcgacctcccagtcgaacgcctcggtctcggcgggcctgacgatggcgtcgttcgcgccgatcagggtctcggcgaacttcgggaaaagggtcgggtggccgggcaggtcccggcccatctccttgatgtggttggtgtagttgtggccgacgcagatgaccttggaggggttcgggacgaccggcgcgaagtccgcgccctcgaccgggtaggtggtgccggtcgcggcggcggcccgctcctgccagccgtcctcggcgaacagctcgcccaggtcggcgtggccgaggtcgacgaggacgtcgccgtcgaggcggaccgcgcgggtgccgtcggcggtgcggagagtggcgagcttcatgtcaggcgtccttctgggtgcgagcgagcttgagcgcctcgaaaacgggcgcgtcggagaagcggaacaggtcgagggcgtcctcgtcggagtcggtggcgccggcctcggagcggacggagaacggttcccaggacgggacgacgaacaggtcgccgcggctgaccgtccaggaccggtcgccgacggtcaccacgccggcgccgtcgaagacctggtagacggaggagccggtctcgcgcacgggcgcggtctcggcgccgcgggcgacgcggtggaactcggcgcggacggtcggcaggacgtcggagccgtcgtgcgggttggcgtagcggaccgcggcgtggccgggctcgacggtgccgccgaagccctccttctccagcaggagctggtcgcgcagggcggcgtcggtgtactcccacttgtaggacagcagcgggctgcccggcgtggccgggacggccgacagcgggcgcaggccggggtgggcccacaggcgctcggagcgcgagcgttcgggggtgatccgctcggcctcgccgatctcgtcgcggccgaactcgaagaactgggcctcggtgacgtactggaaggggatgtccaggccgtcgatccaggccatcggctcggaggtggcgttgtggtgggcgtgccagttccagccggcctgcgggaggaagtcgccgcggttcatcggcaccgggtcaccgccgacgaccgtccacacgcccgagccctcgacgacgaagcggaaggcgtgctgggtgtgccggtgctcgggggcgtcctcccccggcatcaggtactggatggccgcccacagggtcggggtggcgaagggccggccgccgagggaggggttggccagggcgatggcccggcgttcgccgccgcggccgacgggga

SEQ ID NO: 153 - DNA, 17060 bp, Unknown
  Kingdom: Bacteria, Phylum: Actinobacteria, Class: Actinobacteria, Order: Streptomycetales, Family: Streptomycetaceae, Genus: Streptomyces
gccgtcgcccagacccccgacggctgcacccgctcctgctcatcagtcaccgcgccaccctagatgatcgatcccgacccgacaggccagatgacttgagccaggggcatgcgcggccggccaggcacgcgtgcaccgaccgcctaccccctacgtacatcgccgtcagcgctgcaagccgtgtgtgcggttacctttcccgggttcctcttgtcagagggcgactgtcagccagtcgcggggctgctactgccgagcggtcctggtccgcacgacgactgcgtagccgccgaggccgaggaggcagtctccgctgatctcaccgagggctgtgtagagcgtcaggacgcgtccggtcgtcgggtcgtaggcgatgtccgtgacactgccgtgctcggcgccgtcttccgtcaggacccggtggcccaccgcctcctgatgcgcggggaagctcttctcgccggaaccggcggcgtgcgagtgcacgatgactgcgtcccgccccacgccctcgacggcgttccaggggatggccgtggcatggcgcggggcgccggacaggcgcagacaggcgatgctcctggtgtgcgggtcgatggtcaggctttccacccgccccagtggttcggcctcttccaccgtgatcaccggaaggccccgggtctgcgtgaacagtctcatgccggacccccctctccacgtgcgggcgttccggtgggtgtgtccacagctgtgtccgcgtgtccggtcgctgtgtgcgcccggaaggcctcgacctgggcgctgaagctgggcaggtcgtcggcgatgaagtggcgggcgtgggccggtacgaccagagcacgtccggagacggccagagtctccccgcgtgggatgaacgccttccgttcccgccggtccaggttctcgtcggcggcgatctcgaaaccgatcacccgtccgcctcgcccggcctcgatcaccacatccaggatcgtgcccaccttggtcccctggtcggtgaggacaggagtaccgatgacctgaccgcctcctcccgcgccggatcccagggccacgccccgcttttccaggaccgcctgactggggatcatcacggcggccggtccgatcgcgtgcactccggagaacggcagcaccttcttgagcggtccggccagcaggccgcggccgctcagggtgaagccggtgatccggcccgcgtcggcgtcgaagacggtgtccttgatctgggcgacggcttcaccttccagcgtcaccaccacccgcttggtcagttcggaggcgagcgcgagcgagatcacagcgaacctccccgcccgtgacggcgccccgaccgcacggcgatcaccgtcccgctgcgccgcctcgcctggaccgtcagcaccgtgccagtgagcacgatcgccaccgcgacgagaaggaccacccagccccaccacaccatcgccgaccacctcggtacagtcttgacggcgaatgccgtcttgttccggcgaactcccctgggttatccgcttgcccgcggtacgcccaccgcacgcctgcgggcaaccgttcccggaagccggaagccggaagccggaagccggaagccggaagccggtgactgggtgggccagtgaccgacagacaccgcacagacgacgggggttcttcatgccgcgctccacctggccccgcctccagggccgtacccgccccttgaagatgaaggagtggggcgacctgaccgtcatggaccccgacaccggcggcccccagccacgcggccgcggactcctgaccgcggggaaggactggctgcacatcgacgcaggcagcgcgctggagaaccccgtcgtcaccctctacgcaggagccgaccccggaccggagagcggctgggacgaggtcgaagagaccaccgtgatctccacgaccggtttcctcgccctgtgcgacagcggatacgaaccggtgcgcaaggagaacctcgccaccgcgggaccgggcccgtatctggtccgcgtccatgccggcgaccgctcgacggacggcaggaagccccgcttcctcatccagctcatccctggcgaccgtaccggcgccgaacccggctcgcggccccccacgatcgaggagaccgcaggacccctcctggtccgcacgtcctacgaccagcccggcccatgggcgcgcctgctccaggtgttcgcgggcggctcggagcaccacgagtcggtcaccgtcatcgacaacgcggtctatacgggcttcacggccggtcaattgcaggagcgggtcgggcgtgacgacgagggccggcccgtcagcccctttctcctcgtcgccgacgaacaggctctgacctcggcggagtttccgctgctggccgtcaacaacctgcccgacgaggacgacgccccgttcaggatcgcccttgccgcagcgggctccttcctcgtcaacatggagctggggagcacgagcttcggcgactggagccgcggcgccggcaccgacggcgtctaccgggcgcagcaccactgacagtccctggtcggtggccagagcctcggtggccgcagtgccggcgcgagcggacgtcatgggcgcggattgaccgctgtcgacctcacggcccgcatttctcgttgcgtacgacgatgcccggtatcagcgatcaccgttgccaacgagattatgcggctgttccgcggtgcgctgcttcgtccgggtccccgttcggccgtgtcagcccgtcgtccaccgtcggttgacgcccgcgctccgtctcgtccagctcccagtgatgctcgcattcctcacatcgaggcccggtctcgcccggctcgaacacctcgccgttcgggcagtccgtgccgtcgccgcggcccacacatgcttccctggcatcctccatgcgtcgaccgtggctcggcgtgcccaagacgggggagagggccatgggggcgcacgggcgctcatcaccggcacgacgccccaacacccgtcggcagcaccaacagtcagtcggcggtgaaccagccatcgaggaaccgcactcggacccggcttgtcgtccccgcctgccggactggccgccccgccgacgatgcggttcgtgggcgcggcggctcgtgttgtcgatgacgttgccgcgcttgatccgggttcggcctggggcccgtcaggcagtacttccagcgcctcgcatcgccacccgtttcgacgccgtcccgcaccacccgtcaccacccgtcaccgccgtacgacccgggcgaaggctgaagagagcaggccaggtccggtcgcgcaaggggcgctgtcgtcgtccgagggggcctgttcccggactcgccgcggcatcgtccgcggcgcattccccggcgccgatccggacgtgctcgccaccacggtgtgggccctcgtccacggcctggcgttcctgcacctcgacggcaagctcgacacctccacctccgaggcggacgccacccaggtacgcaccgccgtccacgcactggtcaccgcgcccgcggcgctgtcgcaggcgaggggacagcgggccgggtgcatggccgctgtctgctgcattggcggcaccgaggtcaccgggtcggaggaacgaacccccggctgccgggccggtctccgcgatcaagtgtgatcatcacacagagatgacatgacgactccgggcagtcactgccccctggcaggaggtcccctcgatgagcctgttcgtgcaaccccttctcggcgtcgccgcggcgatcgccataggcgcgccggtcccactcggcacccccgccgcctccccctccgtcaccgcggagggcacccattgcgaccgtgccgaccaggacgtgtgggacagcgggcccagccgcaacctgtccgccaggcgctgcagcatcccggcccaccagaaacgctggtacagcgtagaggtcgacatgctcgtgcagacctactacaagggcgacaccccggaggggggagtcgaccggaccagagcactgcgccacaggaccatcaggtgcctcggctacacccgcaacagtgacaccggaacggtcgactggttcggctgcccgcccgtctgacgcgcccgtcccggctccccgcggccggctcccgcggccggcctcacagcgcggcggcgctccacagcttcaccgacggtgccgagcgagccgtgggcagccgaccaacggaaggacgtcgccggacccggacccgcccgtacagcccccaggaggttcgtctcagccgtccccggactgatcgagggggcggcagacgctgcgggcccgcgccctcgccgcccgagaacacatccctcagtagccgctcaggagggcccgtaccctgtgcagggcctgcgggccggcgctgctgtgccagcgcgaggagtcggcgggacgccgtccccacagcagcagcacccgggtggcggcgtcgctctcgatcgcggccggaccctcgggagcggccagccggatgctgcacccgtcgccgcgggtgtcggcacgcacgacgacgtcgtccgtgcccggcgtgcgcaaccgtccttcgaacggtccgtcgccgggtccgaggtccagcccggcgcggccccggaccagcagcgggcggccgaccgacaccacactgtgctcggtcatccacggttcgccgagcgcccgcacggcggtgggatcgtcgccggtcaggtcccagcggtgcaggatcagctcctcccgcatgtgttcggcgaagaacgggaccttcacggtccggccggtccacatgacctccgtgtgcggggacaggtcccgcgcggcggcaacggcggtctcggcgagctgttcgcagtggcccaggaaagcggcccagagttccgggccggacatccgccggtacggagcctcccgctcgaagcccctggtctccacaggtgttcccgcgaggaacccctggagcacccgggtcagttcctcggcgttgcccgtctggtggaccaggacgtcccgtaccgtccacgcctcgcaccaggtgccgtcgtcgggccgccgcgcctgcacggcgcggaggaacgggaccagttccggcagggtctcctcgacccgggaggggatcatgtgcgatgggtatcccgatcgggccgcccgccaaaccgtcggtgtcccgcggaccggcggtgcccgtcggccgacgcgtgcggcgccccgaccttgccaccccggtccctgccgtgccgccaccaccagtcgcacggctaggctcaccgtcgtggcgcagatcatcgactacgggcggttccgggagcggttggagagcgtacggccctccggcgaggcggacatggcggcgaccgggccgcgctgggagctgctgcgggagttccaggagcagtgggggtacgtcccgacgggcggcgagtgccgggagcgggcggcgcccgatccccacaaggagtacctcgccgggctgaaggcggcgcatccgggcgaaccggaggacgaccagccggagggcgtcgacccccgaatcccggtaccggcggcactggacgaatggtggaacctgccgttcaactcgttcgccgaccggtccgagctgtacgagaccaatcccgagtggccgcccaccgtccgtcccgacccgggcggctacggcgtctcggaggggctgccccgcgaaaacccgttcaccggaccggacgaggacccgcgggtctgcgtgttcatggcggagaaccagtactgcaacgagtggggctaccccgcggcccgcgcccacctcgccgacccaccggtcctggtgtccgccgtgggtgacgacggggaggagagctggatacgccaggcccacagcgtctcggagttcttcctgctgctcgccatggtccggctgctcccgcactacggctggaccgtcgaggacgatgagcccggggaggaactcctggcccgcgtgcgggagaagctgacccccctgggcttcgaaccctggcgggaaatgacctgccgcagcgagtactacggcggccccgacgtcatcgtctgccacgacccgtgcagcgactacctcagcgaactcaccgtctacggccgcacccgcgaggcactcgaacacctcgcgcagaccctcggcgtcgactggtccgatgacgtccgcgaacccgaaagccgcccctgctgatcactctcctgccgccctggcatcgatgcgaaggcagcacgcggacacgcacagtgctccccgcgcgaagccctcgcctgccacccgtaccagtggcagtgttaggtaggtgcggatcgaggagaacttcctgccacacctgcggaagccgagtcatgcgctgctggcgatccccatcgcgctcatcgtggtgatcacggtagtggaccagttcgtgcccgaggacatccacctcagtccgctgctggtcgtcgctcccgccgtcaccgcctacttcgccaatgcctggacgaccgcgctgatcgggttgctcgccgtgggcgcgcaggcgtacatcggctggcgcttcgacgtgctgacgacacgcaacgtgctggtgcagatcctcgccctggcggtgctgtccgccatggtcgtcttcttctgcgtggtacgggagcgccgcagccgccagctggcccgcatgcggaccatcgccgaggccacccagcacgccctgctgtggccgctgcccgatgtgctcggctgcgtgcagatcgccgtgctctacctcgccgccgaggacgatgcccagatcggcggcgacctctacgccgccaccaccaccgaaaccggcacccgcatcatgatcggcgacgtacgcggcaaaggcctgcctgccatcggcgaggcagccctgctcatcagcgccttccgggaagccacccaccagcacgccactctaccgacgctggccaccgccctggaacagagcgtcacccggaacctggcccacctggggcgcaccgcggaagtcgatgaacgcttcgccacagcgctgctggtggagattcccgacgacgacaacatcacccaggtgatcagctgcgggcacccgccaccgctgctgctcagctccaacggcgccggcacggtcgcgctccatccggcgctccccctcggtgtcggcggcctgggaccggccgacaacaccgtcgacgtcttctccttcgaacccggcgacacactcctgctctacaccgacggcgtcatcgagacccgcgacgccgacggcaccttctacccactcgccgaacgggccgcccagtgggcggctgacagccccgaggaactcgtgcgcctcctgcggcacgacctgatggcgcacgccggcggccgactcgacgacgacgccgcggtcatcgccctgcgccgcacccactacggcggccggctctagtgacgtgggccggagattctctggcagtaggcggcgacttcgccgaggatctcgtcggcggtcttcgtccagacgaagggacggggtgttcgttccagtcggcgagcagaaatcagcggaccgccgcagcagcttgcggtccgccggacgctactcggtccgcagcgccgtggctgtacgcgccctggccgcccagcctgccaggaccagcgcgccgagcaccgcgatcacgagcccgcccagctccagcacgagcacctgttccgacgtcatcctcataaacatccggatgccagacggacggcatcgaggccaccaggcgcatcgtcggtgacggggacccggccggaacgcgggtcatcatcctcacctcgtacgacctcgaccaccacgtctacgccgccctcaccgccggcgccagcggcttcctgctcaagggcgtcacctccgaacacctggtcgtcgtcctgtgcctggtgcagaccggcgacgccctcctcgcgttcacgatcacacgtcggctgatcgagcgcttagccccgcacgaccaaccgcagaccatcgtccccgcaccgcgatctgcccgggctgcccccgcgcgaactcgaagtgccccgcccgctcgcgacgggcctcagcaacgccgaactcgcctcccggctgtccctcagcccgaccacggtcaagagccacgtcggccgcaggatggcgatggcgtcggcatccgaccagtcgcgcggtaccggaacccacttgaggagagagacatcgcctccctgaggagcgcgccgaagaggtcacctcccgcgaactcgcagcgcccgatccggcccgccgcgtcgatccgctgtcgcgcgaccggagccaggtgtggttgctcgaacagcacgccagccgtcggagggaaggcgtcgaggactgccatgagcagggtgccgtttccccggcgaggtcgatgaccatcctgaaggcgtgctcgcgccagcgggcggccgctggacccggctgaagcgtttcgcactgagaccacgcctgggcgctcggcgcaggcggggagaccgttccaggtagggggcccggccatcccgcgactgtacttggggccgctgcgggctcgttggggccggctgctgaattcttcgcgattcttgccgaggatgtcgaatacgccaggcgtgcttctacctacgtgtgagagccccgccggggcggcacgacgaatgaggagcagaaccatgaagtacatgctgctgatgcagttcagcgagaagaacgtcgacttccccaagctcgacgaatggaagcccgaggagatccaggcccacatccagttcatgaagcagaccaatgccggcctcgccgccgccggtgagctggtcgacgctcagggcctggccatgccggagaccgcgcggatcgtgcgctcccacagcggcggcgcgccggtcgtcactgagggcccgttcccggagtccaaggagtgggtggccggctggtggatcgtggactgcgacaccgagcagcgggcgatcgagatcgccgccggtgtctccgccgctcccggcccgggcggtcggccgctcaacatgccgatcgaggtgcgccagatcatggcggccccgcccaccgagctgtagacagcctctatgacgaccttcgaaccagccgtcgacgacctgctgcgtacgctcgcgccgcgggtcgtcgccatgctgacccgacgctggggggacttcgccgccgccgaggacgccgtccaggaggctctgctggacgccgccacgcagtggccggcccagggtgtgccgcgcaacccgcgcggctggctggttcaggtcgcgagccgccgcatgaccgagcaggtccgcagcgagcaggcccgccgtcggcgcgaggaactggtggccgggcaggtcccggccgaccggcggtccgcccccggtgccgacgccgggaacgagagcgcgcgcgacgacaccctcacactgctgttcctgtgctgccaccccgtgctgtcgccggcctcggcgatcgcgctcacccttcgctcggtcggcggcctgaccaccggtgaaatcgcccgcgcgttcctcgtccccgaggcgaccatgggtcagcggatcagccgggccaagcagcggatcaaagcatccggggtgccgctccggatgccggacgccaccgagtggccggcacggcttgacgcggtgctgcacgtcctctacctgatcttcaacgagggctatgccagcagcaccggccccgatctgcggcgcgtcgaactctcccaggaggcgatccgcctcgcccgggccgtccacacgctgctgccggaccacaccgaggtgaccggtctgctcgcgttgatgctgctcaccgaggcacgcgggcccgcccgcaccggcccggacggcgacctcgtgccgctcgccgagcaggaccgcagccgatgggacacagccgcgatcaccgagggcgtcgcgctgatcaccgacgcgctcccacgcggaccggtcggcccgtaccaggtgcaggcggcgatcgcagccgtccacgacgaggcccccaccgccgcccagacggactggccccagatcctcgccctgtacggggtgctcgcccgcatctccgacaacccgctgatcaccctgaaccgcgcggtcgccaccgccatggtggacggccccacagccggcctcgccctgctcgccgacccgccgcccgcgctcgcaggccaccaccggctgtacgcggtccgcgcccatctgcacgaactcgccggaaaccgggagcccgccatcgccgactaccgcaccgccgcccaccgcaccgccagccttccagagcggcaccacctcagcttgcgcgccgcccgactggccgcgcgagcgggaaggtgagccaccggtcagagctcggggaggcaggacagctactgacgccggcacaccgggtcacttaggatcgccagcgaatcggaccaggccacctgggacagggacaggtgccgcttctcgccgccaggtacgtgatatgtaccccggcgggtgatcgtgtgccgacatgatggccgacttccccggcctgcactgggccgccggtcaactgggcgccctggcggccatcgtgctccatgagcgccccccacaaggctcctccgctcgtccacagaccggccggagaaggcccgatgccgcctggaccgcgcccacacgcggctgtcccacacgcggctgtcccgcacactgccgtcccgatcgtgtcaccgccgcatgcgcagtgccggctgcggcaggcgcctgaccagccaggcgctgacgagcccgatgacggcgccggcggcgacgtcactgggatagtgagcgccggactgcacccgctccacagccaccagggaggccggcaccgcgcagacggttccggccaacggccacgagggggcgaccgctgcggtgaaggccaccgctgccgcggtgtgcccggaagggaacgacgaggaatcgggccggtcctcgacctcgtcgtgagggatccattccttgggcggccgcggcctgccgctcacctgcttgcacacgccgttgcacaccagctgcgccagagtgagagccgccagaccagctaccgccgccttacggcccttccacccgccggcccagaccatcgccgcggcggcaccgcaccacaacttggtgccttccgcggtttcctctaccgccgacagcgtgtggtgaagcgctggatcccgccaggaagccatccgcttggtcagacggcggtccctctcgcgcactgcagccagcaacctcatgacctgctggtatcccgcgctcaccagatcacacgcgtccgggctccctgccctgcggcgggaactccgcagcagaccatgacgaccccggagtcctggcccggacaccaggacggcgagccgagtcggcccatgcggttgaacccgcgttcggagcgacctcggggagcggccggcctgctcagggccgaaggcccggtcgtctccggtgactgcccgggaaagcaaggggacggaggccgggggctggatgtccgtctgctgtggttgcatcaccgagttccttgagtccctgagtcttcgggccctgggctggtcacatcggcgatgcggagaacccgcggggcctcggccccggagaggaaggtgagggcattccgggggcgagggactggcgcgccaggtacggccctgcgcggtgctgtcgacccgcgacgacggcccggtcgccgcccggttcggcggccccgcgctgctgccggccggcaccccgcaccccccgttcccctacgtcgcctccatcgacctggcggcgctgccgtcggcctcgaccgacctgcccctgccgtccgacgggcacctgctcctcttcgcctggccgcgtgacagcggcgacctgaccaaccacggcgcggtcgtgcacgtccccgccgggacgcctacggaggaacaggacccatacgcctgggaccctgacggcatcccggaggagcgggaggtagccgacgccttcccgcagggcgaactgcgggtgcgcaccgagccgtcgctgccgtaccactacgccgggcgcttcgatcggacgttcaccaacgtgtactggaacccctgagctgatcagctcacgcctcacgtgtcagcctggcgcgcgatggcacgcgggaggctggagtccaggccaccaccccgcacccgcacagctccgccgtcaggtgggcgcatggcacacccggatgactccagggcgggcagtggacggcagggcggtcccattctgggcgggcagcggcgcagttgcggtggctcggccggacggcgcagcgtgaggctttccttcggcatcgacctggcgaagcagctgcgggaaccgacccatccggccgtcgcggaggcgacggctgccgctgtacggcgaaaaaagttcttcgacgacctccggggcgaggccggattgctgttcttcggaggcctggccgtctgctcgatgtagcggcagacggccttcggcgtagaccttggtggccttctctccgtacgggaaaatctcctgcccccctgctgcggggcgaccagcttgccgtgatcccccggggcgccgcgctgccggaagcgggttttgtatccggtgggtatcagggagcgcttggttgcccatcgaaccggtgcgccggcccccagcgatgaaaggcccgaagagagccggacggccctggacccggcagctgcccgagccacgcgacccaatctgacctgagcgttctcggatgcatgggactcccgagagggtgctgcgtgtccgtcgtacgacccgttcatggcatccggtgcctgccgtatcgtttctttccaggtcgtcggctgtgcgtgagcgcatacgggaccgatgcctcccctggcccgtccgaacaggagtccttcccgtgtcctcgtccgcccccgctccggcccctccgcgtcctgttcgcgtgttgctggtggaggacgacgacctgatgcgccggtccttcgccgttgccctggagcgctacggctaccaggtcaaggtcgcggcggacggcctcacggggctggagctcttccgcgacgacagcttcgacctgctgattctggacgtcatgctgcccgccctggacgggatcggcctgtgccgccgggtccgggagaccagcttggtgccgattctgatgatgtccgcccgcggcgacgggctcgatgtcgtcgccgggctggaggccggggcggacgactacgtggtcaaacccgtggaaacctacgtactcgtggcacgcatccgctcgctgctgcggcgggcgacctacgcgcctgccccggcgaccgggcgtgccgcgggcgaggggccgccgcccgagggagacctgctggtcttcggggacctgaccatcgacaccggcggcatggaggtgtccgtctccggaagcccggtggcactgacccccaccgagctgaagctgctgctggaattcgccgcccacccgggcctcgtactggagcggcacaccctgctgcgcaacgtctgggagtacggctgggacggcgacagccgggtcgtggacctgtgtgtgcagcggctgcgcaggaagctgggccgggaccggatcgagacggtccgcggcttcggctacaagttcaggcgctgaggccggtgcgcccgttccaccggctgcggcctgctcgcgtgtccctgcgctggaagatcgccgcgctggccgcggccaccgcttgcctggtggcggtggcggtgagcgtgctggtgcacctgtggaccgcgcaggacatccgcgaccggtccggagcacgcgccttcaacaccgtgtacgcggccatggacacctaccggcgcaccggaacgctgacggacggtgccgagctcgatcccgccgagctgcccgccgcgctgcgccacccggccgacggcaaccggcatacagcctatgacgggcgtgtcaacgggaatctggggccgagcgtctgggccgcccagcgggccggcggccccggcagcccggtgctggccgtccgggtcaatatgagctcggagctctacaggctgcaccgactggacgcgagcatggcagtggcctcgctggtcgcactcacggcggccgtgcccctggcggtgtacggggccgggctgatcggccgccggctgcggcgagtctccgagaccgcgggccggatctccgccggtgacctggacgcccggaccgggcccaccaaggggcgcgacgaggtggccgacatcgccgccaccgtcgacctcatggccgacagcctcggccgacggctgcgcaccgagcaccggttcaccgcggacgtggcccacgaactgcgcacccccgtcggcggtctgctggccgccgccgacctgctgccgaccggtgagacggaggatctgctgcgggccagggtgcgcgatctgcgcggcctggtcgaagacctgctggagatctcccggctcgacgcaggagtcgaacagccggtccgcacccgcgtgccgctcgatgccgtcgtcgccgaggccgtggcgcgcaccggactcgccgcgtcggtcaccagcaccgacgcgaagaacgcgcagaccgccagggccgtggcgactgtggagactgacccgcgccgcatcgagcggatcgtcagcaacctggtcgtcaacgcccaccggcacgggcacgccccggtcgaggtcaccgtgggggaccggacggtcagcgtgcgcgaccacggccccggcttccccgcggacctcctgcgtgacggcccacgccgctttcacacggatgcgaccgggcgaggatcgggccacggccttggcctgaccatcgccctgggccaagctcaggtcattggcgccgagctctgcctcgacaacgctccggacggcggcgccgtcgccaccctccgcctgccaagctgaccctctcgcccctacggaaccgatacagagcggcgcgggcaccgatacaccgtggtcctggccccgatacgttccccggacacccttcgaagtgcaccctgcaccccgcacccgaagaggagtcccctgtgctcgccgaaccctttgccacgcccgcgctgcacccgacggccgggatcgcggccgccgccaccggcctgtcgaaggtctacggcagcggcaacacccgcgtggtagccctggaccaggtcgacatcgccttccgtgagggcgagttcaccgcgatcatgggcccctccggctgcggcaagtccactctgatgcactgcaccgccgggctcgactcggtcagctccggctccgtccgcatcggcaccaccgaactgagcacgctcaacgaccggcagctcaccgcactgcgccgcgaccggatcggcttcatcttccaggcgttcaacctgctgccgacactgaccgcgctggagaacatcacgctgccgctgaccatcgccggacgccgccccgaccggcagtgggtggaccgcgtggtctccatggtcggcctttcccagcggctggaccaccggcccggacagttgtccggcgggcagcagcagcgcgtcgcggtggcccgcgcgctggcctcccgccccgcgatcgtcttcggcgacgaacccaccggcaacctcgactcccgcgcggggaccgaggtcctcggcttcctgcgtgactccgtgcgcgaactgggccagagcgtggtcatggtcacccacgacccggtcgccgccggcttcgccgaccgcgtggtcttcctctccgacggccgcctggtcgacgagatggcacatcccaccccggaccgggtcctggaccggatgaagactttcgacgcccgctcacgcaccagctgacccgacctcacccagcaccgaccgccacccgctcgcacccgttgagcccgcctcccgggccccacgggcatgcgtcgcacatccctgtatcccacgttcccgaaagccacccatgctgagaacagccctgcgcaacgtcctggcgcacaaggcacgtctggtcatgaccgtcctcgcggtctgcctgggggtcgcgttcgtctgcggcaccctcgtcttcgcggactcctccgccgcggcctaccgcgccgccgcgtcgaagaatttcgcggacatcgcggtcaccgtgaccccgaaatcaccccggcccggggctgccacggacgaagaaaccggagtgctcgacgacgcgctcgcacggaagctggcacatgtgcccggtgtcgccgccgttcggcccgccgccgacggctcggcaaccctgaacgccgcagacggcactccgctgcgcgccggcaagacgtgggcgaacatggccgccgcctacataccgggcagcgacggcaaggacagccgctatccgctggccaagggccacgccccccaaaacggcgatgaactcgccgtggacagcgccaccgccgccgccggcgggttcagcatcggcgacaaggtcacgttggccaccgacgaccaggtcatgacgaagcggctcgtgggcatcgtcaccaccaaggacacgcgggtgaccgccggcggcaccctcgccctgttcgacaaggcgaccgcccagcggctcttcgcctccccgggccactacaacgcgatcgatctgtccgccacgcccggcaccagccagtccgagctctccgagcgggtcaccgccgctctcccggccgaccgggccgaggccaccaccggcaccgcccaggccacccagcaggccaccaacgtcgacatgcagacccggggctaccagaagatgccgaagatcttcgccggggtcgcgctgttcatcggctcattcctcatcgtcaacaccttcaccatgctcgtcgcccggcgcacccgtgagatcgcgctgctgcgggcgatcggcgcctcgcgccgccaggtggtccgctccatcctctgggaagccgtcctggtcggcctcgccgcatcgtcggccggcttcctgctcggcctcggcatcgcctccgtactgcccgacatcctgagcacctcacaagacacactgccccacggccccctggtgatcggaccgcggcctgtcgtggcagcgctcggcgtgggcgtgggagtcacggtcctcgccgcgtggctgccgtcccgcagggcggcgaagat

SEQ ID NO: 154 - DNA, 11330 bp, Unknown
  Kingdom: Bacteria, Phylum: Actinobacteria, Class: Actinobacteria, Order: Streptomycetales, Family: Streptomycetaceae, Genus: Streptomyces
gtgttcgtcaccgtgccgcagctgctggcgcccggcaagccggtaccgggcaaggtgtaccggccgtagccgagccgcccgtccggacgcgggccgcggtcgtccgtggccgagccggccggtcaggtcccgtcgtccggcgtgagcgtgcgccggaagctcaggcccggccggcccttgatcgtcagctcgccctcctcggtgaacgcgttgcgggcgagcacggtcctggacgccaggttgtcgcaggtggtcatcgcggtgagcgcgcgcagcccgtacgccccggcggccagccggcacacctcccgcacggcggccgtcgcgacaccccggcccgcggcgcgctccccgatccggtagcccagctcggccgatccgtcggcgacgtcgatgaggttcacccggcccagcagggtgccctgttcgtccaggaccaggtggaagtggcagataccggcgtcctgttcggcgagcagtgcgcggtgacgttccgcgaactgggcgaaatacgcgtccccgcggtccgtgatgaaccgggtgaagtagctccggttctcccgctcgaaggccagcaccgcatcggcgtggtcgggccgcagccgctccagcgtcaccatgaccgcagcatacgaccgcgcgggtgagacggggacgaacccctggtcgtgcggcccgcgttgtctacgatcgtgccgtggtcaccttcagcctggaacgcacgccgccgctcgcccccgacgaggcctggcggcggctcacccagtggccccggcacgccggcgcagtcccgctgacccgcgtcaccgtgctcaccccggcaccgacccgcgagggcacgcgcttcgtggcccgcacgggggtcggcccgctgcgcttcgacgacccgatggaggtgaccgtctggcgaccgcccgccgacggcgagccgggcctgtgccggctggagaagcggggccggacggtcctgggctgggccgagatcgaggtgctgccgggtcccggtggccgcgcgcgggtgcggtggcgggaggaactgcgggtgcgcttcctgcccgccgccttcgacccggtcctgcaccgcacggcgcgggcgatgttcggccgcgccgtgaacaagctgctgcggcagccgtgacggcgggacgcgaccggcggcggcgccagcgggtccaggactgtaaagggggctcctgagaacccgtcaggacaggatctcgacgtacccgtcggttccgtgcacgcggatccgctgcccgtcccggagcagccgggtggcccgctccacacccacgacggccggcaggccgtactcccgggcgatcaccgcgccatgtgtcatcagaccgcccacctcggtcaccaggcccgcgatcgcgacgaacagcggcgaccagctggggtccgtggcggtggtgaccaggatgtcgcccgcttcgagatcggcctgcgccatgtcgaggacgacgcgggccctgccctccacggtcccggcggagaccgggaggccggtcagggcgccgtgcggcacgtcgtcgcgccggtacgccccggtgacggcctctccgtcggaggtgagcacccggggcggcgtgagcgcgtggtaggaccggaacgcgtccttgcgctgccggacgagcgcgtcgtccacgcggtgcgagcgcacgacctcgtggaattcgtggaacgtgaggtagaagatgtcctccttctcgcgcagcacaccggcgccgacgaggcgctcggcctccttcagcagggcctgcttgtagaggaagtagcggctgacgatgccgtacttcgggtactcccggtacccgatgaaggtcctgacccggtcgatcatccgctgggtctcgtcggccttgcggtccccgtccggcagcgcccgcaagcgcgacagcacgtcctgttccatctgccgcgccctctgccgcccttgctcgaagcgccgctcggcggcgcccggcccgaagttcctgacgttgtcgaggatcacgggcacgagcgcggtgggccgctcgcgccaacgcggccgggtgatgtcgatctcgccgacgcagcgcatgccgtaccggtcgaggtaggcctcgatggcgtcgcgtgcttcggtgccgcccgggagcttcgccagcccctccaggaagtcctcgtcctcgacgccctccaggtacgccaccacctgtggccacgggcggatcacgtccgccacgtcgagcagcgcgagacccatctccgacgtgacgttgccgggggcggacagggtcagcgtgtcagccgcgttcttctcccccagccactgccccagcttgtcgttgagccaccacgtggcttccatccccgccatgatcgcctgcatgctcagcgggtcaccgaggactcgcttgtgctcctggaaggcctgcagcaggaagtcgaacagcgccggtccgctcttcgtccggatgtcgcgctccagcgctgcgatggacgcctggctgcgctcgatcagctcggtgacgacggccggatcggtctcgatcggggcgggcccgccgctcctcggcggcccggcgggagccgcgtcggggagcgaggggacgaagccctcgcggtcgaggacggtctccagcgcgtcccgcatcagcggatcgcccttgcccatgacgtccaggaggccggcgcggctcgcgggcgaggccaggcgccgggtgacgtcgacgaacagccgcccgcctgccgtgggcatcggcaccatggccgtcagctgccacacggagatccccaggggcttcatggggtcggtcatcatctgctggtgaccgacggagacgtagacgtggttgtcctggtcgtcggtctcggggaccgggaagagcgtcgtgatcggccggctctggacgatccggaagtcgccgtcggccaggcaccattcgatgtcctgcgggcggccgaagtgcgcctcgatccgccgccccagccgcacgagccgcacgacttgcgcgtccgtcagcgccggccgctcccgctgccgcgcgtcgacggccacttcccgcgtaccgccccccggcagggcccgcacggcacactgcttggcggcgaccgtccgggagacgacctcgccgtcgcgcaccttgaagacgtccgggttcaccaggccggagaccagggcctcgccgaggccgaagccggcgtccacggtggcgaccttacggttgccggtgacggggtcggccgtgaacaggatgccggacgcgtgcgggaagaccatccgctgcacgaccacggccatctggaccgtgcggtggtcgatgccgttgcgcctgcggtagatcacggcccgctcggtgaacagcgaggcccagcaccggctgacatgccgcaggatcgccgccggtcccacgacgttcaggtacgtgtcctgctggccggcgaaggaggccgtcggcaggtcctccgccgtcgcgctggaccggacggcgcaggcggcccgctcaccgagccgggcgagcgcgccggtgatctccgccgcgagaccggcagggacggcggtctcctcgatggactgacggatccgcgcactgagcgcgcggaccgcctccaggtcgtccgtgtccacgcgcgacaaccggtcgagccggtcgtcgatcgacggcacttccgccatgatccgccggaaggcgtccgtcgtcacgcagaagccgtccgggacgcggacgccttcgatccgcgacagcccgcccaggtgcgcgcccttgccgccgacgacggcgacctgcgtctcgtcgacgtcctgaaggtccaacacgtactgctcggtcaccgtggcatctccggggtcgggtgcgtcctcggccgccgattctgcgccacgacgggggccttgccgcaaggccccccttgcgctgtacgttgaaactggcaaggggtgacctggtgtgcgcggctcgcgtgcgcttgagtgggatcatgtacgtcatcgtgttccgataccaggcaccgctggagaccatcgactccctcagggaggcccactacacccaccccgaggggatattcgcgcggggcctggcccggctggccggcccgctggagccccgtacgggcgggctggtcctggcggagggctcgcaggcggaggtggaggccgccgtcgcggccgacccgttcgtcaccagtggcgccgccaccgcggagatcctgcgcttccgcccgacatggcagcggagcgaaagccctgccgccggctgaccggcccgtcggcgttcaggccaccgacccgatccgccgcgccggcaccgaggccgggtcgtggtggatcggggtgtgagcgcccgtcagggaggcgccgctgccgccacggcgggacgcgacgatctccgcggcgatggacagggccgtctcctccggggtgcgggcgccgaggtcgaggccgatgggtgacctgagccgggccaattccagttcggtgacgccgacttcacgcaggcgctcgttgcggtccaggtgggtgcggcgcgagcccatcgcgccgacgtacgccaccggaaggcgcagcgccagctcgagcagcggtacgtcgaacttggcgtcgtgggtgaggacgcacagcacggtgcggccgtcgacgtcggtgttctccaggtacttgtgcggccactcgacgacgatctcgtcggcgtcggggaagcgggcccgggtggcgaagaccgggcgggcgtcgcagacggtgacccggtagccgaggaacttgcccgtgcgcaccagcgcggaggcgaagtcgatggcgccgaagacgatcatgcggggcggcggtacggaggactcgacgaggacggtgagcggggcgccgcagcgcgagccctgctcgccgatctccagggtgccggtgcggccggcgtcgaggaacgcggcggtctcggcggccaccgtgcggtccagttcggggtgggcgccgaagccgccctcccaggagccgtccgggcggaccagcaggggccggccgaggagttcggccgggccggtgacgatccgcgcgaccgccgccgcctccccacgggcggcggcggccagcgcggtcgcgaacaccggccgggccggaccgtcggcccgtaccggtgtgaccaggatgtcgatgacgccgccgcaggtcaggcccacggcgaaggcgtcctcgtcgctgtacccgaagcgctcaaggacggtctcgccgtcctccagggcctgcctgcacagctcgtagaccgcgccctccacacagcctccggagacggagccgatcgccgtgccgtcggcgtccaccgcgagggcggcgccgggctggcgcggggcgctgccgccgacggccacgacggtggcgacggcgaaggtgcggccctgctcgacccaccggctcagttcctcggcgatgtccagcatctgtcggtctccttagggcggttgtgtgaagggcgcggggctcggtcagtggacgccgagccagccctcgatcgggttgagggcgaagtacacgaggaagacggccgtcaggacccacatgaaggccccgatctcccgggccttgccctgggcgaccttgatgatcgtgtacgagaccacgccggcggcgacgccgggcgtgatggagtacgtgaagggcatgatgaccacggtcaggaagaccgggatcgcggtggcgcggtcgccccagtcgacatgccgtgcgttcatcatcatcatcgcgccgatgaccaccagggccgcggaggcgacctcggaggggacgatcgcggtgatcggggtgaagaagaggcaggcggcgaagaacaagccggtgatgacggaggagaagcccgtgcgggcgccctctcccacgccggtggcggactcgacgaacacggactggccggagccgcccgcgacgccgccgatgacaccgccggcgccgtcgatgaacagggccttggacaggccgggcatccggcccttgtcgtcggcgaggttggcctcggtgccgacgccgatgatggtggccatggcgtcgaagaagccggcgaggaccagcgtgaagacgatcacggtgatcgtcatgacgcctacgtcgccccagccgctgaaggacacgtgcccgaagagcgagaagtccggcatcgacacggggctgccgtggagttcgggggcgccgttcacccactgcttggcgtcgatgacgccggtcgcgttcaggatcgccgcgacgacggtgccgccgacgatgccgatgaggatggcaccggggacgttgcgggcctgcagggcgaagatcagcagcagggtggcggcgaagaggagcaccggccagccggacagctcaccgcccgggccgaggaccacggggccgccgccgggcgaggggttgcggccgacgaaaccggccttgaccaggccgatgaaggcgatgaacaggccgatgcccatggtgatgccgtgcttgagcggcaacgggatggcgttcatgatcatctcgcgcaggccggtgacgaccagcagcatgatcacgacaccgtaggccacacacatgcccatggcctgcggccaggtcatgttgggcgccacctgggtggagatgacaccggacacggacaggccggcggcgagggcgaggggcaccttgccgacgaagcccatgagcagggtcgtgaacgccgcgccgagcgcggtcgcggtgatcagggccttctggcccagggtgtctccggcgacgtccttgccggagaggatgacggggttgagcagcaggatgtacgccatcgccatgaaggtggtgacgccgccgcgcacttcacgcgcgatcgtggatccccgccgggatatgtggaagtaccggtcgagccaggaccgtcccgccgggacgcggctgcccgcgcccgcgtcttcggcggcggtcctgggctccactgactgctgggtcatggggccaactcccaaggttcataggtgcacccgcgaatgcccttcctgggcacgggatttgggaatggacggcccgggggacggcccgagacgaacctcgttgctggtacttcaaggaccgcgagcggagcggatctcgaagagatggggggagtgctccgggcggcgcggaaggtgtgacgttccggtgcgccgcccggagggtctgctgttcctcctgtccgggccggccggaacccgtgggcccggccggtccgttcgggagggttacgccttgccggtcaggtgctccggccgtaccggcgtgcgggggagttccagcccggtcgcgttccggatcgccgcgaggacggccggggtggacgacagggtgggggcctcgccgatgccgcgcagcccgtacggggcgtgctcgtcggcgagttcgagcacgtcgaccgggatggtcggcgtgtcgaggatggtggggagcaggtagtccgtgaaggaggggttcctgaccttcgccgtcttggggtcgacgatgatctcctccatgatggcgatacccaggccctgggtggtgccgccctggatctgcccgatgacggagagcgggttgagcgccttgccgacgtcctgcgcgcaggccagttcgacgaccttcaccaggccgagttcggtgtcgacctcgacgacggcgcggtgggcggcgaaggagtactggacgtggccgttgccctgtccggtgcgcaggtcgaaggcctcggtcggccggtgccgccactccgcctcgatctccacgacctcgccctccaggacgtccaccaggtcggcgaggacctcgccgccgtcggtgacgaccttgccgccctccagcaggagttcggcggtggcccaggcggggtggtaggagccgaacttgcgccggccgatctccaggacctgctcgcggacgagttcgcaggagttcttgacggcgccgccggtgacgtacgtctgccgggaggccgaggtcgaacccgccgagccgacctgcgtgtcggccgggtggatggtcacctgggtgacgccgagttcggtgcgggcgatctgggcgtgcacggtgacaccgccctggccgacctccgccatggccgtgtgcacggtggcgacgggctcaccggcgatgacctccatgcgcaccttggcggtggagtagtcgtcgaagccctcggagaagccgacgttcttgatgccgacggcgtagccgacaccgcgcacgacgccctcgccgtgggtggtgttggacaggccgccgggcagctgccgtacgtcggagccctcgctggactcccactggcgctcgggcggcagcggcatcgccttgacgcggcgcaggagttcggcgaccggggccggggagtcgaccggctggccggtgggcatgatggtgccctgctccatggcgttgagccggcggaactccacccggtccatgcccaccttgtcggcgagcttgtccatctgcgcctcgtaggcgaagcacgcctggaccgcgccgaagccgcgcatggcgccgcagggcgggttgttggagtagagggcgatggcctcgatgtccacgtcgtcgatgacgtacggtcccgccgacagcgaggccgcgttgccgacgaccgccggggaggcggaggcgtaggcgccgccgtccaggacgatccggcacttcatgtgggtgagcttgccgtccttggtggcgccgtgctcgtagtgcagccgggccgggtgacggtggacgtgcccgaagaaggactcgaaccggttgtagacgatcttgacgggcttgccggtgcgcagcgcgaggaggcaggcgtggatctgcatcgacaggtcctcgcggccgccgaacgcgccgccgacgccggccagcgtcatgcgcaccttgtcctcgggcaggccgaggacgggcgcgatctggcgcaggtcggagtggagccactgggtggcgatgtagaggtggacgccgccgtcctcctcgggcacggcgaggccggactcggggccgaggaaggcctggtcctgcatgccgaagtagtagtcgccctcgacgatgaagtcggccttcttggcggcctcgtcggcgttgccgcggatgatcggctggcggtggacgatgttggggtgcgggacgtgcccggcgtggtggtcgtcgcggctgtcgtggacgaggatcgcgtccggcgcggtcgcggaggcctcgtcggtgatgacgggcagctccttgtactccaccttgatcttggcggcggcgcggcgcgcggtctccgggtggtcggcggcgacgatggcgaccggttcgccgtggtggcgcaccttgccgtgggcgagcaccggggtgtcctggatctccaggccgtagtgcttgacctcggcgggcaggtcgtcgtacgtcatcacggcgtacacgccggccatggcgagggcctcggaggtgtcgatcgacacgatctcggcgtgcgcgacggtggagcgcaggatctggccccagagcatgtcctcgtgccacatgtcggacgagtacgcgaactcgccggtgaccttgagggtgccgtcggggcggagcgtggactcgccgatgccgcccttggtccggtagccctgggtgattttggtgggagcaccgttggccgtggtcatgctcagaccccctcggactggcgggcggccgccaggcggaccgcgtccatgatcttctcgtagcccgtgcagcggcacaggttgcccgacagggcctcgcggatgtccgcgtcggtcgggttcgggttgcgctcgagcatctcgtcggcggcgaccagcagacccggggtgcagaagccgcactggacggcgcccgcgtcgatgaacgcctgctggaccggggagagttcggtgccctcgccggtctgcgagtcggtgccctgggcacgccagcgcttggcgccgtcgagcgtcgtaccggcgtccttgccctgcgggccgcaggcgccgcgcgcgcagccgccctcggcgcgctgcttggcgaagtcggccaggccctcgacggtcacgacctcgcggccctggacctgtcctgcggcgaccaggcaggaacagaccggcacgccgtccaggcgcacggtgcaggaaccgcactcgccctgctcgcaggcgttcttcgagccgggcaggcccatgcgctcgcgcaggacgtacaggagggactcgccctcccagacgtcgtcggcttcctgcgggcgtccgttgacggtgaagttgacgcgcatcacgcagctccctcggtggtgcggcgggtgccgcggtacgactcccaggtccaggtcagggtccggcgggccatcacgccgaccgcgtggcggcggtagctcgcggtgccccggacgtcgtcgatcgggttgcaggcggcggagcacagctcggcgaactgcttggcgaccgacggggtgatgatcttgccgttgtcccagaagccgccctcttcgagggccgcgttcaggaactcctcggccgcctgggcgcggaccggggtgggggcggccgaaccgatgccggtgcggaccgtgcgggtctcggggtgcagggcgagaccgaaggcgcacaccgcgatgaccatcgcgttgcgggtgccgaccttggagtactgctgcgggccgtccgccttcttgatgtgcacggcgcggatcagctcgtccggggcgagcgcgttgcgcttgacaccggtgtagaactcgtcgatcgggatgcggcgggtgccgcgcaccgactccgcctccacttcggcgcccgcggcgagcagggcggggtgggcgtcaccggcaggagaggccgtgccgaggttgccgccgacgccgccgcggttgcggatctgcggggaggcgaccgtgtgcgaggcgagcgccaggccgggcagctcggcacggagattgtccatgatcttggagtaggggaccgaggcgcccagccgcacgctctcctcgccgacctcccactcgtagaggtcgccgacgcggttgaggtcgaggaggtactcgggccggcggtggtcgaagttgatctcgaccatcacatcggtgccacccgcaatcggcacagcggtggggtgctcggccttcgcggcgagcgcctcctcccagctggcggggcgaaggaagtccatgaccggctctcttcatcgtctcggagggtcgtacagattgagccaatccgtgtgcggcgggccaggctcgttcatgtgctgttcacgtggagtggagtcagtacacaaccgagtactccggcggggtcagtcaccgaaaccatgaagggtttggctggccgtgccgtgcatcttgtagattcgtatgaacgaaggtcgtcacccacctcttcgcttcccccgggaaacagaggtcacggcccggcgggaccccgccgggccgtgacctctg

SEQ ID NO: 155 - DNA, 9019 bp, Unknown
  Kingdom: Bacteria, Phylum: Actinobacteria, Class: Actinobacteria, Order: Streptomycetales, Family: Streptomycetaceae, Genus: Streptomyces
gcgccggccggcgcagttcctcgcggagcttcacgtagtggtggtattcggtcgcggcggcggcggcgatgagagcggtggcgttgagagccatggcgcgcagttgttcggtggtgagccgctgtccgacggcggacagttcaggacggtgcggggcggagcgcagcgcctcatcgaggatccgctcgtacgcctggcggtcctcgctcagcaggtgctgcggaacgctgttcatgtgcatcccccgatgctccgtagggcttggggctcgcatgacagcgagccgtcgggcagaaacggaggggagcctgctacggataagccgatggtagagccgtgacggcgcgcggtgacagggggtttccacaaattgcacgccgggctgcggtccggcccggcttcgcgggccgggccgtcgaacggtcagacctccaagggcagttgctggaccagcagctttccggccatggtcacgccgccgtccatcgcgatggcgagtccgtcggcgtagacgtgcggtccctccacgttcgggcccgtggtctcgtcgccgtcctcggagccgacttcgcccagcagatagggaatggggctgtgaccgtgaacgatgcgggtgccgccgtacgtatcgagcagcgagcgcacggcgtcggcgccgccctcgtcgcggaaggagaagcgtttggtgaacttgcggaacaggtcccagcactcgtccgcgtcgttacgggtgagggtctcgcggacggtgtcgttgaccgcttcgatcgagtcgccgtagtcgaggtaggaggtggtgtcggagtgcacgagcaggtagccgtcgacctcctccatcgcgtcgaggcgggccatccactgcaggtggtggtcctggaggcggtccatgtcggacttctggccgccgttgagcagccaggccgcctggaaggtggcggtgcccgcaccggaattgacgggcgtgtcgccgaaccgcttggcgccgagcagcaggagttcgtggttgcccatgagcgccttgcagtagccgccggccgccgccgcctcggcggacagccgcatcaccaggtcgatgacgccgatgccgtcagggccgcggtcggtgaagtcgccgaggaaccacagccgcgcggtgcccgcgcaccactggcccgccgcgttgatgaggccctgctcctggagtgcggcgaccagttggtcgatgtagccgtgcacgtcgccgacgacgtacagcgggccggggccgacgggggcctgcgcaggtgccaggggggcggggtcgaccgccacctggaccgtgtctccgcgctggatgacgggcaggtcgcgctgggtgggcgtgtacgcgtccgggtagccctcctcggccgccggagggccctcttccaggggtggcgcggtatcggcgtggggcgcgctgggggcgtacggaccggtctcgttcatgtacgcgggcacccggaagtcgcgcagtgccgccgtccgttccgcctcgggtccctgaccggccccctgagtcatcgacccctccaccattgcgccgcatctgcaccgcttcggactgcctggtcgcagcggcccgcggtgtcgtgcgcccatcataggaatgcggatcgcgccgtgtgatgacccaggggtggtgaatcggagcaggactcgggttcaccgcggctttcgccccgattgggccgtcttcggtggtcccgcgacgggctgtccttactgctcctccggcgttctgggcgggctcacggtcgtgcgcggcgggcgccgctgcgaggaggtgcgcacgatcagctcggtcggtatcacctgttcgaccgggtggtccgagtcgactccctcgatggcgtcgatgaggagttggaccacggcggtgccgatgcggcgcggtttgagggagagcgtggtgatcggcggctcggtgttggcgtagacggtggactcgctgcagcacacgagcagcaggtcctcggggacccgcaggccgtagcggcgggcggcggcgagcaggtccgtgccgttcgggtcgaacagaccgtagacggcgtcgggccggtcggggcgcgccagcagccggtcggcggcgacggcgcccgcgcacggatcgtgggcggggtaggcctcgtacaccgggtcctggccgacgcgctcgcaccagcgcaggtaggcgctcgtcgacagatgggtgtaggtgtcggtggtggtgccggtgagcaggccgatgcggcgggcgccggcctcggcgaggtgatcgaggatgtccaggaccgcggcctcgtggtcgttgtcgacccaggcggtgaccgggagggcgccggccgggcggccgtcgctgaccacgggtaagccctgccggaccagctcgctgacgaccgggtcctggtcggaggggtcgatcacgaccgttccgtccagggcgacgttcgaccacacgtcgtggcgcgaggtcgccgggaggatgacgagcgcgtagccgcgggcgagcgcggccgaggtggcggctcgcgccatctccgcgaagtacgcgaactcggtgaaggtgaaaggttcatccccgtacgtcgtcacggtcaggccgatgagccccgacttaccggtacggagtgtgcgtgctgcggccgagggtcggtaccccagccggtcggcgacctcacggacgtggcggcgggtggcgtccgggagccggcccttgccgttgagggcgtcggagacggttgtgatggagacgccggcggcggcggccacgtctctgatgcccgcccggcccggccgactgcctcgacgagaggtttccgcgcggctcacctggtgcttccctgctgctgtcatggcgagccgatagtagggctcatgcggtggggtagcgcggacgcatatgcacgcattggcaggcacgtttctgcatggccatacggggtcaactgcctaagaaaccaagctagttagacgattccacgcaaggaggtgatgcgacggcagccgtaggcctgtcgagccttcgaggtctcgaagaggtctcaactcacctgcacgagcgatgcgcgccacggcgcgagccaccggcgcatagatatatgtgagacgcgcccctcattcgcacatattcgtacacggatgcccctgatgcggcccgagcggtgccggcggaaccgcgagcggtgccgggtggttcgagcggcgccggcgggagcccggcagcagtgatgtcttccgaaccattcgcagggacggtcaatcctcataaggtatggagtattggagtcggcggtggtcatgaggaggacagcggtgagcgagacgaacccgaagctgcgcgccgagctggagggcatccccacctacaagcccggcaagcccgccgcggccgacggcccggtggcgtacaagctgtcctccaacgagaatccgtacccgcccctgccgggcgtcatggagacggtgacggctgccgcctgctccttcaaccggtaccccgacatggcctgcacggacctgatcaacgagctggccgagcgcttcggggtgccggcctcccacatcgccaccggcaccggctccgtgggggtcgcccagcagctgatccagtccaccagcgggcccggcgacgaggtcatgtacgcctggcggtccttcgaggcgtacccgatcatcacgcagatcagcggggcgacctcggtgaaggtgccgctcacgccgggtgaggtgcacgacctggacgccatggcggacgcgatcaccgaccgcacccgcctgatcttcgtctgcaatccgaacaacccgaccgggacagtggtacgccgggcggagctggaacggttcctcgaccgggtgcccggcgatgtgctggtggtgctggacgaggcctaccgcgagttcatccgcgaccccgaggtgcccgacggcgccgtcctgtaccgggaccggcccaatgtctgcgtgctgcgcacgttctccaaggcgtacggcctcgccgggctgcgcgtgggtttcgccatcgcccacgagccggtcgccgccgcgctgcgcaagaccgcggtgccgttcggcgtgagccagctggcgcaggaggcggcgatcgcctcgctgcgtgccgaggacgagctgctgggccgggtcggctcgctggtgtgtgagcgcacgcgcgtggtcgacgcactgcgcgctcagggctgggccgttcccgagacgcaggccaacttcgtgtggctgcggctgggggagcgcaccgtcgccttcgccgacgcctgtgagcgggcgggtgtggtcgtccggccgttccagggtgagggcgtgcgggtgaccgtcggggagagtgaggcgaacgacatcttcctcaagacggcggaggtcttccgccagggggcgtgagccctccctcacgagtcatccctccggtcctcgagggcctgtccggcggcgcggttcctccgcggtccgatccgccgggcgggccctcagtcgttcaccggttccacgcgcacggggtcgccgtcgcggaccgtcgcgagccggcgggggtcgccgtcgatccggccgaggacgttgcacgggctcgcgaggcggcattcgtcgcctcgcgagatcggcgtgggcccgtaggggagggccagcgcgtctccgtcggtccagaaggcgaccgttcctgcctccacgacctgcagagcgtcggtttcacgtggaacacggagaccggtgtcgaagtagacctcctcgccccaggtgcgggcggtggacacgagcggcagttccttggcgagtgcccgggtggtcggggtgtcgtcgaggtgggcggtgaggtggccggacggccaggaaatacgtatctgcatgacgtgcaattcaacaagttgttgaagtccctgccaagggggtgccgcgaaggcgaaggggggacccccggtgccacgtcgaaaatcggtacgtcataattgcttgtgaatgtgaacgcgttcacaagcgcgtccgattactgccttgttgcgtaggacacatcagggcaaaccgccgccgcacaactcggcgacgtaaggagagtgacgacgtgaacctggctttggcgccggagacactggcgcgctggcagttcggcatcacgaccgtctaccacttcctgttcgtgcccttgacgatctccctggccgccctgacggccgggctgcagaccgcctgggtgcgcacggagaaggagaagtacctcagggcgaccaagttctggggcaagctcttcctgatcaacatcgccatgggtgtcgtcaccggcatcgtgcaggagttccagttcggcatgaactggtcggactactcccgcttcgtcggtgacatcttcggcgctccactcgccttcgaggcgctgatcgccttcttcttcgagtccaccttcatcggtctgtggatcttcggctgggacaagctgccgaagaggatccacctggcctgcatctggatggtctccctcggcacgatcctgtcggcgtacttcatcctcgcggccaactcgtggatgcagcaccccgtcggctaccggatcaacaaggccaaggggcgcgccgaactcaccgatttctgggccgtcctgacccagaacaccgcgctcacccaggccttccacacactctccgccgccttcctcaccggtggcgccttcatggtcggcgtcgccgcctaccacctcgcccgcaagaagcacgtcggcgcgatgaagacctccctgcggctcggcctgatcaccgtggtcatcgccggcatgctcaccgcgatcagcggcgacactctcggcaaggtcatgttcaagcagcagccgatgaagatggccgccgccgaggccctgtgggacggccagaagcccgccccgttctcgatcttcgcctacggcaacgtcgagaagggccacaactcggtcgccatcgaggtacccggcctgctgtccttcctcgccgacgacagcttcagctcctacgtccccggcatcaacgacgtcaacaaggccgagcagcagaagttcgggcccggcgactaccggcccaacatccccgtcaccttctggggcttccgctggatgatcgggttcggcatggcgtccttcgccatcggcctggccggactctggctcacccgcaagaagttcctgctgccgcagcatctgcgggtcggcgacgacgaggtgccgcatctggtgctgttcaagaccaaggcgctcggcccgcagatgaccaagtggtactggcggatcgccgtctggaccctggccttcccgctgatcgccaactcctggggctggatcttcaccgagatgggccgccagccgtgggtcgtctacggcgtgctgcagacccggcacgcggtctcccccggggtctcccagggcgaggtcatcacgtccatggccgtcttcacgacgctgtacgccatcctcgccgttgtcgaggtgaagctgctcgcgaagtacgtcaaggcaggtccgccggagctgacggacgccgacctcaacccgcccacgaagatcggcggcgaccaccgtgacgccgacaagccgatggccttctcctactaggccgaggaaggcacagtcatggaactgcacgacgtctggttcgtcctgatcgccgtcctgtggaccggttacttcttcctggagggcttcgacttcggggtcggtgtcctcaccaagctgctcgcccgcgaccgggtcgagaagcgggtgctgatcaacaccatcggtcccgtctgggacggcaacgaggtgtggctgctctcggcaggcggcgcgaccttcgccgctttccccgagtggtacgccacgctgttctccggcttctacctgccgctgctggtcatcctcgtctgcctcatcgtgcgcggagtggccttcgagtaccgggccaagcggccggaggagaagtggcagcgcaactgggagcacgcgatcttctggtgctcgctgatccccgcgttcctgtggggcgtggccttcggcaacatcgtgcacggcgtcaagatcgaccggaacctcgagtacgccggcagtctcggtgacctgctcaacccgtacgcgcttctcggcggcctggtcacgctgacgctgttcaccttccacggcacggtgttcacggcgctcaagaccgtcggtgagatccgggagcgggcgcgcaggatggccctgcgggtgggcctggtgacggccgtcgtggccctcgccttcctgctgtggacgcaggccgacaccggcaacggtcgcagcctggtcgccctggtcgtcgcggtcgtcgccctggtcgccgcgctggtggtcaatcaggcggggcgggagggatggtcattcgccctgtccggcgtcaccatcgtggccgccgtggcgatgctcttcctgtcgctgttcccgaacgtcatgccgtcctcgctgaacccggactggagcctgacggtcaccaacgcctcctccagtccctacaccctgaagatcatgacctggtgcgcggggatcgccacaccgatcgtcctgctctaccagggatggacgtactgggtcttccgcaagcggatcggcacgcagcacatcgccgaggccgcgcactgagtccggtgaggggtgtgtttcacgtgaaacacacccctcgggaccgaagggcatgtttcacgtgaaaccgatcgatccgcgtctccttcgctacgcccgggccacccggctcttcctgatggctgtgatcggcctcggtgccctgggcgcggggctcgtcatcgcgcaggccatgctcatcgccgaggtggtcgtcgacgccttccagcaccggatgtcggtcgccgaactgcgcacgccactcctgctcctggcggccgtcgcctgtggccgggcgctggtctcctggctcaccgaactggcggcgcaccgggcgagcgccgcggtgaagtccgaactgcgcgggcggctgctcgcccgcgcggcggcgctgggccccggctggctgagcgagcagcggaccggctcgctggtctcactcgccacccgtggcatcgacgccctggacgactacttctcgcgttatctgccgcagctcggtctcgcggtggtcgtcccggtcgcggtgctggccaggatcgtcaccgaggactgggtctcggcggccatcatcgtcggcacgctccccctcatccccgtcttcatgatgctgatcggctgggccacgcagtcccgcatggaccgtcagtggcgtctgctgtcccggctgtccgggcacttcctcgacgtggtggccggtctgccgaccctgaaggtgttcggccgcgccaaggcgcaggctgagtcgatcaggcgcatcacggacgagtaccggagggcgaccctgcgcacgctgcggatcgcgttcctgtcctccttcgcgctggaactcctgtccacgctgtcggtggccctggtcgccgtgtcgatcggcatgcggctcgtcagcggcggcatggacctgtacaccggcctggtcatcctcgtgctcgcacccgaggcctatctgccgctgcggcaggtgggcgcgcagtaccacgccgcggccgaggggctggcagcggccgaggagatcttcgaggtactccagacaccggtgcccgagtccggcacggcagccgtttccgccgggcctctcgccttcgagggcgtgagcgtccgctaccccggccggtcggcggacgccgtgaccgaggtgtccttcgccgtggagccgggggagaccgtggcgctcgtcggaccgagcggcgcaggcaagtcgacgctgctgagcgtcctgctcgggttccgccgtcccaccacgggccgtgtccgtgtcggagacaccgacctcctcgacatcgacccggagcagtggcgttcacgggtcgcctgggtgccgcagcggccccacctgtacgccgggacgatcgccgagaacgtccgcctcgcccggcccgacgcggacgacacggcggtccgtgcggcgctggccgacgccggagcgctgggattcgtcgacgcgttgcccgacggaacgcggac

SEQ ID NO: 156 - DNA, 6996 bp, Unknown
  Kingdom: Bacteria, Phylum: Actinobacteria, Class: Actinobacteria, Order: Streptomycetales, Family: Streptomycetaceae, Genus: Streptomyces
cacgagcgcgttggtgaccagttccgagaccacgaggagcacgtcgtcggcggcgtcggcgggcaggttccagccgcccaggagccggcgcacgcgacggcgtaccgccgagacggccccgggcgtgtgcagcagggggaaggcgtggtcgacttccccgtggggcgcggcgtcgagctgcgctacggtcatgtgccttcctcctccggcaggtgccgccgccctccgtgcgggcgcgacgtgtcacgctaaggaacaaatgccccgcaggtcaatgaaccgaggtcggcattaccgaacaacagtcccgaacggggcgaacagggctaatatcgccccatggccggccccgtccagtccatcgaacgagccgcggcgatcctgcgcctcctcgccggcggcccccgcaggctgggactcggcgaggtggcgtcgtccctcggactggccaagggcaccgcacacggcatcctgcgcaccctgcagcacgtggacttcgtcgaacaggacgagaccacaggaaagtaccagctcggagcggcactgctgcatctggggaccagttacctcgacgtcaacgaactgcgctcgcgcgccatcaactgggccgacgccttggccgcccgcagcggcgaggcggtgcgcatcggcacaccgctggagggccgggtcctcgtcatccaccatgtcttccggcccgacgacaccctgcagaccctggacgtgggcgcgctgctgcccctgcacgcctcctcgctcggcaaggtcctgctggccttcggcacggccaccctcggcccgctgcccgaggacggcctggaggcgtacacgcggcacacgctcgtcgtccgcgaggacctggaccgcgcgctcgccgagatccgcgaggtcgggtggggcgcggaggtccaggagatgaccatgggcgacgcggggatcgccgcgccgatccgcgggcacggcgggctcgtggtgggcgccatctgcctgtccggtcccgtcgaacggatctgcgacccgggaggccggccgctgcccgcgctgatcgccctgctccgggaggccgcacgggcgatttcccgcgacctgggagcgggccgttggtagaccccggtaggtctctcccgtcgagcccgtcgagcccgtcgagcccgtcgagcccgtcgagcccggcagggcccccgcaggacaggttgccgcgcccgcgcgacgcaccggaaggcaggaccgatcatggttgaccggtatgtgatgtccatcgaccagggcaccacgtccacgcggtgcatcctgttcgatcaccgcggacggctgtgcgcggtcgcccagcgcgagcaccagcagtacttcccccgccccggctgggtcgagcacgacgccgtggagatctggcgcaacgtccagcgcatcgtcccggaggcgctgcgcaacgcgggcgtggacgccggcgcgatcgccgccatcgggatcgccaaccagcgtgagacgaccgtcctgtgggaccggcggaccggggtgccggtgggccgcgccatcgtctggcaggacacccgcaccgcaccgctcgtcgacgcgctcagggaccggccgggcgacgagttcttcctcgaccgctgcggcctgcccgcctccacctacttctccgcccccaagatccgctggctcttcgagcacacgcagggcctggaggaacgcgcccgcggcggcgacgtgctgttcggcacgatggagagctggctgatctggaacctcaccggcggcaccgacggcggcctgcacatcaccgaccccaccaacgccggccgcaccatgctcgtcaacatccgcaccctgacctgggacccggaactcctggacttcttcggcgtgccgcatgccctgctgccggagatccgctcctcggccgagagctacggcgaggcccgcgccctgctccccggcgtccgcatcaccgccgccctcggcgaccagcaggcggctctgttcgggcagacctgcttctcgcccggcgaggcgaagtgcacctacggcaccggcagcttcctgctgatgaacaccggcaccgaactggtccgctcccgccacggactgctcaccaccgtcgcctacaagatcgcgggcgagcccacgatctacgccctcgaaggccccatggccgtcaccggctcgctggtgcagtggttccgcgaccgtctcggcctgatcagcaccgcgccggagatcgagaccctggcccgcacggtggaggacaacggaggctgctacatcgtccccgccttctccggcctcttcgccccccactggcgcagcgacgcccggggagtcgtcgtcggtctcacctcctacatcaccaaggggcacctggcccgcgcggtcctggaggccaccgcctggcagacgcgggaggtcgtcgacgccatgaacgccgactccggtctcgccctcaagcagctcaaggtggacggcggcatgaccgccgaccacctgctcatgcagatgctcgccgatgtgctcgacgtgcccgtcgtccggcccctggtgtccgagaccgtctcgctcggcgctgcctacgcggccggtctcgccgtcggctactgggcggacctggaggtcctgcgccgcaactggcaccgggccggacagtggctgccgcggatggacgccgagcggcgggcgtgggagtacgagaactggcagcgggccgtcgaacggtccctggactgggtccggccgtgcccggagggcggctgacgccccgcgaaccgccgcgaatcgccgccgccgtggtggttacccggacgtccaggggttcggaagtgagccccttggggctctccgcgccgtgtgccgcggagggccctcacgcgtgtccgggcccactcgcgtgcggagccgggcctcgtacgaggccggacgccggaattccgcgaccgggacgattgcgcggtgcgtggtcgggtacgcgagcaggaccgtgccagggcgcagcgcccggacgggccccacgaccgccgcgaccagggacctgccatggacacacccgcgaacgaccacaccgccacgcccgcccagcatgcgctggacgtgctcgccgagaacgcagaggacaccggggcgctggacacgctggccggcagcgacgtgctggtgcccgtgccggacgacgtcagcgacgaggacgccaccgatccgtcggcggtggcgctgcccgtcttggagcagccgggcggagtgcccgtcgtgcccgtgttcacctcggagctggagatgtccgagctgctgcccttcatctcccggtaccgtctggtgccgctcggcgctctcgcctcccagtggccggccgacgatctgtcgctcaccatagacgccagctcgccgcacggcctgacgctcacctcggagggcgtacgcaccctgctgggccgtccgcggggctagggcctgtccggcggatcaagccgccggagagatacggcaccctgtatgcccacgggggtggggtggcggcatgacccgccggacgggccctgggggcaaccggttcggtccggccccggttgtcacgcgtcctggatgagtccgacgaggttgccgtccgcgtccttcaccgaggcgatcatccggccgccgccgacgtcctgcgcgtcctggagcagttcgccgcccgcatcgagcagcgccgccaggcggccccggatgtcgccgacgtgccagtacggcaccggacctgtcatgcccttggcgtgcccgttggggtcgagaccgacgtcctggccggccgccttgtaaccgacgtagtagggctcgtcggcgtacggctcgacctggagcagtgcgccgaacagggccttggcgcgggcgaggtccttgacgggatagatgatcgtcttgactccggcggtcatgtcggccatggcggaactcctaggtggtgggatggatccgacgggtgcgtcggtggttccaccgtagggcgggggagggcggtgcggcttctccgatcctgaccggccgggccgtcgtgggggatgggctccggcgaccgaggcgagttcagacggacagcgcgtgtacgtcaccggggcttcatgtcggcgcagtaagagtgtctgcgacgcgagtgcgtctacaccactgtcgaccaaacatccccagaactggatcccatgagcgccatctccgtcggtcaggccgtcgtcctcggagtcgtcgagggggtgaccgagttcctccccgtgtcctccaccggacacctcaagatcgccgaggggctcatggacatcccggtcgacgacagctccgtcgtcgggttctccgccgtcatccaggtcggcgccatcgccgccgtgctcgtgtacttcttcaaggacatcgtgcggatcgtctccgcctggttccgcggcctgaccgaccgcgagcagcgctaccaccacgactacaagttcgcctggtgggtgatctacgcgacgatcccgatcgtcgtcgtcggcctggccgccaagccgctgatcgacgggccgctcggctcgctgtgggtggtggcgggatcgctgatcgtcggcagtggggtgatgtggtgcgccgaccagatggggcggcacaagcgcggcgaggacgacacctccttcaaggacgcgatgctggtgggcacctcccagatcctcgccctgctcttccccggcttctcccgctccggcgccaccatgtccaccgcgctgatcctcgacctggaccgggtcgccgcgacccggctctccttcttcctgggcatccccgcgctgaccggcgccgggatctacgaactgaaggacgccctgggcgccggggtgggcgcggcgccgctggccgtcggcacggtcgtctccttcgtcgtcgcctacgcctccatcgcctggctgttgaagttcgtcgccaagcactccttcaacgccttcgtcgtctaccgcatcgccatcggcgtactgctcttcgggctgctgggcacgggcgtcctcgacgcctgagccggccggagcgcgggacggccgccggggcgggacttgacacccccgccccgcagaccggaccatcgcaccgtgaacctgtcagacagccagacaggtgggcagccgccccggcgtgtcagcgccatggaagcggtgctcacccacctgcgcggcgccatcgagcgcggcacgtacgcggtcggcgacaaactgccgtccgaggcggagctgtgccgcacgctcggggtctcccggcccgtgctgcgcgaggcactgcgcgccctgcaggccctgggactgaccgtctcgaagaccggcaagggcaccttcgtcgtcgccgtctcggtggaggaccccaccttcggcgactacaccgccggccacctcatggaggtgcgccggcacatcgagatccccgtcgccggctacgccgccgcacggcgcacgcccgaggacctcgaccgcctgacccacctgctggaacgcatggagcaggagaccgacacgacctcgtgggtcgcgctggacaccctcttccacctgtccgtcgcccaggccgcccagaaccccgtcttccgccgcgtcatcgaggagatccgggacgccctggcccgccagtcggcgttcctcaacgaactgggcggccggcgcgaacagtccgaccgcgagcaccgggcgctgctcgacgcgctcgtcgacggcagcgaacaggacgcggtgcgggccatgtcccaccacctcgaccgggtcgggaccaccctcaccgacatcgtgcgctcctcgcacaaccccaccgcggccgacgcgtgaaccccgcgcaggccgagccacccacccaccagtgatccaggcagtgatgtacagcagctttcccgccgaggcacccctcgtccgcgaaccccgccacgtccccgtcgcccacctcgtacgcggcggagtgaccgagggcgtccaccacggctccgtcgtcgtcctcgacgccgacggccgcatcgccttccacctcggcgatcccgaggccgccttctacccgcgctccgcgatcaaacccgtccaggccgtcgccatggtgcgcgccgggctcccgctggagggcgaactgctctcgctggccgccgccagccactcgggcgaggaacgccacctcgccggcacccggcggatcctggaactggccggcctgaccgaggacgacctgcgaaacgtccccgacctgcccttcgacccggtcgtgcgggacgcctgggtgcgtgagggccggctgccctcccggctcgcgcagaactgctcgggcaagcacgcggccatgctctacacctgccggctcaacggctggtccctggacgactacctcgacccggcccacccgctccagcaggccatcgccgagatcgtcgaggacctgaccgggcagcgcgtcgcgcgggtcaccgtcgacggctgcggcgcgcccctgttcgccatctccctgcacggcctggcccgcgccgccgcccggatcaccaccgccgtgtccggcacgcccgaggcccgggtggccgacgcgatgcgcgagcacgccgagatggcgtccggctccggccgggacgtggccgcgctgatgcgggccgtgcccggactgctcgccaaggacggcttcgaaggggtccaggtcgccgcgctgccggacggccgggccatcgccgtgaagatcgccgacggtgcgaaccgggcccggataccggtcgccgcggcggccctcgtccgggcgggcgtcgacgcgtccgcgctggccgagttcgcgggcgagacgctgctcggcggcggccgtccggtcggcagcgtccgccgcgtcggcccgctggacccggacgcggacctgcgcccggaccaggacacggagtcctcgccggtcgccgtgcgcggctgacagccgggccccgtacgtacgcgccgcaccggtccgtaccggcccaaccggccccgtgcgccgtcgcggaacggtacgggcggtgcgggcgggccggtgatg

SEQ ID NO: 157 - DNA, 8365 bp, Unknown
  Kingdom: Bacteria, Phylum: Actinobacteria, Class: Actinobacteria, Order: Streptomycetales, Family: Streptomycetaceae, Genus: Streptomyces
ccgccgagcgggccgcgtacctggagcaggccgggcggtacgcgtgggagcgcggcgcgctggacgaggcgctgcggcacttcgcggcggcgctgcgcctggaccccgcgctgcgtgacgcccgggccgggcaggcgcgcacgctggcctcgctggaacgccccgcggaggccgtacgggcctacggcctggcgctcggcgcccggccgcgcccggagcacctgctggaactcggcgagctgtacgagtcgctggggcgggaggaggaggccgaggcccagtacgaccggctgcgggagctggccggacaggacgcggcggccggggtcgacgacgagctggtcctcggccggctggaggcggaccacggcgacggccagcccggcaccgccgtggccgacgcgctgggctgggcgctgcaccgcgacgggcaggacgaggaggcgctggggttcgcgacggcggcgacggacgagaagcagggcggcggggtgcgcagcgcgctgtacgagtaccaccgcgggatggtcgagcagggcctcgggctgtccgggcccgcgcgccggcatctggcgcaggcgctgcgcaccgacccgcgtttctcgccgctgtgggccccggacgccaccgaggccctggacgagctgggcgaaccggtacccgccgaggcgcccgagggggtgagcgtcgcggcggagttcaccgcgacgcagtaccggtggaccgctgcgcggtctcagctcacagcgacgccgtcccgatgagggcgttgcgggtgaccagggccgccaggcgctcctcgtcgaggccctccgtgttctcgggccgccggggcagcaccatgtaccgggtctccgcgctggagtcccacacgatgatgtcggtgccgtccggcagttccgtgccgaactcggcgagcacggcccgtggttcgcggaccacccgggagcggtaggcctcggacttgtaccagctcggggacggcccgagcagccgcagcgggtagcaggagcacagcgtgcagacgacgacgttgtgggtcgtcgcggtgttctccaccaccctcagccgctggtaggagccttccatgtagccgagttcgcggacggcggccgtgccgtcggccagcagcctcgccttgtaggcggggtccgtccaggcgcgggccacgacgcgggcgccgttcgcgggtgaggcgccggtgagggaggcgtcgatgatctcgtcgaggcgggcgccggagagcacgcccttctcctccagcagggtctcaaggcgtcgtacccgccgggcgatcgccgcgtccgagtggtcaccgctcatcgttctgctcctccggacggctcaggtagctctcccacagatccaggacgacgtggtggtcgccctcgccccacaggtcacgggccgcgaaccggacggcgtagacctgttcgacgggggcgtcggcgcggccctgcgcgctgacgtcggcgagcggggcgcgtccttccggttcgacgacgacgccctgtttgccgcgggcgtagcgcggcaggcgggtgtggtgcggcgggtcgtgcgggaaggtgcggacccgggtgccgggggcgaagcggtcaggcatcgagttctcccgggctcaggacacccttgcgttccagcaggatgcggatggcctcgaaccagcgctcgtagtacgaggtggtgaggtactcgacgggcggcatcgactcgatggcgtcccggaactcgttggtgttgaacagcccttccgcgcgcagggcgttgagcaggccgacgacccgcgcctcccagtccgcgtggaagggcgcggggtcgtcggtggtgtcgaccgcgccgaagccgagcgtgccgcccacgtcgttgatcctggccatgggcggcagcctacggcctgacggccgggccgtcgcgggaaggccgcggatcagaggttgccgcggcgctcctgctcgcgctcgatcgcctcgaacagggccttgaagttgcccttgccgaagcccatggagccgtgccgctcgatgatctcgaagaacaccgtcgggcggtcctggaccggcttggtgaagatctgcagcaggtagccgtcctcgtcgcggtcggcgaggatcttcagctcgcgcagggtgtcgatgggcacgcgggtgtcgccgacccactcgccgagggtgtcgtagtacgagtccggggtgtccaggaactggactccggcggcgctcatctgccggacggtgtgcacgatgtcgttggtgttcagcgcgatgtgctggacgccggcgccgccgtagaactccaggtactcgtcgatctgcgacttcttcttggcgatcgcgggctcgttgatcgggaacttgaccttgagggtgccgtcggccacgaccttcgacatcagcgcgctgtactcggtggcgatgtcgtcgcccacgaactccttcatgttcgtgaagcccatgaccttgttgtagaactccacccactcgttcatgcggccgagttcgacgttgcccacgcagtggtcgaccgcctggaaggaacgctgggcgggcggctcgaccatgggggcggcggccgtgtagccgggcaggtacgggccgtcgtagccgctgcgctcgaccagggtgtggcgggtctcgccgtaggtggcgatcgcggcgaggacgacgatgccgtgctcgtccttcagctcgtacggctcggccacggagcgggcgccgtgctcgacggcgtaggcgtacgcggcgcgcgcgtccgggacctcgatggcgaggtcgacgacgccgtcgccgtgctcggccacgtgctgggcgaggaagtggccccaggtggtggcgggcttgatcaccgaggtgaacacgaaccgggcggagccgctctccaggacgtagctcgcggtctcgcggctgccgttctccggtccggagtaggcgaccagctgcatgccgaaggcggtggagtagtagtgcgctgcctgcttggcgttgcccacggcgaagacgaccgcgtccattcccttgaccgggaaggggtcggcctgccgtgcggtcgcgtcgggagtgtgctgtgtggtctgcgtcatagcggaagcgtcacccggcttcgcaaggtgcgcaatagttcgcgtattcactgggcaaagtgagcagtgaaagcccggcagcggcgggctgtctgtacaggatgaccaccctgggaggcgaggctcatggcgatcgatcatctggacggccgcatcatcgtgctgctggcacgcgagccgcgcatcggcgtgctggagatgtcccggcggctgggggtggcgcgcgggacggtgcaggcccggctggaccggctccgctcgggcggggtcatccgcggtttcggcccggaggtggatccggcggcgctcggctatccggtgacggcgttcgcgacgctccagatccgccaggggcagggcgcggacgtgcgcgcccatctggcgacggtgccggaggtgctggagctgcacaccaccaccggcaccggcgacatgctgtgccggctggtggcccgctccaacgccgacctccagcgcgtgatcgaccgggtggtcggcatcgagggcatcgtccgcgcgtccacggcgatcgtgatggagaacccggtgccgatgcggatcattccgctggtggagcaggcggcggaggagtagccgaagggccgatgcaaaagactggttgcaaagaagtacttgcaagggttcctttgcaagcctatctttgtacccatgaccgagcctcagcccgactcccaggcccagcccgactcaccgtcccagcagcccccagtccgccaactcgacgcccgctccctcagaggactggcccacccgctgcggatgcggctgctcaccgcgctgcgccacggcggccccgccaccgcctcccaactggccgtgaaactcggcgagtccagcggtgccaccagctaccacctgcgtcagctcgccgctcacggcttcgtcgaggacgcgccggagcagggcaagggcagggagcgctggtggcgggcggcgcacggtggcgtgagcttcgacgagcagttgctcaaggaccccgacccggcggtccgcggcgccgcggacctgttcctgcacgagatcgccaaccagcgcacccgggaactggcgacctggctgggcaccaagaacgactggtccgaggcctggaccagtgcttccgacatgagcgactggaccctgcgcctcacgcccggcctcgccctcgacctcatcgagaagatgcacgcgctcgtggagagctaccgggccctggccccggccgagggcaccccggagagcgagcaggtccgcgtccacacccacgtcctccccacccacacggcctgagaggcagcagcccgatgcatcccgagatccacctcgtcctgcaccacgcccgcgccgccgaactccgcgcggaagcggacgcccaccggctggcgggcgacgcacggcaacggccccaacagccgcgtgacctgcgggcccggctcggctggaccctcgtggaggtcggcctgcgcctggccacggccacgcccgccgttccaaagaccgtggccgcctagtgctgtggcccgaaaggcttgccggaaagctcgcggcgtccggtgcggtgggggcaccgcccgcgcgagcgaagccgagcgtggggagccgtgccgggcgtcgcgacccggtgaacctttccggtcgcagcactagcagctcggtacggccgactccttgccctcgcgcagcgcggtcagcgcgccgatcgcacccttcagcgtggtcaccgggaccagcctgaggcccttggggagttccgcgccggcgtccttgcactcggccttcgggaccaggaagaccgtggcgccgtcccgccgcgcggcctgcgtcttgagggcgacaccgccgaccgcgcccaccgtcccgtcgggactgatcgtgccggtgcccgcgatcgtacggccgcccgtgaggtcggtgccgccgccgtcgccgtgcagcttgtcgatgatgccgagcgtgagcagcaggccggcgctcggtccgccgacgttggcgaggtcgagcttcacgtcgatcttctggccggacttgccgaggtacttcagcgcggcctgggtcgccgcgtcctgcgactccttcatctgcccggcgttgtgctgctcgatctgctgcacggtgtcgccgctcgggtagacggcgtcgcgcggcatgaccgcgcggttcgtggcgaaccagccgtcgatcacgtcgcgcagcgagatgtgcgcgtccgggccggtcgcctcgatggtcaccatccgcagctgcccgtcggtcttgcggaggggcgcgcccgagatcgtgatcacctggttgcccttgtaactgccgagcacgtccgccgtcgaccccggctgcgccaccgagaacggcagcggagcgaacaccgccgtggcgatcagggccacgacgggcagcgcgcagacggtgagggcctgggggcgtgtgaggcgagagagcacgggttcaatctacgcgagggtgcgtcacggtcacctgagtgcctcggcgacctcacgggcggcgtcgaccacccgcggccccacccggtcgggcacggcgtccgcgagcatcaccacgccgacgctgccctcgaccccgctcacgccgagcagcggcgccgcggctccgcaggcgcccgcctccagttcgccgtgggtgagggtgtagccgggttcggcggacggctggcggcgggcggtgagtatcgccttgcccgcggcgccccgctccagggagtggcggaaaccggcccggtaggcgacgtggtagtcggtccaggtgggttcgacgacggcgaccgcgagcgcctccgccccgtcgaccagcgtcaggtgcgcggtcgcgcctatgtcctcggccagggagcgcagcgcgggcagcgcggcctcgcgcaccagggggtgcacctggcggcccagacgcagcaccccgagtccgacgcgggcgcgtccgcccaggtcgcggcggaccagcgcgtgctgttcgagggtggcgaggagccggtagacgacggtccggttcactcccagcctctgggagagttcggtgacggtcagcccgtggtccgtgtcggccagcagtttgaggacccgcagtccccggtcgagcgtctgggatgtctccgcggtcacgacgcccactccttcagtggtgaggtcggcggcgctccttgcggcaggtgcgtcaccgagtcccgtcagtggcgcgcgacgaaggccgccgatcggccggcggtccgggggcggtcccggacttcagtcgcttcacggctgcgctccgcggcggctctgccacggggcgtgtgcgtagcgggacagtagcgaagcaggttcgctgagcggaaggctccgtccagaatccgggcagcgccggacgggaactgttcgcgtacgtcccgatacgtaccgcacacccctgcgcaaggtcctcacagctcactcgggcaccaggtgcgacggccctcagcacgcgggtcgcccgccggccacctcgttcccctggcgcatcggcgtggcggccctcagcgcatgcgggtggcccactcctgcaccttggcgatgcgctggcgcagttgcccggccgtggcctcggcgctcggcgggccgccgcacaccctgcgcagctcggtgtggatcacgccgtgcggtttgccgctctggtggacgtaggcgccgaccatggtgttgagctgcttgcgcagctccatcagctccttgtgggtgaccacgggccgccgctcggcgggcagctcgagcaggtccgcctggtcgtccggcttcttgcggctgtgcgcgatctgccgggcctggcgcttctgcagcagcagctgcacctgctcgggttcgagcaggcccgggatgccgaggtagtcctgctcctcctcgctgccggggtgggcctgcatgccgaactcggcgccgtcgtagaggacccggtcgaagacggcgtcggactccagcgcctcgaagggcagcatgtcctgctcgccggtgtcctcgtcctgctccctgttcgcctcgtccatctccttctcggactcggcgtaggggtcctcctcgccctccttcttcggcttgtcgagggcgtggtcgcgctcgacctccatctcgttggcgaaggtcagcaggtcggggatggtcggcaggaagacggaggcggtctcgccgcgccgcctggagcgcacgaaacggccgacggcctgcgcgaagaacagcggggtggagatcgtcgtcgcgtacaccccgaccgcgagccgggggacgtcgacaccctcggagaccatgcggacggcgaccatccagcggtcgtcgccgtcgctgaagtcgtcgatcctcttcgaggcgccggtgtcgtcggacaggacgacggtggcggcgctgccggtgatctcgcggatcagtttggcgtaggcgcgggcggagtcctggtcggaggcgatgaccagggcgccggcgtccgggatggccttgcggacctcggtgagccgctggtcggcggcgcgcagcacggacggcatccactcgccgcgcgggtcgagcgcggtgcgccaggcctggctcaccgcgtccttggtcatcggctcgccgaggcgggcctcgatctcgtcgccggccttggtgcgccagcgcatgttgccgctgtaggagaggaagatgaccgggcggacgacgccgtcgctcagggcggagccgtaaccgtaggtgtagtcggcggccgagcgccggatgccgtcgttgccctcctcgtacgtcacgaacgggatggggttggtgtccgaacggaacggcgtaccggtcagcgcgagccggcgtgtggcgggctcgaacgcctccaggcaggcctcgccccacgacttggagtcaccggcgtggtggatctcgtcgaggatgacgagggtcttgcgctgctcgacgcggttgcggtgcagcatggggcgcacgccgacgcccgcgtacgtcacggccacgccgtggtactcccggccgagcgggcccgcgctgtactcggggtccagcttgatgcctatgcgcgcggcggcctcggcccactgcttcttcaggtgctcggtcggcgcgaccacggtcacctgctggacgacatggtggtgcagcagccaggaggcgagggtcagcgcgaacgtggtcttcccggcgccgggggtggcgaccgcgaggaagtcgcgcggctgctcctggatgtacttctccatggcgctctgctgccaggcacgcagcttgccggcggttccccagggggcacggccggggaaggcgggcgagaggtggtgggaggaggcagacacggggg

SEQ ID NO: 158 - DNA, 10250 bp, Unknown
  Kingdom: Bacteria, Phylum: Actinobacteria, Class: Actinobacteria, Order: Streptomycetales, Family: Streptomycetaceae, Genus: Streptomyces
cgcggcggggtcgggcagctcctcggccaggcgctgctccagggtctcgccgcgcccgacggcgacggcatcggtgactgtgacggttccgacggggaactcctggacaacgaggtcggtggtgcccgctccggccgcctggtcgcacccgacgagggagcccacgaggacgaggagagcgcgctggtcgccacggacgtcggcatcgacggcgcggccgcttccgccgaggaggcggcgatgcacgtcgtcgacgaagacaccctctacggctgaccccgctgccggacggccgtcgcccccgcctcttcccgcgccaccgccgcacgacgaggagcattcatgcagcaggacaagcaccccgactaccacccggtggtcttccgcgaccgggccgccggctacgccttcctgacccggtcgaccgcggccagtgacgagaccatcgactgggacgacggtgagacctacccggtcgtggacgtggagatctcctcggagagtcatcccttctacaccggcaaggcccgcacggtggactcggagggccgtgtcgcccgcttcgaacgccgctacggcggcggctcgggccagggctgagggcggaaacgacggacccgacggatcggcccgccgtccgcgcggatgccgggtagagggcggccgcggggacggggtgcgcctcagatgacgttcagcgcggccgcgcagcccactccgcccagcaccatgaagaccggcatcagcaccttgagctcgatccagcttcccgcccggaagcgcatcgccttgggcggaccgatggggtaccagcgcctgcggcccagcggtatcggccacaggatggggcagccggagacggtcagcgcgtccccgatgtcgtgcaccagggcgcccagcacgatcggcagccccagccacaggtactcctggcccggcgccgtgaacagccagtgcgagccgttgccgggccggtccaggattccggcgaggatccaggcgctcgtcccggccagcaaccacaccaggatgtcgctgctggagccgcgggccgcccgccagagcaggccctcgatggccagcaccatgtgcgcgaagaggatcgcgagcaccgcccagcgtccgccggtgatcgccgcggcggaggcaccggcaccgatcaggaccgcccacagccaggtgtgggtcagcgtccggtggccaccggaacggcgtgggtcgcccttcttgcgtgtcgccttgtagacggcgtaggacaacttgtcgacgatctcgcagagccagtgcgacagagggccgaaggcccgcgagatggtggcggccttgtggtccaggtccggggcgagcgccgccccggcgcagatcagcgcaccgaccagcaggaccggccagggcatcgggtgcccggccgcggcggtcgccgctccgacgccgagccaggccgcggcgcccgacagtgagtgtgctggtcccatcatggccgttccccgccccattcgtcgtgagttgccgcccagttggcccggtgcgtcgagagtgcgtcggcgacacagcgtagcggtcgtgatcttcccttcggcagccgattcccgcccgggcggggcggccaggcaagatgggtgcgtgaccctcatcgatcagctgccgccgaccgccgaccccgacgccctctacgaagccttcgagtcgtgggcccaggagcggggtctcacgctctacccccaccaggaggaggcgctgatcgaggcggtctccggggcgaacgtgatcgtgtcgacgcccaccggctccggcaagagcatgatcgccgcaggtgcgcatttcgccgccctggcccgggacgaggtcaccttctacacggcccccatcaaggcgttggtgtcggagaagttcttcgagctgtgcaagctgttcggcaccgagaacgtcggcatgctcaccggcgacgcctccgtgaacgcggacgcgccggtcatctgctgcacagccgaggtcctggcctcgatcgctctgcgcgacggcaaggacgccgatgtcggccaggtcgtcatggacgagttccatttctacgcggaacccgaccgcggctgggcctggcagatcccgttgctggagctgccgcaggcgcagttcgtcctgatgtcggcgacgctcggcgatgtctcgttcttcgagaaggaccttgcccaccgtaccggccggcccaccgccgtggtccgctcggcgacccgcccggttcccctgtcgtacgagtaccggcgcacgccgctcaccgagacgctcaccgatctgctgcaggcgcggcaggcgcccgtgtacatcgtgcacttcacccaggcgcaggccgtggagcgcgcccaggcgctgatgagcatcaacatgtgctcccgtgaggagaaggaagagatcgccgagctgatcggcaacttccgtttcaccaccaagttcggccgcaacctctcccggtacgtccggcacggcatcggcgtccaccacgccggcatgctgccgaagtaccggcgactggtggagaagctggcgcaggccggtcttctgaaggtgatctgcggcacggacacgctcggcgtgggcgtcaacgtcccgatccgtacggtgctgttcacggccctcaccaagtacgacggcacccgtgtgcgcacgctgcgtgcccgggagttccaccagatcgccggccgggccggtcgggcgggcttcgacacggagggcttcgtcgtcgcgcaggccccggagcacgtcatcgagaacgagaaggcgctcgccaaggccggcgacgacccgaagaagcgccgcaaggtggtccgcaagaaggcgcccgaggggttcgtcgcctggtcggacaccaccttcgacaagctcatcgcctccgagccggagccgctgacctcccgtttccgtgtcacgcacaccatgttgctgtcggtgatcgcgcgtcccggcaatgccttcgaggcgatgcggcacctgctggaggacaaccacgagccgcgcaggcagcaactgcggcacatccggcgggccatcgccatctaccggtcgctgctggacggcggcatcgtggagaagctcgaccagccggacgccgagggcaggatcgtccgcctcacggtcgatctccagcaggacttcgcgctcaaccagccgctgtccaccttcgcgctggccgcgttcgaactgctcgacccggagtcgccctcctacgcgctggacatggtgtccgtcgtggagtccacgctggacgacccgcgtcagatcctggccgcccagcagaacaaggcgcgcggtgaggccgtggcggcgatgaaggcggacggcgtcgagtacgaggagcgcatggagcgcctccaggacatcacctaccccaagccgctggaggaactgctcttccacgcgtacaacacctaccgcaagagtcacccgtgggtcggtgaccacccgctgtcgccgaagtccgtgatccgggacatgtacgaacgggcgctgacgttcaccgagttggtgtccctctacgaactcgcgcggaccgagggcatcgtcctgcggtacctggccagcgcctacaaggccctggagcacaccgtcccggacgacctgaagtccgaggatctgcaggacctgatcgcctggctgggtgagacggtgcgccaggtcgactccagcctgctggacgagtgggagcagttggcgaacccggaggagatgaccgccgaggaggcccaggagaaggccgatcaggtcaagccggtcaccgccaacgcgcgcgctttccgcgtcctggtgcgcaacgcgatgttccgccgtgtggaactcgccgctctcgaccaggtcgaggagctgggcgagatggacgccgaggacgggtgggacgccgaggcctggggcgaggccatggacaagtactgggacgagtacgaggatctgggcaccggccccgacgcccgcggtccgaagctgctggtgatcaaggaggagccgcagcacggtctgtggcgcgtgcgacagatcttcgacgacccgaacgacgatcacgactggggcatcagcgctgaggtcgacctggccgcgtcggacgccgagggccgtgcggtcgtccgggtgaccgctgtcggacagttgtgaacggacttcggtcagccggaaacgcaccccggtcagctgtgaacacaggagaatcgcacccatgacgaatccggccgagaggcttgtcgacctgctcgacctggagcagatcgaggtcaacatcttccgtggccgcagcccggaggagtccctgcaacgggtcttcggcggccaggtggcgggccaggccctcgtggccgccggacgcaccacgggcagcgatcgcccggtccattccctgcacgcgtacttcctgcggccgggccggccgggggtgccgatcgtgtaccaggtcgagcgggtgcgcgacgggcggtccttcacgacgcgccgggtcacggcggtgcagcagggccgtacgatcttcaacctgaccgcctcctttcatcaggccgagcaggggggttttgaacatcagctgccgcccgcccgcaaggttccgccaccggaatccctgccgacggtcgccgaggaggtccgggagcatctgggcgcgctgccggagcagttggagcggatggcgcgccgccagcccttcgacatccgttacgtggaccggctgcgctggagtgccgaggagatcgaggacgccgaggcgcgcagcgcggtgtggatgcgcgcggtcgggccgctcggcgacgacccgctcgtgcacacctgcgcgctgacctacgccagtgacatgacgctgctcgacgcggtgcggctgccggtcgagccgctgtggggtccgcgcggcttcgacatggcctcgctggatcacgccatgtggttccaccggccgttccgcgcggacgagtggttcctgtacgaccaggagtcccccgtcgcgacgggcgggcggggtctggcccgcggtcgcatcttcgacaccgagggacgtctgctcgtctcggtcgtccaggagggactgttccgcccggtgtaggcggccgacgtcagtgaccggtggctgccgcccgtagccgtcgccggtcggtgccggttgcggtgcctggtgcgggaccgtcggcccgggaggtcaggcgcctctgcggaagagccgcccgagcagcccccgctgcgggtgtccttccgtccgctcctgctgccggtcctgtgcgggccgcgcctcctgtgccgcttcccggtcgggatgccgtggcgccgggcgcggcgcggcgcggtgggcgcgcgcctcggtcaccgcgctcgccaggtcggcccggagccaggcgatctcatcgggatcctccgccgtggtgatccgctcggtgaggtgggcggtgggtgaaccgggtgcaccgtgcgcgggcgggcggggccggaagcggttcagatgggcgcgttcgtaggggtcgccgacggtctcggacacctggagcgggtcgagcagtgaggcgagcgccgcggcccgctcccaggggtcctcggcctggcgcagcaggaaaccgagataccgcccgcgccagttgcgcgggcgcaggtcgaggcccgcctgcagctggtcccgcagtgccttcggcaacggccggttcagcagcgaggtgttgtgcgcgtcggccgcgaactccttcagttcgtcggccagatacagccacacgacggccctgtaccggttgacgtaaaaatcgaccggtaccaccaggccgaggcgggccaggcgggtgaaccggaccgtggtcgcccgcatgatctccgtggcctgccgggtgccgacggcctcggcccgccggcgcagtgcctcggggaagtcgtcctgggcgcggagccgctcgatctcgtcgcgtgccacccgtcggccgcctcctccttcgtccggcagggtgcggatgtggccgagacgcacggcgagttcgaattggctgcgtttgaggcccagttcccgggcggcccggctctggctgaagtgcgtgtcacgcttgccggtggcgggttcgaccgtgtgtgtgggctcgtgcgtgatggtgtttccggacatgttcgtcccccgtggagtgagtggctcgcgtctgccgcgctcgtacgtgaaaaaccgtagccggtgcggcgcatctcggcgcgggcctgtggataactcccggacaggcagcgaacgcgctggtcagaggccggttgcggagccgcgttcgggtcgccgggtcgccacgtcgaggtgttcaccgaccctgttcaccagcagggtcatctcgtaggcgatctgcccgatgtcggcctcggcgccgctgaggacgcacaggcagctgcccgcgccggccgcggtgatgaacagcacggcatcgtcgaactcgaccatcgtctgccgtaccgagcccgcgccgaagtgacgccccgagcccttggccaggctgtgcagcccggacgagacggcggcgaggtgctccgcgtcctctcgccgcaggcctgtgctggctcctgtgaccaacccgtcggtggacaggaccagggcgtgccggacgtgttccacccgctcggtcagatcgtccagcagccagccgagtgtgtggttgtgctccatgatgctgtcgccccctgtgtggtctcctcctgaccggaggatctcccgccagccttcaccactgttcctgccccggcaaggaggatgggggcatggcacgcaagatgaccgacgaggaatggcgggcgttcgtctcgtacggaacccgcaccggaaagctgtccaccgtccgggccgacgggagccctcatgtggcgccggtctggttcctgctcgacggggacgacgtggtcttcaacaccgggaaggacacggtgaaggggaccaatctggcgcgtgacggccggttcgcgctgtgcgtggacgacgaccggccgccgttcgccttcgtggtggtgcaggggcgcgcacacctgtccgaggacctggaggaggtccggcactgggccgcccggatcggtgcccggtacatgggcgaggagcgcgcggaggagttcggcgcccgcaacggcgtcccgggggaactcctcgtccgggccacgatcgagaaggtcgtggcggtgcacgacgtcgcggactgatccagccactctcgcggcctcggacaggtcatgcgtccgcgtgccgttcagcccacggagtcgagcagccgggcggtgtgcatccgcccggcgtattcgacgaggctgatcagtacttccttccccgagtcacggtctctggcgtcgcagaggaccacgggcgtgccctgatcgagatcgagtgcgcgggagacctcgggcgccgcgtggccgcgggcgcccgggaagcagttgacggccacgacgaacgggatgcgccggtgttcgaagtagtccaccgcgggaaagcagtcctccagtctgcgggtgtccgcgaggaccacggcgccgagcgctccctgcgacagttcgtcccacaggaaccagaagcggtcctggccgggcgtgccgaacaggtagagggagagtccggagcggatggtgatgcgtccgaagtccatggccacggtcgtggtcaccttgtggtccacgccgtcggtgtcgtccaccgactggcccgcctggctgagcagttcctcggtgcgcagcggccggatctcgctgaccgcgccgaccagcgtggtcttgcccacgccgaaaccgccggcgaccagtatcttcagtgccagggcggccgtggcgtcgtcctgcgggccgggattctcggtggccatggatcacttctctcgtcagaggggctacagcgccttcagtcccgcgatcacctcgcgcaggatccgttcgtccggcagttgggcgggcggcaccgggcggctgacggtgacgcggccgagttccaggaggtcgccgaggagcactctgaccacgccgacgggcaggtcggttccggcggccagttcggcgaccgactgtgtctccgtgcggcacaggtcgatcagggcccggtgttccgggccggtcgccgcgtcgtcgtccgccccgggcgctcccggggcgagggtgacgagggcgatgaggtcgagcggcacgcccgtcgggttgggtctggtgcgtccgcccgtcatggcgtacgggcgcacgagtggcccggcctcgccgtcgtaccactggctgcccggtccgggcgaggggtccgcgtagtcctcggtcatggcatggaccgtccttcacctcatcgggcggcggcgggcggcgggagggtggccctcaagggggtgcacaggtgctcgccgacgcgcttgaccaggcgggccatctcgtacgccacgagtccgatgtcggccgtgacggcggtgaggacggcgaggcaggagccgtcgccggccgcagccacgaacaggaagccgtcgtccatctccaccatcgtctgccgtacgcccccggctccgaagtgccggccggcgcccttggccaggctgtggaagccggaggccacggctgcgaggtgttccgcgtccgcgcgttcgaggccggtcgacgcgccgacggccagtccgtcgttggacagcacgaccgcgtggcgtgcgtcgtgcacacgctgcaccatgtcgtccagcagccagtcgagttcgccggaccggtgggcggcccccgtgctcgggtcgtggatcatgcgggttctccttcgtcgctgccgctgtcgtgctcgggagctctgccgcggccgggctgccggccaccgccgcgagcccagccgtcgcggtaggcggccatccggtcccgtacgagttcgggtgtgcgcccggtgtcgtcccgggcgtcccgggcgtggtcgggctcttcgggcgcgtggtcgcgcagttgcggggcgaggctcgcctggcgtacccgccgcgggagccggtcagtttccgcgtcgtcgtcggcggtgcgatgcagccgcagggcggtgactgcgggcgcggaggtgtccgccgagggatcggccacggggtgcgcggcggtggcaggggcggtccgctccaccgggccgggcggggactcgtcgtgccgcgcggtcaccggcacgcgcgcgtgcacgtgttccgcgatacgcgccggctccgccgggacggcgtcgggagcggtggcggtcggctgatgctcttgtgtgccgtggtgcagcagggccgtgggcagcaggacgaccgctgtggtgccgccgtagggcgatgtccgcaggtgcaccttgatgccgtgccgggcggcgagcctgctgaccacgaagaggccgagccggtcgctgtcgaacaggtcgagcgcctccgactgggcgatgcgccggttggccgcgtccagtgcctgcttgcccatgccgagcccacggtcctcgacctcgacggcgtatccgttgccgaccggttctccggtgatgcgtacgcgtgtgtggggcggcgagaactgggcggcgttctccacgatctcggccaggaggtgggtgaggtcggccacggccgcgccgacgacggccgcctcgggcggctgccgtacctccacgcgcgcgtagtcctcgatctcggatacggccgcgcggacgacgtcggtcagcgggacgggtgtgcgccatgcccggccgggcgccgctccggagaggatgatcaggctctcggcgtggcgtcgcatccgggtggtgaggtggtcgagccggaagagatcactcagttcgtcggggtcgtccgaacgccgttccatgctgtcgagcagactcagctggcggtggacgagtacctggctgcggcgcgcgaggttcacgaagacgcccgcgatgccgccggcgagttcggcgcgctccacggcggcccgcagtgcggcgcggtgcacggtgcccagtgcttcggcgacctgtcccgtctcgtcctccgcgggcggccccggcggcgcctcggcccggatgtcgatctcctcgccggcgcgcagcctgcgcatcgcctcgggcagttcacggcgggcgatccgcagggcgctgttgcgcaggttcaccagttccacgactaggccgcgtccgatgcggacggagatgacgagtgaggcggcgacggcgacgaggccgaagaggacggcggcgccggcgggggtgagcaggccacgggtgaacggggcggcgccgtcggcggcgtcccgggccgcgtccgccccgagggcgcgcatgccgtcctgcacgcgcgcgcgtgcccggt

SEQ ID NO: 159 - DNA, 6521 bp, Unknown
  Kingdom: Bacteria, Phylum: Actinobacteria, Class: Actinobacteria, Order: Streptomycetales, Family: Streptomycetaceae, Genus: Streptomyces
cgcaggtggcgccattcgccgtgcacgggcatgacgttgcggggtttgacgatgttgtagcagtagacgagttcgccggcgctggcgtgcccggagacatgcaccttggcgttgcccttgtggaccacatgggcgccccaccgcgtcagtccgttgatcacccggtagatggcgttctcgttgccggggatgagggagctggcgagcaggacggtgtcgcccttgccgatgcggatcatgtggtcgcggttggccatccgtgacagcgcggccatcggttcgccttgggaaccggtgcacaccagagtgatcttgtggtccgggagcttctccagctccttcgtgctcaccaccagaccggaggggaccttcagatagcccaggtcacgggcgatgcccatgttgcggaccatcgaccggccgacgaaggcgaccttgcggccgtgctggtgggcggcgtccaggacctgctggatgcggtgcacatggctggcgaagctggagacgatgacccggcgcggcgcggtgcgcatcacctgctcgatcgccggattcagctcacgctcggaggtggtgaagccgggtacttccgcgttggtggagtcggtgaggaacaggtccacgccctcctcgccgaggcgggcgaaggcgcgcagatcggtgatgcggtcgtcgagagggaactggtccatcttgaagtcgccggtgtgcagcaccatcccggcccgggtgcggatcgcgaccgcgaggctgtcggggatggaatggttgaccgccacgaactcgcagtcgaagggcccgaagccgcgccggtcgccctcccgtacccgcaccgtgcgcggccggattccgtgttccttgagcttggcctccaggaacgccagtgtcagtttggagccgacgacgggaatgtcggaccgctcgcgcagcaggtacggcacgccgccgatgtggtcctcgtggccgtgggtgaggaccatggccacaacgtcgtccagccggtccctgatcgaggtgaagtccggcaggatcacgtccacgccgggctgggtctcctcggggaacagcacgccgcagtcgacgatgagcagcttgccggcgtgttcgaagacggtcatgttgcggccgatctcacccaggccgcccagggccatgacccgcagccctcccttgggaagaggcggtgcggctttcagctcggggtgcggatgactcataccctgacggtacccggagagcgggacaggtgatccattgcctgcgcgatctccttttcccgacggagccggggcacccgcggcgggcgcccgcgcccgcgaggtcttccacctggtcggaccggtctcccgcacccccgcgttataagggcgtccgcgagacatgagagggtcttgggcgtgagtgagacaccgtcgaacaccctgcaataccgctttgacgggccagaagaggccccggtcctgatcctcggtccctcactgggtaccacatggcatatgtgggaccggcaggttccggagttgacgaagcagtggcgtgtcttccggttcgacctgccggggcacggcggcgcgcccgcgcatccggccggttcggtggcggacctgaccgaccggctgctggccaccctcgaaggactcggcgtgcagcgcttcggctacgccggctgtgcgctcggcggcgcgatcggcgtcgagctggccctgcgccacccggagcgcctcgcctccctcgccctgatcgcggcctcgccccggttcggcacggcggacgagttccgccagcgcggggtgatcgtccggacgaacggtctcgaccccatcgcccgtacctccccggaccgctggttcaccggcgggttcgccgccgctcagcccgcgatcaccgactgggccgtgcagatggtccgcaccacggacccgggctgttacatcgccgcctgcgaggcgctggcctccttcgacgtccgcgccgaactcggccgcatcggcgtgcccacgctggtcctggtcggctccgacgaccaggtcaccggccccgccgaggcccgcacgctggtcgccggcatcagggacgcccgcctggccgtcgtgcccggcgcctcccacctggtcccggtcgagcagcccgccgccgtgaccgacctgctggtgcggcacttctccacggcctggcagccggccttcgagtcgagcacgggccagatggcgatcgtcgcggccccggccaagcccgccctggccgcgccgccgcaggctccgcccagcgggccgatcgccgagatcgccccggcggcggtgccgccccagcccacggcggccccggactcctacgacgcggggctcaagatcagacgcgcggtgctcggcgacgcgcacgtggaccgggagctggcggaggccgacgacttctcgggcgacttccagacattcctcacccgctccacctggggcggtgtctgggaccgtccgggcctggaccggcgcacccgcagctgcgtcgccctcaccgccctggtcgcgggcggccacctggaggacctggccgcccacacccgggccgccctgcgcaacggcctcaccccggacgagatcaaggaggtgctgctccagaccgcggtctactgcgggatgcccgccgcgagcagcgccttccgcgtggcccagcgggtcatacaggaggagacgacgcccgcggagtgagcccggcgcggccgcggtgatcgttcagccgggcaccaggagcaccaccctgcacagcgcgtgcaccccggcggacgcggcaggatgggacacatgaagctcacgaagaagtcgcacgcctgtgtccgtctggagaaggacggccggaccctcgtcatcgaccccggcaccttcagcgaggaggacgccgcggtcggtgccgaggccatcctggtcacgcacgagcacctggaccacttcaacgaggaccggctgcgggcgggcatggaggccgacccggcagccgagatctggaccctgaaggcggtcgcggagcagctctcggcggccttcccgggccgcgtgcacaccgtcggccacggtgacaccttcaccgccgccggcttcgacgtgcaggtccacggcgagctgcacgccgtgatccacccggacatcccgcgcatcaccaacgtcggctacctgatcgacggcggcaaggtcttccaccccggcgacgccctcacggtgcccgaccagccggtcgagacactgatgctcccggtgatggcgccgtggaacaagatcgcggaggtgatcgactacgtccgcgaggtcaagccgcagcgggcgtacgacatccacgacgcgctcctgaccgacctggcccgcccgatctacgaccaccagatcggctccctgggcggtgcggagcacctgcggctgacgccgggggactccgccgacgtgtgaggaggcaccggggccggcggcgggagcggagcgggaaggggcaggggaggggacgtccgtccgggggttgtcagtgccgcccggtaggttgtgaggcatgcgcatcgcgacctggaacgtgaactcgatcaccgcccgcctcccgcggctgctcgcctggctggagagcagcggcaccgacgtgctgtgcctccaggaggccaagatcgccgaggaccagttcccgttcgaacagctgcgcgagctgggctacgaggcggcggtccacgccaccggccggtggaacggcgtggcggtgctctcccgcgtaggcctggaggacgtggtcaagggcctgcccggtgacccggggtacgacggcgtcgaggaaccccgcgccctctccgcgacctgcggcccggtgcgcgtctggtcggtctacgtgcccaacggccgcgaggtggaccacccgcactacgcctacaagctgcagtggttcgaggcgctgagagctgccgtcgcaggcgacgcgtccggcagccgcccgttcgccgtcctcggcgactacaacgtcgcgccctccgacgacgacgtctacgaccgcgccgccttcgagggctccacgcacgtcacccccgccgagcgcgccgccctcacgtccctgcgcgaggcgggcctgtccgacgtggtgccccggcccctgaagtacgaccaccccttcacgtactgggactaccgccagctctgcttccccaagaaccgcggtatgcgcatcgacctggtgtacggcaacgcgcccttcgccaaggcggtcaccgacgcctacgtcgaccgtgaggagcgcaagggcaagggcgcatccgaccacgcgcccgtggtggtcgacctcgacgtgtaggcgccgcggccacggaccggtccgcgtacgcccctgagtaccgggtgcgcgtgcgcgccccgcggtggcgccggcggtcgccctgtggcgctcccggtggtcgcggtgccacgctgggtgcatggacttccggctcttgggcaactggcgcaagaagcacgcaccggccgtcagcgtcacggtcgtctccgccggcgacggctctccgaccccggcggatctcgccgacctcttttccacctgcgaacagttgcgtgccctggtgtccgaggccggcgtccggctcgacgggtccgccgcctccctggaggcgctcgaccagctgctgccgcgctggcgggacgacgccgagacggtgtcgtggctgggcatcgacgccgggctgtatctgggcacggtcatcgtgcgctgcgtgccgggcgcggtctgggagttgtggccgaacggccatcccgtcgtacggctcgcctccggccgggagatcgtcgtcgtggaggccgggcacgcctgggccgaggagggcgtaccggaactctcccagatgtacgcggaggtcgcggagggctgagagccccggggacgggcgattgctgcaaccaccgcaaagccgccggtgagtttaccggggcgcttccgcccgcgggcttccttcccggcggatgactcatcgggccgaacctcgactacgatatggcgttcgcgaccgtctcaggggacagcggtccacagagccatacccggccggcggcagccggagatcactgctcgcgcggcggtacggacagccactccgggtcgtccgcaggcgagaagaaggtcagctgcgcgccgggcgggttgtgctcgacgcccggccgacggaccggcgggctccggttccagcggagcgggggcgcccgggcccgcgggtcacgggagcaatcggcaggcgcaggcgcgcgggcggctcggacggtaccgtgttcgagacggtcctgacgggctcatggcaatggcataggctgcgcggacggtctctgactggaggtgcggatgcgtcgcgctggagtacggaaactgacggtcctggcggtctcggccgccgtggtgtcggtgggagcggcggcaccgcccgccgcgcacccggacacgaggacgaaaccggcccagaaggttcccgtggccgtcggctacggcggtgccgtcgcgagcgtcgacgcggacgcctcggccgccggcatcgaggtgctgaagaagggcggcaacgccgtcgacgcggccgtggccaccgccgccgcgctcggcgtcaccgagccctactcctccggcatcggcggaggcggctacttcgtctactacgacgccaggtcccgcacggtgcacacgatcgacggccgcgagaccgcgccgctgagcgcggacgaggacctcttcacggagcacggcaaaccgctctccttcgacgccgccgtcaccagcggcctgagcgtcggcaccccgggcacccccgccacctggcagaaggccctggacgaatggggcaccaggcggctcggcacggtcctgaagcccgccgagcggctcgcccgcgacggcttcaccgtcgacgacaccttccgctcgcagacggcggccaacgagacccgtttccggtacttcccggacaccgcgaagctgttcctgccgggcggcgagctccccgccgtcggctcgaccttcaagaaccccgacctggcccgcacttacgaggagctggcacggaagggcgtcggcgccgtctaccacggcgacctcggtgacgagatcgtcgacacggtcaaccacccgcccgtcgccgccggttcgggatggaacgcccggccgggcaagctcgccgagaaggacctcgcggcctaccgcgccaagctccaggcgcccacgcgtacttcgtaccgcggcctcaacgtctactccatcgcgccgtcctcctccggcggcaccaccgtcggcgaggcgctgaacatcctggagcggacgaacctctccaaggcgagcgaggcgcagtacctgcaccacttcatcgaggcgagccgcatcgccttcgccgaccgcggacgctgggtcggcgaccccgccttcgagaacgtgcccacccgcgacctgctctcccagcgcttcgccgactcccgcgcctgcctgatcaaggacgacgccgtcctcaccagcccgctcgcgcccggcgacccgcgccggcc

SEQ ID NO: 160 - DNA, 4196 bp, Unknown
  Kingdom: Bacteria, Phylum: Actinobacteria, Class: Actinobacteria, Order: Streptomycetales, Family: Streptomycetaceae, Genus: Streptomyces
ggccgccgccggggccgccgccccagccgccaccaccctggccgccaccgccgccgtacccgccctggccaccgcggccgctggtcttggtgaccttggccgtggcgttgcgcaggctggcgccgacttcctcgacgtccagttcgtagaccgtgcgcttgacgccctcacggtcctcgtaggaccgctgcttcagccggccctgcacgatgacgcgcatgcctcgctggagcgactcggcgacgttctccgccgcctgacgccagaccgagcaggtcaggaacaggctctcgccgtccttccactcgttcgtctgacgatcgaaggtgcggggcgtggacgcgacgcggaacttcgcgaccgccgcaccggagggggtgaagcgcagctcggggtcgtcgacgagattgccgacgaccgtgatgacggtctcgcctgccatgggggtacctctcggcgggtttgctgctggctgctggtgctgctactcggatcccgaggccggctgagcgaaggggctcagtgggtctcggggcggaggaccttggtccggaggaccgactcgttcaggttcatctggcggtcgagctccttgacgaccgcaggctcggcctgcaggtcgatgaccgagtagatgccctcgggcttcttcttgatctcgtacgcgagacgacgacgaccccaggtgtcgatcttctcgacctttccgccgccgtcacggacgacagagaggaagttctcgatcagcggggagacagcgcgctcctcgacgtcggggtcgaggatgaccatcacctcgtagtgacgcatgtggaacccacctcctttggactcagcggccacggtcgttccgtggcaggagggttgtgatgcgtacgcaatcgtgtctgccagtaaaacagccggcactgacaacgggggtcggccggtgaaatctctggccgtcctcaggttgtcctgtgctcgggccgggcagacacaagtgcagacggaacagactacccgcacccccgcttccggttgaaatcggggcgcagaacccggcaatctggacacctcgggtgtacatggcgctacgatgcgctgcctttcgcaggaggtgccccatggcacagacgatgcgaccgaacaccgccgcccgcaacggcctcttcgccacggacggcaagccccaccccctccaggacacactgctcgcggtgaccctggtgctgggcgtcctggctctcatcaccgggctcctctcccacggcctgcacctgctgagctcctgggccgggctggtgggcatcctcaccggcgcgtacggccagtggatctccgtgacgacgcgcgagcgcttcctcctcatcctcggcctcggcgcctccgcgatcgggttctacctcggcatggcgcacggcggcctcttcggcggtctcttcagctgacacagcccccggccgttccggtcacggacggcgtccgccggacctggcgggcgccgtccggacgccgcatgccgtacccgcgccgggcgacaggccggtgcgaaggtggcgtgcggccagtctgcgcgctcccctggcgcagtaggcttcggcgcgagagccggagcccctgaacccatggggacacgccagcccgaggagcgccccgaatatgagcctgaccctgaggaccatcagtcgagagcagcatctggcctacatccagagcctgccggcggcgagtcacatgcaggttccggcctgggcagacgtcaaggcggaatggcgctcggagagcctcggctggttcgacgaccgtacgggtcacatggtcggtgccggtctcgtcctgtaccggcagctgcccaagatcaagcgctacctcgcctatctgcccgagggcccggtcatcaactggttcgcgcccaacctcgacgactggatccagccgatgctggcccatctgaagcggcagggcgccttctcggtcaagatggggccgccggtggtcatccggcgctggaactccgagaccatcaagaagggcatccaggacgcggacgtcaagcgcctgcgcgatctggaggccgacttcatcgagccccgcgccttcgaggtctccgacaagctgcgccgcatgggctggcagcagggcgaggacggcggcgccggtttcggcgacgtccagccgcgttacgtcttccaggtgccgctggccaaccggtcgctggaggaggtccacaagaacttcaaccagctgtggcgccgcaacatcaagaaggccgagaaggcgggcgtggaggtcgtccagggcggctaccacgacctggaggagtggcagcggctgtacgagatcaccgccgtgcgcgaccacttccggccccggccgctgtcgtacttccagcgcatgtggtcggccctcaacaccgaggaccccaaccgcatgcggctgtacttcgcccggcacaacggcgtcaacctggccgcggcgacgatgctgatcgtcggcgggcacgtctggtactcctacggagcctcggacaacatcgggcgcgaggtccggccctcgaacgcgatgcagtggcggatgctgcgcgatgcctacgccctcggcgcgacggtctacgacctgcgcggcatctcggactcgctggacgagaccgaccacctcttcggtctgatccagttcaaggtcggcaccggcggtcaggccgccgagtacctcggcgagtgggacttcccgctgaacaagctgctccacaaggcgctcgacatctacatgtcgcggcgctgaccccgcgttcctcacttcgacgacgtcggcagtcttcctacctctgacacaccgcagccacgagaaaggttccaggtccggccatggcgctcacgctctacgtcgacaccgcgcgctggcgggcgcatcacaagcacgtgcaggagcagttccccggaatggtcccggtctgcaagggcaacggttacggcttcgggcacgagcggctcgcggaggaggccacgcggctgggctccgacgtcctcgccgtcggcacgacgtacgaggccgcgcggatcaaggactggttcggcggcgacctgctggtgctgacgccctaccggcgcggcgaggagccggtgcccctgcccgaccgggtgatccgctcggtgtcctccatcgacggcgtgtacggcctcgtcggggcccgcgtggtcatcgaggtgatgtcctcgatgaagcggcacggcgtcagcgagcaggagctgccgcagctgcacgccgccatcgagaacgtccgcctggagggtttcgccatccacctgccgctggaccgcaccgacggctcggacgccgtcgaggaggtcatcggctggatggaccggctgcgcgcggcccggcttccgctgcacaccatgttcgtcagccatctcaaggccgaagaactcgcccggctgcagcagcagttcccgcagacccgtttccgtgcccgcatcggcacgcggctgtggctgggcgaccacgaggccacccagtaccgcggggcggtcctggacgtcacgcgtgtggccaagggcgaccgtttcgggtaccggcagcagaagacggccgccgacggcttcctggtggtcgtggcgggcggtacgtcgcacggcgtgggcctggaggcccccaaggcgctgcacggcgtcatgccgcgcgccaagggtgtggcacgggcaggcctcgccaccgtgaaccggaacctgtccccgttcgtctggggcggcaagcagcgctggttcgcggagccgccgcacatgcaggtctcgatcctgttcgtgcccgcggacgcgcctgaaccgaaggtcggcgacgaactcgtggcccatctgcggcacaccaccacgcagttcgaccggatcctggaccgctgagccgacggaacgtggaccgctgagccgcgccgggccgcgcgggagaacgtgacgagaggccgtacccggcagttgccgggcacggcctctcgtatgccatgccgacccgcgttcgctcagagtgaacggtcttccggggcgcttccgggccggctgccccacgccacctgagcgctctcgaagggcgccgcgggccgcgccggcggccgggccgcagcgcccaggacgaagacgtcctcggcgccgtcgagcacgccgcccgacggatcgtcgtccccggaccggcgcaccacgtcacggtccggcatgaggatgtcg

SEQ ID NO: 161 - DNA, 7854 bp, Unknown
  Kingdom: Bacteria, Phylum: Actinobacteria, Class: Actinobacteria, Order: Streptomycetales, Family: Streptomycetaceae, Genus: Streptomyces
acaacaggccacgaccaggccaaacaggcctcacccgctatcacgcaccaactcgttagtgtcggccaagtgctgcggcaacgccgggtctccgcgtgtgttccatccgcggggagccgcagtcacaagccgccgactcggtgaacccctgcggacggcggggcgcttgtgctggtggagcttcatcggcagctaggcgctccgcggccgccggcccgtcgccttcttcgccgtcttcttggcgggctgcttcttcgccgcggccttcttcttcggggcgggcatctcgtgcacctcggccgcgccctcgccgcgcgactccttggccttctgcacggaggcgttcagcgccctggaactcgggtgcggtcgaaggccatgtcaaccggatcaagatgctcaagcgccagatgttcggccgccccggcttcggcctcctgcgcaagcgtgtcctgctcgcatgacacagcctgcaacctcacaccgcaggaacagctacaccagctcctcatacagatcgatgtcggagggcatgcgaccgagtagcagcgcgagacgcctctccatgacggcgaaccactcgccgatgtccgtatctgcgtcgtggaagaaccaggagtcgaagcttcccaaggcgtccagatctggatcgggctcgtatcggagttcgcagtgaatctgacgtgatggtcgtgctcgccgccgtcgtcagagacctcgaactgccgcgtgagatccacagtgaacatcggtcgcccgctgaaggcgtacgtgccgtattgaaagagcaagccgtcggagtcgggcgcgggcgctgtgtcaaagcgcatccgcccgaaacgcatgaaggggagccctgcacgccgagtagcccactcggtcatctccgactgcccgtccccaactcgacccgcaggaaaccgagggctgcctccagccgtggtctgcccaggacgtcggctcccttcgccgagtgaatcagcaccctgacctggtggggccgggttgaacccagccctgaccaccgaggtgttccccacccgcctgcaacgctcggtgacggcttcacagaagttgagccagaacccgttctcgcgtgcatagccacgacgagcagcgcgcggagtgaccgtcctcggggtgcggtggtaggccggtgtcgaggaggtatcccggtcacggagtggggtggggtcgggggcgggacgtgaccgaaggtcgcgcgggttcctggcgcgcgtgtccgtcccgcccccgactccggcgcgcctaccccggatgccgtcggggacgcgttcgcccagtgtgattcccggtctgctcgcagacgtgcctgcggggcccggccgtgcaagcggccgggccccgcagggtggtgcgtgcggtctcaggtcaccatcggtaccagcggccgcggcctccgcctgcgttcgtggaacgcacgaggaacccgagcagccacaccaccagcacgaccagggccacccaccagagaaccttgagggcgaaaccggcgccgaaaaggatgagcgcgagaagcagcacaagcaaaagggggaccatggatatcaacctcctgacccccgtgcgccctccatcctggcgtgcattcctcgcatgtgtctttgtttccgaggaggcgaccggggcacgagccggttaccgcaacagcgaacgaaggcttcgaggaggctgtctttcatgagtgccggtgagaaggccaaggcgaacagcgagcaggccaagggcaaggcaaaggaggctgtcggcactgccctcggcaacgaccggatggctgccgagggtcaggccgacaagagcatcggcgacgctcgtgaggccaaggagaagacgaaggacgccttcaagcactgacgtctctcctgtctcttcagtccccggaaagccagggggccttcccggcgacggaaggccccctggcccgcgccggacagaagttgtcagccggtagcaccgaattcaccgcggccagggtcacatgcccgtctcgtctcacgttgggtccgactcggtccgccgccgtctccgcggctgcgcgacggcaagggccggcggagccactcgcgacgggcggctgtggtgctgacacgatcggcctcatcctcgccgtgaccgtcgccggtgccggcctctccgggaacgccatgggaatacgcctcctcgaccaggcgaaagcgacctacccgaccatcgcgaaaagctgggtcggcacaggcttcgagaacgccgtcgtcgagtacggtgcccgcctcggcgtcgacgtcgaagtcgtcaaccgaaacccggaaaagcgcggcttccacgtcgtgaaaaggcgctgggtggcggaacgcagcatcggctggatcatgatgcaccgccgtttcgcccgcgacgatgagaccctcaccaccagctccgaggcgatgatctacatcgcctccagcgacaacctctccaagcgcataacggatgaaaccgcgtcaacctggcgaggaacctactagagtatacggggcaatacgcctagatcagatgcctctgagagttcccgcagctgtgcatggccccaccggtcccggcctcaaccacgcacaccgaatagcgcagggttggaacaccgcctcttcccagttcccgtcaagttcatgttttcggatggattctgtgcaccagcgcgttcgggccaccgtagttcggtcaagatcttcgtgaagccgatcacgctcccgtgcgccggtgacaccccgtcattgccggtgtgatactcgccgaatgccaggagctgctgaggtcggtgttaccgcacctccgcgggggctcgttgagtaagtgagctccgaggacgggttgttacgcgtcgtctccggaggagcagatgatgaccgaagggtggatgctgcgtgctgggtgaccggggcgctctggaccgggctgggatcactgatccggtgctgcgggaggcgtaccggctgtgcggccggttactggtggccgtcgacgggcgatccaactgggcgggtacgttgctgctgccggcggacaagcggccacacgtctgggccatttacgcggttgcccggtgggcggatcagttgttggacagcggggaccctcaggaacgcgccagcaggtacgaggtgtggcgtcagcggatgctcacggatctgcgccgcggccagtgcgccgatccgctggggcaggcgttcgcccacaccgcggaggtgtacgggttcgatccccatgatgtcgagacgatgctggacgggtggctcgcggatctggaggtgagcgagtacgccacctggcaggagcttcgcgagtacgccgaggtgctcaatgggccggccggacgaatggttctgcgtctgctggagccgatccacgcgggagccaacgatgccatgaccgagcttgtcgtggccttgcagttggccaacgtcgtgcgggatgtcggggaggacatccgtctgggccggatctacctaccggccgaggatctgcagtgttacaacgtgactcccgatgagctgcgtgcggctcggcccacacctcaactgcggcgcctgatccgtttcgaggtgcagcgcgcccgcgaactgttcgcctgcggaatggaggtgaccgagctgatccatcctcgttgcaggccgttcgtgtgggcggtcatcgagcaccaccgcgtcatgctggcccaggtcgaacggcacggttacgacgttttcacccgccccacggctctgggcgggcgaggactggcctcgctcgctttccaggtgggggtccgatcgtggccgaggaaagtgccaggggtgttggtcgcgcggcagtgagcggccttgcgctcggggtcgctgcctcggaagtcgggtccgggcactgtcattgtccgtagcggcggcagcaggacgcgaagtgatcgagtgcctgcgcgaagtggcgttcgtcgaatccgggccagcctgtgtcgcagaagtagagctcgctgtaggtggactgccaggtcatgaagtcggacaggcgttgttcgccggaggtgcggatgatgaggtcggggtcgggaagtccggctgtgtagagatgacgggccagcatgtcctgagtgagcccggcctgcgcctgggtgatgccccccggggtggacagcagctcttgcagggcctggaggatttcttctcgtccgctgtaggcgagtgcgatgttcaccgtcggcccgctcaccgctgcggtgaggtccactgcttcccgcagctgctccacgatctgcgtgtcgagcagttcgatccggccgatcagccggatgcgccagcgggtctgccgggcgagctgccgcagcgtctcggccaccgcccgcagactggcgatgacggagtcgtcctcgcgccgcaggttgtccagggacaccgcgtacagcgtcacgacgtcgattcccgcagcgtcacaccagctgaggaactgcagggctctgtcgcctccctgcatgtatccccaggcggattcgcgggctgcggctttggcccagcgacggttcccgtccaggatgacagcgatgtgcccgggcaccgggccgcggcggccaccgggccgaggagtgctccggcggctgaaacaagtctccacagtggcccgtcctccccgacggcgacgcaacggcaccgtcatcgtaggagcggcgatcaggtagagagtgctcagccgagaagcgcctggcgcgtaccgggggcgcgtagaagcttgaggagagactcttgcgcccccgcaccacaaacctgacctcgaccgccgcctccctcgccaccggcggcagtcgcagcacgttccatggagatggcaagctggccactgacgtccatgaggaaggccggccggaacgcagatgaacagcaatgccctcaccgccctggagcgtgccgccggtcaccagcagcgcttcgtttcgtccttcgagaagtacttcgccgaactcgccggcgacctcaacggttccaggctgggccgtttcacgccccggtgtctggagctgctggcggagttgtcgctgcgcggcgggaagcggatccgggtcgccctgctccacgaggcggcgcgcctggtcacggaggaggaggtaccggggctgctggaggccgcactgagtcttgagctgctccacagccatgcgctcatccttgacgacatcatcgacgactctcccctgcgccgcggtggcctctcgacgtactacgcgtgccgcgaagacctccccgagaacccgcaggccgcgctgggactggccatgatgaccggcgatctcgccggcttcctggccctgcgcgttctgttccacgcagaccttcccgccgaccgcaagcaggccatgctcgacgtccaactcggcgtgacgaccgataccgtcatcggccagatcctcgacatcgaacgcgacgtcaccccctcagccgatgaagggctgctggagacggtgggcgagtacaagaccacccgttactccatcctcgcccccctgcgcctgggcctgctggccgcgggcgaggacccggccaagcacgaggaaagcctgcgccgctacgccacgctggccggcatcagcggccagatgcgagacgactacctcgacctcttcggcgacccggacatcaccggcaagcccatcggtaccgacctgcgggccggccgcctcacctacctggtccgccagctacttgccgccactgacgcggacgcgcacaacaccgtcaaggccgctctcggaaatcccgactgcacgccgcagaccatcgacggtatccgggatatcgcctaccgccacgacgtgcaccagcacctgcaatcggcgatcgaccggtacgccgaagccgcctccgccgaagccgcgtcctggcgccggcactggtgtggggaagccgtgggcttcttcgaacaactgccctcgtggaacacccgcaggacccggtagtcccaggtgtcccccgccccgatcggacggtacgacgatgcggacgttgacacggcgtatccgcccctgaccatcagccgttgaagacgcaccggatcgaagggggaggacggaccttggaagtgcgcggactgcggcacgcctacggccgacgcgaggtcctgcgcggcatcgacctggacctgcagccgggcaggctgtccgggatcgtcggcgagaacggcgccggcaagtcgacgctgctgaagatcctcgccggtgaactgcgggcacagggcggaaccgtccggcacccgggccgcttcggctactgcccgcaggacgtggtcctcaacgacgccctcaccgtccgccagcacctgctgttcttcaaggcggccttccagctaccggatctcaagcgcgcggaagaaatcatggacgtgctgcgcttctccgattacgccgacgagcgtgccggagtgctcagcggcggcacacggcagaagctcaacctgaccctggccctcatgcacgatccacaagtcctgctgctcgacgagccctaccagggtttcgactgggacacctaccagcgcttctgggatctggccgcccgtcttcgcgatgccggccgctccgtcctggtcgtctcccacctcgcctacgacatcgaacgcctcgacgaactctggcgcctggacagcggcatcctcagcccgtacgaaacggcggcaggatgagacggcacctgggcctgtatgcgaccgccgcccgttacgacctggtcgaacacagccgcaaccgtttcgccatgctgctgatcgttctctacatccctctgtggatctcgctcgcatacgtcgccatccccgaccggcccgcgcctctccacctgcgctccaccggagagcacctggcaccggccggcaacgaactcacccagatcaccggcgccatcaacgcagtcactctgatcacaggcttcatgatgttcgccgccacattcaccggccaccgcttcgaccgccgcctggccatggccggttacccccgcctccacctcatcgccgccaaggccacctctctcaccctcacctccaccgtcatcgccggctacgccgccgccgtcacctccctctcctggacgcccaagcagcctctccagctcgccgccgccctcttctgcgccgcgatgacctacggcgcgatcggcgtcatcctcggatccatcctccgccgagaggtcgagggcatgttcgctctggtcatgatcagcgtcatcgacgtcctcctgcccaaccccatgtggagctcgggggccaacagctccctcattcgcttcctgccctcctacggcgcctcccaggccgccacagccgcgggtttctccaccacgccgacccctgcccacctcgccatcgaactcctgtggtttaccggcgcagcactcctggcactcctcaccttccaccgccgcacccgcaacgcccaccacaagccacagccctccggggctgtcgcaatgctgccccagcccgaggacaccgacccccagcgtggccgcgacgcaacagatcctgcgggggcgggtacctgacatccctcaaccttgtgctgctgcgcggaagttcgtggatccggtcgacatgcgggccgccaccgaggcggccgtgcgcgaaggggtgtggctgcgcccgttccgcgacctgatctgcaccatgccgccctacatcaccgccgacgtcgacgtcgtacgcatcacccgcgcggtctgcgcggcagcgaaggagggatgacatgcccgtactggtgatcacctgcaccggcaccgaggtcggcaagaccgtggcgaccgccgccgtcgccgccacggcgctgggcgccggacggtcggtggccgtcctcaaggccgcccg

SEQ ID NO: 162 - DNA, 4862 bp, Unknown
  Kingdom: Bacteria, Phylum: Actinobacteria, Class: Actinobacteria, Order: Streptomycetales, Family: Streptomycetaceae, Genus: Streptomyces
caggaacggcacgcgccagccccaggagttgaacgcgtcgtcgctgagcaccgtggtcatcagggacaggacgccgacggcgaccaggttgccggcgggcgccccgccctgcggccaggacgcccagaacccgcgccgcctggcgtcgccgtgctccgacaccagcaggacggcaccgccccactcaccgccgagcgcgaaaccctgcaccagccgcagcgtggtgagcagcaggggcgccgcgacgccgatcgtgtcgtagccggggacgcagccgatcagcgcggtggagccgcccatcatcagcaggctgatcaccagcagcttcttgcgtccgagccggtcaccgtaatgcccgaagaccacggcaccgatcggccgggcggcgaagccgatggcgtaggtgaggaaggagagcagggtcccggtcagcgggtcggagtcggggaagaagacccggccgaagaccagggcggcggcggaaccgtagaggaagtagtcgtaccactcgatggtggtcccgatgaggctggcggcgacgatgcgcttgaggttgttcggcgcgggtggagcggctgcgggcgacgacatcggcaccacttcctggcgtttcgacggagacgtttgcgtgtcgccacaccgtaggaatccgcaggtcaggcgcacatgtggcggggcaacatagttcgatggttcgctatgcgtgccgccaccatgccggctcgtggaaaggcggttcaggggagcgatggtggtcctaacgagtgctgtccgggacgcgtagttcagggtgatttgacggtgcggtgctgactcccgtgctggtttggtgctgactaaaagcccacgtcatcacccgtgttcacccctcccgtgctgacttggtgctgactacgctccgttcaactcggacatcctggccgaccggctcagggccattgcgtcgtaggcgacctgaacggtgggtggggccgacagcagtcgatctgccgcaccggcgatgacccgccacgccgagccgcgctcgtcggacacggcggcgccgacccggctgagagctaccgcggacctgcgcaccgaccggtgggcggacggtgcgggcccggtctaccggttcgcggcttcccgagaggcgatccggttcgtgcgaccgaccgcgcggcccaccgtattgcgcaccgcgaggcccggccgggtgcggggcaccatgagcctggagagcagaccgacgcgtcgctgccgcggacctacctcacggcggagccgtgactcgtaggcggcgaaggcgcgggcgtgatcaccgggttgggcggcgagctcttctgcgagggcgtacgcgcccgccatcgccatgctggacccgtcgcccagcagggctgtcgccgccgctgcgtccccgagcagtacgacccgtccgcgggaccacgagggcacccggacggtggtcagggggtcgaagaacggagccgggtggtcgaggaaggctgccacgagttccggtgcccgccaccgcacgtcggcgtaggcgtcggccacggtctgcttgtgaagggtgacgttcttgcggtcgtggggcgccggctgtgcggcccggaaggtgaagatcgcgagcggggtggtccgcgaggggtggaggaccagcatccggttcggcacggtcagcatcgtcatctcggtcgggtcctcgatggcgtcgggttccagcgggacggtcgcgccgtacaggcccaggtcgctcgcgaactgccgctcggggccgaataccaggcgccgtacggtggagtgcatcccgtcggcaccgattaccaagtcgaagcgccgtggcgcggaccgccggaaggtgacgtccaccccaccttcatcctggtcgagagcggtgaccgtgtcgtcgaacaagaactcggcctcggtctgcgccgaccggtggagcacctcggacaggtcggcgcgggtcacctcgaccgtcggcgccttgtccgaggtgagcgggagctgcaggattcgcctgccgccggggtcgagcagggtcagcgaccgattgcgggtggcgagctcgcggagctgcgggaggatgcccatgcgctcggcgaccgggatcgcgggccccttcacgacgatcgcgctaccaccggagcgcagctgccgggcgtgttcgacgaccgtcggccggtatccgttccgggagagccagtacgcgagtgcgggccctgcgattccggcaccgactatcagcacctctggcttcttcatgacgatgacctctcggagtgtcgatgaccaggtccccggcgagtgccgggccgggtctgagggagcggcggcacggggaggtgcaaccggaccaaggtacgatcattttcgtacctcagggaagcacgtccttcaggtacgatgcaagtcatacctgaaggaggtgcggcgtggccgggaggaacctggtcggcccgggggtcgatgcgctcgatctgggtgcggtgtttcgcgccctcgccgacgagcaccgtcgttcggtgatgacagagttggccgccgaccgcagcgacagcgagcggggctgcaactcgttcaatcttccgatctcgaagcagacccagacccaccacttccgagtcctgcgcgaggcaggtctcattgacgagatcgactacggcaaccgcaagggcatccgactacgacgcgcggacatcgagaaaagattccccgggctgctcacgctcctgggcgcagagtccccgggcggtactgctcctcgctgagcacagctgagcacaccggggggagtccgagctgagccgcgagctcggccgaatccagcccgcgcccggctcgcaggtagccgggcacgacgcgggcacaaaggggatcggtgccgcttcgaccaccgtcccgcgctcgtgatcggcgccgaactcttccgcacactccctcacgcccacacccactgaggtctcctcaatccgcatgcggagcagggccactgggggtgagggcggggtccgggcatagagaagctcctggtggacgggtgcgtgtcgagtccaagccatcccgccaggagctttccgcatgcttgtctacccagccggggtcgatctgtccacctccgctctgcgcttcctcgcccgtgagttgaccgcacgtcgtcttgcgcaagggacacgatggcgacggctggccgccggacggcaggcactgctcgtgctggctcatctacgatgcggccatacctacgcccagctcgccgccggattcggtgtgggcaccaccaccgcctaccggtacatcgcagaggccgtcgacatcctggccgctctggctccaaccctcgccgaggcggtgaggacagcctccggcaaggccttcgtgatcctggacggcacgttgctgccgatcgaccggatcgccgccgaccgacccttctactccgggaaacataagaagcacggcatgaacgtgcaggtgatcgccgacccggcaggacggttgctgtgggcctcgcccgcgctgccgggatcggtccacgacatcaaggccgcgcgaacccacggcatcatcggtgccctggcgggggccggggtggaatgctgggccgacaagggttaccggggcgccggcaccgtgaaaagatcgcgggatgctgcgactcaccgatttcattatcgactgcccggacacgatgaagctggcggctttctactccgaggtgacgggccgtccgatcaaggaaggcagctccgaggactgggctggcatccagttcggcgagatcgagatggcattcatccgggtggacgactaccgcgctccgcagtggcctgacagcgagcaccccaagcagttccacctcgacttcgaagtggacgagatagagtccgagcagcgccgcgtcctcgacctcggcgcgacgctgaggcaggatttcatcggccccaacggctacggctggcaggtctacaccgacccgatcggccaccccttctgcctgtgtcgcaacaagggcgtcatctggaccgaccagggcccgatctggcccgagcgcgactaactgatcgtttcaaaatgaggttcggattcgtcgcaagcagatgatgctacaggcgagttggagcagtccgaggtggaggtcggcgcgtgtctcgtagcgggtccgcaggcgtttgaactggtggagccaggcgaaggtgcgctcaacggcccacctcgtcttgcccaggccggatccgtgggcggtgcccttgcgcgcgatcttcggcgtgatgcggcgagcgcgaaggagtcgacggtacttgtcgtagtcgtagccgcggtcggcgaacagccgccgtggccggtgacgtggccgtcccaccaggccgcggatgcggggtatcgcgtccagcaggggcatgagctgggtgacgtcgtgtcggtttccgctggtcaacgacaccgcaaggggtgttccgtgccggtcggtgatcaggtggtgcttgctgccggggcggccgcggtcgaccggcacggaagtccggtgtgaaccccccctttcagggcccggacatgcgagccgtcgatcgcggcgtcttccatgtcgagcaggcccgtcttgtaagtccgcgatccgccgcaaccggtgataccggggggtgaaccggggcgggcgggtggtactgcggtactacggccgcggtggggccgggcggcgggcccgtcaggcgtcgagggcgagggaggcgatgatcgaccggaccgtctcctcggtgatgcccgggtggaggaacgccaggcgggcgacggtctcgccctcccacacgctgggggtgacgaacgcgaggccggaggccagcaggcgcttggaccaggcgtagtagtcctccgggagc

SEQ ID NO: 163 - DNA, 2411 bp, Unknown
  Kingdom: Bacteria, Phylum: Actinobacteria, Class: Actinobacteria, Order: Streptomycetales, Family: Streptomycetaceae, Genus: Streptomyces
cgcgccggatgcgagggccttcgtcacgacgtgcgggcggtcgccggggacgtagagccaggtgagcgggaagggggcggtggccgtcacagcgcgccctccgcgcgcagcgccgccagttcctccggggtgaggcccagctccgtcagcaccgcgtcggtgtccgcgccgtgcgggcggccggcccagcggatcgcgccgggcgtggcggagagccggaagaggacgttctgcatccgcatccggcccagctccgggtcgtacagcgtggtcaggctgcccagggcctggtactgcgggtcggcgacgacgtcccggacgtcctggatcggcgcgatcgccgcctgtgccttctcgaaggcggccatgacctcggtgcgggtgtgccgggcgatccagccgccgacggcctcgtcgaggacatcggcgtgggccgcccgcccggcgcccgtcgcgaaccacggttcgctgatcagctcctgccgccccaccagccgcagcacgcgctcggcgaccgactgcgccgaggcggacacggcgacccaggtgccgtcggcggtgcggtaggtgttgcgcggggcgttgttctgggtgcggttgccggtgcggggctggacgtagccgagctggtcgtaccagaggggctgcggcccgaggacggtcaggatgggttcgatgatcgccatgtcgacgatctgcccctcgccggtgcgttcccgggcggcgagggcggtcatcacggcgtacgccgtggccaggcccgcgatcgagtcggcgagtccgaagggcggcagggtcggcggggcgtccggctcaccggtgatcgcggcgaaaccgctcatcgcctccgccagggtgccgaagccgggccgggaggcgtacgggccgaactggccgaagccggtgacccgggcgaggaccagacgcgggttggccgcggagagttccggccagcccagttcccagcgctccagggtgccgggacggaagttctccacgatcacgtcggcggtcgcggccagccgcagcagggtggtgcggccgccgggccgggacaggtccagggtgatggtgcgtttgttgcggccgaggagcttccaccacaggccgacgccgttcttcgccgggccgtggccccgggcggggtcgggcctggccgggtgctcgaccttgatgacctcggcaccgaagtcgccgagcatcatggcggcgatcggtccggcgaagagcgtggcgaggtccaggacgcgcagcccggcgagcggcggcgcgggctccgggcccggcggctgcgggccgggggcgtggccgtgcgtggggggcgtcatgggcgggacgcctcctggtgggtgagccgggccagggcgtcgaagccggtgccgtcgaagtcgccgacggtcgtggtgagccggttcttgagcggggcggtccagcggtcggggagcgcggcgggggagccggcgaggagtccggcgacggatccggcggtggcgccgttggagtcggtgtcccaaccacccgacaccacccggcagatggaggccgtgaagtcgccgtcggcgtgggtgagggcggcggcgatcagggcggtgttcggcacggcgtgcacccagtggtacgcggcgtgcacggcgtggagttcgtccacgaccgtgtcgaagtcctcgtgggcggcggccagtcggatcgcgtggcggaccgcgcgggcgaggcgggagccgggcggtacgaccttcagcccggtggccaggcaggtgtgcacgtcgtgggtgccgctcgccgctgcggcgatcacggcggcggcgaacatcgcggcgtagacaccgttcgcggtgtggctgaggacggcgtcgcggtacgcctgctccgcggcggcggccgggtcgcccgcattggtccagccgtgcacgtcggcgcggatgagggcgccgatccactcgcggaacgggttgcggtggcgggcggtgcgcggcggttcgatgccgagcagcaggttgcggtaggcgacgcgttcggcggtgaaggtacggcccgcgggcagttcgtccagccagaggcgggcgaggtcggcggtggtgaagtccctgccgtggcggcgcaggaggagcaggcccagcagcgggtggtcgaggtcgtcgtcctcgggcatgccgtcgatgttctcggcgaggctggtggccgccgagcggcggttccaggggtgggccgcggccaggtcctcgggcacgccccgggcggtgaaccaggtgctgagcggccagttcccggtggcgcgggccagctggcggatgccgtcgagggggagtttctccacgggcttgcccagcagacagcccgctgcccggcccagccaggcggcttcgaggcggtcggggccgggcggggcaggacgagcgccggcgccggcgctc

SEQ ID NO: 164 - DNA, 7723 bp, Unknown
  Kingdom: Bacteria, Phylum: Actinobacteria, Class: Actinobacteria, Order: Streptomycetales, Family: Streptomycetaceae, Genus: Streptomyces
ccgccgcgacgatccgggcgacgtagtcgtcgaagtacgcctccggcgcgtcctgcgcgatgtgcacgcccgccgtcagcagcagctcgccgcccagcatgtacgggtacgggtcggccatctccgaggtgtgcgcccagtggatcacgacctccgggccggcgggcccggcgatctggcgcagggcgaggtcatcgcgggccagcagcgcggccagcggcaccggtggggtcggtgggaccaccggtgctgccggggccgccggggcaggtgtgttcggcatggtgtgcgcttcctccatccccgccccttcgaatggatgaaaagtacacttcgcagtcgctttccggccacctaatgtcattccagaccggcagccacgggtacgggcggatgtccccgcgagccgctgccgacggcccccctgacccatccggggggatcccaggacaaccacacgtctctgcacgacccgcctccggaaagtgcgcgaaggagggccccacatggccgtcgactacacggtgatcgttctctatctggccggcatgctggccatgggctggtggggcatgcgccgcgccaagtccaagagtgagttcctggtggcgggccgccgcctggggcccgctatgtactccggcaccatggcggcgatcgtcctcggcggcgcgtccaccatcggcggcgtgggtctcggctacaagtacgggctctccggcgcctggatggtcttcaccatcggcctcggcatcctcgccctctccgtcttcttctccgcccgcatcgcccggctgaaggtctacaccgtctccgagatgctcgacctgcgctacggcggcaaggcgggcatcatctccggcgtggtcatgtgggcgtacaccctcatgctcgcggtcacctcgaccatcgcctacgccacgatcttcgacgtgctgttcgacctgaaccgcaccgtcgcgatcatcatcggcggcgcgatcgtcgtcgcgtactccaccctcggcggcatgtggtccatcacgctgaccgacatggtgcagttcgtcgtcaagacgatcggcgtgctgctcctgctgctgcccatcgccgtcatcaaggccggcggcttcggcgcgatgcgggccaagctgccgacctcgtacttcgacccgctgggcatcggcggcgagacgatcttcacctacgtgctgatctacaccttcggcatgctcatcgggcaggacatctggcagcgcgtgttcaccgcgcgcagcgacagggtcgcccgcctcggcggcaccgtcgccggcacctactgcctggtctacgccctggccggcgccgtcatcggcaccgccgccaaggtgctctacccgcacctgggcagcgccgacgacgcgttcgccaccatcgtcaaggacgaactgcccgtcggcgtgcgcggactggtcctcgccgccgcgctggccgccgtgatgtcgacctcctccggtgcgctgatcgcctgcgccaccgtcgccaacaacgacatctggtcccggctgaggggcgcggtgcgccgcggcggggacgagcacgcagaggcgcacgacgaggtgaagggcaaccgcgtcttcatcctgatcatgggcgtcggcgtcatcggcaccgcgatcgccctgaacaacgtcgtcgaggcgctgaccgtggcgtacaacctgctcgtcggcggactgctcgtgccgatcctcggcgggctgctgtggaagcgcggcaccgcgcccggcgccctcgcctccgtgatcgtcggcggcctcgcggtcatcggcctgatggcgggcttcggcatcctcgccaacgaacccgtctactacggcctgctgtcctccctggtcgcctacgtcgtcgtgtccctggccacccggcccaccgacgagtccgtcctcgccgtctggcgcgaacgcctcgccggacgcacccccgaacccgcgtccgaagccgtcccggcgcacccgtagagtcgccaggaaagcagtacatgcgcgacgaagcgcaggaaagaaggcatttcaccatgagcagcaacgagacgccccgcggccccgtcgactcctcccgcgtcccgcgctacgccggccccgccaccttcgcccgcctgccccgcctcgacgaggtcggccgcaccgacgtcgccgtcgtgggcgtgccgttcgactccggcgtctcctaccggcccggcgcccgcttcggcggcaacgccatccgcgaggcgtcccggctgctgcgcccctacaacccggcgcaggacgcctccccgttcgccctcgcccaggtcgccgacggcggtgacatcgcggtcaacccgttcaacatcaacgaggccgtggagaccatcgaggccgccgccgacgacctgctgggcaccggcgcccgcctgatgaccctcggcggcgaccacaccatcgcgctgccgctgctcaggtccgtcgccaagaagcacggcccggtcgccctgctccacttcgacgcccacctcgacacctgggacacctacttcggcgccgagtacacccacggcaccccgttccgccgggccgtcgaggagggcatcctcgacacctccgccctctcccacgtcggcacccgcggcccgctctacggcaagcaggacctcaccgacgacgagaagatgggcttcggcatcgtcacctccgcggacgtctaccgccgcggcgccgacgaggtcgccgaccagctgcgccagcgcatcggcgaccgcccgctgtacatctccatcgacatcgactgcctcgacccggcccacgcccccggcaccggcacgcccgaggcgggcggcatgacctcccgcgaactcctggagatcctgcgcggcctggcctcctgcaacctggtctccgccgacgtcgtcgaggtcgccccggcctacgaccacgccgagatcacctccgtcgccgcctcccacacggcgtacgaactcaccacgatcatgacccgtcagattgcggaggctcgcgcgaagtgacccacgaccacgacctggagctccgcccgacgtccgcccagacggaggcagccctcaaccctccccccggccgcaacggcggagacctggtcgtggagaccctggccgggctcggcgcgaccaccgtcttcggcctgcccggccagcacgccctcggcatgttcgacgcgctgcgccgctccgacctgcgctacatcggcctcagagtggagaacaacgcgggcttcgcggccgacgcctacggccgcgtcaccggcgaggccgccccgctgctcctgtcgaccggcccgggagccctcacctccctggccgccctccaggaggcggcggcggcctccgcgcccgtcctcgcgatcagcagccaggtcccgaccgccggactcggcggcggccgccacggctacctgcacgaactgcccgaccaggcggcctcgttccggggcgtggtgaagtccgtccacaccgtccgcacccagtcccagatcccgtccgcgatcgccgcggcctggcagtcggcgctcaccgccccgcacggcccggtctgggtcgagatcccgcaggacgtcctgctggcgcagaccgcgctgccggcggtgacggcgatggacgccgccccggaggagctggtcccgcgccccgaactgacggccgtggcggcgcacttgctgtccacggcggcccgccccgcgatcatcgcgggcggcggggtcgtccgcgcggacgcctccggcaaactccgcgccctggccgagaagctgaacgcccccgtcgtcaccaccttcggcggcaagggcgccttcccctggaaccacccgctctccctccagtcctggctggaggaccggcacaccaccggcttcctcgaggacgccgacgtcctgctggtcgtcggctccggactcggcgaactctcctcgaactaccacacgttcgcgccgcgcggccgggtcatccagatcgaggccgaccccggcaaactggagtccaaccaccccgccctcggcatccacgcggacgcccgcctcgccctccaggcgctcctggagaccgtggaagaacgcaccgacgacacggccgccgaccgcgtacgcggcctcctcgccaaggtccgcgaccgcatcgccgcccaggacctcaccctggagcaggacgtcctcgcctcggtgcgccgcgccctgcccgccggatcgccgtccttctgggacatgacgatcctggcgtactgggcctggtcggccttcgatccccggggtgcgaacaccatgcactccgcccagggcgccggaggcctcggctacggcttcccggcggcgctcggcgcggcggtggccgaccccacccgcccggtgctcgcggtctccggcgacggcggcgccctgtactccatcgccgagctggccacggcccgccagtacgacctggacgtcacctggctgatcgtcgacgacggcggctacggcatcctgcgcgagtacatgaccgacgccttcggccaggccacggccacggaactcacccgccccgactacgtcgccctcgccgagtccttcggcgtccccggtgtgcgtacgtcccccgagaccctggaggcggacctggcacgggcgctggcggcgcccggtccgtcggtggtggtcctgcccgccgtgctgcggatgttcgcgccgacgcacctggactgaccggcgacggaggggtatcggtcaactctccatgagccgcccgtacttctccgcgtgggccgcgcgctgttccgcgtacccgtccgcgaaggcggcctgttcgtcggggttcatgttgtcggccagtacgcgcttgggcggcacgaggtccggtatctcccggaaaacctcggcggcagacgtccagtgctcgcccccgcggaaacgggccgccaggacgcgcttcggcagggacgacagctccctgtccaggaagtgcagcggccgctgcttcacgacgaggtcctcccgccgcggcggccgtccggtctccccggccagcagacgtaccgtccacagcgccgcgaggagccgtccggacaagtggtggtcgccgtgcttctgttctgccacgcgctcttcctacccacgccggtgacgctcatccggagccggtgagggcgtgacgtccggcgcctgccggggacgtgaaccggtcacgccgtacggaagttgccgcgtccgtacaaccattccctcgaatccgtgcgtccactgggtatgactcactggatatcacgacgcgtcagggtgctcgcggcgatcggtgcgggtgccgggatgctcgtaccctgcgtggccgccgcgacgcccgcggccgccgccgcagcgaaggtcagctgcacgtccggcagggcgggactggccgcccagctgcagaaggacatcacggcggccatggcgggccgcaagggttccatcgccgtcggcgtacgcgaccgcggcaccaacacgacctgcaccttccgggaatcgagcgcctacgactcggcgagcgtcgtcaaggtgaccgtcctcgccacactgctgtgggacgcgaagaagacgaaccggcagctcaccgaccgcgaggcctccctcgccaaggcgatgatcacccggtccgacaacgactccacgtccgccctgtggaagcagctcggcctgacgaaggtcaagggcttcctgagcgccgccggcatgacccagaccaagccgggcgcggacggctactggggcctgacccagatcaccgtgcgcgacgagcagaagctgctcgccctcatcacggcgaagaactccgtcctcagcgacaactcccgtgcctacatcctcaagctgatgggccaggtcgtgtcctcccagcgctggggcacacccgccggggcgcccaccaacgtcgcctggcacgtcaagaacggctggctgcagcgcgccacccacggctggcgggtgcacagcgtcggcaccttcaacggcggcggccacgactacaccatcacggtgctcacccaggacaacagcaccatggactacggcgtcaccaccatccagaacatcgcccgggccgtccacaaggacctcgcccccaccgcgcggtgggccaagcgcgtggagccggcgccccggcccagtgaggcgaccgtcccggtgccgccgaccggctgacgcttcacggcgcgctctcccgccggtcacccgggagccctacggtgacggtcatgcgcctgagaaccgtactcgcgaccgtcaccgccggcctggcggcggccacctgcctcaccgcagtcccggccgccgcctccaccgcccccgccgcagccgcggcccgtgaccactcctgctccccgtccgtctccctcgaccgcttctcggacgcgctcgacaagatgacgtaccagggctcctacgtcggcaacttctccgcgctcgcgcacgaccggcacggcgacctcgccgcgctctccgaccgctccgagctgttcaccctggaccggcgcacgctcaagccgacgggcgtggtccggctcgccgacgagagcggggcaccgctcgactccgagggcctggtcaccgaccgggacggcacccacctggtcacctccgagaccgagccgtccgtacgccgctactcccgcgacggccgcctcctggaccggctgcccgtgcccgacgcgctgcgcgtggccccggccggcggtgccaccgccaaccagaccttcgagggcctgaccctgctgcccggcggccgcaccctcctcgcgtccatggagtacgcgctcagcggcgacgacacccgcaccgtccgcttccagacctggcagcgcgaccgggacgggcacttccggctcgccgcgcagtacgcctaccgcaccgacgacgcgagcctcggcgtcccggaggtccaggccactcccgacggccggctgctcgtcctggagcgcggcttcaccaccggggtgggcaacaccgtccgcctctacctcgccgacccgcgcggcgccaccgacaccagcggcgtcgagaagctgaccgggcagcccggggtacgcctgatcagcaagaccctcctcaccgacatcgcctcctgccccaccctcggcgccaccgccaagcagccgcagcccaacccgctcctggacaacatcgagggcatgaccgtcatcggccacgacacccgggaccgcctccgcgtcctcctggtcagcgacgacaacgcgaaccccacgcagacgacccgcttctaccacctgcgcgtccggctgtgaccgcccgctgacccgacacgcagcgtccccgccgcgccgccgaatgttgcggagggatgaaatccgccgccgcccttgttggtgccttccggaagatcaggccgtcagggaggcaccgacgtggcagcgcagccgggggagacacgagggtgggtgcgcaggctcgcctcgtacgcatggcgctatccgaaggacgtcgtgctcgccctcggttcctccctcgccgggatggcggtcatggccgtcgtcccgctcatcaccaaggtgatcatcgacgacgtcatcggtgaccacagccgctccatggccccctgggccggtgccctgatcggcgccgcgctcctcgtgtacgccgcgacctacgtccgccgctactacggcggccgtccagcttcgtgatcgacccgtacatctcggtgcgcaggtcgtgctggacgtcgagggcgagccggccgccgtagtagcggcgg

SEQ ID NO: 165 - DNA, 1600 bp, Unknown
  Kingdom: Bacteria, Phylum: Actinobacteria, Class: Actinobacteria, Order: Streptomycetales, Family: Streptomycetaceae, Genus: Streptomyces
ggccgccccggcgtccccgggccggccgtccgacgctcccggacggcccctcgaacggctgccgttcagcccctggcacctgctcctcgccccgctcgccctggtcttcgcggtcccgctgatctggctgctgctcagctccgtcatgagcgacgcgcagatcaaccggttcccgccggcgctgtggccctcgcacatcgacctgggcggctaccgctacgtcctgggcaacgccatgttcccgcgctggttcgccaactcgctgctggtgtccctggccgcggtggtgtccaacctggtcctcggcgccctggccggttacgcgttcgcccggatgcggttcgcgggctcccggctgctgctgggcctgatgctggccaccatggcgatcccgttccagctgacgatgatcccgacgttcctcgtcatgaagcggctcgggctcatcgacacgctcggcgcgctgatcgtgccgtcgctggtcaccccgttcgccgtgttcctgctgcgccagttcttcctgtcgctgccgagggagctggaggaggcggcctggctggacggctgctcgcgcctgcgggtgctgtggcagatcgtgctgccgctgtcgcggccggcgttgagcacggtggcggtcctgaccttcctcaccacgtggaacgacctgagctggccgctgatcgccatcaaccacgacacccagtacacgctccagctgggcctgaccacgttccaggggcagcaccacaccaagtggtccgcggtcatggcgggcaacgtgatcaccgtggcgccggtgctgctcgccttcctgctcgcgcagaagtccttcatccagtcgatcacgtcgagcggtctcaagggatgacccggccgccgcggccctcccccgtccgccgacgtccgcccgtcagggtccacacctcaaggaacaccgcatgcagcacacctgtgacctcctcgtcatcggggacgccaaccccgacatcgtcgtcggaccgctcgacgcgccgctcgccttcgggcagcgggagcggctcgtcgacagcgggacactgaccctcggcggctccgcgtcgatcatggcctgcggggccgcgcggctcgggctgaaggtggccttcgccggacgggtcggtgacgacgacgccggccggttcgtgcgggcggcgctggaggaccggggtgtcgacacctccgccctgcgcgtcgaccccgcgctgtccaccccgctcaccgtcgtcctgacccgccccgacggcgaccgggcgatcctcacctcgcccggcacgctgccggccaccggacccgaggacgtacccgaggcgctcctcacgggcacccgccacgtccacgccgcctcctacttcctgctgccccggctcgccgccgcgctgcccgccctgttcgccaccgcccgcgcgcacggcgccaccacctccctcgacaccaacgacgacccggccgacgcctgggcgcccggggatctgaaagaggtcctcgcctacaccgaccacctgctgccgaacgcgcaggaggcgagcgccctcgcggcctccgccgccggcactcccgcggacgcctccctggaggccgcgag

SEQ ID NO: 166 - DNA, 17498 bp, Unknown
  Kingdom: Bacteria, Phylum: Actinobacteria, Class: Actinobacteria, Order: Streptomycetales, Family: Streptomycetaceae, Genus: Streptomyces
cgccccaggcagccgcgcccgcccccgccaccggcgtgggcgcagccccccgggggtcgacgacggccgcagccaagcccaagccgggcctgtggagcaagttcctggcatggaccagaggagagtgaccaaggcaactgcctggtgaacggtcatcttgtatgtgcgccgccatgcatgggtatgcatggcggctggtgaccaagatcatgaaggggcctccgtgaagactgcgataactgcgcctgccggtcggcgcttgactgtctcgatcttctcccgtctgcggaccaggcaggggcagacggacccgttcccgctctatgcggagctgcgctcgaaaggcgaagtcatcgcggccccctggggagggcacatcgtcaccggcttcgcgctgtgcgatcaggtactgcgcagccgtgactggcttgagcccgacgccgactggcgcgagagacagggaaccggcgcccgctggggggcaccctccgcacgcgagatgagcaagaccctgccggcgctcaacccgcctgaacacacccgcgtgcgccgctcggccggcatgttcgaccgcggcaccctcgaggaactgagcgcacccgtcgaccggatcacgaggaagctcctcgactccctcgccgagcgactgcatgacggtgaggccgacctccacacgctggtcagcgaggaactgccggtggccacgctcggccactggctcaggctgcccaccgcggacttctcccggctccgcgaactcacacacgaccaggtcttcacacaggagctgcttccctccgccagccaactggcgctgtccgacgctgccacggcggagctgcgcgcctacttcaccgacctggtacggagccggcgcgcgcatccgggcgacgatccggtctcccgctggatcgcggtatgggacagggtcgagagcgaccgtgacagagccgacgaagcggtctacttcctggcgctcttcgtgctgctcgccgggctggaaaccacatccaccctgttgtcgaccatgacgctcctgctccttgagcacccggggcagtgggaccggctcagcgtccagccggacctggtgccggccgcggtggaggaggtcctgcgctatgacccgcccacgcatgtgatcagccgcgtggccgcgaaggactgcgtactgggcggcgcagaggtcaggaaggacgagatggtccacctcatggtcggagcggcccaccgcgacccggccaagcaccaggaccccgagtcgttcgacgtgcaccgcaaaccggcgcacctcgccttcagcggcggcatccactactgcctcggcgctcccctggctcgcctggaggcccagaccctgctccaccagctggtcacgcgcttcccgcgcctggctctcgcacaaagaccctcctgggcgccacgcgtggcgttcaggcggctgctgaacctggacgtgaccctgatatgagcacgatcgatctccacgccctgctcccgcacaaggccctgcacatcaccgaggacggtcccgtccttcaggtggtcctcgacccgtcggccgaggacggttccctctcagcagccgccctcaccgatctcagagccgttctggagggcctccacgaccggcccgacatccgggtgctcgtcctcggctctgcggacgaggacttctgtctgggcgccgaccgcaccgagtaccaggcggcgctggaagaggaccccaccggcgccgtcctgcgccgcatcgccgaccaggcctaccgcgtgtgcgacgcccttgagaacacgcacgcggtcaccatcgcccgactccacggcaaggtggtcggcgccggcttggcgctggcctccttctgcgaccttcgtgccggtgcggacaactgccggttccgcatgccggagatcggtctcggcctgccgccggcttggggtggcgccatgggtcgcctgatcgtcgaagcgggcgctgccaggatccgcgaactcatgctcacctgcgaaagctttgacgcggacaccgctcaccggctcggcctcctgcacaaagtggcgccgatcgacgagctggacgccgcgatcaacaggtgggtcaggccactcgtccgccgctcgcccgaggcgctgacgctcaccaagcgcatgctgaccggctactcccgtgccgcccgcacgtcggacgtcgcactgctcgacgcccacctcctcagcgcccagctcgcccggccccggtcgtagcgagcaggtctctcccggacagctcgcggcaacggcgtgggggcgcatgcggtgcagccgaccccgtaccgggcacaggaccctttgctcaacgccctgtactgacggcggggctggaagagcgttctgtcttggggggtgcttggtaactggcgcgagtcgaccgccatggtcgaggagcggcttggcggcggtggcgggcgcgggcttgtggagtcggcaccaggtggtccggcgcggtcggtgcgtgaggtcggggaccggctgcgagcagagtggtgaacaggcgctggatctcgggcaagtgagcgggatcggtccgttcgggggccccgcatacccctctgaccgcgcccgcgcggccgagccggtccccacgtcggctcggcggcacggcagtcggcctcaggactggcgtgcgagatcaagcgctgctctgtggacggaccactccagcgcggagtggcacaccccctggctggtcgcgaactgtgtctgcgctcatgaggcgaaggccgcggagaggatccggttgaccagggcgagatcgtttcctccaccgttggtggggttgaaggagtacaccaggcgccgacgcagatcgcgggtggtgaacataccgtcggtgaagccgaaggtgcttccggtcttgccccacacggtcactccgttgggcagggtggcgcgcatcagcccggcgctgtagtaggcgcggccgtgccccgggtcgtggtcggtgccgccgaggtaggggacgtcggggacggtgaacagggccgcctgctcggccggcggcaggagccgtcctcggaagagggcggtcaggaagtggtcgaggtcggccgtgtcggagatcatgccgccggcacccgggttctgttcggtgatgtcgacgagctgcgttccgccgtccggctggggcacggcgatgtagccgtgggagtgagggccggggatggtggtgtcggtttccggagcggtggtgtcgcgcaggccgagcggccgcaggatccggttggtgatctcttgctggtaggtgtgtccggtgaggtgctcgatgagcatcgaggcgacgtagtagccggtggctccgtagacctgcatggagccggggtcctggaagggacggtcatggcggaccgctttcgcgaccagttccgccagcgggtggtcgtcgaagcggtgctcgacgatgccgtccggggtggtgggcaggtcgtccggtgtcagttcgggaaggctgctggtgaagtcgagcagggtgcgaaccgggatcggcgggtagttgtcgggcagcacgtccggcaggtaccgctgaacgggctgatcgaggtcgacccggtgttcggaggccagctgcagcatcacggtggcgatgaaggtcttggtcacgctgccgaggcggaaccggccgtcgaccggaaccggcgccccggtcgcgatgtcaccggtcccgtacgtgccggcccaatggccgtccgggccgctcactcgcgccagcacccctgtgacccggtcaggcgcactcgagagtgcccgctgcaagatctgcgggtccggacccggcaagtggccactggcgcgctcggcagccgccgcaggccgcgcggcaggagccgccaccgccgggacggccgtgcccagcgccaccgcggtgagaaccgcgcaggcgagcgttgccaccggcagtcgcctgcgccgacccctcgtcgtagtcgtctcggtatcggaagaacggggcttgagagtcatacccacgacgatgccgcacgatccctgcgcgactcatcagggaacacccctgacaagacccccataggcccctgaggtcgcatcaggtagcgggacaggaggacatttgcggtaggcgaattgccgttgatactggacacagccccgtcgacccgtcgacctggtcggcacgatcggccgcgcggccctgggcgacctcctgcccgcccaccgacggcaacgggtgaaggcccgcaccgcacccgaaagaaccccaccagcgagtacggcccgaacgcgggacaacacccccacaaggcccagaactacaccgtccgcaccaccgtcgcgttcttcgcccacggcctcaacagccgcccccatggccctaacgcagcggtgctgaggccccagcccgtggtcttggggccttcaccacggcgcccccggcccgaacggttcgaagaacatgacgtccagcggatgcaggtcccggccggtcagaccggggaagccggattcggcggggccgccgcgcaaccacgtgagcaaggtcgctgtgaagtcgcccggcaggggcggtccttggtcccagtggcgtgggtcgacggctacgcgccaggtctcgggcgggccgtccacgcaccagccgatctggtcaccgtcgatcgtcgacgcgaacggcaggaagccgccgggctcgggccacgcgggcatcgggtggtactggggatgggcggcgcgcagttggcggtatccgtcgagcatgccctcgacggtggccgcgagcccctgctcccgtggccggtccagggacaggggggcgctcatgtccagccaccagctccagttgcccgccccgtaccgctccgcgagcgccacgaagtccggcggcagccgggtgccgagccgctcgaagacctgctcccatgtcccctcgcccagatacggctccaggggcggcggaaccagcgccatgacggcgtcgaggcccgagccctcggtgagcgccgcgtgctgccgcgcgtccacggcggtgcccgcaggcggtggcgaccagggtgcggccccggccagcggcggccatacccgtatctgtgaggacagcgggcccagcagcccgccgggctcgcccgggtgcggcacgccggtgcgcagcagcgtgaacagcagctccaggaacgggacttcgtagtccacccagggctcgctcaccctgactgccactttcgtggtcatgagcgtgaccggccactcgtcggggtcgtccgacgcgcccgtgtcccagaagaggtggtcgccgctcctcgtcgtggcgaaggcgagcaggccgccctcctcgggcaggaaggggcgccgacgcgcggtgaacatgccgggccggatcgccgagtgccggtgcgtctcgacgatccatgccgcgtactcgaaccggccgtcggtgctgacgcacgggggatgcagccggatcgccgcacccgggccgcctatctcggccgcaccgtacgccgacacgagcgccttgtagtcaccgggcagcggggtgccgagccagccctcgaccgccgcccagtcgacggcgggcgccgggccgggcggcggtccgacgagacctgtgaacgcggtgatccgcgctgagtgatccatggagccgaggatgacatcccccaccgacattgagactgggacctggcaccgctggggggtctgacccgcgcgctgactgacgcttcggctgtcctcgggttgaatcgctcggctcccgggcggtgccacagcgcgcgtgaccggccgggctaccgtgacctcattgcctcgcccagcccccttgccccgcagatcacagcgttgacgcaacggcgttgccctcaaggatgttcggtgactggcgcgatgtcagccgcttggggtgagggccgttgcggacgccggcgtctggaggaagcccgggggcacgttggagacgcagacgcggcagtggcgggtctgctcgtgcagggcgcaccagtcctcctggacctggcgcatgccgccccggggcgggcggcgccactccatgtacaccgagtcgaccgcgcgggcggtggcgatgaggccgtcggcccggtcgtcggggccgcacgccgaacaccgccggcagagccgggtgggcaggcggctgcccggccccagcgtgatcacttcatggagctggcgttcgggtcggcggtctaccgtgcctggctcggtgcctgctcgccttgccgccactccggtcggccgcagcgccgccgggaactggacgccgggctgagcgcccgggctgcgggaatcgtgccaccgccgcgttcccgttgcgccgaaacggggacttcagggggacacaccgacgtccgtgatgagccgcgacccgagtctcatcttggctgggggctctctgaggactgggtgtcacgtggcaagcgtcccgacagtgaacggaatcatgatgcccgtcatgtcgaggagcacggcctgcagggtgacctgacctacgtccatcaccccgacctcacgcacggcttcccccagttcagccactactcccgggcgtgccgggcggccaccgaagacctcgcccgcaggatcagagaacgcatcggctgaccaccgtatgcgctcgcggtcccggcgagcggtcccgcctcaggcagtggtgggggcgccggcgatccggcgttcgccgccctcgcgttcttgccggagacggtggacgtcgacggctgcgtcgcgcggctcgtggcgcatcggcattcggcgttcgtcccagttcttggcgaactcgtcgtagaagtcttcgagttcggatcaattgcggccgtcgacgtatacgaacccctgacagaatggtctttgagaagtgagtgtcggttcgcgttcttccctgcatgagggcaatgatcgtttcttgccgtcggcggagtcggggtccgcttcccccttggcatggtggttctagcaggacaccggtgcgcgagtggcgcctgcgcgccctctgcgcgtgttgcggtgtgcgaaggtccgattccgcgcacgtggcggttgtaggtcattcgtcgggggcgaaggattttcgacgggcactgcgcggtcggcgggtgccctgtccagtgcgccatgacaaggggtgaagagcaaccgtgaaagcagcgatgttctacggcaaggaagacctgcggatcgaggacgtgccggaaccggaggtcggtcccgggcaggtgaagatccgcaacgggtacgtcggtatctgtggtggtgatgtgcacacctacttccacccggaggcttcgcctgtcgatctcttccgtccgcatcccgtgaccggcgcgcagttgccgcagcccctggggcatgagttctccgggacggtcgtcgaggtcggggaaggcgtcaccggcatcgaggtgggcgatcgcggctcgatcttccccaccgcctacagctgtgggaagtgcacggcgtgccggcacggacggccgaccagctgccgcctcatggcagggctgggagccaacgccaacggcggcggcatggcggagttcgtggcgatcgactcgaagcagttccaccggcttcctgaggacgtcgaccttcaaaggggtgctctggtcgagccgatgtccgtcgcatggcacggtgccggccgcagtcgttccggccccggggacgtcgtactcgtggcgggcgccggccccgtgggcatcggggcgtggtacgcgttccgcgcgcgcggggtcgagaacatcctggtgtccgagccgagcagagagcgccggaccaagatcgcggcgctcggggcacaggtcatcgatccggtcaccgaggacctcgatgcggcggtcgcggacttgacgggcggtgacggcgtcgacgtgttctacgacgccgccggtgtcggcgcagctctgcagacgggcctggccaacctcgctcccggaggccgggtgatcctgcagtcagggcatgaaaagccgttcgagatccagccgaacgagatcatgatgggcgagtacgagctcctgggctcgctgggctatcgccccgacgagttcgacggtgtcatcgggcgcatgtccgcgggcgagtacgacaccaccggctgggtggaggagatggagctcgacgacgtcgtcgaggccatccacaagctgcgcgcgggcgccgggaccaagatcctgcttcgcgtcgggtgatgacctacgagcgcggcggacggccggccgtccgccgcgctccggtgtctcccggtctcagaaggtcgacgtcctccgtacgagggcgcaccgcacgctcagttccttggtgcggcagcggagctgcgggccccggtccgggggcaggcggacaccgtgcgtgccaccgaagtcgacgaacgcgcaaggcgggctcctccctccggttcatcgaaccggggtcctcacctctcgccgggtgtgtcggtgaggcgctggagcagtgcggcgccgatgtagcgcatcctgccgatgttcgtgcgcgggtcgtagcccaaggcatcgatgagtgcctcatggcgcgcctggacgctcgagtggtgcatgccgagcgttgccgccgcggaccgcatgctgtcggcctccacgagtgcgcggagcacgtgcgcggaacggtcgtcgaggcgggccagggcctggacatcctcgtggggagcctgcgggtcgtgcgcgcgcagcagcatgagcagggcgccgaggtccgaggcgtccaccaccggatcgtccgggtccgtcagccggaaggcgatgcatgctccttcccaggactccggggcgtgatcggcacgcacccaggggccgattcccgtcgcgcccggtgtctcgaggcgtccggagacgtcgagggtggcgcgcaggagtccgtaccgggtcggcatgaccactgacggtgcgccgagctccggcccgtccgacgcggtcgcgaggacgcgcacgggcgtggacggttccaggcggaactgggcgagccgcttggcgcgttcggcgagcgggcgtgcctcgtcgatgacggcgtcgaagcccgtgggggtgcggtgggtctccaggagttcgacgccgaaggcgagacgttccacgatcatctcgtccagagccgaactgtctccgtcgcgttcgagccagacggcccagttgccgccggagcgccggggcgcgcgtggtgcgccggggttctcggccggtcgtttcccgtcggggtcgcggcgccgggtccgtccggagatctcggcgccggcgatacagcctgcgaggactgcggcgccgcgcagcagtccgtcgaccccggagccccgggcgaggagggtgtcgaagtacgcgacgacccggaggctgtctccggcctccgggtcgctcgcgctcagtcggccgagcagatggtgcatgtgcgttctctcgtcgcgttcgcggaagtctccggccgatccctggggctgaggccgctcactccagtatgcgtgccacccaggcgttccgtgcggtgacggccgcctgggcgaccgcggtgtgcggcgccgtcatgtcgaatccgtggaacccgccgggccagacgtgcagctccgcctgcccgccgtcccgccacagggccgtcgcgaaggcgacgtcctcgtccctgaagatctcggcggagccgacttcgatgaacgtgggcgggagcccggacaggtccgtggcccgcgcgggcgctgcgtagacggagacgtcctcggtcccgcggcggtcgccgagaagggcggtccagcccatgaggttgctgctgcggtcccatacgccgatgccgtcgaactgggccgaggacgcggtctggttccggtcgtcgagcatcggatacatgaggacctgaccggccagggccggtcccttccggtcgcgggcgagcagggcggtgccggctgcgagtccgccgcccgcgctggggccggcgatgatcagccggttcgggtcgatgccgagctcgtgcgcgtgctcggccgtccacaccagcccggcgtagcagtcctcgaccgggtaggggtccgggtactccggggcgagccggtactcgacggtgaccaggacggcgtcgtgctccagcacccacgggatgcactggccgagcgccgcgaaccggttgcccgtgaccatcccgccgccgtgcgtgttgtagatccccggcccggtccctcggtgatcgcgccgggcgatcaccgagaccgtgatgtcgtctcccccgaaccccgggatcgtgacgtcgcgcctggtcaggtcatcggctgcgagctgctcgtccgtcatcgtcccgagatcggcctcgcgcagccgcgggatcatctcggcggtcatgctggcggggaaccggtcgcccagcgcggcgagcacggcctccagctccgggtcgaacgggggacgcggagagcgcaccgacatggtgtctcctttctgcccggccgcgttcaagcggctgggaatcatgggaacggctcgggtcgtgacgggaactacgggtcgggcacccgggccggaacccgtccgcagggtcagcgggcagcttccggccgcagcggcctgtcctgtccaccggggcgacgccgccgaggatcatccgccccgacggatcggggccgtgccggtcgcccgtgtcccggaaggcctgttcgatctcgcggtacggctccgtgacggtcggcgtgaagtcgccgtgggtcggaatccctaaccgcccggcctccatcgcctcgaccacctgctcacccacacggtccgggttcgcgccggccgggtgctcgaggatggggtccggtccgagggctgcctcggcgcgatcggcggcgtcggcccagcagccctcagcgctgacgtcgagcgcaaccgccgccccacccggagcgccgagttccgcggcgaccgcggcgagcttgtctccgtcccggtcgacgagggcgacacgggcggcccgggcaccgcgggcgacaagcgctcgcgcgatgcccaggccccggcccgaggccgctccggtcacgaaggcggattccccactggccaggtcatggtggctccccactgcgagggcgagtgttgcgcgcaccagaccacgatcacctcctgcggccggccggcgacaccgccgactgcggcggaacccgcgcgatccacccgccgaacgcgcgctgccgagaacaggaccttggtgacggggctgtggggcgtgtggacggcacggtgtctggggtgcctggtgtgcgcgatcgcgccgccagccaccggccccgccctcggtgccgggcgtcgtaggttcaggccgatgcgcagaagacgcggctgcccagggtgccgagctgggagcgggccgccgattccatgccggagcgggcgagggcggacaggcacaggaggcggtacttctcccagcgggcggactgcgcggcgggcagttcctggtcctgtgtccagccgcgcggtgccgccgcgaggccggcggcgtcgccgaacgccttggaagtgccggacgcctcggaggtgccggacgccgtaagggggttccttttcttccgcgggacgcggaacacggggacgcgggatcgccgggctccggggccggtggcctgcgggccgggctgcccggctccggggcgggggcggtcaggaggcgatcgccggccggcgcttccaggtgcccgtcacggtctccacggcgtgcgcgagctgcagcaccccgaagtcgtcgccgtgccggccgatgatctgcagccccaccggcagaccgtcgggcgtgaaggagaaggggacggagaccgccggattgccggtgagcgagatacgcgagcagacccgcatccactcgcggtaatagctctggggcacaccggcgacctcccggggccagtgctggtcgacggggaagggcggcagctggaccacgggcgcgacaaggaactcgtgcacggccatgaacgcgtgcatgcggtcgtacgcctcggcgagcaggacctcggcccggccgaggtcctccaccgtcaggtcccggccgtgtccgatctcccagcggacgttctcgccgagcagctccggacgggtgcggtagtcctcggcgtgcatctgccagtagtaggcggcacgcatgatgccgaaggcttcgtcgaccccggtcatgtcggggtcggcctcctcgacggcagcctccagcacgtcggtgaggaggccgcgggcgggggccatggcctcggtgatccgccggtcgacgggcaggccgccgagcgtgtccgaccaggcgatccgggcgccggtgaagtcacggtccaggggagcggagaagtcggcctcgggcaggttcatcacggcgcggctgtcggggcggccgatcgcctgcatctgcagggcgacgtcaccgacggtgcgggccatcggcccgtactggacgagggtgaagacgggccgcggattcggccacaccggtacccgtccggcggtgggccgcagcccgacgacgttgttccaggcggccgggttgcgcagcgagccggccatgtcggagccgtcgcagacgggggccatgccgcacgccagcgcgaccgcggcgccgccggaggagccgccgcaggtcaacgagggatcgtaggcgttgcccgtcgcgccgaagacggcgttgtacgtctgggagccggtgccgtactcgggcacgttggtcttgccgacagtgaccgcaccggcgtcgatcagccgttggaccaccagcgtgttgatctgcggtacgtgccgcgcggtgatcggcgagccgtaggtggtgcggataccggcggtgtcggccaggtccttgtggagcgcgggcaggccgtgcagcgggccgagggagcggcctttggcgatcgcctcgtcggcccgccgggccagcgcgcgggcgtgctcgggcaccagggtcaccaccgcgttcaccttggggttgacctgctcgatctgttcgagatgggcgtcgagcacctctcgcgccgacacctgcctgtcgagcatgaggccgacgaggtcgcgggccgtgcggaagacgaggtcgtggcggtcctccatgtgtcgcatcccttcgtcgtaggggaatcgcgggccggtgggtgcttcgtgcaagaaaatcggcaaggccacctggccacccgcccgctttcaatacaccgggaaaaggcgcaagccctccaccaccagccgctggaagaaccctcgcgacggacgcgctgagcccgatcggccgtacccgtctgcctgcccgaacaactcgtcgaacgcctgcaggcatacgtacatcaagaaggtctcaccgttggtgaccggctgccatcggagcgcgagatcgccgcccggctcggcgtcagccgggtcacggtcaagcaggcactgctgatcctggaggtgcggggagccatcgccacccggcagggcggcggcttcctgctgcgcgcgggagccgagatgcccgagagcgtggcgcagctcgccgagcggcgcggtcggctccccgagcactggaggcccggcacgccctggaggtctagttcgcccaactcgccgccgtacgcaggacggacgaggatctcgccgccatggaacaggcgcggacggacagggaaggggagatcgaggcgggcggccacgcggaggagccgacccgcgctttccacgaggcggtggaccgcgcgacccacaacaagatcctgcaagccctcatggaccggttcgcctccacccgggtggcgaacaccccgcaggccgggcaggcctggccatctcgtcggccgtgaccaggtagcccctgtgccctccgtcagccagccgctcaacccgcgcgacggacaccccgtccagatcgagcagcaacgtcgtatcgtcgaccaagccggtggctcctgcttgattgttccgcgtcgagaacagaaatgatcaagcaggatcacgggcgctctgcatccgggccgtgcacgaatacgtcatgacaaccggccgggtgtggttcgctgctggggtgactcaggacttggagatcgtcgcattcgaatccgccgaggcattccagacatggctcggcgagaaccacgccgtctcgcccggcatctggctcaagcttcgcaaaaagggccccggcatcgtcgcgctgaactacgcccaggcgctcgacgtggcactctgctacggctggatcgacggccagaaggccaagttcgacgaccagtggtggctccagcggttcaccccgcgcaagccgcgcagcaagtggtccaaggtcaaccgtgacaaggcggccgccctgatcgagcagggccggatgcggcccccggggcaggccgaagtcgaccgcgccaaggcagacggccgctgggaggcagcctacgacggcgcgaagaccgccacggtgccggacgacctcacggcggccctgaccgccgacccggccgcggcggagttcttcgagacactggaccggcagaaccgctacgcgatcctgtacagggtccaagacgccaagaagcccgagacccgggcgcgccggatagagaagtacgtagcgatgctggcgaagggcgagaaactgtacccgtagtcacgacacaggggccgccgtgcagtgccccaggggctcggcgcgcctgcggccccggcagcagccaccaggcgcgccctcactgagcgtaacgagacgtcagggaacctgagcaggcacaccgctcaagatcgaagacccgagaaaccttgcccgctatcacaatcagcggtgatcatgaccgctatgaacagccggccccaagggagaacacccagtagcagtgatcctccaccggaatgggctgagagggtgtgcctgcagaccgttgacgcggacggcggcatgcaagaggtcatcgtccagatcagcaccccctccgcagggctgatcgagcttcttgacgatcactcccggacactcatcagaggggcggactacctcgactgcctcatccggctccggaggcgactggaacatgagggccgtctgctctgctgccagggggctcgtcccaacgtccacccttccgggcagttgcggcagttcactgacgggcggcaggcttatgtgctcccctcggacgcccagaacaaagctcctgcaacagtcgacatcttcgcccctgcgctccccggcgacgtcgtgagtctcgaggaccagcgcatgtcagtcgtcagccactggaacgcccggcacccaagaaatcgaatctgaccgtgcaatgggccccggtcgctcaccgtgtgtccgtcacgaaagtcgtgccaccacacgggaattgacggcactgtcgtcagtgagaacgttcgcgccgatcactggagcgaccagctcctctgggagatcaggcccggtagcctcgggccatgcctgagacatcggtggcgcacttttacgacgaactggccgacgactaccacctgatctattcagactgggacgcgagcatccgtcggcagggggacgcgctggacaccctgatcggccaggatcgcgcggcggtgctcgactgttcctgcggcatcggcacgcaggccatcggcttggcgcagcgcgggcaccgcgtcaccgggaccgatctcagccctcgcgccgccgcccgcgctgcccgtgaggccgcccgccggagcctgagcgtgcgcacggcagtcgccgacatgcgacgcctcccgttttccgatggccgattcggtgtcgtcgtctgcgctgacaacgcgctgccccacctgctgacagggcaggatgtgcacgctgccctggccgagatgcgccgcgtgctgcgtccctccggcctgctgctcgtcagcacacgcccctacgatgacttgctgcgcgaccaccccgtttcgacgcctccacaagtccaccaggccgccgacggcggagaacggacagtcaccttccagctctggcactggcacgacgacggtgagcactacgacttggagcacttccaactccttccggccggcggagagtggcgcgtccaggcccgccggaccacttactgggccctcagccaggaccggttggccggcctcgcagccgaggccggcttcaccgacgtccggtggcggttgccgcgggagacaggcttcttccagccgctgcttgtggcccgcgccggcgagtaggtgattccaccgtccggctcgaccgccgcccaggaggacggcggtcgagccgggaccggcaggtggcaggagcgggtggatgagcacggcgcccttgcactgccgctcgctactgctctgaccagaaacggtcaccggagtgaggtgccggccgagtgtctacggcagtagatgtcgggcaggtcaactgaaggtcctgcgcggcctgcgccgcaccacgctgcccatcagcgtggcagccggcgtactcgtcgccaccctcacgggcctgctcaccacccaccgccaggacctgccccgatcggcttcgcggccaggacctgcccctgatcgcttcgcggtgatgacccccgccgttccggtcgcggatgccacaccggccggaacggggagacgagaaccgggggacgaagacgacgtgccggtccgcggagcgtgtcatgtaggttcgggtcggcgccgcgcgctgatccgcgcacggtgctctccggccgctgcggtgccggtgtccggatgtgagggaggtgcggcggtggccgagcagaagcagaacggtggcgcgaccgtcggggccgccgccgagcggaccgtccgcgtacgcaacccgcgcgggcagggcgaacggctgcgtgaggagatcctgcgggccgccggggggctgctggagcaggtgggcagcgaggacgccctgtcgctgcgcgcggtggcccgggaggtgggcatcgccaccccgagcatctaccgccacttctccgacaagacggaactggtgtgggcggtactggcggagcactacgagcggctggccgagataatggccgaggccgacagctcggcgcccgccgacgacccactggcacggctgcggtcccagttgaccgcgtactgccgattcgcggtcgcgaaaccggcgaagtaccgcctgatgtgcgagacctggcagaccccggtggacgaggagcgcctgcacggccatcccgcggggctgctcctgcgcggtctgagtcgggcgctcaccgcgtgcgaggaggccggctggagggtgcggggcacccgcgcggacgccccgtacatgttgtggtgcgcgctgcacggccggatcaccctgtggcaggtgatgccgcgacgcaaggaccccgcacggctcgaccggttcgtcgacgagctgctgagcctgctgctggagcgctgaccagcgccaccccgcacgtccctgaccgacacatccctgagcagccgcccgcccttgatcggcaccatcccatccctgagcagccgcgtcccctgagcagcgcatcccggaccggcacggtccctgaccggcccggtccctgaccagcgcgtcccccgaacggcacgcccctg

SEQ ID NO: 167 - DNA, 7034 bp, Unknown
  Kingdom: Bacteria, Phylum: Actinobacteria, Class: Actinobacteria, Order: Streptomycetales, Family: Streptomycetaceae, Genus: Streptomyces
gccgccttgtgcccgtcggcgggcgaggcggcgaacgggccggacgtcaacgcccagcccgcacaggcgagtacgacgaccggactcagccgcgcggcgagtgcgagcggcaggggaagatcacgcacggcacacttctcgtgtgggggacggacgatgcggggtccgtccgcagtgtggacgggacgccagtgtcacatgcccgcctgtgcggcggaagtgcgaactcgctccgtgcccggacggtcaccgaggcgccgccgcccggtcgggcgcggaggcgcttggcgtgcggtcagggaaggtgcgcggaggcgcctggcgtgccgtcaggggacgcgcgcggtccactccggtgcgccgaacttggtgcgcgccaggtcctgggcgcgggccagctcggcatcggtgaccttgccgtccgccaggccgtaccgtccgtcgaaggactcgatcatccgctcgatgacggtctcgcgggccagcccggtctgccggcgcagcgggtccacccgcttcttcgcgctcttcgtgcccttgtcggacagcttctcccggccgatgcgcagcacgtcgagcatcttgtcggcgtcgatgtcgtaggacatggtcacgtggtgcaggacggcgcccggcccgccgcccggaccgacgatccgcttctgcgcggcgcccgcgatcttgccctggtcggtggcgatgtcgttcagcggctggtaccaggccctgatgcccatgtcgccgagggcgcccagcacccagtcgtccaggtaggcgtagctgtcctggaaggacaggccctgcacgagcgcctcgggcaccgacagggagtacgtgatcgtgttgcccggctcgacgaacatcgcgccgccgccggagatacggcgcaccacctcgacgccgtgccgcgcggcgccgtcggcgtccacctcgttgcgcagggactggaaactgccgatgatcaccgcgggggaggcccactcccagacccgcagtgtcggcgggcggcggcccgcggcgacctcggcggtcagtacctcgtccagcgccatgtgcagggcggggggctgcgggccttcgtggatcagctgccagtcgtagtcggtccagtcggtggcgtgcgccagcgcgcggcgcaccgcgatcccgacgccctcagaggtcagcccgtacatgacggtgccctcggggagcgccgcgtcgatcctggcggccaggcccgccgcgtcggtgtcggccggggcgccctccagcgcgccgttcaccgcgtccagcgcctcgtcgggctccaggaagaagtcacccgccacccgcacccgccgcagtacgccgtcctcggactccacgtccacgacgacgagcttgccgccgggcaccttgtactcaccgtgcactttcccgggcctccctttctgccgcaggaaccaacgcccgggacggccgccgtgttccccgcgacctgtgatgcgcctgtgacccggaagtatggcttccgtcacagtgccgccaattggcccctgatggggtggcgcgcatgcgcagagccacccccctcgtcctgctcctcaccgcctgcctcgggctctcggtggccggtgaccagtccggcacctgggcctcggccgccggatccacgacggccggcgcctccggttcccagccgctggacgcctacgagatgaccgccgcaaagacgcacacggtcgccgtcgcccgctggaccctcgccaaggagtgcatgcgcggcctgggcttcgacagcctgcgcgacctggaccccgggcacccgccggcttggccgcagcgcccggccgacggcaagacgatcgtcggcttgatggtcatcgccgacagcgaccacaggtacggcgtcgacgaccccgaggaggccgcggcctacggctaccgggccccggccgccgagtaccggcgcgccgcaccggacaggaagtggacgctgcccgagtacctggcgctcacgggcgccggattcggcgacgacccccggagcgtccacggtcacccgatccccgaacggggttgcctgggccaggccgacctgcgcatctacggccgggaccggtacacggcaccggacccggtcctgaccctgctctccgagagccggcaacgggctcagcgggacccggcctggaagcacgccgaccggatgtggtcggcctgcatgagccgggcgggctaccactacgccacgccgcgggaggcgcagcagggcgacgacgaccgccggcaggaggagctgaagctgcgcctgctcggtgacggccgcgccccggacgggccctcggacctggagaagcggacggcggtcgccgacgcccgctgcaagcggcgcacggactacgtccccgccgtgcacgccgccgacgtccgcgcgcagcggcgcgtcatcgccgggcaccggcaagaactggaccggatccgcgagggcgatcgcgccgccgtgcgcaacgccggcgccatcgtgcggaacgggtcatgaggcaggcggccacggccgggcgcggggcgtggacccggggcttgtgcgggcaggtcgtgtggcggggcgcagatccggccaggtcagaccgggccggctcaggtcgccaggccgtgccggaaggcgtagacgacggcctggacgcggtcgcggagctggagtttggtgaggatgcgggagacgaaggtcttgaccgtctcctggctgatgacgagtgccgcggcgatctcgctgttggacaggccgtccgcgatgaggcgcagcacctccagttcgcggggggtgagcgggatgtcgcggttggtgctctcgacggggcggatgcgggcggcgtagcgccccacgagccggcgtgtcacatcggggtccaggagagccgcgccggtggccacggtccggatgccgtgcagcagccggtccggcggggcgtccttgaggaggaagccgctggcgccggcgcgcagggcctcgtagacgtactcgtccaggttgaacgtggtcaccacgagcaccttcaccgggtggggcaccccggcgccggccagcaggcgggtggcttcgaggccgtcgaggaccggcatgcggatgtccatcacgacgacgtccggccttgcctggcgggcgagttcgacgccggcccgcccgtccccgcattcgcccgccacctccatgtcgggctgggcgccgatgatggtgaccaggccggtacggaccagcatctggtcgtcgcagaccaggacccggatcggtgcgctcacgaggtcctgccggcggggatgcgcgcccgcacggtgaagccgccgcccgcaccgccgccggcgctgaagtcgccgcccaggacccggacgcgttcgcgcagaccggccaggccccgtccgctgccgatcgcggcggcggtgcgtgaaccggtcccgtccgtgctgacctccacggtgatctccctctccccgtgccgtacctggacgcaagtccggctgccgtgagcgtacttgagggcgttggtcagcgcttcctgcaccacccggtaggcgacgaggtcggcgcttccggtcgacgccgggggtgtgccctcttcggtgaagtccacgggctgcccggccctgcgggtctgctcgacgagcgtgaggaccctgccgacggccggtgtcctgggctccttcgctcccgtcgtgccggtgccggtgcccgtgccgtgctcggtgtcctggccggggttgagcaggtcgagcaggtggcgcaggtcggtgagggcacggcggccggtgtcgctgacggccgtcagggactgctcaagccgctcgggcgcggccgtcaggtagcgggcggcctcggcctgcacgaccatcgcggtgacgtggtgggtgaccacgtcgtgcaactcccgggcgatccgggcgcgttcggcgatgcgggtctgctccgcgacgcgctcgcggcgttcggcctcggcgagccgggtggaccgcagccacgccccggcaccccaggcaagcgccagcaccaggtagaacgtcacgaactcgtcgggcgtctcgcgacccgaaccgagccgggagagcgcgaccgccagcggcacgtacgccacggagaggaggaccgtggtggtgcgcctgcggtgttcgagatggcatcccgtgctgatcagcacgaggggcagggtggcgccggcgctggagtggtagccgcgcagctggtcgagggcgaagccggccgccaccagggcgagacagacggccggcgaccgccggcgcaccacgagcggcaggcattcgaacgcgagggccacgccggcgagcgcgtcgaagggccgggtcggcaggtccccgacctccgtgccgtggccgcgcacccccggcaggaacgacgtcagcaggaacaggagcccgagcgggaggtcgcggaccgtgacgtcgagtcggcgccacacctggcgggccccctgaaggctcatcaccgggcgagtgtagccagggcgtcgacgcgctcggtccgccggcggggcacgatggtgccgcgccggtgggccagccacaggaaggcgatcgtcaccagcgcaccgaacaccaccgagtacacactggcctccggaccgaactcgccgcccgtgatcagcttgctgcccgacgtcgaggcgtccagcagtccgtgggtggcgccgttgccggagacctcggtgccgaagatgccggactcggcgaagttccagccgaagtgcaggccgatcggcagccacagcgagcgggtggcgatgtaggcggcggtgagcgtcccaccggcctcgatcgcgatggcgacggcacccagtacggtggcgtccttgttgagcaggtggctcgcgccgaacaccacaccggacagcacgagcgcgatgtacgtgcccgttccccgctccacgagccggaagagcaggccgcggaacatcagttcctccgtgacggcggcaccggccatgaagccgaccagtgcgatcgcgccggtcagcgagccggagccgtggaccttgtagtccccgaggaagtagaggttcgcgatgacgcacccgaaccatgcgacgccgatgaccaggccccgcagcagcgccccccgcgccccctgccaggccagctccgtgacgggccgctgttcggtgcgtccgacgacccaccggtagacgagcaccgacagtacggccgccagggcgcccaggagcagtgagagccacgcgttgtcctgtacgccgttgacgatctgaccgcccaccgcactgaccgcgaccacggccaggatctgccacaccagtttcatgacgactctctctcgggtcccgtttccggtccctcgtccggtccgcggtaagggctccgcggctgaaccgaacgctagggaaacggtgatcgagaagcgtcacctcacagtggacacctgcacgtagctctcacgggggacaggccggcgcctccgcgtccggggaacacctccggccgcccgctccggccatcggcccatgccaacgccgggatcatgtctcggaccacggcccactccgcgtccctcatgccggtgggacagcggggtccgccgctcggatgcgactgcggcaacggggcctccccggcagcctggtggactcgacgccctccgtgctaccgagaggcactgtcttcgtgcccccacgcggcaacagatcgcgttgacggtccgttcgcgccgcaagcgcacggccgctctcgcgcgcagtggcaggcattccagcagtaccgaagctccggccaggggcgacttctgcagatcacgcgggtccaccagcacggacgccgtggctcaaaagcctcgtgacccggtgcgacaccggtcgggaccaggacgtctggttctggaaccggcacgttccccaggcgccgtacctgctcgtcagtgcctccagcggctacgggccgcgcagtcaccgtctggggtcgtctctgccggccggcggcgacgccggcatgtgcggcgaagatcgcctcggcggcaccggtctggccggacggccacgggccgcgagaccaccgtcgtaaccgagacgtcggtggcctcctgtcaccccagggcctggacagccctgtcggcaccgctggaggccccgcgcccgtgtgctcagccggagccggaactgcccgccgattgggtggcggcgcggcggtactcggcgttgatgcgctgcgcttcctcgagctggtcctcgaggatgacgatgcggcacgcggcgtcgatcggggtccccttgtcgaccagctcacgggcgcgagcggcgatccgcagttggtagcgggagtaccggcgatgtcctccctccgagcggagcggagtgatcagccgagcctcaccgatggcccggagaaaggccggggtggtgccgagcatctcggctgcgcggcccatcgtgtacgcagggtagtcgtcgtcgtccagacgatcattcagggggttgtccgatgtcatgtcacctcgctgtgcaacgcgtcgaggggccctggtgccgtacggcaccagggccccgaagggaattcaacaccatctgtcggccctactgctgtgccgaccttctgtttccgctacccggcccggcagggcggagcgggggatcgcagctgcgtgaccggggaccaccatccaatccggggtcttgcggcacccgggccgagcacttcgcggaccgggcgatcctgatggcgtctgctcctcccttcctctccggaccagccactggatgagctggcactgttgccggcggctccttgacgtgcgaaccgcactgacctgcgtacttctgttcagtcatccgccagttcgtgtctggcggatctccttggaccgtgtctacgagaagaagcgtacccacatcggaagcgaaaagctactccggcaaaagtagatttccctcttctggtggagccggaagcctgatgcggacgtcttcgcccggcccgcgaggcggcgggccgggcggcgggccgagtcgctggccgggcggagacacagcggtgggggccctgccgacgcgcgtcggcag

SEQ ID NO: 168 - DNA, 12347 bp, Unknown
  Kingdom: Bacteria, Phylum: Actinobacteria, Class: Actinobacteria, Order: Streptomycetales, Family: Streptomycetaceae, Genus: Streptomyces
ggctcgccgagacggccgagcgccgtccccgggaccgcggcgatcgcgagcacgggcggcttgcgccacaggaccttcgggaccgggaccggcgccagggccatcgcctcgacctcgacgtcgatgcgcgcctgatcggcgtccaccttcaggaacacctcgccgacgcgcagggtcgcgcgctcggaatgggcaacgacgacttcgacctcatccatgggcgaccagtatcccggggatgatcgccgacgtcgccggatttatcgcctgtgacggcgcggccgaccgcgtccggtcgcccggtggcctcgtgcgtccccacggcctccgacggggcaggacaccctcccggaccccctcccgctcccggatgcgatcgagggcacacccgttccccacgaaactttcggacccggcgtgatgagcctttgagggcgacgcggtcatgccggtgcggcggacgtccgtcacgcggacgcctggccagtgaggcggccagtgagacggccctcccactgcggtgcgggtcagcgctgcgaaccggattccgtcgcggacaacctctgcggtgccatgccctccccgacgcccagctcctgggttcctacgacagacagcagatccagctgctcggctcccgggcttccgggcggcgcggtgaaccacagcaggcgttggcgtccgtcctcgctgaggaggttgtagcagtcgagttcgatgacgccgagcatgggatggacgatcctcttgtggtccatgcggcgcaccgcgacgtcgtgggtgtcccagagagccgcgaactcctggctgcggcggcgtagcacggcgaccatcttcgtgacctccgcgtcccggccgcgccgggcggccgctgcctggaggtcggacacgaacacccgggagtggtgcgggtggtcctcggacgggtagatcccgcgcgcccgcggatcggtgaaccagcggtacacgaagctcgccgccggaccccggtgtgccggggacttgccgagcagggtccgggccaggtcgttctccaccagggtttcgtgcaggtcggtgatgacgcgcgccggggtgttggacagccggtccaggagtccgaggagcgcgggctgcacgtgtgccgagggtccgtgtgctgacggggggaccggccgttcggccaggtggaacaggtggtcgcgctcgtcgccgttcagccgcagggctcgggcgagggcggccagggtctgggtcgagggctgcacgccgttctttgcgctgccgcgttccagctcggtgtagtagtcggctgacagccctgccagctgggcgacttcctcccggcgcagcccggggacgcgtcggcgcgggccgtgagggagaccgacctcggcggggcggatgcggtcgcggcgtgtcctgaggaaggcgccgagttctggaaggttcacccctccatggtcgctcggcggccagagcgtagccagggggtggcacccccggggtagacgcagccctggctggggatgggggaccggccgatcgtggaggacgcagcagggcgacggcgaggccgcggcccgacccgcacccaccacaggagcacgtcatgcccatcccctcttcttcacccgtcggaaccactgccccggcccagccctccgcctcatcccgtgtcgcgatcgtcaccggcggctcgcgcggcatcggccgccagaccgccggccggctggcggcggacgggtacgccgtcgtggtcggctgtgccggcaaccaggacgaggccgaagccgccgtgaacgaggtcgtcaccggcggtggccgggcgatcgcggtgcgcgcggacgtcgccgacgaacgcgcagtggcggccttgttcgacgcggccgaggcagagttcggcggcgtcgacgtcgtcgtgcacgcggccgggcggatgcacctggcgccgatcgccgagctggacctggccgtcctggacgacctgcaccgcaccaacatccgcggcaccttcgtcgtagtccagcaggccgcccgtcgtgtgcgccccggcggcgcgatcgtgacgttctccacgtccgtggtggggctggccttcccgggctacggcgcgtacgccgccggcaagggcgcggtcgaggcgctgacgctgatcctggcccgggagctgcggggccgggacgtcaccgccaacagcgtcgcgcccggccccacggccaccgacctgttcctggacggcaaggacaaggagaccattgcccgcctggccgcccagcccccgctggagcgcctcggtaccccggccgatatcgccgaggtcgtcgcgttcctggcctccccggccggccactggatcaacggacaggtcgtccgcgccaacggcggaatcatctgaaccgcccgcagccaccccccgtcgatcaacgaaaggccctgtcatgaggaactgcgaaacaggcaaggccatcctcgtcaccggggcctccagcggcatcgggatgctgtccgtgcgtgtgtcggccctcgcaggtcacaccgtgacgcgggcatccgccggagtggccgtcagctacgccgccgagtactcccgttcggcatcgacaccgtgatcgtggtgcccggtgcgttcaccaccgccacccaccacttcgccaacgcgggcgctcccgccgacgccgaccgtgcggaagtccacgaccggcgtcaccgaggcctgatgggcgatctgggcaagcgcccggccgcgctcgtccctccggacgccgatgtggccgaggaagccgaaaccgtcgcgcgcctggtcgcgatggcgcatggcactcggcctctgcgcgcccacagagaccccagccgcgacggcagcgaagtcgtctccgcggtcgccgaccgcctccgcgcagacttcctccgccgcatcggactggacagcctgctcaccgcaggcagctccctgtaacgcccccctgagagaaggaacaaccagccatgcctttcgcgaacttcaaggtccccgagaagaccctcaccccgcagcagaaggaggagatcgtcacccgcaccaccgagctgtacgtcgagatctacggcgagcgcgcccgtggcaacaccatggttctggtcgaagaggtcgccgacggcggctggggcatctccggcaacgtgctgaccctcgccatgctcggcgaggcggcaccgaccgacaccagcgacgcctgaccgcacccgccggccctcatccggttcaggacagcaccttcgaacgagggccgccgatcacacccggcggccctcgtccgggccccgcagtgctgcgcgacccgcttgtgcggctggtgcctgagccaggacaccaggggtgtctcgatgcgctcccgggcggccgggtaaccggcgctcgcgaagtgggcggccatcggtacgtcggcctggcccgtcccggccccaggccgtcagctcgatggtccccgttcctcccgtagccgtcaggtcgctgccttcgcactgtcctgtgaggcgtcttccttgggatgcggcttcacggcgtcccgcccacgcgtacggtccatctcgcgccattccggccgcaggccggccagattcgtggtgaggaagtacgcggtgccgcaggcgaggagcaccggcacgaatccgacagcggtcaccgccgcacctgcgatcagcccgccaagagggataccggcccaggccagcgagtcgccgagggcgttgacccggcccagcatccggcgcggcacccgctcgacgaggacggcacccagcactggattgacgaagccggcaccgaacccgctgagcgcgaagacggccagtaccgcccccaacggagcatcggcggcgaggatcaggaacctcggggcccccgccagcaggaacccggtgagaaccaccacccggcgccgcagccggtgcccgaccacggcggcgatcaggctcccgccgaccgccgcggcccccatcacgctgcccatcaggccgatcatggtcggcccattgccggactccctggcccagacgggtacgagcaccgagctgatcgccgcgtccaggaggttggtgatgccgcacatgacgatgacggtgagcagcagcggctcgccgcgcaggaaggtgaagccctcgccgaaccgccgccagtaacccggtcctgtgtccccggccggcgagggggcttcctcgaccgcgtgtcccatgccgcgaggcagcgcgagtttgatgatcaccgatccgagggcgaagcagcccgcgttgacggcgagtccgctcagaggaccgagcagcgccaccacggatccgccgaccgccaggccgacggtggaggcgagccgctcgatcacgccggacagaccggtggcccgctccagcggcacccggccgcgctcggccgcctccgggaccatcacctccttggccaggtcgccgggcccccgggccgcgccgatcagcgcgaccagaaccagcagaaggggaaaggagagcaagtccagggcatggagcaggggaaccgcggcggcggcggtcgcgctggccagatcggtggtccaggaaacggcccgcgggccgatccggtccaccagcggcccggtgaacgccttgaccgccacgtacggcgccatctcgcagaaggcgaccagtccggtctgggtggcgctgccggtcgtgacgaggacgaaccagggcagcgccaccacggagatccgcgtgccggtcagcgacacgaccatggccgccagcaccccgcccagcggccgtaaggacctctcgccgggtatgccgacggcctccgaggcgtcgtcggtcatgacgtcgggctcccttccgcttcctgaggaccggaagggagcgacgaggcggcaggcgcatccagttcgggcaggatctgcgtgatcacggcgacccgttcggctccgtcgggggcactcgccgccgtctccggcgcgtctcgccggtagcgcgcgatgacttccgtcaactcccggtagagagcggcggcttcctcgggggtgagtcgcaaggcccagtcgctcatgtcgaacgtcttccgccatgcgcggggcatcgtctgaagcccgttcagggtctgctgcgtgcgcagggtgtagatggcggcgacggactgctggtaggccagtgcggcctcgggctcccgctcggccagctccgggtcgttgaaccaggtggtccggtgcaccgaacgccaccagcgctcgcgtgcgttgccgcgttcggtgtcctcctcgacgaaaccggccgcgccgagctgccggaggtggtagctggccgtaccggaattcacgcccagccgctcagcgaggcgggtggccgtcgacgggccgtacttccgcagcagcccgaccaactgcacacgcaccggatgcgccagggcacgcagccccttggcatccaggacaaccgagtcctctgcgacgtccgggccatccggcctctccactgcatcagccatacgccacacggtagaccacaaagagttcttcgcaaagagttgtccgcgaagaaatctttgcggttcggctcgctcgcgaggcggcgctgctcatcgaccgattggtgagcgagatcggtaagtggcgacggcggtccgtcagccccagccccgctgggagcttgctcagccatgccggggatcagggcatgcaccgcctccggcagcgcgtactcctcccggccctgaacccgggtcatctcgtcgcgttggctcgtagaagcaggcggatgccaggagtgaggcagacccagttcgtcacggacccgcgtcgccaacgagcacgggccccgtgacattgacgggggtcgatcggcgcgggttagggtgacgcgctcaaggtccgatgcaagggtcggcctggccggcgagtagccacgtctgcctcgctgctggctggtgccgcgatggcgctcaggacgggcctgcctcactctcctctggctcccgaatcccggcatgatcaattgccggacacggcctgggcctgtccggcgacggatgccttcacgtctcggcgcggcggaacttacggtttgtgggttacccagagcagttccgccggccagcggtgtgcccagtcgggtgggtcggtttcgttgtagccgttgggtgttccgggttcgggccgcggctcgatgaggtcgtcgatgatgagacccgcgccgcgcaggaccctgacccagtcgccgtaggtgagctgataactggtcgcgccgtcgccttcggcgatggtgttcaggccgaagtagtcctgctgcagcgtcgtggtcacgcggctggcggcttcgtcgtagcacgcttcgaaccatgggctggcgacgttgaacaccaggcgcccgcctcggcccaagacgcgtgcggcctgcgggacggccaggtgcgggggcgcccagctgagcccgccgaagtcgcagaacaccaggtcgaagctgtcggcggcgaaggggagttgctcggcggcgccttgcaccagcgagtagcgggccgctcccatcgcgcgggcagctgcgccgagttgggcttcggacaggtcgagcccgaccacggtggcgccctcggcggcgagcgccctggaccactggccggcgccgcagccgagttcgaggacgcgcttgccggtgacgtcgcccagggcgtgcaggtgcgcgtcggggatggagtacataccccacagccggggtgtggcgccgatgcgcgggtcgtgctcgtgctggtaggcgctgctgatctggttccatagccgccggttggcggggatgctgtccacgtgccgactccagcactgcctgccggggccggtcaacacgattagggcactggcacggccctcaccgccttcaccaagctgacgctgccccccgtcgagcgacagcaaccggcgtgtcctccgccgtagctcgcccacctcaacgcctgggccgtagacccctgttcgggccggtaggggtggtggttccgccgctgccccagctggcgatcgagtccgtacggccccggcgcgcgagcaccgtggcgctggtgcccacggaccgcgggcgtgagactgccggtgcgggcgccgtccccgcgccaagcgggacacgtcaccgaccccgtgcacaaccgggcatccgctcccacaggtagctgctgccgggagtgctacccggcccgagcgcggcacccgtggccgaacgggtgccgttgtacgtgacgccgtacttgcgctgcgggccgagtggacgaggaggccatccaacggatcaccacctgccggctcgccacctagggcacgcacgcggaacgggtgcgcgccgtgctcaccgactcgactgcgcccccgacgatcactcgaacccactctccgcgaagtcctggcggcggccgtgagtaccgtgagtatgcgtgagtacgcgtactcaaatcccgcgtacgaagctgaccgcgccttcggtgtctgatacatctgtcgccgttgtcatgctccgttcgaccggcggaagcggggcccgcggaagcgggcagagggtgggaaccaacgatgacgtatcggcgtgtacttgggctggcgctcttcggatcgctgttgctggctggactgctctggtgggcgggctccagcgttcacgcactcagtctgcccggcgccacccggtttttcggccccgaccaggcgaaccgtctggtgacgtggacgatgccgtggtcgaccggcctcccgtcctcgaaccagtacaccgaccccgccggcgcggccggtcacggcgcggactacgcggcgttgcggcagaccgccatgcgggtgcggtacgccgcgctcgtcctgctctacccgtgcggcgcgctgccgctgttgcgccggctctcgggccgcggcgtccggcgcgcagtggtctgcgcagcggccctctggggatggggcatcgccgcggccatgctcgctgtcaccgtctccgcgccttggatgctcgcttcgggcggatcggcggccttccggctgctgccccacctcgcgagcctcacgtctcaggggcgcgaactcccggtgggcgccgccttgttggcagcggcggcgaccacaggtctcatgaccctgctggggcgtgaggggacgtcagaaccacgcccggccgtgccgagcgcggccactgcacggctcgccgcgaccctgggcaccgccgtggtcgccttcgccctcgtcgtgctctccaacgaccgggtcgccgggcgtctgcagaccgcgttcggcggctcggggcggctgtccgagcccggtgacctgctgcggcagtggacccagctcagcgtctggaccatgcccaccggctcggccttcgggcactggctgctgtaccggctcggcgacgtggcactgctcgccgtggtctggtgggggctgcggctgctgcccgtcctgctcgaccgcgtgacctaccccgcctgcgcgctcggcgccgtcgccgccaccgccctcggtgtcgaagtgagtgaaatctggacctcgctcctctcctaccagggcagcactgccggaccactgctctactacgtctccatgggctcaggtgtgtccgctgcgctggtcttcggcaccttggccggctgtgtgtgcgcggcgaccgtgcggctgcgcacccgcccgcaaccgcctgccccagccgtggcacaggcccaacccgtctgaccggtccccgcgcgccgcgggtacgagtcccggcgcactgcttggcagcagtggcccagtccccttcacgttcattcctcacggcttcgagaaactgctgccgcgggaacctcggcttgttggcggtcgagatgtcgtgagggcggcggatgccgtcgatgcgggtggtcgcggcagcgcggcggaaggctgctgccacgcaggtgaagcccttcacgggccccgctcgtggtgtggccgccagggcgggggagcgcgcgggtgccggcgtgatccggtggagcggtggtgaagaccctggggcgacgatgtcggtggggccgcttatgctgcaccggacgatcatgcgaaaccaggggagggtgtggcatgttccgcaagttgttcggcgggggcgagaagaagccggtggcggatccgtacgccctgcccgtccgacgcagaaacggtgtgtacacactggacgcgctcggcgacgtgcgggtgctcgcgttggtgcaggccgtcgagtcgaaggactgggaggcggtcaaggcgggcctggccctcttcgatctcggccgtgaccacaaggttctcgcagaactggccgaggtggacggggtgcaggactggatcgtgccggccgccgaggaggacgaggagcaccgggcgacggccctgctgatatccggggcgcgccacattctctggggctgggaggcgcgcaccagcgcacgtgccgtcgacgtctcgcgggaacagtggcaggtcttccaccagcggctccgtatcggcgaggaccagctcctcgaggccgccgagtcgcgcccggcgtgggtcacgccgtggcgccgtctcctcacgtccggacgaggcatgtcgctcggctccgacgtcaacgaggcccggcgcgacgcggccctgcgccgcgacccgctggacctggagacccacctcgagtgggtgtcgtaccttcagccccggtggagcggcgaaccgggccaggccctggagttcgcgcggggggcggtcgccgccgcgccggagggccatcgcctcggctgcgcggtcgccatggcccacatcgaggactgggtggagtcggacagcggggactgcctggacaccccggcgatccagaacgagctcaaggaggcggccgagcgcagcatcctccaccccgcctacgtgcggcgcctgggctggcaggaggacttcaacatcttcgccatggccctgtcgctggccggtgagagcgtcgtggcccggcgcgtcttccacgagctggacggggcgtacaccccatggccctggaagtacctggatcagccggaggagaggtacgcccactaccgcagacacgcctgagccgccaccgggcctgcctcgtggcacatcaccccgccggtgcacccatggcactcggcgtctccacggcagccaaaggcgcgcgtgactccacggcagcgcgcaccgcgcccgcgatttccggcagcccaccgcgccggtggctccgaaaacacctcgctccacccgtcgcccgccgaacaccccaccccggactccgagatgactctgcccgacacccccgcgaacccgaccggcgccgaccgcaccttccaggtggatctgcgcggcctcgtcgatctgctctcccaccacctctactccagcccccgcgtctacctgcgtgaactcctgcagaacgcggtggacgccctgaccgcccggcaccgcctcgaaccggacgcccccgccgacgccctcggtatccgcctgtacgccgacggctcggtcgtacgcgtcgaggacgacggcgtaggtctcaccgaggccgatgtgcacaccttcctcgccaccatcggccgcagcagcaagcgcgccgccggtggccccgaggaagagcccatccgaggctgggggaagatcgccgagcaacgcggcgacttcatcggccagttcggcatcggccttctctcctgcttcctcgtcgccgacgagatccacgtggtgagccgcaccgcccgcacccccgacgctcccgccgtcgagtggcggggacgcggcgacggcagttacagcgtccgcaccctgcccgcctccgcccggccccggcccggcaccaccgtcaccctgacgccgcgcgccgacgcggcagagtggaccacgccgacccaagtgcacgccctggcgaggcacttcggctccctgctgcgtcacccggtgaccttcgacgacggcagccggctgccggccgccctgatcgccccggacggggacgtggacggggcgggctcctccggcgccctgatgcccggcgtgggccgcctctcgctgcgcggcacggacctggtggcggaccatgtcgtctcccacctgccaccgaaggtgcgctccgcgttcgacgacgccgaactgcgccggctgctcaccgatgacccctcggcgttcaccgggccgcgcggcgcccgcttcgtggcgcggcaggcctccggcacgggctacgagatcaccgtgcaggccgtcccgtaccaccgctgggagcggttcgccgaccccgagggcgggacggtgaaactggactcgctgcaccgcggccagggcgcgaccaccgcggcccgcaccgtcggttcggtgcgccggatcgcgggcgcggcgcgcatgggccccccgctggagtggatggtgcggctggcggcctcgctcggccgctcgcgccgcaccgactacaactccggtacgcaggcgttcagccagtccgagtggcgtgccctggacggttcgcacctgcacctggacgacgtgcactaccgggtgcgggtggaccgtgtcaccgcccccaagggcacgccggggccccgcggcggcgagggcaggcccgccgcggactggcggcgtacaccggtgcacgaggacggtttcgccgtgcgcgacggactcacctggcggctcccggacacgatcaccgagccctacaccggtgcgcggctggccccgcgggaactcaccttcccgggcggtgtcatgccccgggtcagcgacaccgaggggctgcacctgcgggatgcgccggaggagctggcgctggccatgaccggtgcgcggccgggtagttcggcacaccggacgctggtgtcgttcctgcgtccgaccgggctgctggggctgttcccccgtctgaccggacaggtggtggggcccgagctgacccgcggtcacacgcagcgtccgctggggcacgtgatcgtggagcgttcggtggcgcaccgcggcacgctggtcaccgaggcgaccaaggtggagctgcgggacatcgtccagatcgtccagcagaacgaacgtacgcacagccgggacacacggttcagcgcggaggtgtccgcgggtcccaaccacacgttccacgacacgtcggttccgctgcgggtgcaagccgggccgatggcacagatcggcctcgccacggggcgcgcgcactacatcggcggttcggccgcacggaagttcaccggccggatcaagggcaccccggtgggtctgtaccgggtggagcggacgctgtacctgcgcaagcccggcgaaccggccggcgacgcacggcccttccgggtcaccacgctggactggctgccgaccaccgaggcccgccgcctggcgggctgggacgcccgcacgcccggacagagcgcgccgcac

SEQ ID NO: 169 - DNA, 18143 bp, Unknown
  Kingdom: Bacteria, Phylum: Actinobacteria, Class: Actinobacteria, Order: Streptomycetales, Family: Streptomycetaceae, Genus: Streptomyces
tcctggtggtcgcggccccggagcgggacgcgttgcgcgaggccgcgtacttcgtggagcggctggcggcggagaagatgccgctggcgggtctggtgctcaaccgcgtccacggcagcggggccggacacctgtcggccgagcgggcgctcgcggcggcggaaaatcttgaagagccccgcattgtggatcaggaggacgggaaagctggacttcgtaactctcccgaaacgtacggaagttcagactcccccggttctgccgcttccggtcccgcgcccgccccttccgccgaagccgtcgacgcctccgccgaggccgccgacaccgacgccgagcacaccgagtcagacgaggccgccgacgagcacgcggagcccactgggtccgccgagcaagtcgagtccgttgagtccgccgaccccgtcgcccaggtcaccgcggggctgctgaggctgcacgccgagcgcatgcagttgctctcgcgcgagcagcgcacgcgggaccgcttcgccgcccgccatcccgaggtggcggtcgcggaggtcgccgcactgcccggtgacgtgcacgacctcacggggctgcgggacatcggggaccggctcgcggacaaccgccgcgaactgcccgaacccgaaccgggcgcctgacaaggccggccgggacggcacctgaggacgtcatggaggtcgaggtctcggggcccgagacacaggggcccaggccaaggagaccgaggaggccaaggagaccaggcagacaaaggagcccgaggagaccgagaagaccgaggagaccgaggaagtcagtcgcccggcggccggcgatcggcgcccggagggcgggaaagaccgcgcctgcggaacaccctcaccccaccgccgcgtagctctcgtacacctggtcgtcgtcgagagagacgaggcccgtgtcgcgctcgtactccatgcgcgcggtctccagcagcctgcgccaggaggtgacggtcggccgtctgcgcagcagtgcgcggcgctcccgctccgtcatgccgccccagacgccgaactcgacgcggttgtcgagcgcgtcggcgaggcactcggtgcgtaccgggcaccccgtgcacaccgctttggccctgttctgcgctgctccctgaacgaacagttcatccggatcggtagtgcggcaggccgcctgcgcactccagtcggttacccagcccataccggcgccgtcctctcccgaatcgaggctcccccacggcggcagcggcatattcaccgccgccagttgaggacgttacggaaggtaggcacagcgcaacacccccagcgggcccaatcttgaatggtccgaacggactatgggccaacggcagatcacccgggggagtgaggtggcgacatgcgcgacattcccggcacaacggggcactccacttgtctccccttgcgccacaacggacgccccgtcacacacaagccgataccggacacataccggtatcgggcacataccggtatcgggcacaggccccacgcgcttccgcccccgccgcccaacgacgctgagcaccacccggtgcgagtccggaacgtttcgggatcgccggacgtatgaatggatggaaggtgggcggccgtaccgctgtgacagctgagagcagcttaggccaaggcatatacgcgtgtccggcgaatgagaacgtaggctgcccccatgccaaagaagcgctcgggcggtggccagtcgccaacgcagcaggccgccaagttcctcggtgtcagtgtgctcgccggagcggtgctggccggtatcgcgttgcccgcggccggcgcactgggcctggcggccaaggggtcggtccaggggttcgacgacatcccggccaacctcaagcggccgccgctcagtcagcgcacgacgatcctggacgccgagggcaaccagctcgcccaggtctactcccgtgaccgcacggtggtggagctgaaggacatctcgccgtacatgcagaaggcgatcgtcgcgatcgaggactcgcgcttctaccagcacggcgcgatcgacctgaagggcgtcctgcgcgcgctcaacaagaacgcgacgagcggcggggtcgcgcagggcgcctccacgctcacccagcagtacgtgaagaacgtcttcgtggaggaggcgggcgacgacccgacgaaggtcgcgcaggccacccagcagaccctcggccgcaagatcaaggaactgaagtacgcgatccaggtcgagcaggacctgggcaagaagcgcatcctcgagaactacctgaacatcaccttcttcggtgagcaggcctacggtgtcgaggccgcctcccagcgctacttctccaagcacgccaaggacctcaccctcccccaggcggcgctgctggccggcgtcgtccagtcgccgagccgctacgacccggtcaacgacgaggccgaagccaccaagcggcgcaacaccgtgctgcagcgcatggccgaagtcggggacatctcgcaggcggaggccgacaaggcgaagaaggcaccgctggacctgaaggtcacccgcccgcgcaacggctgcatcacggcggtcaaggactcggccttcttctgcaagtacgtcgagaaggtcttcctgaacgacccggtcttcggcaagacccgcgccgagcgcgccaagatctggaaccagggcggcctgaccatccgcaccaccctggacccgcaggcccaggcgtcggtgcaggcctcgctgaagcagcacatctaccagtcggactccgtcgcgtcggcggccgtgctggtccagccgggcaccggcaagatcgtcgcgatgggccagtccaagccgtacggctacgggaagaacgagaccgagatcaactactcggtcggcagcgacgcgggcggctcgaactacggcttcccgaccggttcgacgttcaagccgttcgtggcggcggcggcgatcgagggcggcaagccgcccacgcaggagtactcgtcgccgtacaagatgccgtacccgagcccggtccaggcgtgcgacggcaagcgctgggtgaacacgtaccacgacaacgtggagaacgagagcacctccgagcacggcccgtacgccatgaaggaggccatggcgaagtcggtcaacacctacttcgtgcagatgatctccgagatcggcctctgcccggtgaccaccatgaccgacaagctgcacgtggtgcagggcgacggcaagaagctgccgcaggccccctccatcgcgctcggcgcggtcggcatctcgccgctgacgatggccagcgcgtacgccacgttcgcctcgcgcggcacgtactgcaccccggtcgcgatcgagtcgatcagccagaaggtcggcggccaggagaagtcgctggccgtgccgaagacgacctgctcgcgggccatgtccgagaagaccgcggacaccgtcaacacgctgctgcagggcgtgatcgactccggtaccggccagcaggccggtctctcggaccgcgacaacgccggtaagaccggtacgacggacgagcgcaagaacgcctggttcgtcggctacacgccgaacatggcgggcgcggtgtgggtcggcagcgccacccagaaggtcaagatgaccgacatccgcatcggcggcatcatgcacggtctcgtctacggcgccgacgtgcccggcccgatctggcgcgacgcgatgaccggcgcgctgcagggcaagcccgccccgtccttcaacatcatcgacatcccggatgccgacaagggcaaggaccaggacaagggcaagaaccagaacaaggacaggggaaaaggccgggacaagggaaaaggccacggcaacgggggcgggggtaacggcgacaacggcggcggcctccccggcggcctgggcaacggcggcaccgggttccccggcttccccggcggtttcatccagggccagggcggcggcacgcacggcaacagcaacggcggggtacggggctgacacagccgacgcggtgacgtaggagccgtaggagaagagatgaggggcgcccggcggacagccgggcgcccctcatctacagctcatccggtgtggcccggctcatctgctgagccggtgtgggccggccgggtcagccggccagcagcttcttgaccacggcggcgacgcgtccgccctcggcctgccccgcgaccttcgggttcacgatcttcatgaccgcgcccatggcccgcggcccctccgcaccggccgccctggcctcctcgacggcctgggcgacgatcgtgttcagctcgtcgtcggacagctgcttgggcaggtacgcggcgagcacctcgccctccgccttctcccgctcggccgactccgcacgaccgccctgcgcgaaggcctcggccgcctcacggcgcttcttggcctccttggtgatcaccttgaggacctcgtcgtcggacagctcacgtttctccttgcccgcgacctcctccttggtgatcgcggcgagcgtcagccggagcgtcgaggagcgcagctcgtcgcgctccttgatggcggcgttgaggtcgtcgtgcagcttcgacttgagcgtggtcatggagttgattgtcgcaggtacgccgacaccggcgcgcgccgatttcacggtgtacgccggggcgatacagcggcgtacgaccggccgacgcggcggcgtacgaccggccgacacggcggcgtccgaccggccgacacggcggcgtccgacggcatgcacgggaatccgttcccacggctgatttccgcggtacggcaggcttttgagacgatggacacatgcgcgcgcgatacggagtacccctgggcatcacggcggtcgcgaccgccggtctcctctactcggccggattcgaagtccgctccttccgcctgcggcgggtgacggtcccggccctgccctccggcatgcgccccctgcgcgtcctgcaggtctccgacatccacatggtcggcggccagcgcaagaagcagcgctggctgcgctcgctggccgggctccgcccggacttcgtgatcaacaccggtgacaacctctccgacccggagggcgtaccggaggtcctggacgcgctcggcccgctgatggagttcccgggcgcctatgtcttcggctccaacgactactacggccccaagctgcgcaatccggcccgctacctgctggagaagacgagcggccgacacggcctgaacggcaacaaacccgcggtcggcgcgatccacaacccctgggaagacctgcgcgacggcttcgacgcggcgggctggctcaacctcacgaacacccgcggcaccctgaaggtcgagggcgtctcggtggagctgacgggactggacgacccgcacatcaagcgggaccgctacgcccgcgtggccggcggcccgtccggcacggcggacttctccatgggcgtggtgcacgcgccctacctgcgcgttctggacgccttcgcggccgacgcctaccccctgatcctggccggccacacccacggcggccagctctgcgttcccttctacggcgccctggtcaccaactgcgacctggacaccgaccgggtcaagggcctgtccacccacacgtccgagggccacacgtcctacctgcacgtctcggccggctgcggcacgaaccgctacaccccggtccgcttcgcctgcccaccggaggcgacgctgctgacactggtgagccaggactgaccactgggcctgggctgacgactgagcccggactgacgactgagccgggactgaccactgagccggactgacgagggggaagtaacccgcacagtccactcaaatcgcccatgacgctctcgcttcctacggtgagggcatgaccgcgccgatacccccgataccgtcgcccccgccggcagcctcggcacctgcgacaccctcggccccttccccgccctcgacaccctcgacgccgtcgatcccccgggacataccggatctccccgcgatcccgggcatcacggcactggcgccctccgtcgtccccgcgaccgccgtggtgaccccggtgcgccgcccgtggacggcggcgtaccgcctcctggtcgccgcggcggctgtgaccgcggtgacagcggacatggtcatcgggccgccgctccgcgtcctgagccacttcgcgatccagagcaccctcgtactcgcggcggccctcatcctctcggcccgcagggcctggaccgcccgccgccccgcacccgcctccctgaccggcgcggccgtgctctacgtcaccatggcagccctggtctaccacctgctgctgaccgacaccgccccgccgttctcgatcacggactcccccggcacccacccgctctggcaatcggtcgccggccggctcctgcacacggcgatcccggccgccgccctcctggactggctcctgctgaccgccccggcccgcctccacctgcgccaggccgcgcactggctgctctaccccctggcctacctggccttctacctgatccgcggcgaactgctccccgcgggcacggagggccgctacctgtacaccttcctggacgtcggccggcacggctacaaacacgtcctggccaacgccctcctcgtgggcctctccttctacgccctcgccctcctcctggtggccctcgaccacgcccgcccgaacccggtccgccgccgcacgaaaaccggatttcgcctcaggcccccagtgggctaaagtaaacgtcgtcgccgcgacaagcagtgacaatcggggtgtagcgcagcttggcagcgcgcttcgttcgggacgaagaggtcgtgggttcaaatcccgccaccccgacagagaaacaccaggtcaggcccggtgctgagagatcagcaccgggcctgatttgctttgtggccgcgctttgggagccgtttgggagccaacttccagaaaccggctctcggcggctcccagcgagcggccgtccgccgtccagcccgctctttgccgctcacgctgggaaagggtcacccctacggttgtgcgaggccgatcacaggcggtacgacgatcgccatgcaccgatggtctccgttgaatgaccgacagctcgcactcctcacccgcatcgggggcggagccgaccccgtcacgtcggacagcccggagttcgccctcaccgcccgcgcgctcaaggagcagcgtctgatcaccatgcccaagcaggatgggaagtggcaggcggagatcactgacgcaaggcgcttctacctggaacacggccatcacgttgtccccactggtcgaccttgtccttcggctcgaccaggtaaggcccccacatcgccccggcagccagcgacgtggcccccggcacctgctcggcgatcacgtgcaccgaagccccggcctcggcgagaaccacggctgtggtgagcccagccaccccagccccgacaacgacaacgcgctcctctgctgtcatgagccgaccgtaacggcctctgcgcgtgacgacgatgcgcgggcgaggttgtctccaacacacgagtcccgcgattgaccacgaggcatcctgaggaccttccaagcgggatgtacccccgcaggcccgccctggtcacggggctcataccgcgggggacggtaggcacttccgtgaccagggcgggggcttaaccgcggcggaggaatcctcgtcggcccggatgtctaccggcccgccgtgctgaggccggcgcaggggaggtggcatcgctcggccgagcgcggcgagttggttcgtcccggctgaggagagactgccagacccgctcctggagtgctcggatgcaggggccgcaggcgtacatgggcgcctgggctccggcgacgctcgcgggaccgatccacaggacgcgagtccaccgctgcccgcagtagagccaacacaatccgtcgacccactcgttgccgtcatcggtggctgccggtgcgggtagtccgccgcgtgcgaactcggcgatccccgggatcaccctgtgccgtaatacggcttccgtgagcatggcttgtccgccctcttgatcagtggctgctgacagcggaggaagcgtcctcctgcttctcggcgtcggagaacaggagggtgggctcggcgaggatgtcgcggccggcctcgctcttgtagatctcgtcgacgctgccgaaacgggctttggagtagtcgaggtccaacagcgcggcggcctgccggaccgatgcctcgtcgggcccctcgatctccaggaaggtggggaggtcgggccaggtgtcgaagtcgaaggcgacctcgcccaggcgccactcctcgcggtagttctcctggtagcgcacctcggtgaggccgacccgccgcaggatgtcggccatggcgtgcaggtcggacacctcggtctcgatctccttggtgccgtcgatcgtggtggcgtcggtgacctgcttgagcgtgagggtcgaccgggtgccttcgtcccgaaggcggatccaggcccctccgtcgagggagtcgttctcgaagatcttgcgagtgaggagggtgcgggggaacgcctggacggctccgagggcggtcagcttggcctggaggccggcggcgtcgacggccaggaacttcgcctcgtactcgtgcttcatgtgtccttctctcagaagtggtcggtgaaaggggacgttcgggctgccatgagcaggcccatgcggtgggtgtggtcgttcggctgaccgacgtgggcccgttccgtgaactcgttcgtgcgcagggtgagcaggatttcccagtcaccgatgaagtgagggagcaggcgctcgggggaggtgtagtgctcggtcatgtggtggcgtctttcgacgggcatcatgaactccgcaccgaacacaccgcccgggcggaccaggcgttgcatgcggtcgacaaactcggcgagcgggcggtgatggttggcactgtagtgccacgagcagctcgtccagaccgcctcgcactgcacgcccaagggcttgccatcgaggaagtcgtcctcaacgacgtggacaccggaatggagttcttcgagcttcagccggtcgatcaggcccatcgcgtgggcctcgctgtcacccggaaggcgtacctcgcctccgtgcagggcgagcgcatcgcgttcgatggcgaccacgtggtagccggcggcggccaacggcaggacgaacttgccgtcgctcgcgccgacgaccgcgacggtggcgtcaggggcgactcgctcgcgtagtgtgccgaggaactgggggaagaacgtgagggtgtgctcccacaggctctgggtctgcatgggagttcgctccttgcctgtcggtttctgtgatcactcggaggacctcttcggggctgcgccccgtggtgtcgacgcgacgcatcgggaacgaggcgtaggcgccggtcacctggtccgggacggtttcgatcagtgcgtcccactgcgacgctggcttgtcccgggcggccagacgacggcggcgttcatcttcggcacagacgaggtagtacgtgacggggatcggcagccagcgtggcagcgtgacgccgatgcgtgcgcccatggcctggtgggtggcgagacaccgggcgaagtagctctcgacgactacggggacgccggcgtcgaggtggctctggatttcctcggccgcggtgaacagcgcggagaggtagaggcacatccgcgcgtcgacgttggtccgctggtccacggccgccctgaggggctggtacagggcgggcacggtggggacgaggacggcttggcgggcggcggcgagcatcggggcgatggtcgacttgccggtgccgcgtaagccctccaggctctcgaatcgcgggtggtcaggcacgggcgtacaccacgtccggcaccgcgagcgtgagctcgtccgtggccgagggctggtggacgatgcggccggcgctcttctcgtaccagaaggcgtgggagtccttgcccacggccttgcaggacatggtcagggcaccacgcgggtcggcctcgatccggtcgatctcgcggggcccgccggtcggagcacaggtctgtggggcgccgtactcggagaggtcctcgtcgacgatcacctccaggggcaggtcggccgccgcgagctcttcccgtagccgaccgtaggcggacggctcggtgaccagcagctcggggtggtcggcggcgttgccgacgggccgcaggtgatggagcttgagctgtcggacgccgagcccggccaagatgccggcgagcggcagcacctcaccgatgttccgtgaggtcacggtcatggtcgcgcccgtcggaaccccgaggtcccgtgccaggttcagcaagtcgagggcgctctggtagctgccgtacctgcggatgccgtcgttggtcgatccgacgccctccagggacactctgaggaggtccaggtgtggcgcgatctccgtcaggcgtcgctcgatccggtacccgttggtgcagatctcgacgcgctggcccagttcttccttggcgtgacggacgacctgcgggagctcccggtgaacgaagggctccccgccgagcagggtcacttcctccgtgccgtactcgtctcgcatcagggtgaggaggcgagtggcttcgtcggcggtgaaggcatccgcgtactgaagccgcttgccgtggaagcagtgcaggcacgtgaagttgcagcggtagagcagctgcaggtagagcatccggatcttcctgatcccggtgacttccctgatcacttgggctccttcggctggctgcctttcgggaacccgatcgtggctgttcgcctggggacctcgtcaccgcgttcagggacggcccgaggacgtcctgggacgttttccgtcacctgcgatcgactccaggacccttagaaggcgcttggcgtctgccaggtcgggcaggacctcgggggcgccggccgctgcgagttccgcgcgatcgtgcagaccagaggcgacggcgacgatcccgcaccccgtggccagggcagcctccacatcacgaggggtgtccccgaccaggacgacgggcgtgtcgacccggacgccacgcagccgctgcactcgctcgcgggcgaccgcgaccagatcgggacggagatcagcgtccgctccgtaggcgcccaccggcaggtccagcaaggagtcgaggccgaacgcggagagcttcacacgggcgttggccgcgatgttgccggtcaggacagaggagacccagccgctccgtgccgaggcgaccttcaatgcttcatgggctcctggcaaggcccatccgcgcgaacgcagcgcgtcccggcgctcaccccctgcccgttcgagggccgcctcgatgccgggccagtcgggcacgggcagcccatcccgaacgaacatgtcgcgcatgatcagtcggtccgtacgcccctcggtgcgtgccggccccgtcggctcgcgccccgccagcgccgagaaggcggcagcgtagatctccttgctcacccccgcgttctcgatgagggtgtggtcgatgtcccacaggacgatgagctccatgccgccagcgtaagcagccatcggcgacgctgtgattccgcgacaacgtcccacaacgtccttgcgcgatgacgcgttgcaccgcttgcatggtttttgtgaacgaccgacttcataccgtgctcgcccaacgaggggtctcacccgacgtgctcgccgagatctgcgaggtcgaccccaagacagtgagccggtggctgggaggacgggtcccccacgcgcggcatcgctttcgcgtggccggtcacctacgcgtggaggagaccttcctctggccgacgccctccaagcggcccggtccaccccgcgacggattaggcaccgaactggtcggcacctaccagaaccgagccagcgtgccgcgggacgtatggctctcgctgctgcgggaggcccggcaggagatcagcgtcctcgtcttctccggcacgttcttcgcacagtccaacccgcacgtcgccaagatgctctccgaacgcgccgccgaaggcgtccgggttcgcctgtgcttcggtgaccccgccggacaggcagtcgctgtacggggccgcgaagagggaatcggcgacacactcgccgccaaggtccgcgcctcgctgacgtactaccgccccctgctgggcgaggccgggtgtgcggtgcgtctgcacgacaccacgctctacacgtccatgttccgctacgacgacgacctcctcgtcaatccccacatctgggggcagccggccagcgccaaccccctcctccacctcaagagagccgacggcacggggtggttcgacaactacgctcagagcttcgacgccgtctgggccgccgcacggccatgggcacccgaccaggagaggaccgccgaccatgggcaggactgagtactacaacgacccggccgctccgaaagcgaacaccctcatcccggccagcaacctgctcgtcgtcgacgagacgggtgccatcctcctccagcgccgccgcgacaccggacagtgggcactccccggcggagcccaggacatcggcgagaccgcggcccagtgcgcggtccgcgagtgcctggaggaaaccggcatcatcgcggagatcaccggcttcctcggcgtctacaccaacccgaaccacatcgtcgcctacaccgacggcgagatccgccagcagtacgagaacacctacatcggccgccccgtcggcggcgagcccacaatcaacgacgaggccgacggcgtccgcttcgtccagcccgcagacctggaccagtacgacatccaccccagcatgcgccagcagatcggcgactacctcgccggcacctatccctacctcggctgagccgccagagcggcctcgatcctctcggcagaggagaagatctccggcgccgcccgccggatgaaccgaccgaccacgctgtccgcgccataacggtcgacgatctccgcgacccgctctcgcacgatcgtccggccgccgtcgggcgtcgtcgtcatgtcgcaatacacgagggcgtccaccaacagcggatcatccaacaacgggaactccctcgccaactcctcccgcagcccccgttcttccgcctccagcagcgcgaacgagtggttcgccaccagacgggtcagcctctcatcgacaccgtgctcgtcccgtaggaagcgcgcgccatcgagcggatggaacccggtggtcgccaagcgaggcgcgtatcccacgtcatgcaggatcgcggccgagatcagcaggtcagcgtccttccccaagatcaggccgacctcggccgcccgggctgcgactccacagctgtgcgcccaccgtcgtgggagcacagtcccgagttcagtcgccgcgactcgcctggcccagcccaccatctcctcgtccatggccctctacatgccccgccgagtggctgccagtggtattggtccccgtcccgcctcagtgagcccgccgctcggcagtgagctgagccgccggacgacagggtcggcccaagagggcgcatctctgctcgaagtccgacgggagccagccacggctcagcaagcgcgggtgtgcgggaaacgccgtgatcgcggcaacgacgaaagcgagcgatgcccatggcgtgtgcacgcgcgtcatcacctgctggccgcgcgtgctgataaagctcgtctggaaggtgtccggagcaacgagttcgattgcgctcagcgccctccagtcgaggtcgagctcgcatgtcgggttcgcgaaatgcagcctgcgtggcgtgagcgtcaccgcacctgatccatccaccacccaccgtggctgcgcgtcacgcgccgcctgccggcgccgcgtggagttgcccaatgctgagcccaccaggctcccgatgacaagtgcaggactgccgacggcgaccacattgctgtgctggtaacggccgtctcccagggctcgccaagtcgagcgctgaccggggcccacggcaagcgcacggtcccctgggtccagtcttgcggttgtggcgaccaaggggcggccagccaggcggccttcgagtaggtcggcgaggatgtcgcacgtgtgccacagatactcgtccagcggggaccacgccagccggttcgcgttctccggcggcggcgcgaaagggttgggcactgtcacttcggcatccgtccgaggatccatcgattacctagcgcgatcaaccctatccacgccgcactacgagcgggatgccgttcacctaatgaccgatttcgttcgctcggacatctggacaagggacaggcgccagcctcacgcgccgaccgcacctgtgccttacgggtgatgcatgacactgagccggaggacgtggccgaatccgttcgtgcgcccctggtgcgtacttgttgcgctccccggcactttcctagcgtccaacggctcacaccacacggcatcgacagagggggcgccggtgaaagaggacggaaccaaaaccgtcaccgagatcttggacgaactgagcatcacctccaacattcaggtccgctcgtctcacgaactcgctgccgaggtcgacaaggcggcttcagacgaagacaagaagcgtgcggaggacgggcggggcccgctgcgcaggcgcaccgactacagagccgtccggaaagcgccgcgatcactgtcactcaccccatggcaagtcctgcacgccatcggccttggcgttgccgcggcccgtcagggagccggccgaggactcgccgagcactggggcagcctgcgctacagccaggcactggaggcgaacagggggcgattcctgcagttgtcgtccgagggacgcgacctcctgcgcttctacaaggccacgcagtccggagagatcggcaccggcttcgcctcgctgctggccgagcacatagtccggtcccggtaccccgaccactcggtctccgtaataccggcggacatcgcccttaaagctggctggacactgcgcagctccggcaccgggcctcgcccggaaccgttgcagcgacgcccccacttcttcgtcgaagcctggcaacccggacagccgtccaagatcttcctgatgtcctcgaaggggacacacagcagcgttcatcaggtgtacaagcaactcagcaccgccagtgcccacgtggagtcagtccacatcggcccctacggcaccgtcccctacctcctcataggtaccgagatcccagccaaggagagtctcgccctgcacgttctggaagcgccgggcacaactctgctccgcccgcccggcggaaaaccgggaatcgacctcgacctcgcactcacgcaggaagagttcatgcccgatgtcgtagggcccaccaacggcgacagggcaaccattcccgggttccaggtacagcccgagtccttcgcatggttcagcatcgtgctggcccggacggaagcagccgcactcaccgccttcaccggcggtggcaaacccaccgcccggtacctgaccaaggaacaagggcgacgacacttccagcacgacacccatgccagcacggccaggctgcgagacgcggagcaccgcatccacgacatcgacttcgtcggcaccgatcacatctaccgcctcaacggcacccgggtagaagccttctccgggctagagagaagcctctacacgcatctccaccacggacacgtcaacgagtaccgccgccaggtacacgacctgcgaggacagtggccgccgcgcagcacatcgaagtactggaacacggtgtcggtccgagccgacggaacagtcctggctatccgcctccgggacgagtgacccaggagcccgtgaaagctccagatccgcgcccgcggcctgccgggcggaggtgcacacagccgcgcatacgctggcgaagagagtccgtgcagctgagccgcctcctgatcgcgatgacaacagccgaatccgtccggcagtgccttacgcagagcttcccgcagatggatccagcaggagcagcccacagcaagcgggagtaccagagtcgccatcctgcccgcccatagccgggcaggatggctgcatgacacccaccgacctgtctcgcctgcaattgccacacgcgtgccgtgaggctcttgcccagcagcggtcagagcggatcgacgatcacaccattgccatacctgcccactggtggaactccgaggtagccgccgctcacctgcctggcgctcccgtcactggcccaggcaccacgcatctcagccggggcgacctcttcgcgcatgcagccagcctcgatttggattcggaagaggagctgctgcgattcctgtggcggacccttgcctggggcagcggcatgaagctccgccacaaccgcaagcgcatccgagctgtggcggatggcctgccatcggctacggcggctcttcgccgggccctactggcggcccgcgaagatccggggcaggcttacgaagctctgcgcccaggaggccgcaacgccatcgcacacctgggcccggccttctcgaccaaggtcctgtatttcgtcggcggcggcgccctggaccacccgtgctcgatcttggactcccgtgtcgccaacacgctcagaacggcctgccagtgggactcgctcggcaacagcgaatggccgaccagtacctacgtccggtactgcgcactgctgcagcgctggtcccaggaggaaagtcagcagctcgggcgccgcattggcgccgatgagatcgagcgctggctgttcgggacctgactagagaaccgcctgctcccagccttccgcagggcttacggcgccgccctcgccgaggatgcccgccatgcatctggaccgctgcgccttactgcacccactgcgcaaggtgcggcagcctgcccctctgccgcgggtatccacagcgaatggcctgcgcactggtagcagcgatcgcccaaccgcggcgcgaagcgggaaagccgcaggtgagccgcttccggacggcgatcctctacttctcttgcacaaccgtcctgcgagccccggaccgcagggttccagccctttacactggccattcccactggtcgcgttcgcggtcagctgtacatcccagtctcggtggacttcctgccgcgcagctgggatgttcgtgcgacagacggactcgttcgcacgttcgagtccggcctgccgagggcagccgagagccctccatgacgacggcgccgagctggatcacagggcggatccgcttgcggtagatctcctcggtgacggccgtaccggagtgtccgacgagccgggagatctcctcctgcggtacgccacggtcggagaactcaacggcgccaccacccgcggcctcgccgcacgggccgtggcggcactcatgcagcgcggtttcacggtcaccggaaccggcaacgcgatcagtcggcagcacaccgccacggtcgtcgagtaccgggccgggctccggagccgggccgagacggtcgtccggctcttcccgggggacgagctgcgttccgtcggcgggacggacgtcgagcgtgggctcctcctacgctgtggtcctacgcggtggcggaggcggccggggcctccgcaccggcggctccgcccagcaccgcgcccgagtcgctggtccacgacgcccgttcctcggacgacggcctctgctccgacctgtcgtacgggaacggcggctgacaacagccggagatttttccgcgcagagccatccctcctgccgtccggcacgtatcaagtgggcgagtacgagtccggtacgagccaagagcagggagacatgccatggcgatcttcaagaacctcttccccgccgaccgccacggtggcggtcacggagaccacggtgaccacggcgaccacggcgaccgcgacgaccacgggcacggccggcgccacgggcgcgacgagacctcttcgggcggccgtcaccaccgttcgcacgacgaggaccgcggttttggccgccacggctgacaacggtccggcagagccgggcggaacggcacccccgggtgccgttccgcccggccggtccgcactg

SEQ ID NO: 170 - DNA, 864 bp, Unknown
  Kingdom: Bacteria, Phylum: Actinobacteria, Class: Actinobacteria, Order: Streptomycetales, Family: Streptomycetaceae, Genus: Streptomyces
gcgctgccgtgggggaagcgggtggccttcgaggtcgcggaagggggagtgcggacctgcgtgggggcgcggggacatgcgtgtccggcgcggaccgccgtgccggggcggagtaccggggcgcggtgcgagcagtgcgcgcggctggaccgggcgcactccgtggccgccgacacgatcgcggacgacccccggccgtaccacgtgtatctggcgtggttcggtcccggcatgaccaaggtcgggatcacggcggtcgagcggggaccggctcggctgctcgaacagggcgcggtctgcttcagctggctcggtgccgggccactgatggcagcccgccggaccgaggaactgctgcgcgccgcgctcggcgttccggaccggatcccctacgccgcgaagcgggccgtgcgctccgcactgccgccgcacgcggcggagcgggcggccgagatccgggagttgcacggaagggccggtgcgctccccggctggccggagtcgctggagcgggagccgtttcggccggtggaccatgccggtgtgttcgggctcgacgggaaggtgcccgacgcggtcggtgaggtcagcgagctggccgcgggttccgtggtgagcggtgggctggtcgccgccgccgggccggatctgcatctggcgtccgcaggcggggtcgtcgtcctcgacacgcgtctgatgaccggctgggagctgcggccggccagggccggcgacggcgaccggctcacggtcccggtgcgggagttcgggcgggcgaggggagtgcaggacggattgttctgaggcggcagcaggcagacgagggcggcaggagggagagggtggcagcaggcaggcgggggc

SEQ ID NO: 171 - DNA, 1714 bp, Unknown
  Kingdom: Bacteria, Phylum: Actinobacteria, Class: Actinobacteria, Order: Streptomycetales, Family: Streptomycetaceae, Genus: Streptomyces
gtcaacggtttccgggcgggccccgcgcccacccgcgtgaaggaggtcatcccggccatgcccgacggctcgcccgtgacactcgaccggtcctcgctcgaccgcttctcgctgcccgcccggaaaccgttgacaccggaaatccgttgacagccgtacccgtccctcctacggtgtacagcgttcctgttgccgccgattggagaaggacgttgctcgtctgaggtccgaagacaccgcgtcacaccgcactggtgtgtgcgtcgcgtgcgacctcggcgtccgagccgtcctgaaggaagccgacccaggggcttttctcatgcccggtggagcccgtcctacacggtgaccgtcgcctcgcggtgtcctgacacgcgtttgcccctgcccaccgcatccagcaaccgcgaggcgctcatgtcagcatccctcagctgtacctccctgtccttcgcctggcccgacggcaccacggtcctcagcggcctcgacatcgccttcggcccgggccgcaccgggctcgtcggtgccaacggctcgggaaagtccaccctgttgaaactgatcgcgggcgaactggccccgtccgacggcgtcgtccgcacgtccggcgagatcggtcacctcccgcagaacgtcaccctggacaccggtctccgggtcgacgaggccctcggtatcgcccggcagcgggcggcactgcacgccatcgaggcgggcgacgcgtccgaggagcacttcgagaccgtcggcgacgactgggacgtcgaagagcgcgccctggccacgctcggcgaactcgggctcgaccgcatcggtctggaccgcacggtcggcgaggtgtccggcggtgagtcggtgctgctgcggctggccgcgctgctgctgcgccggcccgacgtgctgctgctggacgagccgacgaacaacctcgacctgtacgcgcggcggcggctgtacgcggccgtctccgcctggcccggcacgctggtcgtggtcagccacgaccgcgaactgctggagctggtcgaccagatcgccgacctgagggccggtcaggtcacctggtacggcggcaacttctcggcgtacgaggaggccctggccgtcgaacaggaggccgccgaacgcatggtccgggtcgccgaggccgatctgcgcaagcagaagcgcgaactggccgacgcccacgtcaaactgtcccgccgcaagcggtacggccagaagatgtacgacaccaaacgcgaacccagggcggtgatgaagctgcgcaaacgcaccgcccaggagtcggcgggcaagcaccgcatcatgcacgaggagaagctcgccgaggccagggaacggctcgacgaggcggtggaggcggtgcgcgacgatgacgagatccggatcgagctgccgtgcacggcggtgccgccgggccgtgcggtcctcaccctgcgcgacctggaactggcgtacggcgcacaggtgcgcggcggactcgacgtgcacggcccggaacgcgtcgcgctgatcggccgcaacggcgccgggaagacgaccctgctgcgcacggtggccggtgagctggcgccggtgtcgggtgaggcggcggcacacgtcccgctgcggttcctgcctcagcgcctcgacgtcctcgacggcgagctgagcgtcgccgagaacgtggcccggttcgcgccgggcgccacggagaaccggatcc

SEQ ID NO: 172 - DNA, 4103 bp, Unknown
  Kingdom: Bacteria, Phylum: Actinobacteria, Class: Actinobacteria, Order: Streptomycetales, Family: Streptomycetaceae, Genus: Streptomyces
gcgtcaccgtccgcccgtccgagtccgcaccgccgcccgtagccctcggcgccggcgacgcaccgccgctgtggcctacctccgcgcctgcctcctgcaccacgtcccgcccgaagtcccgtaccagcgccgcccgcaccgccgccggaccggtcgccggactgatgcccggacggccctggcaggtcagcgtggcggcggcacgcccggtcagcgccgcggacagcagcgtggcgtcctgctcgtgctgcgcgtacgcctgagggaaaccgctgcgctgcacccgctgcgcggccaccgtcagcggcagccgcgtgtagtcgtggaccttggccaggtgctcgtagaacacgcccgccgcgtacgccggttccatgatctccttggccgtcccccagccctgcgagggccgctgctggaacaggccgcgggagtcccggtcgccgtggtcgatgttgcgcagtcccgactcctgcagggcggtcgccagcgcgatcgtcaccgcccgctcgggcatgccgcgcccggtgcccacggccgcgatcgtcgccgcgttcaccgcctgctccggcgtgaactcgtaggcgccgccgtccttgccggcggacaccacctcacagccgggacccgtcccgcccgtcaggtactgcaccgtgagataacccgcgaccgcgagcaggacgacaagggccgccccgatcctgaggaggcggccacggcgcttcgaagtgggggacggctctggcacgcgtacaaggtactggagcgtgaccctaccgccgcgtccggtaggcagaacgccgccggcgggcggaaaccctgcggcacgcgtccggttcgcggggttagggtcgacggcatggccgataccccgcttgacctcacgctggacgccgcgcggctgaccgcgcagctcgtcgacttcccctcggagagcggcaccgagaagccgctcgccgacgcgatcgaggccgcgctgcgcgccctgccgcacctgacggtcgaccgcatgggcaacaacgtcgtcgcccgcacggacctcgggcacgaccagcgcgtgatcctggccggccacatcgacaccgtcccgatcgccgacaacgtgccctcccggctggacgacgacggcgtcctgtggggctgcggcacctgcgacatgaagtccggcgtggccgtgcagctgcgcatcgccgccaccgtcccggcccccaaccgcgacctgaccttcgtcttctacgacaacgaggaggtcgccgccgagctgaacggcctcaagcacgtcgccgaggcccacccggactggctcgcgggcgacttcgccatcctcctcgaaccctccgacggccaggtcgagggcggctgccagggcaccctgcgcgtgctgctgaagaccaagggcgagcgggcgcactccgcgcgcggctggatgggagccaacgccatccacgccgccgcgcccatcctgcgcaagctcgccgagtaccagccccgctaccccgtcatcgacggcctggagtaccgcgagggcctcaacgcggtcggcatctccggcggcgtcgcgggcaacgtcatccccgacgagtgcgtcgtcaccgtcaacttccgctacgcccccgaccgcggcgaggacgacgcgatcgcccacgtccgcgaggtcttcgcggactgcggcgtcgaggagttcgtgatcgacgaccacagcggcggcgcgctgcccggcctcgaccacccggccgccgcggccttcatcgaggcggtcggcggcaccccgctgcccaagtacggctggacggacgtctcccgcttctccgcgctcggcatccccgccgtcaactacggtccgggcaacccgcacttggcgcacaagcgggacgagcgggtggagaccgcgaagatcctccggggcgaggagcggctgcgagcctggctgacgagctgacccggcggccacgaacccgaccggtcgaggtcccccgcccgtaaccggcggagatctacgctgaggtggaactaccgcacgtggagggagcgcacatggcaacaggcaaccccgagggcaagaaggtgccaccggaggagcagcgcctgggaccggtgctccggcgccggggccaggtccaggccagcaccacggaccagcggctgctggacgaacgtgcccccaccgactgggtgcacaccgacccgtggcgggtgctgcgcatccagtcggagttcatcgagggcttcggcacgctggccgaactcccgcccgccatcagcgtgttcggttcggcacgcaccccggtcgactcggccgagtacgaggccggggtgcggctggggcggggcctggtcgacgcgggcttcgcggtgatcacgggcggcggcccgggtgcgatggaggcggcgaacaagggcgcctgcgaggccgggggcatctcggtcggcctgggcatcgaactgcccttcgagcagggcctgaacccctacgtcgacatcggcctcaacttccgctacttcttcgtccgcaagatgatgttcgtgaagtacgcgcagggcttcgtggtcctgcccggcggcctcggcaccctcgacgaactcttcgaggcgctcaccctggtccagacccagaaggtcacccgcttcccgatcgtcctcttcggcagcgcgtactggggcggcctggtcgactggctcacccacaccctcatcgcccagggcaaggcggcagaggctgacctgaccctcttccacgtgacggacgacgtggaggaggcggtggcgttgatgtcgaaggaagcgggcaagtaagaacgttcctgcgggggcgcgccctgcagggacgcggggctgtgccgagctgcggctccgccgcgtgggcgcgccgagacccccaccgggcgcgcgcccgaaagcgaacgcatagggggtctgggggcagagcccccaggttcgggacgggaagacgggaaggggcggcgggggcgaaacccgccctacgccagcccccgccgggccaccgcaggctcccggtacccggcgatagccgccaccatgtccaccacctgccgcgtctcggccacctcatgcacccggtacacctgagcccccaaccacgccgacaccgccgtcgtggccagcgtccccaccacccgctccttcaccggccggtccagcgtctcccccacgaagtccttgttggacaacgacaccagcaccggccacccggtcgcgaccatctcgtccagccgccgcgtcgcctccagactgtgccgcgtgttcttcccgaagtcgtgcccgggatcgatcagcaccgactcccgcggcaccccgagcgccaccgcccgctcggccagcccgacggtcaccttcaggatgtcggccatgacgtcgtcgtacgtcacccggtgcggccgggtccgcggctcggcgccgcccgcgtgcgtgcacaccagtccgacccggtaccgcgcggcgacctcggcgagccgcgggtcgacaccgccccaggcgtcgttcagcagatccgcgccggcctcgcacaccgcctcgccgacgtccgcccgccaggtgtccacgctgatgaccacgtccgggaaccgccgccgcacctccgcgacgaagccgaccgtgcgccgcgcctcctcctcggccgtcacctccgcgcccggaccggccttcaccccgccgatgtccacgatcgcggcgccctcggcgaccgcctgctccacccgcgcgagggcgggctcgtcacggaacgtcgccccctggtcgtagaaggagtccggggtccggttcacgatcgccatgatcaccggctcgtgggcgtcgaattcacgcctgcccagcctgagcatccgctgtgacctcttctcgtacgttccgctcttcggccgcctgcgaccctaaccgtcagcgtcgcatggcacgatcggaccctgacacacacgacagactccgtgaccccagactccgtgactccaactccagactccgtaactccgtggggacctcagcgatggtgatgttcttgttcctggtcgtcgcgctcgcggtcgtcgtcgccgcggtgaccctcgcggtcgtgggcggcgggggcggcggcccgctgcccgaggcgg

SEQ ID NO: 173 - DNA, 6354 bp, Unknown
  Kingdom: Bacteria, Phylum: Actinobacteria, Class: Actinobacteria, Order: Streptomycetales, Family: Streptomycetaceae, Genus: Streptomyces
gcgtcggtacctcgacgcccagcggccgggcgaggccggtcacgccctcgtccaggcgctgcagatgccgcagcacgcggtcggtgatccggccgtagcggggggtgccgggggtcgcgcccgactccaggagggacgcgatgctcgggccggtctcgatctcgggggcgtcctgctcgcccgccacgtgcgccgtgagcgccgcgatgttgtgcgtgatccggcggcacgcctgacgcagccgcggatccgccgctatcgacggatgagtgggcagcagctcggccgtcgcggccagcgaccgggcgtggtaggcgcacgtctccagcagggccagcaggtactgggccgtgttgcgccgcgcgcgcagcggggtgatcgggtgggtcagcggctggacggcgccccgcagatcgctcagcgcctggtccaggtcgcgcgcctggtcgagcaggtcggcctgccggccgccgctcagctggtcgacggcggtgccggtcacgtcgtagagccgctccaggaccgtgccgagcagctcgtccgtacgccggtccgtgcgcaccggcagcaccacggccgccgcgatgatcccgcaggccgcgcccagcgccgtctcctcgatgcgcagcaccagcaccgacaggctgtaggtgtgcagcagcgtgtacagcaggcccagcgcggccgtgacgaagaacgacatcagcgtgtaggacagcggcgccgtgtagaacatcgcgaagacgaagagcagcaccagcgccagcgccggccatgtgtgcggcccgaccagcccggccagcacgataccggccaccacaccgaggacggtgcccagcagcctgcggtagcccttgaccaggatctcgcccgtggacgaggtgttgatgaagacgatccagcaggtcagcaccgcccagtaccagcgctggctggagaggaactcgccgccgacgatggccagcgccgaacccagcgccacctgcaccgcggcccgcgtggtgggccgccgcagtccggtggcgggctcctcgagggcctcctcgcccgcctcggcgccctcgatggcggcgtcctcggcgtccagttcctcgcgcgagcgggtggtggccggggtgtcgtcggactcgtcctgcggcgtacccagcgcggtccgcaggcccagtaccgcgcgggcggcctcgccgatgccacggaagacgtcctgcacggcggccgacgcggccggcaggttctcctcctcgcggtagccgaggagccggttgcgcacatgggtcatggccgtgccgccgccctcgccgacgggccgcagcaccagcatgcgcagcgcccccagatcgcggcgcagtatgtcggtggcctcctcgcgcaccggcagcctgccgcccgaggggatgggcgcgccgggcaggtggagcgtgagcgtgtcggtccgttcgctgctgcgggcgttcagcaggagcagacccagccgctcggccgtgatctcggcgcccgcgatgcgccgctgcaccagccgggccacggcctcgtcggaggtgccctcctccagccggccctggatcatcagagccgtctcgtgcagccgggcggtgccctcgcgcacggcccccagggccttgtcggcgtcgccgggaccggcgtccagcaagtcgatctgcgcggccaccaactgggccagccgcacccggaaggcctcgcgcagccgcagcaggatgcccgccggagtctcgtagacgatcacgaagcgcaccagcgcgctggacgcgaacgcgatcgcgacgacggtgtacagggacagcagcgtgtgggcggtggcgccgacgaacagcgacatgaagtagacctggaagccgatcaggcccagcgcgttgccgcggtcgccgaagcggcggctgtagacggcgcagaagatcagtacgacgaagaagacgtccccgcccaccacatgcgcgttgaggagtgccgcgagcgacacggacgccagtgccacgggcaggccgagcgcgagcgtcacggcctgctgggagcgcagtttctcgcggatggcgaaggtggccgccatggacgcgatcgcgccggccaccagatgcggcacgggcacgcgcagcgcgctcagcacggccagggtcagcgctatcgaaccgaccgtcctcgaccccgcggccagcctcagcagcccgggatcggacgccgagacgcgatcccgcagccgtgcccagaccgacccctccgctgcactcacgccgccgtactctctcccgatccccgtggatctccgtgatgatccgtttctccagcatcgcacgccatggccggaccgccttccgtggcccggccgtgcacggcgacgcgccgcccacgcggcgtcacaccacgaggcgccgggtcacgccaccacggcgtccggtcaccttgccaggtgccgggtcacgctgccaggggtccggtcaccccgccggggttggccaccctgacggggcccgggtcaggcgcagcccgggtccgggtcacccggtccagggtgcccggccgggctggtcgccactcggggtccggccggcgggtcacaacgcccgggggcgggacttctccacgtactcctgcacctcctgtgccgacatgtacgcatccgtgtactcgaagtccttgagcttggccggcttgcgggcctggaacccggtgcggacgaaatcgtcgcccgcgaccgcgttgagcagccagctcgtcccgacccgcaccttggcgacgttggtgcgcagcgcccccaggtggtagccgcgggccaccgcctgggcgggaaccccgtgcagttcgacaccgagcggtttggcgaccgcgtccgcgccgcccaggtccacgacgagacccaggtccttgtgctcgtagggccgcatcggctggttgcgcagcgcggcgacgaggttctccgcgacgcgcttgccctgccgcgacgcgtgctgcgcggtcggcgggcagaccgcgccgtcgcccttggcgaggtccggcacggccgcggagtcgccgagcgagaacacgccgtcgtagccgggcaggcacatctcggcggtgaccgcgagccgtcccttgacggtgtccgcgccgagagtggcgatgagcgggctcgccaccacgccggccgtccagatcagggtgtgcgtgggcaccacccggccgtcggtgaaggtgacctcctccgggcccgccttggcgatggacacgcccagcgagatctcgatgccccgccggcgcaggtcctcctgggcgctgcggccgagcttgtcgcccagctccggcatcagcttgggcgcgatgtcgatgaggtgccatttgatcagcgccgggtcgatccgcggatagcgcttgacggcggcgtgcgtcagacgctgcaggcaggcggcggtctcggtgccggcgtagccgccgccgacgaccacgaactgcagccgcgcggcccgctcggccgggtcgtcgctggcgtcggccaggtcgagctgggtgatgacgtggtcacggatgtacgcggcctcggcgagggtcttcatgccgaaggcgtggtcggtgagaccggggatgtcgaaggtacgtgtgatgctgccgggggccagcacgatgtagtcgtacgactcgtcgacgatccggtcggtgatggtacggatgacgcagaccttggccttcaggtccacgccgatcgcgccgcccggaatgatccgggtgcggtacttcttgctgcggcgcagggagacggcgatcgactgcggcgtcagcacgccggaggcgacctggggcagcagcggcagatacagctggtaggcgaacggcgtcaccaaggtgacctcggcctcgctgggcgagagcgtgcgttccagacggcggacgcactccacgccggcgaaacctgcgccgaccaccagaatcctgggtcgtgtcacggtgttcatcccttctgcggctccaggcggtgtgcctcgacgtcagtcgcctgcccctggatcgctgcttcgcacctcatcgctcccaccgtgccgccggtcctcctcacgcccggccgggcacgacggccgcacacacgtgtcgatcaccaccatgcacgccccggcccgtccgcgcaccagaaacggcggcaccggtcgtacacgacagcgccggtcatacgcggcagcaccggccgtacacgaaagaacgggtcgtaccggacgccacggagcggcgggccgccccggctcagtccgcccggtcggcggactcgtcggcccgggcccctgcgggttcgtcgaccagggccagcgcctcctcggtggtctcggacaccggcaccgtgaggctgacgccggtgaggtcgaggatccgccgcacggccggggcgggcgcgatgatgtgcacgctgcccggacgctcacggacctcctggtacacgcgcaggatgatgttcatgccggaggagtccatgaacggcacccccgccaggtccagcaggaagtgccgccggtcgtggtggagctggttggccaggtgggcctggagttcggtcgcggtgtcggcgtccaggtagccctcgaccgtgagcagggcgacgtcctcccggacgagggtgacctcgacggacagcgggttctgggcaacgggcacgagtacctccaacgagtgcggactgcgcacccgcgcctacccgcgaaccggccgggcacacgcgccgcagcgcgcgcccgggtcgtcgaatgcggacgtcggcgcagggtaatgggtgctgtggagccaccgagaaggccgctacggcgaagtccatggaaccactgagaggaaggagcagcgtgaccatcgagggaatctggtcgtacccgccgcaggcgggccgcaccgagggcctggacctgaccggcttcaccgtcgtcgccgacgacggcaccgtcggccacgtggaccgggaggccggcaacttcgggatgcggcacctggtcgtggacacaggtgtctgggtgttcggccgcagcgtcctggtcccggtcggcgtggtccgccggatcgacccgggcggacggagggtcgaggtctcctgctccggggcggagatcaaggcggcgccgcgtttccgcaccgacagcgagacccaggaccgggactacctgacgcgggtgggggagtactaccaccggctgccgccgcgccaggagacgagcactgcctgacgcgggcgcccccgcgcggccgcgggctcaccagggcaggaagacgtgcacgtccttgccgtggtcggtgacgacgacgctgacctggtcgctcagcgtgtggatcagatgccagccgatcccgccgccgccccggctgggatggaagggccgcggcgccggcgctgtcgtgctggtgtcgctcagcgtcacgtgcacgccgtcgaaggtccgccgcagccgcagcacgaacggccccggcgcgtactgcacggcgttcgcggccagctcggtgaccaccagcaggatgtcgtcccagtgctcggccgccgcgggcagcgcgcaccgcgcgagatcgtccaggaactcctccgcggcgaggcgcgcacccgtcacatggtgcagctcgcccgcgaagcgagcggtgcggctcggtatcccctcggtggccagtgtgtcttccccatgcggatcgattgccatctcgccttccctgcccggcgtgcgcagggcgtcgtcgtgctgtcccttccgtgcgtccccctgtctagttcccgtgcgtacggaggctacgcgtcgccggcccgtggcaccggtctcagccgggacgggcacgaatccggggcggcccgcacgggagtcggaaggcaggagtggggactcggaggacatgagtcacgtcaacccagatcccgatccggaacggacgtccggcctcgaaccgggcggcggtgtgccgcccggcgagaccccgcccgccgagagcagcatgcccgaggccgccgccagggcgccggaggccacctccagggggtgggcgaagacccccctcgccctcatcctgctgctggtcctggtggtcgccgccggcttcctcgcgtacgccctggccctgatcttctgacctcacccctgggtgaggcgtacgcactcggtgacgacgtcgcgcaggctgccggtctcctccagcagctcgcgctgcgcccgcgcgccgttcccgcgcaggagcagcgcgtccaggccttcgcgcgccggttccaggtcaccggtgtcggcgagggcgtcggcgacatggtcgagcagggcccgcagcaccgaccgcgcgggcagccgccgcatggtggacggatgcagcagctcggcgcgcggcccggtcctggcggcctgccaggcggccagccgcagcagg

SEQ ID NO: 174 - DNA, 13326 bp, Unknown
  Kingdom: Bacteria, Phylum: Actinobacteria, Class: Actinobacteria, Order: Streptomycetales, Family: Streptomycetaceae, Genus: Streptomyces
gccgtgaccgcggcgctcggcccccgccacccgcgcccggtcgtcttccacgacgcgccgagcgccccgcgcggcgaggtggcgctcacccgcaccgacccggtggtggccgcgatcgcccgcttcgtcctggacaccgccctggacgagaagttcctggcctggcagcgcccggcccgccgctgtggcgtgatccgtacgagcgccgtacgacggcccaccacggtgcttctggtacggcaccgcttccagctgagtctgcccacccgcgacggcggcgtgcgcacccagctcgccgaggaggcgcgggtggtggccttccacggcagacccgaggcgccgcagtggctgcccgaggacgaggccctcgccctcctggaggcccgcgccaccggcaactccgacccggccttcgccaccgaccacatcgcgccgatcctcgccgccctcgacaccggcctgatggacgcactgcggctgcgctccaaggcggccgcgaaggagctggaggcatcgcaccaccgggtccgtaccgccgcccgtgcccgcctcgccggtctgaaggccgccccgcagggcgacccggacgtcctcggtgtcttcctctaccgcccggccgccacgatccagctgggagccgacgcatgagcaccgcgaggaccctggtcaccgacaccgtcgccacggtcggcggactgctgccgtacgacctcctcgtccgtatcaaggagggcaaggaacagtccggcgcgaagcccgccgactaccggctgttcgccaagggcgagtccgtacgggacgccgccgagcgctcctggggctatctgcgcggcgtgtgggccgcctaccaggacgcgctcgcccgcgacggagcggacgacgaccccggtgtgcacgcggtggggctcaccgtcgaacgctggctgctgcccctgttcgagcagctcggcttcggcgcgctgccccccgtgccggagcccggcctgcccgcccacgacggcaccaaggacttcccggtcagccacgcgtgggcgcacgtgcccgtgcacctcaccggctggaacgtcccgctggacacccgcaccccccatgtggcgccgcaggccccgcagtccatggtccaggagtacctcaaccgctccggcgacaaggccctgtggggcgtcctctccaacggtcgccagctgcggctgctgcgcgagtccgcctcgctgaccggcgccgcgttcatcgagttcgacctccgggcgatcttcgagggcaagcgctccgacgacttcgtcctcctgtggcgcctgctgcaccggacccgcttcgagggcacccccgccgcctcctgcccgctggagaagtggcgcaccgaggccatcgactcaggcacccgcgccctcaaggagctccgcaagggcgtcgagacggcgatcacggtgatcggctcggggctcatcgcccaccccgacaacgcggagttgagtgacgccctgcggaccggcgccctcaccgtccgcgacctccaccccgccctgctgcggctcgtctaccggctgctcttcctcttcgtcaccgaggaccgcggactgctcctgcacccggacgccgacgacgccgcccgcgaccggtacgagaagtacttctccacggaccgcctgcgccgcctcgcccaccgcaccggcagcccgcacggcgaccagtgggaggccctcgccctcgtcatcaagggcctcggcgagcccggcggacggcctcaactgggcctgcccgccctcggcggcctcttcgaacccaccgacgtggacgcgagactggacggtctcaccctcaccaacgagtccctgtacgaggcggtgcacgccctcgccgtcatcttcgacgccaaactcggccggccccgcaaggtcgactaccggaacctgggcgcggacgaactcggctcggtctacgagtcgctcctcgaactcgaaccccgccaggacgacgacggctcctacgtcctcaagaagctggacggcaacgaccgcaagacctccggctcctactacacgccctcgccgctgatcgactgcctcctggactcggccctcgacccggtcatcgagcaggctgtgcgctcgggcacgacgaaggaggagcggaaggcggcgctgctcgctctgaccgtgtgcgacccggcctgcggcagcggccacttcctggtcgcggcggcccgccgcatcgcccgccggctcgcggagatcgagaccgacgatccggagccgaccgccgaggccgtccgcgacgccctgcgcgaggtcatctcccactgcgtgtacggcgtcgacctcaacccgatggccgtggaactcgccaaggtgtccctgtggatcgaggccatgaagccgggccgcccgctcaccttcctcgacgcgcacatcaagtacggcaacggactgctcggcacgacgccgaagctcctcgcgggcggtctgccggacgaggcgttcaaggtccttcagggcgacgagtccaaggccgtcaggaacctgaaggcccgcaacgcgagcgagcgcgagcggtggctggccgcgctgcggcaccgcgccagccaggacgccctgttctcggagcagcacgcgctggacatctccaacgcggcgatcaccaggaagacgtcggacatcacggccgcacggtcggaggagctggaggacgtccagaaccaggcccgcgcgtaccacgagctcaccacttccaaggactacctgcgggcgctggaactcgccgacgcgtggtgcgcggcgttcgtctgggagaagaccgagcggaccgacgggaccaggcgggccgacgagaccctcccgcctgcgctcaccacggattccctgctggccctgcactccgccgacgggggcgcgagcctgccggcgggcacggtggagaaggtgaagcggctgcgcgcggagtaccgcttcttccactggcacctggagttcccggaggtgttccgggtgccggcggatccggaggcaccgggggtggacgagcggaccgggtggaagggcgggttcagctgtgtgctggggaacccgccgtgggagcgggtcaagctccaggaacaggagttcttcgccacccgtgacgcggcggtcgcgaacgccgcgaacaaggcggcccgcgagcgcctgatcgacgcgctggccaccagcgaggaggaggtggaccgggccctgcacgccgagttcaacgcggcgcgccgcttctccgagggtgtcagccacctgctgcgcggttcgggccgcttcccgctcgccgggcgcggcgacgtcaacacgtacgcggtcttcgccgaggccgcctcgctcggcatcgcgcccacggggcgcttcggcctcgtcctgccgaccggcatcgccaccgacgcgaccaccgcgccgttcttctccgacctggtgcgcacctcacggctcgcctcgttcctggacttcgagaacgaggcgttcatcctcagccgggacgtgcaccactcggtccggttctcgctgctgaccgtcaccggccggggcgaacgggtggattcggcgtccttcgcgttcggcacccggtacatggaggacctggacgagcgccgcttcgcgatgccccccgaggagatcctcctggtcaaccccaacaccggcacgctgccggtgttccgtacgcgcaaggatgcggagatcacgctggggatctaccgtcgggtccccgtcctcaggcgggagccggacgcggagggggagggcggcacggacccgtggggcctgaccttcatgaccatgttccacatgtccaacgactcgcacctgttccgtggcaaggaggaactggagggcgacggctggaagctgaaaggcaacatcttcacgcacccgtccgacgggcggcgctatctgccgctgtacgaggcgaagatgctccaccacttcgaccaccggctgggtacgtacgaggggcagacgcaggcgcaggccaatgtggggactctgcctcgcgtgacaccggaacagcacgatgatccggagttcgcgccgatgccgcggtactgggtgccggagttcgacgtggactcggggaagcgggacaagaagctgaacccgatcatgtggccgggggtggcctcgcggctggctgagcgggagtggtggaacgggtggttgatggggtggcgggacgtcgcacgctccacggacacgcgaactgtgatcagtacgcctcttcccgcgcacggcgtgggccacaagttcccgctgatgttcgtccagtccggggctgcggcattgacgggcattctggcgtcgtacgtcttcgattacgtggcacgtcagaaggtcgccggaacgtcgatgacctacggctacgtcatgcagtttcctgttccggtgccggatgccgacctgccgttcaccacggcggacgccaggaacctggcagagtggatcacactgcgagtcctggagctttcctacacctcaagggacatggttcacttcgccagaacgcatggggacgagggaaatccgttccgttggaacgcagaacgccgcgagctgctgcgcgcggagttggacgccgcgctgttccacgcgtacgggctcagccgtgatgacgcggactacgtgatggagacgttccccacggtcaagaagagggaagagaccctgtgcggcacctaccgcaccaaggacctcatccttgacatctacgaccgcatggcggaggcccgcgagaacggcagcgcgtaccagaccgtgctggacccgccgccgggcaagggcccccgccacgaggggtgaaccctagagtcgcgggcggagccggtcagttggatcggctctgcccggtctcgccgacgaacccggcccaggcagcacgcgtgaacgcgagctgcgagccgccgggcttcttggagtcccgtacgtggacggtggcgggggcggcggcgacctctatgcattcgccgccctcgtcaccgctgtagctgctcttgtaccagtcgagctgcgcgggctgttcgctcttcataggtctcccagcatcttctcgatcaggcgcagggaatcgcgggtcgtgagcgcctgcccacggatgctgccatacttcgcggccagaacccgtacgtcttccggatcggcgatcaggcggctgacgtgctgaacctccagataggccatgcgcggtcgccccttgatctccagcagggtgaacggaccgcccatccccgcatggtcctcgctggccgtcggcatgatctggatctcgacgtgccgcaggcgactcacctccgccaggcgctcaagttgctcccgctggaccgctcggccaccgaatggctgcctgagtacggcctcttgcacgatggcgctcacggttggcgggggccacctggacaggagttcctggccggccaggcgggcggtgacgcgttgctcgatcgtctcctcgtcgaagaagggttgcctgctggtgaagacagcgcgagcgtagttctcggtctggaagaggcccggcacggcctgattggcgaagtagtacagctcgaccgcctgtgcctccaactccgcgtagccccgaaaccactccggatgccgcaccctccgccgtgccttcgcccgctccacgtcctccccgagcagcgccaacagcccaccgcacccgagcagctcgtccaccttcaccaggaaatccggctgtggcgtccggcgcccccgttcgaccgacgagatctgctcctcgctgtagccgagccgctgccccagttcccgctggctcagtccggcccgctcccgcgcggccttgatcatgcggccgatggcgcggaacaggtccgcgacctcctccgagcccgccgggtcctccacacccgcgtcaccccgtaccgccgtcatcacgcatcaccccgctcgttcccggcccgcccgcctaccgttcaccgacagcccgtccccgtacgtcacgggcggtcacccgtacaactcccgtacaagaccaccgcccacacggacggcctgcccgcgccgccggacagtgactctgcgtaccctttcggtcactgtcgaggatagatccggcacgccaccctcggtgacgtgaaccaagaaacaggaaccgcgatccggccgcccgccgcccccgcaggtgacgtaagcctcagcacgcttttccccgccaccaggcacggcgcgcacgcagtccgccacgccgccgaacgatggctcgcggcgcacctgccgcccaacgcccccggtaccgacgacctcgccgccacggccgctctcctgatcgcggagctgaccgcgaacgcggccctgcacggccgggtgcgcgggcgtgacgcccgcctggaactgcgcctcgacgcgaccgagctgcggatcgaggtcaccgatgccaggggcgaccggcagccggcgccccaacccgtcgatcgcggagacgactcggggcgcggtctgctgctcgtcggggccctgtccgacgactggggcgtccgcccgcaccaccccggcggcaagacggtatgggccgtctgccgtcggtgaggtgcgacggtcgggtcagaagcggaacccgaacagcccgccttcgtcgtaggcgtcggtcaggcgcggctcgatcaggtaaggggaagggtcgaagccgcccaggcgggcgcgttccagcttgtccgagttgaacgtcacgatgtactggaggccttcctcctcggcgacctcggacgccagagtcagcgcctcggtcacctgccggtcgtccaccccgtcgaagagatggctgtcgtggaccaggaagtcgggcccacggtcgtggcggtgggcgatcaccgcggccgtgagatcgaggcagaagatcaccatcttgttgatgccgacgctgccctgactgtcgacatgggcggagatctccaggctgctggtgccggccttgatcgtgaggtaagcctgccggtcttgcccgtagaggcggcgggcgaagcgggcgaagagccaggtggcctcccgggtctgctcaccgcgttcctcgaggtcgagctccagctcctcctggagctcgacgcgctgtgctgtgatctcccgctggctggcctccatgaactgcgctgtctcatactgcttgcgcagtgcttcgagtgccgcctgcttctgggcgagcagctgctggagtgccgtgaggccgtcgagggcgcctccgtcgcgcagtgcgctcagtgtctcggtgagctcctcgccgagacgggcgcgctcgtgttcgcgtgccgcgagtctggcctgggtctcctcgatctcgtcggcgaggtagcggcggcggttgcggacgatggaggcgtggaagccgcgtacgtcctcgaaggaccggtgcactcggtcggggagaacgacccccagctcccggtagacggcgtccacgtatgccgtgtcaggttcgttcgcctcgtccaccgcgcgctgcagttccgccaggttccggcggtcgatgacgtcctgctccggcagcgagcggactctcttgtccaactcgtcagcccgcagctggagctcctcatacgccggcagcacacggaaggcggcgatctgctcgctgagtcgcttcacgtccccctcggcgacgatgatccggccgcgcaggtccgccgtcgtaccgacgacctggtgccaggacggatcgttcatcgccgaccgcagctgccttcgggtcgcctcccgtgcggcgatggcgcggtagccggcggcgagccgccagtccaggccgaggagataggcgaggttggccgcggcctcggcggtgggctgctgcggataggtccgcaccgggtcgttgaaggcgtgcgatccgacgcggcgtacgaggagggacagcagggcgcgccccgagatgccggggtggtcggcgggcagccggaagaggtctgcctctatgcgtgttcgccactccggcaccggcatctcacgggtgaggctgatctcgaagagccctccggcctcaccctcggtgccaccgggagcatcggtcaggacgatgccctgctgggcgccacgcctgctcacccgtaccggctcctcgcgcccgggccaatccaaggtcagcgtgaagagggtgtgccgcagccgggtgcgggtgggcaggctgcccttgccggcctgggcacccagggcgaagtgcagcagctccaccaggctggacttgccggtgccgttgcggctgtccgttctggtcgccccggggtgcgcctccgcgaccagaaggttgaggccgcgccggaactcgacggtacggaaccggggatcgtcagcgctcagacgacgcagcatcgtccctccttctgatcggcgaatcggctcgccttctcgtcagcagatcgtcgcggaattcgatcacaccgagcgcgtacagcacatcgagcccgaggacgaaccactggaaggagaccggagagtggtggccgagccggattcgttcggcgcggaacctcgaccaggtctgggtgacggtcagcggcatgtcgaggacccgcaggatctgcgcgccgacggccagcagggagcggtccggggagatgcccttcgtcggagtgatcacgcggcgctcaggtctgccgggcccgggacccagccgtcgggcggcacgtcgaagacgtcgcaccgctggaagaagtgggcgatgacgatccaggcgcagtacatcgagttcaggctcggcgcggcgttgccgaggatgtactcctgcagcgcggcccacagcttgtcctggtcgtcggtgtcggcccggacctggtcgtagtacacccggaagccctgggcgacccggtccgcctcgtccggtgcgccgagtccggcgtagtacccctcgacgaggtggctgtgcccgatcccctggatcagcgcgccacggacgtcgccggtcaggccgttccactcgatcttgtacttgttgacctccgggaggacggcgagcggttccgccgtgcgtcgctgttcaccgagccgggcaagcagtgtcgcgagatcgccgagtccgataccgtacgtcttgtcttggaccggcagttcacgacccagcagctcctccgtggcgattctgtcgaggcgcatgacgtcgttccacagccggtgccagccgtagtgctccacccggcgcgggcgcagtttctcctgcgcctcggacatcatcacgctcaactccgggtgcacgcccttgaggtcgttgaccgcgaagcggaacgtgtcgaaggcgccgggccgtttggcgagcgccttctccaggtcgctgctgaacttgcgcttgacccggccgacgtcgtcggtctgcggcgagtagcacgcccagagcacccgatcccacagaaggagaccgtcggcgcccaggtcgccgagctttccgtgggtgcgtacgggcacgaagtcggggtgccgcaggctcagcaggtggtggatcagctgctcgaagctctcgcccggcatgtcggtgagctgctggcgcagggtgagctgcgcgagcatgcgctgggtgaagtccacgtggtcgatccccccgtcgaagtggtcaggctctgccgcgaagagcgctcaaggatgtgccgtccgccgtgtgccaggcgtcccagccgttggccttggccccggtcaccgcctcgcaggcgccggacggtgatgcgcagatcctgccgtcctccaggcgaaggcttccctcggcggtgacgtgtgcgcggtgctcctggccgaggttgcggcggcgccaggtcagccgctgccccggttgcagcagtcctgcggtgagcaacttggcgagcgcgcctggctgaaccgtcgcctcgtccagggcgagcaggcgccgcagcacgctgttgggagtgtcgatgaggggtttggcctcgcgctgcaggcgcgcgaagacttcggcgtcaacggtgatgtggtgttcgggcatccggcctcccgttcttcggaagattttttctctgcatgtgattgagagaaaaaatagccgactctgcgcttcgctgtcaacccctcgattcacggaaggcgcgctcttgcctgcgtggcgggtagctgtaaactcagtcaatggccgcttgttggagcgacggaaagggcgaggaagtgccgcagatcgcgatcaccaacaccttctgggagggcgtggaccggctcgacaagccgtcccgcgcccgggtccacaaggcgatggcgaagtttcagcagttgacggcccaccagctgcacgcggacaagggcctgcacctggaatccgtcgtcggctcccgcgatccgcgcatgcgcaccatccgggtcgacgacgggcagcgcatcgtgctgctcgcgcccgacgacggcagtgacgtgttcgtcttcgtccacgtggtctcccacgacaaggcgtactcctgggccaagcggcggctgtactccgtcaacgcggtcactcgctgtctcgaagtgcgcgatctcaccgccatggagcagatcaccccgctcttcgcccaggagtccgaggccgcgccgaagctcctcttcgccggctggtcggacaccgtgctgcggcacctcggcgtcgacgccgtcacgctgcgcgccgcccgcgtcatcaccggcaaggcgcagctggaggctttcgggtcgctgatgccggaggaccagttcgaggcgttgtggctgctcgcggaggggttcgaccccgacgacatctaccgtgacctcgtcgcggcgcggcaggcggtcgtcgtcgaggagaccgaggagaagcagggcgagctggcggctgccgtcagccgtacgcgcagccggatcaccctcgtcaccgggcccgaggaactcgccggcattctcgccaagcccttcgacgcgtggcggatcttcctgcatcccacccagcgccgggtggcctaccggcccgcgtacgcgggccccgcccagatcaccggcggacccggcaccggcaagaccgtcgtcgccctgcaccgcgtcaagtatctgctcggacgctcacccggcacccgcgtcctgctcaccacgtacaccagcgccctggcgcgctcgctgcgctcccagctcgccctcctcctcgaccacgaccgggtgctcctcgaccgggtcaccgtcaccacggtcgacgccactgcccaccgcatcgtgcgggagctgcacgggaacccgggggacgtcctcggtgacaaggacgagcggcggcgctggcagcgtctggcccgcaggctcgatctgccttggacggatgccttcctggcccaggagtaccggcatgtgctgctcgcccaggacctgcgcacccgagaggagtacgagaagtgccttcggcgtgggcgcggcagcaagctggcggtcgggcagcgtccgcgactgtggcaggcgatgacgcggttcgaggaggaactcgcccatgaccgcgcctgcacctggctgcagctgtgcgcaagggctgcccggctgctcaaggacagaccgggcgagggtccgacgtacgaccatgtggtggtggacgaggcccaggatctgcaccccgcccagtggcggctgctgcgggccctggtgcctgaggggcccgacgacctgttcctcaccggcgacccgcaccagcggatctacgactcccgggtctcgctgcgctccctcggcgtctccgtcgccgggcgcggcgcgcggctgcgcctcaactaccgttccaccgaggagatcctgcgctggtcgcgggcgttgctcgacggggggcccgtggcggacctgaccggtgacgcgccggattcgctctccggctaccggtccctgctgcacggggagcggcccgtgtgcgaagggcacgggacggaagcggccgaggccgatgctgtcgtgcgcacggtgggcgcgtgggtggcggccggggtcacgccgtccgagatcgcggtatgtgccaggttccacacccagactgcgcagatcggcgaccggctcgcccgtgccgggctgcccgtggtgcgggtcaaggacggggcgtccgacgacgccaccggagtacgggtgtcgagcctgcacagcctgaagggccttgagttccgttgtgtggccgtggccggggtgaccgcctcggcgttcccgttcccgccggcggtgactccggccgaggtcgatctgctgcagaacgcgacggacctcgcggcggaacggtgcctgctcttcgtggcgagcacccgggcgagagaggcgctgtacatgtcgtacagcggacggccgagcatcttcctcgacggggtgaggtagcgggaaagacggtgtccgtgtatggcctgtgaacaaagtcaatgctcgtgcgttgccgtagtagtctgccggtcgcgcgggaggggaaaagtggcttgatcacgcgtctttaggtgggggaaagtccgctttcattgacgaacgtccagggagtccagatgtccacgccgcgtgccgtacccgtgtctttggcggaaatcgctcgtctcgcgggcgtcgggcgggctgccgtcagcaactggcggcggcgtcatccgtccttccctgtccggatcgccggcacggacgtcaacccccagttctcactcaccgacatcgagaactggctgcgcgacaacaagaagctcaagaagtccgccgagcgcgaatggctgtggccccgcttcgaggcgctcgggggacgcgacgaaacgggggcggcggtcgcggaggtaggcagaaggctcgcgggccggggcgcggcggcgagggccgtgttcccggaagatgcgggggcgctgatcgagcgggccgtggacctcgggcggcgcgaaggaggcccggagaccttcgccttcctgctgcgccgctggctcgacgtccacgtccgccagatcaccacgacacccgagccgctggccgcgctcatggcggagctcgccaccggcgtcgcggacgtgagcagcggtgtcacggtgatggaccccgcctgcgggaccggccatctcctgatggctgcgaccgaggtggtcaaggggtcaggcggtggggcgccgaccctactgggcggcgaccgtgatcccgtactcgcggcactcgccgaagcccgcctgggcctcgccggggacgcatcggaaaaagaacccacgcgtatcgacgtacgcgcggcggactccctgcgcgacgccccgttcgccgaagcccgcgccgacatcgtcctgtgcaacccgccgttcaacgaacgggactgggggtatgaggagctggccacggacgcccgctggagccacgggctgcctccgcgtaccgaacccgaactcgcgtgggtccagcactgcctggcagggctggacccacgcgagttcgg

SEQ ID NO: 175 - DNA, 10649 bp, Unknown
  Kingdom: Bacteria, Phylum: Actinobacteria, Class: Actinobacteria, Order: Streptomycetales, Family: Streptomycetaceae, Genus: Streptomyces
gccgacggcggcgccgacgcctccaggcggtcggtggggacctggtcgtagtcgacgccgtcgacccgccgcacatgctcgggggcgcggacccacccccggtactccgcggcctgcacggtcccgtcctcgctgccctcgtatgggggcaggcccaccaggagcacccagccggtctcggtctgccgccgcctccacaaccgcgccacgatctcctgctcgggataccccagcaccggttcggcaggcagcacaacccgcaccggcacaggaccgggagcagcagggtcagggggcgtcgtcacgttcactaccgtacgcagtcggactgttagcggcgctgtccccttttgaaggggaggggactgctgcatgatcgggtgacagccgggtttatgcagccagagctgcgggtggggtcatgatggtctcgtactcgacgggggtcaatcggcccaggcgtttctggcgccgccgccggtggtaggtccgctcgatccaagtggcgatcgcgatccgcaactcctgtcgggtggcccagacacggcggtcgaggacgttgttctgcaacagtgcgaagaagctctccatcgcggcgttgtcgccggcggccccgacccgcccatcgagccgaccaggccgtgccgagtgagtacggcggcgaccttccgcgaccggaactgcgagccgcggtccgaatgaaccacgcacccggccacctggccgcgacgggcgacggctgactccagcgcggccaccgcgaggcgggactgcatccgggcgtcgatggaatagccgacgatgcggccggagtacacgtctttgaccgcgcacagatacagcctgccctcgccggtcgcatgctcggtgatgtccgtgagccacagccggttgggggcatcggcggtgaagttgcgtcgcacccggtcatcgtggaccggcggcccggccttggcgttcttgctacggcccctccgcttgccgaaggccctccaccagccgttgtcccggcagatccgccacgcggtccgctcggccatcggctcaccagcagtacgggcctcatcgagaaggaagcggtgaccgaactcgggatcgtcgcggtgcgcgtcgaacaaggcgttggcgcggtatgcctcggtcagttcggcgtcggtgaccggccggtccagccaccggtagtagggctggcgggccagcccgagcacccggcacgtcaccgccaccggcacgggtgcagcggcggcggccagctcgcggacgagcgggtacatcattttgccggcaggttcgcctgcgacagatacgccgcagccttcctgagcacttcgttctcctgctccagcagccggatgcgtttgcgggcctcgcgcagctcggccgactcacccgacgccgttgcgggcccggcgccctcgtcgatgtcggcgcggcgcagccacttcgacagcgtgatcgggtggacgccgaagtcggcggctatctgttccagcgtgacgccgggctcgcggttgcgcgcgacccgcacgacgtcttcgcggaactccttcggatacggcttggacactgcaacatccttccaggccgcctctcagcaagccaggtcaggtgtcacccaaccctgcagcagtcccgaacctcgggcagcaactcagccagctcggtgcccaggacatcgccacccgtgtccaggagctggcccaggccaacacctctctccaagcgcgacttcaggaagccaccacagccaattccagtctggaacgccgtgtcgtcgaactggaagacgagctcgcagccgctcgcaccagccttcgacgcatgatgcgcgatcggaactgaaagccctcgccggtccgacggccgtcacccccaggtggaatggcggccgtcggggcctcagcgtcccagaccgcacggagctgccgtggcagcggactattgcccgatgatcttgctcaacctaacgagactgcccaggccagccgagacgccagccaccgtcgccgcagctgccatgcccacggcattcgctccgagtgaatgaaccacaaccgctgcgccacacccctcgagtcccgacacggcggttgccgcaagtgagatcaccgcccagcgcaacggcaccctgtcgtcagacggcttcgggtcgtacatgcacatgcctatgagttcccttcgcagacaagccgaggacgctcccaggtggctcctgcctgagacgtcgttccacttcgtgcttccagtcagccagctgggaacgctctaatacacacagaggtcgcatagttcaggggggagacagatgtcgccagggcccagtgccgccgagttggaactgcttaacgacttggccagtgccggaacccacgtgagcgtcgatcagctgcgtcgatggcggcgggcccgtcttctgccgacgaatgagaagacttggggcggccccggctccacatcccgtactccagcaatcgctgccgttatcgccaaggcactggctgccgaagcccgtcaaggcaggtcgatccaggagactgcgctgagggtcttcacctcgcacctccacgtcccactcggccatgacggcatcatgtcgtccctggcctggtggatcacgcaccgtgacgacggtccagcccggaggatcgagcaggcatacgagggcgcggccacggaagaggaaggcatcgaagcggccttggcgatcgccaagcgcactgtcaggaggaggagaccccttcctggcaaggtgggggcccccgatgcaacgcatcggcaattcatggatgcgtacgcgaggatgctactcggaaacgtcctcggtacgaccatcgtgggatcagaccaccgaatggctatgtttgaggtctgggcagcctacttgctgcagcactcaagcagcgacatccaaaacagaccttcatacacgcccgacgaactcaagtcgatgggacaggagttggtagtgtcgttcgatctcgccggcgcggtcgatgatgggcctctgccattgaagcgacgccgagaggaagatcttgccctcgtccagcacatcagcccggcctctctcctttggacccgtgattctctcgccctactcgaccgagccgccaacgttctcgcggtcggagccgacgtcgtccccgacgatcaaaccgtcactgcagtcgatgagatcgttgagtccgacgatgatgcccacgtctcggccagtttcgtcctctcgttgatcgcgagaccgcagtggcttcagggcagccagcgggatctgtgggtcaagaccctctaccgattgctggacggttgccgcgacaacaacctgccaggcggccaggcagacctgagagtggccatgcgcgtgctcgaaccggtgatgctagcgctgccagagcttgtcgagcggatctaccattcgtggcctgccgaccgactggaagaccgcgacgatcgcacggatctcgacactgagatcgcggaactcaaaatgctgatccagtcgacctaccgagaaggttctctctcccgttgatcacgagatccgggctcgcagaaggcgctgcccccgcgggcccctgccgtcacgttgatccctcataggccggacgcggcacctccacctgcgactcccgtgcctcacgtcactcacagtcgtgcatgaggctgaccagcgaaacaacttggcacccctggataaccagggctggatgctcctgcacgcgggccagcggatcgaccgggctgtcctgcgcgtcccgctgatcgcccgcacgatccgcggccgggagctgaccaccggagccgtgatcggcctcgcgcgcctggtcgactgccaccgggaccccgagggctccgagccctgcacgccgtgggcgcaggccggcgcctggcacctggtcctcgaggacgttcaggagctgccgctgccggtccccgctgccgggcagctcgggccctggaagccgaccgaggacctgctggagagcgtgttccagcagttgcccggcttccggccgtgacccgccggggacgcacgaaggagaagccgccgttcgagccgggcctgattccggctcccggcgagcttctcgtctggcgcgacagccagcacttcgaccgctggcagaacctcccctgcacgctgtgcggccagcccacgcccatgcgctcccactccggcgagcccgtgcacaaggcctgcgcggagtcctggctcaccgcctaccccgttgaggcccgccgcgggcggttcgcctccgacctcacgccgaagcccaagtccgagggcgacggtgaccacgcctgacctccgcctggaggaccttcatgagcagcaccgaacgcgacgtcgaccacgccctcgcctacccggagccgccggcctccccgctccgggccgccacggcgcgacggcccggccgctcaccgacgcccagaagcgacgcaaccgcgaactgctggacatcgcgcagcgcaagccccgcaccgccgccgcgtaggagggccagacatgttcaccgaccaaaaagaggccctcgaagcggaggccctccaactcacccccctcggcagcgaccagcgcgacgcagcctcgctggtggtcgctcaccaggcccgagacaaggacgacctcaccgacgtgctgggcgcgctcggactgccctgcggtgaggacgacctcgtacgcctgctcccacacctcaccacccccgacaccaccccgaccggagatccgatgcccgtcaacgccttcaccgccaccgccgcctccatgctggccaacggcgacagccccgagcacgtccgtgaaacgctcggactgccggaggccgaactcgccgaagccctccagcacagcgaactgcccgcccccgccgaagcgggcacgcaggacagcgccagcaccccggcgcagaaggcggctgccccggcccccgtcacgacggatgccgaccagatcgaggccctgctcgcgtgggcggagaaccatggcaccgccagcatccgcaaccgggctgcccgcgttcgcagcgacctcaccgagctgaccgaccgccgcgccaccgaggcggctcagcgggaggcagaggagcgggttgccgccgccaaggccgaactcgaggccgcgcaggcgcagctgcgcaaggtgaaggccggcggccgcgccgacaccgaggaccagacccccgtccccgtggccccggccctggtcccgaccggcaggcgcagcagtgaggaactggccgcgatccggacatgggcacgtgccaacggtcaccaggtcgccgaccggggcaccccggccaagaaggtcttggacgcctacgacgccgcccaccgcaccagcctggcggaggcgagctgatggacaccaagcccctcaccgtggacggcttcctcgatgccgtcctcacccccggcgacgcgccgtacaccgcccgcttccagctggtcgtctctccccaccgacgacgccgtggacgacgtgatctggtcctgcaccaccagcaaacccgggatcacccacgcgctgctcaccgagatccagcccggcgacctgctacacgtctccggcgtcctcacccagcccggcagcgcggcggagacggcccggctcaccgtcgattccctggaggttctggccaccgcaccggcgcgggccctgaaggagatggtcctcgacaggtacggcgactacgtcgtggtgttcgacgccgacaccgatgccgtgccggtattcacggccctcgggcagtgggtcggcagggcggagagtcccgacgccatcggcacgctgatcgagatccacgagcgcgtgaatggcggtgatgcgtgatggccacgaccaccgcgcagtcccgcacggtcctggagcgattccccgctggagctccccgaggctcatggccggcggaagagtacgcggccgcccaacgcgcacagggcacggacgcccaggtcgtgatggacctgaacgccgaccagttcctcgtggtcaccgacaccacctgtcagtagcactgccccgagcgccgcgccccgtcccgaaggccggggtgcggcgctccccatttcccgccacgtcagcgcatcgagaggaccagcgtgttacccaccctcatcgcagccgccctcgccaccgtcgccaccttgctgggcgcgatcgtctccggccgcttccaagagcgcgccgccgaacgaggcgtccgtgccagccacggcgaggcaatccgccgggaccgcctggaggccgtcaccgccctcgcctgcgccgccagcgaacaccgcacgacgatgtggaggcgcggcgacgccgtcctcaagggcgccagcactgaccggctcgaagctctgcgcagtgagagccacatgacccgcagcgcggtcacccgtccgctggtcgccctgcgcgtcctcatcgaggaccaggccgtgcgcgccgccgccgaccgcatgatcacgctcacgtacgcgatccgggacgcgtacgccaccaccgaggacctgaccgccgcccgcgaggccgcgaaggtcgcacacgacgacttcgtcaacgccgctgcccgctacctgcgcccggcgagcacccaccccaccttcgagcaggagaccacccgatgatccgtcgcttccgccgctgcggccacgcccccggcgccatctcccccgaggaccaggccgtcgtcgaccagttccgcgcgatgctcaccgccctgcgcaacccgcagccctggacgcccggcagtgcccgggacatcgccgtgagggtcgggccgttcatcgagcgcgcgcacacccgacctggcgacgaccacggccccgacatgatcgccgtggccctggtccatcccgacacccagcacgccggcgcctacctccacggccgccagctcggctacaccgaacgcgtctggatgcgctgcaagacgaccgccatcctcggcttctggcagcccggctacgcgatgctcacccacgccgccgccggcctgcccctgcccggcgacgtcggcatggaacccgcgcactacgccctctacatcgaggcccgcaagcgcgacgacagcctggacggcttcaccctgctgcgcctcggtccgtacacccagacccggcacgcccagcaggactgcgaccggctcaccgccgcgctggacggacacgagaccaccctcgtaccaggacatcgcgtctccgcgcgatacgcaccgttcgacggcagcgatcaccggctgttcgccgacccgtacgaggccgacgccgtgacgcttctggacgccgccctcgcggaggtgagtgctcgacttcttggactggctcgactcccagcacatagcctcagcgggctccagcagcgacatctggacatctgggcgatcgaccggccaaccctgcgctcccgctcgatccccttcctccgctggagcacagcgcgacacctctgcccgcccggtctggtcatcgagcgcccagcctcgcaactcccaggccacttccaagccgaggacgaggcctgaaacgaaccgcggctctgcttcaacgacaccgcgttccccctggacctccgcgtcgcagctgccctcgtccgtctctacgccctgcccctgacccgcatcgtcgagctcaccaccgaccacatccgacgcgaccaggagcacacctacctggcggtcaaccagcaccccttcgtgctccccccgaagctcgcccgtctcatcgacgatcagctccgacacagcacaccccggcacagcaccacgaccggccacaggtatttcctaccaggccaaagccctggacgcccgcgtaaccccctcggtctcgctgacaccttgagacaccacggtctgcccgcccgcgcagctcggaacaccgccatgatggacgccctggtagacctaccgcccatggtcatcgccgacctgctcggcatccaccccaagacagccgaacgctgggccacgctcgccggcgaaaactggtccgaatacgtgtcctcgctgacaacgtgaccgggccaagccgtggttgcgtcatgctcgcactccagcgccccggactcctcaggatgctgtgccctctacgaggcgagcacaggccattgtcgtttcccgagagcagttggcgacaagacgggcagttcctgcgtcgagcggtgttcagcctgcggtgagctggcgggtctctactcggaggccgtggtagacctgccgcccatggtcatcgcccggcctggttccggtcagcatggcggggcggccaggacggccttggcagccagccggagattcctgatcattggattcgggtcgcccttgcggctgaccaggacgacctggctggggggagcaccctcgatcgggacggtgacgaggtcgggacgcagtgagctgcgccgatcgccgaccggtaggacggcgatcgccctgccgctcgcgacgagttcgagcttgtcctcgtagctctcaatcggtggcacgccggccccgaggatccggtaagacgtccagtccggggtctcgaacgcgcacggggccgcctcttcgtcggccagttcttccgcggtcaccgacgcgcggtcggcaaagggatggccgcgggggaccacgagcatccggggctcctcgtacaggggggtcgtggacacgttgtcggcggcgagcggcaacggggtccgcgcgatcagggcgtcgacgcgcttgtcggacagtgcgccgacgtcgcggcagctcagatgccgggtggcgatcgcggcgtctgggtgacggtggcgcagttcccgtacggcggcggtgatcaccaggtcttcgacatagccgatggtgattcgttcggtccgggcttgttcccggacggccagttcggcctggcgggcggcgtgcagcagggcttgggcttgagggaggaatgtctggccggccggagtgagccgggcgccctggggggtgcggtccagcagtcgtgtgccgagatatttctcgagccgttggatctggcggctcagcgccggctgggctacgtgcaggtcggctgcggcccggccgaagtgctggtgcgctgccaccacggtgaagtagcgcaccagccgcagttccaggtcctgtccgggatcgttcacccttgcagggtacgcgtcatgctgtttcggaatgatcaggttgccgaaccggtcttggacggccatgccgtcccgggctttgactgaaggagcaacgtttccctgagaaagcgataggcgcgatgaaggcgatccagttccacgaggcgggcgggccggaagttctgcggtacgacgaggtgccggttcccgagatcggtccgggcgagatgctcgtgcgggtgcacgcggtgggtatcaacccgccggactggtacctgcgtgaggggatgaaggtcatgccggccgagatgaggccggtgctggagttccccctcatccctggaacggacatgtcgggcgtggtcgaggcggtcgctccggacgtgtccgggttcgccgtcggtgacgaggtcttcggcatgctgcggttcccgggattcgacggccggacgtacgccgagtacgtggccgcgccggcttctgacctggctcacaagccggccggtatcgaccacgttgaggcggccggggcgccgatggccctgctgacggcctggcagtacctggttgatctcggccacgacgtgccgtctcccttcaccggccaggtgcaccagccggtgccgatcacgccagggatgaccgtgctggtcaacggggccgctggtggagtgggtcacttcgtggtgcagctggcgaaatggaagggggcacacgtcatcgcggtggcctcaagccggcacgagcagttcctgcgcaagctcggcgccgatgagttcatcgactacaccacgacggaggtcgcggacgtggtcagcggcgtcgacctggtgatcgacaccgtcggtggcccggacagttcacgcttcctgaccgtgctcaagcgcggcggcaccatgcttccggtgttcttcgcccagtacgacccggaagagacggcgcgtcttggcatcaccgtctcgaacattcaggtgcgttccaacggcccccagctcgccgagatcgggcgcctgttcgacgagggcgagctccaggtcggggtggacagcacctacccgctttccgaagcgggcagcgcacacgcgcgagccgcgcagggccacatccagggcaagatcgtgctgacggtggtctcgtgatcgccgacctccagcaggcagttgcgcactacgcccatgccctggacgagctgaatgtcgccgcgttggaagcggtcctgaccgaggacaccacctggaccttcacgatgcccggacagggggtgctcggcccggtcgccggacgcgcggcggtgctcgacttcatccgtgacgggcacacgtcccagaccggaagggtgcggcaccacctgggtaacgtcgtggtcacgacgacggacgccgccaccgccgaggtgcgggcctatctactgcagacgaggaacaccggcgagagcatccagatgatctcgaccggggtctacacgttcagcttgcgacggtccgacggtatgtggcggatcgccgagctcaccctgacgctggacaacgccttacagggcatctcaattggt

SEQ ID NO: 176 - DNA, 6103 bp, Unknown
  Kingdom: Bacteria, Phylum: Actinobacteria, Class: Actinobacteria, Order: Streptomycetales, Family: Streptomycetaceae, Genus: Streptomyces
ggtcgagcctgcgccggacgacggtggtgaccgcctcgggctgctggccggcgtccacgaccaggtaccggccggggtcggcggcggccagggccaggaagccggaccgcacgcgcgcgtggaactccgccggctccgactccaggcggtcgggtgcctcggtgaaccgctcgcgggcggtctccggggagacatccagcaggaccgtcagatgcgggaccagtccgttcgtcgcccagcgggagatgcgggcgatctcggtcggggacaggtcacggccggcgccctggtaggcgacggacgagtcgatgtaccggtcggtgatcaccacggcaccgcgctccagggcgggccgtacgaccgtgtcgacgtgttcggcgcggtcggcggcgtagagcagcgcctcggcgcggtgggacagtccctgcgaggacacgtccaggaggatcgagcgcagccgcttgcccacgggcgtggcacccggctcgcgggtcaggacgacctcgtggcccttctcccggatccagtcggcgagcgcctcggcctgtgtggacttgcccgcgccgtcgccgccctccagggcgatgaagaaaccggacccggcgggggccgtgacggggtcgtccccgccgcgcagcgcgtcgaacagatcctgccgcagcggtacgccggagcggtcgtcgaccttggcgagcaccagcgcggccaccggaagcagcagcgcgccgacgagcatcagggtgaaggcggctccgccgtgcgcgaagacgaaccggccgttctccagccggtgcgggccgatcccggccgcgaccacgggggcgcacagggcgccgacggccacgaagacccgtaccaccgcgtgcaggtgctcggtcatgcgcggcctgcgctggtcctcggcctccagatcgagcagtgtgtgtccggcgttggcggcgatgcccgcgctcaccccggccagggcgaggagcagcaggacggtggtgacgtccgggacgaggccggcggcgagcagggcgatgccggtgacggcgacggccagggcgagcagcctgcgccgcgacagcgagacgagcgccttgggcgccgtacggatgccgacgacgactccgccggtcagggcgagcaccgccagcccgtagagcaccgggccgccgcccaggtcacgggcgtgcagcgcgctgacggcgaccgcggcggcgaccgctccggcgacggcggcgcaggcgagcacgagcagcggcaccgctcccgtgcgccccttgtccactccggtgcccgtcttggggcggcgcagcccttccagcggcgaccgcgcgcgcggggtgcgggtgccgggcagctccaggtaggtcagcacggacagggacgcggcgaacagaccggccgcgacgtacgcgccgagagccgcctggtgctggtcgaaccaggtgacgccggtgcccaggaggttgttgaacagggaagcgacgaccaggacgcacgccgccagcgggatcgacaggaacgtcgtgcgcagcgacaggcggcgcagggcgtcgaggtggtcgggcagcggccggacggtggcgccctccggcggcggggcgggcagcagtgcgggtgccgcgctctcccggcacaccgtccacagccgctcggcgaccccggtcacgaagacggtgaccaggaggagagtcggtgcgttgcccggcgtccagtcgatccacaggggggcgacgatcagcagcgcggcacgcacgccgtccgcgccgaccatggtccagcggcggtcgagcgggccgtcgggtgaggtcagcgaggtgagcgggcccaggaggaccgctccggagagcagcgtcgccacgatgcggacgccgaagacgatcgccaccgcgaacgccgcgccccggtagccgccgccgaaggatccctgcgcgaccgccgcctggaggaccagcacgaccaggaccaggagcgcgagagtgtctcccacgccccctaccagctgggcgctccacagccgcttcagctggggtcggcgcagcagggcgcggacggcgcgctcgcgggagtccgccaccagtgcgtcgtcgggggccggtgggggggccgttggctgctcggctcgcgtcatgcgttcagcctatcgggatgcaccgacagcacgccgtgaccgtccgaacgtctgcgcgccccggcgggggatgtgctgccggggcgcgcgcgggaggtgcgatgtgtgaacgtgtgtgaagatccgcggcacgaggctgcggttccctaccgcgcggtgccgcgcggtaggggcagggctacggctcagtcctccgccgtcgccgccggggaggccgccgccttcttggcggtggtcttcttggcggtggtcttcttcgccgtcgtcttcttggccgcggtcttcttcgcggtcgtggacgccgtcttcttcgccgtcgtcttcttggcggcggccttcttcgcggtcttcttggccgggcccttggcgcgcttctccgccagcagctcgtacccgcgttcgggggtgatcgtctcgacgctgtcgccggagcgcagcgtcgcgttggtctcgccgtcggtgacgtacgggccgaagcggccgtccttgaccacgaccggcttctcgctgaccgggtcggtgcccagctccttcagcggcggcttggccgccgcacgaccgcgctgcttgggctgggcgtagatcgccagcgcctcctccagcgtgatcgtgaagagctggtcctcggactgcagcgaccgcgagtccgtgcccttcttcaggtacgggccgtagcggccgttctgcgcggtgatctccacgccctcggcgtcggcgccgacgacacgcggcagcgacatcagcttcagcgcgtcgtcgagggtcacggtgtccagggacatcgacttgaacagcgacgccgtgcgcggcttgaccgcgttcttgccggtcttcggggtgccctcgggaaggatctccgtgacgtacgggccgtaacggccgtccttggcgacgatctggtggccggtcaccgggtccgcgcccagctcgaagtcgccgctcggcttggcgagcagttcctcggcgagttcgacgctcagctcgtccggggccaggtcgtccgggatgtcggcgcgctggtgctgctcggtgtccttctcgccgcgctcgatgtacggcccgtagcggcccacgcgcagcacgatgccgttgccgaccgggaacgacgacacctcacgcgcgtcgatcgcgcccaggtcggtcaccagttccttgaggccgccgaggtggtccccgtcgccgttgccggcgtcggccgcaccgccctcgcccgtgccctcgccgaagtagaaccgcttcagccacggcacggcccgcgcctcgccgcgcgcgatgcggtcgaggtcgtcctccatacgggcggtgaagtcgtagtcgaccagccggccgaagtgcttctccagcaggttcaccacggcgaaggacaggaaggacggcacgagcgccgtgcccttcttgaacacgtagccgcggtcgaggatcgtgccgatgatcgacgcgtacgtcgacgggcggccgatctcccgctcctccagctccttgaccaggctggcctcggtgtagcgggccgggggcttggtggcgtgcccgtcgaccgtgatctcctcggcggccagcgcgtcgccctcggcgacctgcggcaggcggcgctcgcggtcgtccagctcggcgttcgggtcgtcggcgccctcgacgtacgccttcaggaagccgtggaaggtgatcgtcttgccggacgcgctgaactcgacgtcccggccgtcggccgcccggccgccgatcttcacggtgaccgagttgccggtcgcgtccttcatctgggaggcgacggtccgcttccagatcagctcgtagagcttgaactggtcaccggtcagaccggtctcggcaggcgtgcggaagcggtcgcccgagggacggatcgcctcgtgcgcctcctgcgcgttcttgaccttgcccgcgtacgtgcgcggctgtggcggcaggtagtcggcgccgtacagctgcgtgacctgggcgcgggcggcgctgaccgccgtctcgctcagggtggtggagtccgtacgcatgtacgtgatgtagccgttctcgtacagcttctgcgcgacctgcatggtggccttcgcgccgaagcccagcttgcggctggcctcctgctgcagcgtcgtcgtacggaacggggcgtagggcgagcggcggtacggcttggactcgacggagcggacggcgaagtccgtgttctccagggcggcggcgagcgcacgcgcgttcgcctcgtcgaggtggagggtgttcgcggtcttcagctgccccagcgagtcgaagtcgcggccctgcgcgacgcgccggccgtcgaccgtctgcaggcgcgccaccagggacgacgggtccgacggatcgcccgcgcggcccgtcgtgaaggtgcccgtcaggtcccagtactcggcggagcggaaggcgatgcgctcgcgctcccgttcgaccacgagccgggtcgcgacggactggacgcggccggccgacagccgcggcatgaccttcttccacaggaccggcgagacctcgtagccgtagaggcggtcgaggatgcggcgggtctcctgtgcgtcgacgagcttctggttgagctggcgcgggttggcgacggccgcccggatcgcgtccttggtgatctcgtggaagaccatccgcttgaccgggatcttcggcttcagcacttcctggaggtgccacgcgatggcctcgccctcgcggtcctcatcggtggcgaggaagagttcgtcggagtccttcagcaggtccttgagcttcttgacctgggccttcttgtcagcgttgaccacatagatcggctggaagtcatgttctacgtccacaccgaggcggcggacctcgccggtgtacttctcgggaacctccgcggccccgttgggaaggtcccggatgtgcccgacgctcgcttcgacgacgtagccggggccgagatagcccttgatcgtcttcgccttggcaggcgactcgacgatgacgagtcggcggccgccctgtgcggtctcgctggtcggggacaacttcgctcttctctccggtcgacgcttggtctcgctgtgtctcgctgggtctccccgggctgtggattcccgggccgggcagtgctgacgctgcggagtgtgacggtacatcccgcccccgtgtcaaacgggaaaagcccgcaacggccactcgaacggtaacccgactacagcccttcctgccgcccggagtgtcgacaggcccgttcacgcagatgcggaaggtgagctgtcggatacggggagccgaccgccgcgacggttctcacacgcccgtcaggcaccacgccccgagcgcgagggacgccagggcgatcatggtcgcgagggtcaccgacacggtctgccgcaccccgagggccaccggctgcccgcgccgcgcccggaccgcggtccatcccagcagcaccgccccgaacagggcgaacaccgtccccgcgaagatcgccggaccgctctccacgtacgtaccccccgccccggatgccctcggccgcccccggtcggggaggctggcaccctcgctcgacgagccggccaacgccgcgtgaacgccgggcggccggacgcccgcgcggcctctcgaggaccggggcgcggggcacggacgtgcggtggacggatgaccgaaaaatggccgagggaactgcgggcggggccggtgcggaggcggttctgacggcggggcggaccagcgggtggatgccggccaggccgtctcagcccgccggctcccactccgccggctccaggaagccctgctccaccagcagccggatctgcgccggggtgcggtcgcgcagcagcaccgggtcctcgccgaccagctgggcgatggcgtccaggatgcggccggcactcagcgtgccgtcgcagacgccggcgaagcccgcgccgaccgtgtccaccgtggtggcccggcgcatgccgcggtgctgccgcagcaccacgtgctccggatcctcggcaccgg

SEQ ID NO: 177 - DNA, 4214 bp, Unknown
  Kingdom: Bacteria, Phylum: Actinobacteria, Class: Actinobacteria, Order: Streptomycetales, Family: Streptomycetaceae, Genus: Streptomyces
cttcacgccagggccctgtggctgcgcgcccgactggtccgcgggctgctcgggctgggccggcggtgcggggtcggggcggccggcggcgtcggcagggccggacgcgccggattcctgtccgtcggacggggcggatccgggcgaggcccagcccggagtgtcgttcatcgtcgctccttcttggtgcccgtccgcggtcgcggcggcaggttggctgccatcgtgccatggggcggtgttcgggtgacctgccgcggtgcgggctgcgcgccttccattgtccggtcgatacggggaacactgacggcatggctgatcagtacgcgcagacccgcgaggacaaccggccgccggggattcccgccatccgctgggaggagccccctgagggacccgtcctggtcctcctggaccagacgaggctgcccgccgaggaggtcgagctggtgtgcacggacgcgcccgcgctggtggaggcgatccggtcgctcgccgtacgcggggcgccgctgctcggtatcgccggggcgtacggtgtcgcgctcgccgccgcccgcggtttcgatgtggacgacgccgccgacgcgctcgcgggggcgcgcccgaccgcggtgaacctctccctgggcgtgcaccgggcgcggtgcgcctaccacacggcgctggccgagaccggtgatccgctgctggccgccccggcggcgctggccgcggcgcagcggctgcaccaggaggacgcgcgggccagtgcgcggatggccgagcacgggctggcactgctggacgagctgctgccggccggcgggcaccgtgtgctcacgcactgcaacaccgggtcgctggtgtcgggcggggagggcacggcgttcgcggtggcgctggcggcgcaccgggtgggccggctgcgccggctgtgggtggacgagacccgtccgctgctccagggcgcgcgcctgacggcgtacgaggcggcccgcaacggtctggcgtacacgttgctcaccgacaacgcggccggttcgctgttcgcggcgggtgaggtggacgcggtgctgatcggcgcggaccgcatcgcggcggacgggtcggtggcgaacaaggtgggcagttatccgctcgcggtgctcgcccgctaccaccacgtgccgttcatcgtggtcgccccggtgacgacggtggacgagaacaccgcggacgcggcgtccatcgaggtcgagcagcgtccggggtacgaggtgacggagctgatcgctccccaggtcccggtgacggggtccggcgggggcattccggtggcgccgctcggcacgcaggcctacaacccggcgttcgacgtgacgccgccggagctggtgaccgcgatcgtcaccgaggagggcacggtctcgccggtgaccgcggaggggctggccgagctgtgcgcgcggtcgcgggaggcggcgccggggtagccggccgggctccgctgcgggcccgttggcgggcgagggcagacagtagtgactccgtgcggctatcgtcacaggccagtgagctgtctcacctggatcttcgccaccgttacaagaatgggatgatgtcgttcatgaagggacgagtccttgtcgtcgacgacgacaccgcactggccgagatgctcggaatcgtgctgcgtggcgagggtttcgagccgtctttcgtagccgacggcgacaaggcgctggccgctttccgggagaccaagcccgatctggtgctgctcgacctgatgctgcccggtcgggacggcatcgaggtctgccgcctgatcagggcggagtccggggtgccgatcgtgatgctgaccgccaagagcgacaccgtcgatgtggtcgtgggcctggagtcaggggccgacgactacatcgtcaagccgttcaagccgaaggagctggtcgcccgtatccgggcgcggctgcgcaggtcggaggagccggccccggagcagctcgccatcggtgacctggtcatcgacgtggccggccattcggtgaagcgggacggacagtcgatcgcgctgacgccgctggagttcgacctgctggtggcgctggcccgcaagccgtggcaggtgttcacccgcgaggtgctcctggagcaggtgtggggctatcgccacgcggcggacacgcgcctggtgaacgtgcacgtccagcggctgcgttccaaggtcgagaaggatccggagaagccggagatcgtggtgaccgttcgcggtgtcggctacaaggccggaccgagctgacgtgtccggggacagtgccgcttcggcgaatcccggacggtccgggtcccgcgcggggcggcctgtcggccggaagggcgcggggtcccgctggggccacctcctggagggcgggctgctgcacggtggcgtgcagggcagtccggtcctgcggctgctgctgcgctgggtgcgccggccgctgctgcccgtcatgcggctgtggcggcgcaacatccagctcaaggtcgtcgccaccacgctgctgatgtcgttgggcgtcgtgctgctgctgggtgtcgtcgtcatcggccaggtgcgcaacgggctgctggacgccaaggtcaaggcgtcgcagagccaggccaccggcgggttcgcggtggccaagcagcgggccgacgaggcggcgagcggaaccggcgacgacgccgcgggcagccctgcggacgggcattcctcgcagaacgtcatctcgtggatgagtgagctggtgtcgtcgctctccagcggcggccagggcgccttcgacgtggtcacgctgcccgcgggcgacgacggcgccggcgggcgcggtccgcgcgcctccggccaggtggatccgaccgtgagtgtccccgaggacctgcgggcgcggatcaacggcagcatgaccgccggccagagctacacgcgcatcgtctacaaggacaccgacaaggagccccagcccgccctcgtcatcggcaagcaggtcaacgatcccaacgggcacccgtaccagctgtactacctcttcccgctcacccaggaggagaagtcgctgagcctggtgaaggggacgctggccacggccgggctcttcgtcgtcgtcctgctcggcgcgatcgcctggctggtggtgcgccaggtggtcacaccggtgcggatggcggcggggatcgccgagcggctgtcggccgggcggctgcaggagcggatgaaggtcaccggtgaggacgacatcgcgcgtctgggcgaggccttcaacaagatggcgcagaacctgcagctgaagatcaaccagttggaggacctgtcgcggatgcagcgccggttcgtctccgacgtctcgcacgagctgcggacgccgctgacgaccgtacggatggccgccgacgtcatccatgaggcgcgtgaggacttcgatccggtcaccgcgcggtcggcggagctgctcctcgaccaggtggaccggttcgagtcgctgctgtccgacctgctggagatcagccgcttcgacgcgggcgcggcggcgctggaggccgagccggtcgacctgcgcgaggtggtgcggcgagtggtcagcggtgccgaaccgctcgcggaccgcaagggcacgcgcatacgtgtcgtcggcgaccagcagcccgtggtcgccgaggtcgacgcccggcgggtggagcgggtcctgcgcaacctcgtcgtcaacgccgtggagcacggcgagggacgggacgtcgtcgtcaagctcgccgcggcgggcggcgcggtcgcggtcgcggccctcgccacggcctgcagcggcggcggggcggggacggcgacgccggcgcccggtaccggcggcaccggccggagcaccgcggcgtccgccaccggcacccggagcaccggcgcccccgccgactggaccgcgctcgcccgctccctcgacggcaccctgctccgccccggcgacgcccactggaccaccgcccgccagctgtacaacacccgcttcgacggcctgcggcccgccgccgtcgcctacgtggcgcacgccgacgacatccgtacggccctctcctacgcccgcgcccaccacctgcgcgtggccgtccgcaacggcggccactcctacgcgggctggtcctccggcgacggccgcctgatcgtcgacgtgtcgaagctcgccacggtccgggcgagcggcacctcggcagtggtcggcgccggcgccaagctcatc

SEQ ID NO: 178 - DNA, 2318 bp, Unknown
  Kingdom: Bacteria, Phylum: Actinobacteria, Class: Actinobacteria, Order: Streptomycetales, Family: Streptomycetaceae, Genus: Streptomyces
gccttcctaccgccatggaccgaccgcacttcatcggcatcggcggcgccggaatgtcgggcatcgccaagatcctcgcccagcgcggcgccgaggtggccggcagcgacgccaaggagtcggcgaccgccgaggcgctgcgcgcgctgggcgccaccgtgcacatcgggcacgcggcggaccacctcgcctccgacgcctcctgcgtcgtcgtctcctcggcgatccgcccggacaacccggagctggtccgggccgccgagctgggcatcccggtcgtccaccgctccgacgcgctggccgcgctcatgcacggcctgcgcccgatcgcggtggccggcacccacggcaagaccaccaccacctcgatgctggcggtctccctcaccgcgctgggcctggggccctcgtacgccatcggcggcgacctggacgcccccggctccaacgcgctgcacggcgagggcgacatcttcgtcgccgaggcggacgaatcggaccgcagcttccacaagtacgcgcccgaggtcgccatcgtcctcaacgtcgaactcgaccaccacgccaactacgcctcgatggacgagatctacgagtccttcgagaccttcgccggaaagatcgtccccggcggcacgctggtgatcaccgccgaccacgagggcgcgcgcgagctgacccggcggctggccggctcggtgcggacggtgacgtacggcgagtccgacgacgccgacgtgcgcgtcctgtccgtcgtgccgcagggcctcaagagcgaggtcaccgtcctgctcgacggcaccgagctgaccttcacggtctccgtccccggccgccactacgcgcacaacgccgtcgccgcgctggccgccggcgccgccctcggcatcccggccgccgaactggcccccgccctggccgcctacaccggcgtcaagcggcgcctccagctcaagggcgaggccgcgggcgtccaggtgatcgactcctacgcccaccaccccaccgagatgaccgccgacctggaagcgatgcgcgctgccgcgggcgacgcgcggatcctggtcgtcttccagccgcacctcttctcccgcacccaggaactgggcaaggagatgggccagtccctcgccctcgccgacgcctccgtcgtcctggacatctacccggcccgcgaggacccggtccccggcgtcaccagcgaactgatcatcacctccgcccgggccgccggcgccgacgtcaccgcggtccacgacaaggccgaggtcccggacgtgatcgcgggaatggcgaagcccggtgatctcgttctcaccatgggcgcgggcgacgtcaccgacctcggaccgcgcatcctggaccgactgcggcagaactgagcgaaggaagggctgagggctcatggcgtacgacgtggacaagccggacgagcagtggcgcgcggagctgaacgaggccgagtacgccgtgctgcgccaggccgcgacggagcccgccttcaccggcgagtacaccgacaccaagaccaagggcgtctactcctgccgggcctgcggcgcggagctgttcacctccgacaccaagttcgagtcccactgcggctggccgtccttctacgacccgaaggacaccgacgcggtggaactcctgcgggacgactcccacgggatggtgcgcaccgaggtgcgctgcgcccgctgcggatcgcatctcgggcatgtgttcgagggtgagggatacccgaccccgacggaccagcggtactgcatcaacagcatctcgctgcggctggcgccgacggagggctgagccggggcccggccgggcccctctgcggcaccgtccggtgccctctgcggcactttgcggtggcccgtcgcagtgggacactggacaatatgggacacaggtggcgctaccggcgccacccattgtttcgccgcatctccgcagaggcgggtggaagacatgggcacagcctccaacgtcgtactggccgtggcaccgcacgtgtgggccacgctcggtgccttcatcggcgggctcatcatcgtggtggcgctcgtctgggccgtcggcatgggcatcggtgtgatgcgccgcgaaccgaagcgacccgagacgtccgaccagccgcatctcccggtcaccggcgccgtcgaggagatcagcgagaagcgcgagcccgacgaggtgcactgcggcgaggacggaaagcggatcctgccgcacgaactgcacgccgcgagcacccggcgcagccaggaccagcaccgcagccgctgggccccgggcagcagcggatccttcggcag

SEQ ID NO: 179 - DNA, 3865 bp, Unknown
  Kingdom: Bacteria, Phylum: Actinobacteria, Class: Actinobacteria, Order: Streptomycetales, Family: Streptomycetaceae, Genus: Streptomyces
cgtccttggtttcctgccagagtgccgggtcggaggtgacgacgagcgcggggccggcggcgtcgaggaccgcctgggcggctgtcggacggcggctctccctggggagtgtgggccgcgcggtgcccggcagcgagggctgcggtcccgtggggcccgccgggaccgtgacgggcgctgtgggcgccatgggggcggtctgggcctgctggagatgcgaggcgggagaggcgggcgaggccagggtttccggctctggcgtctgctgtgacggctgcgcggccaccggctgctgttgaccagggccggaaggcgccctctgggcgggtacctcctggggggccggcgcggggttgtcctgcggggtggtgcgggcggccgcggctgccgctcgccgccttgcccgtcccgcgcgccatctcgccgtcgttcccatgacgaacaccgtcaggacgaacagcaccatcagctggccgatgaacaggccccagaacagcccgtagccggagaggctgcccggcggtgtggcgggccaggcgcccgggatgtcgtgcggttcggcgatgaggtggcgcatcgccaggggcgtccgggtgaaggtgacggccgacggccaggagccgtgcgagaacaggccggccaggccggtcgccgtccagaccagcacggtcatgccgaggaggaaggcgagcagcccgatcagcaggccgtccgggatgccgccctggccccggcccttcccctggtcgcggtcgtcgggtctcacgggtgcccgcctctcctacgccaccgtcgactcggaggagccgcccaggtcggggacgtgctgttccacgaaggcggcggcccgctgctcggcctccagctcggcggcccgcagggcgtcgtcggcggcgaggtggtcgtgggaggactcggtcatggcgcggtcggtgaagaccagtgggcgttcggtctcggtgatcaggtgtttgacgacctggacgttgccgttgacgtcccagacggcgatgcccggggtgagcgtcgggatgatctccaccgcccagcggggcaggccgagcacccggccggtggccctcgcctcgtcggccttctgggcgtagatggtcctggtggaggccattttcaggatcgcggcggcttccttcgccgccgcgccgtcgacgacgtcggacagatggtggacgacggcgacgaacgacaggccgagccggcgcccgaacttcagcagccgctggaacagctgggcgacgaacgggctgttgatgatgtgccaggcctcttcgacgaggaagatgcgcttcttgcggtcggggcggatccaggtgtgttccagccacacgccgacgatcgccatgaggatgggcatggcgatggagttgcggtcgatgtgggacaggtcgaagacgatcaggggcgcgtccaggtcgatgcccacggtcgtcggcccgtcgaacatgccgcgcaggtcgccgtcgaccaggcggtccaggaccagggcgacgtccaggccccaggcgcggacgtcgtctatggcgacgttcatcgactcggccgactccggttcggggtggcggagctgctcgacgatgtcggacaggaccggctggcgctggacgatggtctcgttgacgtaggcgtgcgcgaccttgagcgcgaagccggagcgctcgtccaggctgtggcccatcgcgacctcgatgatggtgcgcagcagcgcgagctggccggtcgtggtgatcgacgggtccagggggttgaggcggatgccgtggttgagggcggccgtggggtcgaggcggatgggagttatccccagctcctcggcgatgaggttccactcgccgacgccgtcctcgccctgggcgtcgaggacgacgacctggcggtcgcggaagcggagctggcgcaggacgtacgtcttctccagggccgacttgccgtttcccgactccccgaggaccagccagtgcggggcggggagctgctggccgtacagctggaaggggtcgtagatgtagcccttcccggagtacacctcgcggccgatgatgacgccggagtcgccgaggccgggcgcggccgtgggcaggtagaccgcctgggcctggcccgtggaggtgcgcaccggcagcctggtggtctcgaccttcccgaagaggaaggacgtgaaggcgtccgtgagtgcggtcagcgggtcccgcatcagagcatcagcccctaccgtcggattccggtggcgaacgggagcgtgttcacgaaggcgcggtggtgctcgcggtcgcaccactccagtttcaggtacgactttccggccgaggcgcggatggtgcgcttgtcgcgggccagggcctcgggggtgcgggaggagacggtgatgtagccgacgaggttgacgccggcggcgccgctggcgaggtcctcgccgcgctggtcgaggcggtggtgggcctggacgtcgcgcgggtcgacggtgcggttcatcttggcggcgcggctggcctcggcgacgtcgttggtcttctcggtcagcatgcgttcgatggcgacctcggtgggttcgaggtccatggtgacggcgacggtgcggatgacgtccggggtgtggacgaggagcggcgccaggaagttgacgccgaccggggtcatcggccactccttgacccacgcggtggcgtggcaccagggctcgcgggtggtggactcgcgggtcttggcctggaggaacgtcggttccatggcgtccagttcggccggccaggcgttgcgctgggtcatcgcctggatgtggtcgatcgggtggtccgggtcgtacatggagtggattagcgaggcgagccgtccctggccgagcggctgccgtacgcggatgtcggcctcctggagccgggagcagatgtcggtcagctcgcgggccatgacgacggcgaggcccgcgtcccggtcgagcttgcggccggactgggggcgggcggcgcgggccatcgcgtgggcctcggcgccgagttcgcgggtgaagtgcatgcaggcgacgaggtaggcgcggtgctgctcgctgctggtggagaccatggactggagctggtcgtaggactgctggagccactgcggtgagcggctgtcgccgcgctgggcgacgtccttggcgtgggcgtcggggtcggcgggcagggtgcgggcgagcatctgcaggcgggtgacgaagccgtcgccgttggccacgtgcttgagcagggtgccgaaccggtcgaccagggcctcctggtcctcggagtcgcgcaggccgacgccggggccctcgatctcgatggcggcggtgacggtcttgcggtcggcgtgcagcaggacggcgatctcgtccgggccgaacggtgccgcgagccaggtgatccggccgatgccgggcggcgggccgatctcgatctcgcggccgtcggtgcgggtgccggcctccatgacgccggagcggtagacggcgccgcatttgacggtgcgcttgaagctgcggttgatctcgaaccacttgtagaaggtccggtgccggtagggcacgtagacggcggccagggccagcagcgggaagccggccagcaggacgatgcgcagggacagcacggggacgaggagcccgcacatcatgccgatggccgcgccggcgatgatcagtgcgatctcgccggtctcgcggttgcggccgacgatggcgttcggccgggcccggccgatcagatatgtacggcggggcgtgaccgcgggggacacgtgggactcggtcgtcaacgcccttcacctcccgtgcggttgctgttgcgggtgttgcgggcgtgcggggtgttcaccgggctggaggaccggggagcgg

SEQ ID NO: 180 - DNA, 21362 bp, Unknown
  Kingdom: Bacteria, Phylum: Actinobacteria, Class: Actinobacteria, Order: Streptomycetales, Family: Streptomycetaceae, Genus: Streptomyces
ggcgggcagcgcgcgcagtcgctggtgcggcagggcgtgtcccagggccgaccgggccaccgctcggcccggcacgagacggtgtcaccgaggggcaggcaggcacggagccggccggccgtcacggccgtgtatgagccagtcgccgtccaccggttcactccaagccggggggcggccgcgtccctgcgccgctcgcgcgtggcacggcgctgcccgggcgtccacggagaccgtgacaggctgagcccgtggagccgaagtcgggagccgagccctgcccggacgggggccagcacaggccggacgggagccagcacatgccggatgagagcgaggacatgacggagagccggagcggcgcgctgctgcttgtgatcgtcgacggcgccaacgtcgtcggctcggtgcccgacggctggtggcgggaccggaagggggccgccgaacggctccgggaccggctggtggcgtacgcggagcaggggcttgccgagcgtgccggaccggtggaggtcgtcctggtcgtcgagggggccgcgcggggcgtcacgtccgttcccggggtccgcgtcgaggcggcgtccggcagcggtgacgaccgtgtcgtcgaactggtcgaacaggccggtgaccggcccgtgctggtggtgacggcggaccgggagctgcgccgccgggtcgcggagctgggcgccgaggtcaccgggcctcgggcggtacgcggctgatcctgtagtcccggtatccgttggccagccgcccgggcatgagcaagcccagcgattcgtaggagcgcaccgcttgcgtcgtcacgcccgcgcggcgggccagctcactgatctgcatgcctctcacctcgccgaacgctgaaccttgcccctgagggcaaggtcaagtcgagggggcgaggatgctccactgtccgagccctgggcctgccgacgagcctcgggcgccgcaggcaccgcgcgcaaggaacgacggccaagacagctccggggcgctggtcaaggccactcgttgatggctgcgaccagcacgggcggcctcgtggcgcacggccgacttgccgtgtctcgtggccaccgcgcgggtccgccgccgtgtgccgtcgatcagctgccgacgcgtccacgtccgcggcccgccggccttcttccccactggcagcgacggctccggtcaagcccgctggcggcccgtcaggtcccctcgcgccgcaccgtgatcgtcacaatccaagatccacgttcggcacaggccctaggcccgtccctcctcccccgtttccgcgcccgtgccccggctcgccgccgcgcgggcccgctcggccagccggctgtgcgagcgcccgtagaggaagtagacgacgaagccgatcgccatccagatgccgaagcgcacccaggtctccgcgggcaggttgagcatcagccacacggaggcgcagaccgagaggaccgggacgaccggcacccagggcgtgcggaaggcgcggggcaggtcggggcgcgtgttgcgcaggatgatcacgctgatcgcgacgacgacgaacgcgaacagcgtgccgatgttcaccagctcggccagcacgctcaggctggtgaagcccgcgacgacggcgatgacgacgccgaggaggatcgtcgggcggtagggggtgcggaagcgcgggtgggtgtgggagaagaagcggggcagcaggccgtcgcggctcatcgcgaagaacacccgggcctggcccaggagcaggatcatgcacaccgtggtcaggccgacggcggcgccgaaactgatcaggccggcgaaccaggggtgcccggtggacttgaacgcgtcggcgagcggcgcgtccacggacagcaggttgtacttctgcatgccggtcaccacgatggacacgccgacgtacagggcggtgcagatgaccagggagccgaggatgccgcgcggcacgtcgcgctgcgggttgcgggtctcctcggcggcggtggcgacgacgtcgaagccgatgaaggcgaagaagacgacggaggcggcggtgaagatgcccatgacgccgaagtcggagggcgcccagccgaccatgagctggatcagcggggccttgaggctgcttcctgcgggcaccggctgcggtttcgggacgaacgggtggtagttggcgcccttgacgaagaacgcgcccgcgatgatcacgacgagcacgacggccaccttgatggcgacgacgacggtggtgacccgcgcggagagcttcatgccgaggacgaggatggcggtcaggaccaggaccagtgcggcggcgaggatgtcgaagccgaacccggtggcgccgtcccggccgccgaggtaggcgggcaggtgccagcccgcgttgtcgagcagcgagtggacgtagccggaccagccgacggacaccaccgccgtaccgagcgcgagttcgaggaccaggtcccagccgatgatccaggcggggaactcgccgagcgaggcgtaggagaaggtgtacgccgatccggcgaccgggacggcggaggcgaactcggcgtagcagagtgcggcgagcgcgcagaccacgccggcgacgacgaaggagagcgccacggcagggcccgcggtgttcctggcggccgtgccggtgaggacgaagatgccggtgccgatgatgacgccgaccccgaaaaccgtcaggtcgagggcggacagggacttccgcagcgcgtgctcgggttcctcggtgtcctggatcgactgctcgacgttcttcgtcctgaacagcgaattgctcacgggcctacctcccacgctggtcgcctcgacctggctcgacgtgatcgagagggctggggatgcgtatgccccggcactggcaggttcacgcaacaggaccggttccgccacccgtgggagggggcgggaccggtcctgtccgagcgtgcgggggcgcggccggctcagtcgcgagcgggctgtaccgccgagtcgacctcggcgcccggccgggcgaagcggccgtccagctcggagaccaggccggtgacctgacgggcgatgtcgggcgcggtcaggccgatctcggccatgacctcggcgcgcgaggcgtggtcgaggaagcgcggagggatgccgaagtcgcgcagcggtacgtcgacgccggcgtcgcgcagcgcctgggcgatggtcgagccgacaccgccgacgcgggagttgtcctcgacggtgacgaccacgcggtgccgctccgccagcggggccatggcctcatcgacgggcttgacccagcgcgggtcgacgacggtcgtggagatgccctgtttgttcagtagtgccgcgatctccaggcacatcggggcgagcgcgccgacggagacgaggagcacgtccggggtgtcggtgccgggctcgcgcagcacgtccatgccgccgacgcggccgacggcgggtacggcggggccgacggcgcccttggagaagcggaccacggtgggcgcgtcgtcgacctggacggcctcgcgcagctgggcgcgtacctggtcggcgtcgcgcggggcggccaggcgcaggcccgggacgacctggaggatcgacatgtcccacatgccgttgtgcgaggcgccgtcggtgccggtgacaccggcccggtccaggacgaaggtgacgccgcacttgtgcagggcgacgtccatcagcacctggtcgaaggcgcggttgaggaaagtggcgtacacggcgaagacggggtgtacgcccgcgtgggcgaggccggcggcggagacggcgccgtgctgctcggcgatgccgacgtcgtagacgcggtcggggaaggccttggcgaacttgtccaggccgacgggctggagcatggccgccgtgatggcgacgatgtccttgcgttccttgccgagcctgaccatctcctcgccgaagacggaggtccagtcggcgccggaggcggcgatcggcaggccggtgtcggggtggatcttgccgacggcgtggaagcggtcggcctcgtcctggagggcgggctggtagccgcggcccttctcggtgaggcagtgcacgatgaccgggccgccgaagcgcttggcgcgcatcagcgcggactccagggcctcgatgtcgtggccgtcgatcgggccgacgtacttgaggcccaggtcctcgaacatgccctgcggggcgatgaagtccttcaggcccttcttcgcgccgtgcagcgtctcgtacagcggcctgccgacgaccggggtgcgctccaggacctcgcgggtgcgggcgaggaagcgctcgtagccgtcggtggtgcgcagggtggcgaggtggttggcgaggccgccgatggtgggcgcgtaggagcgctcgttgtcgttgacgacgatgacgagcgggcggtccttggcggcggcgatgttgttcagcgcctcccaggccatgccgccggtcagggcgccgtcgccgatgaccgcggcgacgtgggcgtcgcgctggaggatctggttgcccttggcgatgccgtcggcccagccgaggacggtggaggcgtggctgttctcgatgacgtcgtgctcggactcgccctgcgaggggtagccggacaggccgcccttcatcttcagcttcgagaagtcctggcggccggtgagcagcttgtgcacgtaggactggtggccggtgtcccacagcaccttgtccttgggcgagtggaagacgcggtgcagggcgatggtcagctccaccacaccgaggttggggccgaggtgaccgccggtcttggacacggcgtcgaccaggaaggtccggatctcctgcgccagctggtccagctcctcgatgctgagccggtccagatcgcgcggtcccctgatgcgggtcagcagcggcacccgtgcctccttgcagtagagctgatcgagctgttgccgggcttgtcgagtctaatgttccgcctgagcgccccgtgtccgggcggtgcgtcgtaggtcacgcgaacggctgtaccccggcgcgggcccttccatgggggccggttcagacttccccgcacggctgtgcccggcaccgctccggcgccgggcacaggtgttcggtccgggcgcggtcaggcgcgtccggccgtcttctgggtcttgcgggtgaccgagtcgatgacgaccgtggccagcaggaccgccgcggtgatcatgtacttcaccggctcggcgatggactccagctggaggccgtactggatcgagacgatgaccagcacacccaggagcgcgttccaggtgcggccgcggccgccgaacagggacgtgccgccgatgacggccgccgcgatggcgttcatcagcaggtcaccggcgccggcgctctggttggcggaggcgatcttggaggccaggaagagaccgccgacggccgcgaacccgccggagatcgcgaagaccgagatccggatcgcggtgacgttgatgcccgcgcggcgggacgcctcgacgctgccgccgagcgcgaagaccttgcggccgtaggcggtgcggcgcagcaggaagtcggtgccgatcaggaacaccaggaagatcaccgtggccagcggcagccccttgtactggttgtacatgaaggcggcggcgaaggagaccacggcgagcaggacggtgcgcaggacggtgtcgctgagcggccgggacggaatgcccgcggcctcgcggcgccggttgccgaggaaggaggtgacgaagaacaccacgaccacgatcagcgcaaggccgtaggcggcggccacgtccgagaagaagtacgtagtcagcttgccgatcaggccgtcgctgtcgaggttgatggtgccgttctcgccgaggatcttgagcatgaagccgagccagaacagcagtccggccagggtgacggcgaaggcgggcgcgccgagcaccgcgaagaagaagccgtgcagcgcgccgatggccgcgccggcggcgacggcgatgagcaccgcggcccactcgggccagccctggttgacggcgaggacggcggccagggcgctgccggcgccgctgacggagccgacggacaggtcgatctcgccgagcagcagcacgaagacgatgccgacggagatcatgcccgtgccgaccatggtgacggtgatgtcgctcaggttctgcgcggacaggaactgggagttgaggctctggaagacgacgcagatgatgatcaggccgaggatgaccggcagcgagcccagttcaccggccttcatcttccgcttgaactcgccgaagtagcccgcgaggccctgctcgcgcaccaggaggcgcgggtcgaccgcggtcaccgcggcggccgcggcctcggtgttctcgacggactgctcgtcctgcgcggtggcggaggtcttgtcgatgctcacttggatacctccccgttcgcgcgcgccgcacggcgggtcacggcgttgtcggtggcgccggtgatggcggagatgatctcctcctgcgaggtcgtcttgacctcgaagacgccgttgttgcggcccaggcgcaggacggcgaccttgtccgccacggccttcacgtcggccatgttgtggctgatgaggatgacggcgtggccgcgctcgcgcagccgctcgacgaggtcgaggacctgtgcggtctgctcgacgccgagagcggcggtgggctcgtccaggatgaccagcttgggctcgccgagcatggaccgggcgatggccacgacctggcgctgaccgccggagagcgaggcgatcgggatgcgcacgctcgggatgcggatcgacagggtgcgcagcagctcctgggagcggcgctccatctcgacctcgtcgagcacgccgaagcgccgcagttcgcggcccaggtagaggttgccgacgacgtcgatgttgtcgcacagcgcgaggtcctggtagacggtcgcgatgccgagattctgggcgtcgtagggccggttgatctggacgcgcttgccgtcccactcgatggcgccctcatcgatggggtgcacgccggcgatcgtcttgaccagcgtggactttccggcgccgttgtcgcccaccagggcgaccacctcaccggcgtggacctcaagctctacgtcggtgagcgcctgaacggcaccgaaccgcttggagaccccgcgcaacgccagcacgggcgtagcggacacgtgaaccatctccttcgccgcctgacccggcgggaggttgtgcagaagtttggggggatgttccgtccggcaccccgcgccgagcttgcggggctgaatggtgcgcggggcgccggcggagccatggggcggccggggtccgcaggggaggtctcgggtgaggtcccgtacgcgggccggggtgggccgctcggtcacggaccgggccgctgtgcgcgggcccggccggaacgcttacttgacgccgtacttgtcgcagtaggtcttgtacttgccggtgcagatctgggcggcggtgtagaagccttccttgatgaccgtctggttgacgttgtccttggtcagggagatgaccgggaccagcagcgccgggacgcccttggcgctgtcgctgtccaccttggtcttggcgatggagtccaggcccgtgcccttggcgagggcgaccgccatctcggcggcgacattcgcctccgtcgggtaggacttgaagatgctcatgttctgctcacccgcgaggatgcgctgcacaccggcgagttcggcgtcctggccggtgaccgggacgttgatgcccgcggccttcagggcggtgatggcaccgccggccatgccgtcgttggcggagtagacgcccgcgatgttcttggcgccgatcgcggagatcgccgcctccatctcggagttggcgttgtccggcgaccactccttggtgtcgtactccttggcgatggtcaccttgccgtcgagggcggagtgcgcgcccttcttgaactgggcggcgttcgggtcggtcaccgagccgttgatcatgacgatcttgctggacttggtggccttgctgcccatggccttcagcagcgcctcgccctgcgccttgccgacctcttcgttgtcgaaggtggtgaaggcgtcgatcgggccctcggccagccggtcgtaggcgacgaccttgatgccctggtccttggccttctggacggagttcttgatggccttggcgtcgaccgcgtccacgatgagcacgtccaccttgttggtgatcatcgtgtcgacctgctggctctgcaggttcgcgttctgctgggcgttgttgtagaagaccttggccttgttgttcgtcagctccttgatcttcttctcgatcaagggcttgtcgaactgctcgtaccgcgcggtcttgttctccggcagcagcagaccgaccttgatgtcgtcgcccttcttggcggcgggcgccgacgacttggaggagtcgctgtccttggactccttggcactgccacaggcggcgagcgagacggccatggcaccagcggcaacggcgaaggccgcacgacgcatacgcgtgttcacttcctcaaacctccctgacgaggccgcgtcgttgcggccgaggtggctggaagtcaactcggccacgcgtgcgacgtcaagaagtaaatccttaacgagatgacaacggtgccatacgttgtctaagtgaaggcaggagccgccatggccagggttccgtccaaaagggtggaatcgcccatctcgctgagcgcgagggcgagcgcgccgagcacctcggcacggccgccaagtgccccgggcagcacggacagttggcgcgcggcgctggggatggcgtagcggcccaccgactcccggatgggcccgaggaccagctcgcccgcctccgcgaggtcgccgccgaggaccacccggctcgggttgagcaggttgcagagattggcgactccgctgccgacgtgccgcccgacgtcggcgatcacccgccggcacccggggtccccctcgcgcgccagccggacgacgccctccatggtcagctcgctgccgtggctgggccgcagcagcggcaggacgtagcgggcggcggtgaaggtctccaggcagccgcggttgccgcagcggcagaccgggccggcctcgtcgagcgtgatgtgcccgatctcgccggccgtgccgccgggcccgcggtagatcttcccgtcgatcaccagaccggcgcccacaccgctggcgatcttgatgtacgccaggtcgcgcaccccgcgcccgctgccccagaccagctcgcccagggcgccgaggttggcgtcgttgtccacgtgcaccggcacgcccaggcgcccgcgcagctcctcggcgggcttgatgccgccccagcccggcaggatggccgtggagccgagcgtgccggactccacgtcgatcgggccgggcacgccgaggcccactccggcgatcttcgagcggtccacgccggtcgcctcgatcaggcggttgaccagctcttccgcccggtcgaagccctcgccggcggaggcgtccacgtccagcggctcggactcctcggcgagcacctggtgggcgaggttcccgatcgcgacccgcaaatgggtgtgcccgaagtcgacgccgatcacgatcccggcgtccccgctcagcgagacgctgcgcgcccggcggccacccgcggacgtgggtgtgacctggaccgttccgccgtccttcagctcccgcacgatgttggagaccgtcgccgcggacagacccgtggtccgcgcgatctccgcctgggtgagggatccggcaagacgcacggcacgtacgacccgctccaggttggctcggtgcagcgacgactgcgaccctggagtctccacgacgacctcctgcgcgcggggccgctccgatgaggccccgtccatgtccaacaagtgaactctaagatgagccgttcggggtgtctcgcgtcaagaggttgaaccgtttccgggtacatgaaacggcacgcggacctgcggtggcatgcgccgggcagcgcccgtcccggcccgccgggcagcgctcgtccccggccgccgcccacgccgaagccgcccccggcgggccgggagcggctgtggacggctgggccccccgcagggggcccgggaggctatttcagggcgcctgccgtcaggccctgcaccacctggcgctggaagatgatgtacgccgcgaggaccggcagcatcgccatcaccagaccggcgaagagtccggaccagtcacccttgtagccctggctgacggccagctggaccaggccctgggtgagcacgcgtttgtccgggtccgtgttgagcacggtcggcaggatgtactggttccactgccccaggaaattgaagatcccgacgctgatcagacccggcttcgccatcggcagcatgatctggaagaaggtccgggtgtgcgaggcgccgtccacgaatgcggcttccgccaccgaactgggcagtgaccggaagaacgccgtcaggaagaacaccgtgaaaggcagcgagtaggcgatgtagaccaggatcagcccgtggatggtgttcagcagccccatgttgttcacgacgtagaacaacgggaccagcgccagaatgaccggaaaactcattccggcgatgaacaggtagtagatgaaccggttgcccgggaactcgaagcgggccagtacgtaggccgccatcgagccgaggaccagggtgccgatgagcgatccgccgaccaccaggacggtgttcaggaagtagtcgctcatgtgcgcgtcgttccacgcccgcgaccagttgccgaagtgcagtgtgtcgggcagcgcccagggcgagctgaagatggcgccgtcggacttgaaggacgtcatcaccgcccacaccagcggcaggacgaccatgatcgcccagatgatcaggaccccgtgcgagaagacgttgaggacaccgccctccttcttctgccggggcggcttcttctccgggccggtcttgccgacggcggtgccggtcccggccggtacgggggcgggggtctcggtcgtttccatgatcagaactccagccgctcgcgccggcccagcttcatcacgacggccgagaagagcagcgtgacgaccagcagggcgacgccgatcgtggtggcgtaggcggcctggccgtcacggaacgccttctggtacacgtacaggaccatgacggtggtcgagtagtcggggccgccggggccggtcgtcatgatctgtacgaccgcgaacgactcggcgccgagcgcgaggatgcccatgtagacccagccggactgcacggtgtcccacagcagcggcagggtgatgcggaagaacgtggtgaagcggctcgcgccgtcgagcagcgcggcctcgtacaggtccgccgggatggaggccatggccgccgagaagaggaccacgaagaagccggtggtcgaccagacgaggacggccatcacgcaccacagggcgaggttcgggtcgcccagccacagcggctggagactgccgagcccgatcccgcgcagcagcgagttgatcgctccgctgtccgggttgtacgcgaaggcgaagagcagggcgacgatggcgatcgacagcacctgcgggaagaagtagacgatcttgtagaaggaggagccgcggacaccgctgatggccgggccgcccttcctgcgccgtccgccgacgttgatcatgaaggagaagaacagcgccagcccgatcgtcaccaccggcagcaccagggcgaacagcaggctgtgctgcaacgacttccagaagatctcgtcgtcgaacatcctcttgtagttgtcgacaccgaccatcttgaagtcgggactcaggccggtccagtccgtgaacgagtagtagatggactggatgaacggccagacgacgaagagcgcgtacagccccaggggtaccacgaggaaccccgcgatgaaccggtacttgccgtgctgcattgctagcgaccccgatctgaagggcggacggtgccgccagggtccgcccggcggcctgaccgaccgccgggcggaccctggtgacgtaccgtcactggtgcttgtagtgcttgatcgacgtgtccttggcagcctcgtcggcgaagccctggatcttcttgatggtctccgccggggtggcgcggccggccatcatctcgcccagaccggccacaccgatcttctccttctgcagctgcacgtaccagtcctgcaggcgcgggttcagcacgttggagccggccttgtccagcgcggccacgccggacttcagaccgggcgtcaggtcgatgccggtggtgccgccgttgtacgcggtcagcgacttcaccttggcggtgaagttcttggaggaggcctcgctgagcatgatgcgcagctgttccatgccgccctcggtgttcgcggccttggccgggacgatgaagggctcaccgccggaggcccagatcgtgccgaacggcatcttgtcggagctgtcgatgccgctgggcgcggagacggcgaggttgaagtccgacgggatgacgttcgcggactcgttctccacccaggagccgttcgggatgaacagcgccttgcccttggcccacgcggtctgcgactggatgtggtccaggcccggggtgcccttgaggatgaagccccgctggtacagctcgtagtacgcgtcgaagcaggccttgaccgccgggtgcttccaggcgttcggctccaggttgtcgatggcgtccagcacctcgcggccgccgaccttgccgatcatcgggtacagcgagaacgggaggtagtacgggtacttgcccgcgtaggtccagccggccatgcccttcttctgggccttctggcagaccttgatcatctcgtcccaggtctcggggtacttctcgtccagcgagtcaagggccttctgggagtaccagacgccgtagaccgtgtaggcgtagtagaggatccagaccggcttgccgtcgaactggcccatctccacgatgcccggccgcagcgtgtcgcggaccttcttgctcgggtcgtcgtaggagggggcgtccagcagcggggtgaggtcggcgagctggctcttgccgacgaggacacccatgtccatctgctcggcgccggagttgtcgatgaggtccggcgggttgccctggttgaagcggggctggagcgtggactggatcttctgggtggtgctgaacttgaccttcgccttcgggaagttcttctgatagatctgggtggcgtccttggcgtactccgagccgaagccgccgtcgaacaggacgaattccatctgcgcggtgtcgttgacgccgagcgggttcttcgccgtcttcttgcccgccttggccttgtcctggccgtcgccaccgccactggcgcacgcggacaggaagctcatcgcgggtacggagaccagaccgagggccgcggacctcttgatcagggaacggcggccgacgcccccgtggttctcggcggaagtggatcccatgcgcaagtcctcgccttctccaggactcaggcggtgaaccggatcctccccggcaccgcggtaggccaagctgggtcgtgcaataagtacttcgtgcgtcatctaccgggatggctgggaaaacaaggaggccgacgcgtttcgcacgtcgaaccacctttccggctccccccgggtccgcccgccggccggtcgaacggcttaacggacgccgacaggtatagtccacttcaggcggacggagcaagatcgaacgcaaggttcactgtcggtcttttccgagttgagacctcacggaaatatgaaccccctgtggggggccttgacggaaatatccgggacttcacgcccgaatgccgcacccaacacccttgacatcacaggccacttgactccctactggtgcttgcgccgaatttgacaacgttgtccggcgcttgggagaaccagggagggtgccctcgtatgcagcgcagagtacggcacagatggggtccggcggtcgtcgtcacggccgccttcgtcttggccgccggttcccagggggcggcggtcgccctgcccggcaaggccccggcggccgaccgggagttcacgtcctcgttcgagtccggcgacccggcaccggactgggtgagcacggtcgacaccgcgccgggcggcggcaagcgcgcctcgggcgtggacggcggctacagcaccggtatcccgggcaatgtggacgaccatgtcaccggcctgagggccagcgccgagaacaccggctccggcgaggtcaaggagaacctcgtcgacagcgatcccggcaccaagtggctcgcgttccagtccaccggctgggtggaattcgatttcgacaaaccccagaaaatcacgcgatacgcgctcacatccgccaatgaccacgacgagcgcgacccgaaggactggacgctgaaggcgtccgccgacggcaaggactggaagaccgtcgacagccgctccggcgagtccttcccgcagcggttccagacgaagacgtacgacctcgccgcgccggccgagtaccagcacttccggctggagatcacgaagaacaacggcggctcggacatactccagctcgccgatgtgcagttctccaccggcgccgacggcgggaccgtcccgccggacatgctcaccgtccccgaccgcggcccgaacagctcgccgaccgcgaaggccggcgtgggcttcacgggcacgcgcgcgctgcgctacgccgggcggcacaccgccgagggcggcgcgtactcgtacaacaagatcttcgacgtcgacctgaaggtcacccgggacacccagctgtcctaccggctcttcccgtcgatggccgacggcgaccacgactacgacgccacgaacgtctccgtcgacctcgccttcaccgacggcacctatctgagcgggctgggcgccaccgaccagcacggcttcgggctgagcccgcaggcgcagggcgcgtccaaggcgctcttcgtcaaccagtggaacaacgtggtctcgcggatcggctcggtcgccgccggcaagaccgtcgaccgcgtactgctcgcctacgactccccggcaggaccggcgaagttccgcggctggctcgacgacgtgtcgatcaagcgggcggcgcccgagcggcccaaggcccacctggccgactacgcgctgaccacgcgcggcaccaactccagcggcagcttctcgcgcggcaacaacttccccgccaccgcactgccgcacggcttcaacttctggaccccggtcaccaacgcgagctcgcagagctggctgtacgaatacgcacgtgcgaacaacagcgacaacctgcccaccctccaggccttcgccgccagccacgagccgagcccctggatgggcgaccggcagaccttccaggtgatgccgtcggcggcgtccggcaccccggacaccgaccgcaccgcccgcgcgctgcccttccggcacgagaacgagaccgcgcacccctactactacggcgtgcggttcgagaacggtctcaaggccgagatggccccgaccgaccacgcggcggcgctgcgcttcacctacccgggtgacgacgcgagcgtcctgttcgacaacgtcaccgaccaggcgggcctgaccctggacaaggagcacggagtcgtcaccggctactcggacgtgaagtccgggctgtccaccggcgccggccggctcttcgtctacggcgtcttcgacaagcccgtcaaggacggctcctcctccggtgtcaagggctacctgcgcttcgacgccggcaaggaccgcaccgtcaccctgcgcctggccacctcgctcatcagcgtcgaccaggccaaggacaacctgcgccaggagatcccggacggcacctccttcgacacggtcaaggcccgcgcccagcacacctgggacaagctgctgggcaaggtcgaggtccagggcgccacgccggaccagctgaccacgctgtactccagcatgtaccggctgtacctgtacccgaactcgggcttcgagaaggtcggcggcaaggaccagtacgcctcgccgttctcggcgatgaccggcgagaacacgccgacgcacaccggcgcgaagatcgtcgacggcaaggtgtacgtcaacaacggcttctgggacacctaccgcaccacgtggcccgcgtactcgctgctgacgccgaagcaggccggtgagatggccgacggcttcgtacaggggtacaaggacggcggctggacctcgcgctggtcctcccccggctacgccgacctgatgaccggcacctcctcggacgtggcgttcgccgacgcgtacgtcaagggcgtcccgatggacgcgaaggcggcctacgaggcggccgtcaagaacgccaccgtcgcgcccccgtcctccaacgtgggccgcaagggcatgagcacctcgcccttcctcggctacaccagcaccgccaccggcgagggcatgtcgtgggcgctggcgggctacaccgacgactacggcatcgcgaagatgggcgaggccctctacaagaagacgggccagaagcactacgaggaagaggcgcagtacttcctcaaccgcgcccaggactacgtgaagctgttcgactccaaggccggcttcttccagggcaaggacgccaagggcaactggcgcgtcgactcctcgaagtacgacccgcgggtgtggggctacgactacacggaagccaacggctggggctacgccttcgccgtcccgcaggacagccgcggcatggccgacctgtacggcggccagaagggcctggcggacaagctcgacacgtacctcgccacgccctcggtggcctcttccgagttcgccggctcctacggcgggatcatccacgagatgaccgaggcgcaggacgtgcggatgggccagtacgcccactccaaccagcccgcccaccacgccctgtacatgtacgacgcggccggccagccctggaaggcgcaggagaacatccgcgaggtcctctcgcggctctacgtcggcagcgagatcggccagggctacaccggcgacgaggacaacggcgagcagtcggcctggtacctcttctcctcgctcggcttctacccgctggtcatgggcagcggtgactacgcgataggctcgccgctgttcaccaaggcgaccgtgcacctggagaacggccacgacctggtcatcaaggcgccgaagaacagcgcgaagaacatctacgtgcagggtgtccggttcaacggcaagcagtggaactccacgaacctgccgcactccctgctctccaagggcggtgtcctggagttcgacatgggcccgcggccgtcgaagtggggcacgggcaagaacgccgggcccgtgtcgatcacgaccggtgacaaggcgccgacgccgcgcgcggacgtgctcaagggcgacggcgcgctgttcgacgacacctcgtcgacggaggcgacggtgaacacggtggacctgccggtctccggctccgtcaaggccctccagtacacgctgacctcgtccggcgaccacgccaaggccccgacgggctggacgctcgaggcgtcctcggacggcacgcactggaataccgtggaccggcgctcgggcgagtccttcgcctgggacaagcagacccgcccgttcacgatcgcctcgccgggcacctaccagaagtaccggctggtgctcgacggttccgcgacgctggcggaggtggagctgctggcctgacgcacacgcggtgtgcggcacggcacaacagaaggggcgggtcctttcgggcccgccccttcgtcatgccggtgtgcggctcagccggtcacttcacgcggtcacttcacacggtcacttcaccgcgagggcgaagacgtgcaggtcggtgtcggacggcagccgcaccgaccggatctgcttgcccgccggggcctcgaagggccgggtggcgaacacgtaggtggcgacggggtccttgtcggcgccggccacgttgcggtacgccgtcctggcgacgaccgagttgccgaactggacggtgccgccgcccccgccgacggtccagtcggtgaaggagaggtcggtggtggccgtggtgccgtccgtgtaggtgacggtggccttggtctgctggttgccgttgaccgcgctgccgacgaaggagagcgccgacgcgggggcggacaggtcgatcgtctgcccggccgccgacacgttgtccggacggccgctgggcgagttcggccaggtgaaggccaggccgtccaccgtgccctgcccgcccggggtgagcccggccgcggcgagggcctggcgggagtagctccagccgccgccgtcgaaatccgcctcgtcgtggtcgcccgtgtcgtcggagacaccggtgttgttccgggcggcgagcagggtgccgggcgccgcgagggtcagggcgacgggctgctcgtaggactgctcgcccgaggtcaccgtgaccttcacgtcgtagaagccctgggcggcgtccttcccggcggtgagggtgatctcctgggagccgccggtcacggttccctcggcggggctcgcggtgacgccggccggcgcctcggcccggaagcgtacgtcggggccctgcccgccgttcagcgacagcgcgcggagggagatcttcgtggtgtcaccgggcgcgagcgtcgccgtggtcgggcccacaccgatctggtacggctgctcgccctgccggaaggacggcggcgccgcggccgggtcgctgccccaggagcggttcggggtcgaggagagggtgtagtcgaggcgtccgccgtcgcggacgaaggaggcgggcagccacggccgttcgctcgtgcggccgttcaccttcagggactggacgtacggcgatccggccgccgctccttgggcgcggatggagatgtcgcctccgtgcgggcggtggatctcggcgcgctcgaacagcggtgaggcgaggacgagttcggcacgggagggcacctgcgggtacatgccgagggcggagaagacgtaccaggcggacatggcgccgaggtcgtcgttgccgggaatgccgccgggctcggtcgtccacagctgccgcatggcggcgcggacggtctcctgcgccttgtagggcgcgcccgcgtagtcgtagaggtacgggacgttgatcgacggctcgttgtccatggcggccttgtcgccgctgctgccggtgaacgcccagccgccgtcggccgtgtggaagaaggcgtcgagccgggccagggccttgtccttgccgcccatggccgcgaacagcccggccgggttgtgctggaccatccaggtgtactgggcggcggtgccctcgacgaagccgttgccggtgtccggggtgaagccggtgacccagctgccgtcggccttgcggttggcgatgtagccgccgtcgggtgtggccgcgatgttgaagttgttctgccaccactgggagcggccggcgaacgtgtccgcggtcttctgctgcccggccgcggcggcgagctgggagagggagaagtcggcggtggacatctccagcgtctcggcggcgccgccccaggcgttggagacggacggcatgtagtgcagcttcaggtacttgtcgagcgagggccgctggcctgcggacagcaccggcttgcccgccggcgacaggtcctgcgcggtcggtacggtggccgccttcaccagggacgccagcgcgcccttcaggtcgaagtcggtgcccccgaaggcgcggatgccggccagcgcggagggcgaggggtcgccgttcatgacgtgggtgccgctcgcgccgtgcagccagcggtcccacgtgccgccgttctgccgggccagctcgtacagggactgggcgatgtccgagccggtgcgcgggctgagcagggtcagcagctgcacctggtcgcggtagacgtcccagccggagaaggtgccgtactgcgcctggtggccgcggccgacggtgtgcacctcgccgtcggagccccggtagcggcggtcggcgtcgctgatgacgttcgggtgcagcagggcgtggtacagcgcggtgtagaaggtggtgcgctcggcgtccgtgccgccgccgacctggatcgcgcccagccgcttacgccaggcgcggcgggccgcgtcgcgtacggagtcgaaggagcggcggggcgggttctcggccgcgaggttggcggcggcgccggcctggctgacgtaggagatgccgaccttcactccgaccgggccggtgccgggggcgaactcgacgtagccgccggcgcccttgcccgccaccggccgtccgccgtgcgagaagccgccggtgccgccgccggccgaggtcgaaccgggggtcaccttgtcgtcctgccaggtgccggtcgccttgaacgggcggtcgaagcgggctgtgaagtacagggtgtagtaggcacgttggccctcggggtccaggtagccgcagaagttcccggaggtcacggagccggagacggtccgggtggccgggtcgatggtgaccgaggagtcggtcgagccgacctcggagttggcggtgcggatcagcagcgaggcgggtttgtcggcggggtaggtgaagcgtgccgagccggtgcgggcggtcgcggcgaggtcggcggtgacgccggaggcgaggcccaccttgtagtggccgggctcggccgtctcgtcggcgtgcttgaagtcggaggcgtagacggcgtccttggtgtcgctcgccggggaggtggtgacctgcccggcgtacgggaagaacgggatgtcgccgctgccgccggcgcagccggtgccggacatgtgggtgaggctgaagccgcggacgcgggtggcgtcgtactggtagccgccgggggcggtggtacgggtggcgtcgccgcgggtggtctccgggctgaaggagagcatgccgaagggcgtgacggcacccgggaaggtgtcgccgccgttcttcgtgccgatcagtgggtcgacgtacccggtggggtcctcgaccagggcggggctggatctcccgggggcggtggtcgccgcgagggcgggggtggcgccggccgccgcgagggcggcggccagcagcagggacaggggacggaagcgcatgacgcggcccctcctccttcggacgggtcgcgcaccacggatcacacaagccgcagggacagtagcgcgcgccggtggtacagcggaagaccgcgtactcccccggcgcacgccggccactcacatgggtgggcgcgggccaagttgcttgacatcgttttcggttgcggcg

SEQ ID NO: 181 - DNA, 3513 bp, Unknown
  Kingdom: Bacteria, Phylum: Actinobacteria, Class: Actinobacteria, Order: Streptomycetales, Family: Streptomycetaceae, Genus: Streptomyces
  misc_feature (3302)..(3303): n is a, c, g, or t
cgcgggggcctgtggggcggggtccggtccacgatgtcagtccggcggtccacaatggtcggcgtcagatcccgtcacgcttcagcaaggagccggcagcgatggcccgccgcagcacgaagaccccgccgcccgacgacccgtacgaggagaagatcctcgacatcgacgtggtcgacgagatgcagggctccttcctcgagtacgcgtactcggtcatctactcgcgcgccctgccggacgcccgggacggactcaagccggtgcaccgccgcatcgtctaccagatgaacgagatgggcctgcgccccgagcgcggctacgtgaagtgcgcccgtgtcgtcggcgaggtcatgggcaagctccatccgcacggcgacgcgtcgatctacgacgcgctggtgcggctggcccagtccttctcgatgcgcgtcccgctggtcgacggccacggcaacttcggctccctgggcaacgacgacccgcccgccgcgatgcggtacaccgagtgccgcatggccgaggcgacgagcctgatgaccgagtcgatcgacgaggacacggtcgacttcgcgcccaactacgacggccaggagcaggagccggtggccctgcccgccgccttcccgaacctgctggtcaacggcgcgtcgggcatcgccgtcggcatggccacgaacatgccgccgcacaacctcggcgaggtcatcgcggccgcccggcacctgatccgccatccgaacgcggacctggacgcgctgatgcggcacgttccgggtcccgacctgcccaccggcggccggatcgtcggtctgtccgggatccgggacgcctacgagtcgggccgcggcacgttcaagatccgtgccacggtcgcggtggagaccgtgaccgcgcgccgcaagggcctcgtcgtcaccgagctgccgttcacggtcggcccggagaaggtcatcgccaagatcaaggacctggtcggcgggaagaagatccagggcatcgccgacgtcaaggacctcaccgaccgcgagcacgggctgcgcctggtcatcgagatcaagaacggcttcgtgccggaggcggtcctggagcagctctacaagctgacgccgatggaggagtccttcggcatcaacaacgtcgccctggtcgacggccagcccctcacgctgggcctcaaggagctgctggaggtctacctcgaccaccgcttcaatgtcgtacggcgccgcagcgagtaccggcgcggcaagcggcgcgaccggctgcacctggtcgagggcctgctcacggcgctggtggacatcgacgaggtcatccggctgatccgctccagcgagaactccgcgcaggccaagcagcgcctgatggagcggttctcgctgagcgaggtccagacgcagtacatcctcgacacgccgctgcgccggctgaccaagtacgaccgcatcgagctggaggcggagaaggaccggctcatcgcggagatcgaggagctgacgcggatcctggagtcggacgcggagctgcgcaagctggtctcgaacgaactggcgatggtcgccaagaagttcggcaccccgcggcgcacggtgctgctggaggcgggcgccgtcccggtcgccgcggtgccgctgcaggtggcggacgacccgtgccgggtcctgctgtcctcgacgggtctgctggcccgcacggcgggcgacgggccgttccctcgggacgcggacggcaggcggcacaagcacgacgtgatcgtctcggccgtgccggccacggcgcgcggcgaggtgggcgtggtgacgtcggccggccgcctgctgcgggtgaacgtcgtggacctgccccagctgccggagacggggaccgcgccgaacctgtccggcggtgcgccgatcgcggagttcatctccctggaggacgacgagacggtggtctgcctgaccacgctggacgagtcgtcgccgggtctcgcgatcggcacggaacagggtgtcgtcaagcgggtggtccccgactaccccgccaacaaggacgagctggaggtcatcaccctcaaggagggcgaccggatcgtcggcgccgtcgaactgcgcaccggtgaggaggacctggtcttcatcacggacgacgcgcaactcctgcgctaccaggcgtcccaggtccggccgcagggccgcccggcgggcggcatggcgggcatcaagctcaccgacggcgccaaggtcatctcgttcacggcggtggacccggccgtggaggcggtggtgttcacggtcgcgggctcgcgcgggacgctggacgactcggtgcagaccacggccaaggtgacgccgttcgaccagtacccgcgcaagggccgggccaccggcggcgtgcgctgccagcggttcctgaagggcgaggactgcctgtcgttcgcctgggcgggccccaccccggcgcgggccgcgcagaagaacggcaccccggccgaactcccgaagatcgacccgcgccgcgacggctcgggcgtgtcgctgccgaagacggtggcggtggtggccgggcccgcgtagacgggaagcgacctgggctacgcgggagactgtcccgggctgagcgggagaccgttccgcccggcccgggcgccgtcccggccccggcgagggctaccggcctggaggctggggggcctcaggcctcggcggaagggtcctcggcgggttcttcttcctcttccgggccctggacgtagcgcaggacgccccacatgccgtgctcgtcggcgtgcggggtgtccgcctcgcacgcctggagttccttgacgaggccggggacgtcggtgccggaaccgatgagcacgagctgggtccggtgcggttcgccggccggccagggttcggggtagaagcgcaggaaccggcccacggcgtgcacggcgtagcggttgcgcggatcgcaggggccgaagccgacgtagcccttgatgcggtagagcccctcgggcctgctgtcgaggaaccgcgtcaggcgtcgggggtcgagcggcacgtcggagacgaaggagaggctgtcgtagccggcgtgcagatggccggcgtggtggtcgtgggcgtcgccgggaccgtcctcgccggggacgtccaggtcgtcgaaggacagctggccgacgcgttcctcgctgggtcggcagtcgaacaggaactcggggtccacgcggccgtaggaggccgggacgacggctgcccggtcgaccagggaccgtacagtcgcgagcacctgttcgctgtcgtcggcccggtcggccttgttgacgacgnngccgtgcgcgggtgccgtcgaactcggcggcgtccacgacctcgacgagcccgccgtagacgacacgtgggttctcgctggccagtaccatccggaccagttcctgcggctcggccagtccgctcgcctcgatgacgatcacgtcggtgccgacgcccgggcgggtgagccggtccaggtactggtccagttcccccgcgtcgacggcac

SEQ ID NO: 182 - DNA, 3665 bp, Unknown
  Kingdom: Bacteria, Phylum: Actinobacteria, Class: Actinobacteria, Order: Streptomycetales, Family: Streptomycetaceae, Genus: Streptomyces
tcctgcccggccgggcaggacatcgcggcagcgagcaccgctgcctctcccgcctgctcgatgaacctcgtcgtcacggtggcctccctccgttcggacccctggtgccgggctcgccggaagcggatgacaccgcccggcccgggtacccagcacctttgaccgggagtgaggaggaaccatgggaatgctcagcaggacggcagccgtgaccacggcgaccaagcccctgtggaccgccagggccgcggcgaaggcggggaagaccgctcccgcctggtccgcgaaggccgtacgcatcctgggcggtgaggacgccgtcgacgtcctcacccgccagcaccggcagatcaagctcggcttcctgcgggccgctgtgcccggaccgctgcgacgccggaacttcgaccggctcatgcgcctgctcgccgtgcacgaagccgctgaggaggcacacgtccacccggtcgcgcgccgggcgctccagcacggccgggaactggccgcccgccgccgccacgaggagaaggaagccaaggaactgctggtggcactgtggcacaccggcccggaagggcgcggatacctgcggctgctgaaccgggcccgtcgcgcggtcaccgcccacgcggcgcgtgaggaacgagaggagttcagcgccctgcgcaaggcggtgagcgcgtcccggctgcggatgctgggcgccgaggtcaaactcacccaggcctacgcgccgacccggccgcaccgctgggtcaacaacgaggccacgaacaagctggccgcgcccctcctcggccccctcgaccgagcccgggacgccgtccgccaccgcatggcacactgaccgccggccgcgccccgcagccggacaccggcctgacgagccggacaccggcccgacggcacacgccccacgccggccccgcgcgccccggcctccggccccggcccatcggtccgcctgcggtgtgtcacctcgcagcgcatcggtcgtgaccgtaatgtccgggtggccgtggttgtgcggggcgcgactggagtgatcacatgggtgaccaggtcttctgctcggccggaagggtgacgcggtgatccagcgtcatgtcttcggcactgtcttcaccctcgagtccgccatcgcggcgttcgtgttcctggtcgtcctcgtcctggtggcctacgccgtcgtcggccggcgggccggccgtcggccgaccgtctcccggaagccggaacggcccgtgctggagaagtactacgtcggcgtgctggccgcgttcgcggggttcctgatcgcctggaccgcctggcagaaccacgaggagcaccgcccgccggaccgcccgcccgtgcgcgtggacgtcatgggcttccagtggtgctggaagttcacccacctccagtccccggtcaggcgcagcaccatcggcacctgccggggcgatgacctgcccacgctggtcgtcccgacgggtcagccggtccagttgcggctgacctccaaggacgtgatccactcgctgtggatcccggacctgcgctacaagatggacgccttccccgaccacgtgaacaccttcaccctcaccctcgaccacaagggccgctggcggggccggtgcgccgagttctgcggcgagcggcactacgccatggacttctggatccaggccgtctcgcccgaggagtacgaccgctacctgcacggccagtcgaccggcaccggggcaggagcgacggcgtgacggtcgcgccgcccgcccgggccgaagaggccaccggcggccggcccgtcgcacccggcggctggctgggctgggtgtgctccaccgaccacaagcgcatcggcctgctgaccatcaccacctctttggtcatgttcctgctcatgggcgtcctcgccctgctgatgcgcagccagctcgcccagcccgaacagcacatcctggacccggtcaccttcagcgagctgttcaccatccacggctccggcatgatctacatggtgttcaccccgttcgccctcgggatgggcatctacctggtgccgctgcagatcggggcgccgggcatcgccgcgccccgcctgaccctgctgggctactggctctacgtgctcggcgccgtgctgatgctctccggcttcgccaccccccaaggcgcccacgcggggggctggttctcctacccgcccctcgccgacaaggagcactcacccggcatcgggtccgacctgtggatcgccggcgtcgtgctggcgaccacgggggtgatcatcatgggctgggccgtgctgtggacggtgctgcgacggcgcgcccgcggcatgaccatgctgcgactgccggtgttctgctggtcgatgatcgccgcctgcctgatggtgatcggcgccttccccgccctgctcgccgcgctcgccctgctcgccgtgggccgcgccgaccccgccgtcttcgcctccaacgaatggaacatcggctaccagcacctgttctggttctacggtcacccggtcgtgtacgtgatgttcttcccatacctggccgccgcctccgaagtactggccgtcttctccggccgccgcttcttcggctacaaggggaccgcactgtccctgctggtcttcgccgccgtctcgatgagcgtgtggggccaccacatgttcgccaccggccaggccaccaacgactactactccctgacctccatcgccctgctcgtcccggcgggcgtggagtacttcggcatgatcggcacgatcctcggcggacgcatccgcttccgtgcgccgatgctgttcgccctggccttcatcccgcagttcctgatcggcgggctgaccggcatcatgatcggcaccccggtcatcgactaccacgtcaccgacagctacttcatcgtggcccacctgcactacgtgctcttcgccggcagcgccttcggcctgttcgccggtgtgtactactggttcccgaaggtgaccgggaccgtcctggacgagcggctggggcggctgcacttctggctgctggtgatcggcaccaacgtgaccttcctgcccatgttcgcgctcggctacctgggcatgccgcgccgggtggccacctacgccgacttcgacgggttcgcctggctcaacctgctcgccagcatcggtgcgggcttcatcgccctcgccatcaccgtgttcgtcgtcaacgtgctctggaccctgcgcaccgtggccctgggccggtcggtgaacgcgggcgacaacccgtggcaggcccacaccctggaatgggccacctcctcgccgccgccgcggctcaacttcgcggcggaccgcccgctgccccccgtcaccagcttcgcgcccctgctcgacctgcgggagcggcaggcgagtcgggcggcgacggcggcaggacccaaggaggcgagcggatcgtgaaacggcatctgccgtacctggtcgtcgccggctggggcgccctcaacggcatcctgctggcggtgctgggcatctacggcgagagcagcctggtcttctggctgtacggaggcgtcgtcgccctgctggaactggccgcgctggccgtgctcgcctcctcgcgctccggccccgcggtccggcagccggtaacggacctgctggtcggggccggagcgcgaggagg

SEQ ID NO: 183 - DNA, 4554 bp, Unknown
  Kingdom: Bacteria, Phylum: Actinobacteria, Class: Actinobacteria, Order: Streptomycetales, Family: Streptomycetaceae, Genus: Streptomyces
cgacggccctccacgcgcgcgtggagggccgtcggccggtgcggtgccgtgccgccggtcagcggctcacggcttgagcaccagtgtgtcgctcgtgctcttgtcgacggcgccggccgagtaggaccacggcagcagctcgcccttggcccacttgtccgtctggtcggtgtagtgggcgctgaaggcgtgcccggaggcgccggtcaggttgatccacttcgacttgtcgaggtcggcgaggttggccaccatccgcatcgacggcacccagacgactccgtaaccgccggccgcgttccacccggaggcgttgaccgcggcctcgccgccgctgagcttccaggggccccggttgaggatgtacttcaggaagccgggtccctcggtgcccagggtctggttcttcaggaacaggcggtgcagccggccccagttccaggtgtcgatgtccttgccgagcttcgaggtcagctcccagcgggcgtcgatcagggcgcgcgcgaagagctggtcgcggttgtcggccttgggacgggtgccggaggccggcaccttccaccagtcgctgtccggctggttcaccaggttgcggaccacctcgaaccagcggtcgccgccgtccggctgggcctggtcggccgaccgctcgccgcactcgcggaccttggtgttctggtcgacgggaccggtgttgccggccggctccacccacaggcactgcccctcgacccgcagctccttgggcagcttgttgccgaaggccagcttgaggatgttgcgccacaccgcgttgaagtacgcggccgccgccgagtcggcgtcctgggtgtagtcccagccctccagcagcttctgcgcctggcggacgtccttgtcaccgacgtcgatcttcagcagcatgggcacgagcagcttggcgatctcactgctgttgtccatctgcatctggcgcatgtcgtcggtggagatcttgccgccgccgtcgatcttcgactggatcaggtcggcgatccgctggctgcgcgtgccgtatccccagtccgtggtgagcgtgtacgggtacttgtccggcgagaccacggcctggttggcggtgacgatgtagccgcgcttcgggttgtactcgtagggcagctcggcctgcttgacgtagcccttccagtcgtacttcgagtcccagccgggcgccgggaccgagccgtcgtccttcttggcgcgctcggggatgcggccgggcagcgtgtagccgatgttgttgctggtgtcggcgtagatcaggttctgcgaggggacgtcgaagagcgcggcggccgagcggaagtcgctccagttcttggccttgtcgatggcgaagacggcgtccatggtggtgcccgggtccagcgcggtccacctcagcgcgatcccgtagccgtcaccgcggtccggtgcggcggtggtgacctgggccttcttgccgacctgcacgagttcgtcgtcgcggtcggacagcagcggcccgttctcggtctcgcgcacgacgatcgtcttggagctgccgccggcgaccttgatggtctcctggcgggtccggaacggcaccgtcttgtcgtcgcgcaggtagccgtcgccgctgagcttctccaggtagaggtcggtgacgtcgacaccggagttggtcatgccccaggcgatgttctggttgtgtccgatgacgacaccgggcatgcccgcgaaggtgtagccggtgacgtcgtaggggcacttgccggacacggcgcggcagtgcaggcccatctggtaccagacggacggcagcgcggcgcccaggtgcgggtcgttggcgagcagcggcttgccggtgatggtgtacttcccggcgacgacccaggagttggagccgatgccgtcgccgttcacaccgacggccgtgggcaggttctgcatgacgttgcgcaggcccatgagctggctctgcacgccggagccgccggaaccgctgtccgagccgccgcccgtggtggagccggccggcacaccgcccgtcgttgcggcgcccgtgcccgtgccggagccgctgccgctgattcccgaggtgccggagttgccgagggggctgccggagctgctggagccgtcggacgtaccggatccgtccgagccggcggacccgctcgcgccgccttcgaacgcctgcgcaagttcgtcgtactggccctgcgtgacgatcggcttgttccggctgtacgggtagtccgggtacaggtccttgatctgcttggggccgaggcggctggtcatcagggcgcggtcgatctcgtcctgcatgttgccgcgcaggtcccaggccatcgccttcagccaggagaccgagtcgaccggggtccattgcgcgggcttgtagtcgttggtgaagcccagcgccgcgtactccagggagatgtccttggcgtcccggcccttcaggtaggcgttgacgccctgggcgtacgcctggaggtactgcttggtggcgggcgacagcttcttgtcgtactcctgcttggcgacccggtcccagcccagcgtgcgcaggaactcgtcgttctggacctggcccttgccgaacatctccgagagtcggcccgaggtcatgtgccggcgcacgtccatctcgtagaaccggtcctgcgcctggacgtagccctgcgccatgaagaggtcctgcggggaggaggcgtagatctgcgggatgccgtagccgtcccgcttcacgtcgacggggcccgacaggccctggagcgtgatcgagcccttggtctgcgggaaggaggcgcggacggtgctgacggaccagtaggccccgtaggcgatgcctccgatgatggccagcaccaggacaagcccgatcagtcgggcttttcgccccttcttcctgccggacttgccgggcttgtcacccgttgtggcggtggtgttggggggcatcgctgtccttgctgtcctaacgcgagcggcaggcggtactggagtgctggagcaaccataggcgcaggaccctgtggcacttgacgcggagtcgggtccagccgcgtacgggcgttcgatccggacgccggaagcgtcaagaaagcgtcaagagttaggtaaggtaacgaagtaaccggagaacgcggagaactcggggaaggaaccgccactgactgtccagcacctcaaccagctcctgctcgcctgctccctcgtcctgctcgtcgcggtcgcggcggtgcggatctcctcgcgcagcgggctccccagcctgctcgtctacctggggatcggcgtcgtcatgggtcaggacggcctcggtcacatccacttcagcaacgccgagatgacccaggtcatcggatacgcggccctcgtcgtgatcctcgccgagggcggtctcggtacgaagtggaaggagatccggccggtcctgccgtccgcctccgtgctggcgctggtcggggtcgcggtcagtgtcggcgtcacggccgccggcgcccactacctgaccggcctggagtggcgccaggccctcatcgtcggcgcggtggtctcctcgacggacgctgcggccgtcttctcggtcctgcggcgcatccccctgcccgcgcgcgtgacgggcacgctggaggccgagtccggcttcaacgacgccccggtcgtcatcctcgtcgtcgccttctccacggccggcccggtcgagcactggtacgtcctggtgggcgagatagccctggagctggccatcggcgccgcgatcggactcgcggtgggctggctcggctcctgggggctcaagcacgtcgccctgcccgcctccggcctctacccgatcgccgtgatggccatcgcggtcgccgcctacgccggcggagcgctggcccacggcagcggcttcctggccgtctacctggcgtccatgatcctcggcaacgccaagctgccgcactggcccgccacccgcggcttcgccgaggggctcggctggatcgcccagatcggcatgttcgtcctgctcggcctgctggtcacaccgcacgaactcctcgacgacttcgtgcccgccctgctcatcggcctggtcctgaccatggtcgcgcgaccactgagcgtgctggtcagcctgctgcccttccgggtgccctggccggagcaggccctgatgtcctgggccgggctgcgcggcgccgtccccatcatcctcgccaccatccccatggtgaacggcgtcgactccagcggccggatcttcaacatcgttttcgtgctcgtcgtggtctacaccctggtccaggggccgacgctgccgtggctggcccgcaagctccggctcggcgacgcccaggaggccgccgacctcggcatcgaatcggcgcccctggagcggctgcgcggccatctgctgtccgtcgccatccctgagggctcacggatgcacggcgtggaggtggccgagctgcggctgcccgccgggtccgcggtcaccctggtcgtccgcgaggggaaatcgtttgtcccgctgccgacgaccgtcctgcggcgcggcgacgagctcctcgt

SEQ ID NO: 184 - DNA, 11187 bp, Unknown
  Kingdom: Bacteria, Phylum: Actinobacteria, Class: Actinobacteria, Order: Streptomycetales, Family: Streptomycetaceae, Genus: Streptomyces
cacccacccgggccgccgcgccagcacccgcagcagcgccatcccggcgggcggtacgggcaacaggtcgccgtccaccagcaccgcgtgcccgcggatctgcacccggtgcccggcgaggggcaacacccgtgcgcgtcccggcagttcccggcacagcaactggaccagcggacccagccggaaccgctccggctgcaccgtgtccaccccgtgcgcctgcaacggcacggcggtcaccggcccgacgcaggcgggcagcacgccgtgggcgagcgcggccagcagctcgtccagcagaccgcgctcctgcgcccgggacagcagggacgcggcggccggggcgctggtgaaggtgagcgcgtcgaggccgccggagacggcggcgtccagcagccggtccagcggaccggggtcctccggcggcagccagcggtacaccggcaccgggacgacctcggccccgccggcgcgcagcgcctccacgaacccgggcagtggctccccgtgcaactggacggcgattcgccgcccgtccacgccctgttccagcagccggtcgagcacctcggccagggactccgaggacggcgaccactcctccgtgagtccggcggcccggatcgcgcccttgaccttgggcccgcgcgccagcagttcgacctcgcgcagccggccgatcagcgcctcgcccagcccccacccgtcggccgcctccacccacccgcggaaaccgatcgcggtggtggcgaccacggtgtccggcgcctggtcgatgatctccttggtggcggcgaggagttcaccgtcgtcggcgagcggaacgatgcgcagcgcgggcgcgtgcacgacggacgcgccgcgccgctggagcagcgcgcccagttcgtcggcgcggcgggccgccgtcacgcccacggtaaacccggccaggggcccgtaccgcccgtccccggcccgctgctgttcttcgacctcacccatggttcatcgtcccgcgttcgactcgtcctgccgcttcgtaccgtcctgccgtccgagcctgtcaacggcgcgtgacgggctcggttcaccggcatgtcaccagtgttacgtcacacctcggcgtaaccgagccgcggctccgcgccgacgccgccgccgggggatacccggtcgccctccggacggcgaaggtacacggcccaggtgaccgcgaaggcgacggcgtagaagaccaggaaggcgacgaacgcgccggtgccggagccgtaggagaggaacgactggcggaaggcgaggttgatgccgaccccgccgagcgcgcccacggccccgatgagccccatggaggcgcccgacagccgccgcgcgtgcgccgccgcctcctcaccggcgagcccccgggcgagcgccttggcctggaagatcccggggatcatcttgtacgtcgacccgttgccgagcccgctgaggacgaacaggacgacgaacacacccacgaacagcggcagcgagccccgcatcccggcaccgacgagggcggcggtcgcggcggccatggcgacgaagttccacagggtgatgcgcgccccgccgtaccggtcggcgagcctgccgcccagcggccggaccagggacccgaggagcggcccgacgaaggtgaggtaggcggcctggagcggcgtcctgccgaactggctggtcagcacctgcccgaaggcgaagctgtacccgatgaacgacccgaaggtccccacgtacaggaacgacatgatccaggtgtgggcgtccttggcggcgtccacggcggcgccggtgtcgttgcgtacggtggccaggttgtccatgaacagcgcggcgaggacggcggcgacgacgatcagcgggatgtaggtcccgagcagcacccgcggcccgccgcccgccccgatgacggcgagcgctgcgagctggatgacgggcacgccgaggttgccgcccccggcgttgaccccgagcgcccaccctttgcgccgcatcgggaagaaggcgttgatgttggtcatggaggaggcgaagttgccgccgccgatcccggcgagcagcccgacccacaggaaggtggcgaacgaggtccccggctccatgacgacgaacgcggcgacgctcggcacgagcagcagactcgcggagacgatcgtccagttccgcccgccgaacagcgccacggcgaaggtgtacggcacccgcgcgaccgcccccaccagcgtcaccacggaggtgagcaggaacttgtcggccgccgtcagcccgtactcgggccccatgaacagcacgagcacagaccacagcgtccacaccgagaacccgatgtgctcgctgagcacggagaacaacagattgcgctgggcgatccgctcccccgcccgcgcccagaacccctcgtcctccggatcccactcctcgatccaacacctgcccgccatcccgcctccacgtgcgccgagtgcctggctgccgacggtaggaagcggcggtttccgcgctgtggccacggatgaccgggagggaacgttgctctcactgacgggggtacgggggtgagaggcgaggcagcgtgccccacgtcatggccggcactgagctgctcccctggtggagacgatctgggaggtctgccagacaccgtcggcgttcttgtccagcctggtgttgtagagcacgtaactgttcttggtgacaggcgtcttagagatcttgtcggtcttcttgtccttgctgaagcccttgctctcgtcggcgcagaaggtgacggtcgccgacgtcttgccgtgcagcgtcgctttgcggtcgtagtagcgggcttcaccggtgagcgtggccccggccgccttcaactgggccacccaggacaacgcggcctcccgggccttgcccttgtcgtagtacgcgagcgcctgcccctccgggtccgttccggtgatcgcggcgtccacggcacgcatgcgctccgcactgtccgccagcaccgcgtccagtaccgggtcccccgtcttcgagtcctcgaaggtcagagtgaggtccgggggcaactcgatctccggccgtccggccgccgcagacgccgacgcactcggcgacgaggaggccggagcggaggacgccgtgtcgggggccccgtccttgggcttggcactgccgttgcccctgccgctgcctccgccacaggtcgtgaggaggagaacggccgccgtgccggcgacggctgggagcaggcggggcaacggttcacggttggctcctggtggggcgtgtgcgggcgaagacgcaggcgacaccgtaccgaggtatcacctcagcggttgaccgactggatctcctggaccgtgacgtcctgggtgccgccgaaggtgccgtcgggcaggtccttgcctgtgccaccggttccggtccagtggatgtgccaggtgatcgtggccttcagttggaacgtgccgtcgcccgaggagcgcaggtacttcactccgcagggcggggtctggtccgccttgcccggggcgtacgactcgccgatgcgagtgccggatctcccgcagacacccgaggccgggtaggcttccgcgtccggcgtgcccgggtcgatgttcacggagaccggttcagcggtggtcgtcgcggaaataccgagagccggcacggaagccgtgacggacaccggcttgaactgcgcgccgtccagccacgcccacgtgggcaggttcacctttgtggccttcgcaggagcgagactcacctcggtgctcgggacacggatctcgttgtaggcgagctgcgcgaggatttccggcgtgatggcctcggggacatcagccggaggcagggtgcccttgtccacccagaagggcggcttgtcgcacttgtcccagccgggcggaaagccctcgttgacgtaggagtcccaccagtagcccttgccggtcttgtcctggttgaagtccttgtacgggtggccgttcacgtaacggtcgcgctgctgggcatcccattccgatccggtggagtcggcgtcccagatgggtttcatggtcttcttcaactgctccggcgtgtacttcggcgcgtaccagcaggcgggcggcgtccaggaggagacaggcactaccggccccactgaacccccggtgccattcttggatcggtcgtagacgatggctccggccgtcgcggagagcgtgccgtcatccgtggcattaccgtgctgttccgtctgattcaggtttccatcaccctggcggccgcccgcataggcgatgccgggtatgagcccgagcccaacgacgccgctaacggacagagccgtcactgcccttgccagatgcctcacggctggcacgcctggtctccccggttcgatgcgatgtcggtggtctgccatacgccatcggagttcttggtgagcttcgcgtggtacaccacatagctgtccgcggacgtcggcgtgttgtcgaccttccccgtcttacggtccttcagaaacgacttgctctcgtccgaacagtaggtgacataagcatcgttactcccggaaagggtcgctttgcgcctgaagtaccgggtcgtgccgatccacgtgtgatttttgttgatatagccctgtacataagtgatggccccgctcagggccctacccttgttgtagaagccgagagcctttgtaccggtactccgcttgaagatggcctcgtcaatcgagttgacgctgagggcactgtccgccagaaccgcgtccttcgtcgcgtcacccgtcttctgatcctcgaagacgttcttggcatcggacgggaaggtgatcttcggccgcccggcgtccacgggcgtcggcgcgctcggtgaagccggagcggaagaccctgtgtccacgcccgcgatcttgtcgttcgggttggagctgccgtccctgcccccgccgcaggctgcgaggagaagcgcagccgtcgcgccggcgacggcttggtgagcagacgggtgcggcggttcacagctggctcctggtggggcgtgggggcgaaggcgccaccataccgagatccctcaacgcccgcaccaggcctcttgtgttcactaggacccacatcagacgtatgcgaacggatcgcccgcctccgccagcaatgctcccctcggctcctcggaccgtcgactgcgcagacgcgctgacagattgtcaagcgactcaccgcaccgggatggccgacacccagtcatcggcgcgcgcaagggtcggcccctccacctcatcagcgccacatgaatacgccagccagcgcaactcgtcgcaggcgaagaatggctcaccccaggaatcgacccatacacgagcctcgtgatcccccgcctgcgtcaggtcccaccaggcccagccgcggaattcggattccgggtcgaactgatacagccactcctgcaggtcccatggctcccgcccgagcgcggcggcataatgttccgcgccgcggaccgcgaactcgggagccggggccgaggatcctcgggcagcggccacgaaccaatcagggagttcctccacggggaggtcctctccctggaagggctgggagagcgcaagcgtgagagcgggggcgagcaccgaccgcagtcttcctccgaactccgcaacggagccgctggtccgcacctcgaaaacgcacagaacgggcggcgcctcctccggcgaaggcctgcttcccaagcggcgtcgctcttgctcgatatccgcgatctcatgaaacattccgtatacctttcatccttcctgcactaccctacctggatatttagaaacttcttttctgaactcattgagcatgccactcggaattccatagagatcatcacccttggtcggatcagaaatctccggacagatccgcttcaactgtttccactcctccttgctgaacccgagccccgggggctgctcctgcgggatcgccgtcctccttatcttgtcccggtactccgatgatatctggaactccacgatctgcccgccctctccacggaactcaaccgtatgtcccacgtcaccgctcaggttcacatacaacgcacccttacccgtaatagtaaccttgccgtcctcgccaatatgaattcggcgactcaggggatgatccgtctgttttcggtatccgaggactgcgtcgccacactctggcgcgaggccgagagggtcgacccatctatgtgggttatgaacataggtagagggattaggagaaggcgcgagtcctagggggtcggacgtgagatagcgcgcggtctcaggatcgtagtagcggtgataattgtaatggagccctgattccggatcgaagtactgacccgggaatcgcagcggagtgtacgccgtgctgtcggatgcccaagaggtggtgccccacatggtcgagcgtgcacgccaagcaatgtttccctcttcatcgacgagctcggtcggggtgccgacgatatccgtgaccacggcgaagaaccgagcatcgatctcgtcctgcgacacctcgtccacgccgatgcgctcggtctgagcgatcggacgcagcccctggtggtcccaagtgaccgtgactggacgtgggaacgcggctcctgccgtggtctgttcgcaaactgtggcaccgtcccaggtgaacactgtgcgctcgacgaccgtgacgccgtcttcagccagtcgctgcttgaccgagcgacgcccgagagggtcgtacaaataccgccactctgtgccgtccggtgtggtgacagaggtgagacggtcctcgaagttccaggtgtagcgccaaatatcgggtttgcgcgacaagcggggcttctgccgtagggtgatacgtccggccctatcgtgctcgtagcgcacggtcccggcgcaagcaatgtgcgtaccattataggtacgaggcccggcggcttcttggtcggcgtaggcaggaggccagtaagcttccgcctgattgccggcatcatcgtacgcgtagcgctctgcccagcccttggcatcgactcctgttacacggcccactcggtccagagtgaaacgccgtggtccattcatcgggtcgtcgatgcgaaccaggtggccgtcactctggtagccatagtcgcggtgccggagaaccgccccttggccgtccgtaaccgactgggaggtcagacggcctccgctgtcgaaggtattcgtgagagagaccgtctcgacgagccgagtcaactgccggtcggccgcgtcgtaggtaaacgctatctgccggtcgcccgtgtccaagcggtggcaacggcccgcggcgtcgtaactccacttgctggcaaccccggtgggtgtgacacggctcgtacgacgacccagcagatcataggtgtatctgatggtgcggccgtccacagactcggacagcacacgcccgacagcgtcgcgtgtaataacgagtgcgctctcttgggtcgccgctgtgttgaggtgaccggaaggcgtatacgtgaagcttgttacctgatcgcaagtggtcttgcgagtgagtcggcccagcgcatcccggtcgaacgaggccgtctcgccgaatgcgtcagtgaagcttctgagacgacctaccgcgtcgtaggcgtacgtgagaacacgtccgtcgaagtccgtctcccccagtggccgtcccgcgggatcgtaggaatagctccaagccagtccgcgagggtcagtgacctttgtgagacgcaactcggagtcgtatacgtactcataccgcgccccgtccggcccggtacgcgcagtgagcaggtcgaattggccgtactcaaaggaagttacggcgcctgttggtgaggtgtgcgtgacgcagttgccctccccatcgtacgtccacgactcacaagggtcatcggcaaccgtgcggcgcaccagcttgccttccaccgtccattgttgccgagtctcgtggcccagcgggtccacgaccgtgacggagcggccgaaagcatcccgtcggaacgaggtgcgcgctccgaggggatcgacgatctcggtgaagagccctgcgtcgtcgcaggtcacatgcgtcgtgtgccccaacgcatcagtgacggcggccaaatgccccgccgcgttgtaggtgaagttagttgtcgctccggccgggtccgtgacagcggtgcggtcgccgttctcgttgtattcctgcaaccagaccgacccgtcaggccccgagatgatcaccggcaggcccaatgcgttgtaactggaggtgagccggctgccatcagcccgcatgactacagtgacgcagccgccttcgttgtaaccgtagcgcgtcacacagccgagcgagtcggtgacggcgacaaggcgaaggttctcatcccattcttgggtggtggtgtttccgaggggatcggtttcggagatgaggcgcaggttgtcgttgtgttggtaggtgcgggtgtggccgagggagtcggtgacccgggtggtgcgtgtgctggtgtcgtaggtgagggtggaggcgagggcgccgccggtgccgccggtggtggtgacgcggccttggtggtcgtagcggtaccagtaggtggtgtcgttgcggtcggtccaggaggtgatgcggccttcggggtcgtaggtgtaccgcaggggcaggccggaggagttggtctcctcggtcaggtggccggcctggtcgtagccgaaggtgagcagggtgatgccgggcccgccgggggtgttggggtcgagcaggcgcaggccggtgatgcgggaggcggacgggtcgtggtcgagggcaatgcggtagccgccggagtggacgatccgggcggggatgtcgccgcggtcgtactcgatggtgatgcggttgccgttgcggtcctggaggtattgcaggggcaggtcgaccgcggtgtcaccggcggcgggcaccggggagtggaagacgtatgccaggccggtgtcggggtcggtgacgcgtagcgcgccgtcggtcgtctcgtcccaggacagggtgaggcgtgagccgggggtttccgggcgcactggttcgttggtgtcggtgtccggggtggggaagcacaggcgggcgccgtcggctgccgcgtacacgaagccgtcgtcgtcggcctggatccgctggtccagggtggaggcccagctcggtccgaaccagccgccgaagcggtacgaggagatgtgcacgcgttccaggaccagcggcagcacgcccggcagggtcacgtccgtgcggggcagtgacacatcgccggtggccacgtcgatcgggtcgcggacgaacttcttgaccgcgttgcggatcgaggcgggcagcttgtcgaaaccgggccggagccggagccgttcgaaggcggcacagtcaacgccgaggctcttgcccagcttcgccagcgcggccggccccagcgccttcaggcccttgcccagcgccttgcccaggacgccgaagccgacgcccatgacagcgccttcggcaaggatcccggccagcttctccgggtcctcgaacgcgcccgggtcctccagcgccgtggtgaacgccgtgaacttcgctccctgcaaggccatgttccccacggccttgaccccgcggacctccttcagcgccttcagcgcccgctcgatctgccggatcaccgacagcaccccacggatcaccgaaccgagcgcactgccctcctcctcgatccggccgaccagagcgaccaccttcaccgcccgctcacccgccatcagggtggaggcgaccgatgccgcgccggcggtcagtacatccagtgccaggcccgccagctcgaactcggcgatctccgccagcagtaccccgatctcggagagcagctcgtgtgctttgtcggcgaagtcatccagagcctttgcgcccttgcgcaacgcgtgtgccatgtccgtggcctgcttgcgggcggccttggagcgtttgctgaaggcgctcgccgcctcgcccttccactccacaccggtcagcgactgctgtgcggccccggccgcactctccagtcccgcagccagatgacgccacttcttggcgatctcccggatcccgtccgggtccaccgccgggtccgagatacccaggaactccagcccgctggcgaccgtgtcgccgaacatgtggttgaacttgttgatgtagtgcagggggttgaggtcgaccatgcccggctcagcccttcttctgcccggctgccgccagcagcagatccagcaggtcgaacgcggcggacacgtcacccaccagcttcgcctccgcctcccactcctcctccagctgccgcgtcagcttcgccagcgtgtccatgccctcccgcacctggctcttggcatgagtgagcgaacccagcgcaccgagcgcgtccaggtcgtgcgaggccgccttgaagtcctgcaacggcttcgccgtgtgatgccccacgccccgcaagcccgacgccgcccgatgcatggagacggcttccttcttcagatccgacacgacacccgacccccgtacttcacgctgtgcacatgccaaacccgtgatcctatcgagtcacgctcacggcgaggcaatgatgaccccatgcgtgagcaaagccgttcacggagacgggattccaaatccacggggctgctgtgtcgccgtttcccacccagctgatcttccaggcgatcacgacactcagcttgaacgtaccagcgttcatccccagtccgccgatccgtgtgaacgtggcggcaccgaaggccacggcctgccagatgccctggtacatggcgcggtcgcttatgcgcggatccttcgcgaggagatattcaggctcaagtgaaaaggatgtgggaggggtggaagacactacgcgccagccactcgcccccctccccggccgaacccggctccggagggaccatcagtcactggcgagcgaaggactccgtgtccgagtgagcaacagccaaggccggcgggggccttacgccgccccgccggcctccctgatcagttcgtgccgatgtcgacctgtgaggtggggaagcaggtcggggcgggcttggtcagcatgacggccatgcttcccacggacttgtggagggcgccggccggggcttcgtcgacgatcagcagggtgtccccgtgcgggatcgcgctggtcgagcagcgcgatcccgcacgggga

SEQ ID NO: 185 - DNA, 7060 bp, Unknown
  Kingdom: Bacteria, Phylum: Actinobacteria, Class: Actinobacteria, Order: Streptomycetales, Family: Streptomycetaceae, Genus: Streptomyces
ggccctggccgcccgcgccgacgtgaacggagccctgccggcggctttcgggctggtggcggccgtcgcctaccatcactacgacacggtgtaccgcatccgcggtgacgccggagcgccgccggcccgtctggtgcgcgccatcggggggcaggaagggcggacgctgctcgtcgccgtgctggcggcgctgctcaccgccgcgcagttcaaggtcgcgctcacggtcatcgccgtgctcgtggccgtcgtggtgctcgccgagagcatccgcttctgggtggccgcccacaagggcggcgcgcccgccgtacacgacgaaggagaacccgcatgatcggcctcgtgctggcggccggcgccggacggcgcctgcgcccctacaccgacaccctgcccaaggcgctggtgccggtcgggcccgcgagcatagaggacggctccgacgggctcaccgtcctcgacctcaccctcgccaacttcgccgagatcggcctgaccgaggtcggcgtgatcgtcggctaccgcaaggaggccgtctacgaccgcaaggcggccctggagcagaagtacggcctcaagctcaccctcatcgacaacgacaaggccgaggagtggaacaacgcctactccctgtggtgcggccgtgacgccctcaaggacggcgtgatcctcgccaacggcgacaccgtccacccggtctccgtcgagaagaccctgctggccgcccgcggcgacggcaagcggatcatcctcgccctggacaccgtcaagacgctggccgacgaggagatgaaggtcgtcgtcgaccccgccaccggcgtgcggcgcatcaccaagctgatggacccggccgaggcgaccggcgagtacatcggcgtcaccctcatcgagggcgaggccgccgccgacctggccgacgcgctgaaggccaccttcgagcgcgacccgcagctctactacgaggacggctaccaggagctggtcgaccgcggcttccgcatcgacgtcgccccgatcggcgaggtcgactgggtcgagatcgacaaccacgacgacctcgcccggggacgggagatcgcgtgccgctactgacccggctgatcccctcgccggtcgccgtcgacatccgcccgggcgccctcgacgacctggcctgcgtactcgccgacgagcgggtctcgcactccggccggctcgccgtcgccgtcagcggcggctccggcgcccggctgcgcgagcggatcgcccccaccctgcccggcgccacctggtacgaggtcggcggcggcaccctggacgacgcgatccggctggccggcgagatgaagggcggccattacgacgccgtcgtcgggctgggcggcggcaagatcatcgactgcgccaagttcgccgcggcccgcgtcggcctgcccctggtcgccgtgcccacgaacctcgcgcacgacggcctgtgctccccggtcgccaccctcgacaacgacgcgggccgcggctcctacggcgtgcccaacccgatcgccgtcgtcatcgacctggacgtcatccgcgaggccccgtcccgcttcgtccgctcgggcatcggcgacgccgtgtcgaacatctccgccatcgccgactgggaactctcccaccgtgtcaccggcgagaagatcgacggcctggccgcggccatggcccgccaggccggccaggcggtgctgcgccaccccggcggcatcgaggacaacgactttctgcaggtgctcgccgaggcgctggtgctcagcggcatcgcgatgtcggtgtcgggggactcacggccgtcctccggggcctgccacgagatcaaccacgccttcgacctgctcttcccgcagcgcgccgcgagccacggcgagcagtgcgggctcggcgccaccttcgcgatgcacctgcgcggcgcccacgaggaggcggcgctgatggccggggtgctgcgccggcacgggctgccggtgctgccgcaggacatcggcttcacggtggacgagttcgtccgggccgtggagttcgccccggagacccggcccggccgctacacgatcctcgaacacctcgacctcaagaccgaacagatcaaggacgcctacgccgactatgtcaaggccatcggtagctgaactcagaccggtcgtgcaccccgcgggggtcaaggaccggcgcagcggtgagcactggatgggacgcctctacatgcgtgaggtgtccctgcgggtggaccgctacctggtgaacaccaaggtcacgcccaaccagctcacgtacctgatgacggtgtgcggtgtcctcgccgccccggccctgctggtgccgggcgtgtggggcgcggtgctcggcgtcgtcgcggtccagctctacctgctgctggactgcgtcgacggcgaggtggcccgctggaagcagcagttctcgctcggcggcgtctacctggaccgggtcggcgcctacctgaccgacgcggccgtcctggtcggcctcgggctgcgcgccgccgacctgttcggcaccgggcggatcgactggctgtgggccttcctgggcacgctggccgcgctcggcgcgatcctgatcaaggccgagacggacctggtcggcgtcgcccgccaccagggcggactgcccccggtcaaggagagcgcggccgagccgcgctcctccggcgtggcgctggcccgccgggccgccgcggcgctcaagttccaccggctgatcctcggcatggaggcgtccctgctgatcctggtcctcgcggtggtggaccagatacggggagacctgttcttcacccggctcggcacggccgtcctggccggcatcgcgctgctgcagacgctgctgcacctggtgtccgtcctggcctccagcaggctgaagtgagcgcgcccatgaaggtcggggccgtcattatcacgatgggcaaccgccccgacgagctgcgcgcactgctggactcggtggccgagcaggacggcgacccggtcgaggtcgtcgtcgtcggcaacggctcgcccgtcccggacgtccccgagggcgtacggacgatcgaactgccggagaacctcggcatccccggcgggcgcaacgtcggcatcgaggccttcggccccggcggcaccgacgtcgacatcctgctcttcctcgacgacgacggcctcctcgcccgtaccgacaccgccgagctgtgccgtcaggccttcgccgccgacgagaagctgggcatcatcagcttccgcatcgccgaccccgacaccggtgtcacccagcgccgccacgtgccgcggctgcgggcctccgacccgatgcgctcctcccgggtcaccaccttcctcggcggcgccaacgccgcccgtacgaaggtcttcgccgaggtcggcggcctgccggacgagttcttctacgcccatgaggagaccgacctggcgtggcgggccctggacgcgggctggctgatcgactaccggtccgacatggtgctgtaccacccgacgaccgcgccctcgcggcacgccgtctaccaccgcatggtcgcccgcaaccgggtctggctggcccgccgcaacctcccggtcctcctggtcccggtctacctgggcgtgtggctgttcctcaccctggcccgccgcccctcgcgcccggccctcaaagcctggttcggcggcttcagggaaggctgggccacaccgtgcggaccgcgccggcccatgcggtggcgtaccgtgtggcggctcacccggctgggccggccgccggtcatctgacaagctcgaagcccggcagcaccggccctacccggccggtgcccgtgccatgcccgtccatccgcacaggctgcgcatctcgaagacgaaagtattcccttgtgagtgagacaacgcatgacggctctgtcaccctcggggcggcaccgccgcccgacgagggcctcccggcggaccggctcgccgcgaagtacggcctttccgtcagcggcgcccggcccacgctcgtcgagtacgtacgccagctgtggggcaggcgccacttcatcctcgccttctcccaggcgaagctgaccgcccagtacagccaggccaagctcggccagctctggcaggtggtgacaccgctgctgaacgcggccgtgtactacttcatcttcggcgtcatcctcaaggccaaccggggcctgtcgcacgacacctacctgccgttcctggtcaccggcgtgttcgtcttcaccttcacgcagaactcggtcatggccggcgtccgcgccatctccggcaacctgggcctggtgcgggcgctgcacttcccgcgggcctcgctgccggtctccttcgcgctgcagcagctccagcagctgctgttctcgatgatcgtgctgttcatcatggtcatcgccttcggcagcttcccggcggtgtcctggctgctgatcgtcccggcgctggcgctgcagttcctgttcaacacgggcctgtcgctgatcgtggccaggatgggcgccaagactcccgacctcgcccagctgatgccgttcatcatgcggacctggatgtacgcgtcgggcgtgatgttctccatcgacagcatgctcaagggccggccggaatggttcatccggctgatgcaggtcaacccggccgccgtctacatggacctgatgcgcttcgcgctgatcgacggctacggtgcctcgcacctcccgccgcacgtctgggccatcgccctgctgtgggccgtcgtcttcttcgccggcggtttcgtgtacttctggaaggcggaggagaggtacggacgtggctgagcagaacaccggcggcaacgccgcgaacggggcccggatccccaccgtcatcgcggacgagctgcacatcgtctaccgcgtcaacggcgcgaagagcggcaagggcagcgccacggcggccctcagccggatcctgaagcggggcaaggacgagtcggcgcgcggtgtgcgcaaggtgcacgccgtcaagggcgtctccttcgtcgcctaccgcggcgaggccgtcggcctgatcggttccaacggttccggcaagtcgaccctgctgcgggccatcgcgggactgctcccggcggagaagggcagggtctacaccgacggccagccctccctgctcggtgtcaacgcggcgctgatgaacgacctgaccggcgagcgcaacgtcatcctcggcggcctggccatgggcatgtcccgcgagcagatcaaggcgcgctaccaggagatcgtggacttctcgggcatcaacgagaagggcgacttcatcacgctgccgatgcggacgtactcctccggcatggcggcgcggctgcgcttctccatcgccgccgccaaggaccacgacgtcctcatgatcgacgaggcgctggccaccggtgaccgcaagttccagacgcggtccgagcagcgcatccgcgagctgcgcaaggaagcgggcaccgtgttcctggtgagccacaacaacaagtcgatccgggacacctgcgaccgggtgctgtggctggaacgcggggaactgcgtatggacgggcccacggaagaggtgctcaaggagtacgagaagttcacgggtaaatagacgacgcggtgaccggggccccgccggaactttccggcggggcccttcgcccgtaaaggaaccgtcaactcgcgcggtccttaggaatcttgacggcgatcggtgtgttgttgtgatctgcgggacaccccccctgcgacccgcgacgttgtacaacgtaagctgtaccggtccccgaaagcggcaagtggggagataatgcgcgacaccctccgccagggccgctgcccggagggccgggcggcgtgtccgaaatagtgtgtgttgggtcggcagtgtagaacgggagatgtgacggcaatggctacggaaactcccctgctcaccgcagcatgtgccgtccatgcgccgggcagcggacgatgaccgggacggacgcggcgctcgacccggaacgcgccacactcgacaaggccgcgggtgagaacttccccgtggcaccgttcttcctgccccgggcctggcgcaccgacctgatggccgtgtacggcttcgcccgcctcgtcgacgacatcggcgacggcgacctggcccccggcggtgccgacgcgcgactgctcggcgtgccgtccgaacgggccggggaccgcctcgtcctcctggacgccttcgaggccgacctgcgccgcgtcttcgacggtaccccgcaccaccccctgctgcgccgcctgcagcccaccgtgcgccgctgctcgctgacccccgagccgttcctcggcctgatcgccgccaaccgccaggaccagctcgtcacccggtacgagacctacgacgacctgctggcctactgcgagctgtccgccaaccccgtcggccggctcgtcctcgccgtcaccggcacctcgacccccgagcggatccgccgctccgacgccatctgcaccgccctgcagatcgtcgagcacctccaggacgtcgcggaggacctcggacgcgaccgcatctacctgcccgcctcggacatgaagcgcttccacgtccaggaggcggatctcgccacgcccaccacgggcgcatcggtgcgcgcactggtcgcgtacgaagccgaacgcgcccgtgaactcctgaatgaaggcgcccccctggtgggtagcgtccacggcaggctgaagctgctgctcgcggggttcgtggcgggggggagggcggcgatccgggcgatcgccgccgccgaatacgacgtacttcccggcccgcccaagcccggcaaggtccagttgctgcgcgaggtgggcgtgactctgcgaggagaggggtgatccgggccgtggagtcggaacagcacgcgtccgcaccggtactcgccgcctacagctactgcgaggccgtcaccgggcagcaggcccgtaacttcgcgtacggcatccggctgctgccggcacccaagcgccgcgccatgtcggcgctgtacgcgttctcgcggcgtgtcgacgacatcggcgacggcg

SEQ ID NO: 186 - DNA, 2596 bp, Unknown
  Kingdom: Bacteria, Phylum: Actinobacteria, Class: Actinobacteria, Order: Streptomycetales, Family: Streptomycetaceae, Genus: Streptomyces
ggccctgctcgcctccgagatcgaggccggcaagaccgtccaggcgttcgtggacgaggccaacgccaacctcggcgagaagatcgtcctggaccgcttcgcgcagttctccgacggcttcgtcaccgcgtacatgcaccgcacgatgcccgacctgccgccgcagatcggtgtcctcgtcgagctggacaagccgaacgccgaggtcgccaagggcgtcgcccagcacatcgccgccttcgcgccgaagtacctctccaaggaggacgtgccggccgaggtcgtcgagtccgagcgtcgcatcgccgaggagaccacccgcgccgagggcaagcccgaggccgcgatcgccaagatcgtcgagggtcgtctgaacggcttcttcaaggacgccacgctgctcggccagccctacgcgctggacaacaagaagtccgtccagaagatcctggacgaggccggtgtcaccctgaagcgcttctcgcgcatcaaggtcggcatctgagtcttcagtccgtaccgcgacggacgcccggcccggatagggtcgacagcagtcgtccatgtcgcgcgcgccggcacgcggccgcgcgtgacggacgacagcagatctgacgaggaggccattgccgctgcatgggatgcgaaacacgccccaccggcaatggccttcttcgcatgtgtaccacgtaaaagaggcgggatctcatgaccaccaaggcccagaagagcgacgacggcaaagtgaccggccggtttctgctgaagctgtccggagaggccttctccggtggcgggggcctgggcgtcgacccggacgtggtgcacgccatcgcccgtgagatcgcggccgtcgtccaggacggcgcgcagatcgcggtcgtgatcggcggcggcaacttcttccgcggcgccgaactccagcagcgcggcatggaccgcgcccgctcggactacatgggcatgctcggcaccgtgatgaactgcctcgccctgcaggacttcctggagaaggaaggcatcgacagccgggtccagaccgccatcaccatgggccaggtcgccgagccgtacatcccgctgcgcgccgtgcgccacctggagaagggccgcgtggtcatcttcggcgccggtatgggcatgccgtacttctccacggacaccaccgccgcccagcgcgccctggagatcgacgccgaggcgctgctcatgggcaagaacggcgtggacggggtgtacgactccgacccgaaggccaacccggacgccgtgaagttcgactccctcggctacggcgaggtcatcacccgcgacctgaaggtcgccgacgccacggcgatcacgctgtgccgcgacaaccggctcccgatcgtcgtcttcgagctcctgaaggagggcaatatcgcccgcgccgtcaagggtgagaagatcggcacgcttgtgggtgaccaggccggccggagctgaccggcaccccccggtcgccgggccgccgtgaagccccctgtccgggggacggacgggacggacccggaccgggggatggacaatgtcctgccggtcgggaaccgtgcaggaagaagacgcgacgcagccggccgccggccccgaccgggaaccgcagccgggcctactcaagacacgcaggagcaagtggtgatcgaagagaccctcctcgaggccgaggagaagatggagaaggccgtcgtggtcgccaaggaggacttcgccgcgatccgcaccggccgtgcgcacccggcgatgttcaacaagatcgtggccgactactacggtgcgccgacgccgatcaaccagctggcctcgttctccgtgccggagccgcgcatggccgtcgtgaccccgttcgacaagagcgcgctgcgcaacatcgagcaggcgatccgcgactccgacctgggcgtcaaccccagcaacgacggcaacatcatccgtgtggtgttccccgagctgaccgaggagcgccgccgtgactacatcaaggtggccaagggcaagggcgaggacgccaaggtgtccatccgctccgtgcgccgcaaggccaaggacgccatcgacaagctgatcaaggacggcgaggtcggcgaggacgagggccgccgtgcggagaaggagctcgacgacaccaccgcgaagtacgtcgcgcaggtggacgagctgctcaagcacaaggaagcagagctgctcgaggtctgatgaacgactcttcctggggagcgccgcagcaggccgggtactgggggcccgctcagggggcaccggcccagggacccgtcccgggcccggcccccgcgggccccgcctacgatgcgccgggcgcccagcagacacgccccatgcccatcgtgcccgaggtgcccgcacacggcggaaaccaggatgacgaccggggggccgcgcacacgggcggctccccgttccgcgacgagccgccacggccgcagccctacggccagccgcagccccagccggggaaccctccgcgtccgccgcagccgcaggacctctcgggtccgcagccgcaggggcacccgcacgcgtacggcctgccgcagccgcatccgcagccgtacgaggc

SEQ ID NO: 187 - DNA, 1612 bp, Unknown
  Kingdom: Bacteria, Phylum: Actinobacteria, Class: Actinobacteria, Order: Streptomycetales, Family: Streptomycetaceae, Genus: Streptomyces
gttccgcctgagcgtggacgtcccggcgggcagcacggccgaggggacgtggatctcggccgtgctgcccgccgggacgtccacgctcaggcggaaccggtcgccgtcgcgctgccaggcggtgcgcgcgagaccgtacggagtgcggtacgcgccggacgccgacgtcatgtcgccctcgaccgccggatccaccagcagttcggcgtaacccaccgaggcggcggtctggtccaggcccgcgacacgggtggtgaaccaggagtcgatcgcgccgagcatgaagtggttctgcgactggccgggaccgccgtcccaggactcgcccagcgtcgtgttgccggccaggacctggtagccgtagctggggctggtggtccgggtggcgatccggtggacgatgtcgtcgcggtccgccgccgacagcacgcggaacgcggccggcagggagatctcacccagcagcagatggtcgccggcggcctcgacggaggccgtgaagtgaccgaggagacggtcccgtgcgcccgccggataggcagccatgtccagggcgagggcctcggcgccctggccgccgccgccgaacgtgcccgtctccgccgagtagtacttctccgacagggcccggacgctcgcatcggccttggcccggtacgcgtcggccgccgtcgtgtcgccgagcagcgcggcgatccgggcgagggtgtccacgacccgccagtagccgtaggtgccggccaccgcgcgcgggaaggtgcggtcgggtgtgaaccagtcgcccaggccgtagtccaggatgccgccggagacctggctctccaggaaggccgcgtaccgcttcatgcgcggatagtaggtgcgcagcgtgtcccggtcgccgtaggtcgtgtacagctgccagggcaccaggacgaaggcgccgccccagttggcgtcgttgcggtaggcgccgggcaggctggtgtactcgggaacggtgctggggatcagcccgtcctcggtctgcgcgtcggccatgtcccgcacggtcttgcggagttgggcctgcatgtcgaagttgcccgcgagcgccgggaacaccagctggtcctgttccagccagccgagcttctcccggctggggcagtcggtcaggacgctcatcatgttgccctcgatcgaccggcggatcagcgaatggatcgcgtcgatcagcgggtcggaggtggtgacctcaccggcggaggcgttgtcggtgtgcaggaccatgccccgtacggtgaccttcgcacccgtgggcacacccttgagttccaggtagcggaagccgtggtagctgaactccgggtgccaggtggcggtgcgggcggagccggtggtgtagctgtcccacaggggtgcgcccacgttgctgatggactggaaggcgtggccgcccttcaggctctcggccgggtagacacgtatcccggtgccggcgggggcggcgagggtgatctcgggccagccggcgatgttgcggcccaggtcgaagacgcggctgccggcggcgccgtcgacctccttgccggtgagcgtctccaccacgcggatcggctcggtctcccgggcgctgagcacggccgggccc

SEQ ID NO: 188 - DNA, 8004 bp, Unknown
  Kingdom: Bacteria, Phylum: Actinobacteria, Class: Actinobacteria, Order: Streptomycetales, Family: Streptomycetaceae, Genus: Streptomyces
cccccgttccccccgtccccccgttctccgggtcaccggtgtcccggtcacccggctcctcgggcggtgctcagcactccggcaccatgtgcggtgcgacctcgcccttcttgctcatgatcgacgtactgtcgtcgatgtagccggagccgtcgtcgtaggagatcttgtaccagccctcggtgtggcacttgacggtcaccggcgccaggaccgtgagttcgcccacctcgtgcgacgaggcgccgccgcccgaccagaccgtcacgtcgtcgtagttggcgatcttcccctgcaggccgtcgtccccgcacccggcgagcgtcagcccgcacagcaccgcacagaccacggccgacgccgagcgccgcacggcggtcacctcaccgcctccccggtccgatgcgcgaagcggtccttggcgtaccgtccccgcgcggccagcggcagctgcccgtgcgccccggccagaccgaacgcgggcatgtcgaagtagatcgactcgtacgccccctcgggcaccacgtacgcctcgtgccacagccccacgtggccgcgaaccgcgcccgagcgctccttgcggttgatgatcgaccagacccggtggtggaacatgtcgggcgaggcggcgtaggcgtacagcttgtccctggactcccagtactggacgacgtagtacgtgcgcggtgaggccgtcagcaggacgtggcccagcagcccccggccgcggtcgcgcacgagctcccgcagcatgcggagcatcgacagcatgaccagcggccactggtgcaccgcccagaagtggttgatccgcatgccgatcagcaggaccaccacatcgccttcggcgcctgccgtcgtacggccccgtaccggcttcgcgaacacgaagaccccctcatcctcgatctggtcgcagatgggatagctccactatccatccggttggtgattggatagtggcacttcccaaggaaaggcgcaagatgcggctggccgagctgagcaggcgcagcggtgtgtccaccgcgacgatcaagtactacctgcgcgaagggctgttgccgccgggacgccaggtgaacgcgacgaaggccgagtacgacgaggagcatctgcgccggctgcggctggtgcgggcgatgatccaggtcggcaaggtgccggtggcgacggtgcgcgaggtgctcgggcacgtggacgacgaggccctgggccgcacgatccggctgggcgcggcgctgtgggcgctgccgcaggtgccggagcccgacgaggacgacgagtacgtccaggccgcgcagcaggaggtgctgaccctcctcgaccggctcggctgggagaacaccaagcagctcacgaccatctcccccgcgtaccgctcgctggtggtggcggtggccgcgttccgccggctcggttacggattcgggtccgaactgctcgcgccgtacgcggagttgatgtaccggacggccgtcctcgacctggacaacatggagcggtacacgtcggacgcggaacgggtcgagttcgcgatcctgggggcgatcctcaacgagccggtgctccaggcgctgcaccggctggcgcaggaggaggagacggcccggcgctacggcttcgagtgagcgggtccggccgggccggacacgccgatgggccccgccgaagcggggcccatcggatctgtacccccgaccggattcgaaccggcgctaccgccttgagagggcggcgtgctaggccgctacacaacgggggcgtggacactgcaggcgtttcatactgcaccgccgcaggtccgagctggtctacctggactcgaaccaagactaactgaaccagaatcagtcgtgctgccaattacaccatagaccaatgatggtttagaccagtcagtacccccgaccggattcgaaccggcgctaccgccttgagagggcggcgtgctaggccgctacacaacgggggccctagcgatcctgcatcgaggtcggcgggagctaccctgaccgtcctcgcgggaaggatctgtacccccgaccggattcgaaccggcgctactgccttgagagggcagcgtgctaggccgctacacaacgggggcttgcggatgtgatccgcggttgcagactgaagcgtctgcgagctggcctacctggactcgaaccaagactaactgaaccagaatcagtcgtgctgccaattacaccataggccactggaacgcaagcccctgcggggttcttgttctagtactgcgcttcgggtttccggccttccggcccgctccccgcggcgcaggaagaacattacctgaaggtggacggggctccaaaacgagtatcggcgccgaggagcgcgggcagttcggacagggaggcgatgcggcgcggtccggcggccgggtcgagcgtgacgcgggcgccgccgcggtcgatccacaccgacagcaacccggcgtcggcggcgccgcgtccgtcgatctccgggtggtcgccgacgtacgccacctcgtgcggggccaggcgcagggcgtcgcaggcggcgaggaaggcgccggcctcgggcttggagacgcccagctcggcggcgcacaggacggcctcgaaacggtcgcgcacaccgaggaggcgcagtttgcgctcctggacgacgaggctggagttggagagcaccgcgtggcggtggctggcggccagggcgtccaggacgggcagcacgtccgggaagagcgcccaggccgcctcgtagtgcgtcatgtaccggtcgaaccaggcgtcggcctcggtgtccgtgaggtcccgctccaggaagacgcgggtgcggtcgcgccgcagtgtgacgaagtcgacctcgccggccgcgaagcgggcccactgccggtcggtgatctcccgccagcgcaccagggcctcctcggcggagccgtacccggcgagcagtccctcggccaccagatgggctcgcatgcccttgcggtccgcggtcgtgtagtcgaagagggtgtcgtccacgtcccagaccacggcgcgaatgctcatgatccgacggtaacgcccgggggccgccggcgtccgccggaacggcgaaggggcggcgcccggagttccgggtgccgcccctgacgcgtgtgccggtcaggccgcgagcctcgtcagtgccgcgtcgatgcgggacagcgtcttctccttgcccaggacctccagggactcgaagaggggcaggccgaccgtgcggccggtgacggctacgcggaccggggcctgggccttgccgagcttgaggccgtgcgcctcaccggcggccaggacggcctccttgagggagtccggggacgtccagtcggccgcctggagcttctcgcgggccgtgcgcagcagcgcgtcgctgccctccttcatcgccttcgtccagctcgcctcgtcgaagaccggctcgggcaggaagaggaagtcgacgttgtcggtgatctcggagagcaccttcaggcgggtctgcgcgtgcggggcgatggcctgccacttggcctggtcgaagtcctccggggcccagggggcggcgggggcctgcagccagggggtgcagcgctcggtgaagtccttcacgtcgagcaggcggatgtggtcggcgttgatcgcttcgcacttcttgaggtcgaagcgggccgggttggggttgacgtcgctgatctcgaaggccgcgaccatctccgcgaccgtgaagatgtcctggtcggcggagagcgaccagcccagcagggagaggtagttgagcaggccctcgggcaggaagccgcgctcgcggtagaggttcagcgaggactgcgggtcgcgcttggagagcttcttgttgccctcgcccatgacgtagggcaggtggccgaaggcggggatctccttggcgatgcccagctcgatcagcgccttgtagagggcgatctggcgcggggtggaggagagcaggtcctcgccgcgcaggacgtgggtgatctccatgagggcgtcgtcaaccgggttgacgagcgtgtacagcggggcgccgttggcgcggacgatgccgtagtccgggacgttctcggcgaggtaggtgatctcgccgcggaccaggtcggtgaaggtgatcgtctcgtcgggcatgcggaagcggacgatcggggcgcggccctcggcctcgtaccgctcgacctgctcggcgctcagctcacggcagtggccgtcgtagccggagggcttgccggcggcgcgggcggcctcgcggcggctgtccagctcctcctgggagcagtagcagcggtaggcgtggccggcgtcgagcagcttctgggcgacgtccttgtagaggtccatgcgctgcgactggcggtagggcgcgtgcgggccgccgacctcggggccctcgtcccagtcgaagccgagccagcgcatcgcctccagcagctgctggtacgactcctcggagtcgcgggccgcgtcggtgtcctcgatgcggaagaccagggtgccctggtggtgccgggcgaacgcccagttgaacagggcggtgcggaccaggcctacgtgcgggttaccggtgggcgaggggcagaaacggacgcgtacgggtgcgctagccacgcttgacaaccttgttggtgagagtgccgatgccttcgatggtgacggcgacctcgtcgccgacgctgagggggccgacccctgccggggtgcccgtgaggatcacgtcgccggggagcagcgtcatggcctcggagatgttgacgatcagatcctcgatggggtggatcatctcgctggtgcggcccagttgccgctgctcgccgttgacggtgagctggatggtcaggtcggacgcggcggcgaggtcgaggtccgtctccacccaggggccgagcgggcaggagctgtcgaagcccttggcccgggcccactgcttctcgcggcgctggacgtcgcgggcggtgatgtcgttggcgcaggtgtagccgaagacgacgtccttgacgcggtcgcgcgggacctcgcggcacatgcggccgatgacgacggccagctcggcctcgtggtgcagttcctcggtgaaggaggggtactggatcgggtcgccggggccgatcaccgaggtggacggcttgaagaaggcgaacggggcgtcgggcacctcgttgccgagttcacgggcgtgctcggcgtagttgcggccgaaggcgacgaccttgttgggcagcaccggcggcagcagccgcaccttgctcagcggcaccttggtgccggagagctcgaagtccgcgaacgggatgcccttgatgatgtcgaggacgagctggtccggctggtcgccctcgaccgcgccgaaggcgacgttcccgtcgatggagaacctggcgatgcgcacgggttgcttggccccttgactgagctggctggagtctgacgctccaggctaacgcggcaggcggcccgcgcctcgcgcatcggcctccggcacggcaggtgcgcagacggcgaaggggcgcccccttcgacgacccgagcggtgtctcggcgacaccggcactgtcttcgacgggggcgccccttgggccggggcccggtctgcccgctactcggcggccgtggccgcgaccggtgccaccatgaggatggtgcgccgggggttggcggtctgggcgggcagggcgacggagtgctccggcagttccggcgtctggagcgcttcggcgtcctccaggtgcgccagcgtggtgcgccgggggttggctatgttgcggaacatcatcgtcgtcttcacggtggtagcagaccttgtcgtgtacaggcacccggagggcctcgggaccctcgcgcgggcgcggtgggcagttgcgtccctcatgtaaagcgtcaggctaaacatgcaattcccggccgaagacgtgaagagaccgtgatctccatgtgagtttgctcacggcaccctcgacaatccggacaattcctggccggacgtcgccttgataaaccggacataaaccgcctgaagccgtcattccgctcccgatcagcgcgactgggacacctgtgtcgcctcatcggctcgtagagatatgtccggtatgggggaggtcactttccacatctcgtaacccggtcctcacgcgctgtcacagaggtcacgggctggcccacatgccttgttggagatcctgcactgtgctggaatgccacggaccgccgcgggatcgaaccggcgcgcagggggcgcaacgcagcgccgagtgggcggcgagaagggggagccagcgccggtcactcacgaccaccggggagcgttttcagggcgctttccatgacgccgacaccgtctttccgctcgcgtgggaaggcgcctggtccagaggttgcgacgctagtgcagggacgtttcaagagggatggcagcgcttcggcggagccggagccgcacggcgggactggccccaaggccgtcagttcctcgccccagcacgcccagaaccagggcccggccacgtccggtgacggcgccgcgcgctccgccggagcggcctcctcggcctcggcgaagcaggacgcggccccggcggccaagcccgccaagagccctgcccccgtcggtcccggctcccgcgtgtccctgcgcaactggcgcatctccacccgcctggtgtcgctgctcgcgctccccgtgatcgcggccaccacgctgggcgcgctgcgcatcaaccagaacctggacgacatccagcagctcgacaacatgaagctgctgacggacatgaccaagcaggccaccgagctggccgccgcgctccaggaggagcgcgaccagtccgccggtccgctgtcgcacccctccagcgcgagcgccatcaccgtcaagggcttccgggacaagaccgaccgggccacggagaacttcctcgccgcctccgaggagatcgacagcgccagcaagggcggcaacctccagggcgtccgcgagaccctggtcggcctcgccagcgagctgaaccacctcggcagcatccgcaagacggcgtacgcgcacgagaagaactcgacccagaccgtcgaggcctaccaccggctcatcaccgagctgctcagcctctcgcaggacatggccgaggcgaccagcaacccggagatgatccagcgcacccgcgcgctgtccgcgttctcctccgccaaggagtacgcctccatccagcgtgccgtcatcgccgccgcgctgccggccaacaacacctcctcggccaacctctccgagaacgaccggctgtacgcgcagtcggcgctcgacagccagacctccgagatcaacagcttccgcaacatctacggcgacggcgcggaagagctgatcaagcccatggaggagggcaacccgaccatccaggcggcggacacgtacgccaagcgtgccctggacagcagcagcggcctggaccagcagagcaagcggtcctaccgcgactgggtggacgacagctcgaccaagatcgagcagatgaagaagatcgagcacacgctgctcgaggagatggaacagaaggcccgtgcgctgcgcagcgccaccgagcgcgacgccatcatctccggtgcgctgatcctcctcgtcctcggtgtgtcgctggtcggcgccttcgtcgtggcccgctccatgatccgctcgctgcgccggctgcaggacaccgcgaccaaggtcgcccaggaccgcctgcccgagctggtcaagcagctctccgagtccgacccgcaggacgtcgacacgtccgtggagtcggtcggtgtgcactcccgggacgagatcggccaggtggccgcggccttcgacgaggtgcaccgcgaggcggtccgcctcgccgccgagcaggccctgctgcggggcaacgtcaacgcgatgttcaccaacctctcgcgccgctcccagggcctgatccagcgccagctgtcgctgatctccgaactggagtcccgcgaggccgacccggaccagctg

SEQ ID NO: 189 - DNA, 1095 bp, Unknown
  Kingdom: Bacteria, Phylum: Actinobacteria, Class: Actinobacteria, Order: Streptomycetales, Family: Streptomycetaceae, Genus: Streptomyces
gcccacgacggaggccgtgtccgaccaccacagggcgatcaccgcggcggccccgcaccacagcagcgcctgcagggcgcccgccgggaagcgccgcggtgatcgccctgtggtggtcggacacggcctccgtcgtgggcacggcgggccggctgaccggcgccgggcggatcacggggctgctgtgcgggtactcctgcgcggtgctcgtcgggctgatggcccgggtgccgctgctggagaaccggatcggttcggaccgggtggcccgctggcacgcgatggccggccggtacacggtgtgcctgctggccgcgcacgtcatgctgatcctggccgggtacgccgcccaggaccacgcctccgtgctgcacgaggcggtcaccgtggtcctggactatccggacatgctgatggccaccgcgggcacggtggtcctcctcgccgtcggcgtcacctcggcgcgtgcggtgcgccgccggaccagccacgagttctggtactacacgcacctgctcacctacgccgccgtcttcctcgccttctggcaccagctcgcgctgggcgagcagttcaacggccggcccgccgccacggccgcctggtacgcgctgtacggaggcgtgagcgcgctggtgctgtggttccgcgtcctggtcccggtgcggctcaacctgcggcaccggatgcgcgtcgagtcggtgcaccgggaggcgccgggcgtgtactcggtcgtcgtccgcggccaccgcctcgacgaactgggcgcccggccgggccagttcttccgctggcggttcctggccgagggcatgggccggacctccaccccgtactccctgtcggcgccgccccggcccggcctgctgcgcatcaccgtgaagacgctcggcgaccacagcgcggccgtgccgctgctgcggccgggcacccgggtgtgggcggagggcccgtacggagccctgaccgccgaccggcggacctcgcaccgatcgctgctgatcgcggccggcgtcggcatcaccccgctgcgcgcgctgttcgagacgctgcccggcgaggtcaccctgctgtaccgggcccgcagcgccgagg

SEQ ID NO: 190 - DNA, 627 bp, Unknown
  Kingdom: Bacteria, Phylum: Actinobacteria, Class: Actinobacteria, Order: Streptomycetales, Family: Streptomycetaceae, Genus: Streptomyces
tttcctcattctgagcggaaccggccacgagcgcggcagacacaggccgcatgcgtcgcggggggaatggggatcgggcccggggagaacccgccgtggcggagtgtgggggaaggcacccgagtggcaagcaggattgtgtataaaatttgatgtgtctagggccgtgcgcgtatcggaccggtcacgagccggcgtctgcgaaggtgctggtttccggggcggcccttgccccctcgcctacttgcccccttgccctcgacgagactcgcagatattttattttatgtttggtcgagggaagacggtagagaaagggcaacaagccatgcggcgagcagccattgtcagcccggtgcgcacgcccgtcggggcgttcgggggcgccctcaggacggtgccggtcgaggatctcgccgccaccgtcatcaaggccgtcgtcgagcggaccggcatcgacccggagcgcatcgacgacgtgtccatggcgcagtcgtacgccaactcggagacgccgtgcatcgggcgctgggccgcgctgcacgccgggctgccgctcgcggtgcccggcttccagaccgaccggcgttgcggcgggggcctgcgcctgcgacgtcgtcctggccg

SEQ ID NO: 191 - DNA, 17790 bp, Unknown
  Kingdom: Bacteria, Phylum: Actinobacteria, Class: Actinobacteria, Order: Streptomycetales, Family: Streptomycetaceae, Genus: Streptomyces
caccgcccagccggcggggcggcgctcgccgaggatctcgcggacggccgacggggggcggcgccttccaccggtcggtggggacctggtcgtagtcgacgccgtcgaccggccgcacgtgctcgggggcgcggacccatacccggtactccgcggcctgcacggcgccgtccaactggtgtagaggcagttttccaggggtgcggtattgcattcctcgccctgctcgcgactgggaagactgaagcatcgacgaagcggagtggatgtccgagtagtactgagaaccgcagtcagcggccgaagagtacgttccttggctgagggctgcgggggcaccgtctgcggcgctaccgtgctagcgagatcgtctggtgctttagaggagggaaacggggatggtggagcaggcgttaacagcactcgccgccgcaggcgggactgcggtggtgcaggccgcggggacggatgcgtggagcgggctgcgacaggcagtggctcgctggttcggccggggcaacgagcagcgagaacgggcggaactggagcgtctgaatcagaccgctggtgagttggagaccgcagagacggccgcgctggaacgggtgcgtatccgccaggagtcggcgtggcaggcccgcatcgaggccttgttggaaagtgtgggtgacaccgaacgagcccaggctgctgaggaactgcgcgtcctgttggctcagcacgcccctcaaggcgggacatcggccggtcagggaggtctggctgttggtggcaacgtggacatccgcgctgacggaggctcaatcgcggctggagtcatccatggaggcgtgcacgtaggtcaccctccggcgccggacccgtcccagggctgaacgggccggccaccccaagcccactcacaagtaccggtacgccgaccagcgtcacagcgctggcttaccataacagcttggcgatcggcagcgccggtcaggtgttctaccatgccgcaccacggtgcctggcgtcgtggccgcatcaagtgggggtactgccacggcaggctgactttttccaggaccgcaccgttgtccagcatcttgagcgggccgtcgccgacagccgtacaacggtcctgggccaggtgctggccggcatgggcggagtcggcaagacccagctcgccgcccactacgcccgcaaagtatgggccagcggtgaggtggatctcctggtatgggtcactgctaccacccgcgccgcgatcatcgccggttactcccaggctgccactgaagtacttggaaccgatcccaccgaccccgaactggccgcgcgttcatttctggcctggttacagccgaaatccagcgccctcagccgtcgctggttgatcgttttggacgatcttgctgatccagccgatctgcgaggcctgtggccccccgagagcccgcgcggccgcatcctcatcaccacccgccgccgtgatgcggctatgaccggctaccgccggcgcatggttgaggtcggtgtgttcgctcccgacgaggccctcgcctacctcaccagtgcactcgcctcccacggtcgtacggaacccccggcggaactcgatgccctcatcgttgagcttggccatcttcctctggccttgtcccaggctgttgcctacattgtcgatgctgacctggactgctccgcctaccgtcgactgctggttgaccgtaggcaatccctctccgacctactccctgacccttcccttctaccggatgatcagccagccaccgtcgccgccatctggtcactctcagtcgaacgcgccgatcgactgttcccggcggggctgtcccgccccctgcttcagctcacggcgctcctagccgctgacggcattcccatctcagctctgctcagcccggcggctctgtcctacctcacggaacatcgcacccccctcggcgcccagccccacagcggagaggtcaaagccgaggatgcaagacgggcactgcgcaatctgcaccggctcagcttgatcgatcacgtctccagaaatcaccaacgggaagttcgtgtccaccaactcgttcaacgcgcaacccgtgagaccctcacccctcagcaacgcgacgagcttgctggtgccgctgccgacgccctaactgatgcctggcctgaagtcgaacgcgatgcagcgcttgttcaggcccttcgtgacaacgccggggccctcttccgccatgctgaagacgccctgtaccgacccgatggcgtgcatgagctgttcctgcgtgtcggccgaagcttcggcgaggctggtcaggccgcggttgcggtggatcacttccgacgcgtgtctgacaccgctgcggacctactggggcccgatcacaaacatgtcctcacggcgcagtattacctagcccattggcagggagccatgggtgacgtcgctggagctgttgtcgcctccgaggagatcttcgaaaagtcactgaggttgctgggacctgatgacccggaaattctggctgccgggcaagaactcgccaactggcgggcgaaagcgggcgacgtggtcggggcggtgaatgccttcgaaaaactgctcgatcagacgcggcagatattggggccgggccacccccacaccctcatagctcggcacaacctcgccctatcgctgggagaggcgggggaaccggcccgagccgcggccgcctttgaggagctgctggctgaccgggagcggacgttgggcaccagccatcccgagactctgaaaacccgagcccagatcgcccactggtggggtgaggcgggggaaccggcccgagccgcggccgcctttgaggagctgctggccgagcaggaacaggtgttgggccccaaccacccggagaccctcatcactcagctcggcatcgggcgatcaatgggaaatgcaggcgatcctgttggtgccgtggctttcttggaagaactcatcgaccagatgctaggagagttggactttgaccaccccattgtcctcgacgcgcgccacaatcttgcctactggttgggtaaggcgggtaatttcactggtgctgtgggcgttttcgaggtcctgatacctgatgaagatcgagttcttgggtcccgccacccctcgactttactgtgccgcagtcaacttgcggcatggcaaatcaaggctgggctccctggtgccgtcgctgcctttcagggagcgttagaccagatgcagcgcatcttggggccggaccatcccttcactatctatacgagagatgagttcggtgagtgtggcgagaacgacggcggctccgccgctcatctatcgaccaacgcctgaaagtaaatcgcgttctcgctgccctcgtacgagggcaggcccaccaggagcacccagccggtctcggtctgccgccgcctccacaaccgcgccacgatctcctgctcgggataccccagcaccggttcggcaggcagcacgacccgcaccggcacaggaccgggagcagcaggggcagggggcgtcgtcacgttcccaccgtacgcagcgggcatccttccctggggaccgcccaccgtgccgtctcgcgcaggagcgccacgtccggcgaatctgcgagccgccgcgggatgagccacgtcgtacggtgcgatggcttcgttcatctcaaggaacagcgattgtcgaccggttccgggtcggttgtcgatcagtcggctcatgaatgtcgaagagaaatgacggcactgtcgagtccgtgaacgcgggacggccagtcgcccgtcagcggctggccgtcgaggcaggtggagacaggagtgtgacgtatctggccagcgcggtgctactgaaggatctgcagactccaggtgtcggcctcgggactgcgccggtagaagacgttcggttgaaccgggtcacatgccaccagcagaatgtctccctggccgagcacgaccgtccgttcgacgtgtgtggagcgtcgcttgcgggtccgaagggtctcaagccgcagcaagtgcgggcctgcgggaagagggacgaaacgaacctttctgaagttggtccggtccacgctgcagagcatgcggtcaccttccctgacggacaccaagcaccacttgggtgacatgctgcggatagggtcgcgtaggtcaacctggatcagcaggccagtgcgacctcggcggcgggccctgtggatcagataacgagagcgccacttcaaccggccgtcgaagacactgttcaccagcaccgcaatgtctgccatgcttcccccgtctgagagcccgtcaagtccgtcgaccaggctggcacggacatgccgagaaccagaagtgccccgaccggcaacatggcccggccgaagcttgccgacaacagcggtgtcaagcccagatgtggaggtcagccggccttggcgggttcctcagctcgtgcccgcgaagagggccggatgtccgctgcgcgagtggccgcggctgcccagagcgtgggacaggggcgcgaaaaccgccgggccgggggatgggtgagggcatgagcactcaccatgacggtccggacggtgcgcacctgtgtcgacggtcacgtaattccccaggtctgcggtcacgtaattccccaggtcgtcgccccagtgcgggtttaggttggcgagcatgaccatgcgcgggcgaagctatcgctatgtcggaccggccgagttgaggaatctggtccgaccggacggcgagggtcagagcatgcgttcgtcggcggacttcggcgagtgggtcacggctcggacggtggaggagttggccgagcccttcacgttcgtggtcgatcaggctggggttctgcgtctcgcgccgcgtcgcagtgagcacgtggtgtgtgctggtggagaagctgtcctgggtgctggcgagatcagcttccgcgaggagtccgggcggtgggcggtcgacgaggtcagcaatcagtcgaccggctactgcccggacgtcagctcgtggtcggccgtcgtcgaggccctggaccaggccgggatcgttcgcccctccggcttcacgcacgaggtggtatttcgacgctgcctctcctgccggcagctcaacatcgtgcgcgaggaggacttcgtctgcgtattttgtgacgaggccttgccgcgcgagtggaacgttgaccagcccggacgctaggcggtcggcggcttgccggtcagactcttggggcgtttgttcggccggtagctggggccgttcatgatgacctggtgactggtgttgatcagccggtccaggagagactcggcaacgacggggttggggaacagtggataccagtcgctgggagcccggttgctggtgatgatcagggaccggccctgcctctcactgaccagctcgtagaggtcatctgcctgggctgcggtgagctgccgcatcgcgaaatcgtcgaggatgagcacgtcggggcgaaccagttcgcggatgcgcttgtcccaggtgcggtccgcgtggccgccggcgagctcggccaggatgcggctggtcttggcgaagcggacgttggcgccctggcggacggcctggtggcccagtgcctgggcgacgtgtgtcttcccgacgccgacgggcccgaacagaatgacggactcgccggagtggagccagcgcagggccgcgaggtcgcggatctgggcggccggcagcttcggggaggcgttgaagtcgaagccctccaaggtggcctgttgctcgaacttcgctctgcgtaggcgccgttcgagggcgatggactcgtggcgggtgatctcgtcctggcagaggacctggaggaagtcgaggtgtccgagttcgcccttctgggcctgagtgaggcgggcgtcgagtgtctcgagcattccggacagccgcagggtctagtgctgaccccgcaggaggtggtccgcaacgagcacttcgccgcccggtccgtcttcacccggccgccgctggccggtggccgcgccgtcgccgtggtcgacggactggtggagatcgacggtgtacgggccgggtaccgcaccgcggctccggagatcggcagggacaccgacaaggtgctggccgacctgggtgagcgtcggccgggccccctcccgtcgcaccgggtgcacgagcaccgttcgagggactgcgcgtgctggacctcggggtcatcgtcgcgggcggtgaggcgggtcggctcttcgcggacctcggcgccgaggttctgaaggtggagaacctcatgtcgcccgacggctctcgccagtcactggacggcagcgcgatgacaccggtcttcgcctggggcaaccgcaacaagctcggtttcggcctcaacctcaaggacgtccgcggacacgacctcttcctgaggctcgcggcctgctccgacgtggtcctcagcaacttcaagcccggcaccctccacaagctcggcatctcgtacgagcagttgaaggaggtcaaccccggcatcgtcgtcgtggagtcgtccgcgtacggccacaccgggccctggtccggcaaccagggctacggtcccatggtgcgcagcgcggtcggcgtgaccgggctgtggcgctacccggaggacgagtaccgcttccaggacgacaccaccgtctaccccgaccacgtcgcggccaggatggcggttttcgccgccgtggcgaagctcgtcgaacggcgcggaacggggaccggcggcacggtgcagcttgctcagacggaggtcgtgctcggtcagcacgcgcatgtcttcgccgcagagtccctggttcccggaacgacggtcgcggtcggcaacgtcggacccggtgacgcgccccggggcgtctacccggccgcgggcgacgacgagtggctggtcgtcgacgttcagggcgacgaccagtggcgccgcctcgccgaggtgaccggcctcgacgcctcccgctgcccggatgcggcggcgcgggtggcccaccgagcggagatcgacgcgcatgtggccgcctggtccgctgtgctggcgcccgaggagggcatggaacggcttcaggaggcaggcgttccggcggcgaagatgatgcgcatcaccgagttccccgacaacccgcacctggtcgcccggcggaccttccgcccggcgctgcacccgctgatcgaccggccgatgccgagcgagaacctgccgggcctgttcagccgcgtgcccgaccccgagctgcggcccgcaccactcctcggtcagcacacccgcgaggtcgcggcccgtgtcctggggctggacgacacgacactggacgagctgttcgcggcgggggtcctgcagcaggacccgcgggtcgccgaactcttggtgccaacgggggagtagctgtcacggggcgcccgctcgcgccggtgccccgctcaactcctcgaccgccgcctcgacacgccgcaggatgtcgggcctgcggccggcctgctcggcgcaccacgcgaagccgacgtccatgccgaatccggcgtcctcgaccgggacggtcacgaacgcgggtggcgccatcagggacggcagggaagctcccggcacgtcgggtacgaacgtcaccaatccgcgcagcagcacctcgcgggagatctccacgcctcccggcgcaccatggacgcgctcgatgcgggtgactccggtcctctccagcatcgaggcgaccggctgcgcggctcgggcggacggtgaggcgacgaccggtgcgacgaccctccggtggcgaagatccgccagggacaccctgttccgtcgggcgagcgggtcgtcggccctgaccgcgacggccagcgggtagcggagccacggcaccacactcaaccccgcctctccggccggcaggtgcagcagtgcgaggtcgaggcgtccgttcaggagggcgggcacgatgtcgtcggagtcctcgacgatctccagcgctgatccgccgtcttcgtcggcgctgccgacggccgacgcgaagcgggtcaccaacgacgtcggcgcccaggtggtggcggcgatccgcagcggccggacttctccccgtgcctgggcagcgatcgacgcaagctcgccgacctgagcgaggatctgccggaccggagccaccagcgcctcgcccatcggggtgagggccacgtggtggtaccggcggacgaagagcgcgccgcccagttctcgttccaattgggcgacctgtcggctgagcggcgacgtggtcctgtgcagacgctccgccgcccggccgaagtgcagttcctcagcgacggtcaggaaggccgtgagcttggtgagatccatccgacccccagacctcctcgtgacgtccccagtgtccagcgaccgctccagaccagaatcctcctgctggtccacatgccacctctagaacggtctctggggcgagacggcgggcggtaagagaaaggggcccgtgcaacggtccgcagaccggtgcgcgggcccctgggtggcgtacggctcagtcctcgacggcgagggcgaggcgctccgcggcctcggcgaagtcctcggccatctcgtacaccacgtcgcgagcgggccgcacccggttcatcaggcccacgccctgcccgacccagtaggtggccagctcccgcgcgccggagtcgcccttctccgcgagggtgtcgacgtagcgcagggccggctcgctgaccagtgactgcagcggcatcggcagcgcgcccgggctgtccgggctctcccaggcgtcggtccaggccgacttgagctgacgcgagggcttgccggtgcgccccttggagcggacggtgtcgcgcgaggacgcggcgagcatcttctgcacggtgtacggcgccgtctccgcctcctcagtggtgagccagacggatccggtccaggcgccggccgccccgagcgcgatcgccgcggccatctggtggccggtcacgatgccgccggccgccagcaccggaacctcccggatcgggcggatcgcctcgatcacctcggggatcagcaccatcgtgctgacctctccgcagtggccgccggcctcggtgccctgcgcgatcaggatgtccacacccgcgttgacctgcttgacggcatgctccttggcgccgaccagcgcggcgatcggcaccccctcggccttggcacggtcgatcatgtactgcgggggcacgcccagggcgttggcgatcagcttcaccgggtggcggaaggtgacgtcgaggagttcctccccgatggtgtcgctcatcccgccgccctgccacaccggctcggccgggagccgtacgccgtgcctggcgagcagtccgtcgacgaactggcgtcggtcggccggcacgcgctcggccagctgctcgggggtgaggtgctgtcccttgccctcgaacttctccggcacgacgatgtcggcaccgtagggcttgccgtcgacgtgctcgtcgatccaggcgagttcgtactccagctgctccggggtgtgggaggaggcgcccagcacgccgaacccgccggcgttggtgacggccgccacgacatcgcggcagtggctgaaagcgagcagcggcagctcgatgccgagcatctcgcagatcggggtcttcatcagaggtgatccttcccgtgcggggacggcgcgggtgtcgtcctgggcacacgtgccgctgggaccataaaacgagacggaaaccgtccgcaatgggttgcggacgatttccgtccagaagtttgcgagaatcgccgtcatgagtacatcccgcgaaacggccgccgggcagcgcaggaccgccggtcggccacgagatcccggcgtcgagggccgcgtgctggccgcggccctggacgtctacgcggaccatgggtggtcgggcttcaccttcgatgcgatcgcccggcggtccgcggcgggaaaggcggccctgtaccgccgctggcagaacaaggaggagctgctgctcgctgcgctggacgcgcacgcgatggtggtcgaaccgatcgacaccggcaccatccacgacgacctgctggtcgtcgctcgcgagctgttcgccgtgtatctgcagggctcggtcggacttgcttcactgcgcttgttcgtggaggcgcgggcgcatcccgacctgctggcgaagtcgtgggcgcgggtcaacgcggcgcgtgtgagagccgcgcggaccataatccgccgcgccgtggagcgcggtgagctccccccggacacctcggcgaccgtcctgctggaagccctcagcggcggggtgatggcccatgtgctggcgacgccggccgggccggaccggggtatggacgaaggcgacgaacgcttcctggccgacctcgtcgaccttgtcctgcgaggggcccgctgccgctgcccgaggtccggctgcggatcctgaccccggcccggcgcgagcggcgggccggggtggctacggcccgctcactaggtgtttttgaacctggtgaaccggcatccaggctgtttggagcacatagaactcggtgtcctcaggacacggcactatgtcaaaatccagcgcatggctgttcgatacccgtcccccctgcgtcccggtgaccgtgttggtgttacctctccgtcgagcggggtcgcgaaggaactgcgtgagcgcctcaacatcgccgttcgtgacgttcaggaacgcgggtacgaggtcgtcatcggccggtgtatggacggctcggggcacgtcagtgcttcggccgctgaccgtgcgagcgaactgatgtcgatgctgagcgaccccaccatcaaggccatcgtgccgccgtggggcggagagaccgcgattgacctactaccactgctcgactgggacaagctgcgggaggcggagcccacctggcttgtcggcttctccgacatatcgactctgatcacgccgatgacgctgctcaccgggacggcgaccgtccacggcaacaacctcatggacacgccctaccgagtgcccgaaggactgcgatcgtggctcgacatcgtcgcagcgccccagggacaccggttcacccagaccccgcccggccgccaccggaccaccggcttcgacgacttcgccgccttccccgccatacgcgagtacacgctcgactccgtgggcgcctggacccggctcgacgggagcagtgacgtggatgccgagggaagactgatcggcggctgcatcgaaactctgtgcaatctcgcggggacagccttcctcgacgtctcgtccttcgctcgcaacgagtcaccggatgggctcctcgtgtatgtggaggcagccggcgacgatgctttcactatctgccggaacctgcatggcatgaggctcgctgggttcttcgaccgggcgaacgcggttctcgtcggccggaccaacgcacccgacaaccgttccctcagccagcacgaggccgtcctcgacgcactcggttctctcaacgtgccgatcatcgccgacatcgaatgcggtcacgtcccgccctacatgccgatcgtcaacggagcgtacggccgtatcgttcacacagcgagccggagcgaactgacgcagaccttgaactgacacatcagaccgatcaccgacctctgaccgagggtcggctcaacagggcgtctccccacttccggtgcgcttttttgtccagccggtgtgaggtctggggtgggtgtcactgattgatacgggtggttgtcactgtggttgagggcctggtagggccttctttttgttgtggcggctggtgacaagagtccgtatctcgcggtgtcgggtggccgttttgggcggtgtcgcctggtccgtacgtccttctccgtgctggcgtgtagcaggcggggtctgggtgggggagtggttttcggggtgattcatcatctcggggtggggaagcgtttttgcgttttggcgggcctgctggggctctttagcgtgccgggtcatggagggtgaggatcccggttgcggggcggacgtgtcgatgggcgggcagagccggctgctgcgcgccgctgcggtaaacaggctccaacagcggcgtgcggcgggggagttctcgacggcgcatgtgcggttggtggcgtcgtcgctggatgtgagcgtgcggacggtgtggcggtggctggctcgggccgaggcgacggggtcggcttctccggtgccgcggacgcgtcttgaggttacgggcgaagtcgtggacgtactcgcggatgtgtgcgggaatgtgaagcgggcgcacgaggaactggcgcgtcgtgcgcgggcggcaggggaagagccgccggggctgacgactttgcatgatgcgatccgtcgtgatctcaccccggggttcatggcagggctgcgggaggggatcccagcggcacgtggccatgatccggcgttcaagcggcctgccgtacgtcgtaatgaggtgtgggagggggatcacaagcaggccccgacaagggtggggatgccggatggggcgctggcgaaggtgtgggtgacgtggttcgaggaccgtgctacgcagatggtgatggggtgggcggtgaccgcggcctcggcgcaccggggttcggtgctggcagcgctgcgctcttcggtgctgcgtgaggacccgtatggtccggcgggcgggctgcccgatttggtgcgtatcgacgggggagcggacttcgtgtcgaagacggtccgcgccgcgttcggggcgctggacgtgccggtccatgtggttacggctgcacggttgaagggcggcgtggagcggctgaaccgtactgcggtcacccggttcttcgcggaccttccccgctatacaaaggccccgctgctggaccacaagacgcgtgtggggcaggacgatccggcgctcacgttcgaggcgttcgtgggcctgctgcgcgactgggtcgcgtggcacaacaccgagtacgtcgtggcgcgcgccggcgtgacaccgcttcaggcgtgggaggccgacgcgaggccgctgcgcgaagtggatgccgaggatttgcgtgcctacatgctggagagcgacggcaagccacgcaggattaccagtcgtggggtggatttccacggccgttcctacatgcccatggacggggtgggacgcgtcggcatgcaggtctatgtgcggtggatgccgcaccacgcgcacgaggtcgatctctacaccgtgcgccagggccgctatctgggccgggcggtgctctcggatcaggcgagcgaggccgagcgccgcaaggtgcttgccgcccgcgacgagcgggaccgggtgctgcgccgggccttgcagcgctcggcggtgcgccggcgcacgaagtacgaggcatccacccaggcggccccgcccaagccggcgacggcgatgacccgccgggaggcggtggcggaactggaggagatccagccgcgctcgcggctcaggcgggctacgggagcggcgtatcagccgcgcaacgccccggccccgggctgggtcgtgcccgcccgcagacggcaggcggatgccgactcaaacgaggagaaggaccgttgagtagcgaagcaatcgagccagagggccagcgggtgcttcagccgcagttctttttggacgtaccaggctcgtcggtcgtgacgacggacgtgctgctgcagatccaggacacgatcctggaggccatcgaggtccgcgcgatgtcgctgatctacggggacgcgggccggggcaagacgttcgcgacccgggcagcgctgcagcaggtggctccggacctgctgctgtcgctggagttcgcgcgctcacgcccaggcccgaaagatctgcgcgaggagttgttcgcgcagatgcgcctgcccggcaagatgccccgtaccgcgacgccgttgtaccggatgctgctggctgcactgccgcgccgcccgtatgtgatcgtgtgtgacgaggcgcagcagtacagccgccagtggtgtggggcgcggggttgttcgtaaggcgggagttgctttcgttcaggagtctcgttgatgacttcggtggcacgcgcaggattcaggtgctgccttaaccaaggatcatcgacgtgatggcggtggagtgtgacggagaagcctgttcttcggctggttcagggcgggctcactgacctggcccccgatgccggacgggcaccggaggcgtgggtgttccaggccggctgtgtccaggcattcgcgaacacctgggtgacccgggggtttgccccgacgacgatcggtgcctacacctccctgcttccccgggtgctggcccacttcgaccgcccggtgtggcagatccagcccgcccacgtggacgcgatgctccacaatctgctgctcgcgggccggagcgcgggaaccagacgccgctacctggacatgctgcgcgccttccacacgttcgtacgtctgcgctacgccaccgagatccgcgccctgtacggcaccatcgtgggcgatccgctggaccgcttcaaccggctgcgccacgtctgggacgagccttcccgccgactgccgcccaccgccgagcgcctcacggccttcttcgctcacgcacgcgcccgcctggccgtcacatccgactaccccgccgcagcacgggactacgcgctgctgcgcaccctgtaccactccgcgccgcggctgagtgaagcgctccgcctcgagctgtgtgacgtccaccccgaactgggtccgtccggcaagctccacgtacggttcggcaaggcggccaacgcctcgggaccacgcccgagatgggccccgatgctggacggcctggaccggatccttgcctggtaccagagcgatgtccgacccctgtttcccgataccgccgcgctgttctgcgacgcccacggacagccgctgaagccggagaccgtacgcgaccgcctctcccgtctcctggataccgaagcaagacccgaaggcgatcggttcactccccacgacctgcgccgcgcctgcgcaacccatcactacgaacagggcatggacctgcttaccgtccagcaactcctcggccaccagcacatcgcctccaccatggcctacgtccggccctgcctcaccttcgtcgaggacgcatggcgccgcgccaccctgaccgctctcaccggcctggccggctgacccccccgggagcccccatgaccacacctcctctgcgcgccgtggagacccccaccccgccacccgaggtggagtggaccctgcgcatgaccgcggcacagcgcggcatctggaccggcaccgaactgcgccgcctcctggccgagcgcgctggtctcgaactgtccgcggcatcggtgtccgccctgttcaccaaacagccctctcaggtgaagctgtccaccctggccgcactatgcaccaccctcgactgcacccccggcgacctcctggccctgcacgactccaccggaccctcaacccctccgccgcgcccagcccacgatccggcacggcagccttcgcagcaacagcccatgccccaccaccgatctctcccaccgctgtgaccgcaccccagcccgccgcgaacccacccgcgcccgtcactgccgcgccccggatggccaaagacacctgcccggcctgccaccgcctgcgccagctgcgccccgacaccggccgctgcacctggtgctcccggacctgcgccctgtgcggagctccccgacgatccacccaggacctgtgcgcgatatgccgacaccgctcggcgggccgaccgacacggggcccgtgccagcactgcgggcgccgacgcaccctggacacggcgacgcgacggtgccggtcctgtaccgatcccgccaccgcaccacccccgacatgctgcgaacgctgcggcaccagcggccagtgggccaagggcctgtgtaaacgctgctacgagcactcaccgcacaccgtcatcacccgcgcgaccggctgggccgagcgcatgccagctccgccaccttggtggagcgacttcgccgcgcacctcgccgatcaccgccaccccatctacgcagcagacgtcgtcgccaccactgcacgcctgatcatcgcgactacgaccgacgatccccgcgcactgctcgcgcacgcccacagcaacgccaccgaactcgtgggagcactcaccgacttcttccaaactcacggccacctcgccccgccaccagacctcgccgaccgacgcgcagcagcccgccgtacccgccgcattgaggccacccccagcccactgcgcccccaggtcgacgccttcgccgacttcctgctgctccagcgcgagcaagcccgccagctcgggctgcaccccaaccagccgacgaccatcgagatccgcctgaacaccatccgcgacctggccctccacctacaccccgcaggacatacgagctgggcgagcgtcaccaccgccgacctcgaatcattcctcgccctggccccggcccgccgcgcctcccacctcgcaggcatgcgtcagttcttcgcccacgcccaccactccaaggccatcctccacaaccccacggacccgataactgccgtgcagcagaggggatttcacggacccaccctcaccccggcccggcagcgcaccctgtacgaacggtgggccacccaccacgacatccacccacacgaagccttcatcggcctcgccgccctcctccacgcagcaaccatcgccgagctgcggcagctcaccgacgccgacatcgaccccgaccgccacagcgtccggttccccggcagatcagtgcatctcccactggacaatgcgacttggaaggctttgcaatcctgccaggagcaccggcgccgactcggtacggacaacccccacctgcttgtcacccggcttacccgaacacaccacggaccggccggcgccgcccacatccgcgacagcctcacgcccgtcggcctcctgccgcggatcctgcgctctacacgcctgctcgctctcgcagacgaactcgacgccaagatcctcactgtctccttgggaatgtcctacgcaggagtcgcccactaccgccccaccccgactctcaccaagccaatatgacggaccgtcagattgtggaccgggcagtcaggcgctccgctccatgtatcggatttctgccgaatccaccacatgacaagaagccaagaggtgctcgaaaacctacacaatacgcagaccgaatttccgagctcgcgaaggtgaaataaactccgagaaagggcgcgcccaactccgctccggtgtacggtaatttggttgtgaggtcatagagcgctgggcgcagagggcggcctggccctgcggtcctggcagtcgctcaggtacctgccgggacgtggcagagagcatcgcgcgtgctggtgaggcccctaccagggagttttgtgtctcggcacgccatctctctgcggacctgtggccacagcttgccgagacgatagcgcaggcgtacggtcagtacctgaactggcaggagagcaaggggaactggcaaggattcaggccgaggttgaaattctcaaatttcaaccggagactgcgagtccaaacaggaagctgaattccggcgcatccttccctcctctagccagctctaggaattcgcggagcgaattcctgcaggccgaattgcggagcaattcgagccgcggacaacggagttgtccgcaccggacggcggagccggccggtgggccacgcggagcgtggccgtctttccgccacgtagtggcggcgcgtcgtgtctgcgg

SEQ ID NO: 192 - DNA, 24443 bp, Unknown
  Kingdom: Bacteria, Phylum: Actinobacteria, Class: Actinobacteria, Order: Streptomycetales, Family: Streptomycetaceae, Genus: Streptomyces
ggccacggggtgggcgtgcaggtcgtccaggcagtcgcggaccgaggacgggccggccagctcgccgccgtgcggcgccgcgaacaggccgccctcccgtgcgatcgcgaacgcccggtcgaagtcccgcgccatgccgcgccgttcgtcgttggacagtccgaaaccgaccacgccacggtcgcggtagcgcacggccagccgggccagcgtgcgggcgtccaggggatgcttcatgcggttggccgcgaccaggacccgcatgcccaggcccgtctcgcgcgcggccgtgtcgaccgcgtccaggatgatctccagcgccgggatcagaccgcccaggcgcggcgcgtacgaggtcgggtcgacctggatctccagccagcccgagccgtccctgacgtcctcctcggcggcctcgcgcaccagccgctggatgtcctccggctcccgcaggcaggaacgcgccgcgtcgtacagccgctggaagcggaaccagccccgctcgtccgtcgcccgcagtctcggcggctccccgctgaacagcgcctccgtcagcgcgtcgggcagccgtacgccgtacttgtcggccagttccagcagggtggagggccgcatcgacccggtgaagtgcaggtgcagatgggccttcggcagctcagagacatcacgtacacgctccattgggcgatcctgccgcacccgcccccgccaccggtagtcgtttccccgttcgtgctcttgctcgcacaaacgaacgggacggtcgcctccggagaaccggagccgaccgtcccgtgcggaggcggacgtcagtcccgcgcctccgccagcagcttctgcatccggctgacgccctccaccaggtcctcgtcaccgagggcgtaggacagccgcaggtagcccggcgtgccgaaggcctcgccggggacgaccgcgacctcggcctcctccaggatgagcgcggccagctccacggagttctgcgggcgcttgccgcggatctccttgccgatcagcgccttcaccgacgggtaggcgtagaacgcgccctcgggctccgggcagagcacgccgtcgatctcgttgagcatccggacgatggtcttgcggcgtcggtcgaaggcctcgcgcatcttggcgacggcctccaggccgccggagaccgcggcgagggcggccacctgggcgacgttcgagacgttggacgtggcgtgcgactgcaggttggtcgcggccttgacgacgtccttggggccgatgacccagcccacgcgccagccggtcatggcgtacgtcttggccacgccgttgacgacgatgcacttgtcgcgcagctcgggcaggagcgccggcagggacacggagaccgcgtcgccgtagaccaggtgctcgtagatctcgtcggtgagcacccacaggccgtgctcgacggcccagcggccgatcgcctcggtctcggcctcggagtacaccgcgccggtcgggttggagggggagacgaacaggacgaccttggtcttctcggtgcgtgctgcctcaagctgctcgaccgtgacgcggtagccggtggtctcgtcggcgacgacctccacggggacgccgccggccagccggatcgactccgggtacgtcgtccagtacggcgccggcacgatgacctcgtcgcccgggtcgaggatcgcggcgaaggcctcgtagatggcctgcttgccgccgttggtgacgaggatctgcgagacgtcgggctcccagccggagtcgcgcagcgtcttcgcggcgatcgcggccttcagctcgggcagaccgccggccggcgtgtaccggtggtacttcgggttcttgcaggcctcgacggcggcctcgacgatgtagtccggggtcgggaagtcgggctcaccggcgccgaagccgatcaccggacgcccggcggccttcagggccttggccttggcgtccacggcgagggtggcggactcggagatcgcgccgatacgcgcggagacccggcgctcggtcggaggggttgcagcgctcataccgtccatcgttccagaccccgatcgccccgggcacacgggtttcacccagtgaacaggtacggcggacctgtggaacatccgtccggatcccgtccccggacaggcgatcttccggtctgaatcgctccggcgggtcccggagaacactttctgttcgacgaccggccccggaacacgtacactctcacctcgttggccttcagcagccgccgccgcacctggtgcacaccgggcctacggtcggatgcggtacgttgggggacacacaaagggtcgtagctcaattggtagagcactggtctccaaaaccagcggttgggggttcaagtccctccggccctgctacacacaccttcgccaggatgtgtgcgcatgtacgtacagcaatgcaccgccgtgcggctcgaccgggcgcggcacggccacgacccggaatcaggtgaggacgaatgacggacgccgtgggctccatcgacacgcctgatgcccaggacgagatggcggagtccaagaagccccgcaagggcggcaagcgtgccaagaagggcccgctgaagcgccttgccctcttctaccggcagatcgtcgcggaactccgcaaggtcgtctggccctcacgtaaccagctgacgacatacaccaccgtggtgattgtcttcgtggccgtcatgatcggcctggtgaccgtgattgactatgggctcaaccacgcggccaagtacgtcttcggctgagccaagagcgaagggcgccgtggttaccggcgcccgttttcgcatgttccacccctatgtatccaggaagaagcagccaccgtgtctgacccgaacctgaacgacgccatcgagccgaccgagtccgtggatgacgagctcgacatcgtcgagggtgcggacgaggcggacgaggcggaggctgccgacgccgccgcgggcgagcccgccgaggaggccgccgtccacgtcgaggacgaggacgtcgaggccaccgaggactccgagggctccgaggagccggtcgcgtccgaggagtccgaggacgacgccgccgagggtgaggacgtcgaggccgccgggaccgaggccgtcgaggaggagcccgacgtcgacccggtcaccaagctccgcgaggaactgcgcacgctgcccggcgagtggtacgtgatccacacctacgccggctacgagaagcgtgtgaaggccaacctggagcagcgtgccgtctcgctgaacgtcgaggacttcatctaccaggccgaggtccccgaggaagagatcgtccagatcaagaacggcgagcgcaagaccgtccggcagaacaagctgcccggttacgtcctcgtccgcatggacctgacgaacgagtcctggggcgtcgtccgcaacaccccgggtgtcaccggcttcgtcggcaacgcctacgacccctacccgctgtccctggacgagatcgtgaagatgctcgcgccggaggcggaggagaaggccgcccgcgaggccgccgaggccgagggcaagccggccccgcagcgcaaggtcgaggtccaggtgctggacttcgaggtgggcgactcggtcaccgtcaccgacggcccgttcgcgacgctgcaggcgacgatcaacgagatcaacccggactcgaagaaggtcaagggtctggtggagatcttcggtcgcgagaccccggtcgagctgagcttcgaccagatccagaagaactagttctttctgggcatactgcttccgcgcaggtcaggcgatcgctcaagcggccgtctgacctgctcggttttcagccgcgcatctatacccgttatcgttgtgcggtatgcctgcgtccgggtggtccccgagcgcgggcaggacccgaaccgaaaggacccggagagctatgcctcccaagaagaagaaggtcacggggctcatcaagctccagatcaacgccggtgcggcgaacccggccccgccggtcggcccggcgctgggccagcacggcgtcaacatcatggagttctgcaaggcgtacaacgccgcgaccgagtcgcagcgtggctgggtcatcccggtggagatcacggtctacgaggaccgttccttcaccttcgtgaccaagaccccgccggccgccaagatgatcctcaaggccgcgggcgtggagaagggctccggcgagccgcacaagaccaaggtcgccaagatcaccgaggcgcaggtccgcgagatcgcccagaccaagctgcccgacctcaacgccaacgacctggacgccgcgtccaagatcatcgccggcaccgcccgttccatgggcatcacggtcgagggctgaaccccagcctccgtcccaccctcgtagaaccgtggcagggcctgctcggcccgtaccacgactcctttcagaacccacaggagcagttgtgagcaagcgcagcaaggctctccgcgctgcggacgccaaggtcgaccgggagaagctgtacgccccgctcgaggccgtccgtctcgccaaggagacctccacgaccaagttcgacggcaccgtcgaggtcgccttccgcctgggtgtcgacccgcgcaaggccgaccagatggtccgtggcaccgtgaaccttccgcacggcaccggcaagaccgcccgggtcctggtcttcgcgaccggtgaccgtgccgaggccgcgcgtgccgcgggcgccgacatcgtcggcgccgacgagctgatcgacgaggtggcgaagggccgtctggacttcgacgccgtcgtcgccaccccggacctcatgggcaaggtcggccgcctcggccgcgtcctcggcccgcgtggtctgatgccgaacccgaagaccggcaccgtgaccccggacaccgccaaggctgtgaccgagatcaagggcggcaagatcgagttccgcgtcgacaagcactcgaacctgcacttcatcatcggcaagacgtccttcgaggacgacaagctggtggagaactacggcgccgcgctggaggagatcctccgtctgaagccgtccgccgccaagggtcgctacatcaagaaggccgccatcagcaccacgatgggccccggcatccagctcgacccgaaccgcacccgcaacctcctcgtcgaggaggacccggccgcggtctgagcccttcggctcgcacaggtcggcgacgagccccgcaaccttccgaggtgcggggctcgtcccttttcccggggccgtgcaccggccttcccggggccgtccgtgcaccggcttcgcccgggcaccggcgcggtccgcgcgtccaccgccgtccgtccgtctgaccggccggacggctgtcggtggtctgcgctagcgtgcgaggcacagcaaccgcataggggtggggacgaatgaagagcacgaccgtgcgccgtacgacgctcgcgatcgcggtgacggccgcgctgaccggggtggccgcctgcggctcggggagcgcgtccgggggttcgggcaaggacgggaaggcgggcgggcagggcgtcacgcacgtcagcccgctggcggccctgcgcaccgccgccgcctccaccgacaaggcggactccgcccacgtcgacatgacagtcagcatgggctcgctgatgtccatgaaggggagcggcaccctcacctgggcccacagcctgtccggttcgctcacgctcacctacaccggcggcaccgtggccgacacgatgcgcgccgcggggaccacgtcgatgcaggcgcgctatctgtccgacgcctactacgccaggatgagcgaccagttcgccgagcaggcgggcggcggcaagcactggatcaggtacgggtacgacgacatcgccaagctcggcggcggctccggcgcgtacctcaaggaccagatgcagaacaacacgccgaaccagtccgtgaagctgctgctggcctccggtgacatcaagaaggccggagaggaacaggtccagggccggcacaccacgcactaccacggcacggtgaacgtcgccgacctcgccgcacacaccagccggaacctctcggccgcgcagctcgccgacatcaagaagcagctgagccggtccggcatcaccacggagaccgtcgacctctgggtcgacgacgagaacctgctggtcaagaagtccgagacggcggacacggcgaacggcccgatgaccagcaccgccacctaccgcgactacggcgtgaaggtctcggccgcagcgccgccgaagagcgacacgctggacttcaagcagctggtggcgtcgcagggtgcgggagccggcgcgtcctgagtcaaggaaccgccaagtccgcttgctcacagctcggataggctcacgtcccagctgtgtgagaaccatctgttcccaggggggaaaccatggacacctctgtacgcacgaccggcacgcccggcatgaccaccacccgcacgtcccgcaggcccgggcgggcctccgccggacgcagggtcgcgacggcgtccctggccgcgctcgtcctcgccgccggcgcggtgggctgttcggggggcgactcgaaggacggcgcgaaggacgcggggaagagcggctctgccgccgagtcccccaagctctcgcccgccgcggccgtcgccaaggcggccaagaactcgcaggcgatcacctccctgcactaccgcatgacgggccaggtccccgagcagggccgcgtcaaggcggaggcgcagatgcagatgaagcccaccgtggccatgggcatgaagatgacgatgcccgaccaggcctccgccggcacggtggagatccggctcgtcgacaaggtcatgtacctcaacggcggtgccgaggccgcgaaggagatgggcggcaagagctggctgaagttcgatctgtcctcgaccgccgcgggcaagcagatggaccagctgggcagcggcgcggcccaggcggaccagaacccggcgaccgagtccaccttcctcaccggggccaaggacctgcacaaggtcggctccgagaccgtggacggcgtcgccaccacgcactacgcgggcaccgtcgccctctccgatctcgccaaggcccagcagggcgagagcccggaggtcgccaagacccgtgagaagagcctgcagcagtacaagcagatgggcgtcgacaaggtcaccatggacgcctggatcgacggccaggaccacaccaagcagttccggatgcgcggcgacgccaccaagggcccgctggacatgaccatcaccttcctggacaccaacaagcccgtgaaggtcaccgccccgccggccggccaggtcgccgacctcgccgagatgatgaagggcgccgagcagggctgagccgcgccgccgccggggcggatttgctccgcggcggcccgttcccgtactctcctacagaagccaaagaccgctggtcgttgccgtgcgctcccgtgagggcgcggtggccgaaggatccgctgaaactgcggacgacccgcgcaggtgactgtggaagtactcccggtgtgtgcatgccctcggtatgcgtgcggccggtcgagtccgccccgagcgcctgcgccggggcgtttcgttttccccagtcctccttcgggtccgcgcggtcagaatcacccggaaggaggccgaggctctatggcgaggcccgacaaggctgccgcagtggcggagttgacggagcagttccgcaactccagcgctgccgtgctgaccgagtaccgcggtctcaccgtggcgcagctcaagacgctgcgtcgttcgctcggtgagaacgcccagtacgccgtggtgaagaacacgctgaccaagattgcggccaacgaggccgggatcacgacgctggacgacctgttcaacggtccgacggctgtcgccttcgtcaccggtgacccggtggagtcggcgaagggtctccgtgacttcgccaaggacaacccgaatctcgtcatcaagggcggtgtccttgacggcaaggcgctgtccgccgacgagatcaagaagcttgcggacctcgagtcccgcgaggttctgctctccaagctggcgggtgccttcaagggcaagcagtcccaggctgcttcgctcttccaggcgcttccctcgaagctcgtccgcacggtggacgctcttcgcgccaagcgggacgagcagggcggtgccgagtaactcggctcgctttctgaccctggccgtctaggcggcacgggtcgcagcgggccgacgtacgcccgccacacccagtacatccggcaccagccgaatcagtggaaggatcgcccgtcatggcgaagctcagccaggaagacctgctcgcccagttcgaggagatgaccctcatcgagctctccgagttcgtgaaggccttcgaggagaagttcgacgtcaccgccgccgccgccgcgccggtcgtcgtcgccggtggtgccgctggtggcgccgccgccgaggccgccgaggagaaggacgagttcgacgtcatcctcaccggtgccggcgacaagaagatccaggtcatcaaggtcgtgcgcgagctgacctccctcggcctgaaggaggccaaggacctggtcgacggtgcgccgaagcccgtcctggagaaggtcaacaaggaggccgcggacaaggccaaggagtccctcgagggcgccggcgcctccgtcgaggtcaagtgacccgacgagtccccgcggactctcctgcgcgctgaatacggtccgacagggctgtaacgcgaacgcaccgaagagcgatcatccatccgggtggtcgctcttcggcgttcccggggggtggctgtggcggccttgcacccgtgacggggaggggtatggtgatcttcgttcggcctcgagaggcccccggagacaggccgcgagtgacgacggcagcatccggttcgggtatggggggccttgacgaaccgcacgcagcgcgcaattctcaggacgcgtcgtcacaacgatccgaatccgaggcatggatcggcggcgaagagggcagtatcaacgtgcgttgagggtgacaggccgtaggcggtgacgacgacgagggttccggaaatccggcactggacatcagtgggccaagtggctacactgaccctttgcgctgcctgttagctgtcccctgcccgtcaccaggggcatgccctcgcccgagcatcgacgaccggaccgcacctgacctggcctcttggtcatttcagaaccgtctgtcccggtgcgcggaagaggggccggtacgcgcgtagtgagtccgagccctcggaaggaccccctcttggccgcctcgcgcaatgcctcgaccgcgaatacgaacaatgctgccagcaccgccccgctgcgcatctcctttgcaaagatcaaggagcccctcgaggttccgaaccttctcgcgctgcaaaccgagagcttcgactggctgctcggcaacgacgcgtggaaggctcgcgtcgaggcggctctggagtccggtcaggacgtccccaccaagtccggtctggaggagatcttcgaggagatctccccgatcgaggacttctccgggtcgatgtcgctgacgttccgcgaccaccgcttcgagcccccgaagaacagcatcgacgagtgcaaggagcgcgacttcacgtacgccgccccgctcttcgtcacggccgagttcaccaacaacgagaccggcgagatcaagtcccagacggtcttcatgggcgacttcccgctcatgacgaacaagggcaccttcgtcatcaacggcaccgagcgtgtcgtcgtctcgcagctggtccgctcgcccggtgtctacttcgactcgagcatcgacaagacgtccgacaaggacatcttctccgccaagatcatcccgtcccggggtgcctggctggagatggagatcgacaagcgcgacatggtcggtgtgcgcatcgaccgcaagcgcaagcagtcggtcaccgtactgctgaaggcgctcggctggaccaacgagcagatcctcgaggagttcggcgagtacgagtcgatgcgcgccaccctggagaaggaccacacccagggccaggacgacgcgctgctcgacatctaccgcaagctgcgtccgggcgagccccccacgcgtgaggccgcgcagacgctgctcgagaacctctacttcaaccccaagcgctacgacctcgccaaggtcggccgctacaaggtcaacaagaagctgggtgcggacgctccgctggacgcgggcatcctgaccgtcgaggacatcatctcgacgatcaagtacctggtgcagctgcacgccggcgagaccgagaccgtcgtcggtgacggccagacgatcgtcgtcgagaccgacgacatcgaccacttcggcaaccgccgtctgcgcagcgtcggcgagctgatccagaaccaggtccgtacgggtctcgcccgtatggagcgcgtcgtgcgcgagcgcatgacgacccaggacgtcgaggcgatcacgccgcagaccctgatcaacatccggccggtcgtcgcctccatcaaggagttcttcggcaccagccagctgtcgcagttcatggaccagaacaacccgctgtcgggcctcacccacaagcgccgcctgtcggcgctcggccccggtggtctctcccgtgagcgggccggcttcgaggtccgtgacgtgcacccctcgcactacggccgcatgtgcccgatcgagacgcccgaaggcccgaacatcggtctgatcggctcgctcgcctcctacggccgggtcaacgcgttcggtttcgtcgagaccccctaccgcaaggtggtcgacggccaggtcaccgacgaggtggactacctgaccgccgacgaggaggaccgcttcgtcatcgcgcaggccaacgccacgctcggcgacgacctgcggttcgccgaggcgcgcgtcctggtccgccgccgtggcggtgaggtcgactacgtcagccccgaggacgtcgactacatggacgtctcgccgcgccagatggtgtcggtcgcgaccgccatgatcccgttcctcgagcacgacgacgccaaccgtgccctcatgggcgcgaacatgatgcgccaggccgtcccgctcatcaagagcgaggcgccgctcgtcggcaccggcatggagtaccgctccgcggtcgacgccggcgacgtggtcaaggccgagaaggcgggtgtggtccaggaggtctccgcggactacatcaccaccgccaacgacgacggcacgtacatcacgtaccgcctgcacaagttcgcccgctccaaccagggcacctcggtcaaccagaaggtcatcgtcaacgagggtgaccgcgtcatcgagggccaggtcctcgccgacggtccggccaccgagaacggcgagatggcgctcggcaagaacctgctggtcgcgttcatgccgtgggagggtcacaactacgaggacgcgatcatcctgtcgcagcgcctcgtgcaggacgacgtcctctcctcgatccacatcgaggagcacgaggtcgacgcccgtgacaccaagctcggccccgaggagatcacccgggacatcccgaacgtctccgaggaggtcctcgccgacctcgacgagcgcggcatcatccgcatcggcgccgaggtcatcgccggcgacatcctggtcggcaaggtcacgcccaagggcgagaccgagctgaccccggaggagcgcctgctgcgcgcgatcttcggcgagaaggcccgtgaggtccgcgacacctcgctgaaggtgccgcacggcgagaccggcaaggtcatcggcgtgcgcgtcttcgaccgcgaggagggcgacgagcttccccccggtgtgaaccagctggtgcgcgtctacgtcgcgcagaagcgcaagatcaccgacggtgacaagctcgccggccgtcacggcaacaagggcgtcatctccaagatcaacccgatcgaggacatgccgttcctggaggacggcacgcccgtcgacatcatcctgaacccgctgggtgtcccgtcccgaatgaacccgggacaggtcctggagatccacctcggctggctcgccagccgtggctgggacgtctccggcctcgcggaggagtgggcgcagcgcctccaggcgatcggcgccgaccaggtcgaccccggcaccaacgtcgcgacccccgtcttcgacggtgcgcgcgaggacgagctggcgggtctgctgcagcacaccatcccgaaccgggacggcgagcgcatggtgctcccgaccggcaaggcgcggctgttcgacggccgcagcggtgagccgttcccggacccgatctcggtcggctacatgtacatcctgaagctgcaccacctggtcgacgacaagctgcacgcccgctcgaccggtccgtactcgatgatcacccagcagccgctgggtggtaaggcccagttcggtggccagcgcttcggtgagatggaggtgtgggcgctggaggcttacggcgccgcgtacgccctccaggagctgctgaccatcaagtccgacgacgtcaccggccgcgtgaaggtctacgaggccatcgtcaagggcgagaacatccctgagcccggcatccccgagtccttcaaggtgctcatcaaggagatgcagtccctgtgcctcaacgtggaggtgctgtcctcggacggcatgtccatcgagatgcgtgacaccgacgaggacgtcttccgcgcagcggaggagctcggcatcgacctgtcccggcgcgagccgagcagcgtcgaagaggtctgacgggagtccggcaggggcctcgccgatgagtgaggcccccgccgacccccaggcccccgtttcagaccacagacttacaaccctgagagggattgacgcatagtgctcgacgtcaacttcttcgatgagctccggatcggtctggccaccgctgacgacatccgtcagtggagccacggcgaggtcaagaagcccgagaccatcaactaccgcaccctcaagccggaaaaggacgggctcttctgcgagaagatcttcggccccacccgggactgggagtgctactgcggcaagtacaagcgcgtccgcttcaagggcatcatctgcgagcgctgcggcgtcgaggtcacgcgtgccaaggtgcgccgtgagcggatgggccacatcgagctggccgccccggtcacccacatctggtacttcaagggcgtcccgtcgcgtctgggctacctgctcgacctcgccccgaaggacctggagaaggtcatctacttcgcggcgtacatgatcacgtacgtcgacgaggagcgccgcacccgcgacctgccctcgctggaggcgcacgtctccgtcgagcgccagcaggtcgagaaccggcgcgacgccgacctcgaggcccgcgccaagaagctcgagaccgacctggccgagctggaggccgagggcgccaaggccgacgtgcgccgcaaggtgcgcgagggtgccgagcgtgagatgaagcagctgcgcgaccgcgcgcagcgcgagatcgaccgcctcgacgaggtgtggacccggttcaagaacctcaaggtccaggacctcgagggcgacgagctgctctaccgcgagctgcgcgaccgcttcggcacgtacttcgacggttcgatgggtgccgcggcgctgcagaagcgcctggagtccttcgacctcgacgaggaggccgagaagctccgcgagatcatccgcaccggcaagggccagaagaagacccgcgccctgaagcggctgaaggtcgtctccgcgttcctgcagacctccaacagccccaagggcatggtcctggactgcgtcccggtcatcccgccggacctgcgtccgatggtgcagctcgacggtggccgcttcgcgacctccgacctcaacgacctgtaccgccgtgtcatcaaccgcaacaaccgcctgaagcggcttctcgacctcggcgcgcccgagatcatcgtgaacaacgagaagcgcatgctccaggaggccgtcgacgcgctcttcgacaacggccgccgcggccgcccggtcacgggccccggcaaccgtccgctgaagtcgctgtccgacatgctcaagggcaagcagggccgcttccgtcagaacctgctcggcaagcgagtcgactactcggcgcgttccgtcatcgtcgtcggcccgcagctcaagctgcaccagtgcggtctgccgaaggccatggcgctggagctgttcaagccgttcgtgatgaagcgcctggtcgacctgaaccacgcgcagaacatcaagagcgccaagcgcatggtcgagcgtggccgcaccgtcgtgtacgacgtcctcgaagaggtcatcgccgagcacccggtgctgctgaaccgtgcgcccacgctgcaccgcctcggcatccaggccttcgagccgcagctggtcgagggcaaggccatccagatccacccgctcgtgtgcaccgcgttcaacgcggacttcgacggtgaccagatggccgtgcacctgccgctgtccgcggaggcgcaggccgaggcccgcatcctgatgctgtcctcgaacaacatcctcaagcccgccgacggccgtccggtgacgatgccgacccaggacatggtcctcggtctgttcttcctcaccaccgacggcgagatgcgcaacgtcaagggcgagggccggtccttcggctccgcggccgaggcgatcatggcgttcgacgccggcgagctgtcgctgcagtcgaaggtggacatccgcttcccggtgggcaccatcccgccgcgcggctggaccccgccggcgcgcgaggagggcgagccggagtggcagcagggtgacaccttccgcctgcagacgaccctgggccgcgcgctcttcaacgagctgctgcccgaggactacccgttcgtcgactacgaggtcggcaagaagcagctctccgagatcgtcaacgacctcgccgagcgctacccgaaggtcatcgtggcggcgacgctcgacaacctgaaggcggccggcttcttctgggccactcgttccggcgtcaccgtcgccatctccgacgtcgtcgtccccgacgcgaagaaggagatcgtcgccgggtacgaggccaaggacgagaaggtccagaagcagtacgagcgcggtctgatcaccaaggaagagcgcacgcaggagctcatccagatctggacccaggcgaccaacgaggtcgccgaggcgatgaacgacaacttcccgaagaccaacccgatcttcatgatggtgaactcgggtgcacgaggcaacatgatgcagatgcgtcagatcgccggtatgcgtggtctggtgtcgaacgcgaagaacgagacgatcccgcgtccgatcaaggcgtcgttccgtgagggcctgtccgtgctggagtacttcatctccacgcacggtgcccgtaagggtctggcggacaccgccctgcgtaccgccgactcgggttacctcacccgtcgtctggtggacgtctcgcaggacgtcatcatccgcgaggaggactgcggcaccgagcgcggcctcaagctgcacatcgcggagcgcggcgccgacggcgtgctgcgcaaggcggacgacgtcgagacgtccgtgtacgcgcgctgcctcgccgaggacatcgtcgtcgacggcaaggtgctggccccggccggtaccgacctcggtgacgtgctcatcgacgagctggtcaagcacggcgtcgaggaggtcaagacccgctcggtcctgacctgcgagtccgccgtcggcacctgcgcgatgtgctacggccgttcgctggccaccggcaagctggtcgacatcggtgaggcggtcggcatcatcgccgcccagtccatcggtgagcccggtacccagctgacgatgcgtaccttccacaccggtggtgtggccggtgacgacatcacccagggtctgccccgtgtcgtcgagctcttcgaggcccgtaccccgaagggtgtcgccccgatctccgaggcctccggccgcatccggatcgaggagaccgagaagaccaagaagatcgtcgtcaccccggacgacggcagcgacgagacggcgtacccgatctcgaagcgcgcccgtctgctggtcggcgagggcgaccacgtcgaggtgggccagaagctcaccgtgggtgccaccaacccgcacgacgtgctgcgcatcctgggtcagcgtgccgtccaggtccacctggtcggcgaggtccagaaggtctacaactcgcagggtgtgtcgatccacgacaagcacatcgagatcatcatccggcagatgctccgccgcgtgacgatcatcgagtccggcgacgccgagctgctgcccggcgagctggtcgagcgctcgaagttcgagaccgagaaccgtcgtgtggtccaggagggcggacacccggcctccggtcgtccgcagctgatgggtatcaccaaggcctcgctggcgacggagtcctggctgtcggccgcctccttccaggagacgacccgagtcctgacggacgcggcgatcaacgccaagtccgacagcctcatcggcctcaaggagaacgtcatcatcggtaagctcatcccggccggtacgggcctgtcccgctaccgcaacatccgggtcgagccgaccgaggaggccaaggccgcgatgtactcggccgtcggctacgacgacatcgactactcgccgttcggcaccggctccggccaggccgttccgctggaggactacgactacggtccgtacaaccagtaagcgagcagcatgaagggcggtcaccccggtggggtggccgcccttcggcgtgttgccggacaggtccgggggagcgggtctacgggacgcccagctcgaagatgacgtagtggccgtaccagccggaggcgatggccgcggtggcgaagaacaccgcgaggctcccgttccgcagccggcccagggccgcggccggggcgaggagcagcgggaaggcgggcagcaggtagcgggcggtgttgccgaacatctgctgggtgcccaggacggtgacgatcgtggccagggtgtaggcgacgagcaccagcggcggccgtttgcgcagcatcagggcgatcaggaacggcagggccagcacgatctgcagggcgagcacgtcggggacgtcgaaggcgaagacgtagtcgtggtggccgacggcgaggttcttcaggacgcgcagcgtgtaggcgccgtagtcgaagtagtgcgcccatccctcgcgctggagcgtgaagtacgcggtgggctcgccggtggcgtagccgacccaggcgatgtagccgagcaggccgagcggtgcgacgagcatggcgtacacgggaccggccacgccgtgctcgcgcctgctgtcgcggcgcgccagcgtcaccagcgcggcgagtcccaccgcgccgatcagcacggcggaggtgggccggttcagcccggcgacgcaggcgatcaggccggccgtcacccagcgccgggtcatcacgcagtagcagcaccaggccgcgagcgcgacgaacaccgactccgagtacaccgcccactcgacgccggcggccggcgccaccgcccacagcccggcggcgatcgtgccagcgcgcacgcccgcgaccgtccggaccacggcgtagatcccggcggcggcgacgaacgacgacacgacggacaccaggatcccggccccgtacaggccgagcccggtcacgtccgagaccatccggatgagtgccgggtacagcgggaagaaggcgaccgagttctgctggacggtgaagaagccgtcgccgccgagccgttccagcttcgggtcgtagccgtgctgggcgacctggaggtaccaccagccgtcccaggtggccaggacgtcccaccagtgggcgccgccgccgaagcgcggcggcttcgtgcggtagtccccggcgtgctccagcagccaggcgaagacggtgaggccgacgagcttggtgacgccgtagaggagcagcggcggcaggtagggccgtacggcggcgggcagggcggggtgctcccaccagccgggccggcggaaggcgccggcccggtcctgccgctcggccgtctcctgtgccgcgtccgccggcccggcggggggcgggtccggtgcggctcccgccgaggaaccggtcaccgcgttgcccgaacccgtactcatgcctgtgtgtcccctcggtcccccggttccctggcgcctgcccggcgtggtcagcgcgggtccggaggcctgtgaaccgtctgtcataagatcgcaccacggtcgcacatcggcgcgggccgaggggaggcccgggtggcacaagaggcggacgggacggacggcacgacggtgctgtcggtcgtcatacccatgtacaacgaggaagaggccctgcccgccctggtcaaccggctgcgcccggtcctggacggcctcgggccgcgctacgaggtcgtcgccgtcgacgacggcagcggcgaccgcaccgccgacctgctcgccgccttccggctcggctggccggaactgcgcgtggtcggcctgcgccgcaactccgggcaccaggccgcgctcaccgcgggcctggaccgcgcggtcggcgcgtacgtggtgagcctggacgccgactgccaggacccgcccgagaagatcccggagatgctcgcgctcgcccgcgagcaggggctcgacgtcgtctacggcgtccgcgccgaccgcagcagcgacagcgcgttcaagcggggcacggcgggcgtctactaccggctgctgcggcgcctggcggggccgtccgtgcccgcgcacgccggtgacttccggctgctcagccgggccgccgtggacgccctgaaggcgctgcccgaccagcagcgggtctaccggctgctggtgccgtggctgggctttcccagcgggcgggtcacctacgagcgcgagctgcgctccgccggccggacgaagtatccgctcgggaggatgatcctgctcgccgccgacagcatcaccggtttctccgcggcgccgctgcggctggcgacctggctgggcggcggggcgttcgtggtctgcctcggcctgctggtgtacacgttcaccgggtacgccctggggcacaccgtccccggctggacctcgctgctcaccgcggtggtcttcatcggcgcggtgcagctgatctgcgtgggcctgctgggggagtacgtcgcgcggatctacacggcagtccagaaccggccctcgtacttcgtgcgggacgacacgggggcggagcgggcgggggcggaccggctggaggagagcgactccgcacggcgtccgtgaggcggggctccggacggagtgggtgagacagggctccgtacggtgtgcgtggatcggggctccgcaccggtgtgcgcgaagcggggctccgcaccggtgtgcgcgaagcggggctccgcaccggtgtgcgcgaagcggggctccgcaccggtgtgcgcgaagccggactccgtacggttgcgcgaaacgggccttcgcacgacgtgcgtgaactgggcgaaagtggtatggagcggccctgggcggccgtcccgcccatttgttttgaccgcagcgaatgcgataggtacgctcagaccttgtgcctggggtgtgccctggctctcgtgcgtgccttcaaccgccagggagccgtcataggccaccgcgatctgcgcttcttcctgccttgcggcgggggtccgcgggattcgacacacccgaccgcgtgggtcggcgacgttccaggttagctgtacccatcggcacacagaaaccggagaagtagtgcctacgatccagcagctggtccgtaagggccggcaggacaaggtcgagaagaacaagacgcccgcactcgagggttcgccccagcgtcgtggcgtctgcacgcgtgtgttcacgaccaccccgaagaagccgaactcggccctgcgtaaggtcgcgcgtgtgcgtctgaccagtggcatcgaggtcaccgcttacattccgggtgagggacacaacctgcaggagcactccatcgtgctcgtgcgcggcggccgtgtgaaggacctgccgggtgttcgctacaagatcatccgcggctcgctcgacacccagggtgtcaagaaccgcaagcaggcccgcagccgttacggcgccaagaaggagaagtaagaatgcctcgtaagggccccgccccgaagcgcccggtcatcatcgacccggtctacggttctcctctggtcacgtcgctgatcaacaaggtgctgctcaacggcaagcgctccaccgccgagcgcatcgtctacggcgccatggagggtctgcgtgagaagacgggcaacgacccgatcatcacgctgaagcgcgcgctggagaacatcaagccgaccctcgaggtcaagtcccgccgtgtcggtggtgcgacgtaccaggtcccgatcgaggtcaagcccggtcgcgccaacacgctcgcgctgcgctggctggtcggttactcccgcgcccgtcgcgagaagaccatgaccgagcgtctgctcaacgagctcctcgacgcctccaacggcctgggtgccgctgtgaagaagcgcgaggacacgcacaagatggccgagtccaacaaggccttcgcgcactaccgctggtagtcgctacccacatcgagaccgagagaagactgaagccttatggctaccacttcacttgacctggccaaggtccgcaacatcgggatcatggcccacatcgacgcgggcaagacgaccaccaccgagcggatcctgttctacaccggcgtttcgtacaagatcggtgaggtccacgacggcgccgccacgatggactggatggagcaggagcaggagcgtggcatcacgatcacgtctgctgcgaccacctgccactggccgctcgaggacaacgactacaccatcaacatcatcgacaccccgggtcacgtcgacttcaccgtcgaggtggagcgctccctgcgtgtgctcgacggtgccgtgacggtgttcgacggtgtcgccggtgtcgagccgcagtccgagacggtgtggcgtcaggccgaccgttacggcgtgccgcgcatctgcttcgtgaacaagctggaccgcaccggcgccgagttccaccgctgcgtcgacatgatcagcgaccgcctgggtgcgcagccgctggtcatgcagctgccgatcggtgccgaggccgacttcaagggcgtcgtggacctggtccgcatgaaggcgctcgtgtggtccgccgaggcggccaagggcgagatgtacgacgtcgtcgacatcccggacacccacaccgaggctgccgaggaatggcgcggcaagctggtcgaggccgtcgccgagaacgacgaagagctgatggagctgtacctggagggcaccgagcccaccgaggagcagctgtacgcggcgatccgccgcatcaccatcgcctccggcaagtccagcgagaccacggtcaccccggtcttctgcggcaccgcgttcaagaacaagggcgtccagcccctgctcgacgcggtcgtgcgctacctgccgaccccgctcgacgtcgaggccatcgagggccacgacgtcaaggaccccgaggtcgtcgtcaagcgcaagccgtcggaggacgagccgctggccgcgctcgcgttcaagatcatgagcgacccgcacctcggcaagctcaccttcgtccgcgtgtactccggccgtctggagtccggcaccgccgtgctgaactccgtcaagggccgcaaggagcgcatcggcaagatctaccgcatgcacgccaacaagcgtgaggagatcgagtcggtgggcgccggcgacatcgtcgccgtcatgggcctgaagcagaccaccaccggtgagacgctcgcggacgagaagaacccggtcatcctggagtccatggacttcccggcgccggtcatcgaggtcgcgatcgagcccaagtccaagggtgaccaggagaagctgggtgtcgccatccagcgtctcgcggaggaggacccctccttccaggtgcacaccaacgaggagaccggccagaccgtcatcggcggtatgggcgagcttcacctcgaggtcctcgtcgaccgcatgaagcgcgagttcaaggtcgaggccaacgtcggcaagccgcaggtcgcgtaccgcgagacgatccgcaaggccgtcgagcgcgtggactacacccacaagaagcagaccggtggtaccggtcagttcgccaaggtgcagatcgcgatcgagcccatcgagggcggcgacacctcgtacgagttcgtcaacaaggtcaccggtggccgcatcccgaaggagtacatcccctcggtcgacgccggtgcgcaggaggccatgcagttcggcatcctcgcgggctacgagatgacgggcgtccgcgtcaccctcatcgacggtggctaccacgaggtcgactcctccgagctggcgttcaagatcgccggttcgcaggccttcaaggaggccgcgcgcaaggccagccccgtgttgctcgagccgatgatggccgtcgaggtcaccacgcccgaggactacatgggtgaggtcatcggcgacatcaactcccgccgtggccagatccaggccatggaggagcgggccggtgcccgtgtcgtgaagggcctcgtgcccctctcggagatgttcggctacgtcggagacctccgcagcaagacgtcgggtcgcgcgagctactcgatgcagttcgactcctacgccgaggttccccggaacgtcgccgaggagatcatcgcgaaggccaagggcgagtaactctcccgagttccagcccgtaggcttgactccggagcctcgtggggcattccacctcttccacagcgaagcgggaggaatgccccccgggatccgggccatccagcaaagatcacctggcgccgatgaagtaaggcgtacagaaccactccacaggaggaacccagtggcgaaggcgaagttcgagcggactaagccgcacgtcaacatcggcaccatcggtcacatcgaccacggtaagacgaccctcacggccgccattaccaaggtgctgcacgacaagtacccggacctgaacgaggcctcggccttcgaccagatcgacaaggctcctgaggagcgtcagcgcggtatcaccatctccatcgcgcacgtcgagtaccagacggaggcgcgtcactacgcccacgtcgactgcccgggtcacgcggactacatcaagaacatgatcaccggtgccgcgcagatggacggcgcgatcctcgtggtcgccgccaccgacggcccgatgccgcagaccaaggagcacgtgctcctggcccgtcaggtcggcgttccgtacatcgtcgtcgccctgaacaaggccgacatggtggacgacgaggagatcctggagctcgtcgagctcgaggtccgtgagctcctctccgagtacgagttcccgggcgacgacgttccggtcgtcaaggtctcggcgctcaaggcgctcgagggcgacgccaagtggggcgagtcggtcctggagctcatggacgccgtcgacaacgcgatcccggagccggagcgcgacgtcgacaagccgttcctcatgccgatcgaggacgtcttcacgatcaccggtcgcggtacggtcgtcaccggccgcatcgagcgtggtgtcctcaaggtcaacgagaccgtcgacatcatcggcatcaagaccgagaagaccaccaccacggtcaccggcatcgagatgttccggaagctcctcgacgagggccaggccggtgagaacgtcggtctgctcctccgtggcatcaagcgcgaggacgtcgagcgcggccaggtcatcatcaagccgggctcggtcaccccgcacaccgagttcgaggcgcaggcctacatcctgtccaaggacgagggtggccgccacacgccgttcttcaacaactaccgcccgcagttctacttccgcacgacggacgtgaccggcgtggtgaccctccccgagggcaccgagatggtcatgccgggtgacaacaccgagatgaaggtggagctcatccagcccgtcgccatggaagagggcctgaagttcgccatccgtgagggtggccgcaccgtgggcgccggccaggtcaccaagatcaacaagtgacccaggtctgtggcaccagcgcactgaggtgagctgagctaccggaagggcccgtacgacttcggtcgtacgggcccttctgcttgtccggggtgtcttccggtccggtcccgcctccggggcgagtcccgggcatgcgggcgggcccggggccatgggtggggctccgggcccgcctttgcccccctcgggcggtcagtggctggggtgggg

SEQ ID NO: 193 - DNA, 7501 bp, Unknown
  Kingdom: Bacteria, Phylum: Actinobacteria, Class: Actinobacteria, Order: Streptomycetales, Family: Streptomycetaceae, Genus: Streptomyces
gcgccggtgggggccggtcacggtggtcctggctctgccggtggcggtggccctggccggcttggcggccctggccgtcctcgctgtggcgatgctgacatggatgctgtcggacgacccgctaggcgccggaccccgcaaggtgccgtgcgccgaggcactggccttcggcggggcgaagctgcccgcgggcgcctccgacacgcgatgcacggtgcgggtctggctggacaccgactacgaggcccgcttccggatgccccgcgaggacgtgcgcggctggctgggcgccgcctatccggacgcgccgctgtccgggacgcactcctgcgtcccggactccgcggacctctgcctggacctcgggctcaccgagggcgacgggaactacgccgggcgcgtccccggccgcaccgacccgggtttcggtgcgtcggccgtccaggtcaccgtgaagtacgagggccctgaccaggccctcgtcaccttcacggcgttcaccgtctgagccggcccctgagcgggatccggcgccggtgcctacagcgtcttgccggtcgccgggcccaccagcaggccctcgccgaagcggtcgacgcggaccgtgtcgccgtccttgatctcgccggacaggatctccttggcgaggcggtcgccgatggcggtctgcaccaggcggcgcagcggccgggcgccgtaggccgggtccatgccctcgtcggcgagccattccagggcctcgggcgtgacgtccaggttcaggcgccgctccgagagccgcttggcgaggcggtcgatggccagcttcgcgatccggctcagctcctccttggtcagcgcggagaagaccaccaggtcgtcgaggcggttgaggaactccggcttgaaggaggcgcggaccacctccaggacctgctccttcttctccgcctcgctggtgatggggtcgaccaggaactggctgcccaggttcgaggtcagcaccaggatgacgttgcggaagtcgaccgtacgtccctggccgtcggtgaggcggccgtcgtcgagcacctggagcaggatgtcgaagacctccgggtgcgccttctccacctcgtcgagcaggaccacgctgtacgggcggcggcggaccgcctccgtgagctggccgccctcctcgtagccgacgtatccgggcggggcaccgaccagccgggccacgctgtgcttctcgctgtactccgacatgtcgatgcggaccatggcccgctcgtcgtcgaagaggaagtcggcgagcgccttggccagctccgtcttgccgacaccggtcggaccgaggaagaggaacgagccggtgggccggtccgggtcggcgatgccggcgcggctgcggcgtacggcgtcggagacggcgcgcacggcctcgccctgcccgatcagccgcctgccgatctcgtcctccatgcgcagcagcttctgcgtctcgccctccagcaggcggccggccgggatgccggtccaggaggcgaccacgtcggcgatgtcgtcagggccgacctcctccttgaccatggtgtccttggcggcctcctcctcggcgcgcgaggcggcctccagctccttctccagctccgggatctcggcgtagagcagcttggaggcggtgtcgaagtcgccgtcgcgctgcgcgcgttcggcctggccgcgcaggtcgtccagcttctccttcagctcaccgacccggttgagggactgcttctccttctcccagcgggcggtcaggccgcgcagctcctcctccttgtcggcgaggtcgcggcgcagcttctccagccgctcgcgcgaggccgcgtcggtctccttgtcgagggccagctcctccatgcgcagccggtccacggcgcgctggagctcgtcgatctcgaccggcgaggagtcgatctccatacggagccgggaggcggcctcgtcgacgaggtcgatggccttgtcgggcaggaagcgggaggtgatgtagcggtcggacagggtcgcggcggccaccagcgcggagtcgttgatctgcaccttgtggtgggcctcgtagcggcccttgagcccgcgcaggatcgcgatggagtcctcgacgctgggctcggcgaccagcacctgctggaagcggcgctccagcgccgggtccttctcgatccgctcgcggtactcgtccagcgtggtcgcgccgaccatgcgcagctcaccgcgggccagcatcggcttgagcatgttgcccgcgtccatggcggagtcgccgccggcgccggcgccgacgaccgtgtgcagctcgtcgatgaaggtgatgatctgcccgtcggagtccttgatctccgcgaggacggtcttcagccgctcctcgaactcgccgcggtacttcgcgcccgcgaccatcgccccgaggtcgagcgccaccagccgcttgtccttcagtgactcgggcacgtcgcccttgacgatccgctgggcgagcccctcgacgacggcggtcttgccgacgccgggctcgccgatgaggaccgggttgttcttcgtacgccgtgacagcacctgcacgacacggcggatctcctggtcccggccgatgaccgggtccagcttgccctcacgcgcggcagccgtgaagtcggtgccgaacttctccagggccttgtactggccctcggggtcgggtgtggtcacccggcgccctcccctcgccttccggaacgcgtcttgcagcttcttcgcactcgcaccctgcccggcgagcacctcgccgaccgcgccgcccttcgcggcgatgccgaggagcaggtgctccgtggaaaggtagtcgtcgcccagttcccgcgcccggttctgcgcgtccgcgatcacggccagcagttcgcggttgggctgtggcggcgcaacggtggacccggtcacgctgggcagcgacgcgagcacccgctcggcgcccgcgcggacggacgcctggtcggcgtcgacggccgacagcaggtcgatgatgttctcgttgtcctggccctcgagcagcgcgaggagcaggtgggcgggggtcaggtccgggtgtcccccggtcacggcccggttgccggccgcctgaatggcgtcccggctcctgttggtcagctcggcgtccacggtcgcttctctcctccttggcgtcagcggttccccggcatcggctggtctgccacgtctcccggtaccgactcagtccccagcactcagtcatccagtactgactcagtcaacgtacacaaagttgagtctattccactcaaggaagaacggcgcctacattcttgccatggccaccacgacgtacaccctggatcctggggttcccgacgcgccgtacctcgccttctggcaggaacggcacgtgtgcaccctgaccacgctgcgccccgacggcaccccgcacgtcgtgccggtcggcgtgacctacgaccccgaggcgcggctggcgcgggtgatcacgagcagcaccagcacgaaggcgaggaacgtgctggcggccggggagggcggcaccccggtggccgtgtgccaggtggacggccggcgctgggccacgctggaggggcgcgctcgcgtccgcaccgagccggcacggatcgccgaggcggaacgccgctacaccgagcgctaccagcgcgccccgcggcacaacccgctgcgcgtggtgatcgagatcgagctgacccgggcgctggggcgcggctgagcgcggacggggccgaggacggccgcggctgagcgcggtcgcggtccggttgcgttccggtccgttcggggcgcgggcaggggccttttccggccagagcagaaaagcggcggtaaccgcggaaaacccccaaaactgcagcggcgtcaccgtgttcaggtcacggtgacgccgctgcggggggaagcacctgagcgatctgttacgacgggggaatcgcgtcaggcactgcggggggtggctgagatggtcctgataccggcgggctccggcgccacttgctggtggtcccgctggtccaggttcacgaagatcattccgtatcggatggcacaccgtacgggctgcggcgccccccgaggacgccgcaggcaccggtaggcccgtacgtcaccgtcctcgtcccgcgtcacgacgaccggctctccgaagacggtcaccatcagcgagtcaccactgtgggggatggcggtgaccaggtcgatgaagtgccatccggagcggtaggcggtggccatttcacggcggaaggaacggtcgtcgggtggtgtggtcacatcaactcccggctccatctgtcgcagcggcgccattgcccgaggtggtggagttcacggccaccgacggccactgagtgttggcctgaacctcgcccttcgcctcgtggacgccaccccagacgccgagagccacgacggcggagaaggcggcgacaagcaccgagcgaagcagtctgttacccataatcggcttcgtcctcacttgaaggtccccttttcccccgtcacgtacgacgatggctcattcgggcacgtcatggccacacaatcggtgcatcatgttcctgcatgttcaggaccctggggggtggagattaggtgacgaatcaggaaaaagagggacatgaccacccaatggccgagctgtgcgacgaaggaagccgcctctacgccacagccctgcggtcggggcgcctctcgcgcgcggaggcggagccggcgccctgcctggtcgacctcgctctgctccaccccgatccggacgatcccgactgcctgcggcccgttgcgcccacggtcgcgctggcgcagcggctccagcccatcgaacgcgagatagccgaacgccggcggctgtccatcgcactcgccgacgccttcgagcccttcatggcactcagcacccaggtggcggcgtccagcgactccgtcacggtgctggagggcggcgaccggatcaacgcggcgctcgacctggccacggcccagtgccggatgcagctgctcaccgtacagcccagcgaccgcgtctccgagcgcagcctgctgcaggcgctggagcgggaccggccgctgatagaccgcggtgtccgggtccgcagcctgtaccagcacaccgcccggtacaacccggagaagctcgcctatgtggcccagctgtccaacggcaaggtggagtaccgcaccatcgacgaactcgtcgaacggctgatcatctgcgacgaggacgtcgccttcatccccacccgcgacgaccagcaggtcgcgctggaactgcgccaccccgggctcatccgctacctcgtcaaggtcttcgagttcatgtggaaccgggcggtcccgatgagcgcgggcaccccctacgaaaccgcccccgacggcatcaccgacatccagcactccatcgcgaaactcctggtggaagggcacgtcgacgaggccatagcccgccgcctgggcatgaacgtccgcacctgccgcgcccacatcgccaagctggccaccgccctgggcagcggcagccgcgcccagctcggctacctcatcgcccagtccggaatcctcaagcaggagccctgagtcaccgaggagccccggatcacagggagggacgcgggcacgtcactccgcggccggggaaccgcggcccggcgccgagtggacgccgaccgcccccgcgccgaccgtgcgcggtggcccgtccagacccgcctgggcgatgcgcacgcccagttgggtgcggctggccgcgcccagggtctccgacaggcgggcgatgtgcgcgcggcaggtgcgcacgctgatgcccagccgctcggcgatcaccgcgtcctggtggccctccgccagcagcgccgcgatcgactgctcgcggtgggagatgccctcgatgccggtgtccggcaacggcgcggtgagcgggatcgccagccgccactgccgctcgaagaccgtcaccaggtactccacgagcgccgggtggcgcagctccagcgccatcgtgtggtcggcgctggcggggatgaaggccaccgtgcggtcgaacaggatcagccggtcgatgacctcgtccagcgtgcgcgcctcggccgcgtcgcccatcagctccatgtagttgagcaggccctggccgtgccgggccacgtgcgtgtacaggtcgcgcatgcgcacgccgcgggcgcgcagcgcaagcgcccggggcaacccctccgacagctcgtgctcgcggcggatcccgccgggctgcacggtcagcacctcccgcgtgcacacctgggtcgcctcgtccatcgccgcctggatgcggttcagtccgtccaagacccggatcgcgctgccctcgccgcccgcggcgggcacccgcacctgacggccgaggcccgcgtaccgctcgaacgcggccaccgccgagcccacccggcggtggctctcgctgacctcgtcgtacatcccgcgcagcagccgcgtcatgacctcctgcggcgcggtcggcaccaggaagtccatgtcgtcggggtccgggtgcagcagggccagttcaagcaggcagggcaccggaccggcgtcgccgcgcggcacccggccgcgccgcacggcccgggaatacacacgatccccggcctcgcacagtcggtcggcgccgtgaggatgctcctgcgccccgtgcccggccatggcccatcacacccccggtctccgcgtggttccgcagcgcaactatgcgcggcccggaccggctgtgcaacacggctcccggcggccctggcaccggaaaacaccgttcaggcccggtatgtacggcccgtcgccgcgtcctgtgcaacaagctgcaggcagcggcgcggccacggtccgacccgtacgggggacactggaactccgtcgtcctgacggttacttgaggccgatctgcgcgcagtccgcgctgtacttggccgtgcagatgtcggacgccttgtagatgccgtcggcgatgaccgtgtccttgatgttgctcctggtcagcgcgacgacggagacgagctgcgacggaatgcccttggtggtcgggctgtcgaccttgtcgcgggtcagcgagtcgaactggatgtccttgccctggaccttggcgacggccatctcggcggcgttctcggcctccgtcgggtaggacttgtacacgctcatgtactgctcgccgctcacgatccgctgcacggcggagagttcggcgtcctggccggtgaccggcggcagtttcgtgacgcccgcggccttgagcgcctcgatggccccgcccgccatgccgtcgttggcggagtagacgccggcgatgccgttcctgccgagcgcgctgatcgccttggccatctcggcctgggcgatctccgccttccagtccttgatgtcgtaggacctggcgatcgtcaccttgccgttcagctgggcgagggcgcccgccttgaactgcttggcgttcgggtcggtcggcgagccgttgatcatgacgatcttg

SEQ ID NO: 194 - DNA, 9125 bp, Unknown
  Kingdom: Bacteria, Phylum: Actinobacteria, Class: Actinobacteria, Order: Streptomycetales, Family: Streptomycetaceae, Genus: Streptomyces
gcccagcccagcccttggagcgtcgcgggactccccgccctgtcggcccccgctggcttcgtggacggactcccggtcggactgcacctcgtcgcagcaccgggaggcgagcacctgctgtcggccaccgcggcggctctgcagcacgccgaaggccgagccctgccgatcccccccaagaagcggccacaccgcgcggctgcccagcaccccgcgcacacctgcaatcaccctgctctggaatcacccagctctgaagggagcgccccatgccggaccgtcccaccgaggccaccagcccggtcaccgcggccgccgtccagttcgaccctcaggtgggggtggagaacagggagaagaacctgagccggacgctcgacctgatcaacgaggcggccgacaacggcgccctcctgatcgtcctgcccgaactcgccaacacgggttacgccttcaccacgcgcgaggaagcctacgcacacgcggaggaagtcccctccggcccctcctgtcaggcgtgggccgacctcgcccacagccgtcgcctgtacgtggtggccggcctcagcgaacgttcgggcgagcaactcttcgacactgccgtactgatcggcccggacggcttcatcggcaagtaccgcaagacccatctgtgggaccgcgagaaactgatcttcaccccgggcgatctcggctacccggtgttcgacaccaggatcggccgcatcgggctgctggtgtgctgggacatctggttccccgaggtgccccgcctgctcgcggtgcagggcgcggacgtcatctgcagtgtgaacaactgggtctggaccccgccgcccctgttcgacgagtccggcaagtgcatggcggcctacctcacgatgaccgcttcccatgtcaacaacgtcttcttcgtcgcggccgaccgcgtgggcacggaacgcggcggcaagttcctcggctgctcgctcatcaccggaacgaacggctggcccgtcgcagacatcgcctcaccggtcgacgagacgatcgtctacggcgatctggacctcgtgtccgcccgctcggcgtcgatctggaaccagcacaacgatctcccccgcgaccgccgcaccgatctctacgacgacaggctcggctaccggcgcggcgacgcgtctgtgcggtgagtggtgtgactcccgatcatgctcctcaaggcgggtgcggcaggactgtgccattcggacgtcggtacgctgcgcaacccggccgccgccgctctcctggccaggacgccgttgactctgggccatgagatcgccggcgtcgtcgatcgagtgggcgcgggagtgaccgagtggaagacgggcgatcgcgtagcggtctgccccccagaccggcgcctccgccgggccctagggacccaaagcacatgaggccgctccgggctgcggccacgacggcgggttcgccgagtactacctcggctcggtcgacgatctggtagccgtgccggacgggctcgatctcgcgcacgccgcgatggcgaccgacgcgggtgtgacctcttaccacgcagtcgtcgttcgaggggtcgtgcggccccgctggaaggccggcatcatcggactcggcggggtaggccagctggctgcacgcatcgcggtcctcaacggcgccgtggtacatgtggcagagccaaggagagcgtctgacagggggcgcgcgctgggtgtcaccgatgtcgtccgcgacgccgccgcctgggcgggtggagagttcgacctcatcgtggactgcgcggagttcggcacgacatcagccgctggcccgctaccggcccgacatcaccggagcaaggtgaccgccctgcgttcgaggacgcgggcagctgcacagatgtcaccttccgggacgcccgccaagctccgcctcgatcagccacacctgtcgtccgactacgggcggccctcgcccttggccccacggtggccggacctctgatcagcgtctccgacggcacctcgcggacccgtgtcaccacacgccgggcatccggtcggcagcatgcaacagccacgccgagcgaggaggcagcagccctctcgcagggttttcctcacccacaacaccgagtgccgacgcccgcacgggctccagcctgcagcagaggcacggcgcgccgggttcgccagggcgaatgggttgtgagaagtcgacgtcaccgacgccttcggaaggcgcctggagagtgcggtccgctgttcgagcagtcggtccgatcaacggccgagtggccagtttcttccgctcatgactgcaggtggggcttgtttcagacacagccttgccaaagttaacctaacactgttaggacaggtggcgaacgcactctctcgccatggaggcacgcatgaccgagacgatgacggacgcccccgccgaccttcctgagcacccgtcccctcgcgccgccggctgccccttcgacccgccgccggccctgcgggcactgcagaccgaccagccgctctcccgggtgcgaatctgggacggctccaccccttggctgatcacccgccacgaccaccttcggaatctcctcggcgacgcccggatcagcgcggacgcaactctctccggatatccccaccgcaatgcggggttccaggagaacgaccgcgcccgcccgaccttcctcaccatggacgatccagagcacgcccggaagcgccggatggtcacggcgccgttcgccatcaaaaagatcgaggccatgcggcccgccgtccagcacatcgtcgacgacctgatcgacaccatgctcgccggaccgaaaccggtggacctggtcgaggccttcgcgctgcccgttcccagcctggtcatctccgaactcctgggagtgccctacgacaagcacgacttcttccagcgccacaccaagaccatcgtccgccgcacctccacgtcggacgaggtcaccgcggcccgactggagctcaccgactacctggacggccttctcacccagaagctcagccatccgcacgatgacctgttgtcccggcttgcgaccgagcgtgtggccaccggtgaactcacccagcgcgaggccgcgcagatgggcgtgctgctgctgtcggcagggcacgagaccaccgcgaacatgatcgcgctgggcactctcgccctgctccgcaaccccgaccaactcgccctgctgcgcgactccgaggaccccaagctggtcaacagcgcggtggaggagctgctgcgctacctcaacatcacccactccggccgccgccgcgtggctctggaggacatcgaactcgacgggcagaccatccgggccggcgacggcgtcattctcgcgaacgacgtcgccaaccgcgaccccgaggcattccccgaccccgaccgactcgacatcacccgcgacgcccgccgccatgtcgccttcggctacggcgtgcaccagtgcctcggccagccgctggcccgcctggagctccaggtggtctacagcacgctgtaccgccgcatcccgagcctggcactggccatcgacttcaacgagatcgagttcaagcacgacgggttcgtctacggcgtctacgaactccccgtcagctggtcgtagttccccctgcacttccgctcccccgccctgcactctccgcaccccacagcgaaaggcgagaagcccccatgcgcgtagaagtcgaccagcccaagtgcgtcgcctccggtcagtgcgtcctggtcgcccccgaggtcttcgaccaggatgacgaaggcatcgccgtactcctcatcgagtcccccaccgccgagcaccactccgacgtcaaggaagctgccgccatctgccccgccgcggccatcaggctggtggaggagtgaacctcgctcccccgatcaagcgggttgtgatcgtcggagcctcggtcgcggggctgacggccgccgaagcccttcgccgggagggcttcgacggctccatcacgctggtcggcgaggaagcccaccttccctacgaccgcccgccgctgagcaagcaggtcctcagcggagactggcccgccaacaaggcggcactgcgcgaagcccaggatctggacgcgctcggcctcgacctccgtctcggcatcccggccgtcggcctgtccacggattgccgcacagtggccttggccgacggggtcgagctgggctacgacggtctgatcatcgccagcggtgtacgtccgcggctgcttccccagtgcggcgtgcccggcgtccacgtgctgcgcgccctcgaagacgcgctgatgctgcgcgaacgcctgggcccgggcagccgcctcgtggtagtgggggctggattcctcggcacggaggttgccgcggcagcgcgcgggctgggggcgtcagtgacactcgtcgaacccgccccgatccccctggcacacgctgttggagagctggtcggaacccatctgggcgagctccaccgggatcgcggggtggacctgcgcaccggaatcggcgtcagtgagatcaccaccgatggcaggcgggccacgggggtgcggctgaccgacggggcgctcgtcccggcggacgacgtcctggtggccatcggctcgcagccgaacatcgagtggctgaacgggagcgggctccggctggccgacggtgtgctctgcgacgcctacacggccgctgcccccggcgttcacgcggccggcgacgtggccttctggcacaacccgcggttcggcaccgcgatgcgcatcgaacaccgcacgaacgctgccgagcaggccatggccgcagcccggaacctcctccgccccaagaaggcccggccgttcgcccccatcccctacttctggtccgaccagtacgacgtacgggtccaagcctacggctacctgcgcggccatgaagaggtccgcctggtggagggaagccccgaggacggcgccttcctcgtcgcctaccgcaccggcgggaagctggccggggtgctcggcgtcggcatgccaccgaaggccctgcggccctggcacaccctcctcgccgcggacgccgagtgggagaccgcgatcggggaagcgctccccgcctgacacgtgtgcctcctccgggaaggctctacggggcccacgatcgatccggtgcccggcgtctgctcccagccaagtcggttggcgcggtcgctgggcaccgtcacgttcggcgaggggtgcgatccactgccgtcaggtctcctgcacaccctaagcgagcagagcgtcggtcttctgctcgcccaacgcgcgggatgtccggcgagggaagagatctttcggaacgagacgtgcctgctcccatgcgtgcctgctcccatgagaggaaaactcatgccgacgtcagcacgctagattgctctcgaacacctgctgataaatgctgcaaaccggcagatccgaagatcgtttgctgtttttctacttgcccggaggaccgccgaagatggcacgcacgcggcgtgcggcgctggacgagctggacctcgcactggtcgacgcgcttcagatcaacccgcgagcgccgtggacggagaccgacacccgcgttggtatcgacggtgccaccgcctccagacggtgcaccgtctccgcgccggcggctatgcatgggtcacgacctgtcctcgcttgtacggcgcgtgcggggcgttcaccgaggtggactgcgctcagggccagggcgcggctgtcgccgaggcgctcgcacgggagccatcggcggcgaccgtcgagttcgccgcgggcggccgcgatctgctcgtcacggtcctggccgccgacttccgcaccctggccgcgttcatctgcagcggattcgaaacctccccgggtcaccactacccgggcccacctcatgacgggaagcgggtgcgccgagggcagcgcctggcggcggcgcagcccggaacgcgctccgcagcaggcgcgggactccggccgccgtccccgacaggtccgcgccgacgcggtctccgacaccgaccgggaacgcgccctggcactcgccgaggacggcaggcttcctctgacggagttggcgaaacgcctcggcgtcagcctcaacacggccttgcgccggctcggacgcctgatcggctccggcggcccgatcctgcgctgcgatctctcgcccccgctgtccggatccccggtcccggtcgcctacttcggttcggtgcgctccgagcttctggccgcgacggcccaccaggtcgcccggttcccggagatccggctgtgcgcggcagtggccgggccgcagaacctcctcgccacggcatgggttccctcgctgagccatgtgcagcggctggaactgcgtctcgtcagcgcgctgccccagctgaagatcgccgatcgcgccgtcgccctgcagccggcgaagcacacggggagactgctcgaccaagacggccgggagacgggctttgtgcccgtggacatgtgggccgtgggccgggacgtcgggccggggcagcgtcaaggatgaggagagaaaccaggatgagtgaggacttcaagcgccggacacccagtagacgcggacagggcggtgcgctgcgggaggagatcctggcggcggccgcgcggcttctgatggaatccggccgggagcgggatttgtccctgcgcgcggtagcgcgggaagtgggcatctccgcaccgagcatctacctccacttcaaggaccgggcggagctggtcgaggcgctgacgcagcgcgtgtacgaacagctggtggaccggcttcaagaggcacgcgagcagggcgcggcggacggcccgcgcgccgcgctgcgcgccatggcccaggagtactgccgcttcgccttcgacaaccccaagcactaccggctgatgttcggcatcgaacgggtcgaggtctcccgcaacgaagcggccccccatccgctgtggcaggtctcccagacgtggaacgaagccgtgtccacctgccaggacgagaacaccccggcggaggagaccgcgcgcaccgccagactcctctggtccgccctgcacggtgtggtcgcactggccatggcgacgcccttcccggccgaccgccaggccgtcgaggagatggccgacgagctgctcgacctcgccctggccaggtaaaaccatgcccacgaacgacgcagtggcccccttggcagtcacgtcccccatgtaggcagtcacgcccccccatgatcgcgtcgaggatcagcgtggatgaggctccgggcgccagttcaccccgctcgatggttcgccgcacggcgctacgagctgccttcacctgctgggcgaagaccgattcgacgatgcccgccgaattcaccgattcgcgtgctcgtccgcctctggtcgtagatcagttgtccaggaccaatccagtgcccgtaaggcagccgtcgttcgcctcgggccggactgaagctgcttgagccgtcgtttcaccgcgcgcgtgacgtcggccggtcggcggcggcgaggttgccgatgccgcgcttgaccagcgaccagacgccttcgacagcaccccggcccggctgcgctcgcgctaggcccggggccaccgctctaccgaccgctcgctcacccgcaatgcggcggcgatctccttgctcgtctctccggcctcgaaacgagctacggcctgcagccggatccgttcgcgcgcggccctctcgccgtcagtcagccctactcggcgcggctgagccggacagtgcgccggcgagtctgccctcaacggtgatctcgacggcgttgagggcggcctcccactgctgtgaccagtgtgtgcggcccttgccggtcgggccaggctcacgcaggggcatggcgagtatccgccgcctgatcgtgtggcagccaatcgttcacggcttcgcgatgtcgcgatgagttcggtcccctctgccagtctgtacgtatgccgcgcggtccgatgacctcacgacaacccgcacctgccgcttccagggagaagctgatgtccgacaccacctgccacatgtcgatctctctcgacggcttcgtcgccggatccgagcagagccgagacaatccgctgggcaagcgcggccaagagctgcacggctggcatatcggcgacccgcgcgcgaccgaagccgacaagacggccaacagctggctgatgcgcccgcgtggcgcctacgtcatgggccgaaacatgttcgggccgatccgaggtgagtggaacgagacgtggcacggatggtggggccccgagcccccctaccacgcccctgtcttcgtgctcactcgctacgcccacgaaccgatcaagatggagggagggaccaccttccacttcgtcaccgaaggcttcgacgccgcttacgcgcaggcgctcgaagccgccgacggcaggggtgtggacatcgccggtggtgcttcgacggttcgacaggcactcaacgccggcgcgatcgatgaactcaccctcgacatcgcacccgtcctgctcggcggtggcgagcgcctgttcgacggcgtcgagaccttcgatttcgagcccgtcgaggtgcttcactcaccgctggccactcatatccgctaccgcaagcgcgacgcccgctgaacaacaactgggctttctcccgcctcgattgcgggtctccccacgaacaatcggcacctggccgggcatgtcgccgccgacatcctggaacacggcccgctgcccgacccgtgcatggtgctgatcgtctccggcgggcacacctggctcctcctcgtccgcgatccggcccgcgacccgatcgcccgcctcgacgtcacgctcgacgacgccgcgggcgagtgcttcgacaaggtggcgcgggtcttcgggctgagccgtatcccggcggtccggtcatcgagcgggcggcgcgcgtgggggatccgcgcgctgtcccttcttccccgccccctgcccggctcgtacgacttctccctcgcgggggctgaagagggccgccgcccgctgggccgagggggcacgccgggcgcgagctgcccgtgcacgacgtggtccgcatcgctccaggaggcggtcgccgacgtgctgacccgcaaggc

SEQ ID NO: 195 - DNA, 4547 bp, Unknown
  Kingdom: Bacteria, Phylum: Actinobacteria, Class: Actinobacteria, Order: Streptomycetales, Family: Streptomycetaceae, Genus: Streptomyces
gccacgccactgccggccctgaagtccagggaccccgcttccctggaccagggccggcagtggcgtggcgtcagccggtcgcgccgcccgcgacccactggctccacggcatgttccagtcgctgaggccgttgtccggggccagcttggtcgtgtcgtgggagttcttgacgatcaccacgtcgccgggcatcgagttgtcgaagaaccacgcggcgggctgcttgccgtcgctgccgctcctgacgtccttcaggcccacacagccgtggctggtgttgagcttgccgaagaccgagccggcgctccagtagttgccgtggatgaacgtgcccgagtcggtcaggcgcatggcgtgcgggacggactcgatgtcgtacgcgggcttgccatccttgttcgtgaggccgacggtcgaggcgttcatgcggatgtgccggtacttctcggagatgaccatctgaccgttgtacgtcgggtgctcggcgctgccggacgagatcgggatgctcttgaccgccttgccgttccgcacgaccgtcatctgcttggtcttggcgtcgacggtgctgacctggctccggccgatcttgaaggtgaccgtcttctgcacgccgtgggcgttgagcttgacggtgacggtggagccgggcttccagtagttctggggacggaagtccaggcggttcccgttcatccagtggccgacgacccgctggccgctgctggagctgacctggatctccgactgcacggcggcctggtcgccgaccgccttgccgaaggtgaccgacaccggcatgcccacgccgacggtcgagccgttctcgggcgagaggtgcccgatgaagtcgttggccggggagaccgtggtgatcgtggcgttctccgcggcggagcggccctgggagtcctgggcctccgcggcgatctggtacttggtggcccgctgcagcccgccgtccggcttccaggacatgccgtccgcggacagggtgcccttcacctcggcgccggtcgccacggcggtcatcgtcaccttggtgagtttgccgttgctgacggtgaccttgaggggggcgttgatcgcgacctcgtgagcgccctgcccaggcgtgatccgtatgcgggcgtcggaggcgtcggaggcatccccggctgccgcctggcccgctcccgcctgcgccttctgctgggtcccggcgtcgttgccgccggtggcggcctcactgacaccggcgagcgccgtgaccgagagtacgccaccgagtacgcctgccgcggccaccagcctggtgcgccgcttacctgccgtgatcaaacgcttctcccatgctcttggtctgtcatgcccttggtctgccgcatctctggaggcggaccgccctggaggcggttcgctcgaagagtgcaaccagctccacaaccccttatacgcagctatccatccctaaatgggcaaaatgtggcgaaggccaccgggtcctgtcaccggcagcccgcactgccaccggctgcccagcgtgccgccgaggcactgctcgaaggccgggacggtgcgtagccgtctgctcacggtcaccctcgccaccccgctcccgcaaaatgtcggactgtagtacttgtggcgaccgaccgttacgatcatccttctccgcgtcacgtgttgtccgacacggaggtgagagtgacagccacggtggaaccgaccgcggtggaggcggtggtgcgcggcgacgcggccctcctggaggacgatctcgccgagttcctcggctccctgagcgtcgcaccggcgcacgggggtccggggccggcgacggtgtacgacgccgcgttacggcgtgcgttgtacgggccggtcgcggatgccgtcggatccaaggtggggcaggaggcgttgccgcccgccgccggggcgcccggcggcaccagggcgccgctgcgcccctcgatggtgtactgggcgtaccgcaactaccggggcttccccgacgaggccggggacgaggctttcccggccgacctggcggtggtccgccgcgcagcggtggcggtgcggatcctgctgaaggccgcggtcgccctcgacgacatccaggacggcagcgccgtccgctacggcgaggccgccctccacgtcacccacggcgtaccgctcgccctcaacaccggttcctggctgatcacggccgcactggtgcacgcggccgacccggccgtcgtggacagcctggtgcgggcggtcggcaacggcttcaccggccaggccgtcgacatggccacgcggtcggcgcgcacccgcgccgagttggtcgacgcgccccacgacgtgcgggtggacttctgggcgtcgatggccgcgctcaagaccgggacgttgttccggatgccactcgacgcggcggtcgcggccctgcgcgtgcccgaggacgagcggcgcgcactggacgaggccatgcgcaggctcgggctggccagtcagctgttcaacgacctgaccgacgtcgtgcccgaactcggcggggccaacacgcacgaggacttcgacggactgagcaaccgggtcttcctcgaactcctcgactccgaaccgcccgcacagcacgcctcgggcgaactcaccggtgaccggctgaagtcgttcgtcctgggccaccccaagctggagcacacgctcctcacgctcgccgcggaagcggtcgaactcaagcgtgcggcgaaggacgccgtgcgccgcgtgtgccgctccgaacgcagcgcggcgtacttcgacctgacgatcgaacgcaaggggcacctcatcgaccgcctccaccggacggttcggcagcggagcggcgtgtgagcgccacgctgaccgagcgcctgcgcgcgaacacccgggcctggcacgacgccctggaaaccaccgggttcgccgccgccatggtcgccgggacactcccgctcgaccggtatgtcgcgcaactcgccgcctactgggctgtgttggaggcgctcgaaagcgaactgccgcgagccgcgagcccgtccgtcggcagtgtgtggtcgcctgaactggcgaaactccccctggtcgagcacgacctgcggtacttcgccgagtccggcgtcgatccgaagccctgggcggccgaagaggccgaggcgtgcgtgcgggagatccggcgcaccagggcgtcggcccccgaggccctgctcgggttcctgtacgtgctggaaggttccacgctcggcggcctggtgctgcgccggtacgtcaccacggcctaccggctgggcgacgcgggcggcgtgtcctactacggcagcggcgaccgcgaccgctgggcgcgcttcaccgcccgcatgaaccaggtactcaccgagccggaggcgcaggaccgcgtcatcaccggcgcccaccgggcctaccaccacatcgcagcgatggccgacgccctgtccgccggcctggcccccggcccgtgaaccggcgcgagccgctcacgccggcggaagggcggacagccggagcgtcgggcggtggtgagaggaggatcgggcgccctgccctccgcccgtggaccacaggccaccgacggcatgccaagatgacgtcctgacgttcactcaccacggtgcacacggtggcgggatgcgagttcaggacggagccaggcagcgatgacctcccccagcagcgacggcagcggcgccctcgcgcacgcgatagacaccagcaagccccacccggcccggatgtacgactacttcttcggcggcaaggacaactacgaggtcgaccaggaggccgccgagcagttcatgaaggcggccccggaggtgcgggcgggcgtcctcgccaaccggcgcttcatgcaccgcgccgtccggcacgtcgtcgccgaggggggcgtccggcagatcctcgacgtgggcacaggcctgcccaccgaaccgaacgtgcaccagatcgcccacgccatcgcccccgagacccgcatcgcctacgtcgacaacgacccgatcgtcagcactcactccatggccctgctggacggcaccggcacctccgtcgtcctggccgacctgcgcgacccccgcgccgtcctggaccaccccgacgtgcgccgggtgatcgacttcggcgaaccggtggcgctgctcctggtggccgtcgtgcacttcctcgcggacgcggacgaccccggggccgtcgtggccacgctccgcgacgcgctgcccgccggctcctacctcgtcctgtcacacgccacgggcgacttccacgaggaccggaggcaggacgcggcggccgtctaccagcgcgccaccgcctccatgaacctgcgcacgcacgcccggatcctggacttcttcggcgacttcacccttctcgaaccgggcctggtgaaggtcacggactggcgccccgacgagaccccggagcccggcgcaccgccgatcggcatctacggcgcagtggcccgcaaggaccgctgagcccggacctcgcggggtccccctccctcggacgggaaggggaccccgcgaggtccggg

SEQ ID NO: 196 - DNA, 7062 bp, Unknown
  Kingdom: Bacteria, Phylum: Actinobacteria, Class: Actinobacteria, Order: Streptomycetales, Family: Streptomycetaceae, Genus: Streptomyces
ccggcccacccgggggtggcgctgcgggtcgccggtgacgaaggggaacacggacagcaacagcgcgtcggcgccggacagttgcgcggtcaccatctccgaccaggtctgggtgtccgacttggtccagtgggtgtgcggccagttctcgacctcgggtgcggcttcgacgcccgcggggcgcagcgcgcgctggagttccagcatcgtgatcgagcgggccagctcctgggccggggtgtcgcagtagacggcgtagtgcggccggtgcgcctcgacggtctcgaacagggcgctccagtcccgtccctccatggaggcgacgcccagcccggaactcatcagcccgagcttcacggtcccgtcgaccgcggacaccgcctcgcggaccgcggcgacggtctccagctgggcctgccgccaggtctgctggagcagggcccgccaggggtgcggttcgccgggggcggtgatcgcggcgacgagttcctcgcgcgagggcttctcacccgccagggcggcgaaccgctccagcatctccggttcgaaaccgccgccccaggtcagcggggagtggttgtggaagcggaagtcgtcctccagccacaggatgcgcggtccgagcgcagcgaaccgtgcgaagtgcgcggccagccacgcgcgccagcgcgggcaggcgaaggacgcggtggaggtgctcacctcaccggccggtgagaccatcggggcgaagccgggcggcagcagccggccccggtcggcgtgcccggccgtcacccacggattgaggctgaccgtcagcccgtgctcgcgcgccaccgcggcggcccgggagacacgctcgaaccacgcgtcctcggccgcgcccaggcagtgcccggcgaacagctcctccgcgtcgaacatcagcaccacctcctcgatgccgtgtgcgacgcagaaggccgcgagccgctcgggatcggtcccgggcgtcgtctggtagcgaaggtggtagcgcgtcatgccaaatctccacggcggtggcgggcggtacggaaatcgcttgcgggcagggctacttggagatgccgagcgtcatgccctccatgatcttccggccgaaccagaagaacagcaggaccatcggggcgaccaggatcaccacaccggcgaaaagcccgccccagtccgaggtgtactgcatcgtgctgctgagctgactcagcccggccggcagggtgttgtccttgggatcgtcgatcaggaccatcacgagcagcagttcgttccagatcccgatgacgttgagcacggcgatgatcgtcagcccggggcgcgccacggggaccatcacctgcaggaaggtgcgcagcggaccggcgccgtcgagcgccgcggcctcctccaactcggtcggcagcgagcggaagtagccggtcagcacgtagacggcgaacggcagcgagaccgcgatgttgcagatcacgagcgagatccgctcgtcccaccagccgaagacccagtccaccatcaactcgttgagtttgagcgccagtgtcttgtacgggatgagtaccgcctgcaccggcagggcgagccccgccgcgaagtacgtcaccacgggcgcggcggaacgccgccgggagcgggccagcgcgtaggccgccggcgccgcgagcaccatgatcccggcgaccgaggcgcccgtgacgacgacgctgttgagcgccatgccggcgaagtcacccgcgttccaggcccgtgcgtagccgccgagactcagtccgccggcgccgagcggatcggtccacagggaccgcgaggtccgcagcgagctgagcagcgtccacgccaggatcagcagattgaagccgacgaacgcccacagcatgaccttgatggcccgggggatcgcgacgtccccgaagaagcggctcacggccttcatgagatctccacccgttcgctccggctcagccgtctcaccaggacgagcaggacgatggtcaggacggtcaggagcgtcgccatcgccgcgccgtaaccgagttcgggtacaccggtctgcgagctggtcgtcagccactgctgcaccgcgtaggtgcgggcctgcggtgtgggggtgcccgcggttccggtgaagccgatcaccacgtcgaaggtccgcaggctgttcaccgtccacaggacggccgcgatcgagaccatgtcgcggctgagcggcagggtgatgtggcggaactgctgcatacgggtcagccccgccagcttcgcctcctcgtagaggtgctgggggatgccgtcgacggcggtcatcagcagcacgatgtaggtgccgctggtcatccagacgacgccgagcacgatgcacccgaagatgtgctgcggagccagccacggctgctccagcgcgtgcagcccaagcagccgcagcagccggttgacgaccccgtccgggttgagcaggaacccgagcgaggtgccgatggcgatcatcgagatgatcgcgggcaggtacacggcggcgcgtacgaatgcgcgcccgcgcatctcccgcagcacggccatggcgcagaacgcgaccgcgaacacgcacgccccgcccgccaccacgatgaccagtgtgttgaagaacgcctggcggaccgtgtcgtcgcggaagatccgtacgtagttgtgccagccgatccacgtctgctcggtgccgggccccgcccacttggtgaagctcagcaccaccccgtacaccgagggcaggacgaagccgaccgtgtagacgatcgccgccgggaacatgaaccggcggtacgcgcggtccgcgggcccctcgtcgggcctgcgccgggccggccgggcggacccgtcggacccggcggagccggtggacctggcgaacctggacggtcgcgcggatccaccggaccggccggagcggccggaggtccggccgccgcctccggccaccggatcagctgttggcgagagcatctgccgtcttcttcctgccctgggccacgaactgctcgggtgtgatcttcccgcccagcaactggtcgtccagcgggagcatgacgttgttccaccacgtcgtgttcgcggtggcgccgtcgtacgtcgcgttggtctccttggcgcccacgatcgcagcctgcgccgacttgagcgcggcgggggcggggacgtcggggcgcgcggggatgttgagcgcctgcgtgctgatccccgtgctcacggacttctgcaccaggtagctcaggaacagcttggcggcgttcgggtgcttcgccttggcgctcagctcccagccgagggcgcccacctcgaccgagtcgtggcccccctcgacggtcgggaactggaagctggccggagcggcgtcggcgggcgcctgcggcttggtctcgccggccagccaggtgccgttgatgttcagcgactccttgccctgcgcccagtcgttctgcgccgccggatacttggtgcccatgtaacccgactggaaatagccgcccttggcgagctgcgcgacggcctgggccgccttcagcaccgcgggcttctcccagttcgcggcgtccgagccgagtccggccaggctgccggggcctccgtagcgcatcatcagccagtagaaccagtagacgttgtacgtgttgaccagtccgtcctgggcgagcggcgtccggccggccgccttctccttgtcgagcagcccgatgaagtccttccaggtcttcggcacggacgcggcgatgccgggggagcgggcggagtcgtaccagatcgcggtggagatcagggtgtgcggtacggcggtcagccggccgtccttgtccttgacggagttcagcacgttggccggcaggacgtccgccacggtcttgccgccctcgccgggcacggggagattcagcaccgagtccacgctctgcgtcaggttctgcgcctcgtcggcgccgatgtggtcgctgccgccgtcgaagaggtccgggccgttgcccgaggcgacggcctgcggcagcaccttgttgccgctgcggcccaggtacctgatgttcaccttgacgccggtcgccttggtgaaggactcggccgcggccttgaagaccttggcctgcggctcgttctcgccccaggcggaccagtagtcgacctgtttctccgccttggccgccgtgccgatgtccttgcccgccgcgggctcgtcgccgccgccgaccttctttccgcagccggcggtgagcatgaccgtggcgatcgccgccgcgagggcggcctgggctgtcgtcgtgcggcgccgcgttgcgcgcatgtcggtgaacctcctgctggatgacggtgaggcggtgtgcggtaccggctgccggccggggcgggaccggggcgcgctcacagcgcgaccaccgtcgcggtgcgtcgggcccgctcggcggcccagaccacctgatgggacacgagactgtcgtgcgcgtcggtgaggaccagggagggatcctcggtgcggaccgcctcgatgaaggcgtccatgagtgcttcgtcgccgccgccgtgtccgtcggcggcggtgccgtcctcgccggccccggtgtcgatcacgtcgacggcgccggtggtgaagtcgtgcacgcgcagcctgaccccgtcgccctccacccagccgcgggtgccgaagatccgcgtcttgcggtgctccgcggcggtgaacgcggtcatcgtgaacgagacggtggcgccggaggcgaactccatcgccaccacctggtggtcgaccacgtcgttgccgcccgagtacacacacctgccgtacgggctggtgcgcagcgcggcgagcacgccctcctccgtgtgatcggtggtgacgaccgacagcggccagtgccgggcggccgggtcgtccaggcaggcggtgtagatgcgcttcgccgagtaggggcactgcgcctcgacggcgcagtcgaggcaggtgtccgccgctccggccggcttgttctccggggtgaagtgcagcagcgagccgaacgaggcgacgcgggaggggacttcgcccatcacatggatcagccagtcgatgtcgtggcacgatttttgcagcagcatgggcgaagactcggcctcgttgcgccagttgccccgcacgaaggaatgtgcctgatgccaccagccgaccggctccaggtgctcgatgctcgcgatcgtgccgatccggcccgagccgatgagttccttcagggcccgggtgtaaggggtgtagcgcagcacatggcagaccgcgagcatcactcccgccttctgcaccgcttcgatgatccgggcgctgtcctcctcggtcggcgccatcggcttctccagcaccaggtggtagcccgactcggcgaaggcgacggcgggttcggtgtgcatcgagtcctgggtcgtgatgatcgccgcgtccgcgatgcggcccgcggcggcgagttcacgccagtcgtggaacacccgggaggggtcgatgccgaactcggcggccgccgcctcgcgcacctcggcgcgtggctcggcgagcccgacgatcctcgcccgtccttcccgcacggcccggcgggcgtagatcatcccccgcattcccgcgccggcgacgacgagcgtcaccggtcctgccggcctctgtggcacgttccgcaccatcccccctgaccatgggtgaataattaatgcggtgatgattaataactggcgggagcaccgtcaaggggatggacgcagatatcggcaggagggtgaggtgcatggagtagttcctccgtggatgcccggaaaattcttggtcgtgtgaccaagaagcgcggccggagtgtggccggggcgcgaccggggcgaggtcgaccggcggtccggcggcactaatattgcttcgcacgatcgagaatccgggtcaggggtgtgggatgaacgaactcgcggtgacgatcaagggaaccgacccggcgctgctccgccggatccgggccctggcagtgctcagtaccctgcgcagggccggaccgctcgcgctgaccccgctcgcctcgcagtccgggctctcccggcccgtgacgcagagcgtcgtcgacgaactcatggccaccggctggatcgacacggctcccgacgacaccgccgcggacgccgtccgctcggtggggcgcccggcccggctcttccggttccgcagcgaagccggacacgtcgcgggcgtcgacatcggtgcgcacagcgtcgcggccgtcgtctccgacctcgacgggaccatccgcgcccggtccaggaccacggtctcgccgggagaccccgccgacgcgcggctggcggcggcccgcgcggcgatcgcgagggcggcggaggacgccggtatcgagcggtccgacctgtggagcgtcgggctcgcgaccaccggcgtggtcgaccactccggacgggtcgtcaagtccgtggccctgcccgagtggtcgggcctcgacctcggcgccgcgttcgccgacaccgtcgcctgccccctccacgtcgagaacgactgccgggccgccgccctcgccgagcgctggctgggcgccgcgaagggcacggacgacctcgtctacatccacgccgggctgcgcaccggcgccggaatcctggtcggcggcaggctgttgcgcggatacagcggtgccgcgggggagatcggcgcgatgagcgccctgggctgggccgaggccccgatgcacctcatcagcctgcccggcctggaggccgggatcgcgccggaggacgtcgcggagcgggtgttcgccggcgcccgggccggcgatccgctcgcgcaggccgcggtcgaacggttctccaccgcgctggcccaagggatcgtcgccctgtgcctgaccttcgatccgcagctcgtcgtgctcggcggcggcatctcacgctccgccgacatcgtgctcggacacatcacccaggaactggaacgcgtctgcatccgcgtgccgcgcatcgtggcctccgcgctggaccgcgaggccgtcgtgctcggcgcggtacggctcgccctggacatggtcgacgaacgcttcttcgaccatgtcc

SEQ ID NO: 197 - DNA, 4733 bp, Unknown
  Kingdom: Bacteria, Phylum: Actinobacteria, Class: Actinobacteria, Order: Streptomycetales, Family: Streptomycetaceae, Genus: Streptomyces
ccggagtcccaggcctcggcgagcgggacgaggtggtcgatgtccaggtcggaggcggcggtccaggtcgcgccgtcgtagggggagtaccagctgccgctcgtggcggcgcaggaggagtcggtggtgacgttcgagccgtcccgcttgaggacggtctcgcgggtgttgcagctgccgctgatggtgatccagtgcgggaagaggtcgcggttgtagccggtgcggttctcggtcgcgacggtgagggaggcgaggtagccgcgggcggtggcggcgctgaccggggtgggcagggcggcggaggcggccggggagttgatcagtgcggcggaggcgaggaggccggtgagggccgcgagtatgcccagtcgtcgacgcgcgtagaacgtcggccggggagacctgcggaacctgcggatcatgtgaactcccttgcttcgtgggggttttcggcgcgagcgtgggaatgctcgcggcggcgcgttgcggggaggtgtgcgcgcggtgagaagctagtgacgtgtgcatgacatagcaaggctcgtgacggaacttccggtcgcgtacgatggacggcgcagaaggggagtagctcttcgccggaccgtcgacatactgctcagctgggctgagccggcgcccggaggcaggccccggacaggatccgggggcggccagcgagaccttcggcacagcagtgcacgcccgtgcgtacggcacgggtgcatccgtgcgctgccctgccgaggctctggtcgcacaggtcgcagcactctcggcggggtggcccgaccgattgagggacagtgatcagtctcagcgtcctggcgctcgtcttcggcgtcgtcttcctcgccgagctgccggacaagacggccctggcgggactcgtcctcggcacccgctaccgcgcctcctacgtcttcgcgggcgtcgccgccgccttcctgctgcacgtggtgctggccgtggcggcgggcagcgtgctcacgctgctgccgcagcggatcgtgcacgcgctgacgggcgtgctgttcctcggcggcgcggccgtgctgctgctgaagaagggcgacgacgaggaggagatccggcagccccaggaccagtccttctggcgggtcgcgggtacgggcttcatgctcatcctggtcgccgagttcggcgacctcacccagatcatgacggcgaacctcgccgcccgctacgacgaccccgtctccgtcggcctgggcgcggtcctggccctgtgggcggtcgccggactcggcatcgtcggcggcaaggcgctgatgcggcgcgtaccgctgaacctgatcaccaaggtcgcggccgtcctgatgctcggcctcggcgtgtggagcctgtgggaggcgctggcctgagcggcgctggcggtctgagcggcgctggcctgagcggcggtggcggtctgagcggcggcgcggccgtacggccttcgccgctgctcaggcccgcaggtaggcgaggacggcgaggaccctgcggtgggtctggtccgtcggaggcaggtccagcttggtgaggatgttgccgatgtgcttgccgaccgccgcttcggaaaccaccagctccttggcgatcgcgccgttggaccggccttcggcgatcagcgccagcacctcgcgttcgcgcggggtgagccgctccagcggatcgcggcggcggcgcagcaactggcgcaccacctcggggtcgaccaccgtcccgccgtccgccacctcgtgcagcgcctccacgaactcctcgacctggccgacacggtccttgagcaggtagccgacgcccgttccgtcgccggagtccaggagttcggcggcgtacgtccgttgcacgtactggctgaggaccaggaccggcagagcggggagcttctcgcgcagccgcaccgccgcgtgcaggccctcgtcctggaagccgggcggcatgcgtacgtccgtcaccacgatgtcgggggcgtgctcctcgacggcggcgaccagtgccggcgcgtccccgacggccgacaccacctcgtggccgcagcggctgagcaggccgacgatcccttcccgcagcagcacactgtcctcggccagcactacgcgcagtggccggccgcctcggtcaactcgcaaggaaactccacacgcaacagagtcggcccacccggcggactggtcagggcaagtctgccatccaggacggagacccggtccgcgagaccggtcaggccgctgcccgccgaggcgtccgcgccgccgcggccgtcgtcgcgcacttcgaggaacaggcgtccgtcgcgatgaccgccgctcacccgcgcgcggccggccccgctgtgtctgtcgacgttggccagtgcctcgcagaccacgaagtaggccgcggattcgaccgcctggctcgcccggcccggcaggtgcaggtcgacgtcgacggggaccacgcagcggtcggcggcgtcggcgaccgcggcctcgagcccgtagtccgtgaggaccttgggatggatgccgtggatgagctcgcgcagctccgtgagcgccttgcccgcctcctcgtgggccttggcgagctggtcggcgagcgggccgggcggggcgtcgaggcgggccagcccgagggtcatcgtcaggaccacgaggcgctgctgggcgccgtcgtgcagatcgcgttcgatgcggcgccgctcggcctcgaaggcctcgaccaaccggacgcgtgagcgggccagttcgaccacccggtcgcccagctcgccctcgcgggaggcgaccagcagccgggtcaactcggcgcgggcgcccgccgcgacgccgagcacgtaagcacccagggccgtcaggagcaggcccagcacggcgacgccgcacgcggtcggccatgtggtgaccgtccacagcttgagcaccttcgtctcgtggccgtcgccggccgtcgccagcagcagcggggtggcggccatggacagcggggagagcagggcgaccgtgaccgccacggcgtcgaccggccacagcagcccggcgaacaacagggcgtacccgagttcccgccaggtcgcctgctccctcagccgggtgaccagccaggcccgcagccccggcgcggccggcacccggtggccgccggacacccggtcgcgctggaccaggcgcagcctgcgccgctccacctcggccaccgggaccccgctgaggacgaccaggacgagcagcggcagccccaccacgacgacggcgagcgcaccacagaccacggccaccaccacgatccccaccagggcggcggcgccggtcaccacaccggtgagcagatacgcggcggaacgccagggccacgccgacagcaggaagcccggccgggacatggcctgccacacattccgagggtgcatggacatgaccgtaagcggcccggccggtccggtgccatcggcccagagtccgtatcgggggtaggcctggccctaccccaggtctcggtccggccgtactgcgccaccagggggttccggggtttcgtggaggcgtcaacgagtcgacgaacagaagctggtgggggaacacatgaccgacgacgcgatcagattgcgctccgtgacacggcggtacggctcgggcgggacgtccgtcaccgccctcgacgacgtgtcgctcgccttcccgagggggacgttcaccgccgtgatgggcccgtccgggtccggcaagtcgaccctgctccagtgtgccgcgggcctggaccggcccacgtcgggctcggtcaccgtgggcggcaccgagctgacggggctgagcgagaccaggctgaccctgctgcgccgcgagcgcgtcggcttcgtgttccaggcgttcaacctgctgccctcgctgaccgccgagcagaacgtggccctgccgctgcggctggccggccgccgcccccggaaggcccgggtgcgcgaggtgctcgaacaggtcggactcggcgaccgtgcccgccaccggccggcggagatgtccggcggccagcagcagcgggtggccctcgcccgcgccctgatcacccgccccgaagtgctcttcggcgacgagccgaccggcgcgctcgactcgcacaccggccgcgaggtgctggacctgctgcgcggcatggtcgaccgggacggccggacgatcatcatggtcacccacgaccctctggccgcctcctgcgccgaccgcgtcgtcttcctcgtcgacggccgtgtcaacggcgagctgaccggcgccgcggccgaggacatcgcggcgcgcatgaccaagctggaggccgtgccgtgctgagcaccgtcctgcgcaccctgcgtgcccgctgggtcaccttcgccggcagtttcgtcgccctctccctgggcgtggcgctgatcgccgtgatggggctggtcctcgcgtcctcgcgggacgcgcccgagcggcgtccggaacggttcgccgccgcgccggtcgtcgtccagggccaggacaccctggaggtgcccaccgcgatcggcgaccgcacacagaagctcgcgcagccgcgagccgtacccgccgaggcgatggcgaagctgcgcggcctcgggaccgtcgtcgaggaccgctcgttcgccgtgcgggccgagggcgggcccgccgatctggtgggccacccctggtccaccgcggcctcgggggcgcgtcccgcgtcgagttcgtacggcgcgaaggccgcggtggaccaggggt

SEQ ID NO: 198 - DNA, 5923 bp, Unknown
  Kingdom: Bacteria, Phylum: Actinobacteria, Class: Actinobacteria, Order: Streptomycetales, Family: Streptomycetaceae, Genus: Streptomyces
ggcgcgggggcccgcccgcgcgccgcctcgcgtccacggccggttacgcgagcagtcccgaggaccgccacagccggcgtccgaccccgcgcagcacgccgatgtcgtcgaggaagtcggtgagccgcttggcgccgctctgcatgacctcgcgccggtgcccgctggccttcacctgggccatggcctcgcgcttgtccaggcccacgttcgtgtacacctccgggttgacgaaggcgacggagaagacccgggcgaactcgccggaggtgacccgcgtgaactccttcgaccacttcggagcggtcaccatctggcggcgcagctcctcacgggcgtagcgcacgtgccgcgcctcctccacgacgtggatgcgcgtgaccccgcggaccagcggctgtatccgctcgtcggggaaggtcaggcgctgcatccagtcgagcacctcctcgccgagcagggtggcggtgaaggagccgggcgtggtggagatggtcttgaacagccggccgaggtgctggtgggcggggctcaccgggtaccagggggtgccgccgcgggtgatcaggcgggcgaacatcttcgagtgccggcactcgtcctcgatctcggtgagggcgtagcgcacgtgcgcgctggtggccgacttgtcgtagatgtggcgcacgagcagctgcatcaggatcagttcgaaccagatgccgagggaggcgagggccgcggcctcgtgctgggagagcaggatccgctgctcctcgctcatccgcttccacagcggtgtgccgtacagcgacaccagctccggcggccagaaccacttgccctcctcgaagggcgcctcccagtccagttccttgtccgggtcgaaggagtgcttggcggaagagtcgagcagccgctcggccacctgctcccggtccttgagcaggccgagcgcgtcgcgcagtccggcgagcgcgtcggcttccgtcacggtcgtcatggctgtcccacctcgtcgtacggggatgtggctggctggatcgactggttactcgggggtcagctccccactcccttataagactgcgtgtcagcaagcgcgtcaatcccttgtgcgggacttgttgactcggcgtctacgaaaccggtgtcccgggcgagtgcagcaccgcctccatcacggccttcgcgatcggggccgccgtaccgccgccgctgatgtcaccgcgccgggcggaggcgtcctccacgaccaccgcgaccgccacccggggatccatgtcgttcacgccctgcgcccaggagatgaaccaggcgtacggcgtccccgcgttgcccacgccgtgctgggcggtgccggtcttgccgccgacgacggcgcccgggatcgccgcgttgccgccggtgccgtcggtcaccacaccgcacatcagctcccgcagccgggccgcggtcgtcgcccgcatcacctgccgcaccggccgggaaccggccgccgacaccgtgtccccgccgctgcgcgtcgtccgctccacgaggtacggcacgcgcacctggcccccgttcgcgaccgccgccgcgaccatcgccatctgcagcggcgtcgcccgcgtgttgtactgcccgatcgacgagagcgcgagctgcgcccggtccgcgggcgcgtcgaacgtgctcggcgccaccgcgaagggcaccttcaggtccgggtcgtcgaagccgaagccctccgcagcctgccgcatggcctgcgcgccgacgtccacgccgagcttggcgaacaccgtgttgcacgaccactcgaaggcgaagcgcagcgacgcgttctcgcagtcgtcggcctcgttgaccagccgtgtggtgctgccgggcagccggtaggggtccggcgagtcggtcggcgcgtccaggtcggtcaccagccccgtgtccagcgccgccgctgcggtcacgaccttgaacgtcgaacccggcggatacgtctgccgcaccgcccggttgagcatcggcttctccgggtcgtcgttcagccgcgcccaggccgccaccgtcgcgggcccgttcccggacagctccgccgggtcgtacgagggagtggacaccagcgccaggatccggcccgtcgccggctcgatcgccgcgaccgcgcccttgcgcgcgcccagcccgtcgaacgccgcgcgctgcgccgccgcgttcagggtcgtcaccacgttgccgcccgcgggctgtccccgggtgaagtcgtgccacagcgggaaccctgccagcatcgggtcggtccccgccagcacccggtcctcggcgtgctccaggaacgtcgtcccgtaccgctgcgaggcgaagccggtgaccggcgcgtacaacgggccgtcggcgtacgtccgttcgtagcggagctgttcgccggtgtcccgggagccggtgaccggccgtccgccgaccaggatctcgccgcgcggctgctcgtaccgggcgatggtggggcggcggttggccggattgccgccgtaggaggggccctcgagcacctggagccaggccgtgttcaccagcagcgccacgagcagcagcacgcagaaggcggcggcgcgccggatgtaccgggtcaccggacgccctcgccgctgggccgcacgctgcccgcgccgggccgcccgccgctcacggcgccaccgtcccgtcgtactgccgccgtgccacgtggctgacccggatcagcagcgccacgatcgcccagttggtgaccaccgacgagccgccctgggccaggaacggcatcgccatgccggtcagcgggatcagccccgtcaccccgcccgcgatcacgaacacctggagcgccacgatggaggcgaggccgaccgccaggagccggccgaaggggtcgcgcagggcgaggcccgcccggtagccgcgctcgaccagcagcgcgtacagcaggaagaccgcggaaaggcccgccaggcccagttcctccccggcggtggccaggatgaagtccgacttgaccgcgaagccgaccaggatcgagtggccgagccccagtccggtgccgagcaccccgcccgccgcgaacgagaacagcgactgcgcgacctggccggggccctgaccggcctcgatggacgcgaacgggtgcagccactccgccaccctgctgtgcacgtgcggctccagcgagccgacggcgaaggcgccggccgcggcgagcagcagaccgagggcgatccagccggtgcggccggtggcgatgtacagcatcacgacgaagagcccgaagaacagcagcgaggtcccgaggtcgcgctccagcaccagcacgccgacgctcagcagccagatcgcgacgaccggcccgagcacccggccggtgggcagctgcagccgccacacccggcggccggtgtacgccagcgcgctgcggttcgcggccaggtacgcggcgaagaacaccgcgaggagcaccttcgcgaactcgcccggctggaaggagaacccgccgagccggatccagatgcgggcgccgttcacggcggggaagaggatgggcagcgtgagcagcgcgagcgcggccaccacgcagacgtacgcgtaccgctggagccagcggtggtcgcgcagcacgagcaccaccagcgtgaacagcgccacgcccagcgtggaccacaccagctggaccggcgccgcctcctcgccgggtgtctccaggtccaggcggtagatcagcaccaggccgagcccgttcagcagtacgccgatgggcagcagcagcgggtcggcgtacggcgcccgcaggcgcaccgcgccgtgcgcgagcagcgcgagcacgccgagcccggcgccgtatccggcggcgccgggcgggacggtgccggacttcgctaggccgacggcgcagtagccgtacacggacagcaggacggcgaggacgatgagggcgagttcgatgccacggcgccgggggaggcgtacggcgtccggtgcggacgggtccgccgccaccacggtggctccggcgcttccagggcttccggcgcctggcgcactcccggggcttccggtggttccggccttggtcatgtccggaacctacctaaaagatgcatatcagacgccgtgcgggtcagcaccagcgtggcgcgggcccgacgttgtcgatgtagcgggccgagccccacgtccaggcgccgtccgcgagcaggtaccacaggtggttgccgcccacgctcgagccgttcgtcttgcagtagatccacaccgtctcgccctgccgggcgacccgtagcacccggctgccgtggtccgggcgcgagtgcagcgcgaggccgccgcgggcggtgacgcggccccggtagaagcgggtggcggagtccggtgtgccgctggtcgccggggtcgccgacgccgtccgcgaggccggtatcccggtcttcggcccgtccggtgaggcggcgcagctggagggctccaaggccttcgcgaaggacgtgatggcgggcgccggcgtccccacggcccggtcctacgtctgcaccacggcgaaggaggccgacgaggcgctcggcgccttcggcgcgccctacgtcgtcaaggacgacggactggccgccggaaagggagtcgtcgtcaccgatgacatcgaggcggcgcgggcgcatgccgccgcctgcgagcgcgtggtgatcgaggagttcctcgacggccccgaggtctccctgttcgccatcacggacggccagacggtactgccgctgcagcccgcgcaggacttcaaacgcgccctggacggcgacgagggcccgaacaccggcggcatgggcgcgtactccccgctgccctgggccgaccccaagctggtggacgacgtgctgcagagcgtgctgcagcccaccgtggacgagatgcgccgccgcggcaccccgttctccgggctgctctacgccggtctcgcgatcaccggccgcggcgtccgggtcatcgagttcaacgcccgcttcggcgaccccgagacccaggtggtcctggcccgtctccgcacccccctggcgggcgtcctgctggccgcggccaccggaaccctcgccgacctggagcccctgcgctggagcgacgaggcggccgtcacggtggtcgtcgcctcgcacaactaccccggcaccccgcgcaccggcgacccgatcaccggtctcgacgaggtggccgcccaggacgtcccgcacgcgtacgtgctgcacgccggcacccggcgcgacggcgacgccgtgctgagcgcgggcggccgtgtgctgtccgtcacagccaccggcaaggacctgaccgaggcccgcgagcgtgcgtacgccgccgtcggccgcgtccgcctcgacggctcccagcaccgtacggacatcgcggcgaaggcggcggcgggcgcgtaggaaggcgcggaaacgctcgaccgctcggcaccaggaccaggcctttcgaggctcttttccaagatcaggccccggacaggatccggggcctgatctttgctgtgtgtcatccacctctgaccaaagccattccatcgagtgagcaatggcccatccggctgacgtgggccggacccccaactagggtgcggcgcaagcgttccggcacttggcccaccggcattgcgatgtcagtggcgggtgccacagtgggggagtgggcaacacagggcagtccaggacagtcggcagggggtgacgtcaggtcgtgaccggaaccggtgtggaggtcggcgcgcagtcggcgcgctcccgggccctggccgtgctgcgcgtccgcggccgggcactggccgtggccctgctgcccgcggccttcgccgtgatcctgctcgcgggcggttccaccggccacctcgtgggccggggctgggaccttgcccggtgggtggtgggcatcgtcgccgtcgtcgtcctgctcg

SEQ ID NO: 199 - DNA, 4094 bp, Unknown
  Kingdom: Bacteria, Phylum: Actinobacteria, Class: Actinobacteria, Order: Streptomycetales, Family: Streptomycetaceae, Genus: Streptomyces
gctggcgcgcgccagcttggccgtctcggtcggggtcttgccgaccttgacgcccgcggcctccagggcctccttcttcgcctgggcggtgccggacgaaccggagacgatggcgccggcgtggcccatggtcttgccctcgggcgcggtgaagcccgcgacgtagccgacgaccggcttggtcacgttggccttgatgaagtcggccgcacgctcctcggcgtcgccgccgatctcgccgatcatgacgatcaggtcggtctcggggtcggcctcgaacgcggcgagggcgtcgatgtgcgtggtgccgatgatcgggtcgccaccgatgccgacggccgtcgagaagccgatgtcacgcagctcgtacatcatctggtacgtcagcgtgccggacttcgagaccaggccgatacggcccggcttggtgatgtcgcccgggatgatgccgacgttcgactggcccggggtgatgatgccggggcagttcgggccgatgatgcgggtcttgttgcccttcttgccggcgtacgcccagaaggcggccgagtcgtgcacggcgatgccctcggtgatcacgacggccagcgggatctcggcgtcgatggcctcgacgacggcgtccttggtgaacttctccggcacgaagatgacggagacgtcggcgccggtcttctcgatggcctccttgacggtgccgaagacgggtacctcggtgccgtcgaagtcgacggtctgacccgccttgcgcgggttcacgccgcccacgacgttggtgccgtcgccgagcatgagcttggtgtgcttcatgccggtggagccggtcatgccctggacgatgaccttgctgtccttgttgagccagatagccatggtgtgttggtgtcctcgtcctgagtgattacttggcggcgtgggccagctcggcggccttgtcggccgcgccgtccatggtgtcgacgcgctggaccagcgggtggtcggcgtcggtgaggatcttgcggcccagctcggcgttgttgccgtcgaggcggacgacgagcggcttctcgaccttctcgccgcggtcctccaggagcttcagcgcctggacgatgccgttggcgacctcgtcgcaggcggtgatgccaccgaagacgttgacgaagacggacttgacgtccgggtcgcccaggatgatctccaggccgttcgccatgacctgggcggaggcgccaccgccgatgtccaggaagttggcgggcttgacgttgccgtgcttctcaccggcgtacgcgacgacgtccagggtgctcatgacgagacccgcgccgttgccgatgatgccgacctcgccgtcgagcttgacgtagttgaggttcttctccttggcggcggcctcgagcgggttggccgcggccttgtcgtggagggcctcgaagtcggggtggcggaactcggcgttgtcgtcgagcgacaccttgccgtccagggcgatgacctcgccggaggcgaccttggccagcgggttgacctcgaccaggagggcgtcctccttgatgaaggtgtcccacagcgtgaccaggacgttggcgaccttgtcggcgacctcggccgggaacttcgcggcctcgacgatctcgcgggccttctccggcgtcacgccgtcgatggcgtcgatcggggtcttggcgacggcctcggggcgggtcgcggcgacctcctcgatctccatgccgccctcgacggaggcgatggagaggaaggtgcggttggcacggtcgaggaggaaggagacgtagtactcctcgacgatctcgggggccgtctcggcgatcatgaccttgtggaccgtgtggcccttgatgtccatgccgaggatgtccgtcgagcgggcgacggcctcctccggggtggcggcgagcttcacgccaccggccttgccgcgaccaccgaccttcacctgcgccttgacgacggacttgccgcccagacgctcggtgatctcgcgcgccgcctcaggcgtgtcgatgacttcaccggccagcaccggtacatcgtgcttggcgaagaggtccctcgcctggtactcgaacaggtccacgcgcttccgtccctatcagtgatctcgcggttcgttggatgcgtgggcgtgccgcgaagggcaacgtgacgtccgcttgtcacaagggaggcgcacacggtgtccgagcgcgcggcatgtccatctcgcaggttatcgccgcttgcgggggcgccataaatcgagggtcacacctgagcggtgatacctgtcacatgatgccgccgttgctggcaccgcgtgccgcgcgcgggaccgtttgggggctgtcccgcgaggtctcaccgggctggggttgacccggtgagacccctggatgagccctccatgggctcggacggatgatccccaccccaatggggaccagccggccctccgcgggttgccggacggacgaccggagaaaccgacggttttcggccaaccgggcccctggtcccacggaggcgcgaggctctcgcgggcgggcgaggcactgatcctcgcacgcacctcccatcgccgcgcaagcccctgttaccgactggtaggaacccttctgccgcactctgtacccgtggtccgcgcccctcacgtgcgtctgtgatcgtgcccgtcaggtgtgcctgtggttcgtgtgcctcacgtgtgccgtgttcgtgtggtggttcgtgtgcctgtggttcgtgtgcctgtggtccgggcgtctcacgcggtctcggggaccggcagcggccgcttctccatcgccgccgccatcacctcggggaacagatcgggtgtgcaggcgaacgccggggcgccgagcgccgccagcgccgcagcgtgctccctgtcgtacgccggggcgccctcgtcggagagcgcgagcagcgtcacgaactgcacccccgacgcctgcatcgccgcgacccgcttcagcatctcgttgcgtatgcccccctcgtacaggtcgctgaccagcacgaccacggtctcggcgggccgggtgatctgcgactggcagtacgccagcgcccggttgatgtccgtgccgccgccgagctgcgtgccgaagagcacgtccaccgggtcgtcgagctggtcggtgaggtcgacgaccgcggtgtcgaacaccaccagccgggtgctgatcgaccgcatggacgccagcaccgcaccgaacaccgacgcgtacaccaccgaggccgccatcgacccggactggtcgatgcagaggatgacctccttcttcacggactgcgacgcccgcccgtacccgatgagccgctccggcacgatcgtccggtactccggcaggtagtgcttgaggttggccgcgatggtgcggttccagtcgatgtcgtggtggcggggccggctgatgcgggcgctgcggtcgagagcgccggtgagggtggcgcgggtacgcgaggcgagccgcttctccaggtcctccacgaccttgcgcaccacggcccgtgccgtctccttcgtcgtctccggcatcgccttgttgagcgagagcagcgtgccgacgagatggacgtcggcttccaccgcctccagcatctccggctccagcagcagcgtggacagcccgagccggtcgatggcgtcccgttgcatgacctggacgacgggggcggggaagtaggtccgtatgtccccgagccagcgcgccaccgagggcgccgaggccccgagcccggccgaacgttcccgcccggtccggcccgtctgcggcttgtcgcccttgccgtagagcgcggccagcgcaccgtccatcgccgcgtcccgtcccgagagcgcgcatccggtgccgtcggccgtgtccccgccgagcacgagccgccagcgccgcagccgctcctgagccgcatccgccacgtcgtcaccgaaccccgccgccaccgtcataccgccacccccgcgaactcgttgccggccttcccgccagtactggagccggaaggcacactgtcgtccaggcccagcagcagccggaccaccggcagcaccgcgtcggcgcgccgccggtcgaggccggccgcgaaaccgggcacgcctgccg

SEQ ID NO: 200 - DNA, 9496 bp, Unknown
  Kingdom: Bacteria, Phylum: Actinobacteria, Class: Actinobacteria, Order: Streptomycetales, Family: Streptomycetaceae, Genus: Streptomyces
gctgatccacggccacgagccggccgccccgcaccaccacccggccgaccgcgacgagcctcagcaaaggcgccgccgcgaccgcgcaccccacccgcaactgctcacggggcgtaccgtcccgcccgtccaccccgagcagcacgatctgctcgcccaccgtcagcccagtgtccataagaccccctccggctccacaacgcacggctcactcctcccggttccgcctacgatccgcccgccgggctatttggtggcgggtgcgcggaggaagagggcgctggtgagtgcggcgaggaggacgagggcggtgtcgacggcgacggcggtccggatgccgccgaggatgccggtgacggtggtggtggtcatggcgcccgtggcgatcgcgctcatgacgggggtgcccatggtgatgccgatctgctggctcatggtggccaggccggtggccatgccctgttcgtggtcgggcaggccgctggtggcggcgaccatgaagccgacgatgagcagcatgttgccgacgccgccgatgaaggtggcgggcagcatcagggcgaggctgtgggtggtggtgcccaggaacagcagggcggcggtggcggcggtctgggtcagggcgccggtgctcagggtggtgcgggtggtggtggccgcgatgacgcggggggcgagggcgccgcccacgacggtgcccagacccagcacgccgaaggacagtccggcggccagcggggagaagcccagcaccttctgcaggtagagggtcatcaggaagaccagggaggtctcggtgacgaaggcgaggatgccggccgcattgccccaggccacgctgcgccgggcgaggacggtgaccgggacgaggggggcggggctcctgcgttcgacgaagtagaacgcgaccagcagcgcaatgcccacggccagcacgacgagtgcggtggggtcggaccagccgtgctcaccggcccgggtgaagccgaagaccacggcgagcaggccgagggtgacgctcgaagcgccgggcaggtccaggcgcggacggctcggggggcgggactctgccagcaccatcggggcgatgaccagcacggcggcggcgacgggcacgttgatgaagaacgaccaccgccaggacagcaggtcggtcagcacaccgccgaggacggcgccggtggtgaagccggccgacatcagtgccccgttcagtcccagggccttctggcgcaggggtccttcggggaaggaggtggtcagcagggacagaccggccggggtgaccgccgcggtggcgaggccctggaagacacgggcgacgatcaggacttcggggctggtggccaggcccccggccagcgaggccagacccaggactgccaggccgcccaggaacatccgccgccggccgaacaggtccgcgacccggccgaacagcagcgtgaacccggccgcgcacagcgcgaacgcggtcgcgatccactgcaggtcggccagcgggaaacccagccccttgccgatcaccggcaacgccacgttcaggatcgagaagtccaccgcgagcatgaactgcgcgaccagcagcaccaccagcgtcagccgcatccgcgacgtcaaccgctgcgccaccaccccgcgcggaccgcccccgacagcctcgtcggccacaccatcgacaacagacatgagattcccttcgagaagcttcgaccgagagaatcctgtgacccggtccggcacctacccagtccccgaaggcgactcctcggctgctgacagggcaggcgctgggtggtcaggacatgaccacccaggacgggaaggaccggggcaccgcctccgttggacgcaaggcacggttcacgtcaccggattcactggaagggcaccgcatgccggacttctccgaactgagcgacttcctgcgcagccgccgagccgccctgacgcccgaggagatcgggcttccgcagctggcggaacggcgccgggtacccggtctgcgacgcgaggaagtggcgctggcggcaggcctgagcgtcacccactacacccggctcgagcagggccgtgtcaaccaggtgtccgactccgtcctcggggcgatctcccgcaccctgcgcctgaccccggacgagcacagccacctcatggacctggcccggccccggacggtcacctcccgtcgtgcccagaccccgcgaacccccagcgccgaccagggtgtccgccagctcatcgacaccttcacggacacccccgccctggtcctggaccggcgcaacgacgtcctcgcctggaacgccatgggccatctcctgctggccatgcacctggacttcgacgcgcccgagcatccggcgcgccggccgaacctgacccggatgctcttcctggacgagcgcaaccgcgacctctacccacgctggcacgacgaggcgcagctcgcggtggcctcgctgcggctgatcgccggccgctacccccatgacaagcagctcgccgaactggtcggcgaactcatcatgaacagcgaggagttcgccagacgctgggcccggcacccggtgcggacgtgtgtcgccggaaccaaggagatcgaccatcctctcgtcgggaccatggagctctccttccagagcctgctggttcccggggaggccgggcagcgcatgatcgcctacacggcccggcccggcacgagttcggaggcgggactacggctcctcgcctccaccctccgcgtaccgaacacggccatcccgacgaccgccgactgacgccccggaaacacggcggcaggggccggaatggcggctgagcctgacgcaggagtgggagcggatgctggaccggatccgcggcttcgaacccaactcgtccggccgcaaggcccgttccgcgctggtgaatgtcacctcggcggtctccgccgcggacatgccccgcgcggcagcctcacaaccccacgatcttgttccaccgcttggcgaactccacccgttccgtggaggtgatgtcgcgggcgatggccaggcgccggcgcatggtggcgtcggggaagatcagggggttgtcggcgagggcggccgtgtcctcgtcgtcggaggcggccagcacctccttggccgccgggaccgggcagacgtagttcacccaggcggccaggtcggcggcgacctcgggctggtagtagtagtcgatcaggcgctcggcgttggccttgtgcgcggcccggttggggatcatcagggagtccgaccacagctcggcgccctcctcgggcacgacgaagcggatgtcggggttgtccgcctggagctggatgacgtcaccggagtaggcctggcaggcgaggacgtcgccgctgaccaggtccttggtgtagtcgttgccggtgaagcggcggatctggccacgggcgacctgcttctcgacctggtcgcagacgtggtggaagtcgttcgcggtccacttcccgatgtcgacgccgttgccctgcatcagcagcgcgaaggactcgtccaggccggacagcagcgtcaccctgcccttgaggtcgctcgcccacaggtcggacacgcggtggatgtcccggccgagccggcggcggttgtaggcgatgccggtgatgcccgactggtagggcacggtgaacttccggccggggtcgaaggcgggcgaacgcagcagcgggtccaggtacttggcgacgttcggctgccgggcccggtccatctcctgcacccagcccaggcggacgaaacgcgcgcacatccagtcgctgatgacgatgaggtcgcggccgggcttctggtggttcatcagggacgggctgatcttgccgaagaactcgtcgttgtcgttgatctcctcggagtagtccacggagatcccggtgcgcttctcgaacgcctccagcgtgggccgccggttcgggttcttgtcgtcggtgtcgatgtagagcggccagttcgaccaggtcagccgtttgtcggtggccgagctgtccgggacggagcggtcgccgggagcgacgtaggcggcgggcaccccgcatccggcgagcgcgccgagcgcggcggtggaaccgagggcccgcagcagggaacggcgggaggaggcgggcgcgttgcgcggcggtgtgcggggcgtcagcggagtccggggcatccccgcagcatgccgcccacgcccgccccggacaatcgacgctccgtcgagcccggcggtgccatcccgacaccttgtcgatcacgccggggggccactgcgtcgcccggcccccgcagcgagcgcgacaagcgcacggcggtcgcgctcccccgtggcgcacgacgggtcgtgcacacgggtcgtacgccacgttcgtacgccgcgtccggcgcgacggcccaccgacggcacaccgcggccccggacggtccgtcctccgtccggggccgcggtcgctgcgggcaggtcgtcagggcctcgcgaagaggctcggcgtctcagccgactcggcgtctcagccgtccagcgaagtcatcacgtgcttgatgcgcgtgtagtcctcgaagccgtacgccgacaggtccttgccgtagccggacttcttgaagccgccgtggggcatctcggcgaccagcgggatgtgggtgttgatccacacacagccgaagtcgagcctcttggacatccgcatggcgcgggcgtggttcttggtccacaccgaggacgccagcgcgtactcgacgccgttggcccactcgacggcctggtcctcgtccgtgaaggactggacggtgatgaccgggccgaagacctccttctggatgatctcgtcgtcctgcttcaggcccgagacgacggtcggggcgtagaagtagcccttgtcgccgacctggtggccgccggcctcgaccttggcgtgggcgggcagccgctcgatgaagccggctacctgcttgagctggttggggttgttcagcgggccgtacaggacgtcctcgtcgtcgggctgcccggtcttggtgtccgcggcggccttggcgagcgcggagacgaacgcgtcgtggatcgactcgtggaccaggacacgggtcgcggcggtgcagtcctggccggcgttgaagtagccggccatggcgatgtcctcgacggccttgtcgatgtcgacgtcctcgaagacgacgaccggcgccttgccgcccagctccaggtggacgcgcttgaggtccttggaggcggactcggcgaccgacatgccggcgcgcacggagccggtgatggaggccatcgccggggtctcgtgctcgaccatcaggcggccggtatcgcggtcgccgcagatgacgttgaagacgcccttgggcaggatcgagccgatgatgtcggccatcagggcggtggaggccggagtggtgtccgacggcttgaggacgaccgtgttgccggcggcgagcgccggggcgaacttccacacggccatcatcatcgggtagttccacggcgcgacctgggcgcagacgccgatcggctcgcgccggatgatggaggtcaggccctccatgtactcgccggccgagcggccctccagcatccgcgccgcgcccgcgaagaagcggatctggtcgaccatcggcgggatctcctcggagcgggtcagcccgatgggcttgcccgtgttctccacctccgccgcgatcagttcctcggcgcgctcctcgaaggcgtccgcgatcttcagcagcgccttctgccgctcggccggggtggtgtcgcgccaggccgggaaggccgcggcggccgccgccatggcggcgtcgacgtccgcctgaccggacagcggcgcggtcgcgtacgcctcaccggtcgcgggattgaccacctcggtggtccgtccgtcggcggcgtcccggaactcaccgtcgatgtagttgcgcagacgacgcagctcggtgctcactgccggccctcctgggttggttcaaggtgtccaatcgctgagacacccaccctagtcgccgcgccgacgttttcaacacccccgccaccatcacttctgcgaaatccgcaagagtcagcgccgtaaacaacgaatttcatcggttcgggcttgcggaactgtcgagacgtcgtgcacagtgaggacgtggccagtcgaagcgcagagcagagggactcgtcccgcgagtcccgcaacgggaacggcaccccccagctggacgccgtctccctcgccatcatccagcagctccaggaggacggccgccggccctacgcggcgatcggcaaggccgtcggcctctccgaggcggccgtgcgccagcgcgtgcagaagctgctggaccagggcgtcatgcagatcgtcgccgtcacggacccgctcaccgtgggcttccgccggcaggcgatggtcggggtgaacgtcgagggtgatgtcgagtccatcgcggacgcgctgactgccatgtcggaagtcgagtacgtggtgatgaccgcgggctcgttcgacatcctcgcggagatcgtctgcgaggacgacgaccacctgctggacgtcatcaacaaacgcatccgggcgcttcccggcgtgcgctccaccgagagcttcgtctacctcaagctcaagaagcagacctacatgtggggaacccgataaccgtgagcaaggacctcagccgaaccgcgtacgaccacctgtggatgcacttcacccgcatgtcctcgtacgagaacgcccccgtgccgaccatcgtgcgcggtgagggcacctacatctacgacgaccagggcaagcgctacctcgacggcctcgcgggcctgttcgtggtccaggccggccacggccgcaccgagctggccgagaccgccttcaagcaggcgcaggaactggccttcttcccggtctggtcgtacgcccaccccaaggccgtcgagctggccgagcgcctcgccgactacgccccgggcgacttgaacaaggtcttcttcaccaccggcggcggcgaggccgtcgagaccgcctggaagctcgccaagcagtacttcaagctcaccggcaagccgatgaagcacaaggtcatctcgcgtgcggtcgcctaccacggcaccccgcagggcgccctgtccatcaccggcctgccgggcctgaaggcccccttcgagccgctggtcccgggcgcgcacaaggtcccgaacaccaacatctaccgcgccccgatcttcggcgacgaccccgaggccttcggccgctgggccgccgaccagatcgagcagcagatcctcttcgagggccccgagacggtcgccgccgtcttcctggagccggtgcagaacgccggcggctgcttcccgccgccgcccgggtacttccagcgcgtgcgcgagatctgcgaccagtacgacgtgctgctcgtctccgacgaggtcatctgcgccttcggccgcctcggcacgatgttcgcctgcgacaagttcggctacgtcccggacatgatcacctgcgccaagggcatgacctcgggctactccccgatcggcgcctgcatcatctccgaccgcctggccgagccgttctacaagggcgacaacaccttcctgcacggctacaccttcggcggccacccggtctccgccgccgtcggcctcgccaacctcgacctgttcgagcgcgagggcctcaaccagcacgtcctggacaacgagggcgccttcctgtccacgctgcagaagctgcacgacctgccgatcgtcggcgacgtccgcggcaacggcttcttctacggcatcgagctggtcaaggacaagaacaccaaggagtccttcaacgaggaggagaccgagcgcgtcctgtacggcttcctctccaaggcgctctacgacaacggcctgtactgccgtgccgacgaccgcggcgacccggtcgtccagctcgccccgccgctgatctccaaccaggagaccttcgacgagatcgagcagatcctgcgcgcggtcctcacggaggcgtggaccaagctctgatccgccggaggtgagcgaaccacggcgcacacctccgatcagatgatcatcaccggccccggagccgtccgttcgagtgggaaacggcggcccggggccgtgtgctgtccggcctcccggccccggctgcctagcgtgacgtgaccgatcggctccgccttcgttcccccgtacgagggattcgtacggagaacgggcacgagggatccccggacccgcacggcaccccgcgcggtattcctgatccgaaccgaggtgtacgccatggtggccccgccggacaacgacgtgctctgggcacgcgccctgcattacacccacaaggacggctcgcccgccctcagcggcatctcgctcggcgtcggccagggcgagatcctcgccgtcgccggacccagcggcagcggcaagaccaccctgctgcgctgcctgtccggcatggtgcgcgtgcgcgagggcgaggtctggttcaacagcgcgcccgtgcacaccctcgggccgctcgcccgggagcggctgcgccgcgaccggttcggctggatcgaccccgcccccgccctcgtaccggaactgaacgcctgggagaacaccgccctgccgctgatgctgcgcggcaccagccggcgccgggccaaggtggccgccctggagtggctcgaacgcctggacgtcggcgaactggcccgcagacgcccgcaccaactgcgccaggccgaacgccagcgggtctgcatcgcccgcgcgctcgcccccgcgcccaccgtgctcttcgccgacgagccgaccgccccgctgcaccgcgccgaccgcgcccacgtcctgcgcaccctcaccaccgcggcccgctcgcacggcatcaccgtcctgctggccacccacgacgctcagaccgcggcgctcgccgaccgcacggtggccctccaggacgggcggtgcgtgaagaccgtccacctgcccccggcaggtgacgcgacggaaggccgggccgcgtgctcgctctccgtctgatccgccgcgcccaccccgccgtccagctgcgccgcctgacggtcgtcgccgccaccgcgggcaccggcttcctgctgctgtgcagcctggcctacggtctcggacacccggacgaccccggcgccgcgctgctgcggctgtcctggtgcgcggtgccgctggccgccaccgtgtacctcacggtcgtcgtggcccacaccgacccggccacccggccgcgcaccgcgctgtccgcgctcggcctgggacccggccgtctgatggccgtctcggccgccaccaccgccctgtcctgcacggccggttcgctcctcgcgctgctgctcttcctgcacctgcgcggcgacctcaccggcctgccgttcgacggcgccgcctccgggttcctcgcagcgcgcaagcggctgccggtcccgggcgcgctgacgctgctggcgatcgtcccggccctggcctcggcggccgtggcctggtc

SEQ ID NO: 201 - DNA, 12590 bp, Unknown
  Kingdom: Bacteria, Phylum: Actinobacteria, Class: Actinobacteria, Order: Streptomycetales, Family: Streptomycetaceae, Genus: Streptomyces
gatcaggaaagggaccccggccagcggtgtgctgccggggtcgggcgcgtcgtcggccggccaggtctccacgatggcgttgatccgcgggttcaccgcccgcgcggcctcgcgtgcggccgtttccagttcggcgggggtcacttcgcccttggccaccagctccgcgagcccgaccgcgtcgaagctcacgtactcgtcaattctcactgtcactcccaacggagagaatgatacccatgggtacctcacgatacccatcggtatcacatggaacggactggtaccgtagcagtgggtgtggggggcccgcaccggaccggacgtcacggagaagtcatggcatcgaccgccagaaggccgagcagggtggcgaaactgccgccccgcgagcgcatcctcgacgcagcggaggagctcttccagagcgaggggatccggcgggtgagcgtccaggcgatcgccgagcgggccgagaccaccaaaatggcgatctaccggcacttcgagaccaaggacgcgctggtcgcggagtggctgcggatcgtcgccgccgactaccaggcggccttcgaccgggccgaggccgaacaccccggccgccccagggagcagatcctcggtctggcccgcttcatcgccgagggattgccggccatctcgcaccggggctgcccgttcatcaactccctggccgagctgcccgaccgctcccatcccgcacggcagatgatcgagaagcacaaggccgaccagacccgcagactggtcggcatgtgcgccgaggccgggctgcccgaccccgagcaggccgcggccgagatcaccttcgtactcgaaggcgcgcaggtcagcacgcagaacggaagcatcgaccaggcgggggatcggctgatgaggatcgtcgaggggatcctggaccggcaccggtcccccctcgacgcctcccggacgaccaccggctgaccgccccgcacccgcgtccccgccgccgagaaccaggtgcgtcttccccgggcccggaacgcttgtccccgagtagccggattcccgactcccccgctctctcaggaacttggtcaccgttacagccatgccggtgaggatcacactgcgccgggtgcggccctggatggggacttgcaccgactcccccagcgggtcaacgcttaccgcactccgggatcagcagccgcccaacagcgctgaggcgacggtgtcgacatcagctgccgcacctcatctccctctcgacgagggcccggaaggtgcgcgggggccggccggtgaggcgctcgacggtatcggtgatgcggtcctccgccccttcggcgatggcccggtccatgccggccagcatcgcggcgaactccagtgtcacctccgacgagaggcggtcgcgcatctgctcgtaggacagacggcggtggaccacgggccggccggtgacctcggtgatgatcgcggcgatgtcgtcgtagccgagtgcctcgggtccggtgaggaccagatcggtgttgggggcttgttcgtcggtcagagcgcgcacggcgacggccgcgatgtcctcggcgtcgacgaagccgacccggccgctcgcggtggctgtccagatggcgccttcggcgcgaatgctgtgagcgtgcgcgtgcgtgccggtgaaattctgcatgaaccacgagggccgcagtaccgcccactgttcgaagagaccggtcagggcttggtgcaccgttcccaccgccgggccgccctcggggatggccgaggaactcagcagcaccgcgcggtgcacgccgactgcgcgggcctggtggaggaacggcagcatggtcgccgcggggtcggagtcgcccaggggcggtatcaggtagacgcggtcgacgccgtcgagggcggccgcgtgggtggcggagtcgtgccagtcgaaggggaccggctcggcgccggcgacaggggtggcctgacgactggcggctttgacgcggtggcccgcggccgtcaactgtgcggccgtgcggcttccggtggtgccggtggcgccgatgaccaaagtgacgccggcggcggtcatcggtcgctcccggtgaagtcggcgccgggttcctggacggcgagggggttccagtagtcgcggtaggaggtgatgtgcccgtcccggacggtcacgacggcgatgtaggtcatgtcgaacggagcgtcgctctccaccaggcggccgacaccgcgcatctcgaccacgatggtctgtggatcggtggtctggtggatccgcaggtcggggaagtcgtgcaggtcgatgtggtcggggtagtggcgcatgtaggcggcgatggcctccctgccctccagacgccggggccagccgtcgggggcgaaggggaactccatgaggccgtcctcggcccacagggcggcccatgcgggaatgtccttgcggagcagcagtcgcaggctgtggcggtacagatccgccggagagatcggtgcggacatgggtatcctcctgtcacagaatccggaccatgggtccgtttcaacgcgaccgacgatacggaccgccggtccgttttacaaacgaaaggagcggcatgccggaacgccagtcgccccgcaaggacgccatccgcaaccgggaggccgtgctcgcggctgccgacgccctcttcacccgccgcgaaagccccgaggacgtcaccatggccgacgtcgcggcagcggccggcgtcggcaagggcacgctcttccgggccttcggcgatcgcgccgggctgctccgcgcgctgtacgaggaacggctcgaaccgatcaggcaggccgtcgagagcggcccgccacccctggggcccgcgaccccaccgcgggatcgcgtacccgccctgctcgatgccgtcctgtgtttcaaactcgacaaccgccgcctcgcgctggccctggaggaaggcgggagcagcagcccgtaccgcgcggagcactacgagcggtggcacagcctgctccgagccgtactggagcagatccccggcctgaccggcagcgacttcctcgcccacgccctgctcgccgccacacgcgccgacctcgtcgagcacctggccggagaggagcgtgttccgcgagaaaggatgcgggcgcagttggcggacttcaccaccagattcctggtcccgtccactgcaggggtcgacggccgggagagcgcgtctcttcctgagtgaccgccccgcaccgtggcgaacggaaggctcccgggcgggagccgcacgccgaccggaggctccatgtgccctccagcaacacggtgttccagcaggcggtgctggtgccgcgccggttcgccgacggcacgagcctggcccgcctcgccggtgacacggtcgctatccggtgccggggcactccacaagagcccgcttgcccggcaaagcatcgtcatgcaccgcagccgtcaggttgccgagaacacctcagtgcgcgtcgcacggccaggaggcggtcggcgccggctgggtcgccgaggtcgtccgggccgcccgttgctcctcctgggagcggtgagcggtggggcggtagccgctgggcaggtgctcgactgcgccgaggaagtcgcgaaaggcccggccggtgcgggtggtgtcgccggtggcgtcgaggtccatgaggagaccacggatgacagcgagaacgagcgtcgcgagttccggccggccgatgctgcgcaggccgtcctcgagcggtccgagccagtcggtcgtcgcggtgcgccggaagtcgggccacaactgctgctccgcactctcgcgcagccgaccgaacatccgcaggtacggctgcccgtccgggccggtgatggacgtccaggcgcgatacagggtggccgtgtacggctcgtcgggtcgcacccgcaggaggtccccgaaggtgtcgagctgacgttgccgcgcgcgcccgaggacggcccgcagcagggcgtcgcgggtgccgaagtgataaatcagcatccgggccgaggtgccggtggcggtggccagcggctcgagccggtcggggagaccgtgcgcgagggcgtgatcagcgcaggcatcgagcagcctctccttgatatgcggttccggtcgtctgcccatgaccgcactttttcacgtaacagttattacgtctaccgttgagcgaaaggcggtcgaaggcagacgtggaggcagcgatgagggtcgtgttcgtgcatggggcgtgcgtgcgggacgggtcgtggtggtggcaccgcaccgccgagctgctgcaggagcgaggggtgccgagcgtggccccggccctgccgagttgcggcgaggcgggtctgcccggcggcgtcggcggtccggggctgtccgaggatgtcgccgcggtgcggcaggtgctgcgggccggcgacgagccgaccgtcgtggtcgcccacagctacggcggcatcatcaccgcggaagccgccgcgggagtcgggtcggtacgccatctgctgctggtctccagctacctgcccgaggtcgggcagagcctgtcggatttcggggacggcggccctgccccgttcctcgacgtcgaccccgacgccggcaccttcggggttcgccccgagctgcttgtggacacgttcctgcaggactgcgatgtcgaggtccaggcgcaggcggcgggccacctcgcccggcagagcgcacaggtggccgggcagccggtcggggcggccgtatggcagcaggtgccctcgacgtacctcgtctgtgcccaggaccggggcaccccgccggacctgcagcgcgagtacgcccgccgggccggcagcgtcgtcgaactcgacgccggccaccacccgttcctgtcccagcctgccgcggtccgggacctgctgctgagcctgtgagggcagccgggaacagcacacgctccaggcgggtggcgagatcaacaggcaccggcccggcgcgctcgaactcggcgtgggcggcgcacagctgtgccaccgcgggcaggtcggccgcggtggccggacggatcaccccgcccggccgtgcgatctccttcagcacgcgcaggtgagggagccgacaggagcggtcagcgggtccgccgggcgctgcccggtaccggtcgcgctttcgaccgggaaaccctcgcggatccagtactcgataccgccgatcatctccttgacccggtagccgagttgggccagcgcgagcgccgcgcgcgtggcgccgtcgcagcccggcccccagcagtaggtgacgacggggagtgccgggtccagcaggctcgcggcccgggccgggatgtcggccgtgggcaggtgcacggcgcccggcacccgggcctgctgccatccggcttccccgcgcgagtcgaccaggacgaagcccggattgccggaatcgagcgaggcacggacgtcggagacgtccgtctggaagctgagacgagccgtgaagaaggcgacggcttcggcgggagcagcgggcggcacctgcagcgccggactgatagcggtgttgttgttcatgggcgaaaccttacggagtgtaaccatgcaggggaaccgagaatccccggcgaacattggattcccccggggatgccatggtagagatgggccgtgaccgttgattcccttgacgagactgatatgcgcatcctggacgccctgcagcgcgatgggcgggccagctatgcggagttgggccgcgccgtctccatgtcggccagcgccgtcaccgaacgggtgcggcgcctggaggagagcggcgtgatcagccgctacgcagccgtagtggatccggagcgactggggctgggcatccttgcgttcgtccgcctgcgctacccgacgagcaactacaagccgttccacgagttgatcgcgagcacacccgagatcgtggaggcccaccatgtgacaggtgaggactgcttcatgctcaaggtcctggcccgctccatgcgccacctggaatccaccacgggacggatcgccggactcggctccgtcaccaccagcatcgtctactccagcccgctcccgaaccgcgcgatcacctcgccttgagccgggtggccaggtcacggcaacgtgatccggccacccggctcgagaaattcgccgagcttgcccgaacggtcgctgaaggctgagcggtaggggctggtgaagccgcacggtcccccgacctgtcgtcgccgccggcggtcccgcatggaacctggctgcggggggctgcctgccttcccttgcggaccaggctccgggtgtagccggcggcgcgtacgacgaagccgggaaccgcccgtgcgagtcgagcccaggctggactcacccgctctcggcggtccaggtgagtggcaggctgtggacaccgtagatggacatcgcgtcacgcatccggatgtcctgggccgcgccggccaaccgcaggccggggaaccgccggaacagttcggtgcaggcgatccgcatctccaggcgcgccagttgccctccccactgggatttacgacacgttgctcctggtggctggacctcacaggcccgacgagaggtcagcctcgcagacgcgcacccaccctgtccacgatgcggtgtggcgatcgtacgaacaccaactcccgtttcccagggggagttgggcgttgacgtggtgaatacaggtcagccgggtcgggcggtgacgaggtgaagaggggccggccgggccgggcggtgaggtggcgaagagaggccggacgagtcgggcgctgacgaggtgaggagaggccggaggagtcggtcgctggcgaggtgaagagagggcggcggggaccggcccctggccgggcggcgggggcccgccgggagtcggtcgctccttcctcttcccgctctactccgccttcttccccttctcgacagcgccgatcgctttggcccgctcggcccggcgcgcgaagacgccgtccatgatgtcgtgcatctcctggagcactccgcgacgctcgcgcttggtcagccggtcgatgtagagcaggccgttgaggtggtcggtctcgtgcaggaggcagcgcgcgaagtagcccgtgccctcgatgaccacgggcgcaccgtccttgtcctggccgcgcaccaccgccttggccggacggttcaggtcgaagtgggggccgggcacggacaggcagccctcaccggcttcgagcaggcggcgctcctcggggtccgcgccctgctcgaccaccgggttgagaatgtgccccacgtgccggacaccgtcgtcgtcgaagcagtcgtagacgaacaactgcaggtcgacgtcgacctggttggcggcgagtcccgccccctcggccacgtacatggtgacgaacatgtcgtcgatcagctgggacagctccgccgtcccgaactccgcggacgccggcttgcagggtcggtgcaggatgtcctcccccaccaccgtgatccgcaggacctcgccgcgcgacgcctccggagcccgctcggggtagttgccgtccaccggcgcgccctggacgaggacccggtgtcgggtgacgggattcgttgtcatgatcgcgagtaccttccgcagtgtcccgctatcggtgacctggagtgaccgacatcgccaattcagtgacagtaccttactcgccccgaccgatcccgggggccgaggggaaagccccggcccgcacaccgcggggtgcgcagctgagtcggtcaggggtgcgggtgccggtcctcacacctgcttccgcggtctcaatcgtcttcggtgatgaagtcggtcagtgcggcagcgacggcttcgggctgttcatcggggatgaagtgtcctgcctgcggcacgacgatcccggtggcgtggtcggcccacggcctgatggaagccgccatgtcggggatggagccgtggctgctggagatcccgaggaccgggaccgtcaggcgctgtcgttccagcgcttcgtggttcttccgcgccgactcggcggcgtcccggtagtaggccagggatgcgcggagaccgccgccggcggccacggacgcggcgtatcgctcgatttcggcgtcgtcgaaggtgtcggaggagagggtcttgaccttcaggaaccagccgacgtactcccgttcgcggccggcgagcagtgcctcgggcaggtcgggcacgaggtggaaggcgaagtgccaggtcttccacgcctgctcggggtcggtcggaatggcgtcagggagtgtgatgcccgggatgccggcgtcgagcagtgccaggccacgcaactggctctggtacgtcaaggcgagggaaaaggagacccacgcgccgatgtcgtgggcgaccagccagtatgtcgagactccgagcgcctcgaccgcggcatggacgtgcgcagcgaccgtgtgcgtgtcgtagctgatgtccgggcgttcggagtggccctggcccggcaggtcgatcgcgatgacccggaaccggtcggccaggttcggcatcaccttgcgccatgcccaccaggtctgcgggaacccggcgagcaggacgacggcgggaccgtccggcctgccgccctcgaccgcgtgaagccggacgccgcccgcgtcgacccaacggtggctgaaaccggccaggtcgggcagcggcaggtcgtggacggggttgccagagacacggggggcgcttgcggggtcactcatgatgctcctccactggggtgaggtgtgttgacggtctgctgaaggtgtcaggtgtgccagtcgattcggtgcgtcggccgagggcgacgcccacgagcgcggtggtcacgccaggagggccgtcccggtgtcgcggcgcaaaagggccgctcacggaactcgtgcccgggcgcaggacggcagccgtgctgggcacggcggccgacatcgcggccggagcctcggcgtcgccgccgcgggcgtcaacgggttcttctcctcgccggctcctgcgttcaggaatcgccgacgtcgccgtcgcggtgacgagcccggtcgccaccccgctcagcacacgtccgatgacgtaggcgatgaacacgacaacggtggtgagcggtccgaagcggaacggcgccgaccgcgggcacgtggtgcgcgtgccgctgcgctgtgcactctgcggggtgtccgggcatgatcacgccttcaccctaactcatcttgaactgattggttcaagatgggatgatggtctccaccgctccaccgagaaggcacagcaggagggaggtgcggcatggcgggcaagaagcagttcgacatcgacgcagcactcgatgccgcgatgatccagttctggcgggccggctacgcggacacgtcggtggacgacctgtcccgggcgaccgggctcaaccgcagctccatctactcctccctcggcgacaaggacacgctcttcatgcgctgcctggagcgttacaccacgcgttacggagacaagtacgacgccgcgttgtcctgcgccgccgaccggcccctggcagccgcgcgggcgttcttcgacatcaccctggaacgcatcgcggaccccggtctgcccgacggatgcctggtggcccagacggtcatggcgaccccggtgctgagcgcgagcgtcgccgcgcgtgcacgggaggcgatcggcttccagcacacccggctacgcgccgcgctgaaggccggccgactgcccgacgaggcggccgagtccttcgcgacccaccttgcggccgtgaaccagtccctcgccgtcatgagcagagccggaacgagcacggagcagctgcgcgccatcgtcgacgtgaccctcgaagcacttgcgcggactctcggcgcgagcgactgagattcgtccggcaaagcggacttcgccgccggcagcacaccgccggacgcggccgcccctcccccggggcggttcgtccacggcagtcccctcgttctgggcagcccgaccacccacgggcgtccgaacgccggatacacgggactgttctggagggggccgcgagcttggaccggagccgatctgacggccgccacaggcctggaaggcgaggctgtcatgggcgccacggccgtatgggcgccaggccgtatgggcggccatcaccggcgagcacgacgagatcgacggggcgccaccgtcctggcctgtgcagggcgcgttcgtgggctcgtgggccaatcatgtggttcgccgcgaagtggtgcctctggcagacgagtacaccttgtgaggtcgccgggagacggagacggcagaatactctttcggcgtgcggagcctcaccgtcagcgggggtccggaaacaagccgttgagttcggggaaggggatggcgtcggcgagcgctcggtagtcaccggtgtcgtacagctgctgcgcggccaggcgggtggccgcgtaggcggtctgggcgacgcctgatccgaggctgacgcgggcaacgccgaggcggcccaactcggcgacgtccggcgctccggggccggccatgatgttcagcggtacggagatgcccgcagccagttccgcgatggtggcggggtcggtgacggcgggcacgaagatgccgtcggcgcccgcgtccacgtacccacgggcgcgttccaaggtctccttcagccgggtggcggggtcaccgaggccgagcaggtaggtgtcggtgcgggcgttgaggaagaagggcacgcccgaccgctccgccgcacctcgggccgctgccagccgcgccctgagctcggccggagatcgggtgccgtcctctatgttgccgcccacggcgccggcttccagcacccgtgtgacggtctcaccgacaccggccgcgtcctgtgcgtacccgtcctcgatgtccgcggtgactggtacctcgaccgtcgccacgatacgggcgatcagttccaccacttggtcgggggaggaggtctccccgtccggacgaccgagtgaccaggcgatcccggcgcttgtggtggcgatcgcgggggcacctgcggcctcgatgacacgggcactggcgatgtcccaggcgttggcgagcgcgagggggctcgcgccatcgtggagggaacggaagagcagggccttgtccgtctgcgctgtgatcatgcgaccagccaaccaacgatccaggctcctgtccggcaggaatccgacaccattgtgcccacctctgcctgggcaacctgctggcccgcaccgaggtccgcatcatcttcgaggaactcctcccccggccgggtacgaccccgcgggcgaggagtacgtggccggcgacgacccggggtacggcggccggcccgggcgctgctgacgccggccgtcggtccgggcgcgggcctcttcggcccggccgtcgcccgcggcttcaccggccgcctcggccaggggccgcccgttcagtgcgcggagacggtcatctcgaacgagtagcgagaggcccggtagacatgggaaccgtattcgaccggccggccggaaccgtcgtacgcgacgcgggtcatggtcagcaacgtggcgccgcgggcctccccgaggagcctggcctcggcgaccgtggcccgccgggcgccgatggtctgctccgcgctgctcagaccgacgccggactggcgcatcagctggtagaggcccgcctcggccaactcctccagggtcaggtcgatcaggtcttccggcaggaagttgtgcaggagcgcgaccggctggtcgtcggcgaaccgcagacgctccagggccagcacaggcgtccccgcggccagccggagcccggcggcgatctccccctcggcggggacggtttcgacggacagcacctgggtgctcggccggcgcccgtcgcgctccaggtcctcgtggaggctggtgaactcgagctgccgccttatgcggttggtgacgacctgggtgcccactccgcgcttgcgcgccagcagccccttgttgacgaggtgctgcatggcctgacgcatggtcggacgggacaggccgaactgttccgccatggcgatctcgttgttcagccgcgtaccggggggcagttccccggtctcgatgaggtcctgcaactgctgcgcgaactggaagtacagagggaccggactgttccggtcgatggtgatcctgtgtgccagcggctccacgtcaacctcctgcggactgctgcgctgccgagagtcgccagtatgcctcattcgctctaagctccgtacatctttacgtcagtacaaatacctgatccttggcgcttccgggggcaggaaacaggccgtcgccgacggccgtccgggctggacgcacacccagcgggcctgcacgtccgcgccagtcgggtgccggggcgggccctcggtcgctccggcggcccgggcaggggcgagcgtgcaggagcacgactggttcaggggggcggtggcagtcttcggggcgctgctggcgggagcggacacgttcctggccggcatgcggtggagcatgctgctcgcggcggccgggctcgtactgacggcgggcgcgacgctgacgctgcgcgccgccaccagcacgccgagcgcgggcgccagtccgcacgctgctgagg

SEQ ID NO: 202 - DNA, 9626 bp, Unknown
  Kingdom: Bacteria, Phylum: Actinobacteria, Class: Actinobacteria, Order: Streptomycetales, Family: Streptomycetaceae, Genus: Streptomyces
ctgcccctggaggagcagcggcgctacggcgaggccttccgccgcgtgcacgagctacgcgcggccgtccgccggaccgccggcctcgccgccgacaccgcggccaccctgaccaccggtctcaccgccggcgtactccggccaccggatgccccggacagccgttccgcctgaaacaccccacgcgtcccaccgcacacgaccacactggacccccaccgtcccctgcccggacggtgctcttcggaaggaagccgggacctcttgaacagcagtaagcacacggagctggcgaaccacgcctggtccgtcgccgatctcctgcgcggcgactacaagcagtccgactacggcaaggtcatcctgccgttcaccgtgctgcgccgcctggagtgcgtccttgagccgacgcgcgagaaggtcgtcgagaccgtcgccaagttcgcgggccaggagatcgacaccgaccacttcctgcgcaaggcctcggggcactccttctacaacaagagcgacctcacgctgcggaagatcgcggccgacccgcagaacgcggccaagaacctgcagatctacgtcggcgccttctccgacaacgcccgcgaggtcctcgacaagtacgagttcaaccagcaggtcaaaaagctcgacggcgctaacctcctctaccaggtcatcggcaagttcaccgacctcgacctgcaccccgacaacgtgcccaaccacaacatgggctacatcttcgaagagctgatccgccgcttcgccgagcagtccaacgagaccgcgggtgagcacttcaccccgcgcgaggtcatcaagctgatggtcaacctgctggtggcgcccgacgcggacgccctcagcctgcccggtgtcgtccgcacggtcatggacccggcctgcggcacgggcggcatgctcagcgccgccgacgaccgcatcaaggccctcaacccggacgcgacggtcgaggtgtacgggcaggagctcaaccccgagtcctgggcgatctgccgctccgacctcatgatcaagggacagaacccggagaacatccgcttcggcaactccttctccgacgacggccacgcccgccgcagcttcgactacatcctcgccaacccgccgttcggcgtggagtggaagaaggtcaaggaggaggtggagtacgagcacaagtcgctcggcgacgccggccgcttcggcgcgggcctgccccgcatcaacgacggttcgctgctcttcctccagcacatgatctcgaagatgaagccggtggacgtgaacggcgggggcggctcccgcatcgccatcgtcttcaacggctccccgctcttcacgggcgcggccgagtccggcgagtccaacatccgccgctggatcctggagaacgactggctggaggccatcgtcgccctccccgaccagctcttctacaacaccggcatctccacgtacttctggatcctcaccaaccgcaaggacgcggaccacaagggcaaggtcgtcctgctcgacgcgcgcgaccagtggcagaagatgcgcaagtccctcggcgacaagcgcaaggaactgggcgacgggacgaacggccgccccgaccacatcggcgacatcacccggctgtacgcggaggcggtgcaggtcgcgaaggaccccgagcacccgctgcacggcaaggtcaaggtcttcgccaacgaggacttcggctaccagcgcatcaccgtggagcggccgttgaagctccgcttcgaggtgacggaggagaccctggcggcgctggcggaggccaagccggtggcgaagctggagcggagcgaggagttcgtcgcggcggtgcgcacgctgctcggctcgtcctggacgacgaaatccgatgcgttcgtcgcgctcaaggacgccgtggtcgcggctggcctgacgtggccgtcgggagcgccgttcgcgaaggcggtacgggagggggtcggcgtccgtgacccggagggcgaggtccagaaggtcaagggggcggctgagccggacgcggacctgcgggactacgagaacgttccgctgggcgaggacgtcgaggagtacctgaagcgcgaggtgctgccgcacgtcccggacgcgtggatcgaccacacgaagacgaagatcggctatgagatcccgttcacgcggcacttctacgtgtacaagccgccgaggccactggcggagatcgacgcggagttgaagtcgttggaggcggagattcaggcgctgttgggtgaggtgacggcatgacggccacgaacactgcgccatggctcgcgcaatcccgttggccgacagttccggtccgccttgttgctcgtctcggatctggtcacacgcccagccggagtgttcctgaatactgggaaaactgtacggtgccctggatcaccctggccgatgtttggcaactcaggagcgggaacgtcagcattatctccgaaaccaaggaaaagatcagccctcttggccttgcccactcctccgctgttaaacatccggcagggaccgtcatcctttctcgcacggcctcagtcggattttcggcgattatgggaaccgatatggcaacaagccaggatttcgctacctggaattgcggaccacgcttggaaccaaggttcttgctgcacgctctcagaggcatggctccagacttgaagcgcgtcgccacgggctcgacgcataaaaccatctacatgccggatattgagcagctcagggttccgctaccggcactggaggagcagcgccgcatcgccgacttcctcgacgccgagaccgcccgcatcgaccgactcacttccatgcgagaccggcagtcaaaattgttgaacgaccgtcggcggagtcaactcaccgagcttattgaaagcctcacgcaacgattcggctgtattcgcctacgacacgtgttgatgcggattgagcagggctggtctccccaatgtgaggatcgcctcgcggaacacggcgagtggggcgtcgtgaaggctggttgcgtcaactcaggacggttcgatccgatccagcacaaggcacttcctgccaatgtggaaccacgccgagagtatgaactcaaaaaaggcgatttgctcatgtcacgcgcgagtggctccatcgacctcattggtagtgtcggcgtcgtcggagaaattagcgacaacctgctgctctgcgacaaggtatatcggatcagactggaccggacgagggcgcaagctgatttcgtggctcacgtactccgcggtcaccaagctcgggagcacatcaagaacggaatttccggagccgaagggatggcaaacaacctcccgaccagcgttgttaaagacttgctcctgccaaatgtacccgtgagcaaacaggcgtccatctcggactaccttaatctgagcgccgagtcagtctcacgcgcccgagagtcactgcatcgctctattcagaccctcgccgagcgccgccaagccctaatcaccgccgccgtaaccggccagttcgacgtatccaccgccagcgggcgcaacgtaacggacggagtcaccgcgtagccatgagccccatccacacggagttcgccttcggcgatgccatcgtcgctgccatggtcgagcggggctggcgcgaagcccgcccgcaggactaccaggccgacctcggcctggacaccaacgaactcttcaccttcatcggggcgacccagcccgacgagtggaacgagctgctcaccgtctacggcggcgacccgaacgaggcgcagcgcgggttcgccggccgcctcgaccaggccatcgccaccaacgggctcctcgatgtcctccgcaacggcgtcaaggaccggggtgttctgctccgcgtcgcgtacttcaagccgaacctcgtcgcccacgactccgtgctggacggctaccgggccaaccgtctcaccgttgtccgcgaactccgctacgcgaccaaacaggccgactggggcaacgaactcgacctcaccctcttcctcaacgggatccccgtcgccacggccgagctgaaaaacccgctgaccaagcagggggtggagcaggccaaggagcagtaccgcaccgaccgcgaccccaccgagctgatcttcacccgccgggtcgtcgcgaacttcgccgtcgacccggacctggtcttcgtcgccacccagctcaagggcaagaacacccgcttcctgcccttcaacaccggctccaacggtcccggccagccgggcggcgccggcaaccctgcccccaccgcctacggcacgtacgcgacctcgtacctctgggagcaggtctggcagccggacaactggctggacctgttgcagcggttcgtgcacctgcacaagagcaagacgcccggcggcggcacgacgaagacgatgatcttccccaggttccaccagtgggacgtggtcaggaagctcaccgcgcacgccgcgacgcacggcgccggccacgactacctggtcatggcctcggccggctcgggcaagtcgaacaccatcggctggctcgcgcaccgcctcagcgacctgcacacccccaccgactccgcggaactcgacgccgaggccgtggccaagggcctcaagccgggcgtgccggtcttcgacaaggtcatcgtcatcaccgaccgccgcaacctggacgcccagctccgggagacggtcggcagcttcgagcagaccgcgggtctggtcgtgaagatcgacgagaagcacggggcgaagggcgagcagctcgccaaggccctttcccgtgacaccgggaagatcgtcaccgtcacgctgcactccttcccggcgctgctggactacctgcagcgcaaccccaccgagatccagggcagccgcttcgcgatcatcgtggacgaagcgcactcctcgcagtccggcgacgccgccaccgccgtacggtccgccctgcgcgacctcggcctggactccgactcggacgacgccggcgcgaccacggtcaaggccgagtccgccaccctcgacgagcagctcaagaagagggccgagcagcgttcccgcgccgcgaacctctcctacttcgcgttcaccgccacaccgaaggccaagacgctcgaactcttcggcacgctccaggacatcgacggcaaggccgcctaccggcccttccacacgtactccatgcggcaggcgatcgaggagggcttcatcctcgacccgctgcgcaactacgtcacgtacaacacgtactggaagctggtgaaccagaaccccgacgagcgggaggtcgacccgtcgaaggcgaactccctcctcgcccggtacgcgctcacccatgactcgacggtcgcccagcacgcccaggtgatcgtggagcacttcgtggcgcacagccggggccgcctcggcggccgggccaagtccatggtggtgaccgcctcccggcagtccgccgtgcagatggcgcgcgcgatcaagagctacatcaaggaccgggactacgacaccaagtgccccgacctgggcgtcctcgtcgccttctccggctcgctcacgatcgacggcgaggagacgaccgagccgaaggagaacggcgggctgtcggagagcgcgctgccgaaggcgttcgggtacacgcgggccgacgacaaggccgcccgagccggcggtgcgggacagcgcgagtaccggatcctggtcgtggcggagaagtaccagaccggcttcgaccagccgctgctgacgacgatgtacgtcaacaagccgctgaccggcatctccgccgtccagaccctgtcccggctgaaccggaccgccgagcgcaagacccaggcggacctggcggtcctggacttcgtcaacgacgcgaacgacatacaggacgccttccgcccgtacttcgaggaggcgaacaccctcccctccgaccccaacctgctctacaccgcgcagagccgggtcatgcaggcggggatcctgtccgggcaggagatggacgagttcgccgccgcgtacttcgccgccaaggagaaggcggcaggttcgcagtccaagtgggagaagctgcacgccgagctgtaccggctgctttcccccgccgtcgcccgcttcacgcccctgctggagagcgaggacgaggacgaccaggagacggcggagggcttccgcgccgacctcaacgactacgtcaggaagtacggcttcctcgcacagatcgtcccctaccgggacgccgagctggaacggctgcacctgtacggccgctacctcctcaaccggctgccgcgccgcgcggacggcggcgtggacataggcgagatcgacctcagccacatgcgggtggaaaagaccggcgagtacgacgtctccctcaccgccgaggggccgacgacgatgaagggcttcggcgacggctccggcggcgccaaggaagcggagaagtcgctgctctcgcagctgatcgacaagttcaacgaacgcttcggcaccgagttcaccgagcaggacgtcatccgcccgttcgaggaggccaaggccgacccgaaggtacgggcggcggccgtcgtcaacgacgaggacaacttcggtctcgtcttcgacaacgtcttcgcggacaagatggccgaccacatcgacaccatcgcgggcatgggccgccagtacttcggccccgacaagggcttcaagtccagcctggaccgcagcgcccgcaaggccgcctggcggatgatccgccgcgaagagggcctggacgacgacgtctgatccgtgcgccccggccgaacacgccgaccggggcgcctttcggcctcgattcgcctacggcccggcggccggtaggtacccgaggttcatgccgtttttgtagacgtcagccacaggctgttgttggaaaacaaggggagacaatgagtggcgaccgcaaggcaagcgttccggtgtggacgctggcaaccagtgacgtcagggtgccagggttgaccgcgggtgagtcgatgacggctgagcgcctggctgaactgcgcggagtgctggccgtcctggccgacgagccgatcgtcacacttgaggtgcatccgctgcctgacaagatcgaccgcggccgtggcatcccgctcgacgccgcgagtcccttggcgcagcacctgtcgcagttcatcacgcagtcgacgcgaggttccctcacggcggccagggcgacggcttccggcgagaacctgtatcgcatggtggtcccatcgaaggtcgccgaccagttcgggaaggggctggtccgctcgatggcggccaagagcgtgcccggtggcatccgcggtccgatcgtggacacaacaggcaagatcgccgcaggtgcgaccttcgtgcccgtcggaggggcggcagcggccggcaccgtcggcggggccggtgcgacggccggcgtcgtggccgccggtggcacggtgctcaccgtggccgctccgctcgtgctcatggccgtggcggtgggagtgagcgcgcacgccgaccacaagcgccagcaggccatcgagcacatcacggaactgctggagcaacttcagcaggacaaactcgacgacgagcacagcgccctcaacggctgccgtgccgccatcgacagggccacggccatcctgctcgaccagggcaagctcggtgtctcgctgggcctcgactcggcggtaaacaccatcgacacggcgctgagcaaagccaacctccgcctggcccggtggcagagtgcgctcgacagactgcccgacggcaaggccgtcgaactcggcacgctgaccaagtcgttccccggcgtcgacgaccacggaggcatgttccgcacccacctggaactcgcttccctggccatcgcgctgatgcggcgggtcgtcgtcctccaggccgtagagcacgcccagagcgaacccggcaatccgttcgagaacttcacgcgcgcactcaagcgcgatcagcagcgcctcgacgaactggagtcgggcatcacgggtgtcctggtacgcctgtcggcactcgaactggcacgcccgggaggattgcgacccgtcttcacgcccggtgaagtcgatcgcctcatgagcgcggcacaccggatccaccggctgggcgacggtgtcattggcaacggccgtacgacggacgtggcgatcgagatggcccgcgagaaggacggctcggtggtcgtgttccccgcggtgcccgcgtaggcgcaggcgcgctcgcaccgcgggtggcggtgcccccggtcggcttgctgttgatctacgtctgagcggccgtctccggcgcccggatcacggtgctggaacagctcagcatccgccgcaccacatcgatgccgacggcaccggcttcgcgccgcggctggcgatcgcgggagcgttccgccgtctcagctgaccgtgcacgaggtgggggcccagccgcctgtgcgactggacccccacgggttacgaaggtacggctcagatggtctggtcggcggccagccggacgagccccgtcgcaccgcgaccgctggacggcggatccgcacagcggccacacttgatctctgaccatcactgttcttcacgcacaccgggggcaaggtgccgcaggaggcgatctccgaccgttacgaactcctggaggagctcagccacggcggcatgggtgacgtgtggcgcggctacgacgccgtgctcgaccggcccgtcgccgtgaagctcatccggcaggcgtcggtcacctccccgcagctggccgaggagttcgccaagcgcttccgccgcgaggcccgcatcaccgcgcgcatccagcaccccggcgtgccgcaggtgtacgacgcggtgctcgacgcgtcgtacgagcggctgttcctcgtgatggagctcgtcgacggcataccgctgaccgcctacctcgaccccacccagccgctgccggtcagctgggcggccgccgtcgccgcccaggtcgcgaccgtgctgtcgtatgcgcacgatgtgcccgtgatccaccgggacctcaagccgggcaacatcctcgtcgcgcgcgacggcaccgtgaaggttctcgacttcggcatcgcggcgatgctgcgcaccgacgtcaccaagctgaccgccaccggcagccccatcggcacccaccagtacatgtcgcccgagcaggtccgcggcggacgtatcaccccgcagaccgacctgtacgcgctgggctgtgtgctgcacgaactcctcagcggacgcttcgcgttcgaggcggagagcgagtacctgctgatgtaccagcacgtcaacgccgcccccaccccgctgcggcggctgcgccccgacgtccccgaggagctggaggagctggtcctgcacctgctgcgcaaggcgcccgaggcacggcccgccgacacgcaggaggtgtacgcgcggctgctgccgttcctcccgccgccaggcggggaacccggcactgccgacgtcgggccggccggcgcccccgacccgacgggtgtgttccgccggcctttcgcgccccgcgcccgcgcgcaggcccccgcacccggtgctccggcaccgacagccgtcctcccacaggtccagccggtgcccgtccccgcccgccc

SEQ ID NO: 203 - DNA, 3355 bp, Unknown
  Kingdom: Bacteria, Phylum: Actinobacteria, Class: Actinobacteria, Order: Streptomycetales, Family: Streptomycetaceae, Genus: Streptomyces
gtccgcggcgccttccgtggccgttccgctggaatgcgccccttgagtgcccccgcctcacacccgccgatgggcatatgccaggggcacttcggcacccggtacggccgggccgacctgcgcggacggcccggccggcgccggacggacgccggccaccgcaccgcctgctcaaggttgccttgaggctcccctgagcgccccatcgagcgatccgcgagcggacgcctcgtcaggagcagcgcctcagggacacgtgcgtcaaggacacgtgtctcagaggaacttggccttccccgggccctcctccacgaagctgcgcatcccgcgctcgcggtcctccgtggcgaacagccccgcgaaccaggtgcgctcgacggcgagcccggtgtcgatgtcggtctccagaccggtgtcgatcgcctccttggcggcgcgcagcgcggtcgccggcccctgggcgagccgtgccgcccacgcgtgcgcggcctcgtagacctcggcggccggtacgacccggtccaccaggccgagtgcgagcgcctcgtccgccttgacctggcggccggtgaagatgaggtccttggccttggaggggccgatcagccgggacagccgctgggtgccgcccgcgcccgggatgaggccgagcaggatctccggctggcccagcttggcgttgtccccggcgatccggtagtccgcgcagagcgccagctcgcagccgccgcccagcgcgtagccggtgaccgcggcgaccaccggcttggggatgcgggccacggcggtgaaggagtcctgcagcgcgcgggcccgcagcaccatcgccgcgtggtccatcacctgcatctccttgatgtccgcgccggccgcgaacaccttctcgccgccgtagatcaccacggcgcgcacgtcggcgcggcgcgtggcctcctcggcgagttccttgagccggtcctgcgtggcgacgtcgagcgcgttcatgggcgggcggtccaggcgcagcgtgccgacgcccccggcgacttccagagttacggtcatgccccgcaggttagcggccgttcacgtgcggggcagcaccggtgcgggcgcggggcaagggcgcggggtgcccgtccctacgccgtccactcgctccacgacatgttccagccgttgaggccgttgtccggagagaccgtcttgtcgggggagtgcttcacgatcacgacgtcgccgatgagcgagctgtcgtagaaccacttggcgggcgtggcgccctgcgcgccccgcgcgtcctgcatgccgacacagccgtggctggtgccggagttgccgaagggcgggttgcccgggttgtaccagtagttgccgtggatgaaggtgccggaggtcgtcaggcgcatcgcgtgcggcacgtccgggatgtcgtactcgccgcccaggccgaccgtctggctgttcatgcgcgtctgcgtgaacttctccgagatcaccatctgcccgttgtacgtggtgtgctcggggctgcccgtggagaccgggatcgtcttgacggtctgtccgtcgcggacgaccgtcatggtctgcgtgttgacgtcgaccgtggagacctgcgagcggccgaccgtgaaggtcacggacttcttctgcacgccgtagacgccgttcgcgccctgcacgccgtccaggtcgatgttcatcgtgaccttggagccggccttccagtactcctggggccggaagtcgaggcgctgggcgccgaaccagtgaccgaccacctgctggccactgctggaggccaccgtgatgtgcgactgcacggccttcttgtcggtgatcaccttgtcgaagttgaacgacaccggcatgccgacgcccaccgtcgtgccgccgtccggcgtgtacgtgccgatgaagctgttcttcgtggtgacggtcgtgaagatggagttggcggcggcgacgcggccatcggcgtccttggccgtcgccgacagctggtacttcgtgccgcggtccaactgctccttcggcttccaggtggcgccgtcggcggagatggatccaggtacgtccttgcccgaacccgcgacggtcatcttcacctgggtcagctttccgtcgctgaccttcacgccggtcgcgttgatcgacgctccggtcgacccgtccttggccgagatgtcgatcttggccgtggaggtcttgacggtgtccttgccgccgcccttgccgtcgtcgttggccttggcgtcgccaccgcatccggtgagggtgagggtgccgaccatcagggcggcacaggcccccagtatgcgccgcgctgctatgtccggcgttgtcacgggctgctccaggtcgtgagaagtgagtggttggctgcagtgcgtggatagagaggcggccgaccccgcgcaaggttcccgccgttcggccggaagaccttcacgtgacagaaccgcgacaatcgacgcccccacgagacctgccggcgaccgacggcccgcccggcagggccagttgccccgaatcgcccgcactgtcccccctctgccaccgggcccgcttcatcgcgcccggttcactgcctcccgtacaactcccggtagcccggccatgttccgcccggcccgtccaccgactccgcggccagcaccgcacgtacgatcgcgcgggtcacgacgtccgcgccggcggcgagcacgtcgttcagcgcgaggggccctgcggaaccgggcgagccggacgaagcgggtccggatgacccgggcccaggcgaaacgggtccgggcgagccgagcccaggcgagccggattcgcgcgggcccgttccgggggtgagcgggcgcgctccggtggccagcgcgaacaccgtgtccccgtcgttgagcagatgcaccggccgcacggcgcgtgcgatgccgtcgtgcgcggtgccggcgagtttctgcgcctgggccttggtcaggtcggcgtcggtggcgaccaccgcgagcgtcgtgttcagcgggggcggcgcgttgcgcgcggcggcctcggcgagccgccggagtgctgcctcgtgcacccgcgggtcgggatactcgacccgcccctggaacaactcgccgtacagggcaccggtttgcgggtccacggccgatccggccgcgttggccacgacgagcgccgccaccgtgacacccgaggcgagcacggtgctcgcactgccgaccccgcccttgaccggccccacggccgctcccgtccccgcgccgacgcagccctgggccacaggggcgcccggcgcgctcgcggcggcggcctcgaccgcgtcgcgcccggtggccgcgtccggcctggcccggaagtcgccgcccctgcccaggtc

SEQ ID NO: 204 - DNA, 1457 bp, Unknown
  Kingdom: Bacteria, Phylum: Actinobacteria, Class: Actinobacteria, Order: Streptomycetales, Family: Streptomycetaceae, Genus: Streptomyces
ctcaccggcggccttgttggtgaacgtcaggccgaggacctgttcgggggcgacctggccggtgcccaccagccacaccacgcgggccgccatcacggtcgtcttccccgacccggctccggccacgatcacctgcggggcgggcggcgcggtgatgcaggccgtctgctccggggtgaacgggatcccgaggagctccttgagctgctcgggatcggtgatacgggcgggcacgtccaaaaggctagcggcgggcactgacaaccggtgcccgggtgacctcccgggaccgcacaagcgcaggtcagaccggttggtgccgtacgtcacgcgggtcactcgacgacctggcgtccttccggccgggcactgcaggaggcgcggaacgagcagtgcgtgcagtgctgccctgccgtcggcgtgaaccgctcgtcgaggacctttccggcggcggtggccagcagctcaccgacccactccccctccagcggctcctgggcctgcaccttgggcagggtctccccgccgtcccgcctggccgcgccctggcgcagctggaccagttcggcgccgcccggctcggggcgggtgccgtcgaaggcgtcgtcgacggcaccctcgcggacggcgagctggtagacggcgagctgggggtggcgggccacctcggcacccgtgggcgcctgtttgccggtcttgaagtcgacgacgtaggcgcggccctcgccgtcggcctccacgcggtccatggagccgcggatgcgcacctggtgaccgcccgcgttcaacgtcacgtcgaagccgtgctcgctggccaccggcgtccggccggcgcggtccaggacgtgccacttcaggaagcgttcgagcgccacgcgcgcgtgctcctgctcctgccgcgacttccacggcgcgtcgaaggccagggcgctccagacggtctccaggcgctccatgaggacggcgaggtcggcgggggtccggccggaggcgacctcgtcggccaggacgtgcaccacgttgccgaagccctgggcggcgctcgcgggcgcgtcggccttcacctctcggcccaggaaccactggagggcgcaggtgttggcgagctggtcgagggcgctgccggagagcacgacgggctggtcgcggtcgcgcagcggcaccttgctctcggtcggctcggccatgccccaccagcggtaggggtgcgcggcggggaccagtgggcggccctcctcgtcggcgagggcggcgagcttggccaggcggcgcgcggcggcctccctgagggcgtcggacacgcgcgggtcgacggtcgtggcccgcagttcggcgaccagggccgccacggacagcgggcggcgggggcggccggtgacgtccttgggttcgacgccgagttcggtcaggaagcgggagggctggtcgccgtcgtccgcgggcgccttcaccgcggt

SEQ ID NO: 205 - DNA, 8818 bp, Unknown
  Kingdom: Bacteria, Phylum: Actinobacteria, Class: Actinobacteria, Order: Streptomycetales, Family: Streptomycetaceae, Genus: Streptomyces
ccggggcccggccccggctccgtcactgggccgcggtgaaagcctcgtagaccttcttcgggatacggccgcgcgccggcacgtccatcttgttggcctgggcccaggcgcggacggccgccgggtcgggggcgacctccgtctgccggtaggccttgcccgacctggaccgcttgcggcccgcctcgacgtagggcgcgagcgccttacgcagtttcttggcattggtttggttcaggtcgatctcgtagaacctgccgtcgagtccgaaggcgatcgtctccgccgcttccgagccgtcgatgtcgtcaaagagagtgaccacgacacgctgcgccacgaatatcggtcccttcgtgcggcacctctgcgcccatgcactccgccatgacgtgcggagatgttcggaggtgccggctgtccgccggttatcgggaaaagtatcggctgttgccaattcatttgtacagtgccgggcattgcgaagtgaagtcccgactaaatctgtctgcgtgtcccgggcaggcacccctgcaataccggatgcgagacggaacgccgaactttcccagaacttttcacgaagccccccgaacgaggcccgatcgtgacgggcgtcacgtagtttcctaccagtctactcgcgtagaaattttgtacgggtagtctgaaggaacctgctcagcaccacacaccgggagtgccagtggcacgcgtcgtagtcgacgtcatgctcaagccggagatcctcgacccccagggccaggcggtgcagcgcgcactgccgcggctgggtttcgaaggcatctccgacgttcgtcagggaaagcgattcgaactggaagtggacggcccggtcgacgaggccgcgctcgcccgcattcacgatcttgccgaatccttcctcgccaacaccgtgatcgaggacttcaccgtcaaggtcgagtccggcgacgtggtcacggaggccgcgaagtgaccgctcgtatcggcgtcgtcactttcccgggcagcctcgacgaccgggacacccagcgcgcgatccgcctcgcgggcgccgaaccggtcgccctgtggcacaaggacaaagacctcaagcaggtcgacgcggtcgtcctgcccggcggtttctcctacggcgactatctgcgggccggcgccatctcccgcttctcgccggtgatggacagcgtcatcgagcaggcgaaggccggcctgccggtgctgggcatctgcaacggcttccagatcctcacggaggcccacctcctgccgggcggcatgctgggcaacgaccacctccacttcatctgccgcgaccagaagctgcgggtggagaacgcggagaccgcctggaccagcgactacagcgagggccaggagatcttcatccccctgaagaacatggacggccggtacgtcgccgaccggtacacgctcgacaagctggaggccgaggggcgggtcgccttccgctacctcgacgtcaaccccaacggctcgctcaacgacatcgcgggcatcaccaacgaggccggcaacgtcgtaggcctcatgccgcaccccgagcacgccaccgagccgctgatcggcaccggccgcaccgacggcctcccgttcttcacctcgatcctcaagaagctggtcaccgcatgagccggacgcctctggacacggtcgagcacgcggccgcgacccccgacgtcgagctgccctgggccgaactcggcctgaagaaggacgaatacgagcgggtggtggagatcctcggccgccgcccgaccggcgccgaactcgccatgtactcggtcatgtggtccgagcactgctcgtacaagtcctccaaggtccacctccgccagttcggcgagaaggcccccgagaacgacgcgatgctcgtcggcatcggtgagaacgccggtgtcgtcgacgtcggccacggctacgccgtcaccttcaaggtggagtcgcacaaccacccctcctacgtcgagccctaccagggcgcggccacgggcgtgggcggcatcgtgcgcgacatcatcgcgatgggcgcgcgcccggtcgccgtcgtcgacccgctgcgcttcggcgcggccgaccacccggacaccaagcgggtgctgccgggcgtcgtcgcgggcatcggcggctacggcaactgcctgggcctgcccaacatcggcggcgaggtcgtcttcgacgcctgctaccagggcaacccgctggtcaacgcgggtgccatcggcgtcatgaagcacgaggacatccacctcgccaaggcgtccggcgcgggcaacaaggtcatcctgtacggggcccgtaccggtggcgacggcatcggcggcgcgtcgatcctcgcctccgagaccttcgacgatgcgaagccctccaagcgcccggccgtccaggtcggcgaccccttccaggagaagctcctcatcgagtgcaccctggaggcgttcgccgagaagctggtcgtcggcatccaggacctgggtgcggcagggctgtcctgcgccacctccgagctggcctccaacggctccggcggcatgcgcgtcaccctggacgacgtcccgctgcgcgactccacgctctcgcccgaggagatcctcatgagcgagtcgcaggagcgcatgtgcgcggtcgtcgagccggagaaggtcgaccggttcctggagatctgcgcgaagtgggacgtcatcgccaccgtcatcggtgaggtgaccgacggcgaccgcctggagatctactggcacggcggcaagatcgtcgacgtcgatccgcgcacggtcgcgcacgagggcccggtctacgagcgcccgtacgcccgtccgtcctggcaggacgccctccaggccgacgacgcgaacaagctgccccggccgcagtcggccgaggagctgaaggcgcaggtcctgcagctggtcgcctccccgaaccaggcgtccaagaagtggatcacccagcagtacgaccacttcgtgcagggcaacaccgtgctggcgatgccggaggactccggcatgatccgcatcgacgaggagagcggcctcggcgtcgccctcgccacggacggcaacggccgctacgccaagctcgacccgtatgccggcgcgcagctcgcgctggcggaggcgtaccgcaacgtcgccaccacgggtgcgaagccgctggccgtctccgactgcctgaacttcggctcgcccgaggacccggcggtgatgtggcagttcgcggaggccgtgcgcggccttgcggacggctgtcagcagctcggcacgccggtgaccggcggcaacgtctcgctctacaaccagacgggcgaggccgccatccacccgaccccggtcgtcgcggtcctcggcgtcatcgacgacgtggcccgccgcacgccggtcgccttccaggaggagggccagctgctctacctcctcggcgacacgcgtgaggagttcggaggttcggcctggtcgcaggtggtccacgaccacctcggcggcctgcctcccaaggtcgacctggagcgggagcggctgctggccgagatcctgatctccgcctcccgcgacggcatgatcgactcggcgcacgacctgtccgacggcggcctgatccaggcggtcgtggagtccgcgctgctgggcggcaagggcgcgcggctggtcgtcccggacggcctggacgcgttcaccttcctgctgtcggagtcggccggccgcgcgatcgtcgccgtgccgcgctccgaggaggtccgcttcaacgacatgtgcggcgcgcggggtttgcccgccatccgcatcggtgtcgtcgacggtgacgcggtggacgtccagggcgagttcgccctgaccctcgccgagctgcgtgaggcccacgagaacacgatcccggcgctgctggcgtagccacggaccggacgaggggcccggccgtctcccagggagacagccgggcccctcgcacgcgccgggccctcgcacgcgccggggcacacctgggcggcggagccgccccctcaagccgggacagccccggtcctcagaaagggacggttcccctggccgacgccgccggcgggggctgcgccggcttgggcaggcgcagcggcagacgagcgggccacctcgctcggccgggcaggacggccggatcgccaccaggcccgcgcaccgcgtgcaggcaggcgacggccggcatggcggaggccggggcctcacgccgccctgcgggccccgcgacctggtggcccggctggccggagaccgccgccgacaccccgagtgggtccggcgcccttcgagccggtcgaaaacggcctgagcggtcacgccgtgaaggcataggctcatcgccatgcccccggccaggagacgacccaggacctacgacccggcgcggacccgtacggcggtcctcgcccagctcggccacgtacgggatgccgtgcgcaccctgacgcccgggcagctcgcgctgcccacgaggctgggcgactggaccgtacgggagttggtcgcgcacatcgggatggccgtcacggccgtcggccgctccctcgacctgcccgaacccgcacggcaggacgccgtgctgctcgactggccgttcgcgacctcggccagcgccgcggccatcgacgcgttcacccggcgggtcgccgaggagaccccggacctcgacgcctacctcggggacatcgggcgggccctggaccggcagctcgacgaacaccccggcacgcggctcctcgccaccaacgcgggcgccctgccgctcgccgactacctcgtcacccgcaccgtcgaactcgtcgtccacaccgacgacctgaacgcggccgtgccgggcctggagatcccctgcgaccggcaggcgctcgccgccgccacccgtctgctcgccgacgcgctcgcgacgaaggcgcccggcggttcgaccgaggtgcgggtgccgccgtacgccgtcgtgcagtgcgtcgagggcccccgccacacccgcggcaccccgcccaacgtcgtggagaccgacccgctgacctggatccggctggccaccggacgcacctcgtggcacgacgcgctggagaacgccaggctcagcgccggcggcgaacgagccgacctgagcgcgctgctgcccctgatgtcctgaccccggcccgactcgggcccgacccgggccgggcccacccgggggcatgcccgtggccgccgtaccgctccgggcccgcgtcgccgtgtgcgacaactcactcgtccctgccccgggagcggccaccggcgcgggcgcgcgggtggacgtatcggccaccggcccgtgcgacgaccctctgacctgcagatatgcaggacgtccgggaaggggtgcggacgagtgtccggagggtgccgggtttttttgacattccccaattcggaccagtggtcgacctcgcctacactcggtggcgtgccacgtggtgacggtcgactcaatcacgatctgctccccggcgagaaaggcccccaggacgcgtgcggcgtcttcggtgtctgggctccgggcgaagaggtcgcaaagctcacgtacttcgggctctacgccctccagcatcggggccaggaatccgcgggtatcgcggtcagcaacggctcccagatcctcgtcttcaaggacatgggcctcgtctcccaggtcttcgacgaaacctcgctcggttcgctccagggtcacatcgcggtcggacacgcccgctactcgaccaccggcgcctccgtgtgggagaacgcccagccgacgttccgtgccaccgcgcacggctcgatcgcgctcggccacaacggcaacctggtcaacacggcgcagctcgccgagatggtcgccgaactgcccaaggacaccaacggccgctcgacccgtgtcgcggccaccaacgacaccgacctgctgacggccctgctggccgcccaggtcgacgccgacggcaagccgctgaccatcgaggaggcggcccacgccgtcctcccgcaggtcaagggcgccttcagcctcgtcttcatggacgagcacacgctgtacgccgcccgcgatccgcagggcatccgtccgctggtcctcggccggctggagcgcggctgggtggtcgcctccgagtccgccgcgctcgacatctgcggcgccagcttcgtgcgcgagatcgagccgggcgagttcgtcgccatcgacgagaacggcctgcgcacttcgcgattcgcagaggcgaagcccaagggctgtgtcttcgagtacgtctacctggcccgccccgacaccgacatcgccgggcgcaacgtctacctctcccgcgtggagatgggccgcaagctggcgaaggaggccccggtcgaggccgacctcgtcatagcgaccccggagtccggcacccccgccgccatcgggtacgcggaggcctccggcatcccgttcggcagcggtctggtcaagaacgcgtacgtcggacgtacgttcatccagccctcgcagaccatccgccagctcgggatccggctgaagctgaacccgctgaaggaagtcatcaagggcaagcgcctggtcgtcgtcgacgactcgatcgtgcgcggcaacacccagcgcgccctggtgcgcatgctccgcgaggcaggcgccgcggaggtccacatccggatctcctcgccgcccgtgaagtggccgtgcttcttcggcatcgacttcgccacccgcgccgagctgatcgccaacggtatgagcatcgacgagatcggcacctcgctgggcgccgactcgctggcgtacatctccatcgacggcatgatcgaggcgaccaccatcgccaagccgaacctgtgccgcgcctgcttcgacggcgagtacccgatggaactcccggacccggagctgctcggcaagcagctgctggagaccgagctggccgcagggcccgccgccacggccgcggccgacgccatccgtcgcccgtaggcagcccgtcacccccgcagtacgacacgaaagttctcatcgtcatgtctgagacaaccggtgccagctacgcagcggcgggcgtcgacatcgaagcgggcgaccgcgccgtcgagctgatgaaggagtgggtgaagaagacgcagcgccccgaggtcctcggcggcctcggcggcttcgccggcctcttcgacgcctccgccctcaagcgctacgagcgccccctgctcgcctccgccaccgacggcgtcggcaccaaggtcgacctcgcccgccggctgggcgtgtacgacaccatcggccacgacctggtcgccatggtcatggacgacatcgtggtgtgcggtgccgaaccgctgttcatgaccgactacatctgcgtcggcaaggtgcaccccgagcgggtcgccgccatcgtgaagggcatcgcggagggctgcgtcctggccggctgcgccctggtcggcggcgagaccgccgagcaccccggcctgctcggcgaggacgacttcgacgtcgccggcgccggtacgggcgtggtggaggccgaccggctgctcggcccggaccgcatccgcgagggcgacgcggtgatcgccatggcgtcctccggacttcactccaacgggtactcgctggtgcggcacgtgctgctggaccgggcgggcctgtccctggacgcgcacatcgaggacttcggccgcaccctcggtgaggagctgctggagccgaccaagatctactcgctggactgcctggcgctgacccgcaccaccgaggtccacgccttcagccacgtcaccggaggcggactcgccgccaacctggcccgcgtgatcccggacggtctgcacgccgtggtcgaccgcgccacctggacgccggccccggtcttcgacctggtcggccggacgggtgacgtggagcgactggagctggagaagaccctcaacatgggcgtcggcatgatcgcgatcgtgccgcaggagtcggccgacgcggccctgaccaccctcgccgaccgcggggtcgacgcctgggtcgccggtgagatcaccgcccggggcgagcacaccacgggagcggccctggtgggcgaccacgcgtgagcggcgggtgaggacagcacgaaacccggtccggcgctgaaagcaccggaccgggtgaagtggaggaacctgccacacgcgggggacggaagaaccgacctcgggtgtcaggcgccgcgacggtgttgcgaggagtcgtcctgctcgtcctcgtcgtcgtcctcatagaggtcggcgtaccgtgcgtacaggtcgtcgtcttgctcatcgtcctcgaaatggtcgccgttagtcggcggcgacggattcgacgtcgatgcgcccagctcctcggccaggcgtgagaggtcagtcccaccgctgttgtacttcagctggcgggcgaccttcgtctgcttggccttggcccggccgcgccccatggctcgaccccctcaacgacggggctcaacggccccagagtctgacacgcgttcatgatccggcacgggctctccgcagagagaccggtccgtagggcttccacggtacctgagcccgcggccatacggtacgtcgcccgcaggacgcgcgtgtgcgcaggaccttcgaggcgccccgtcctcgctggtcagtggcgattttaaccacttatcggcgggcgacccgccggtggaagtgagagttctctccaactgcccaccggcaggtaccggtcaaacttcagccgcggggcgcgccggcccccgcgcgtacgcggctcaccgcgcgtgtcccgcgcgtgtcaccgggtgtgcgcggcgcgc

SEQ ID NO: 206 - DNA, 11972 bp, Unknown
  Kingdom: Bacteria, Phylum: Actinobacteria, Class: Actinobacteria, Order: Streptomycetales, Family: Streptomycetaceae, Genus: Streptomyces
cgcttacgggacgtcgtttactgtggcgctgtcgagcccgaggctccccagcccagctcagcgaaaggcggcagatacgcacttttcgcgcgtatccgccgccctcccagtactgaacgctcacgggcgacacgcactcgtatcagctcgtatcgcccaggtcatgatcgactccggccggctacggactcagtccgccagactgttcctgtagcgcgaccacagcctctcgatccagacattggaacctgtcggcggttcggaggtcaccgggggcgtgggggccgactccaccaggtgcagcagcgtccaggccagaccccagcagttgtcccctccgaaagcgccgagcaacaggcgggcctcttcgtcagtgacaggcttctcaatggcgtgcagtgcccgctccatctcgtcgaaggcctcgtcgtcctcctcggagttgttcccctcggagggaagtggccccagtcgaacgaacccccgaacctcgtccctgaccacagctgcccctacttcagaaggtgcggatagttggcgcggtaacagctcactagggcgcggaactcgtcatccattctttcaatgcccggttgtagtgcatcgcgtcacttccagcgctgattcgaatctggaaaaggtcttccttggaaatcggatggcccatcgaagcgagttggttggccacggccgcctggccgcccgcctcgaaagagaaccaactagtagccccttccggcgcgggccgccgctgctcatcgaactccagcgctaccgcgtacgccgatccgatcacttgggccagcgggcggctcgcgtcggtgtccatgtcgatcagccctcgaacagcgtcgagcgcagccgtcaccgctcgcgcccaggggcggccgcaatgttcggcggcggcacgaagttggtccactttcggtcgcgccgctcgccgaatatccgattcatcgccgaggcccccgaattcccgccacaaggattccaccacctggaccgccggataggaagcctcagcatcccccaccgactcggcgaacagcgacacgatcgtgtccacacggccggcggcaacagtcgccagcagccgcctacggtgggcgaatacctcgccggaatcttcgggcaccacggttccccttatttccagacagccagagtcttggtcaggatcttaccaccggtccgttcgatcaacggcgcgcagaactcctcacagaaatggttactcgcgatcagcatctttggttcgacaccaagatttatcgcctcggtgagcagctttccttcggcatgattccgtcccaggaggtacggctcgtttattttcgcggcaccggccttgctcggcagtttgggatagatacggagtgcctcgtcggcagcatccgccaaaccgatctgcgcctcggagatgtccgcctgggcgccgaccgcgaacaggtcgaggccgccaccggatacggggacatggagcccaccgacggtcttcctgaacgcccccgctcccatgcgcttggtcatggcgtcgacgcgagcctggagagccacggggtcagccgtggccgaaccaccgcagttgtgcaccagcagcggagtttcgcccgcctgcacgtagtacgtgtgcaggctgccgacggtgaggtcgtacgtcgtggtgttcgcgtggtacaggcggacaccggtgacctcggtcgtaccggtcggcgtctggaggacgtcgccgatcttcaggtccttggcctcgacgaaggccgactgcgtcttgtcgtagaaggggtggtggaaggtcgtcgtcaggtgggcgtcgtgcgcgtcggccttcgtggcctgcgccgacgacaccgtggcgaccgccgccaccggcttctgcgcgtcaccgtggccgtggccggccgacagggcgcccagcaccgccgccgaggccgccaggccgaaggccgccttgcgggccgccttcctggccacggacctggccacggacttcgcgccggccttcaccgacttcttgcccacgttcttgaccgtcagacccacgaagtcgtggtccgtacgggtcacgatcacgtcggtgaccttgtgcgcctgggtgccggagacgcccgggaccgagttggcaacggtgtcgccgaccttgatctggtcgatggccttggtcgtgccgtcggccatcaggacccgggtggaaccggtgaagctgtgcgggccgccgatccggcagctcgcaccgtcgtcctcggagtgcgactggctccgtgagcccgccccctccgactccgcccgtgaggcagccgcctccgtggcgtccttcgccccggcttcctcgacgtcggtcgccgccttgccgaacaggccgccgacgaccttcatcgccttcggcgcgaccttggaaaggatcttgccgcccaggctgcccagggcgccgcccacggcacccgcgaccgcgccctcgaccgccgagcccgcgaacgctcccgcggagcagtcgcctccgccgttctcggcgcacttgaagccctgctccaccagggagcccgcggcgcccgcggccgccgcgcagccgatggagccgacgccggccgtgaccgcctcgcagcccgcgaagaccgcggtggagaccacgaaggaggtgatcgcggcggcgtggtgcttgacgtacttcgccgccgacttcgccgccttgaccgtggcgtggtacgccgtcctcgccgcgtgggcgaccgcgtgcgcggccttcttcactgcgtgcgcgaccttgtgcgccgccttcttcaccgcgtgcaccacacggtgcaccgcgtgcgagaccttgtggtaggccgtgtggaccgcgtggacgacccggtggtacgcgcgtctgacgtgtctcgcggcgtagtggtacacgcgccgcacgacccgcacggtcgcgtggtacacgtcccggacgtggtgggcgatcttgtgggccacgtgcttgaccgcgtggaccaccttgcgggccacgtgcttgaccgcgtggtagaccttgtgcgccacgtgcttgacgacgctcttggccttgtgcgcgaccttcttcgcgccgcacaccacgtcgtaccaggagcagttgcccgactcgtcggtgcccgcgagcgggttgtcgtcgacgtaggcgaacgggttcgccgccaccgagttcggcaccgcgtccagcgagatgctgtccttgttcaggaacacacccgtggacgggttgtaccagcgcgaggccgttcccacgtcgcccgtgccgggctccgtccagccggactggaagcccaggtggccgacgaccgtgttcgtcggtgagaccaccttgcccagcgggtcgtaggacaccgagcccgcgagcgtggtcgcccccgaagcgaaggtgcccaccacatcgtcgtgccggtcggtcagggccagcaccccgctgccgtcgcccggcttgatgccgacgacaccgccgcccgggtcgtaggtgtaggtgctgtcaccgtccgaggcgatcgtgttgtcagcgccggagtaggcgaaggtgcgggtgctgcccaccgaggtgtcccggtcggagatgttccggcccagcgcgtccaacgtgtacgactgctgtccggcggcgatctggccgccgaaggcgtcggtcttgtaggccaccgtcccgccggccgccgacgactcctgcgtcatcgtgccgcgcggcgagtagtcgtaggtgtggacaccgtccgacgtcagctcgtcgcgctcgtcgtacgtgaagacgtcagagccgttgcggatgcggttgcccgaagcgtcgtaggcgtacgccgtcgtcttcgtgccgtcgttccacgacgtgaggcggttggcccagtcgtagccgtaggtgttggtggacgcgcccgacacacccgccgtcttcttcgacgtcaggttgccgttcttgtcgtagtcgtaagcgaagctcgccagggtcgtgggaccctgcgtcaggacgtcgctgatcaactcgtgatcagtgttgtagccgagggaccgggtctggccggtcgagccgtacttgaccgtcttcagctggttcagctggtcgtagaagtacgacagctgggtgcccgtcgccgcgtcgttcagggacgacaggcggcctgccgtgtcgtagccgtacgtggtcgtgcccgcggcgtccgtgcgcgaggtcatcgcgccgtcgtcgttgtaggcgaagctggaggagcccgccgaacccgacgcggtcaggacgtcgctgcggtcgtcgtacgtgaactcctcgtgcgtggcgtcctgatggtccaccgcgcccgcgatgcccgccgcatccgtgtccgccgacagcatccggccgtccgcgtcgtagctgaagctccgcctggccgtggccgcgtcggcgcccgtgccggacatcgtcttcagctgaccgttgacgtcgtacgtcatcgccgtcgtggtgccgccgggcagcgtcacgttggtgagctggccgtcggcgtcgtaggcgtaggtcgtcgtcgagtcggccgccgaggtgtacttcgcggtggtcggctcgatcaccttctcctgctggccccacggtgtgtaggtgtagcgccaggagttgccgcggccgtcggtgaagcgggtccggtttccggccgcgtcgtagccgaaggtcgtggtgatcgacgtggaggcgtcgaccggctggatctcctgcgtgatggtgccggccgcgtcgtaggtgaagcggctggtatggccgcctgcatccgtggtggaggtcatgttgccgacgccgtcgtagctctgggaggtctcccacagcttgttgctgctggcgtcgtaggaccgggtggccgtcgggtcgccgtcggcgttgtagtcggtcgtggagtaggtgccgtccgccagggtcgtcttcgagcggttgccctcgaagtcgtacgcgtagcgggtgacgttgcccgcgccgtcggtgaccgaggtgatgtcaccggcccggttgtagccgtacgtcgtcttcacaccacccggagaggtggtcgaggcggcatgcgcgccgtaggggttgccggtggtgaccgcgtaggaggtggtgctggtcagggtccgcgtggacgggtagcgctccagcgtcgtctgtgtcagctgccggcccaggaagtcgtacgtggcctgggtctgcgcgcccgtcgggtccgtcatcgacagcagctcgccgtccgggtcgtacgtggcgtgcgtcttcgtgccgtcggcggcggtcgtctgggcgatgttgcccagttggtcgtacagggacttcgtgatcttcccgccgggagtggtgacggaggtctgattgccctcgctgtcgtaggtgtagaccgtcgtgcccgcgttgggcgtcgaggcgcccgccggggtgtagggcggcagggtctcggagaccttgttgccctcggcgtcgtacaccgtcgtggtgaccaggccgttggggtcgcgctcctcgacgccctcaccgaaggtgttgaaaccgctggtggtggtcgggcgcacggtggcggcggtggtgccgtccggctcggcctggacggcgggcgcggtggtgaccgcgaggttgcccgcctcgtcgtaggcgtagtcggtggtgtgctgctcggcgtccgtcatggacgtcggcaggccccgcttgtcgtaggtgtacttcgtggtctgcgcgtcggacgagccgaccgttccgcccgagcggcccttgccgtacagcgaggagacctcggtggtggacaacgcccgctggtagacctgcacattggagacggcgccgggcagcatgtcggtggagttgccggcgtacttggcctgcccgatggtgagcgggccggtggcgttccacggcgtggtgttggtgccggagccggacagggttccgttgacgtagatcttctcggcgccggtggaggcgtcgaagacgcccacgagctgggtccagtcaccggtggtgggcacggcggtggagtacgccgacgggaacgtggcgccggaggcgtccttgttcgtctgctccatgctccacagcggcgcgctggtgtgcgcgtagttgtactggagcatgaacgcgctgttggtgccgccggtctgcgcgacgacggtcgcgttgtgggtgggcagcgagctcatcttcacccaggccgagaccgtgtacgaggcggtggtgtcgagcaccgggccgttcgtggcgatctgctggccggaggtgccggcgaagttcgcggcgccgtcggcccaggtgacgccggaggcggtggcggtgttgccggtgccggaggcgtcggtgacatgggtgccggaggtctggtcgagcttccaccaggcggccgggtgtccggaggcgtccccgtacagcgtctcgctgagcaggttgcccatgtcgtcgtaggtgttggtggtggtgcggtcgtagccggtcgcgtcgtggtcgttctcgctggcgacctggtcgtcgggcgtgtacgacacggtggtgacgcggtccacgccggtcgggtccagctcggtcgaggtggtccgggaggcggcgtcgacggtgtactcggtgacggtctcgccgttgtccgtggtggactgcagcatgttgccggcggcgtcgtaggtgtccgactccagcacgtaggtgctcttgccgtcggcgctggtgcgcttcaccgtcgaggtcaggccgtcgtcggtgtaggtgtacgacgtggtgttgcccatcgcgtcggtgatcgacgcgaggcggccggccgggtcgtaggcccgggaggactcggtgagcagggtcgccggctgcgggtcggtcgggtcgccggtgtacatcacgccctgcgtgagcagctcaccgttgtcgtcgtaggtgtaccgggtctcgttgccggcgctggtgacctccttggtcttgttgccggaggtgtcgtaggagtacgtcgtcgtgttgccgttgctcgcgccctcggccgcgttggcgtcggactcggtgagcacgtggtcgtaggcgtcgtacgtccagttctgggtgcgggccttgtcgccgccgctcgcgtcggagacggtctgcgaggtggtgttgccgtcctcgtcgtagaccgtgctggacacggcggcgtgggtggcaccggtgacgcggtcggtgagctgcgggtcgtgctcctcgatcacctggccggcggcgtcgtacctgtaggtggtggtcaggccgtcggggtaggtgtcggagacgaccttctggctggtgacctggccgatgccgtcgtaggtgtactgggtgaccagtccgatggcgtcggtggtggaggccacgtcgccgttctcgaagtacgacacccggttgacggcgccgcctgggctgaccgtcttgaccggcaggcccttgggtacgacgccgccgtcggcggacgggtaggcgctggtgccgtcgctgtactcggtggtggtggcgcggccgtcggggaagccgggcacggccgggccggtgatcttggtctggttgccggccgagtcgtaggtgaacgacgtcaggtaggtgtcgtcggtcgccgaggaggaccggccgtcgcgttcggtcagcagctggtcgttgcgcgggtcggcggtggtcagctgggccgtggtgtcgtccgggtagtacgagtagtactcggtgttgcacttgttcgcggcctggtcctggcaggacgtggaggagaccacgttgccgcgcacgtcgtgaccggtgacggtcatcgacccgttggggtcggtgacggtgtgctcgaaaccggccgagtcgtagccgaagctggtgcggttgccgagtccgtcggtctcggtcagcgcacggttgccgtgactgacgtcgtaggtgtacgtcggcgtcgagccggtcggcgaggtgaccttgacggtcttcaccggcagcaggccggtggagttcttcgccgcctggaactgcccggtgacgtcggcggcggacagctccgagcggtagagcgccacttcggcgacggagcccttgaagtaggtggcgtagccggtgttgtcggtggtgctgtggtgggcctcgtccggccagttgccgccgaggtagccggcgccgacgtaggcgtacggctggctgaccatggcgggcgcgccgctctgggtgcccacgagggtgccgtcgaggtagagcgactggctggtcgccgaggcggagatcaccgcgtggtgccacttgccgtcggtgacggcggcggcggaggcgagcggcttggtggagccgccggagaagtagaactcgccgttcagcttgccgctgctgccgacgtagaggaccggggtgtaggcggtcgccgtggtgccgccggcgctgagcgcgtcccgggaggttccgagcaggacgccgttcgcggtcgaggtcttgaaccacagggaggccgactgggcgccggtgccgggcacggcaccgctgggcggcgtcaccacggacgcggcgccgtcgaaggcggcggccttgtggtcgctgaacgggccggtgcttccgagggtgaccgcgttgtaggtgccgtcgccgccgcggacctcgtccacggcgttggccgcgccggccgcttcaccgaggcggaagtactgtgcgggcgcctggcccagcaccgcgccgcggtaggtgtcgctggagccggtgacggtgggcgtgccgagcttccacacgccgccgttctcgtccgtgagctggttcagcgtggtgctgtccgggtcgtacgacatcgccgcgaaggtcttgccggagggccgggtgatgctcttgagcaggctggtggcgtgcgtgccgtacgtgtagagcgcgctgacgtcggcggcgaccagcgggcggctgtaccaggcggcgtcggcgatggagccgttgaagtaggtggcgaagccgtcgccgtcggaggtcgagtagtgcggctcgtcgggccaggagccgccgaggaaaccggtaccgaggtagttgaacgactggttcttgccgaaggcgaccgcgctcttgatggagacggtgccggtgcgggagccgaccttggcgttgtccaggaacagcgtctgggagttgccggccgcggacagcaccacgtggtgccacttgccgtcggcgacggacgccgaggacacgatcgggttgacgccgccgctgtaccagaactcggcgttcagcttgccgtcggtgccgacgtagacggagggggtgtagaagcccgccgcctggcccgagccgatcggctgggaggcgtaggagtagaggacgcccgggccctgcgaggtcttgaaccacagggatatcgcgccggagtcggtgtcgttgccgaggttcttgggcagcgagacgtctgagctggtgccgttgaaggtggcggccttggcggtggagccggtcagcgggccggtggtctggccgagggtgacgttctcgtaggtggcgtcggtggtgccctcgttgtcgaggacggcgtccttggcggtggtgccggaggtctccgacagcggccagaaggtgtgcgggtccaggtcgagggccgcgttgcggtagccggagccggagtcgtagccgtaggtggtgcacttggtgctcgacagcggtgagcagaccttggtgagctggtcaccggtgtagccgtacgtccacgtctggacggtggtggcgtccttggggtcgaccgggtcggtgaccacggtggccacgtgcgcggcttgggcgcccgagggggtgctccaggtcagcgacagggagcggcccgcgacggcggaggtcatcttggtgatgtggccgctcgtccaggtgaggtcgaccgaccggccgttggcgtcggtgaccgaggtcaggccgtagccgccggagcccagggactgggtgaaggtgtagacggtgtcgtccttgtcggtcagcgtgtagccgccggtgaccgccttgaaggtggcgaaccgtccgttgccgggggtgaaggtgccgtcgctgttcttcccgtagccgacctgggagccgtcggggtaggtgacgacgatgctggtgaccgtgccggcggcgctgtactgctcggtggcccgggagtcgaagatgctcgaccagccggcgccgaacgcgccggtccagcgcgggtcacgggagttgtagtcgcgctcgacgtccagggacgggccgacgacggagacggaggcgtcggtgtcggaggtggtgtagttgccgatggacgcgtcgaaaccgtggtcgctgctgttctgcgacagccccgaggtgatcaccggctgcgggacctgcacggtcagcgcgtacggatcggccggggagtacatcttggtggtcgcgtcgtacgcctggacctcccaggtgtacgacttgccccaggccagcttgccggccggcacggtccagtcaccggtggcgatcaggcccgagtcggcgaccttggcgccggcggcgtcgtagacctggaactggtactggttggtgccgccgccgctggagttggcgccgcccgcccacgcggtgagctcgggctgggtggtgcccacgacggcgttgtcctgcgggaactgctcgtacagctgcggcgcggtgttgccggtgtaggtgaccgagagcaccgggcccttgcccgggtcgttgaaggagccgaactgcttccagtgcagggcgtcggtggtcgccgcgtagaccgcgaggccgtagtccttggtggtgccgctgaaccagccctggatggcggaggtggacagcgagacggtcaccgagtcgccgacggtgcggtcggcggccgtgttggcgcacgcgttgggcacgctcggggtggcgttgccgatggaggcccccttcgagggcccggggtaggcggtgacggactcgggggtccaggagccggtcaccagggcgacgtcgaaccgctcggcggtgcaggtggaggcccaggtgtcgaacagcttcagggacgcggcggtgacagtggcgccgctggcgtcccaggcggtgtcccagtggttgacgaagccgatcgccgagtgggtgccggagtcgtaggagccggccttgatggtctgctcgtaggagtggtcgccgggggcgcccgactcggcgtaggtggtcgtccagccgtcggcgacggtggggtcgacggtgaccgggaagacgcggcgggagtcgtgcagccagcggttgtccagggtcaccttcagcgcgtagccgtccttggagcggacgagctcggtggtcacgaggtgggtggtggcgggctcaccggagcggcggtccaccctggagtcgtacgcgtacgccggcgggatgcgctcgacggtcctgccggaggcgtcgcgcaggtcggtccagccgttcttcccgtgctggacgggggtgaggcccttgagggcgagggggaaggtccaggagttcgcggcgtccgcggagtgcaggacgaccgactccttcacaccggtggcggtgggggacagcttcaggtcggtggcgtccaggacgctgccgtaggtgacggtgtcgccgtgcgcggcgcccttgacgggggcggcgccctggagggtgtaggcgacgccgtggccggagtcgacggtgagggcggcgaggtcggagtccgtggccttggcgccgaagtcgacggcgagggagttggccttctcgtgccagcggccgtcgggtccggcccggacgtccacgtcgatgggcgcccaccgtcccttgccgacctggtagttgacgggagtgggcgacatctggcgggtggtggacccgtcggcgttgtcgtagaccgtctcggtgcgcgtcgacttggcggcgtcgcgcttgctggtcttcgcgtcgaagaccccgccgctgcggctgcggccgctctgcacggccggctggtgcgggtggtacgcggacagctcgccgcggcccttgcccggcctgtggcccgcgccgcggtgggcggcggtggcgtcggcggggacgtggtgccgcttgctctcggcggtgccggactcctggtgcggccgcttgc

SEQ ID NO: 207 - DNA, 3204 bp, Unknown
  Kingdom: Bacteria, Phylum: Actinobacteria, Class: Actinobacteria, Order: Streptomycetales, Family: Streptomycetaceae, Genus: Streptomyces
ccggtgtcggccgcgacggcgtactgtaccggacgctcctggccgaggagcccggcgagggcgtcgggcagccagcgggcgccgtcgtgggagacgaggacggcggtcaccacgtgccgcgggaactccggcgggcggtccgggtcggactgcgcgggggcgaaccgcttggcgcgcggggggtccgacggcgctgcggcgtcgtagtgggctgccgtatggctgtgcacggacatcgagatacacggccccggttcggtggatgcggtggacgcctgtgcccctcgggcagccgggcgtctcggacgagcgaccacactactggctggccatgaaggcggcccgccgcctgtggataacccacctgcgacgggccgttcgtgaggattctgcggggatgtgcggtgcccggctgccgggcgggggaagtgcggtgcggctgccgggcggcggcaggcgtcagacggcggccttcttcaggcggcgccgctcccgctcggacagaccgccccagatgccgaagcgttcgtcgttggcgagggcgtactcgaggcattcggaacggacctcgcaggcgagacagaccttcttggcctcgcgggtggagccgcccttctcggggaagaaggactcggggtcggtctgggcgcacagcgcgcgctcctgccagccgagttcctcgtccgcgtcgtcgaccagcagttgctccaccagctcggtcatgtgcgcccctcgtctgtctttcgcgtccccgtgatgtagccgttaccgatttcggctgaacgacacgagtgaaattacaagtgtgctgctccgggcgagtcaagccgagatctgctattgagccccttattcactctgcggaaccaaggtcatgcggaaagtgttcaaatcggcttaaaccttgacacccagcgggggctccgaagacctcccgccccgcgcgggcccccaccggagcccacagaaggaaggacgcccaggtcctcgatcccgttccggaacgcgcgccgaagcgaaccggatcacattcggatcacgggatcgcaacggggcttgcgcgcccggcatgtgcgccatgtgtcccggtctcccgctgagcaaacctttcacctgcgagatgaaccggatgaggtgaaccatgtcccacattccgggcatcgagttgacagcgctggagtgaaccggtgtccttgtgggcatgctcgcgaactcggtactcacctcgacccgcaccgccgggtcccacggtgctgcccgcgctcgctgtagctgtcgctgctgcggctgttgagccccgcgcccctcgggcgcccgctccagtcgccgtccgggccccctgcgcggcccggcgcccgctccgccgatccgcggtcctgccgatcgccggtcttctccgcatcttctctgtgcttctccgatcttctccgtgcttctccgaacttctccgtgcttctcgagttcctccgaggaagaaccgcacctcatgaacagcgacagcgacctccagatcgcaggcgacctcctcgaggtcccgcacctcctccaggccccgcgcgagcacccggtcaccgtggccgagttcgtcggcctggccaggtccatcgcggccgaccgcgcccagtgggagcacctcgtccggtacgacgcgacgacccgctggtaccaccggctgcgcaccgcccccggatacgaggtctggctgctgtcctgggtgccggggcagggcagcgggctgcacgaccacggccgctcctccggggtgctgaccgtcctggacggcaccctgaccgagcgcacccggcagggcacgcgcgcgctggaggccggtcaacagcgcgtgttcgccccgggatacgtgcacgaggtcgtcaacgacgcgctcggcccggccgtcagcctgcacgtctacttcccgggtctgaccgagatgcccatgcaccccgcgcacacggagcacgcggggcactcggcgcacaccgcggcccggtgcgccgccgcccccgccggccggtgagcggcggacgccgccgttgccccgacgcggcggacgccgtcaacgcctgactcttctccgcccaccgcgtgccccgttgtcgtacccgcctgccagacttgccccatgcgcattgtggttctggcaggcggcatcggcggtgcccgtttcctgcgcggtctcaagcaggccgtgccggacgcggacgtcacggtcatcggcaacaccggcgacgacatccacctcttcgggctgaaggtctgccccgatctcgacacggtgatgtacacgctcggcggcggcatcaacgaggaacagggctggggccgggcggaggagaccttccacctcaaggaggaactcgcggcctacggcgtcggacccgactggttcgggctcggcgaccgggacttcgccacgcacatcgtgcgcagccagatgctcggcgcgggctatccgctcagcgcggtcaccgaggcgctgtgcgaccgctggcagcccggcgtgcggctgatccccatgtccgacgaccgggtggagacgcacgtcgcggtggagatcgacggcgagcgcaaggcggtccacttccaggagtactgggtgcggctgcgggcgtcggtccccgcccaggcggtcgtgccggtcggcgccgaacaggccaagcccgcgccgggcgtcctggaggcgatcgccgaggcggacgtgatcctcttcccgccgtccaaccccgtcgtctccgtcggcaccatcctcgccgtgcccggcatccgggaggcgatcgccgacgccggtgtcccggtggtcggcctgtcccccatcgtcggggacgcgcccgtgcgcgggatggccgacaaggtcctcgccgccgtcggtgtggagtccaccgccgcggcggtcgccgagcactacggttcgggactgctcgacggctggctcgtcgacaccgtcgacgcgggcgcggtggagcggatcgagacggcgggcatccgctgccgggcggtgccgctgatgatgaccgacgtcgacgccaccgcgcagatggcccgggaggcgctggcgctggccgaggaggtgcggacagcatgagcggcacgccgtcggcagacggccgcggtggcgcgaccgcgcccgcgttccgggcgtgggccgtgcccggcatccccgaggtggcgccgggcgacgacctggccaagctgatcgccgccgcc

SEQ ID NO: 208 - DNA, 5554 bp, Unknown
  Kingdom: Bacteria, Phylum: Actinobacteria, Class: Actinobacteria, Order: Streptomycetales, Family: Streptomycetaceae, Genus: Streptomyces
  misc_feature (362)..(453): n is a, c, g, or t
gccgtacctgcgccgtgccgtcgacgacggcgcgctgcgccccgccggggccgcggtgatcgaggacgtcctggaccgcctgcccgagctggccgggccggccgaacccccggcgcggttgcacggtgacctgtggaacggcaacgtcctgtgggacaccgagggagaggtctggctggtcgatccggccgcgcacggcgggcaccgcgagaccgacctggccatgctccgcctcttcggctgcccgcacctggaccggatcctggacggctaccaggagacggcgcccctggccggcggctggaccggccgagtagggctccaccagctgtttccgctgctggtgcacgccgtgctgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgcacgccgtgctgttcggcggcggctacggcgagcaggcggtcagggccgcccgcggcgccgggcactgacagccgaggcgaccgggaggggccgataccgccgacgtggcgaatctcgctctgctgcggcggcccgtttgcggtcgccacctgtgagcaggcggtctcctggatgcctgtgcgccggcagagaggagccctcatggcgggcaacgcagacggtcttcgcgacaacgacgccgatctcggcgccgtcagacgccatcgcgcgctgttccgtgccgcggaacgccgcaggaaccccccgctgcgacggaccgacatcaccgtcaccgacgagagcgcggtacggcgcgcggtgaaggccgcctcgctgggcaacgccatggagtggttcgacttcggcatctacagctatctggccgtcaccatcggacacgttttcttcccgtccgggaacgccacggtcgagctgctgtcgtcgttcgcgacgttcgccgtgtccttcctggtgcgtccgctcggcggcatggtgttcggaccgatgggcgacaagatcggccggaagaccgtcctcgccatgaccatgatcatgatggcgatcggtacgttcgcgatcggcctgatcccgtcgtacgccacgatcggtttctgggccccggccctgctgatcttcttccggctggtgcagggcttctccaccggcggcgagtacggcggcgcctccacgttcatcgccgagtacgcgcccgaccggcggcgcgggttcttcgggagcttcctggagctgggcacgctcgccgggtacgtcggcgcgtccggcctggtgacgctgctgaccacgctcctcggcagcgacgggatggagtcgtggggatggcgcgtgccgttcctggtggccgggcccatcgggatcgtcggtctgtacctgaggctgcggctggacgagacgcccgcgttccagaaactcggcgacgcctccgtgcaccgggcgtccgaggcggcgtccgcggtggagacgaccgccaagggcgacctcgcgaagatcttccgccagtactggccctcgctcgtgctgtgcgtctgcctggtcggcgcctacaacatcaccgactacatgctcctgtcgtacatgcccacctacctgtcggacgagctgggctactccgagacgaacggcctgctgatcctgatcggcaccatggtggtgctgatgctgctgatcaaccaggtgggccggctgtccgaccggatcggccgcaagcccgtcctcatgaccggcatgctgggcttcctgctgctgtcggcgccggcgttcctgctggtcgggcacggcggcgcggtgtccgtgaccgcggggatgctgatgctggggctgtccctggtgtgcatgctcgggacgatgtccgcggcgctgcccgcgctgttccccaccgaggtgcgctacggctccctgtccatcgggtacaacctggccacctcgctcttcggcgggacgacgccgctggtgatcaccgcgctgatctcggtcaccggcacccggctgatgcccgcctactacgccatggccgcggcgctggtcggcgtggtctccgtggcgtgcatgaaggagaccgcgcgccggccgctggcgggctccccgccctccgtcgcgaccgcggaggaggcggcgcggatggtggagagccaggcgccggcacccaggttctgaagggaggcggcacacccgccgtcccggacccgtcggcgcgcgggtccgggaccgcggctcacaggtgcggccggtgtccccgctcctggtgcgggaaggtctggtcggcgcccggcagcgtcggcttcggcagcgtcgccacctcctccttcgccttctccagctgctccgccgtgtcgtccggcagccgcggcgggcgcggccggctgtgggagaagcggaagggcgaggtgaagtcaccgaacgtctcgcgccgccacgcgctgatgttcgactcctcgacgccggtgaagcgctccaggaaccgcagggccgaggtgtggtcgaaggcctcggtggccacccagccgcccgccgtccagggcgagacgacgatggccgggacgcggaaaccgccgccgatcggcaggcccttgatgaactcgtcgggcgttccctcgggcggggtcggcggggccacgtggtcgaacagcccgtcgttctcgtcgtagttgaggatgaaggcggtcttgcgccacaccttcgggttggacgcgatcgcctcgatcttggaggcgacgaagtcggcgccggcggccggcaggtagtccgggtgttccgactggtgactggtcggcacgatccaggagaccgcgggcaggcggtcgccccgggcgtcgtcctcgaaggtgccctccggctgcgggcgcaccccgcgctcgtacagctccgagcccggctgggcgtccttgaaggcggcgaactgctccagcaggttgcagccgtagtcgtcctcctgctggtacaccttccagctcactccggcggcctgcaggcgctgcgcgtacgtcgtccagcggtacggtttcggggcggtgttgttggtgatcgggccgccgcgggtgccgcccgggtcgatcgtcccggtcatccacatcagccggttcggccaggtcggcccgaagaccgagctgaagtagttgtcgcagatggtgaaggtctcggcgagcgcgaactggaacggtatgtcctcgcgcgtgtagtagcccatgacataggggccgttgacgccgtccgccttgcggtgcgcgggcagccagcggtccatcctgccgccgttccacgcctcgtgctgcaccgaccaggcgtggctcgtggaggggatggcctgcgcgctggacttgtgggtgtcgaggtggaacgggagcagatagcccctcgggttctcggcgtccggctggtagaagaccgaccgtccgtcgtccagcttgagcgcgtcgtggtcggcgaagccgcgcactcccttgagggttccgaagtagtggtcgaaggaccggttctcctgcatcagcaggacgacgtgctcgatgtcgcgcagcgagctgtgccggggcggctcggcggcgacggctttctggacgctcggcgggaggagggagagcgccgcggcgccgcccagcgcgccggcggacgagcccaggagtctgcggcgtgtcaactcggccatctgagctccttcttgagcggttgaaggcttgagcggatgaggctttcacgcgtcacggtccggccggaggctaccggaccgcagtccactttccgaccaccgcgacgggtggaatcagggacgtcgggtgaacaagtggccgacgcgcgaaggggcgttggccaacccgtggcccgcggcaccgggccgtcgcccgctcgtgacctgcgtgtcccgaccgccgggatgccgtccgggttgccccgcaaatgttccggtttggtcaccaagtggcactgtcgtcacagacgttgctttcgcggctgtcgtccgtgttaggaaatacgtcgtcactgaccggcggctgcctcaggggggccttgcgggtcatgtcgtaccggcccgcgagggccgcagggggaagaggtaacagcgcaatgaaccgcacacgcacggccgtcgcggccctggtggccaccggcgtcctcaccaccgctcagctgggactcgccggtgccgcctcggcggcgaccgtcacccagaagagttcgggctgtccggtcaacatcgtctacccgagccggttctacgtggaccaccacggctgggcgaccggcggcggcctgtacttcggcatcaagagcaggacgagccggagctacaagaacgtcaccttcaccgtcaccgacgtacggaacctccggttcggctcggcgacggccaagggcggccggatcagccacaagacgtcgaagaccgtgtccgtctccacccggaccttcaagggaaaggcgagcctcggcttcaaggtccgcacccacctgctcaacacccgcaactacaagctgaagttcaccctgcacggttccggctggaactgcgccgtcaaccagggcacctgggggtcctgatcccggccgcggccgtacggtcctgagccgtccacccggtgccccggcccccggccggggcaccggcatgccatgatcgcgttgcggggtgcggcggcggtcggggggtacgctgcgaggaccggagtccgcgggcgacgacacccccgcagcggcacacggggccggagaacggcacgaggccggaagaagggtggtgcgcagggatggagtggcgcgagttcgccgagcagatggccgacctcgcccggcgtctgctggcccaggagtccccggcggcgacgctccacgagatcgcctccgcggcggtcgagctcatcgacgggtgcgaggccgcgggcatcctggccgtgcgcaagggacgcgccgtgagcctggccgtgaccgggagcgtggtcgaggagtccgaccgtctgcagggcgagctgggcgagggtccctgcttcgacgccgcccgccgggtgaacggcgaccgcgtgttccgcatcaccgacctgagccagccgcagcccgactggccgaggtacgccccggccgcccgtgacctgggcatcggcagcatgatgggtttcctgctgtacaccgaggacgaggacttcggggcgctggactgctactccagccgtcccggcgccttcacccaggagagcgagacggccggctggctgctcgcctcgcacgccgccgtggccctggccggcgcccgcaccgtcgaccagctggaacacgcgctggagacccggcacgccatcggcgaggccatgggcatgctgcgcgagcggcaccggctcagcgaggaggacgccttcgcggtgctgcgccgcatctcccagcaccacaacatcaagctccgcgacgtcgcccagaacatccgcggcggcaagggcccgcacaaactctgacggccacccggccaggccacccggacggcggtacggggctcgcgacgtccccggcatgtacggcgcccgaccgcacacaccggcgcccgccgccgcgcggccgccgtc

SEQ ID NO: 209 - DNA, 6576 bp, Unknown
  Kingdom: Bacteria, Phylum: Actinobacteria, Class: Actinobacteria, Order: Streptomycetales, Family: Streptomycetaceae, Genus: Streptomyces
  misc_feature (213)..(250): n is a, c, g, or t
gccgaaggcagcggccccctgcgcctccgcgccctgtccgccacctccggtctgccgggcggtgtcgacgcgccttcgctgccgtcaggtaccagttgggccggcttcccggcgctggcggaccagaccatcgccgtacggaccttcacgctctgacctgaccggccccggcaggcgcgggcggcaggcccgggcggactccggggccggccnnnnnnnnnnnnnnnnnnnnnnnnnnnnnnnnnnnnnntcaggaaccccgaacggctggtacctcggtcccgggatgtcgtggccggcatcaggaaccccgaacggctggtacctcggcgggtatacccgccgaggtaccagccacttcgcgcagtgtggtccgccccgctcaggcgcggcgggacgcctcggactccagatcgctcagcagggcttcgacatcctccgcgggctcctgctcggcctgccggtaggcgatgcgccgcgcgagcatctcgaccgtcgacgaggcgaagatgtcgcgcagggtgaggtccacctggacggtctcccggatccggatgttcagctgggtcgcgagcagtgagaatccgcccagctcgaagaagctgtcatggacgccgacgcggtcgacctcgaggagccccgccaggatctcggcgagctgccgttccaagggggtccgcggggcgacgtaccggtcggctgtctcacgcgcgtccggacgcggcagagcggccaggtcgtactcgccgtccgcggtcagcggcagccgcccgaccaccacgagctggcgcgggagcagcgcgtcgggcacccgggccgcgagccgcggctgggccgcggccaggtcgaactccccgtcctcggtgacgacataggcgaccagctccgtgcctgcgccggctttcgcggagtccacgacgacggcatcgacgacacccgggagttcacgcagcgcacaggtgacgtggagggtgtcggccgacggatcgccgccggccatgccgacgaactcgatcgtcccgtccgcccagcgccgcccgagctgcccgctccggcggccacctgtgcggagttcggcgacttcgccgaccgcggcgtcctgcccgcctcgccgcacgagacggacagggccgtggacggcatcgccgagaggcataccaagaggcataccgagaggaacacgcaggggcgccgtgtccgcagtccacccgtccggtatgtcgtggaccgccgcgggccggccgtcgggcccggtgccgaacaggcccgtgcaccgggcatccggggccgcccggcgtaccgcgacgacatcctgcgccacgaaggaccccgagttctcgaccaggacgtggcgcagggccggcagcgacgagcccgccagggcacgcagcaacgccgggcccgcgtagagcacgctgacgccggcgctgtccaactccgcggccatcgtgcccgtttcgtcgtcgggcgcgcggtcgaccagcaccacggttcctcccgcggcgaaggcggtcaggagggccgagatcacatggtgggtggagccggagagtacggcgaagcggtcgtgggagccgaacccgtaccgtgccaccgcccaatcggtgccgccgccgggcgacgggacggcgccggtgcccgactccagcccgtcgctccgcggctcgccggtatcgatgacgtgggtcccgtccggcccgagctgcagcgtgatggccgagccgtcggatcgcacggccagtctgccgagggcttccggggcgtctcccgagcgatccagcgacacctggactccggcccgcagacaccccaggagcgcggccacgcacagccccgacggccgccatgcgaggacgacccggccctcgtggtcgtcaggtcgacggctttgcccgtggaggggcaggtgccgggtcatggcccgggcgactcggtccgccaccgcgtcgatgcggcggtaggtccactcgccgtcgcggtcgatgacggcaaccgcggggagatcggccgccggcagcagtccacgggccggggccggggacgcggcccccgaaccctcgtacgcggtcgcgccgccgccctgctccgaggtcggccggtactcgctcagcgggcggtcgggagcacgtgtcgcggcccgcaggatctccgtcagctgctccagaagctgctcgatcatgccccgctcatagcggttcgcatcgaattccaggtcgaagcggaggactccgtcccattcgcgcgcactcaaggtgagctcgaacttgctgggccgggccggggtgtccagcacctcccctgtggtgcccgccagtggatggacctcaggggtgtcgacgccgttcaggatcacctggaacagcggtgtccgggacgggacacgggtcgcgggcagctcgccgaccagcaggtccagtggcgcctgggcgtgggcgtacccgccgagcgctgccttgcgggcccgggcgagaagctccgcgaacgtcgggtcaccgctgaggtccagccggaacgggagcgtattgacgaagaagccgatgaggttctgcaaccgggcgtcggaccgccccgtgatcggcaccccgatcaccacgtcctcctggcccgaccagcggctgagaaccgtcccgaacccggcgaggagcgccatgaacgtggtcgcgtccgccttccggcacaactcgccgagcgcactcgtatcggcttgcgacagcgcggcggacacccgtccgcccaccagcacatcgtccggcgtgctccgccgcctgctggggagcgccagggaggccggagcgccggcgaggtgctcacgccagtagtccacctgctgccgcaggtactcgccggtcagccagcgccgttgccacacggcgaagtcgcggtactggatctccagctcgggcagatccgcccgctccggatcgccgccggccgcgtacagggcggacagctcccgcacgaagacaccgaccgaccagtcgtcgcacacgatgtggtgcgcggtgatgctcagcaggtgttcgctctcgcccacccggaccaccaggcagcgcacgagggggccgtgttcgagactgaagggcgcggcagcgtcggcgtccatcagctcgcgcgcccggtccgcaccgtcgggcagggcgctcacgtcctcgaagcggaggtgccagtcgtccgcgaggtcgtcgacgatctgtaccgtccggccgtcctgtacgggaaaccgggagcgcagcgcctcgtgccggtccatgatggcgcgcagcgaggcgtccagggcggccacgtccagctccccgcggagccgctgccggccgtgcacgtggtaggcggcgcccggcaggagctggtcctcgagccagagccgctgctggtcgtaggagagcacgggatcggctccggcgggccgcgggcccacctccggccactgggcgggcgcggcgtccaccacgtgttgcgccagggtggccaccacgggggactcgaagaagtccatcgcccgcacgcgcaccccgtagcgctcgtgaatccgcccgagcgcccgcacggccatgagcgagcttccgccgaggtcgaagaagtcgtcgaacgcgcctatgtcgtcgcgccggaggatgtcgcggaagatcccgccgatgccctcttcgacagcggctcgggaagtcgccggttcgtcttcggcagtggagcggggagtcgccggtccatcttcggcagcggttcggggagtcgcccgaccgtcttcggcgaggtgcgccccgtgcgcagggctcacgtctgtcgggtcggatgcatgggacgaaggatgagaggccacagggttcacgttaagggcgggtccggcccccggtgacgtcgcagaaaacgggtaccggctctcgtacgtcgcaggtggagcaggggggagcagggggctcctgtcactcgaacaccggacaggagacctgcgcggcggccgggttgactgtgcgtacctggatgccggtcgcagagggagcaagcactgatgtcacccatcgacaagctgtttccctatcggaggcgaaccgacgggttcgagctgttcgcctttccgcacatcgcggcgggacccacgctgttccacccactgcgcgaggcggccgcgcaggaggggatcgccgtgaccggggcgttgctgcccgggcgtggacgcagggtacgcgaggcgccgcaccgcacgatcgacgcgctgctcaccgagatcgaagaggcagcgaggtatgacgacttcgccgccttctccggagactacggcctgctggggcactgctccggctccctcgtcgccttcgagatcgcgcgtctgctcgtccggctgccgtgtgcggatccgcagctcctcgtggtctgcagctgccgaccgccggagctcattccggacaccggcaccagcaggctcttgcgcgacgacatgttcgcgcggaccgccgcgctgggcgggatgccggaggcgctcatggccgacgacgatttcctcgacctgctggaacggccgatgcgtgcggactgggaggtcttcgacagctacgtccacactgcctcccctgcgctccccgtcccgatcctggcggcgcgcggagcggacgacgcgaccgtgcccgcggcggagcagccccgctggaaggcgcagactcagcggctcttccgaagtgtcgacctgaagaccgaccactggatgctctccgccgaggggtcccgcgccctcacccacgagatatcggcaacgctccgcgcggtccgcggctgactacgcgaccctgccggagaggccggcgagcgtcacgtccgggtcggcggccacccggtccagaaccgccaggtagtcctgcaccaggcggtcggccgcggccgcaccgagtgagcccgcgcggaatcgcagcagaccgtgcgcggcgccggacacctcggcgatcacgacctcgacggggaccgcgccgccaccgaggggcagcgggaacttctcgaccggcagggacccgagccggccgcggacggccggggggcccacctgggccagcgcggcgatctcggcgccgtcgtgcgccgtgcccggctgctgcgcagtcgccgactgctgcggagtggccggctgctggggtatcgccggctgctgtagtggcgccgactcctgcgcgctcaggtcgccggtggggcgtgggggcgcctgattgacggtgaacagcacatccacgaggtgcccgcgtccaccgacgccatggcgctcgcggagcagggacatcggatagtcctggtgctccagcgcaccgatgacctgctgtctgacccggccgagcagcgtggagaacggcatgtcaccggccgctcggcagcggatcagcgaggtgccggcgcagcatccgaccacgtccgcgaactcgggacgggtgcggcccatcatgggtgtccccacgaccaggtcgtgctgccccgtggtccggtgcaggaccgccatgaacgatgccagcagcagtacgtacaccgtcacgttctcgccggcggcacgcgtgcgcagcgcgtccgtcagctccgcggagagcgcgaactccaccgcgccgccttcgcccccggccccgtccgcccgcggaaaggcgagccgtggccaggcggtgtccgctgcgaccgccagctggtcgagccagtggcgttcgaggcggcgtacgcgttcgtggtcggacaggacggcattgcgccaggcggagacgtcgaggtaggtggctcgtggcggcgccagggaaatgtcgcggccggccgcgtaggcgctgtagaaggcgcccacctcacgggcgaggagcgtgctggaccagaagtccgtgatgatgtggtgcatccgcaccagaagcacctcaccaccggcgtagcggtagaggtcgacgtgcagcagcggaccggtgaccaggtcgacgggggtgcctgccacggcgttcaggcgtgcggtgagggcgtgttcgtccagctcgggcacgtcgtgcaccccgacggtcaccgggctgtgcgggtggacgatctgtaccagttcctcgtccctcacctcgaacgtcgtacgcagcaccggatgccgggcgcagacggcgtccagcgccctccgcagcgcgccgagatcgaccgactccggcaggcggagcgcggtggccacggtgaactctgggttgtccggctcgagttgctgcatcagccagatctcacgcgcaccgtgcgacagcggtgcccgcacttctccggccgcgtccggagccggcgtcggggcgccgccgccgtgcgtttccgtaccggaaccgggggcgggctgtgagcggccgtccgtgatccgctcgagaatcccctccatggtcccgccggcgagcacgtcaccgagcggcacggtgacgccgaaagcggcctccagccggtgctgcaacgtgacgagggcgagcgagtccaggccgagcgccagcagcggaaccttcacatccagggtgtcgggcgcgacgtcgacgagctgtgcgacgagggcacgcagccggtgctgcgcgtcgtcgcggggcacgggcagcgcgtccacggcgggcgcggtggccgtgc

SEQ ID NO: 210 - DNA, 9640 bp, Unknown
  Kingdom: Bacteria, Phylum: Actinobacteria, Class: Actinobacteria, Order: Streptomycetales, Family: Streptomycetaceae, Genus: Streptomyces
cagcggcaccggccccgccgctccggacggacgtctcaggggcgcgaacggcggcgcatgagttccggcagcggccagcggcggttgaccaggaaggcgccggccgcgagcaggaccagcacgccgccggcgatccccagggcggtccccatcccgctggatccgctctcggcggaggcgctcgccccggacccggccgtcgaaccgccgcgggcgccgcccgcctgtccggccgacggggtcgagcccggctgtccgccgcccgtcgcggcgctcttcggcggcaccagcgtgcccaccggctgcaccttgccggccgccttgaagccccagtcgaagagctgggcggactccttgtagacctcgtcgtgctcgggcttctgcgggttcatcaccgtcacgagcagcaccttgccgtcgcgttcggcgacaccggtgaaggtgttgcccgcgttggtggtgtagccgttcttgacgcccgcgatacccgggtacacggagagaccggcgtcgccgctcagcagccggttggtgttctggatctcgaaggaggaccgggagggcttgcccttcttgttcttcttcgtctcgccggggaactgggcccgcacggtcgagcagtactcccggaagtccttcttctgcagtccggagcgggcgaacagcgtgaggtcgtaggccgaggagacctggccgggcgcgtcgtagccgtccgggctcacgacgtgcgtgtcgagcgcctggaggtcctgggcgtgcgcgttcatgtccttgacggtctgggcgacgccgtcgttcatggcggacagcacgtgcacggcgtcgttgccggaccgcaggaagacaccgagccacaggtcgtggacggtgtacgtctcgttctccttgatgccgaccagactggaaccctcgcccatgcccgccaggtcgctgggggcgaccttgtgcgtctgcgtcttcgggaacttgggcagcacggtgtcggcgaacagcatcttcatggtgctggccgggggcagtcgccagtgcgcgttgtgggaggccagcacctgtccggactcggcgtcggcgacgatccaggagcgcgcgctgaggtccttgggcaggacgggaaccccggcggacaggctgacctgcgtcccgggcaggccgagccgggcgccgccgacgttggacatgcgggccgggggcttggccgagggggtcgtcggggccgccggagcggcgagggccgcgggcgcggtcagggagacggtcagcagggcggcggaggcgaccagaagcgagcggcgggcggtcttggaggctgcgggcacggtcggaaacgtacctgccgtgtccccgggcgcccggccccgggcccggcttccggcccgaccccggccacggagccggaggtccgcaggcgatactgaaggtatgaagctcagccgccccgtctcctggttcctgctcgccttcggggtgtggagctgggtcatctgggtcactttcgtcaagaatctcgtcaaggacagcagcgggctcgcgttcgacgacggtcatccgacggcgtacttctgggtgcacctgacgctggcggtcgtctccttcgtattggggacggtcatcgggggcctggggttgcgcggactgcgtgcactgcgccggacgtcatagcgcgcgcggcgttccgtggcgctgacgggacgtccggtacgcgaaccatccgagcgatcgtcaggatgtgcgacgtatccgtcggatgtgcggcgtatcactctgcctgccgcacgcgacgtcgaaaagggacaaaagtagcatctcccctcattttgaggggtacttgtgggtatctgagggacacctgaggacatcctgtgaaacaaagagacaacacttcttcataacgtcttttcaacccctccagaattctcttccgccgggtgagcgtcgtgtgattatgtgtgcgcggcccttaggggtgtggcatatgcacggcggctcgcgaagggcctggggagggcatcaccgatgcggtcggttcgcatgcggattctgctgacgctgctggtcctggcggtggtcggcgtgggcggctggcaactcctgccgtcgcagggcgacaagaacaaggcgatcaccctgggaacgacggacgccgtcacctcgctggacccggcaggcgcctacgacgccggctcctgggccctgtacagcaacgtcttccagtccctgctcaccttcgaacccgacggcacccagcccgtgccggacgcggccaagaactgcggcttcgtcggcagcggactgcgcacctaccgctgcacggtgcgcgagggcctcaagttcccgagcggccgcacgatgaccgccgaggacgtcaagtactccttcgaccgggtcaagaagatcaactcgaaggtcggtccttcgaccctgttctccaccctcggctcggtggacgccgacggcatgaccgtcaccttccacctctccacgcccgacaccaccttcccgctgaaggtcgccaccggcgccggttccatcatcgaccacacccgctacgcgctggactcgctgcgcagcgggaccgaggtcgacggcaccggaccgtaccgcctggacgggtacaccaaggacaagagcgccgacctgaagcccaacggctcctacgagggcgccatcagcggttccggccggccggtcgaggtgcgctacttcaccgagggcaccgcgctcgacaaggcctggcaggacaagcaggtcgacgtcgccacccgcacgctgacgccgaaggtgctcgccgcgctcaacccgagcgaccccaagcagcgcgtgtcggagtccgacagcgccgagacccgcaacctgtacctcaacacgcacgcctcctcgccgctgcacgacgtccgggtccgccgcgccatcgcctggctgatcaaccgcgagcagctggtcacctccgtctacgacggcacggtggacgcgctctactccctggtcccggccggcatcaccgggcacaccacgtccttcttcgacgcctacccggcccagaacgtcaagaaggcccggcagctgctgaccgacgcgggcgtgacgaccccggtgcggttcacctacggctacggcgagggccgcggccagggcgccgaggaagccgccgagatcaagcggcagctggagtcgagcggcctgttcaaggtcgacgtcaagggctacgagtggaccgacttccagaagcggtacacggctggcaagatcgacgcctgggcggtcggctgggtcgccgactacccggacccggacaccttcggcggaccgctcgtcggcaccggcagcagcatgaacaccggctacagcgacaaggccgtcgacgaactcgtctccgacagccagcagtacaccgaccgcagccgggcggcgtcggacttccgcgccctgcaggagaaggtggccgccgacgtgccgctggttccgctgtggcagcagaaggagtacgtcgtcaccagcgaggacgtcggcggcggccagtacctgtcggacggcacgggcgtcttccggctctggaagctcaactggatctgaggcaccgggcgcagaccccccgcctcccgggcacctgtgaggggcaccggcacgcctgggcgcgccggtgcccctcacgcgtccttgcggctcctgcccgcaggatcgggcagcgccttcgtcattcccggcaggaagtccgtgaacagctcgtgcacctcgtgcaccagcggacgcagcacccggaaccgggccagcgacaccccgcgcgcggtgagccgcgccccgcgctcggcgagccggtagctgcgctcgcggcccggcgtgcggtcgaacacccagtacaggacgaggcccatctgggcgagccacatcagctcgggcagcacctcgcgcagttccgcgggcaccttggtccgcgccccgtacagcacctgccggtggacgctgacggcctccacgcgcgcgtgctccgactcgggcgagaacgggctgagcggactgtcggggtcggccgcgttcttgaagaactggacggcgaactcgtggtacggcgtggcgatgtcgagccaggtcttcagcacgcccgccagacgggcctccaggtcgctctcccgggccaggacgtcgcgcaccgcctcctggtgctcggccgcgatccggtcgtagaagccctggatcaggtgttccttgccctcgaagtagtagtacgcgttgccgacggagaccccggcctcctgggcgatggcccgcatggtcgtcttgtcgtagccgcgctcctggaacagacgcatcgccgtctccaggatcagggcgcgggtctgctcggacttgctcggggccgacgcggccggggccttggcggccggggccggagcggccggcgccggggacgcgtcgttgccgtcgctcttgctgctgtcggggctcttcttctcgggcacggacagagcctagtcagtggcccggcggcggtccggcgggcggtcgctcaggggcggcgtcccagttcggggcgcttggtgtagtccgtgagaccgaggacgttgccccaggggtcggcgatctccacggtccagccggtggcctgggcggacggctcgtccagcggctcgatcccggccgccgccagcgcccgggccgccgcgcgggcgtccgggacctccagccacaggcgcggggtgtgccacggcggcggccggtgcccgagcgcctcctccttgcgcagcaggatccccggcgtctcaccgccgaccttcagcgccgcgatccccgcctcgtccagccggaacgccaccgcgaacccggcccgctcgtagaaccccacggcctcgccgagatcgcccacggccagcagcacgttgtcgaacccgagcagctcgtacgactcgtcatctgacatgtgatcaggttaggtatggccgtcccgcacacccccgcgcacaccccgcgccacgggccgcgaggtcacccgcccggcgcagaaacgccgaggaccccgctcccgagagggaacggggtcctgacccggactgccggaaggcggtgcctcagaagcggcgggtgatcagcgcgcgcttgacctcagcgatcgccttcgtcacctcgatgccgcgcgggcaggcgtcggtgcagttgaaggtggtgcggcaacgccacacgccgtccttgtcgttgaggatctccaggcgctgctcgcccgcctcgtcacggctgtcgaagatgaagcggtgggcgttcacgatggcggccggaccgaagtactggccgtcgttccagaacaccgggcaggaggaggtgcaggccgcgcacaggatgcacttcgtcgtgtcgtcgaagcgcgcccggtcctcggccgactgcagccgctcacgcgtgggctcgttggtgtccttcgtgatcaggaagggcatcacgtcccggtacgcctggaagaacggctccatgtcgaccacgaggtccttgagcaccgtgaggcccttgatggcctccaccgtgatcggcttctcagggttgatgtccttgatcagcgtcttgcaggcgaggcggttcttgccgttgatccgcatcgcgtccgagccgcagatgccgtgggcgcaggagcggcggaaggtgagcgtcccgtcgtggtcccacttgatcttgtgcagcgcgtcgaggacacgctccttggggtccatctccagctggaagtcttcccaggtggactccgccgagacctccgggttgaaccggcggacccgcagggtgacggtgatgtagggggagtcggcgaatcccggctcgggctgcccggccgcgtccgccttgtccagaacaggggttgccatcagtacttacgctccatcggctggtagcgggtctggacgaccggcttgtagtcgagacggatggattcggacccgtcggcgccgacctcgcggtacgccatggtgtggcgcatgaagttgacgtcgtcgcggttcgggtagtcctcgcggtagtgaccgccgcgggactccttgcgggccagggcggagaccgccatgacctcggccaggtccagcaggttgcccagctcgatggcctccaggaggtcggtgttgaaccgcttgcccttgtcctggatcgccacgttcttgtagcgctcgcgcagctcggcgatcttctcgaccgccgtcttgatcgtctgctcggtgcggaacaccatgacgttggcgtccatggtctcctgcagctcgcggcggatcgtggccacgcgctcggtgcccgtggaggagcgcagccgctcgatctgctcgacgacgaggctctccgggtcctccggcagctcgacgaagtccgccttctgcgcgtactccgcggcggcgatgcccgcgcggcggccgaagacgttgatgtccagcagcgagttggtgccgagccggttggcgccgtgcacggacacgcaggccacctcgccggccgcgtacaggcccgggacgacggtggtgttgtccgacaggacctcgccctcgacgttggtcgggatgccgcccatggcgtagtgcgcggtgggctggatcgggatcgggtccgtgtagggctcgatgccgaggtaggtccgcgcgaactcggtgatgtcgggcagcttggcgtccagctgctccggcgggaggtgggtgaggtccaggtagacgtggtcgccctcgggaccgcagccgcggccctcgcggatctccgtgtagatggagcgggagacgacgtcgcgggaggcgaggtccttcatgacgggcgcgtacttctccatgaagcgctcgccgtccttgttgcgcaggatgccgccctcaccgcgggcgccctcggtgagcaggatgcccatgcgccagatgccggtcgggtggaactggaagaactccatgtcctccagcggcagcccgcgccggtacacggcggcctggccgtcaccggtcagggtgtgcgcgttggaggtcaccttgaagaacttgccggtaccgccggaggcgtagatcacggacttcgcctggaagacgtggatctcgccggtcgccagctcgtacgccaccacgccggccgacttcttgacgccgtcgacctcggtgatcagctggtccaggacgtagaactcgttgaagaactccacgccctccttgacgcagttctggtacagcgtctggaggatcatgtgaccggtgcggtcggccgcgtagcaggagcggcggaccggggcctcgccgtggttgcggctgtggccgccgaagcggcgctggtcgatcgtcccgtcgggcgtccggttgaacggcaggcccatcttctccaggtcgaggacggagtcgatggcctccttcgccaggatctcggcggcgtcctggtcgaccaggtagtcaccgcccttgaccgtgtcgaaggtgtgccactcccagttgtcctcctccacgttggccagcgcggcggccatgccgccctgcgcggcgcccgtgtgggagcgggtggggtagagcttggtcagcacggcggtgcggctgcgcttggtcgactcgatggcggcgcgcataccggcgccgccggcgccgacgatgacggtgtcgtacttgtggatcttcatgagtggattacctcagccccgtgcctagcggatgttcgggtcgaaggtgaagatcaccagcgtgcccagcaggatggtccacaccgtggcggtgtagagcaggcccttcagccacagccgcgtgttcgcgcgctccgcgtagtcgttgatgacggtacgcaggccgttgcagccgtgcagcatggccagccacagcatcagcaggtcccagacctgccaccagggcgaggcccagcgaccggcgacgaaggcgaagccgaccttggagacgccgccgtccaggacgagctggatcagcaggtggccgatgaccaggacgacgagcacgatgccggacagccgcatgaacagccagccgtacagctcgaagttgccccgggtcgacttcggggtcttcttggtgcgcttgcgcggggcctcgatgagcggcgccgggttgtcgacgttgtaggaggcgccctctacggggccgacgccggaagcggtggtttcagtggtggacatgcggcgtcagctcccgaagacgactcgagcggcgtggcccaggacggggtagatcgccccgagcatgagcacgacccagacgacgacgaccgtccagagcatctgcttctggtagcgggcgcccttggcccagaagtcgacggcgatgacacggagaccgttcagcgcgtggaagaggatggcggcgacgaggccgtactccaggcacgcgacgatcggggtcttgtacgtggccacgacgttgtcgtaggcctcgggagacacgcggacgagtgcggtgtccagcacatgaacgaacaggaagaagaagatgaggacgccggtgactcggtgagccacccaggaccacattccttcccggccgcggtacagcgttccagccggcacggaagaaccctccgggagcggggactagggccgcgccggcttcggtgtcggtcgggcccggccgggtacggtccaccggcccccagcatcgtagcgacgtgtgcgagcggtgctgacagcgggcctgccggtgtgatcaaagtggcactcaaaggagcacggacgggtgagcgggggcggtggccggacaggtgcgtgccctcacgcgccgactgcgggtgcgtcgtggctggttgcgcggtcgcggccctgggtggcgcgcagcagccgcctgcgtgccaggcgcctgagttcctccgccgtcaccacccgctcgtcctccggatcgttcgtcaatcgtgaccggatcgctgccaggaggtggtcgagggtctcggcgggggagagggggtcgaggcagatgacgaacgtgtgtccgaatctcgcctcgtaggccgcgtacgcggcgctcagggccgtggaggcggccaggtatatgtcctcgggcaggacgggcaggggttctgccgccagtgcctccgccagctcggccgccgccaggtcgtacgccgcctcgtcggccgccgccagcagggccggcaggtcggggtaggggcggtgggcggtgaggcgatgcgcccagcgcgggctgctcaggcaggccaggagggtgcggcgggcctggtcgggcggggcggtgttgaagtgctccagggtctgcgcgggcagcgtgggtcctcggcgtggaaatcgggcacgcccggtgacaggcgttcctgatgagtcggcaggggatggtgtgagatgtgccgccacgttaccgggagtgctccggacgtgtccggtcgatgcccggttttcactcggacgggagagtttgggaacggctcgtggacatcttcggggtgccgtggccttaggttggcggtgtgagtcagcacaggcggcgccgtgccccggcgcgcgagccgcggcacaggtggttattggtcggcggggcgttcgcggtcacggtcggcctcggcgccggtctcggcgtgtgggccaccggcggtgacgacggcggcgtcgcggacgtggcgagcccggcgacggacccggcctccgcgaccccgcccgcgcccaccccgacccggacctacccgctctcccgggcgccgcggaccattcccgcgg

SEQ ID NO: 211 - DNA, 627 bp, Unknown
  Kingdom: Bacteria, Phylum: Actinobacteria, Class: Actinobacteria, Order: Streptomycetales, Family: Streptomycetaceae, Genus: Streptomyces
ggcaacgacgccgtgcacgtgctcgccgcgctcaacggcggctgggaccacaccgcccgtcagatgcagaccaaggcccgtgccctgggagccatggacacctatgtcgtctcacccgacggctacgacgccgacggccaggtgtcctccgcctacgacctggccgtgttcgggcgggccggcctgcgcaacccggacttcgcccgctactgctccacggtggagacctccttccccggcaacgacggcagcacgttcgagatcgccaacaccaacaggctgctgaccggcgccgacggcgtgacgccgtacccgggactgatcggcatcaagaacggctacaccaccaacgcgggcaacacgctggtcgccgccgcccaccggggcgggcgcaccctcatcgtcaccgtgatgaaccctcaggagggcgagggcttcgaggtgtacgaggaggcgcgttcactgctcgactggggattcgacgccgccggacacgtcgatccggtcggttcgctcgacgggctgcgcccggtcgcgcacggcgcgcaggtcgtggttcccgcgccgccccgcgccgccgcgccggcacctgccgcgtccgacgactggtcgcagacgggcgcgatc

SEQ ID NO: 212 - DNA, 2617 bp, Unknown
  Kingdom: Bacteria, Phylum: Actinobacteria, Class: Actinobacteria, Order: Streptomycetales, Family: Streptomycetaceae, Genus: Streptomyces
acgcacacctgcaaccgcttcctgtggtggtgcacgtagcggttcgcgaacgtggcgacggcagccgccggcgtgggggccgccagggcccgtccggcggatcaagccctggccgcacacacagcggcgcagccgctcagcccgccccgtcgccgagcatccgccgcagcagatcccgcagcgcgcgccgctccgcgtcgctcagtcccgccagcggctcgcgcgcgaagcgcagtccctcgcgcaggtcccgcgcgacccggcgcccctcctccgtcgccgccgccagcttcacccgccggtcggccggatcgggccgccgctccgcgagcccgcgcgcctccaggcggtccacgatgcccgtcacgttcgacggctcgcacttcagcttctgcgccagcttccgcatcggcagcggttccacggccagcaggctcagcagccgtgcctgcggaccggtcagcgcgtgctcgcccgcggcctcctcgtagtccgcgtagaagcgggccacgacatcgccgatcagctcgacgacctccatggccagggcgtcgggacggcgggggtgcgggggagtggcggccatgcgtccagggtacccgcttacttgacaacctgaaatatgtaggcgcatggttgtttcaggtactgaagtattccgcccggccggacgggccgggcggggccgacgagaggcgcaccccgtgtccgacacccccacacttcccgccgtcagccgcgaatggcacctgctcagccgcccggtcggctggccgaagcccgaggacttcgccctggtcgagaccgagctgccgcagccgggcgagggccaggtcctcgtacggaacgagtacctctcggtggacccgtacatgcgcggccggatgagcgccgccaagtcctacgcggccccctacgggctgaacgagcccatgcagggcggggccgtcggcgaggtcgtcgtctcccgcgccgagggcatcgaggccggcgaccacgtcctgcacttcggcggctggcgcgagtacgcggccgtggacgccggccaggccgtacgggtcgaccccgacgccgcgccgctgtcgacgtacctcggcgtgctcggcatgaccggcctgaccgcctacgcggggctgctgcgcaccgcctccttcaaggagggcgacatcgtcttcgtctccggcgcggccggcgcggtcggcagccaggtcgggcagctcgcccggctcaagggcgcctcgcgggtcatcggctccgccgggtccgacgagaaggtcaagctcctcctcgacgagtacggcttcgacgccgccttcaactacaaggacggccccgtcgccgagcagctgcgcgccgccgcccccgacggcatcgacgtgtacttcgacaacgtcggcggcgaccacctggaggccgccatcggctccctgaaccggggtggccggatcgcgatctgcggcgccatctcggtctacaacaacaccgagcccgcccccggtccgaagaacatggcccggctgatccagacccgcggccggatcgagggcttcctcgtgggcgaccactacgacctccagccgcagttcgtgcgcgaggtcggcccgtgggtgcgctcgggggagctgaagtaccgcgagacggtcgtcgaaggggtggagaacacgctggaggcgttcctcggggtgctgcgcggcgccaacaccgggaaaatgatcgtcaagctctgacccgccgggcggcggggctgcccgccccggcgacggacccgatgggcgtctcggacccggtgggcgttccctggatttccgacatgcggtaacttcattccgaaaccgctgacgaccgtgggcgcgagtcgcggcggaccgaggaggaaacgcacgctatggccatccagcagtccgacgtccagtacaccgccgtcgccaccgccgagggcgggcgcgacggccgggtcgccaccgacgacggcaagatcgacgtcgtcgtgaacccgcccaaggagatgggcggcagcggcgccggcaccaaccccgagcagctgttcgccgccggctacagcgcctgcttccagggcgccctcggcgtcgtggcccgtcaggagggcgccgacatctccggctcgaccgtcaccgcgaaggtcggcatcggcaagaacgaggacggcttcggcatcatcgtcgagatctcggccgccattccgaacgtcgacgcggccaccgcgaagagcctggtggagaaggcgcaccaggtgtgcccctactccaaggccacccgcggcaacatcaccgtgacgctggcctgacccggtcgttgcccaaggcggcggccgcacctctggacgtggggtgcggccgccgccgtcgtatgccggcgggcgggccggtgcgctgccgccgctcgctacagtgaggccatgcgtgatctcggggcggggttcggatatctcctgaagggccagcggtggatggcccggcacgggagggcgtacggcttcggcctgctccccggcctgatcaccctcgtcctgtacgccgcggcgctcaccgcgctcgccctgtggggcaccgacgccgtcggcgaacggggtggcccagccgacggcgtcgatgcccca

SEQ ID NO: 213 - DNA, 18610 bp, Unknown
  Kingdom: Bacteria, Phylum: Actinobacteria, Class: Actinobacteria, Order: Streptomycetales, Family: Streptomycetaceae, Genus: Streptomyces
cgcccacgtgaacgccgcgagggcggtgtcccccatgtgctgcacgctcgcggcgttcacgtgggcgatgtcgtcatgggccgtgtggtagcgggcgacgccgcccatgaaggcgaggttgatcccgcgcatgccgccggcggccaggacggtgaggtcggtgtcgttggggagcaggctgtacagcgcgcccgcgaacgacgtggtcaccacgtgggtgtcggcgaccgcggcggtcagaccgcccttcatctggaacatcagggcagggcccgaaacgccgcgggcctccatgttgacgacggcgacccgatgcggatcgccggccgcccccgaatcgacgaacgcctgggcgccgagcaggccgggctcctcggcgtcggtgaacagcacatcgatgtcgttgcgcgcctgcggcagcgagcggagcgcacggacgatctccaggacggcggcgacattggagccgtcgtcactggcgccggggccggtgggcacggagtcgtagtgggccaccagcaggacccggccggtcggttccgagcccggtatgtgagcgaggatgttgctcaccctggcgagggccggatagccacccgccggcaggcgggacgcggtccgcgtctgcacggtgggccgggtgccgaggccgcgcagctcgcggacgaggtggtcacggacgtcagccgcggccgcggagcccgcggggtgcggaaccgcagcgatgtcgtggagccgggcgagggcgcgctgcgcggagaactccgtgtggggcgcggaggccggcctcggctgagggggacgcagggaccagacgctcgccgcggcgatcagcagcagcacgagcgccgtcgtgagcgacaccgcgcgccggtgccacgtgatgggcgagggcccgcgctgcgcggccgagggcggcggtgtctgctgctggatcgtcataggcgtcgctgacccgtcatcagagagcactgtcctgtccggggccatgatccggcagccttcgcgggcgcgagcactccccggtttcagggacgcctgcggcacagccggaccgcccggcccggacggggcccgtaccgcaagcgtccctccgacgtccgctccacggctgtgctgtgaaagggggacaggccgggccccgaggagacagctacggtgagagccgcttgccgccgacaaccgtgagcggtgagcgatcacagtggagaggggcccatgcggctgcggagtcagacggtcgagcagtgcgactcacccatcagctctgcctacgatctgctcgaagggcatgagtacgcggggaagctgctcgatctcgcgcaggcggcaccgcagtatccgccggccccggtggtgagcgagcacgtggcggacctcgtacgccgtggaggcggtagcgagtacaccgaggtgcccggaatcccgcggctgcgcgctgcgacggccgcggaactgagcgaggcgtacgcggggcgggtggcccccgagaacgtcgtcgtcaccgccgggtgcaaccaggcgttctcgctggtcgcttcggcgctggccgggccgggtgacgaggtcgtgctggcgctgccgtactacttcaaccacgacatgtggctccggttgaacggcatcgtgccggtctacctggagcccgacgaagacctggtgccccgcgcggcggacaccgaaccgctgatcaccgggcggacgcgcgcgatcgtcctcgtcacacccggaaacccgacgggcgtgacgatgcccccggaggagatcgccgagttcgcggcgctggccgcgcggcacggcatcgcactggtggtggacgagacgtaccgctcgttccgcagcaccgaccggcccgcgcacgacctcttcgcggacccggcctggacacggaccgtggtgagcctgcactcgttctcgaaggacctcgctgttcccggctaccgggtcggggccgtggtggcgtccgccgaactcaatcgtgaggtgtgcaagctcctggactgcgtggcggtctgcgccccgcggatcggtcaggaagcagcgtgggcgggattgacgcatgcccgtcagtggcgcatcgaccgcgcgcgcgaactcgcacgccagagggcttggctgggcgaggcgatggccgagcgcccgggcgggttcgaactgctgtcgtgcggcgggttcttcggctggatcaagcaccccttcgccgatcgccccacggcggacgtcgtgcgcgggctcgtccgcgaccacggtgtgctggtggtccccggcaccgcgttcctgccccaggaccggcagaccctgcgggtgagcgtcggcaacgccgatctggcggccatttccgaactcgcggcacgcctcagggacatgggagctgctgattgatcccgtcaggggcggaccggctgccggtgtcctggcttcacgtgacagtgcgagcagacggcgcaccggtagcttgcctctggcccgaactgccgacatccgatgagagacatgagtgaggcaccatgaatcccttcgacgatcccgacggcacctttctcgtactcgtgaacgacgaggagcagtactctctgtggcccgctgctctcgacgttccggccggctggagcatcagccatgaagcggatacgcgccaggggtgtctcgactacatcgaggcgacctggacggacctgaggccgcgcagcgcccgcctcgaaggcgtcggagccgacaggcaagcggcgcggcgcggcggagacgcttagtggacaccagcatcttcttcttctccgcggacgcggaagcgcaatcgggagcggaaggggaagcgggagaggccgtcgcggatcgctacgcgctggtgaaggcggtcgccgcccgcatcgacgacagcgccatgtgcgggctgtggacacccgaacggcacttcaacgtcttcggcggtctgtaccccaacccctcggtgctgggtgccgccctcgccgtgtcgaccagcagggtggcgatcagggcgggcagtgtggtgctgcccctgcacgatcccgtccgtgtcgccgaggaatggtcggtggtcgacaacctgtcggcgggacgcgcggagatcgccttctccagcggatggcacgccaacgatttcgtactggcaccggacgcctacgacgggcgaggcgcgtccctggacgatgccatggaccggttcgtacgactgtggcacgggggtgccgagaaacggaccgacggcaacggcgaccagatctcgatcaccacatatccgcgcccgcggcgatccgagattcccctgtggatgtccgggcagtccgatacgacgttcgtgcacgccgcgcggcgaggcatgggaatcgtcacgaacttcaccggaagacgcttcgacgacctggagcggagaatcgccctctaccgttccgagttcgtgccctccggccacaccccggaaccccgggtcgggctgatgctgcacacgtacgtcaacgacgatccggatgccgtcgcgaacgcgctcgactcgtcctacgacgcctacatccgccgccacctcgatctgcagttgcgcaacgaggccgccgaggtctcggcggccgatctggacgacatggtggccacggccaagggccggctgcggggcggcggcggacttgtcggcgacaaggccacctgtgccgagcgcatccgccgcttcggcggcatcggcgtcaccgagatcgcctgcctggtcgacttcggcatcgaccccgagctggtactcgagagcctcgacgatctcgacgacctcgcgtcatccgtcaaagagttgggggagtaatggaactgccactcgcgaagctcgaagaatggatgcggcgctactaccacgccgtcgaccacgacatcggcagcagcggagtgagggacctgaccgtcggcgagctgtgcgacatcgccggcttcgagctggccgaactggcggcgctcccgttccatgacagcgagcccctgggagggcgggatctgcgcgcggcgctggccgatcgctggaccggcggcgacagcgagcgcgtcatggtcacccatggatccagcgaggcgatctggctcgtcatgcagaccctggtgcgccccggcgacgatgtcatcgtggtggacccggcctaccagcaactccatgacatcgcagtggcccagggctgtcgactgcacaggtgggacctctcctgcgacgacggcttcgccgccgacacggaccggctccgggcactcgtggccgtacagcggccccgcatgatcgtggtcaacttcccgcacaacccgacgggtgtgaccatcacccgcgagcagcaggacgagctgatcgagatcgcggccgccgccggcgcatggctcgtatgggacaacgccttcggcgagatcacctacgaagccggcaacctgccgctgccgcacgaccgttacgagcgcagcctgtccttcggtacgttctccaagagctacggcctggcgggcatccgcaccggctggtgcctggcgccgcccgagctgctgacccggatggcatacctgcgcgactacgtggcgctctatgtctcaccggtgctcgagttcttcgcggaacgcgccgtccgcaacgcggaccgcatcgtcgcgatgcagcgcgcacatgccctgcagaaccgggaactcctgctcgcctgggcacgggagcgccccgaccgcgtccggctgacacctcccgccggcggggtcagcgcgctcgtcgaactgctcggcgtcaaggatgtgaccgaggtgtgccgcaggctcgccgaggagttccgcacgctgctgatccccggggagtgcttcggggacgcctaccgcaaccatgtccgcctcggcttcggcggcacccgtgccgaactcacagcaggactggccaacttggatctgcttctgaagccgtgagtccggcaggggctcccctgccggatccacgggccgacagctcacgtcctagtagatgacccggtcgtccgcggccgggcgccaggcccgcgagccgcggaggttgcgcgtgatgttcaggcgcttgagccagcggtcgcttccgtcgtagcgggcctggaaggaattgcggccgtgcaccgcacggaaattgtcgatgaaagcgacatcgcccggctgaagggcgacgcccttcatcttggattcgatctcgtcgcacagccccgtgtaagccgtgagcgagcgttcgctccagccctcggttttcatgtggtacgggtcgagaaccatgtaaggatcggtccggtcaccgaagagaaccggtcgcttgacggggttcgcgttccactcctcgatggtcttgaagctgccctcgcgcagccgccggatcgtgggatcgcccgtcgacgacgaattcacgggcaggtgcgagttgtcgggcatctgcgtgaaggccggctcgaagagcgcgtcgacgtccagagcggaccagtcgagatcacccgcgtcgcagaccgtcgtctcgacggcatcggggttcttcaggcacatcagggcgacgtagtcgccgcggcaggggtggaacgcgtcctcggtgtgccaggacaggtgctggaggctgttcgaccccagctcatagtgttcgtggcccttgatcggcaggacgtcatgcatgatccggccgtcctgctgggtcgcccagccgaacacgtcgcccagcaccgatgcgcacagcaggaagaagatctcgtagcgcagcgtgggcgaggcgacgtggctgccgcgccagtgccccggcgtcggtccggtctcctcctcgtccacctcgaagccggagaccaggcagagcgctgccggctcgcgcaaccggtggtcctggaggaactccacgagaccggccggcaaccgcgtggcaagcagcggagcgcggcgcagcagatccggatcctcgatggtggagtaccgggcagcgatgtcgctgagcagcggggcaacttccctgcggtcgtgctccgtcagcgtgagcttgttcatcgcacttccttctgccgcggcggttcgcggcgagtccatgaacacgtagagcacgcacaagcgtatgagcacgcgcggcggcggtggaggtgcccaatacaagggacaagtaatcagtggactcccaaaatagggtcaccagcgttgatcccgattcggaaatccgtgatatcggcagacgagggaatccgtgaccgcgaacctgaccttgatggaagtcgacgctctgaccgaccccgatggccgcctcaatctgacggatggacatgcgcgtctggcgttgacgccggagcaggcagccattgtcgcccgcatcccggagatgttcgcgatcgccaccagccgggcctttccggtcatcgaggaagcggcgcacaccgccttcctcggtgccatcggtcagcgctcggcaccgatcggcaccggccgcatcctcagctgctactcctcgacgctcgccacggacatcgtggcgcgggcactgccggcgggcgcgacggtcgccgtactgcatccgacgttcgacaacatcgccgacctcttccagacccggggtctgaaactggtcccgctgcaggaggaggcgctgctcgaccaggactggccgggaccgcccgtgagcgccgtcgtcatcaccatgccgaacaatccgacgggcctggtcacccccgagggccatctgcgctcgctggccgagcatgccgcgcggcacggccagacggtgatcgtcgacgccagcttccgcggccaggtgcgcgacgcgcagtacgacacctacgccgtgctcgatgccgccggcgcggactggatcatcatcgaggacaccggcaagctgtggccgatgcacgagctgaagatcgggatgctcgcctacagcgaacgcacgacgctcccgatcacccgtgccttctccgagtcgatgctggccgcctccccggtggtcctgcagctggtcgaggcactggcgggggactgggccgacggcgggtacgagcgcgcccgcgccctcgtcgagcgcaaccgcggcgcggtccgcgaggcgatcgaggcggtcggcacaggtctggccgaccccgactcccagatcagtgtggcgcgggtcgcgctgccggagggcggccccgactcctcgcagctctaccacgacctgagggcccgtggagcacatgtgctgccctgcgcccccttctactgggccgaccccgcgagcggcctgcgcagcatccgcatgtcgctcgcgcggccgtacgaggtcgtccacaccgcggccgcggccctggccgacgcctacgcggcccggaggtgagcggtgaccgccgcgacgatggacttcgagatctgccccacgagccggccccggcctgcggctgaacgcgacgcggtgctggaagaaccggggttcgggcagacgttcaccgatcacatggtgacgctgcgctggtccgccgagcgcggctggcacgacggacgcctcgaaccgtacggggcgttcacgctggagccggcgacctcggtcttccactacgggcaggcgctgttcgaggggatgaaggcgtaccggcaacccggcggggaggtcacgctgttccgtccgcacgcgaacgcggcacggttcaacgcgtcggcgcggcgcatggcgatgcccgaactgccgccggaggtcttcgtcaaggcggtcgaactgctggtggaccacgatcgcgcctgggtgccggaaggggccggccggagcctgtacctgcgccccttcatgatcgccacggacgcctcgctgggtttcacccatccgtcgaggacgttcctgttctgcgtgctcgcctcccccgccaccgcctacttcggcggcggaccgcccaggccgctgacggtctggctgtcgacgaacttcacgcgcgcggtccgcggcggcacgggcttcgccaagacggccggcaactacgcgggtgccttcgccgccggtctcgaggcgacggcccacgggtgcgaccaggtggtctggctggacgccatggagcaccggtgggccgaggagatgggaggaatgaacctgttcttcgtccacgtacagcgcggcggacgaccgcgcctgacgaccccgccgctgacgggcacgttgctgccgggcatcacgcgtgactgcctgctcaccctggcgccgaaactgggctacgacgcggtcgaggcacccgtctccatcgaccagtggcgcgaggaatgcgcgtcgggcgaactcaccgaggtgttcgcctgcggaacggcggcggtgatagcaccggtcggcaccgtgaagtcggagagcgggcaatggacggtcgccgacggtgagccggggccggtgacacttcggctgcgccgcgagctgctgggcatccagcacggctcggcgcccgacccggagggctggatccatcatgtccgctgaactcagggcccgcgtcgacgagccgcgcgctctccacgagatggtcatcgagcaggcccgccgcacaccggacgcgatcgcggtcagccacggggatctgcggatcacctacggagaactcgatacgcgatcggcggcactggcgcggcgcctgcgcagcgccggggtggcgcgcggcgacatcgtcgtggtgctgctggaccggtcgatcgacctgatcgtggcgttgacggccgtgctgcgcgccggcgcggcctacctctacctggacccggccgagcccaccggccagcgggagcggatcctggccgacacccgcgccggacacgccgtcaccaacagcgattacgaccagcagatcgacctgccggccgtggtgcgcatcgacgacatggagcccgaggcgtcctcgtccgtcccggccgtcgaggacggcgggactcccgtggacagcccggcgtacgtctgctacacctccggatccacgggggaccccaagggcgtggtcgtctcgcaccgggcggtgttccggctcgtccacgacccctcgtggatcgatgtccgcgacgacgacgtgttcttccagctcacccgcgtcgggttcgacgtgtccaccttcgagatctggatgcccctggtgcgcgggctgaggctcgccctgggacccccgctgcacgccaacctcgatctcgccgacctggcccaggcgatgcgcgccgagggcgtcaccgtgctgtggctgacgtcgggcctgttccaccagatggtgatgcaccacctggacggcctcgcggggatccggcatctgctcgccggcggagacgtgctctcccccgcccacgtcagccgcgtgatgagcgcctaccccggcatgctcttcaccaacggctacggaccgaccgagaacaccaccttcagcacctgctggaccacccgcgagccgggctcggcacccacggtgcccatcggaatcccgatcgacggcagttccgccgtggtccgcggcgatgacctgcaacccgtggccgacggggaggtcggcgaactgtgggtgggcggcagcggggtggccaacggatacctgcaccgaccggcggagacggcggtgcgcttcgtcgcggatctcgacccggacgcggcaccgggcagccggatgtaccggaccggcgacctggcgcggtggcgggacgacggcaccctcgaattcctcggccgggtggaccgccagctgaagatccgcggctaccgcgtggagccgagcacggtggagacggagatcctgcgcctgcccggtgtcgcgcaggccgcggtggtgccccggacctacggagcgagtgacacgcgtctggtcgcctacgtggcggccggggaccgcgacccgtcgacctgggcggcgttcagcgcctccttgcgggagcagctgcaggcgtcgctgccggcccacctggtcccgtgggcgatcgtcatgcaccccgagctgtcgctcaacccgaacgggaaggtcgaccgttcagcgctgccgtcggcgaagatcccgcggaacgtgtggaacgagtacgtggcgcccagggaccccgtcgaggcccggttggcggacatctggagcgagacgctggacatcgagcaggtcggagtcgaggacaacttcttcgacctgggcggacattccctgctcgccgccgagctgctggccgctctgccggcggagttcgactcgacactgcccgcccgcacgctgtacctgcgaccgacgatcgccgaactcgcgaaggaactccgcggctgcgcggcggagtcgaaccctgagaggaccacggatgcatcggctcagtaggaacgaggccgactcgtccgccgccccggccgcgggctgccccgtcggtgtggccgccgccggcctggcgcactccgcggccttcaccgagctgggtttccgtgcggtctgggcgcggatgcgcgaggaggaccacctggagtggacgcaggtggacgagcacaacggcttctggtcggtggtgacgtacgccgatgtcgagagggtgctgcgggatgccgccaccttcacctccgagcgcggcaccatgatcaatatcctgggggtcgaggacccggccggcgggcggcagatcgcggccaccgatccgccgcgtcacaccgtcatgcgggcacgcctgcagaaggcgctcgccatcaagtccatcgagaagcagcagagcatgatcagccgcctggtcgacgaggcgctggcaccgctggccgccgacggcggcttcgacttcgcggaggcgatgctggccctgccggtggccatcggcggcgagtccatgggactgccccgtgcggactggccgcggctgggagaactcctggtcgcctcgatcgccgccgacgatcccgcctaccagaacgacggcggcacccaggcgacgctggacgccgcccatcgtgaactgttcgcgtacttccaggacatctaccgcgagcggcgccgcaacctcggagacgacctcatcagcgtgctgatcaccaccgaggtggacggacgcaccatgacccccggtgaggtcatgtcgaactgctacagcgtgcttctcggagcggtcgtcacgacgccgcacgcccccaactacatgatgaccgaacacatcgccgacggaaccctcggccggtgggccgaggacctcaccgccaccccgaccgccgtggaggaagcgctgcgactgggctcacccgtcagccacttcatgcggtacgcggtcgacaacgtggtgatccgcgggacccgcatacgggcgggcgacgcggtggtcagctggctcggcgcggcgaaccgggacggcacggtgttcccggacccggagcgcttcgacccgcgccggcgcccgaacaagcacctggccttcgggatcggcccgcactactgcgtggggcacaccgtcgcgcgggtcacgctgcgcaccttgttcgacgagctgctgacgcggttcacggcgttcgagcccgccggtgagccacagcgcctgcgctccaacttcgtctccggctaccggaagctgccgatcaccgcgtcgcctgtccacacaggctgagcccgaacgtcggaagggttgcccatgtccttgccccgacctcccctgcgggggcgctggctgccccgtgaaccgtcgcggaccgcgcgcgcacgggtcttcctcattccctattcgggttgcggcgcgagcatgtaccggcagtggcccgcagagcgggacggcgtggagttcctgccggtcgagcttccggggcacgagtcgcggttcgccgagcccaacttcacctcctacgcggagctgggcgagcagatgaccgaagggctcgcgccctacctcgacgtgccgttcggtttcttcggccactgcgggtcggccctcgcggcgtacgagacctcggtgcaactggtcaccaggggcgtggcgactcctgcggcgctgttcgtctcctccgaggtcgccccccaggacggccccgccggcaggttcctcgcgatggacgaccatgagctgggcgccgagctggagaagctgatccgcgaactgggcggcacgccgaccgccgaactgatcgagctgtacctcgaggtactgcgcgccgacgtggagaccaacaagcggtacgtggtgcccgaaccgttccggctgccgtgcccggtcatcgccgtcggctggacgggggacgaggagatcccgtacgccaccatgggcggctggccgaggtgcggggagacgaagtcggtgctgctggagggcggccaccaccggttcatcgaggcgccgtccgacctgctcgacctgatgggcgccgcgctcggggtcacgtcatgagcggcaccgcgggcacgccggcggagcgggagcggcgctggctcaagcggttcgccccacccctgccggccggtacgaccaggctcctgtgcttccactacgccgggtcgagcgcgggcatcttccgccactggcccgcgctgcttgcctcggtggaggtcatcggcgtacagcttcccgggcgtgcggaccggttcctggaagaacgccacacccggatggaaccgctggtggaggagttgatcgaggtgctgcggccgtctctggagcagccgttcgcctgctacggatccagcatgggcgcccgggtggcctgggcgctggcgcacgccctgcgcgaacgtgaactgccccagccccgcgcgctgttcgtggccgcgagcggcgggccggccctcgacgacgggagctggctgtgggaagaccgcgacgacggactggaaggctacgtacgggagatgggaggcaccccgccctccgtgctcgccgaagcgagtctgctggccgctctgctgccggtactcgaagcggacctgacggtgctgagcacgcatgacttccacccggaagtaccgctcgacataccgatccacgccttcgccgcgcagcacgacacggaggcgggcccggaccggatgcgggcatggcgcgacgagacgacggcgtccttctcgatggacgttctgccgtgcgggcacttcttcgacaccgcatccgaggcaaaggtgatcgacgccatcggtgaaatcctcggtgacccgccggcgcccccttcgccctcgcctcacccgcggggcacgcagtcacggccgatgaacgaaggagtggcgaagtgagcgacctggaatcgcgcatcgccgcactgccgcccgagcagcgggccgtactcgaggcccgactggccgaccgtgcggccgctcgcgggcacagtgctgcgggccggatccggccccgcgaccggtccactcccactccgctgggcatcgcccagcaccgggagtgggcggtcgggcagatccggtcggtcaacaacatcaccggcgccctgaggctggaaggcagcctcgacctgaccctgctgagcagcgtgctcaccgggatcgtcgagcgccacgaggtgctgcgcacgacgatcggcctcggcgcggacggaacaccggcccaggtcgtccaggcggtgacaccggtgccgacgccggtggtggacctgacgcacctgccgccggcacggcaggacgacgaggtcacgcggctcgcgcgacatgacatgacgcgccccttcgaccccgctgacccgcaacgcctgcgggtgacgctgctcaggctggagccggaggcgcatgtggcgctgttcgcggccgaccacgcggcctcggacgcctggtcgctggcgatcatcgtcgaggagctggccgcgatgttccgcagccgcctcggcggcgaccacgcggctcccccgccgctcgacatccagttcggggacttcgccgcgtggcagcgcgaggagcgcaccgaggagcgggaagagcgcgaagtccagtactggcgcgagcagttggccggcatgcctgtcgagtcggcactgccggtcgaccgccccactccggcgcgtccgacgtatgcgggcggcgtgtacgacatgcgccttcccggggagctggccgccggcgtccagcggttcggcgagaaggagggcgcctcgctgttcggcgtgctgctggccgcgtgctccgtgctgctcaaccggtactcgggcgaggacgacgtggtcgtcggctcgctcgtgtcgggacgcacccgcgcggagacccagcgcctcatcggcagcttcgccaaccccctgccgctgcgggtgcggatgcacgatgacctgacgctgcgtcaggtcgtacgggaggcacacgccacactggcgggcgcgctggaccaccaggacctccccttcgagcgcgtcgccgagggcctcgacctcggtcgtgagtcgacccgcacctcgttcagcagggtatggatcaacgtgctcaccgtgcccgacatgacactggaactgccgggactgcgcatcacaccggtgtcgatcgccccggccaagacctcggtcgacctcaccctcaacgtcacgccgaacgccggcacgctgcagatccagtggcactacatgtccgaactcttcgacgccgccacggtcgagctgctggccgaacagttccagcgggtgctccaccagctcgtcaccgcacccgacacacccgtctgggccgtccagctcagtgccggcgccgcgcagagcgagccggctcaaccgcccgaggtgagcggattcatcgagcagttccagcgccgggtgcggctcgccccctacgccccggcggtgatctgggactccgtcgcgaccagttacacggaactcaaccgccgcgcgaaccggctcgcccaccggctgcgcgccgcgggagtccgccgcgacgcccgcgtcggcatcctggtcgaccgctcgcccgccctggcagtggcgatcctggcggtcctcaaggcacacggcgcgtacgtccccgtcgaccccacgtacccgcccgaacgcatggcgttcctgcttgccgacgcgggcgtgcgcgtactggtcaccgaggaactgctggcggacaagccgggctccggcgcgtggaccaccgtgctcatggacgcctccgacgaaggcgcgggtgacgaggaggatctcgacctgccggatccggcatcggcggcgtacgtcgtccacacgtcgggttccaccggccgtcccaagggcgccgtgatcgaacaccggtcgctcgcggtgttcgcacgtgatgtggtggaccggctcggcctgggcaccggcgaccggttcctgcagttcgcctcgccgggcttcgacgtactcgccgaagagctgttcccgacctggctcgccggcggcgccgtggtgatgccgacgaaacacctgatcagcggggaggacgacctcgccgcgctggtcgagcgggagcatgtcaccgtcatggagctgcccacggcctactggcacgagtgggcgcgcgagatcgaccggctcggcgtggaactccccagacacctgcgcctggtgatcatcggcggcgagcgggtactgcccgagcgcatcgccctgtggcggcagcgtacccgcgtcccactcgcccacgtgtacggcctcaccgagacgacggtcagttccaccttcttcaggctggaccccgacgacccggagacgaactggccgaacctgccgatcggcaccccgctgccctcggccgacctgcgcatcctcgaccggcggatgcggccggtcccggagggcggcatcggcgagctctacatcggcggtgtcagcctggcccgcggctacctggggcgcccgggcctcaccgcacagcgcttcgtcgcggacccggcccggccgggcgagcgggtctaccgcaccggtgacctggtccgccgccgcaccgacggcaacctcgaattccactcccgggtggacacgcaggtcaagatccgcggtttccgcgtcgagcccaccgaggtcgagtcggccctcatcggccaccccggcgtcgcggaggtcgtggtgagcgcccatgagcccgccccgggagaccgccggctggtcgcccatgtggtgccgtcggccggcatggcgggtgtggccgccggcctgcgtgacttcctcctcgaacgccttccctcctacctcgtcccctcggcgttcgtcgagatggaggagctgccgctcaacgcgaacggcaagatcgaccgggggcgcctgcccgcccccagccgcgccgacgcggcgagcggaacaggtttccgcgctcccgggtcggcgacggaacaggcgctggccacgatcgtcgccggtgtggtgggtgtcgcgcagatcggcgtcgacgacaacttcttcgaggtcggcggcgactcgatcctcgccatccaggtggtcgcccaggcgcagcaggcgggactgcggctgaccccgtacgacctcttcgcgaacccgtcggtcgcccagctcgccgtggtcgtcgaggccggccgcaccatcgacgccgagcaggcggacgtcacgggcccggcacccctcgcaccgacccagtacgcgttctgcacggcggacttgaccgcacccgcgcactcgaacctctcggtgctgctggacctggccgtcgaggtcgacccggaggtgctgcgcgcggccgtcgaagcggtgatcgggcaccatgacgggctgcgccagcgactgctgctcgccggggcccggacccggtcgcgcatcgccccgcgcggtgacgagacgccgttcgccttctacgacttctccggtgaccgggatccggatccgcggaccaccgaggtctgtgcgcagttgcagcgcagcctcgatccggcggtcgggccgatgatcagggtcgcgctgctgcgacccggtcaggggcgggcggaccggctggccgtggtggcccaccggctggtggccgacacggcgtccatgaggatcctcctggaggacctggagaccgcggtggtgcagctgtcggccggtgagccgctgcggttcctgccgaagaccacctcctggcagtcgtggacgcgcaggctcgcctcctacgcgtcatcggagtccgtacagggccaacgcccctactggaccgaggtggtggaaggaggcctcggcgcggagcggcgggggcggcttcctgaggatcacccggtcgagcacggtcacgacaccgaagcaggctcccggaccgccaccgcgcgcctcgatccggccgcgaccgcgacgctgctcgcggcgcccgagcggctggcctgcacggtcgaggaactgctgctggcggcgctggcccgcacactcggggagtggaccggcgccgagcgccacctcatcgaactcgtccgccacgaccgggcgcagctcttcgacgacgtcgacgtgacgcgtaccgtcggctggttcagccccgcacacccgctgctcctgcacgctgccggggaggagacgctccgcaccgtcaaggagaccctgcgggccgtgcccgccggcgggaccggctggcaactgcttcgccaggggcgcgacccgctggacgcggcgccggtcgacctctcgttcgtctacacgggcaaggccatggagcccgcgtccgggaccttcgccgtcgcggcggagaccatcggcggcgaccgcagcccgtccgagccgcggccccatcccctccaggtgcgcgccggcgtgcgaggcggtgaactcgtcgtcgcctgggagtacagcgagctgcggcacgacgccgcgaccgtggagcgcctcggcctgagccacctctctcacgtccgctcgctgatcggcgcggtggccgcggacggcgcttcggcggacttcccgctcgcgcgcgtcgaccgggcccagctcgacggcctgctgggcaggctcgccgagaggcaggccgaatgagcgcggaggacgtggaggacgtctacgagctgtcaccgctgcagcagggcatgctgctgcacagcctctacgacggtgactccgacacgtacctggcgcagcacagtttcgctgtcgacgggcgactggacgcacgggcgctggagaccgcctggcagcagaccgtccgcgcgcaccccgccctgcgcacgtccttccactgggagggcatggacacgcccctgcaggtcgtgcaccgccatgtacccatcgagctgcgccgccacgactggtccggcctggacgcggccgtgcaggacgagaaggcggagcagctgctcgcggccgagcgggcggcgggcttcgacccggctgaggcacccctgctccgcctcgacctggtgtgcctgagcaccgagcggcacctcgtggtgtggacccaccacatgctgccggtcgacggctggtcggtgccgctggtcatcggggaggtcgtcggccgctacctcagcctcaccaccgggtcaccgccgccggcacccgctccgccctaccgtgactacatcgcgtggctccagcagcaggacctgggcgcggcacgggagttctgggccgacaccctcgggggcgctgccgggttcggcaagctgggtttgctgcggccgagtgccccggacggtaccccctcggtcatcgacgagcacaacctcgcgctgggcgaggagctgagtgccgcgctgcggcggaccgccgcccggcacggtgtcacgccgggcacgctgatgctggcggcgtgggccctcgtggtggagtgcttcagcggaggtccggacgtacggttcggggtcgcctgctcgggccggcccg

SEQ ID NO: 214 - DNA, 8103 bp, Unknown
  Kingdom: Bacteria, Phylum: Actinobacteria, Class: Actinobacteria, Order: Streptomycetales, Family: Streptomycetaceae, Genus: Streptomyces
  misc_feature (7676)..(7677): n is a, c, g, or t
acgaccggccggtcgtgctccgtgcccagccggcacaccgtgcccgtggccagctggaacagggccccggaggacggaggcagaccgaggcgccgggcggtgagcacgcgcaggaaatgcccgtgcgccaccagcagcacgaccccctcggtgttggcgaacgcggcgtccaccttggccagcatccggtcggcacgctccccgacctgctcgacgctctccccgggatgctccggcggtcccggcacgaccccgtcggtgaacaggaaccagcccggccgggagcgctggatctcgggggtcgtgatgccctcgtagccgccgtagtcccactcccgcaggtccgggtcgacacgggcgtccgtgatcccgatcagctcggccgtctcccgccgcttcagcgccaccgcacgctccggctggccctggacggacagcgtggccagcctgccgtcgccccggtccagcctgatcggaccgcagctggtgtccatgcggaccgcggtcagtcccggcccggcggacagcgaacgcttcaccggcacgtccagccggtccgcgagccacatcgccagcagttcgcagctcgggttgaactcctcaccctccacctcgaccgaacggacctcgcaggtcacctggtcgagcgcggcggccagcatggaacgccacggcgtgatccgcgtccacgccagatccgtgtcgcccggggtgtacgcctcggcccgcgcggccagttcccgcaccggctcctcgcaggcgtaggcgtcggtgacccggcgttgcgccagcgcgccgagggggtcctcggccggggccagcgggccgttcaccggccaccagacgacgaccggcgcgtccggcagcagcagcggcagcaccaccgactgggcgtggtcgcagacctcgccgtacaaccgcagcacgaccgtctcgccggtgccggcctccgcgcccacccgtacctcggcgtccaggcgtgaggacgtgcggtcgcgcagggtgcgcgagacgcgccggatcacgaccagcgtgcgcgaggggtgctcgcgggaggcgtcaccggcggccttgagggcgtcgtaggcgttctcctcgtcggtgacgatgacgagggtgagcaccatgcccacggcgggcgtgccgatcgcccggcggccctgcacgagcgccttgttgatcttcccggcggtggtgccggtcaggtctatcttcatggccggcgccagctccgtccgtctcgtgcgagcatctcgtccgcctcgtccggcccccacgtcccggacgcgtactgcgcgggcctgccgtgggtgtcccagtactgctcgatcgggtcgaggatcttccaggacagctcgacctcctccgtgcgcgggaagaggttggagtcgccgagcagcacgtccaggatgagccgctcgtacgcctccgggctggactcggtgaaggactcgccgtaggcgaagtccatcgagacgtcccggatctccatcgacgtgcccggcaccttcgagccgaaccgcacggtcacgccctcgtcgggctggacgcggatgacgaccgcgttctggcccagctcctcggtggccgtggtgtcgaagggcgagtgcggcgcgcgctggaagaccaccgcgatctcggtgaccctgcggcccaggcgcttgccggtgcgcaggtagaaggggacgcccgcccagcggcggttgtcgatctccagcttgacggccgcgtaggtgtcggtcttcgacttcttgtcgatgccgtcctcttcgaggtagccgatgaccttctcgccgccctgccagccggccgcgtactgtccgcggacggtggtcgcgcccaggtcaccgggcagccggacggcgccgaggaccttctccttctccgcggccagcgcgtccgctccgaaggaggcgggctcctccatcgcggtgagcgccatcagctggagcaggtggttctggatgacgtcacgggcggcgccgatgccgtcgtagtagccggcccggccgccgatgccgatgtcctcggccatggtgatctgcacgtggtccacgaaggaccggttccagatcggttcgaacatggtgttggcgaagcggagcgccaggatgttctggacggtctccttgcccaggtagtggtcgatgcggaagacctggtccggggcgaagacctcgtggacgaccttgttcagctcctcggccgacgccaggtcgtgtccgaacggcttctcgatgaccgcgcgccgccaggagccgccggtctggtcggccaggccgtgcttcttcagctgctggatgacgaccgggaaggacttcggcgggaccgagaggtagaaggcgaagttgccgcccgtgccctgtgccttgtccagctcctcgatggtgccgcgcagccgttcgaacgcatcgtcgtcgtcgaaggtgccctgcacgaaccgcatgccctggctgagctgctgccagacctcctcgcggaacggcgtgcgggagtgctccttgacggcgtcgtgcacgacctgggcgaagtcctcgtgctcccagtcgcgccgggcgaagccgaccagcgagaagcccggcggcagcagaccccggttggcgaggtcgtacacggcgggcatcagcttcttgcgcgacaggtcgcccgtcacgccgaagatgaccaggcccgacggccccgcgatacgcgggagccgtcggtcggcggggtcacgcagcgggttaccgctggacaaggtctcagccctccgcgggggcgaggcgctccagctccgcctcggtcgacttcagcaggtcgttccaggaggactcgaacttctcgacgccctcgtcctccaggacctggaccacgtcgtcgtaggagatcccgatcttctccagcgcgtcgaggtcggcacgggcctgctcgtaggtgccgcgcacggcgtcgccgcggatctcgccgtggtcctcggtggcctccagggtggcctccggcatggtgttgaccgtgttcggcgccaccagctcctcgacgtacatggtgtccttgtacgccttgtccttcacaccggtggaggcccacagcggacgctgcttgttcgcgcccgcgttctccagcacgctccagcggtccgaggagaagacctcctcgtacgcctggtaggcaaggcgcgcgttggccacgcccgccttgccgcgcagcgccttggcctcggcggtgcccatctcgtcgatgcgccggtcgatctcggtgtcgacgcgggagacgaagaacgacgccaccgagtggatcttggacaggtccaggccgcgctccttggccttctccaggccggtcaggtaggcgtccatgaccgcgcggtagcgctccagggagaagatcagcgtgacgttgacgctgatgccgttgccgatggtctcggcgatggccggcagacccgccttggtggccgggatcttgatgagcgtgttcggacggtccaccagccaggccagctggcgggcctcggcgaccgtcgccttggtgttgtgcgccaggcgcgggtcgacctcgatggagacccggccgtcctggccgtcggtggcgtcgaagaccgggcgcaggatgtcggcggcgtcgcggacgtccgccgtggtgatcatgcggatggcctcttcgacggtgacccggcgggcggcgaggtcggagacctgctggttgtagccgtcgccctgcgagatcgccttctggaagatcgtcgggttggtggtgacgcccacgacgtgctgctggtcgatcagctcggcgaggttgccggacgtgatccgcttgcgcgacaggtcgtccagccagatcgcgacgccttcatcggagaggcgcttgagtgcgtctgtcatggaaattgcatctcctacgtgtcgtatatgagcgtcagcgctgggcggcggcgagggattcccgggccttggcggccacgttctcggcggtgaaaccgaattcgcggaacagcaccttggcgtcggcggaagcaccgaagtgctccagggacacaatgcgtccggcgtccccgacgtacttgtaccagggcagggcgacaccggcctcgaccgcgacgcgcgcccgcacggccggaggcagcacgctgtcccggtacccctggtcctgctcctcgaaccactcgacgcacggcatggacaccacgcgcgtgggaacgccgtcggcctgcagctgctcgcgcgcctcgacggccacgtgcacctccgagccggtggcgatcaggatcacctgcggctcaccgccctcggcctcgaacaggacgtagccgccgcgcgcggtgtcgtcgtccggctcgtacgtcggcacgccctggcgggtgagcgccagaccgtgcggggcgcccttgccgtactccttggtccagcggcgctggatctcggcccaggcgatcgcggtctcgttggcgtcggccgggcggaccacgttcaggcccgggatggcgcgcagcgaggcgaggtgctcgacgggctggtgggtggggccgtcctcgcccaggccgatggagtcgtgcgtccacacgtacgtcaccggcaggtgcatcagcgcggacagccggaccgcgttgcgcatgtagtcggagaacaccaggaaggtgccgccgtacacgcgggtgttgccgtgcagcgtgatgccgttcagctcggcgcccatggcgtgctcgcggatgccgaagtggatcgtgcggccgtaggggttcgcctccggcagcgggttgcccgccggcaggaacgacgacgtcttgtcgatggtggtgttgttcgagccggccaggtcggcggagccgccccacagctcgggcagcacctcgccgagcgcctggagcaccttgccggaggcggcccgggtggccacgctcttgcccgcctcgaacaccgggatcttctcggcccagccggccggcagctcggcggcggcgatgcggtcgaactcggcggcccgctccgtgttcgcctcacgccaggcctggaaggacttctcccaggtggccttcgcctgccggccgcgctccagcgcctgccgggtgtggccgatgacctcgtcggccacgtcgaagtgcttgccggggtcgaagccgaggacgcgcttggtggccgcgacctcgtcctcgcccagcgccgagccgtgcgcggcctcggtgttctgcgcgtgcggagcgggccaggcgatgatcgagcgcatcgcgatgaaggagggccggtcggtgaccgccttggcctcctggatcgcggcgtagatggcctgcgggtccaggtcgccgtcggccttgggctccacgcgctgcacgtgccagccgtaggcctcgtaccgcttggcggtgtcctcggagacggccgtctcggtgtcgccctcgatcgagatgtggttgtcgtcccacagcaggaccaggttgccgagcttctggtgaccggcgagcgaggacgcctcggcggagatgccctcctggaggcagccgtcaccggcgatgcagtagatgaagtggtcgaacggggactcgcctgcgggggcctccgggtcgaacaggccgcgctcgtagcgggcggccatcgccatgcccacggcgttggcaacgccctggcccagcgggccggtcgtggtctccacaccggtcgtgtgcccgtactccgggtggcccggcgtcttggaaccccaggtgcggaaggactccaggtcctccagctccaggccgaacccggccaggtacagctgggtgtagagggtcagggaggagtgaccggcggacagcacgaagcggtcgcgccccacccactgcgggtccgccgggtcgtgccgcatcaccttctggaacagggtgtaggcggcaggagccaggctcatcgccgtacccggatggccgttgccgaccttctgtacggcatcggcggccaggacacgcgcggtgtccaccgcgcgctggtccaactcggtccactcgaggtctgtggtggtcggcttggtgctcacccttgttcagggctcctctccacatgtcggatgccggcgcgtgtgtccacacaccggctgccggcgttctggcgtcggccggccgtcgttgagcctacccccgtaaagacgtgcattttttcgagtcattcaagactgccgggactccgcgaaatccgcctcccgacgggctcctgcccttattcggcaagtgaatacgggggcgctcatccgatcgctcattcgagccgtcgtgcgcccgtcggaaaccctttccgtacgtgacgccggccggtccccgcgatcttctccgggcggcggtcgcgggggcggtgccaacacgaccccacccccgcgaatgtccgggtctgggcaacgtctacagtggcgtggtacgcgcgagtctttaccctgtgttcacaggggcgggctcgctgggagtctctgtcaggggtgtgcgtgacggccgtcgaatcccgtccagcgggggtactcggtggtgcaggccagagcccgagccaccggccgttcggggcccgtgtcaaggcgttcgtggcgctgaccaagccgcggatcatcgagctgctgctgatcaccaccgttccggtgatgttcctggcgcagcagggtgtgcccgacctgaagcgggtgctgctcacctgcgtcggcggctacctgtccgcgggcggcgccaacgcgctcaacatgtacatcgaccgtgacatcgacgcgctcatggaccgcacctcgcagcgcccgctggtcaccggaatggtcagcccgcgcgagtgcctcgccttcggcatctccctggcggtcgtctccacgctgctgttcggtctcaccgtcaactggctgtcggcgtggctgtcgctcggagcgctcctcttctacgtcgtcgtctacacgatgatcctcaaacggcgtacgtcgcagaacatcgtctggggcggcatcgcgggctgcctgccggtgctcatcggctggtcctcggtcacgaactccatgtcgtgggcgccggtcatcctcttcctcgtcatgttcttctggacgccgccgcactactggccgctgtccatgaaggtcaaggaggactacgcgcgcgtgggtgtgccgatgctcccggtgatcgcctccaacaaggtggtcgcccggcagatcgtgatctacagctgggtgatggtcctcgtctcgctgctgctcaccccgctcggctacacgggctggttctacacggtggtcgccctgctggccggcggcttctggctgtgggaggcgcacgggctgcagaaccgcgccaaggccgaggtgaccggcgcgaagctcaaggagatgcgcctgttccactggtcgatcacctatgtgtcgatcctcttcgtcgcggtcgcggtggaccccttcctgcgctgacatcggcagacgccgcccaccgggcggggcgcgtggtcaaggccacgtaccccgcccgtcgccgtacggtctacccgtcggtagcatcctggccatggcagacacgcagcaggttgaccccaaggccgagcgcaaggcggcccgcctcgcccagcggatcggctccttctccaaggcgcacggcggggccgagggacaggtcgcgtacatcgggcagcgcggcgcccggatcgtcctcgtcggcgaggacggcgcctggggcgacatcgtggcccccacgtacgccatcgccgagcaggccgtgnntccttcgacggggagttcgccgccaaggtgaagaccggcccgtacgagtggacgcggatggccggcatccagctcggcggcccggccaacggctgaacaaagccgcggggcgagcaacacctgagagccggttcacccgttaggaccttacggaggatgtggtccagccgagggagaccggatgatcgaaacgccgtccctcgtggaccagtactgccacggcgtcctgcggaccgagctgggcctcggcaccttcgaggcccagctggcccgcaccgagggcccgcccgcgccgggcaccaccctcttcgacacccagaccggtttcgccgtacgccgctggtgtcctccgctgctcggcctggagccgcactgcccgccggcccgctacctggcccggcgccgcgagctgggcgtcctggaggc

SEQ ID NO: 215 - DNA, 1505 bp, Unknown
  Kingdom: Bacteria, Phylum: Actinobacteria, Class: Actinobacteria, Order: Streptomycetales, Family: Streptomycetaceae, Genus: Streptomyces
gggccgggccggccgccgggcgggagtggcggccgcccggtccccgggtggtcgtggcgggtcaggagcgggggcgccgcgggtggcgggccgagccgtccgggtccgggtccacgcgttggacgcgggcacgtcgtacgacccccggtcccacttctgcggccttgcggaccagcgcgggcccgtcccagtcggtgggccagccgtgccacagccgcagcctgccgtccacgaagaccgcggtgatctggtcgcggccggcgagccggaccagttcccacgacaggtcgtaggacggggtgagttcgggcacccggaggtcgacgagcaggaagtcggcggccttgccgacggcgatctcccccgtcaccttgccgaggccgagcgcgtcggcgctcagggcggtggcgtgggcgagccacacgctgccggcaccgcacgaggagtcacccgccatcaggccgtaggtcaggcgctgggcgctctccgcggcgtcgaccagccggaagccgtcgccgcgggtgccgtcggtgccggtgccgaagcggatgcccagggcctgccacatcagggcctgtgcgacggcgttgcccttccaggcgctggccaccgggttgtagctgaccgcggcgccggtgtcggcgagcatgcgcatctcgtcgggggtgagcagggtggcgtgggcgccgagggtgtgcgcgttgagggcgccgatgtggtgcaggtaggacaccgggcggcggcccacactcttgagtgagcgttccacggcggccaggtgctcgttgacgtggacctggaagaccgcgccggcgtccgcgcacaggtcggcggtcttcttcagcacctcggcggtggcatcctcggggacgggtatcgccagcgaggggtggatcaaccgggaactgtggaagcgctccaggtgttccttgccgcctttcccgtcggagacgaccttggacagcacgcagcgcagccccgcctcctcggccgcctgggcgatgacgcccacgtcgacgggtgcgcgggtgccggcgtcggcggcggtggtgaacccaccgcgcagcgcctccagggccgcgagcttcgccgagaggtgggcggtctcctcgtccagggcgtgttccagcggctcccagacggtcttgaagatctccgacggctgcccgaacgcctgggccttgccgaagctctgcgtcaggtggtggtgggagtccacgaagcctggcatgagcagatggcccgtcagccgcaccgtgcgggcgtcgcggtgcgcgtcggtgagccggcggaccggtccgacggcccggaaggtgccgtcctggacgagcaccgcgcggtccgtgaccggcccttcggccagcaggacgacgtccggcacgagcagcagccgctcggcgcggaagtcctccggtccgggagtgccatgaccaccgtggccgccgtgagcgccgtgagcgtcctgactggcgcgtccggcggcagccgccggacgcgccagtcag

SEQ ID NO: 216 - DNA, 2588 bp, Unknown
  Kingdom: Bacteria, Phylum: Actinobacteria, Class: Actinobacteria, Order: Streptomycetales, Family: Streptomycetaceae, Genus: Streptomyces
gcgcgcgcgaggagttcgccgcccgcaggccggcgaactcctcgcgcgcgcgggccggacggtacccctcctgccgtaccgtctccgcaccgaccaccaccacgtcggccagcgcccgcagcgtgccgaagatccgcatgtcggcggcgccggagatgggctgcgaacggccctcgtgctgcgccgccccgtcgagcgtggcgaccatgttggccctcagccagggctcgcgtccgccgggcgcgggctccgggtaggcgtaggccgcggccagctcggcgagggtccactcccggtccacgagggcgccgggcacacgctcgccaccggccccggcggccccgtccgagggctgggctgctgtttcgtcggtcacagggaacaggcgtcgcatgccgtgcagtgttccacgcggcttaccatggggaaccgtgtcgtcctccacagccgcctcccggctcagccccgtgaccggtgccaccccgctctccctgtgcgcccgcgagccgcacgtcccggcggaccggctggtcgccgagatggtgccgccgccgcggttcgactcggtgcgtttctcgacgtacatcccggacccgaagcagccgagccagacggaggccgtgcaggtcctggaggacttcgccaccgggctcggcggcgcgcccgcggccggtaccgcccggcgcggcctcttcggcttcggcaagggtcgcgcgaaggcgccgaaggtcccggccggaccgcgcggcgtctacctggacggcggttacggcgtcggcaagacgcacctgctggcctccctgtggcacgccaccccggccgagcccgcgctcaaggcgttcggcacgttcgtggagctgaccaacctggtcggcgccctgggcttccagaagacggtgcagacgctctccgggcaccggctgctgtgcatcgacgagttcgaactggacgaccccggcgacaccgtgctggtctccaccctgctcggccgcctggtcgacgcgggcgtcgcgctcgccgccacctccaacacgctgccgggcaagctcggcgagggccgcttcgccgctgtcgacttcctgcgcgagatccagggcctgtccgcgcacttccgtacgctgcgcatcgacggcgacgactaccgccaccgcgggctgcccgaggcgccggcgccgttctccgacgagcaggtgacgaaggcggcgcacgccacggagaacgcctcgctcgacgacttcgcccagctcctcgaacacctggccagggtgcacccgagccgctacggcgccctgaccgacggcctcggggccgtgtgcctgaccggtgtgcggccggtgcccgaccagtcgaccgcgctgcggctcgtcgtcctcgccgaccggctctacgaccgcgaggtgccggtcctggcctccgggctgccgttcgaccagctgttcagcgaggagatgctgaacggcggctaccgcaagaagtacttccgcgcgatatcccggctcaccgcactcgcccgggacgccaagggcctcgtcgggacggcctgacccctcccggcccgccggcctctggtctcccgacgacctgcctgagggactcgaccctgttctcgaagcgggcatatcgttgaacaaggccccagacgggcgcttcgacgactggtcgaggagtcgtcatcatgcttcaggacgtactgaccgcagtgatcgccgcgggctgcgccggattcgtgtacctcgcggcggcggcgcgggtcgtcaagcagtacgagcgcggggtggtgctgcggctcgggcggttcgccggaggcgcgcgcccgcccggcttcaccatgatcatccccttcgtggaccggctctacaaggtcaacatgcagatcgtcacgctgccgatcccggcccaagagggcatcacccgcgacaacgtgaccgtgcgcgtggacgccgtcgtctacttcaaggtggtcgacgcggccaacgcggtcatccaggtcgaggactaccgcttcgcggtgtcgcagatggcgcagacctcgctccgttcgatcatcggcaagagcgatctggacgaccttctgtccaaccgcgagaagctcaaccagggcctggaactgatgatcgacagcccggccatcgggtggggtgtgcagatcgaccgggtggagatcaaggacgtctccctgccggacacgatgaagcggtccatggcccggcaggcggaggccgaccgtgagcggcgggcccggatcatcaacgccgacgccgaactgcaggcgtcgaggaagctcgccgaggccgcccagcagatggccgacacgcccgccgcactgcagttgcggctgctccagacggtgacggcggtggccacggagaagaactccaccctggtcctgcccttccccgtcgaactgctgcgcttcctggagcgggcggcccagcagcagacaccggcgccggcgcctgtctccgcgccccccgcgcctaccgcaccgccgaagcccctcggcaacggcacgaagccgctcacggacgtaccggatgcgtcgttcgacgcctcgtccgtgaccccggtcagggccgcccgctccagga

SEQ ID NO: 217 - DNA, 6086 bp, Unknown
  Kingdom: Bacteria, Phylum: Actinobacteria, Class: Actinobacteria, Order: Streptomycetales, Family: Streptomycetaceae, Genus: Streptomyces
tctccgcgatgctgcgcgacggtgtggacggcgtcgcgcagcatcgcggagaagcgggacgtggtcggatggtccagggcctcggtgccgaagcggccggcgcaggcggcgcactccacgaccggtgcggcggcgccgcgcggcagcagcggcaccccgaggacggtgaagcggcgccggccgctcagccgctggtagttgcggtcgccgccgcagccggggcagaagaactcgccgtcacctacgggtgcccaggcggtccgggtgcccagaatgcgggcaagcctggcggcacggccgtttcgtccccgtcctggcagcacgtcgcacctccgtaaccacgcggcaacatcgccgcgtgggcgtgatgttagccacatcggcgaggctgagtcagtaccccggacgagacctttccgtgacctggccggtaaacgacgtccacgaggacgggccccggccgcctcagcaggcggccggggcccggaaagcgccggtcagggtgatcagcgcgccgcgcggttgacggccgagacgaccgccttcagcgacgcacgtgtcgtgttcgcatcgatgccgatgccccacatgaccttgtcctcgatcgcgcattcgatgtaggaggcggcctgcgcggaggcgccctcgctcatcgtgtgctcctggtagtccagcaggcgtacgtcgacgccgatggcctgcagggcgtcgaagaacgcggagatcgggccgttgcccgagccggtcaggaccgtgtcctcaccgtcgacggtggcctcgacggtgagcgcgtccacgccgtcggtgtcggtggtcgtctggccggtcttgacctggatgcggccccaggcgttgtccgggttgggcaggtactcgtcctggaaggtcgcccagatctcggccggggtgacctcgccgccctcggcgtccgtcttggcctggatgatcttcgagaactcgatctgcatccggcgcggcaggtccagcttgtggtcgttcttcaggacgtaggcgatgccgcccttgccggactgcgagttgacgcggatgaccgcctcgtaggagcggccgacgtccttcgggtcgatcggcaggtacggcaccgcccactcgatgtcgtcgacggtgacgcccttggccttggcgtcggcctccatggcgtcgaagcccttcttgatggcgtcctggtgggagccggagaaggacgtgtagaccaggtcgcccacgtaggggtggcgcgggtggacctccatctggttgcagtactcccacgtacgacggatctcgtcgatgtcggagaagtcgatctgcgggtcgaccccctgcgagaacaggttcatgcccagggtgaccaggtcgacgttgccggtgcgctcgccctgcccgaacaggcagccctcgacgcggtcggcgccggccatgaccgccagctcggccgccgccaccgcggtgccgcggtcgttgtgcgggtggacggacaggcagacgtactcgcggcgggacaggttgcggtgcatccactcgaagcggtccgcgtgcgtggacggcgccgaacgctccaccgtggcgggcaggttgaggatgatctcgcggcccggacccggctggtagacgtccatgaccgcctcacagacctccagcgcgaagtccagctcggtgtccgtgaagatctcggggctgtactggtagccgaactccgtctcggggcccagcagcttctcggcgtactccatcaccaggcgggtgccgtcgacggcgatctgcttgatgtcgtccttggagccgcggaagacgacccggcggaagaccggcgccgtcgcgttgtacaggtggacggtggcgcgcctggcgcccttcagggactccacggtccgctcgatcaggtcctcgcgggcctgggtcagcaccgagatcgtgacgtcgtccgggatcgcgccctcctcctcgatgatggagcgcacgaagtcgtagtcggtctggccggaggccgggaagccgacctcgatctccttgtagcccatcttgaccagcaggtcgaacatcgcgcgcttgcgggcgggcgacatcgggtcgatcagggcctggttgccgtcacgcaggtcggtggagagccagcggggagcggcggtgatgcgccggttcggccaggtgcggtcggggatgtcgacctgctcgtactggccgtacttctggatcggcatggaactggactgctggcggttgaccatggtggcgtgggctcctcaggagttccgcggtgacgcgggtgccggaatgacggccgacggcgcaacgccagactccgcggggagggggtcggcctacgactacaggccctcgccgcggcagctaaggagaagcagcccgaaacgcatggtgctgcgcagcttagccgagccgcgccggatgcgcgggcacggtccagtatgcgaaacgcgggcctgaaaatggggcgaagggtgcaaaaagtgcgcgaggtcactccgcgcagccacccctacccttcgcgatcgccacgtgaacgccttgcccggatttttcaccaatcaaggttgcaggtagtgactttgatgtcacgcagtgcgatggtcgacgtatgaccactcacgggggccccgagcccgacctcaagcctgtcctccccgcgcccgtcttctgcaccatcgtgccgccccacctcctcgaccgcctcgcgcgcagcgaggactccgcgatctccggcccggcccgccgcagcctgcagcgcgacgccatggagcgcacccgcaggcggctgaccaccgtcgtcggcgcgcccgccgtcgccccgcccgccggcaagcaggccgagcagccgcaccgcacggtctacgacgcccaccacggcaccgacctgcccggcaccaaggtccgcggcgagggccagcagcccggcaaggacgccacggtcaaccgcgcctactccggcctcggcgccaccttcgagctgtacctgaaggcgtacggccgcgactccatcgacggcagcggcctcccgctgaacgcgagcgtgcactacgacgagaagtacaacaacgccttctggaacggcgaacagatggtgttcggcgacggggacggcgagatcttcctggacttcaccatcccggtcgacgtcatcggccacgaactgacccacggcgtcacccagcacaccgccaacctcgcctacttcggccagtccggcgcgctcaacgagtcggtctccgacgtcttcggctcgctgatcaagcagtacacgctcggccagagcgccggcgaggccgactggctgatcggcgccggactgctcgcgccgcacgtcaccggcaccgcgctgcgctccatgaaggcacccggcaccgcctacgacgacgacgtgctcggcaaggacccgcagcccgccaccatggacggctacgtccacaccggcagcgacaacggcggcgtgcacatcaactccggcatccccaaccacgccttctacctggtcgccacggcgatcggcggccacgcctgggagaaggccgggcagatctggtacgacgtgctgaccggcggcaagctcaaggaggacgcggacttcgcggccttcgccaccctcaccgtgcaggccgcccgcgagcggtacggcgcgggcgacgcgctccaggccgtgcagaaggcctgggagcaggtgggggtgcggacactctgaatccgtactagacacgtcccatgcgtatttcagtgcggcgcacgggcgggttcgcgggcatcgagcgacaggccgaggtggacacctcggggcggcccgatgcccacgaatggcacgccctggccgagaaggcactcgcctccggccgggacacgccgcccgccggggttcccgacggcttccactacgagatcaccgtcgacggccggacggtccacgcggccgatccccgcctgagcgaggaccagcgcgcgctgatcaccaaggtgctcaaggagggcgcgtagcaaggagggcgtgtaacacgctttcggtgcgcgggcgttgacttccgttaccgccggtacggatgatccgcgcatggcgactgacgcaggcacctcaggcacttcggccggggcgctcccccggttcccggacggcttcctgtggggcgtgtccacctcggcacaccagatcgagggcgcggcggacgcacgggaggcgtccgtgtgggacacgttcaccgccgagcccggccggatcaaggacggctccacggcggcggtggcctgcgaccactaccaccgccattccgaggacgtcgccctgctgaccggactcggtgtggacgcctaccgcttctccgtctcctggccccgcgtgaactcccccggcggcctcgacttctacgaccggctcgtcgacgacctgtgcgcggccggtgtgcgccccgtcccgaccctcttccactgggacctgccggcccggctcgactggctccgacgggacacggcgcagcggttcgcggagtacgtgtcggtggtggcggagcggctcggcgaccgcgtcacgaagtggatcaccctcaacgaacccgccgaacacaccctgctcggccacgcgctgggcgtgcacgcccccggcaaacggctgctgttcgacgcgctgcccatcgcccaccaccagctgttcgcccacggcctcgccgtccaggcgctgcgcgcggccggggccacggacatcggcatcgccaactcccacggccccacctggcccgcctcgccggaggccgcggacgtggaggcggccgacttctacgacatgctgctcaaccgcctgttcgccgaaccactgctgctgggccgctacccggagggcgtcggcgagctgatgccgggtgatgtcgaggccgatctcaaggtgatcggccagccgctggactggtacgggatcaactactacgccccggcccgcgtcggcgcaccgcagggcaccgaggtggacttcggcggggtcacgcttccggccgaactccccttcaccgtgcgggagatcgaggaccgcccggtcaccggcttcggctggccggtggtccccgagggcctgacggaactgctgaccggcttccactcccgctacggcgaccgcctcccgccgatcgtcatcaccgagaacggctgcgcctacgacggcctggacgaccaggaccgcatcgcctacctcgacggccacctgcgcgccctgcaccgcgcgatcacggccggggtggacgtccgcggctacttcgtctggtccctgctggacaactgggagtgggcagagggctacgcccgccgcttcggcctggtccacgtcgactacgacacgctgcgccgcacgccgaaggcgtcgtacacgtggttccgggacgtgctgcggacccagagatgacccagcccgggcgctcgcctcgggcgccgggcccgtccccggcgcggagcgcgcctgccggtgcggatccgctcggggaaccggtcgtggcggtcgggcggggatggactgcctcgctctcgctcgccaacggggcgatctgggtgggctggtacgggccgttgcagatcctgctcgccgcccaggcgggggatctggcgccgggtaccgggatgtccaaggagaccctgctggcctgggtgaccggcgcgggcgcggtggtgtcgctggtggcgaacccgttcttcggggcgctgtcggaccggacgacggcacgctggggccgccgcagcccgtggatcgtggccggggcggcgggcggcgcgctgtcgctgctgctgctcggcggcgcgggctcggtcacggtcatggcggtcggctggtgcctggtccagttcaccctgaacgcgtccttcgcggcggtgacggcggccgtgccggaccgggtgccgcgcgcgcagcgcgggtcggtgggcggctggctgggtgcggcgcagatcctcggcgtggtcggcgggacgggcctggcgacggtcgtgggcggcaccggcgccgggtacgcggcctgcgcggtgttcacgctggcgggcgtcctgccgtacgtcctcctccaccgggacctgcggctcgcgccggcggaccgcccgccctggtcctggcg

SEQ ID NO: 218 - DNA, 8379 bp, Unknown
  Kingdom: Bacteria, Phylum: Actinobacteria, Class: Actinobacteria, Order: Streptomycetales, Family: Streptomycetaceae, Genus: Streptomyces
ccggaaccgtacggttccggggcccttccgtgtgccgagggggctacggcagctgcgccgcccgcgcctcgcggcggttgtcgcggaagttgttcacccggcgggccgtggcgaacagcgggatcaccgcgcccatcaccagctggagcgcgcagccggtctgcagcagcagctggccgctcggggcgtcgaaggcccaggcggccagcaggcccatcgacagcacgatccaggagagcatcgccaccgcgagacggccgcgcggcttggggtactccacgcggctcaccatcagccaggcggtgcccaggatcgccagcagcgtcgccacgaagggcagctccagcaggacgacggagaccacggtgagcgcgccgaacggcgagggcatgccctggaacacgccgtccttcatcgtcacgcaggagaatctcgccagcctgaggacgaccgccagcagcaccacgatcgcgccgagcgccgccatccgctggtgggcgtcgtcggccaccatgccgtagaccagtacgaagtaggccggggccaggccgaagctgatcaggtcggagaggttgtccagctccgctcccatgggggaggagcgcagcttgcgggcgaccaggccgtcgaacaggtcgaagaccgccgcgcacagcatcaggatgaccgcggtggcggcgctgtgccgggccatgcccgactcctggctgccggtgaggtgcgggatgaggatgccggtcgtggtgaagtacaccgccatgaacccgcacgtggcgttgcccagggtgagggtgtccgctatcgacagccggagcgagaggggcatctcctcctcgtcgtccaggtcgtcggcctcgggtacccagcctgcctgggtctcgggatcaatcacggtcaatgcgagtcaccccagccacggtcttctggccgacctcgaccgcgacctccacgccctcgggcaggtacaggtcgacgcgcgagccgaagcggatcagaccgatccggtcgccctgctcgaccttggtgcccgacgggagataggggacgatgcggcgggccaccgcgccggcgatctggatcatctcgatgtcgccgagttcggtgtcgaagtgccagacgacccgctcgttgttctcgctctccttgttgaacgccggaacgaaaccgccgggaacgtgctcgaccgacgtgaccgtgccggagagcggggcgcggttgacgtggacgttcagcgggctcatgaagatcgcgacgcgggtgcggccgtccttccacggcatgatgctctgcaccacaccgtcggcgggcgagatgacccggccctgggtgatctcgcgctcggggtcgcggaagaaccacagcatccccgccgcgagcgcggtggcggggacggctactgccttggccacgcccgagcggcgggcgcggaccaggctgacggctgcggtggcgacggtcggcagaagccacggcgatgctccgcgcgcgaggcgtacgccggcgaggctgtcgcgaggtgcagaggtttggctgtggggcatggatgaccttcgtagcggatgatgccgcgctctcgacgggggacggcggctttccgcgatcgtagcggttaagggccacaactgggtaagccgggaagccgagtcgacggctgaagaccgctgacggggtgtgatcttcttctcgtgagaatcaccccttatgcggacattcagccctggaatcgatactcttcgagcagtcggcggccgatgatcattttctggatctcggcggtaccttcaccgatgagcagcatcggggcctcgcggtagagacgctcgatctcgtactccttcgagaagccgtagccgccgtggatgcggaaggcgtcctcgacgacctccttgcagtactcggaggccaggtacttcgccatccccgcctcaaggtcattgcgctggccggaatccttcttccgggccgcgttcaccatcatcgcatgcgcggcctcgaccttggtggccatctcggccagtttgaactgaatggcctgatgctgggcgatcggcttgccgaaggtgtgccgctgctgggcgtagcgcacccccagctcgaaggcgcgctgggcgacgccgcagccgcgggccgccacgttcacccggccgacctcgacgccgtccatcatctggtagaagccccagccggtgaccccgccgagcacccggtcggccggcacccgcagcccgtccatgatcagctcggtggtgtcgacgcccttgtagcccatcttgtcgatcttgccggggatggtcaggccgggcctcacctcgccgaagccgggctccttctccaccaggaacgtcgtcatcgacttgtgcggagccgtcccctccgggtgaccctcgtcactgcggaccaggaccgctaccagggacgacgtgccgccgttggtcagccacatcttctggccgttcaggacgtactcctcgccgtccttcaccgccttcgacgtgatcgccgacacgtccgagcccagcgccggctccgacatcgagaacgcgcccctgatgtcgcccagcgccatcttgggcaggaagtggtccttctgctcctgcgtgccgtgctgcttgagcatgtacgcgacgatgaagtgggtgttgatgatgccggacaccgacatccagccgcgcgcgatctcctccacgcacagcgcgtacgtcagcagcgactcgcccagacccccgtactcctcggggatcatcagaccgaacaggcccagctccttgaggccgtccacgatcgcctgcgggtactcgtcgcggtgctccagctcggtcgcgaccgggatgatctccttgtcgacgaagtcccgcacggtggagacgatctcctgctggacgtcggtgagaccgtgggtctgggcgagacggctcatctacttcttcccctgttccttcagtgcggggcggcccggctgctcgccgccgcgctccttgatgtacgtctcggtcggcaccatgaccttgcggcggaagacgcagaccagcgtgccgtcctgcttgtagcccttggtctccacgtgcacgatgccgcggtcgtccttcgacttcgagggccacttgtccagcaccgtcgtctcgccgtagaccgtgtcgccgtggaaggtcggcgccacgtgcctgagcgactcgatctccagattggcgatcgccttgccggagacgtccgggacggacatgccgagcaacagggagtagatgtagttcccgacgaccacgttcttgccgaagtcggtcgtcccctcggcgtagtgcgcgtccatgtggagcgggtggtggttcatggtgaggaggcagaagaggtggtcgtcgtactccgtgaccgtcttgccgggccagtgcttgtagaccgcaccgacctcgaactcctcgtaggtccgtccgaactgcatgccgctcagccctccgggatctcgaacttgctggtgcgctgcatgccggcggcacgtcccttgcccgcgatgaccagcgccatcttgcggctggcctcgtcgatcatctcgtcgccgagcatcgccgagcccttcttgccgcccgcctcggacgtgcagtactcgtacgcgtccaggatcagctcggcgtggtcgtagtcctcctgggagggcgagaacacctcgttggcggcctcgacctggcccgggtgcagcacccacttgccgtcgaagcccagcgcggcggcgcgacccgcgacctcgcggaagccgtccacgttgcggatctgcaggtagggaccgtcgatcgcctggaggtcgtgggcgcgggcggccatcaggatcttcatcaggatgtagtggtaggcgtcggccgggtagccgggcggctgctcgcccacgaccagcgtcttcatgttgatggaggccatgaagtcggccgggccgaagatgatcgtctcggtgcgcggcgaggccgcggcgatctcgttgacgttgttcaggccctgcgcgttctcgatctgcgcctcgatgccgatgcggccgacctcgaagcccatggtcttctcgatctgcgtcagcagcaggtcgagcgccacgacctgctgcgcgctctgcaccttcggcagcatgatgcagtccaggttctggccggcgccctcgaccaccgtcaccacgtcccggtacgtccactcggtcgtccagtcgttgacccggaccacccgtgtcttgccgctccagtcgccctcgttgaggaacttgacgatggtgtgccgcgcctcgggcttggcaagcggcgcgcacgcgtcctccaggtccaggaagacctggtcggccgggaggccctgcgccttctccaggaagcgggggttgctcccggggaccgcgaggcaggagcgccgcggacgcaggcggttggcgggggatgtcatgcggggacctccagggggtcgagcttgttcgctttgcggatctcgtccacgatgcggccgatgatgccggtgatgtcgaagtccttcggggtgaacaccgcggccactccggcggccctcagctgttcggcgtcaccgccagggatgatgccaccggcgatcaccgggatgtctgtggcaccggccacacgcagccgctccagcacgtccggcacgagctgcgcgtgcgagccggagaggatggacaggccgaccgcgtgcacgtcctcggcgagggccgcgtccacgatctgctcgggggtgagccggatgccctggtagaccacctcgaacccggcgtcacgggcccgtaccgcgatctgctcggcgccgttggagtgcccgtccaggcccggcttgccgaccaggaagcgcagcttgccgacgcccaggtcctgcgccgtcagctccaccttgcggcgcacctccgacagggccgaaccctcctgagcggtgaccgccaccggcgccgacgacacgccggtcggcgcccggaactcgccgaacacctcgcgcagcgcgccggcccactcgccggtcgtcacccccgcgcgggcgcactccaaggtggcctccatcaggttctcggtgcccttcgcggcctccttcagccgctccagagccttgcacgggcgcgggtggttgaacggcggctggtagcgggtgtcgcgccagtgccgcagcgactccaccacccgcgcctcgaccgccgggtccaccgtctggatcgcggtgtccaggtcggcggtgagcgggttcggctcggtgccctcgaagatgttgacgccgacgatcttctcctggccggactcgatgcggccccggcgctcggcgtgcgaggcgaccagctgcgacttcaggtagccggactccacggcggccagcgcgccgcccagctcctggatgtggtcgatctccgcgagcaccgcctcgaccagctcgtccaccttcgcctcgaccaccttcgagccctcgaagaggtcgtcgtactccagcaggtcggactcgtacgccagcacctgctggatacgcagggaccactgctggtcccaggggcggggcaggcccagggcctcgttccacgccggcagctgcacggcacgcgcgcgggcgtccttggagagggtgacggccagcatctccagcacgatccgctggacgttgttctccggctgcgcctcggtcaggccgagggagttgacctggacgccgtagcggaagcggcggtgcttggggttctcgatgccgtaccgctcacgggtgaccttgtcccagatacggccgaacgcccgcatcttgcacatctcctcgacgaagcggacgcccgcgttcacgaagaaggagatccggccgacgacgtcgcccatccgctcctgcggcacctggccggagtcgcgcacggcgtcgagcacggcgatcgcggtggacatcgcgtacgcgatctcctgcaccggcgtggccccggcctcctgcaggtggtagctgcagatgttgatcgggttccacttcgggatgtgcgagacggtgtacgcgatcatgtccgtcgtcaggcgcagcgacggcccgggcgggaacacatgggtgccccgggacaggtactccttgacgatgtcgttctgcgtcgtgccctggagctgcgtgatgtccgcgccctgctcctcggcgacgacctggtagagcgccagcagccacatggccgtggcgttgatcgtcatcgaggtgttcatctgctccagcgggatgtcctggaacagcctgcgcatgtcacccaggtgcgcgaccggcacgccgacccggcccacctcgccgcgcgcgaggacgtggtccgagtcgtagccggtctgcgtcggcaggtcgaacgcgaccgacagaccggtctgacccttggcgaggttgcgctggtacagctcgttggacgcctcggcggtggagtggccggcatacgtgcgcatgagccacggccggtccctttccttgtgggcccgcggcacagggcgctctgtgccggtgtcgacgttcctcagcccgcggtcgccgcgctcccttgtcttcgtctcgttcgacaccggcgcgccctgtgccgcaggcgcggtctgcgcctgcggcacaggctcggtctgacgctcgctcatgtgcgcctctcagatgttccggaagcggttgatggcctcggcgtgccgggcgcgcatctcctcgtcgcgcacgcccaggccctcctcgggggccatgcacagcacgccgaccttgccctggtgcgcgttgcggtgcacgtcgtgggcggcctggccggtgtcctcgagggagtacaccttggagagcgtcgggtggatcctgcccttcgcgatgagccggttggcctcccaggcctcgcggtagttggcgaagtgcgagccgatgatgcgcttcagggacatccacaggtagcggttgtcgtactcgtgcatgtagcccgaggtcgaggcgcaggtggtgatggtgccgcccttgcgggtgacgtagacgctcgcgccgaaggtctcgcggccggggtgttcgaagacgatgtcgatgtcctcgccgccggtgagttcgcggatgcgcttgccgaagcgcttccactccttcgggtcctgggtctgctcgtccttccagaacttgtagccctcggcgttgcggtcgatgatcgcctcggcgcccatcgaccggcagatgtccgccttctgcggcgaggagacgacacagaccgggttggcgccgccggccagcgcgaactgggtggcgtaactgccgaggccgccgctcgcgccccagatcagcacgttgtcgccctgcttcatgccggcgccgttgcgggagaccagctggcggtaggcggtggagttgaccaggcccggggcggcggcctcctcccagctgaggtggccgggcttcggcatcagctggttggacttgacgagggcgatctcggcgagcccgccgaagttggtctcgaacccccagatgcgctgctcggggtcgagcatcgtgtcgttgtggccgtcggacgactccagttcgacggacaggcagtgggcgacgacctcgtcgccgggcttccaggcgttgacgccggggccggtgcgcaggacgacgcccgcgaggtcggagccgatgatgtggtagggcaggtcgtgccgcttggtgagttcgctgaccttgccgtagcgctccaggaagccgaacgtggagagcggctcgaagatcgaggtccacaccgagttgtagttgaccgaggaggccatgacggccaccagggcctcgcccgggccgagttcgggcagcggcacctcgtccaggtgcagcgacttgcgcgggtccttgtcgcgggtctccagcccggcgaacatctccgtctcgtccttgtgcacggtgatcgcgcggtacgactcggggagcggcagtgcggcgaagtcggcggacgtggcgtcctgcgactggatcgcgtccaggatgtccttcacggtcacggtgttgcctccggcggtgagcgcccctgagggagggggcgctgagggttcgtcggtgctgggatgagtgctgctgggggttcggggtggtgccgtcggttcggggggtgccggcggtgcggcgggtggtgcgtggcggcgctttgtggcgcggagggtgcctgtgacgcaggcgtccgggcgtgcgtgccaggtcctgtcgatgacagggccagagcccgccgggacagtcggcacgcggtgcggtcgctgcgtgccggtcgcccggacaccttcaacgtatgacaccgcgtgtcagctgacaaggcactgagtgccatgatttttgctcagacgaaatctttacgcgacagatgagcgatgatcgatcgaagggcggatccgtgccaggccaaaaggggctctgacatgcgaaaacggccaccccgaggggtggccgccagtgcggggc

SEQ ID NO: 219 - DNA, 6226 bp, Unknown
  Kingdom: Bacteria, Phylum: Actinobacteria, Class: Actinobacteria, Order: Streptomycetales, Family: Streptomycetaceae, Genus: Streptomyces
cggcgtggccggctgacccgccgggagactccggccgaggggatcctcaagccactcgtcgggccgcgtactccgcgatctccgtcatcggggggcgttcctccgtgtccacggagtacgtacgcggctcgaagccgtccgcgccgcgttcgaactgcgtgagcgaggggcggagcaggtggccgcgggcaaggcggagctgggccgtgcggtagatcgccgcggacatccggccgagcgcctgcccgtcctggtggcggtggacgcgctcgccgacgtccacctgggcgagcgcgtccaggccgaccaggtgcagcgcgtcgacgagcatgcccagctcgacgccgtaaccgacggggaacggcagctgttcgagcagcgagcggcgggccgcgtactcgccgccgagcggctgtacgaatccggccagctgcggccagtgcatgttgagcagcgggcgggccatcagctcggtgacccggccgccctgcccggcggctccggccagcgggcggtcgtacatcgccttgaccagctgcacctccgggtcggtgagcagcggcccgacgatgccggtgacgaagtcggcggagaagtcccgcaggtcggcgtcgacgaagcagacgacgtcaccgcgggtcaccagcagcgagcgccacagcacctcgcccttgccgggcaccgcggggatgcgggggagtatcgcgtcgcggtgcacgacccgcgcgcccgccgcggcggccacctcgaaggtgcggtcggtggagccggagtcgaccacgacgagttcgtcgaccagcggggcccgcgccatcaggtcgcggcggatcacggcgacgatgtccccgacggtctcctcctcgttcagcgcgggcagcacgacgctgaccgaggagccgctcgcgcgtttggcggccaggacgccgtcgagcggccgatcggcgacggaccaggaccgtgtcctcagccagcgctcgacttcttccagcacggtcggtgactcctcactcctgctcgcctgcttgcccgctcgtcccgccgcggcccgcggcccggcccggatcacgtcatcgtgtgatctgtctcgcggttcggacgaccatctctcgctgtcctggccgtcggttacagtcttgaacaacgcggacgagcctcgcatgccggggtcagcgcggcgccctgccgcccgaccgcccgtgtcagtacaacagcaggaccacaaccgaataccgctcatccagaggggcagagggacacggcccgatgaagccccggcaaccctccagccggtctcgtaccgacggaccgccgcacgacggcgctccggtcgccaccgcgaggctcccggctagggaaggtgccaaatccgtctcacggcgagatgcgtcgtgaggaagatgaggagaaagggcctcgcctccatggctgtgcagacagttgccaccagcaccgacaccccctccgtcgacctcggccccgccgccgcgctcagctgccgcgaatgcggccaccgcgtgcccctcggcccggtcttcgcctgcgaggagtgtttcggcccgctggagatcgcctacgacttctcggcccacgacaccgaggagctgcgcaagcggatcgaggcgggaccggcgaacatctggcgctacgccccgctgctccccgtccccgccgacgtcgccggcaagccgaacctgaaccccggctggaccaagctcgtccaggccgaccacctcgccgccgaactcggcgtcgacgccggcaagctcttcgtcaaggacgactccggcaacccgacgcactccttcaaggaccgcgtcgtcgcccaggccctggaggccgcccgcgccttcggcttcaccaccctgtcctgctcctccaccggcaacctcgccggtgccgtcggcgccgccgccgcccgcgccggcctgcgctcgtgcgtgttcatcccgcacgacctggagcagggcaaggtcgtcatggccgcgatctacggcggtgaactcgtcggcatcgagggcaactacgacgacgtgaaccgcttctgctccgagctgatcggcgacccggccggcgagggctggggcttcgtcaacgtcaacctgcggccgtactacgccgagggctccaagacgctggcgtacgagatctgtgagcagctcggctggcgactgcccgaccagatcgtcgtcccgatcgcctccggctcgcagctcaccaaggtcgacaagggcctgcgcgagctgatccagctcggcctggtcgaggacaagccgtacaagatcttcggtgcccaggccgagggctgctcgccggtgtccaccgccttcaaggccgggcacgacgtcgtccggccgcagaagccgaacaccatcgccaagtccctcgccatcggcaacccggccgacgggccgtacgtcctggacatcgcgcgccgcaccggcggagcggtggaggatgtgacggacgagcaggtcgtcgacgcgatcaagctgctcgcccgcaccgagggcatcttcgcggagaccgcgggcggcgtgacggtcggtgtcacgaagaagctgatcgaggccggcgtcctcgacccgacgaagaccaccgtcgtcctgaacacgggtgacggtctgaagaccctggacgcggtggccggcaccggtctgaccgccaccatccgcccgaccctggactccttccgagaggctggcctcgcatcatgagcgtgaccgttcgcatccccaccatcctgcgcacctacaccggcggacaggccgaggtgagcgccgagggcgccaccctcgccgaggtcatctccgacctggagaagaaccacacgggcatcgccgcgcgcgtcctggacgaccagggcaagctgcgccgcttcgtcaacgtctacgtcaacgacgacgacgtccgcttcgagcagggcctcgagacggcgacccccgacggcgtcggcgtctcgatcatcccggcggtcgccggcggctgaccattaccgtaggtaatggacgtgaccgagcgtgccgtgaatcgccccctccgccagagaagcggagggggcaattccatgtgattgaacgcggtagagttggggaacgcgccctggatctccgggatgagcgcctgttgattcctgccgcccgccgatgagaagcagccaaaatccgcaggtattctgcggcatttgtcttgttttatggggcccgacttgccctgagttcggctgaattctcgtcacattccggaccgctcccgcccggaattctcgtccgattgacctgttgcagacggcagttggacagatacattcagccgcggtcgacgcgttccggcgcacgcccccgatccacggggggtgaggtctgacccggatccgcgaagtgcggatctgtgcaagggccagtaataggggagttaggcatggctcagggcaccgtcaagtggttcaacgcggagaaggggtacggcttcatcgcggtcgacggtggtgcggacgtcttcgtccactacagcgcgatccagatggacggctaccgcacgctggaagagggccagcgggtcgagttcgagatctctcagggtcagaagggcccgcaggccgacatggttcgcgtcaccgcctgaacgtacttcacgcgtagggcccgcacctccacgggggtgcgggccctacgtacgccccgggccggccgcccgcccggcaggtggcccgttcgcctccggctgatccggcgcgggcaaccctgagaggcgcttgcactcgaccatgccgagtgctaatcattgcgttagcactctgaaggtgagagtgacaacgaaggaccgggtcggtgaggcccgcaggccgcgtggggcaaggaaccaccaggccggcgagccgtccgtcgcgggcgcgggcgcggtccgaaggaatcacccccagtcctggagggaccacttcacatggccaagatcatcgcgttcgacgaggaggcgcggcgcggcctcgagcgcggcatgaaccagctcgcggacgccgtcaaggtgacgctcggccccaagggtcgcaacgtcgtcctcgagaagaagtggggcgcccccacgatcaccaacgatggtgtctccatcgccaaggagatcgagctcgaggacccgtacgagaagatcggcgccgagctggtcaaggaagtcgccaagaagacggacgacgtcgccggtgacggtacgaccaccgcgaccgtgctcgcccaggccctggtccgcgagggcctgcgcaacgtggccgccggtgccaacccgatggctctgaagcgcggtatcgagaaggccgtcgaggccgtctccgccgccctgctcgaccaggccaaggaggtcgagaccaaggagcagatcgcctccaccgcctccatctccgccgccgacacccagatcggcgagctgatcgccgaggccatggacaaggtcggcaaggaaggcgtcatcaccgtcgaggagtcgcagaccttcggtctggagcttgagctcaccgagggcatgcgcttcgacaagggctacatctccgcctacttcgcgaccgacatggagcgcatggaggcggtgctcgaggacccctacatcctcatcgccaactccaagatctcctcggtcaaggacctgctcccgctcctggagaaggtcatgcagtcgggcaagccgctgctgatcatcgccgaggacgtcgagggcgaggccctgtcgaccctggtcgtcaacaagatccgcggcaccttcaagtccgtcgccgtcaaggccccgggcttcggcgaccgccgcaaggccatgctcggcgacatcgccatcctcacgggcggcgaggtcatctccgaggaggtcggcctcaagctggagaacgccaccctcgacctgctgggcaaggcccgcaaggtggtcatcaccaaggacgagaccaccatcgtcgacggtgccggctcctcggagcaggtcggcggccgggtcaaccagatccgcgccgagatcgagaacagcgactcggactacgaccgcgagaagctccaggagcgcctggcgaagctcgcgggcggcgtggccgtcatcaaggccggtgccgccaccgaggtcgagctgaaggagcgcaagcaccgcatcgaggacgccgtgcgcaacgccaaggcggccgtcgaggagggcatcgtcgccggtggtggcgtggccctgctgcaggcctcccaggtgttcgagaagctggagctggagggtgacgaggccaccggtgccgccgccgtcaagctggcgctcgaggccccgctgaagcagatcgccgtcaacgccggcctcgagggcggtgtcgtggtggagaaggtgcgcaacctgaccccgggccacggcctgaacgccgcgaccggcgagtacgtcgacctggtcgccgagggcatcatcgacccggcgaaggtgacgcgttccgcgctgcagaacgccgcgtcgatcgccgcgctgttcctcaccaccgaggccgtcatcgccgacaagccggagaaggccgccgcggccgctccgggcggcatgccgggcggtgacatggacttctgatcccgcgcggatcaggctcgtcctttccgagggcggcactccctggcgacagggggtgccgccctcgggcgtgttctgggccgcctcgggtgccgtgccgggccgccgaaggtgtcctgcggggcaggctcgggtgtcatgccgggctgccccgggcgtgttctgggccacaagcggcggcaggcgggccgacggcggaatgccgcggccgggcggggcggttgacgcccggtgcgcgcatttcacgcgtgtgcacgtaccgcacggtatccacccgttcctgcccgaggagcccccatgagcgtcgcgacctccgagcctgcccccgagtccgcctccgactccgactccgcctcccgtgcggcccggatcctgtcccgccccgtcacgctgaacggcctgagggtccccaaccggatcgcgatggcgccgatgacccggatgttctcgccgggcggcgtaccgggcgaggacgtgctgtcgtactacgcccgccgcgccgccgccggtgtcggcctgatcgtcaccgagggcacgtacgtggggcacgcctcggccggggagagcgaccgggtgccgcgtttccacggcgaggagcagctggccggctgggcgaaggtggccgaggcggtgcacgcggcgggcggcacgatcgtgccgcagc

SEQ ID NO: 220 - DNA, 13767 bp, Unknown
  Kingdom: Bacteria, Phylum: Actinobacteria, Class: Actinobacteria, Order: Streptomycetales, Family: Streptomycetaceae, Genus: Streptomyces
tccggtcgccgtccagtgcgagccgggcgtagcgccggcccgccggatcgagcaggccgacggtccggatgccgtgccgccggaacgcggcgaggggcccgacgcacgccacgtccacggcatgggtacgcagtcgcagggcggcgggggtgggccggtgctccgcttcacggcccgtcaggaccgcggcgagcgtgtcggcctgcgcgagcgcggactcgtagccggccaccgtccgtcccctgtgctcggcgcagtccccgatggcgtggacgcggctgtcgctggtgcgcagcgcgtcgtccacgacgatcccgtggtggacccggatgccggccgcgcgggcgagccgtacctcgggttccacgccggtgcacaggaccaggctgtcggccgccacgtgagtgccgtcgtcgagcagcaggcgtcccggctcccggcgtacggcccggcgtccgccgaagacggtgacaccggcctcccgcaggcgcgcggagagcatcgcggcgccggtgtctccgagccggtcttgcaacggatgggggcccgagcacaccagggtggtcgcggtgcccctcagggccagcgcgctcgccgtctcgacgccgagcggtccgcctccgaggaccgccacggtgccgcctcggacgcggtcgcagtcatcagcttcgcgcagcgtggtgacgccgggcatgagccgcccgtttcggtcggtcaccccgggcagcgggggaatcaccgggcgggcgccgcaggcgaggatgagcacgtcgtaggggtgtgcggtggtggccccgtgccggacgtgcaccacgcggcggtcggtgtcgatggcggtcgcgacggctccggcgagtacgcggccgccgggttcgggcgccgggctcagcaggtcggcgccgagccggctgagcagggcggtggtcagcagcggccggtgctggacgggtcggtgttccgccgacaggacggtgacggtttcttggtgcccgtggcggcgcagccccgccaggagccggtgagcggccggaccatgcccgatgacgaggatgcggctcatgacgtcactccgggagagggtcgagtcggacggcgctgaccttgaattcgggcatgccgctgcgggggtcgagggcggagttggtgaagaggttggcccggccgtcgccgccgaagtggaaggggacgaacacggtgtccgggcgcagcgtcgagtcgagccggacgcgggcggtcatgccgccgcgggccgaggtcacgcgggccaggcctccgtcggccaggccgtggcgggccgccgtgtccgggtggacttccacgaacgcctcgccggagaccgcggtgagttccggcacgcgccgggtctgcgcgcccgactgatagtgggagaggatccggccggtggtggcgtgcaccgggtacgcggcgtcggtgtcctcggccggtccgaggtggtcgacgtcggcgaaacgggcgcgcccgtcggggtgggcgaagccgtcgaggaacatgcggggggtgccggggtggggccggtcagtgtccgggcacggccagtacaggctctcgccggcgtccagccggtcgtaggagatgccggagtagtcggcgcgtccgcctcgggaggcggcgcgcagttcctcgaagatctcgcggggctccgtcgggtagtgcccggccggttcaccgaggcgtacggcgatgccgtgcaggatctccaggtcgctgcggacccgcggcggagggccgagcagggcgcgtcggcgcaggacccggccctccaggttggtcaacgtgccttcctcctccgcccattgggtgaccggcaggacgacatcggccatcagcgccgtctcggagggcacgaagtcggccacgaccagcagatccaacgaggccaggcgttccgcgatccgcgcggcgtgaggggcggagaccaccgggttggaacccaggacgagcagggcgcgcggcccgttctcctcgcccagcgcgtcgagcagttcgtaggcccgcagtcccgggccgggcagccggtcgggctccactccccagaccccggcgacgtgggcgcggtccgcggggtcggtcagggaccggtagccgggcagctggtcgttcttctgtccgtgttcgcgtccgccctggccgttgccctggccggtcaggcagccgtaaccgccgcccggggtgccgggcaggcccagggcgagagcgaggttgatgaacgccgccgcggtcgccgtgccctgccggtgctgctcgacgccgcggccggtcaggacatagctgtcgcggctctcggccagcaggcgtacggcggtgcgctgggcgtgtacggggacgccggtgacggcctcggtccgttcgggccaccaggcggcggcccggcccacgaccgtctcgaacccgcgggtccgctcgtcgatgtacgtcttgtcgacgagtccctcggcgacggccgagtgcagcagtccgagggcgagggcgaggtcggtgccgggggcgggctgcagatgcagtgcggcacggcgggcggtggcgctgtgccgcgggtccacgacgatcagccgggcgttctccagatgctgcatcagcggaggcatggtctcggcgacgttgctgccggccagcagaacggttcgcgcccgtgcgaggtcggtgacggggaagggcaggccgcggtccacgccgaaggcgtcgttgccggccaccgcggcggacgacatgcagaagcggccgttgtagtcgatgttgctcgtgcccagggcgagccgggcgaacttgccgagcaggtaggccttctcgttggtcaggcctcccccgccgaagacggccagcgcgtccggtccgtaccggttccggacgcggtccagtcgctcggccacggtgtccagggcgctgtcccaggaggtggtcaggagccgcccgtcacggccccgcacgagaggggtcagcagtcggtcgggggcggcgagtacctcgggcgcggtccagcccttctggcacagccggccgcggttgaccgggaagtcggcgggctcgaccgtgacggctgcggcccggtcgccgctgatccgggtgccgcactgcagggcgcagtacgggcagtgggtccacgcctcgccggcggctggcgggctgtcagacacggctggtctcccgaacgtcgtcaggggtggccgaggcccggggggtgtcccgacggaggtagacggatcggatgatcacgacgcacacggcgtagtaggcgaggaaggagaggaaggcgggcgttccggagccggaagggtcggcgtaggagaccgtgaaggcgacattgatggccgcgccgcccagggctcccacggcgccggccatggagatggccgcgccggacagccggcgggcccccgcgaaggcctgggcggcgtcgccgccagtggtcaccgcggactccgcccgccgcgcgaagaccgcggggatcatcttgtacgtggatccgttgccgaggccgctgaggacgaagagggtggtgaacgcgccgacgaacagcccgaaggacccggtgcgggaggcgacgacgagcacagtggtgccgctcgccagggcaaggaagcaccagagggtgacgcgtgccccgcccagccggtcggccagccggccgcccagcggccggaagagggagccgaggagcgggccgaggaaggtgtatgccatcgcctggacgggcgaggtgccgaactcgtactggagcaccagtccgaaggcgaagccgaacccgatgaaggaaccgaaggtgccgatgtagagcagagagatccaccaggtgtccgggcaccgggcggcctccccgagaaccccgggagcggtgcgaacggcgtccacgttgtccatcagccgtgcggccaggacggcgacgatcaggctgagcggcaggtagacgaccgcgacgtactccggatggccgcgccccgcggtgtggatcacgaggaggccgatcaactgcaccgccgcgacgccgaggttgccgcccccggcgttgagcccgagggcccagccctggtgccgctgcgggaagaaggcggtgatgttcgtcatggaggaggcgaaggtgccgccgcccaccccggcgagggcgccaatgagcaggaacacccacagcggtgtgccgggctgtcgcacgaagtacagggcgagcgtggcgggtacgagcaggagcagtgtggagaacacggtccagtcgcgcccgccgaagcgggtgacggcgtggctgtagggcagcctcagcagggcgccgacgaccgtgggggtggccaccagcaggaacttctcgcggggcgcgaacgccagcccggtctcaggggtcatgaagagcacgaggacggaccacagggtccacaccgaaaagccgatgtgctcgctgaggacggacaggatgaggttgcggcgggccacacgatgaccgccccggtgccaggcgtcctcgtcctcggggtcccagccggtgagccatgtgcgcttcgagttcttctcagccatggtgggttactccgaccgcgccgatgaggcggcgcgggcatggggggctacgggggctacgggacgacggtgtccgagcgcggagcacggtggtgcgggtgccgccgggcaggtgtcgccgaggcggcggtcgtacgcgggtgacccgtgccttgcggaactgttcgacgacgccgtccagcgggccggcgctctcggtccggatcggcaggccgtcgccgtgccggtccaggtgtgtgtcgagcaggaagaagccctgtacgacgtgctgggtgccgagcgagtgcgccgcggggcgcagcgcgcgcagtccagcaccagcacgtgtgcggtgctgcctccggtggccaggggaagcacggccttgtgcgtgaatccgtgctggggcagcaggtcgaggaaggtcttcagcagtcccgggaggctcgccttgcaagacggtgtggtcagcacgatgccgtcggcccgggcggcctggtccaaggccgcggcgatccgcgcgtcacaggtgtcggccctgagcagcgcctcggccggaaggtcacgcgccttcagatgcccggcgtgggcgtcttcttcggccgggcgccgggccacatggtcgtcggcgagtgcggtccgggaggccgggggcggactccccgagatcaccagcacgtgggacacggtcactcccctggatggtcgggtcaacgtcggatgcggtccgggagggggcccgggcccggccccctcccaccgcgtgggtcaggccggctggccaaaggcgctgacactgtcgcgggcgcgctggggctcggggccgttgaagacgaagcagcgcgtgctggagacgttgccgccggccgcctgagccgtggagaagatcggcaccggcgtcggggcgccgtcccgggtgacggagttcgcccggaagtcgatgatcggccagtcctcgtcccagcgggacaggaagccgtccagcaggccctggtcctcgtagctcttgcggatgtgccggcggacgtactcggtcggctgtccgctgtactcgaccggggcggtgtcggccgggtcggcgtgcatgacctgcccgttgaccccgatcaggtgggtcgccaccggcgcgacctcgtagaactcgcgccgtacgtctgacctgccgcgcacatgctgacgcgcatgctgccccctccgggtctggcttgcttgctccgcgatcgccgtgcacatggatgacgactgagcgtcaacatacgtagcgaaagatcggcatatccagatagagatcaagccgcctggccgtttctcgcccaatgtcaccttggccggaaaagaatgcgtgctgcggcccgtgaagacatggaatggcgaggactccgtaccgcctggggggcacccggagccatcagcactcgtttctggtcgaatctttcgaaaggtcgatgacctccctctcacatgatgagacttcagaagagggcaatttgccttttctttacttgcacacctgctggggcgtcatgccgtgacaggggatcatcgcgccgttcagggcgtccgttcgcttccctcgtgcgcgctgcgcccgtccccgtgcggaagatcggtgagcgcggccacctcggcagggttttgaacagcagccaggcgagggcggacatcaggatcagtggggccagggcggtctgcagcgaggtgctgtcggcgatgatgccgatgagcgggctgatcaggcctccgatgcccacggtgcgagcgcgatcccgctggcggtgccgacccgcgagggcaggtagtcctggcccagcgtgacctggagcgagaacgggatgtgcagaccggccgaagtgaggatgacgaacaagtagagggccgggccggggacggagaccaggccggcgaccgatccggccgtcagcagatacgaccgacgcgagacccgcacccggttccagcggttcgccagcgcaccgcccagcacgctgcccaccgcgcccaggcgggcatgtgaggcgacttgttggtcgtgtctggtgcctggccggtgtcttcggtcggtcattcataaaggatgcgcttggcggaacccctaaactcgggccatgagcaggaccgaccgcgccagccgggttattgcggcaccaccggcgactgtctacggcgctctcctcgaccgggagtccctcgaggcctggctgccgccggaaggcatgcgcgggcggatcgagcggtgggatccccggcctggtggcgggttccggatgatcctcacctacctcgacgccgtggacagccccggcaagacttcagatgcgacggatgtcgtcgacgtcgggttcgcagagctggtgccgccggagcgcgtggtgcagagggcggtgttcgaggccgacgacccctcgtacgcaggcaccatgacgatgacctggcacctcgctgccgccggtgacggaaccgaggtgaccgtcaccgccacgaacgtgccacctggcatcgagcaagcggtccacgaggccgggatcgcctcctcgctggcgcatctggcgtcgtacgtcgaagcggctgactgactcaggttgggctgcgccccgggcccgcccacggcgccgcgaaaactgccgaacactcacacccgtcatcgccggcatcccgccagaggggcgcgagcaattaccaagatcagtggttctgggaggttgttcaggcggcgtgagcctcggggagtaacagtcaagacctgtggatcggttggtctcactttcgttcagatgagttgatcgcaccccgaccagcggtacccgaacgcagccggcctctcccaggcactgcgacaactcgacccctcacgcacgcacccacgcacccacgcacccaaggcgcgtgccctcaacgggcgagtccgctccagcccccatcgcgccggcccacgctgagcagcgagcacgacacgacgagcgcggacagcacagcccgcgccttcggcgcccgcctgccctcctcccgcgtgagccgatcggacccaccgctcaccctcccttctcccgcccggccaggccggacgtcgcggcagcgagcaccggagcgatcgcgagcaccagggccaacccggccagcatcccgtacaagggcggcccgggccgggagatgcccgaggtgatgagcagcgtcgtggcggcggccgggggatggtgcgcgtcgcacacatggaggaggaagagcgtcagcccgaccgcgacggcctccgcgccgatctgccgggcgctgtcctggtggagttcgacgatcgacggatggctccacaagccgaacacggccagacatgccaggcccacggccactgccaggatgtgggcggtgacggcaccgcgcaagcgcgcctgcacggattcgggatgggccagcagcaggtacgccgtcgggcccagtgtcgtggtcagcaccacccagccgatgaggcggccgatcgctccgactccggccagcagcagagcggacagcaagaacagccgtacgccgcccagcactcggccgcgtacaccgctgcttccctctcgcgttctcttccgggccggggccgacgccgctcgcgcatcgcggccggtcacccggtcctgcccatcaacccggcttcagcctgatcgaggaacctcgtcgtcacggtagcctccctccggtcggactccatgggtatcctcccgccccttcggtcaaccactgcgcggacactcagcgcgtcacggatcccacgcccacggcgatccgggcgcccggtaccgctcccgccgtgcggactcgccggaagcggatggcgctcgccgatcctgcggcgagggcgcccacggcagccgagcacatcctgcactggtcgcactggtcgcactggcgccgacgacgccaacaccaagcccgcatcagccactgcagacgacgtggacacagcccctgaaactgcccagcactcaccacaaccaccgttgcagtacgtgccacggctggaggtttccactggacggagcccgcgtcgctgcggacagcactcgttcgagtaccttcctgggcaccggctcatcgctgaacgcccgcacggcccggcgactgtccacggcctcgtacacatccacgtcttcgcgtcctctccttcaaccgggcccctccaccgtgttcagcggtcaccaccgagcatcgccgggcgctggacgacgtcccgacgatcagtccagtcgccgtcagattggcagccggaaccagcccgcgggacagccggtaggtggtctcccagcccgtggcccgccccccccacgagcgaaagctgccgcacctcgcaggccatgccactcgactgggcgccattcccccgccgccgacggaatgacggataagggctgtccagtaattgcagcagcctcaccgcgcggcaaggcggtaccgcttcaactcttctcggtgaccaattagcagagaatccgccttttggggcgatataccctatcattacctattaaccccttcctcatcgcccgctgtccactctctttcacgttccatctactcttccgcgggctgtaaagttgcgccctgacgcacggccgcactcgggttgtgacccgccccgtagtgtggacgtaacacctcgccctgaggcgggtagttgggcgtcagagaggtgcgggagtccccctaaccgggtgatagcatccactcgtctgcgaccttggaccactcgcctcaggcgctgtattgatgtcggccacagaatcccgtgcgggaccgtccgccaacggccgcagccatacgccaggaaaggtttccatgactgaagacgtacttgtttggttcctggttgccgtggcggtcctcgcgatcgccgcggtctggttcctcagtcgccgcaacaaggccgtagcgaagagaaaggcccaggtagaggcggagctcaaccagcaactgagcaacgcggacgaacagctggccagcctcagtcgcgaattgcagcagttcaaggaggagcacgcgaagcgtattcggcaagccgaggaggctgccgaagacagcaccaaggctgtcctcaagggctccgcgcgtttcctgcagagtctggctgccgagcagcagacgctgctcgagacaattcagcgcaagtacggaggccactccgtactggtcgatctgctcgaagtcagtcacgcgaacgcgcagatgtcgcggaagtcccagggtattgcggtggtgtgcggcgcgccgctgggccgccgtaacaggcctgcgagtgtttacgacgtagtgcgcagcgcgatgggtcagatccgcaactttgagcgtgtcgccattatgcagcagaccggttttgccctgaaggcatccgctgtttcgcctgtcgcgctcgctgttgccgagcttcttgataacgctgcgagcttctcgcagcaaaatgcgcctatcgaggtcacgtttcagcgggttcagaagaatctgtgcatcgtcatcgacgacgccggtgtcggtatgagcgacgaggacaggcagaaggcgaccgctctgctctcgggtgactaccggccccgcctgtcgcagctgggcaaccagccgaagtggggttttcccgtcatcgccttgctcgcgcagcagtacggcttccgtgtggacgtcaccggcatctcgcgctatggcggcgtccgggcggttgtgctgcttccggaggagctctggaccatggaggaaacggcaccgccggccgagaccagccacatgagcagcatgggcgggtcccttccacagccggactcggcgtcccgtaccacgcacggcctgcctcggcgcggcgcgcgtcaggtggcggtggccggcgtgccggaccgggacacctcgacggcggcatcgccggagtcggaggacgccggccgggcggccgggcggggcctgggtgcgttccagagagggacgctgtcgggtcgaaagctgactgtcgcgccgtccgaaggggccgatgaggcatgaccactgacgacctgtcgtggatgctgcaggacatcgtcgacaacgtgccgaaggcgacgcacgccgtcctgctgtccgcggacggcatcccccgcggggcgagcgacggcatggaccggcaggccgtggggacgatctccgctgctatgtcgggcatgcagtccctcagccgcgccgcggcgaagttcgccggcctggagccggacgcagcgtgggaacagacgatcatcgagttctcgcacgggtgggtcttcctgatcggggccggtcagggcgcctacctggcagcagcagcggagcccgacgtcgacatgggcgcgatcagcttccgcatgcaccggcttgtcgcccgcctcggcaacaatctcaccacccctccccgggtccatgcggatgcctgggccgaacagggggaccggacccgggagcgctcggagagtactgccggggcgggcatcgccctcggggacctggacgcgtccttcgacggcgtgcgcggtgcccagaacgccgtgctgctgggcagcgacggcctgccgcgcggagctaccacgggcatgagccgggacatggcggacaccatctcggcggcgatgcagggcctccacgcgtacagccgcgccacgtcgaggttcgccggcgtgcaggacgcacggtggcggcagacggtcatcgagttctcacacggttgggtcttcctggttccagcggggcagggctccctgctcgccgcggcggccgagcccgagacggacatcgcggagttcgccacccggctgcacgagacggtagtaccgcgcgtgagcactcataccgcagcgagcagggaggcgatccgcaggtgaccgacgagccggaaccgggactggagctgacttcggcattagtcccactgttcgtgatcacgaacgggcggtccctgccgccggagcacgcctacgagcggacgacgctggtgtcggccagccagggtgcctccgcacaagcgcgcactctctcccctgagggctgccaggtcttggaactggtcacgggcggcttcctgtccgtggcagaggtggccgcgcatacgcatctgccgctggggatcgtacggatcctcctggcgcagttggaggagcgcggcctgatcgcggcgaggaagcccattcctcgcgcggaacatgtggatcgagacgtgctcaatgccgtgctcgacggcctcagagcccgattcggagcgtgattcgtgtacctggattcaggggtttccaccgcggtgaaggtgctcgtggtggggcacttcggagtggggaagaccacgtgcatccggagcatctccgagatcgagccgctgagcaccgaggaagagatcaccgaagccagcgtcggtttcgacgatctgtcgggcacccccaacaagacgacgacgacggtcgccatggacttcggccgcctgaccctcagccacgaggtggtcctctacctcttcggcacgcccggccaggagcgtttcaaggagatgtgggaggagttgtcccgcggcgccctgggcgcgctcgtcctcgtcgaccccgagcggctctcagagagcttcccggtcctggacctcgtcgagcagttcggcctgacctacgccatcggcgtgaaccgtttcgagggcacgaccgcctacccccttgaggaggtgcgtgaggctctgagcctgtccgcggacactcccgtcgcccactgcgacgtccgcgaccagcagtcggcggcacaggctttgatcaccctcgtggaacatctgctctccctcagcaactaggagctcacccctcatggagcatcgtcccgacatgcaggggccgccgcccggctgccccgcacacggcaacacccagctctacggcccgcagttcggtgcggaccccggcagccactacgcctacctgagaagcctcggacccagcgcgccggtcgacatcgcaccgggcgtcgaggtcgagctggtcaccagctacgaggccgccaagtggatcctgcagaaccccgccaccttcgtgcgggactcgcggcgctggaccgcgctcaaggaaggccatgtcccccaggacagcccggcactgcccatgatgggctaccggcccaacgcgctgttcagcgacggggcggcacacggccggctgcgggaggccgtcaccgacagcctcgctcacatcaacgagctgcagctcgggcggcagacccggaaatcggccgactacctcatcagccgcttcagcagcgaccggctcggcggggccgagctgatggcggagtacgcccagccgctgccgctgctggtcttcagcgacctgttcggatgcccgcccgagatcggtgaccgcgtcatcaccggcatcaccggcatcttcgccggcacggccggcgctgacgaggtgctgggcggggctcttgccgacctgatcgccctcaagcaccgtcggcccggtgacgacgtgacgacccgtctgatgcagcactcggcacagctgacggacgaggaagtgctgcaccagctggtgaccctgctctcgggcggcaccgcgcccctgaccggggccatcggcaccgcatgcgcgctcatactcggtgaggactggcaggcggaccggccggtggaggacgcgctcacgcaggtcctgtggaactacgccccgatcgccaactacgcgggccactaccccacgcaggacgtggagctgggcggccggaccctcaaggcgaacagtccggtactgatcagcttcgccgccgccaacacggaccctcagctggccgaacaccgcgagcagctcagcgcgaaggcgcatcttgccttcggggccggaccgcacgcctgtcccgccaaggaccctgcgctcaccatcgccgtggccgccgtggagtccctcctcaaccgcctgccggacgttgaggtccgggttcccttcaaggacctgagctgggtcccgactccgtggagccgcgtgctggtagagctgcccgtccggttcactccccgcaccgcgacgccgacgtcggcatcgtcccccgcgccccaggcagccgcgcccgcccccgccaccggcgtgggcgcagccccccgggggtcgacgacggccgcagccaagcccaagccgggcctgtggagcaagttcctggcatggaccagaggagagtgaccaaggcaactgcctggtgaacggtcatcttgtatgtgcgccgccatgcatgggtatgcatggcggctggtgaccaagatcatgaaggggcctccgtgaagac

SEQ ID NO: 221 - DNA, 2245 bp, Unknown
  Kingdom: Bacteria, Phylum: Actinobacteria, Class: Actinobacteria, Order: Streptomycetales, Family: Streptomycetaceae, Genus: Streptomyces
tcgggctcgcgatcggcggcgaccacgacgccgccgatcgcgagcccgaacgtgaggtcccgcttctcctcgtcctcccgcttctcgtacgccccgaagagcacggcgacgaagagcgctgccgccgcgagcagcagcagccgggagacgagggcggcgcccgccttggtctggagcacctggcccagcaggtccaggtcgaagacgtcccccagcttccccgaggtggtgtaggagccgcgcagcagcagcagtcccagggtcgccgcggtgagcgcgacccagccggacacgacgagccgctgcacggcccgtacgcctgctccgcgctgccagcaggcgaggacgaaggctgctccgccggccaggacgatgaagcctgcgtaggagacgtagcgcccgaagccgtacagccagccgacgggtccgccgcccacgtcctggccgccggccacgacggacgtcttggagggggccccgatcgagaaggtgtaggcgccgccgaccggatggctgtcggcggagatcacctggtaggtgacggtgtacgtgcccttggccaggccgccgcgcagcccgacggtgtacgtggtgccgctggtgttggccggcttgccggtgtcgacccgtttgccgccggggtcgaggacccgcagcgagtcgtcgttcatggcgacgttctcggagaaggtcagcgagatccgggcgggtgctgtggcgaccaccgccccctgctgggggtcgctgccggtcagcgcggcgtgcgcggaggccggtgcggcgccggccaggagcgcgccggtgacggccaggaacagcagcaccaggttccggacgcggggggcgatggtctgcgtcaaggtggtccctccctcagtgtccggtctcggggtcgtacgtggccgacttcaccggtatctcgacccgcaggtcgccggagttggcgaagtgcagttcgacggggaccgtctggccctggcggggcttgtgcttgagcatgtcgaacatcaggtggttgccgccgctcttgaacacgaggcgcccgtgggcgggcacggtgagcgcgccggcctcccgcatggttccgccgaccgtctggtgcgcggtgacggaacctgcggcgtcactggtgacggacgtcagcttgtccgccgcgtcgcccttgttgacgatcgtgaggaacccggccgccatcgagtcggagaccggctggggcatgtacgcggcgctgacggagagttcggccttgccgccggactccgcgccggaggccgcgcctccgcacccggtcagcaggacggcgccggccagggccgccgccgacagggctgccgtcgtcgtccggcgcctcacgggttctctcccttgacgagcttgggcaggtccttggtgtagtcaccgacggtggcgtcctcgtcgtagaccacgtaaccgctgtcgttcttcggtgagaaggcgacgacctgggtgccgtgcacggagaccagcttgccgttcttgtccttcttcgtcggctcgatggtgatgccgacgctgcgcgcacccgcctggatggtcgcgaagtcgccggtcaggccgatgaactgggggtcgatgccgttcagccacttgccgagttcggcgggggtgtcgcggccggggtcggtggtgacgaacaccacccgcagcttgtcctgctccgccttgggcagggccttcttggcgaccgcgaggttgttcatcgtcagcgggcagacgtcggggcagtgggtgtatccgaagtagaggagcgtgggccggcccgcggtctccttgcggaggtcgtacttcttgccgtgtgtgtcggtgagcaccagatcgggcttctcgaagggctggtcgaggaccgtcgagggcttctgagaggtgtcctcggcgacgacggtggcgggcgaggcattgtccttgccactgccgcaggcggacagggtcatcgtcgcggcggcgagcagagcggccacggcgaacgtcttcttgcgcatagaaaaatgtcccagatgtgagaattccggcgcgcaccggggccgtacgcccgtgcggtcgtacgaggatccgtacgcctgtgtggtcgtacgggggccgtacgcggacggtgtgcggccccggtgcgcggcgcggacgtgcagggtcaggcggtggtggtgcggcggcgtccggcgaacacgccgtaggccacgccggccgcgccgacgacgatgcccacgatgccgaggacgcgggcggtggt

SEQ ID NO: 222 - DNA, 6499 bp, Unknown
  Kingdom: Bacteria, Phylum: Actinobacteria, Class: Actinobacteria, Order: Streptomycetales, Family: Streptomycetaceae, Genus: Streptomyces
cgccgcagcccgccggccaccaccaccgaggccagcagcagcgccccgcccagcggcgcccacgcgtacaggatccccgccggcccggaccgcagcacctcgtccgtgcccggcttcacgacgacgtcgtacgtctgccccttgcgcaccgccaccgtgtgcgcgatctccaccctgcgggccgacgacccggccgaggcgggcgtgtacgggccgctgcacgtgtcgtcgccgcaccgcgtgacctcgaccgtcccgcgctcacggcccttggtcagcatcacgtacggcgcgctgctccacgacgcccacacacccgcgaccaggatcagcaccgcgaccgcccccatcgcggccacccgcccgaaccgcagcgcggcatgggaggcctgacgggcctggcgggaggcgcgggcctgacggggacgaggggcgctggcagcggcaggcatggccgggatcattggccataccgctccacctggtcaactcctgggcgtgcgggcgcgggacaagtcaggagttgtacgcgctttgcgcccgctccaggccctccgcgagcagacactccaccgagtccgccgcccggtccacgaagtagtccagctccttgcgctccgccgaggcgaagtccttcagcacgtagtcagccacctgcatacggcccggcggacgcccgatgccgaaccgcacccggtggtagtccgcgcccatcgccttcgtcatcgacttcagaccgttgtgcccgttgtcgccgccgcccagcttcagccgcagcgtgccgtagtcgatgtccagctcgtcgtggaccgccacgatgttgccgagcggcaccttgtagaagtcccgcagcgcgttcaccggaccgcccgacaggttcatgaacgacatcggcttcaccaggaccacccggcggctgtccggcccgggcggaccgatccgcccctccaccacctgcgcctgcgccttgccagcccgcttgaaccggccaccgatgcggtcggccagcagatccaccaccatgaacccgacgttgtgccggttcatggcgtactccggtccgggattgcctagccccacgatcagccagggcgcgctcgcggaagtcaccggggtggtcacgtcgtccatctctccttgatacgcgccggccgccgcccccagaaggaagcggcggccggcgaactgcgcggggggtgagggatcaggcctcggcggcctcttcgccctcttcctcgccctcggcggactcctcggcctgcgcggccaggacctgcaggacgacggcgtcctcctcgacggccagcgtcacgccgttcggcagggtgatgtccttggcgtggatcgaggcaccggcctccagaccctccacggacacggtgacctgctccgggatgtgcgtggcctcggcctcgaccggcagcgcggccaggacgtgctccagcaggttgccgcccggggccagctcgccctcggtgtgcaccgggatctcgacggtgaccttctcgccgcgcttgaccagcagcaggtcgacgtgctccaggaagcccttcagcgggtcgcgctgcacggccttcgggatcgccagctcgttggtcttgccgtcgatgtccagcgagatcaggacgttcggcgtacgcagggcgagcagcagctcgtggcccggaagcgtcaggtgcagcggctcggtgccgtggccgtacagcacaccgggaaccttgttctcacggcggacacggcgggcggcgcccttgccgaactcgctgcgcgtctcggcggagatcttcacctcggacatgctcttcactcctcgtagaaataggggatggtggtcacccggccacacgaacggcctgctacgaagagcgcgtcgataacggaccgccgtatccgtccgaaaacggctacggcctccctcgccgagcaactgcagcagtctactcggcaggggaggccgaacccaaaacgatctccggggacccccggagccgcagaatgatcgttactgcgcggaaatcaagcgggggtcacacggcgctcacaggcgatcgtcaggcgatcgtcaggcgatcgtcactgctcgtcgaacaggctcgtcaccgaaccgtcctcgaacacctcacgcaccgcgctcgcgatcgtcggcgcgatcgacagcaccgtgatcttgtccagctccagctcgctcgccgtcggcagcgtgttcgtgaacacgaactcgctcaccttcgagttcttcagccggtccgccgccggacccgacagcacaccgtgcgtcgccgtcacgatgacgtcttccgcgccgtgcgcgaacagcgcgtccgccgccgcacagatcgtgccgcccgtgtcgatcatgtcgtccaccaggacgcagatccggccctccacgtcaccgacgacctcgtgcaccgtgacctggttcgccacgtccttgtcccggcgcttgtgcacgatcgccagcggcgcgcccagccggtcgcaccagcggtccgccacccgcacccggccggcgtccggcgagaccacggtcagcttgtcgcggtccaccttggcacctacgtagtccgcgagcagcggcagcgcgaacaggtggtcgaccgggccgtcgaagaagccctggatctggtcggtgtgcagatccaccgtgaggatccggtccgcacccgccgtcttcatcaggtccgcgaccagacgcgccgagatcggttcacgtccgcggtgcttcttgtcctgccgcgcgtaaccgtagaacggcacgatgaccgtgatcgaacgggccgacgcacgcttcagcgcgtcgatcatgatcagctgctccatgatccacttgttgatcggagcggtgtggctctggatcaggaagcagtccgcgccacgggccgactcctgatagcggacatagatctcaccgttcgcgaaatcgaacgccttggtcgggacgaccccgatacccagctggtgggcgatttcctcggcaagctcggggtgggcgcggccggagaagaacatcaacttcttctcgccggtcgtcttgatcccggtcacagcactgtctcctcagagggtgtacgcagctggatgtcgagaagacctcgtcaaccgtgcaaccgtgcaacgagaggccgtctcagctggtggggtgcgggtgtgcacttatcacggtacgccgtgttcggcgcgcctgtttccggtcagtcttcgctctccgtcttcggcgacaccgcctcggccgccttcgccgccgcgctcccgggccgcttgcgcgccacccaaccctcgatattccgctgctggccacgggccacggccagcgaaccgggcggcacgtcccgcgtgatcaccgacccggcggcggtgtaggcaccgtccccgatcgtgacgggagccacaaacatgttgtccgaaccggtacggcagtgcgaccccaccgtggtgtggtgcttgtcctgaccgtcgtagttcacgaacacgctcgccgcgccgatgttcgagtactcgccgatcgtcgcgtcccccacgtacgacaggtgcggcaccttcgtgccctcgccgatccgcgcgttcttcgtctcgacgtacgtacccaccttggacttcacaccgagacgcgtccccggccgcagataggcgtacggacccaccgacgcctcaggacccaccacggcgcccagggacaccgtgttgtccacccgcgcccccgcacccaccctggtgtcggtcagccggctgttcggcccgacctccgcgccctcggccagatgcgtcgacccgtgcaactgcgtgcccgggtgcacgatcacgtcctgctcgaacgtcaccgtcacgtcgacccacgtcgtcgccgggtccaccacggtcacgcccgacagcatcgccgccgtcagcagccgctcgttcaggatccgccgcgcctcggcgagctgcacgcggttgttgatccccgcgatctcccggtggtccccggccacgcacgcaccgacccggtgaccagccccgcgcaggatcccgagcacgtccgtcaggtactcctcgccctggctgttgttcgtgcgcaccttgcccaacgcgtccgccagcagccgcccgtcgaacgcgaacaccccggagttgatctcccggatcgcccgctgctcctcgctcgcgtccttgtgctccacgatcgcggtgaccgcgccgctgtcaccgtcgcgcacgatccggccgtagccggtcgcgtccgggacctcggcggtcagcaccgtcacggcgttgccgtcggcggtgtgcgcggcggccaggctcgcgagggtctcaccggtcagcagcggggtgtccccgcagaccacgatcacggtcccctcgacggagccgcccagctcctccaggcccatccggaccgcgtgcccggtgcccttctgcttctcctgcacggcggtacgcgcctgcgcgtccacctcggcgaggtgcgcgctcaccttctcccgcgcgtgcccgaccacgacgaccaggttctcgggcttcaactcacgcgcggcggccagcacatgaccgaccagggaacggccgcagatctcatgcaggaccttcggtgtggccgacttcatacgggtgccctcacccgctgcgaggacgacgacggctgccgggcgaatggcgctcacgggatgcccttcggcttttgggtgaggtggacatccgcaggataccggggcggttgaggggggagacgagagcgggtcccgatccaggggatcaggacccgtcgcggcgccgtgcgtggcgtggctcccggagaaggattcgaaccctcattcaacggaccaaaaccgtttgtcctgcccttagacgatccgggatggctggtgtgcggcgccgtccgacgcgttgatcggttgcgcgcgcgacaccactatgccgtaccggcagccctcgacgcacggtgccgtccggacccgcctgtcccacggcccgcgggggcgcgggcgcatgccggttcgtgctgccgtccggtcgcggtgggtgacctcgtgcggtacgcgaaactcgccggaaaagtgccgtcgggcgcccgtaggctggacgcatgaccacgacgggggaagagcgcgccacggctgtgaccgggccgtggtggtgggcgcggtggcgtagtgcgctgttcgacgggagtctggcgctggcgtcggccgcggagtgcgcggcggagggggtgccgttcgcccgggacgccgggattccgcttgccgcgggggtcgtcttcgggctgctgtgcgggtcggtgctgctcgtgcggcggcggtggccgatcgcggtcgtgctggtcgcgatcgccgtcacgcccgcccagatgggcttcctgatggggatcgtcgggctgtacacgctcgccacgtgcgagttgccgcggcggatcatcggggcgctggccgggatgtcgttgctcgggacgatgatcgtgacgttcgtacgggtgcggcaggacatggcgcggggtgatttcaccctgggtgactggttcgtcccgttcgccgcggtcaccacctcgctcgggctcaccgcgccgccgctgctgctgggcctgtatgtcggtgcccggcggcggctgatggagtcgttgcgggagcgggcggacagcctggagcgggagttgcagctgctcgcggagcgggcggaggagcgtgccgagtgggcgcgcggtgaggaacggacgcggatcgcccgtgagatgcacgacgtcgtcgcgcaccgggtgagtctgatggtggtgcacgcggccgcggtgcaggcggtggcccgcaaggatcccgagaaggcggtgaagaacgcggcgctggtcggggacatgggccggcaggcgctgacggagttgcgggagatgctgggcgtgctgcgcagcggggagggtccgaagtccgcccctgccgggcgggggacggccgccgtgccgctggtcgcggtgggggtcgcggctgccgcggcggcgtcccgtgccgcggacgagccgggcggcggcgcggaggggccgtgcctggcggagctggaggaactggtcgggcagtcggccgcggcgggcatggtggtggacctgtcggtcgagggcgacgtccggccgtacggggcggagatcgagcagaccgcgtaccgggtggtgcaggaggcgctgacgaacgtccacaagcacgcggcgggcgcgaagacgcgggtgcggctcgcgcaccggggctcggagatcgcgatgcaggtggagaacgggccaccgccggagccggggtcggcgtcggcggcgcggctgccgtccggggggaacggcctggtcgggatgaaggagcgggtcgtggcgctgggcggcatggtcgatgtcggggccgacggaggcggggggtttccgggtgtcggcggtgattccggcgtagggccgcgctgcgccggtgtcggcgttggttgcggcggcgtggggctgtaccgcgccggtcttggcgtccgctcggccgcggtgattcagcccgcggtcaggcgg

SEQ ID NO: 223 - DNA, 4229 bp, Unknown
  Kingdom: Bacteria, Phylum: Actinobacteria, Class: Actinobacteria, Order: Streptomycetales, Family: Streptomycetaceae, Genus: Streptomyces
gcacggtcccggcgtactccccacggaggtgaggaggttcgctccggcggtggcatcgggctgtcggtggcggcccgtaccgtggacgcatggatcttcgactgcccggactgcgagggccgctgcgcgggccccggcggtggctcgccgccggagccgccgtcgtggtgctcgccggggccggcacctggaccgcggtcgcctccgccgacgacccgcccgccgtgcaccgcgccgaccgggtcatgagcacggccgacggcgtgcgcatcgacacctcctacttcaccccggccgggcccggccgccaccccgccgtcctgctgggacacggattcggcggcagcaaggacgacggctccaccgacgccatcggcaaggccttcgccgcacgcggatacgtgtcgctcgtctactcgggcctcggcttcggcaagtccggctgcctggtctccctcgacgacccggagatcgacggccgggccgcgtcgcagctgatcgacttcctggccggcacccgcgccgccgacgacggcacccgcgccgactacgtcacactcgacggctcgggcgacccgcgcgtcggcatgatcggcggttcgtacggcggcgccgtgcaactggccaccgccgccgtcgaccaccgcgtcgacgccctcgtcccgatgatcacctggaacgacctcgcctactccctcgacccgaacaacgccaccggcgccgccgacgtgcccggcgccttcaagtggcagtggaccaacggcttctacctcatgggcgagagccagccgctgacccagcccgcgctcgacccctcccggatcaactccctcacctgcctgcacttcaccacccgggcctgcgacaccgtccgcaccctcaactccgggcgctaccccgaggacgccacccgcagcctgctctcctacgcgcacagcgtctcgccggtctcctacctcgaccgggtgaaggcgcccaccctgctcgtccagggccaggccgacagcctcttcaacctcaacgaggccaccgcgacctaccggaccctcaaggcccagggcaccgagacgaagatgatctggcagtcctggggccacagcggcggcctgaccgaccccgccaccggtgaactgaacctcgcccagggcaacctggagaccagctacgtcggccggcgcatcctcgcctggttcgaccgttacctgcatcggcggcagaacaccggcacagggcccgacttcgcctactaccgcgactggatcaccgacccggcccacacctacgcgagttccgaccgcctccccgcgcccagccgcacgctgtacctctccggcgacggcaagctcgtcgaccaccgcagcgaggtcgcccgcggcagccgcacctataccaactggctgattcccacgagccattcggaaagctcactggcgggaatcgtcaagctcccggaccccgcgccgtacgacctcaacggcacccacctcgcctggaccagcgcgccgctcacacacgccaccgacgtcgtcggcgcgccgcgcgccaccctagaggtcgtctccccgaaggccgagcgcacccagcgctcgaccgacgccgccgaccggctcgtcctgttcgccaagctgtacgacgaggcgcccgacggcaccctcaccctcgtgcaccggctcgtcgcgcccgtccgcgtgcccgacgtgacccgcgccttcacggtgaccctgccgggcatcgtgcaccgcttcgagcaggggcaccggctgcggttcgtgatcgcggcgagcgacgacgcgtacttcggcaaccgcggagtcaagccggtcaccgtggtcagctcgcccgaggacaccggcgtcctccaactgcccgtagtacaggactgatccgggaagaggaccgatcccagctggtctcggctgatccccgctgattccggccgagccggtggggctcgcgtagggtgacgggatgccgcacaccgcatcccgtcacctcgccgaagggccccgcgtgggcatccgctccttcacccaggaggacggccccgagttcaccgcccgggtccgggagagcgccgacctgcaccggccgtggctgttcccgccggccacggccgaggcgtacaccgcctacgcgggacggctgatcgacggacaggaccgggccggcttcctcgtctgcgagaaacccggtggcgacctcgccggttacatcaacatcaacaacatcgtccggggcgccttcctctccggcgcactcggctacggcgccttcgcgcacgcggccggacgcggactgatgaaggaagcgctgaccctcgtcatcgagcacgccttcgggccgatggggctgcaccggctggagatcaacgcccagccgggcaacaccgcctccatcgcgctcgcccgctcctgcggcttccgcctggagggctactcaccggacatgctgtacgtcgacggggcatggcgcgaccacgaacgatgggcactcaccgccgggacgcggacttccggttgaccttcatggtgtcgaggtcggtgacggtcgacttcagctcgccgaagccgtagccgaggccgcgcagcgcgcgctccgcgcggtcctccgcgatcgccgccgccatctcctcgccctcctcggcgtccgacaccacgacgtagcgcatcgagaagtgcttgagcggcgccggctcgtaggacagcgtcccctcctcggtgaaccgcatgctcagcatcccgtggtcggcggcctcggcgagcagccgcgcccgcgcctcgtcggtcagcccgtcccaggtgccccggacgatgacccgataggtgtgctgctcgctcatcggtacccgtgctcctctgtcaccgcgccggcccgcgaccgcaccggcgcatcctcgcgtacgtggtcgaaaagaccgactctacgtgctccggcggaccccgcccacgggatttcccgcccgccgcccggcccggtcctgcgggcgcctttgcgcaatcctgaccgccggtgcccctggtcagctcaccggcgaccgggttccatggtgatcgtgacgacgatccgacgtgaggtactgacgctccccgccgcacctgtgggccccgacaacccgctgcccgcgctgcggccgctcgacgaggcccaccgcatcgaggaccgggacaagaccgggctgccgcacgacatggcccggcagatcggctacgccccgctgcacagcctgctgcccgcacggatccgcgacggttacggcagaaagcgccggccggccgggatcgacgccctcgtcctggagaacgaccggctgcgcgccaccgtgctgcccggcctcggcggccggatcgcctccctcgtccacaagcccaccggccgcgaactcctctaccgcaacccggtgttccagcccgccaacttcgcactcaacggcgcctggttctccggcggcatcgaatggaacatcggggccaccggccacaccaccctctcctgcgcacccttgcacgcggcccgcgtccccgcccccgacggcggtgtcatgctgcgcctgtgggagtgggaacggctgcgcgacctgcccttccaggtcgacctgtggctgccggacggatccgacttcctgcacgtcggcgtccgcgtccgcaacccgcacgagcggccggtccccacctactggtggtccaacaccgccgtccccgaggaccgcagggtgctcgccccggcgaccgaggcctggctcccccactgcctgaacggcgtgggaagtactcccatcggctacgaacgcaggctgagccgcgtccccgtcccggtttgcgacggcatcgaccgcacctaccccctcaacagcacttacgccgccgactacttctacgaggtgccggacgggcggcgccgctggatcgccgcgctcgacgaggacggcaccggcctcgtgcagacctcgaccgacgtactgcgcggccgcaagctgttcgtgtggggctccgggcccggcgggcgccgctggcagcagtggctcaccgagcccggcaccggcggctactgcgagatccaggccggactcgcccgcacccagctggaacacgtacggctggaaccggagagcgaggtgagctggctggagtcctacggtccgctcgacgcaccgcccccggcgggggagtgggacaccgccgtccggcgcaccgaggagcggctggaggcggtcctgccgcgcgcggacggcg

SEQ ID NO: 224 - DNA, 15988 bp, Unknown
  Kingdom: Bacteria, Phylum: Actinobacteria, Class: Actinobacteria, Order: Streptomycetales, Family: Streptomycetaceae, Genus: Streptomyces
gggttgcggagccgatctcgaaggggccgatcgtggaacggcgctgaacgaccgagcgcccgttgccgagtttcgtccagctactggagccctggacgttcatgaacgcctcgtagtcgacgtaggaggcgtgggcgcgggagttggtgatgacgacgtgcgccttgatgtcgcgccaccagaccttgttgtccttgaaccgctcggcgctgatgcagccttgtgcgccgatgttctgggtggagacggcgccgccgcaggcgatggcggcggcgtgggcgtcggcgggtacggcgagggcagtcagcagggcggctcctgccgctgcggcaaggcgtttcatgtgcatcgtgcggtcccctcggtcaggtgtgtgccggcagccatcatgccgaaataccggcggttaagggtcatttcgcggatatccgtcaccagccggtgacgtcttcaccgaggagtcgctggcacacctgccacagcatccctgcacgagacgccttgaccagaaccttgtcgccggggcgcaggagcttttccaggaactgagcggcggtttcgttgtcggcgacgatcgcggtgtccaccccggctccggcggcggcgagggcgagctgtttcgcgagatcgccaccgaccgcgacgacaaggtcccacgccccccagagagaccaaccagggctgtccaagctgcaatacgcgacagctcaacatgcgggcctaccagtcaggccaacccggccctgcatgagcaggccggattccggagcatcggcggacacggcacaccgaacttgtcctgataccagaggtgaactcgcgctttgttgcggatctctaccttcgcgggcaggccggcgaagactttgcgtccggtcttgatcatcgtgtcttcggcctcccaggacaggtcgccgcggtcgaagtagaagatgtcgtagtccttgattccgttggtcggtggtctgcccgtgacaacgttccaaacggtccgcaacaggcagccggccgttacataccacccgggcagctccagcctcgctgcccgctacaggatctccgtcaacatgtcgttacgggacagcaccacgcgaagggactcaagttgctggtcgagagggagtcggctgatcatcagccctgcctaccacagctcgccagccggacgggccagctctccctcaaggaccctcggtggagggcggacgtcgcccgccctccaccgactccgagacatcgctactgaacttgactgagtgatgtcggtgccgttcgcctgacggttggctgtcggtaccggtagttgtggggtgtgaggtatgcgcagggcggcgggctgaccgacgcagagagggccacgcgggagcggttgcggtttcaggcggtggagcgtttcgagggtgggcagaggaacgcggagattgccgctgccctgcggatcagcgtgcggtcggtcgagcggtggcgccgggcctggcgcgagggcggagaagcgggggtcctgtcgaaggggtcgccgggaagaactcggctcagtgaagcccagatcgccaaactggagccgggagttggagcgtggcccgctggctcacggccgggcggaccagcgatggacgctggcacggatcaaaacgctcattggccggctcttccacgtctcctacacggtcgagggcacatggcggctgctgaagccccacggctggagctggcagcagcccaccagacgcgcgatcgagcgcgatgacgatgcgttcgaggtctggaagaaggagacctggccgcgggtaagagcaccgcggcggagcgcaacgcctggatcgtcttcgaggacgagaccggacagtcgatgactccgccgcgcgccaggacctggggccggaccggccagaccccggtggtgagggtgaggggccggggctcgggacgcgtgtcgatggcgggtatggcctgctacaggccgggcgagcggtcccggctgatctacgcgatccgcgagtaccggggccgcaaggacgaaccgaagggcttcggctggcgcgacttccgcgacctgatcctccgcgcccgcatccagctcggcgggccgatcgtgctggtctgggacaacgtccgcctgcatttgacggccggcatgcgggagttcatcgacacgaactccgagtggctcaccgtgttccagctgcccacttatgccccggacctcaacccgaccgagggcgtctggtcgctggtcaagcgcgacatcggcaacctcgccgcggccgacctcggccagatcacccgggccgtgaagcgcaaactgaagatgctgcagttccgaccggaggtcatcgacggctgcctcgcaggcaccgacctggccctggacctgtgagcgccgggtcaatagatccaaaattggtcgaatcccaaagctgctggtcagctacggtggcggcatgactgacagcctgcccgaggaagtagccaacgtgcttgacctcgtcctgaacgcggacgagcccgtgcacgtcgccctccgacggcaggttccccaactcagggtgcaatcccgctgtaagtgcgggtgcggcaccgcctacttcgaactcgacaccgacgcggtggaacccgcaccaacgggccccggcgccgtcgtggctgccgacgcacagctgttcaccgaaaccggcgactgccccggcgaggtcctggtcttcacacaaggcggctacctctcatggctggaggtctgctcttggagcgatgacgtcgaagtgaatctcgccgcggcacggcgctggctacagccaccgtcctgaacccgagccggcaacagctgacggcctcggtgtcgccgcaacaagccgtccgacatcacgagttcaagttcagtagctcggcgcccgtttcgttcgacggggtacgctccacgccgctggatcgcctctgcgaaccccgtccgactatcacatagttcgcagaggtgaggaaactcgggtcaggaaaagttaaccagcttccagtgctggaacttccggtcgtctgaggactcgctcgaggaagccggtcgtggaaatcacggtgatctccacgacctcgtcccagccgctcccggcttccgggcggctccggcgcagagggtgacgccgggtcctccagcacgctgctggtattgatatgcggccattcctttcccgccgtcaagaggtcgtcgccacgcgacagagggttggccgcccagttgacccctgaaaatatcactccctggtcaggaaacagtcgtcagaatcgtccaggtctcccagagcagcccacaggacgatcttattttctcttctcccagcttcgtactgccctactttccctggaacgcctcgaaacgtcagcttcacctgcgaagcaggatggggctcgacgctcacagaaggggtgactatccgccacgtccccgtccgtaccgaggagtctccgcacactcgttcagccgtgaaatcgcccgccccaaggaatgtaatgggggatccattctcatcctcccaactacctactaggacatcacgtgaaatgacctgtttcaccacgactggagagtccgatggaaagagtccgcacccggagaccaaagatccagtagagcaccatagcagcggcagagccaccacccgtctccaggaactagacgcttttgacatactaaccatcctccattgccgaatggataacttaactagatctggtcaaaaaacagagtctccttccaggtgattacttgggttacatccgccatcggccccgaccgcctgtcaaaactcttagcggaacgctccccctttccatacccagtgaagatatgggcggcggaatggatgctctgaacctcctcaaccctgaatcgcacatttatcccacccttgctcgctccgagcactttcccagttatcgcgaaggaccctagtgccactttgaccatgttaacgtctacaccgccaccctttctgtatctatttagactcatgagatccagtgccgcatggatggatttctggaaaccagacatatttttcagactgtacttcgcgagagttcccaagtctgccttgtggtactttctccagtcgtccaccgcgacagctctagcttccttcgcctctgaagtagcagccatgtaagccgccatccggctgtcgtccccgtagacgacccggtgcgaaccaagccccagcacccagcgaagtatcaaggtatcgggtccatatgcgtccgcggcagcagggttgctcgcctccgccccaccgcagaagggccacaccggcgaggaagcgcagaacgctggcagttcctgccaaacctgagcggctcgcacacggattgcataataggggtcatcgatagccccgcccgtggccggcagaaccccacctcccggcagggaaccggtcggtgtcccgagcccgactccactccctgtactggccgttccgtctcccgtgctgtccccttcatcctctgtatcgcatgaggaaaggcagccatcgtctccgacaggaggcttaccctcgccgttggggtttccggggcccgccgctccgccgtcgtgtcgtgtttcgttgtggccggtgccgtcgtcgagccaggctccggtggggtcgctctgggtggcggggctgttgtcggcgtagctgtagccgttgagggattgggcgtcggtggtgtcgaggatggggtcgacgctgaggaactggccgatggaggggtcgtattcgcgggcgcctatgtgggtgaggccagtgttggtgtcgcggggtttgccgaggaagcccttgtcgtctggccaggggccgtactggggtttgccgcggtcttcgccgaacggggtggtatagcgcttggtgaaggcttgggtgtcccaggtgatggagagggtggaggtgccttggtggttgccggtgaggtaggtgagtttgctggtgccggattggttggtgcggagggctgctgtgatgccgccggcggagtagtagcgctgggcccaggtggtgccgttggcgcggaggtggagttcggtggtgccggcgtagaggatgcgttcgccgttgtccgtcgagcggatcaggaggttgccgtcggcgtcgtagaggtagttcgtggaggtgccggcttcggtgagcttggcgagtttgccttcgggggaccagaggaggtcttgcgtgcccgagatgccggggcgcttgctggtgttgcccgtagcgtcgtaggtgtaggagcgctcgggggtgttgcagtcggtcttggtggtggtgccggtcagggtgtggggctgggtctgcttggtgtagcagtaggtggtttttacgtcaccggtggtcttgtggtctgtttcggtgaggcgctggcctgcggcgttgtaggtgtagctgttccagtacggggccgggccggacagcgcggccgcactgcgagtgtccgcgcacttctgtgacgtgggcgtccatgcttcggtcagtctttggtggccgtcgtaggcgaagcactgggtttcggcggagctgctcgtcccgaggtctgtcgggtcgctgatcgcggtgatgttgccagcttcgtcgtagctgtagtcgagggcctgcagcatgtacgggtgcgtctggtcggtgacgtggctgtacgtcaggcgcccagtgccggactcgtatttgctggtgacgtagatgttcttgttgccggtgccgccggtgcccagggtgagctgttccggctgtgtgagggctgagtaggagacgtcgcgcaggtatccggtggcgccgccgaagctcttcaggttgccgagcgggtcgtatccgtagtccatgccctcggagggcagcccgccgagggccggctccgtggtcacgttcacagtgccgtcgatgttgtagtacgtctcgaacggcagggtggacggttgccccgccttgacgaacgggtcgccggcgggcagctccagttgggaggtcttcactcggctcaggtcgtcgtaggcggtgaccctcttggtgtaggccaggcctgacttgcctcccacgtagcgggtggaggttgcgggcaggcccttgaagacgctgtcgtaggtgtagccggtgacctggttggcgtccgtcttggagcccgtccaggtaccggtcacccggccgagtgcgtcgtagtcggtcaccaccgtgtggagcgggtccgtcgtcttgacgacctggtcgagcgcgtcgtactcggtggtcgttgttccgcggtcggggtccgtggcgctggtctggcggccgaagaggtcgtagcggtaggtccaggtggacttgtccgggccggtgacggtgtcctgcttgccgtccagcgcgtacgtgaacttcgtggacgtgtaggaggcgccgggaccggtgccgaagtcgctgtcggccgggctcttgtccgcgtatgcgcgggtttcggtcgtctggccgcgggcgtcggtgatcgtgcgctgggccgagccgccctgaagagcggtcgtcgctacggagtcacctgtgtagctggtgctggtcgtccacttcttgacgccgaagacggacaaggtgctggtgatggggcggcctgcgccgtcgaagacggtttcggtctggttgggggcctgtccgtactcggcgcgggtgtacgtgctgttgggtgcgttgtccttgtcgaagatgttcgcgtacgtctggtaggccagtccgcgggtgtcgtagcgggtgtcggtcagcaggcgtccgccctgcggggtcggcgactgggtctgcagcgggcgcagcagggcgtcgtagagggcgtaggcggtgttgtaggtctggccgtcttttttgagggtggaggttgagacccaggacggtttgttgtggtcgaggtggtaggcgtaggtggtgttcgccgcttggctgccgcggattcggttcggcagccatacgtcggtcagtcggccgagcgcgtcgtagttcagctcggtctttttcaggttggcgtcataggtgcgcagcgcctggccgcgacgggggtcgaggaagctgaccgtcttgtattgcgcggggtcggtgatgacggttttggtcaggggcccggcgtctgcgggggtgtattcggtggtggtggtgttcttgaccgcgtctggggtcttccccgcgtctgtaacgctcaaggggcggccgagggtgtcgtaggtggtggtcgcgatggtctgccagccggtggccgggcggtcgccgctggtgtcggcggtgggcgtgtagccggtggcacggccggtccatgtggcgtcgccctgagtgggcttctgtgtcggcgtccaggaggtggcggtgggggtgtcgtagacgatcgcggtgtcggcgagtacgtcggcgcgggtggtggtgtttgccgggagggagaggtcggcgtccttggtggagcagctgcggccgacggtgcgggtgcgggaggcgaggctggtgaggccggctgtgtcgttgcgggcgtaccaggtgcgggtgcacgtttcgtcgccgctgacggctgcgtcgccggagtcggtggtgctgaccggcatgccgtaactgtcgtagctggtactggtctggcgggcgcgccaggtcttcgggacggtgaggtaggtgtaggacttcgcggtggcagtgcgcacatagcgcgccaccaggtcgccggcgtcgggctggctctgtcgagcggtctccttggaccaggggtcgttggagctcgccgtgatcggggtggagccgttgtaggtgacctgttcgcgcagctgtccggcgtactggttgctgtcggtgaaggagggcagggcgaggtcgggtgtcgtgaggggcgggacggagacggtcttggtggtggtgcccttggtcttgtcgccgtccatgccctgcaggtagagcgagacggtgcgggagcgggtcacgcttgtcgctccggtccaagcggtgacctggcggtagccgcgccagtcggaccaggtgcgttcgtccttcggtgtgaaggggtcgtcgctgtagtgccaggcggggccgctgtagtcgtaggcgtactcgatgccctggttacctgaggccgggtcggagacggacacggccaggacccggtacttgtggaaccagtcgacagccgcgttctcggcgccgttgatgtgccagtactgcgggtagcaggagcgggtgttggtgtcctgcggggcgctcagcacctcgctgcgcttgcactcgggcccggagagggtgacggtggtgatcgctccggtctcggaggtgatcgtggagatgcgcgggcgggtcatcggcaggatgtcgtccgtcgcgtcgacccggttgggccgcatctggtaggtgaacgtgatcgggtcgaggtggaggaacgtgtcggcggtcttgccccagcggacgatggagttgagggtcaggacctggtcgctgctgtcgccgatgtctccgccgtccaggtaggactgctggagcacccaggcgtcgaccctgtcgtatgcgctggtggtggcgttgtaggagtaggtgtagatgtcggtgaggcgtttgcgggtgaagaaggaggggccggccgcgttgcagtcggagtcgtccttggagcagatggcgtcgtaggggacgtcgggccagttgtcggccgtgtccttggtcagactgccgcagtccgatacggtgcagcgctccgcgtagccgaaggtgaccttcgcgtcggccgggtcggtgaacagggcgtccttgcgcaggccgtactcgatccggttgaggtagccgccccggacgtaggaggtgtcggccgtcttcgccttgttcttcttgtagtagttcgactccttgctgtaccagaaggtggcggcgttgccgtgggtgtcctcgacgtagtccaggttccagcgccaggcctggttcagggagcggtcggcgaaggtgtcgccaccggtgtagccgggttcaccggagtcatcgccgaataccggtacggtccacacggagttggtgcgctgggtgccggcgccgtccagtttttccttgccgaagacgtacttggtgccgtcgcccgtggtgacggtccagtactcgccgtcgttgtcaccgttgtcggcgccggtggaccgcgtcaccttggacgcgtcgtcgttctccagccgccagttaccggtgtccttgtctttgaccaggctgctggacctgccgttgaggacgaggcgggcgttgtcgtacttccagcactggtcgaagaggtcgtcgtggccgtcgtcgtcgcacgagttgtaggtgcgctcgacgtaggactcggtgagggtgaatccctcgccgaccagtgtgccctggttgttggtggtcgcggtgcgcccgtcgatgcttcccgagtcgtaggacagcccgaggggcgggacgggtccggctgccgccgggggcagcgtgaagtcgtaggaccaggtgaaggatccggagctgccgcctgcctgccaggacgacgacggggccagcggcgtggccgcgtaattgcccgcgctggaggatgtcttggtggaggcggtggcggcggctgtgacggcgaggagcgtggtctctggcactgcgctgccggccgctgctgggggggcggctgccaggttcacggtcgctgagacgctctgatgggcgacgtcgttgtgcgagggcagtggctgctgtgtgcggcactgctgctgttgcggagtcgtcagggcgcaggcggggagctggacgaggtgcaggcgctgggcccagccgccgccgatggccgaggcgaagccgctgtagtcgacgctgacttgtgcagttccggcgctgtctgcttgtgctgtcagcaggacgcccgtgacgccggccttctgtgccgccttctggtcgagcacggtgatgtgcgccttgcccgccgcgggttgcttcgcggtgggggctgggcggccgtttcggcccttggcggacgcggtactggaatgcggggtcaccgtgaccgcggtgccgcccgcctcagcggtggccttgtggccgcgggtgagcggcagtgtggcttggccgtgcttgggccagcttgcttttcgttcggttcccgctcgctgggcctgcgccgcgttggcctgtttgtcgcgggcgactttctggcgtgccttcttggctccggggccgtgaaattcctggaccttgctggctttggtgccgggcacgtcgggccgccccaggccgcctggctctgccgcttgggccacctgtgccaggcccatggggacgatgagtgccagagccagcgactgtccgagcagtcggccgccgcggcggcgagcggcggaacggcgccgccatcgtgaggtgcctatgccaaaggccatcggttttgctccacccggtgcgtaaggagaagtgtcagcagggcgcccgcagaccgctgtgtggacggggcgcgtaggtgaggacggcaggatcgttggccgtcctcaccactgggtccgtcagtcgcccacggtctcgccgatctgttcgtaaccggccatcgcgcctgcccacaggcgtacctcggagacctggccgggcaggtagtgctgccaggcgccccccgtgaagcccttgccgagggcgaagtcgcccgagccggccttcgcggtgaacgccagcgcgtcgccgttcgcgacggcgcccagatagaggctgagcgtgccgtcctgtgcatcgaagacgccggtcagtctgaccgcgccgtcgaccagggctccttcgtcggaggacactgcggtgaacgtgccgtcggcgttgaggcggccgaaccgccagaagccgacaggaacggttttctcctcaagggtgtcctcgtccaggaccgtcttcttgtcggtcagctcgtaccagagcccccacgacgatccgtctgccgtacgttgccccaggatttgcgccttgtagccgacgttcttggagacgagctcgtcaccgtccagggaggccaacgtggtgaccgtgaaggacccggtgtcgtccagtaccggtccggcggtgatggcggcgtcatccacgccgtccaggttgatcgcctggccgtccagtgtcgccccgccggtcagagccaggggcctgccgtagccggaagtggtgtcctggatgctgctgccgctgccctggtcggccgaccatgcggcaaccagctccacactggtgtgctgggcggaagtcatcagccgcgactcgtcgccgacctgttcggcggtcagggcgtgctgccacacggacacctcgtccacggagccctgcaggtagtcggtgaaggcatcggcccagatcgcccggccgatctgcaaaggcccgttcgctgcccacggtgtcccggcatcggccgtgctctgcagccgtccgttgacgtagaggcgcagcttcttggcagcggcgtcgaagaccccggtcacatgcgtccacacaccgcggggtgtggcctgctgcgcagctgcggtatggacagtaccgtcactggcccgcatgctcaggctccaggtgtcgcctcctgcggccgcgtaggacagtccgaagggcgtgtacttcttcgggaacgggccggcgttgtcgggtgcctggcccagtgccgtcatcacgtgcgacgccttcgcgtccacgcgtacccacgcggccactgtgaaggaggcccgggtgtccagcaccgttgacgacgtggccgcgtagccggtactgccgttcaggctcagccccttgtcggtgatcggctcaggcagcggtgtgccggaggcgtcacgggtcagcagtccacgccgcccgcggtcatcgcgtgtggcgccgctggacagtgtggcgtcgtggtgcgcggcctgcggcacggtggtggagtccagggcggggccgcttgcctcgtcgaagtgccagcgtccgatcgggtcgtcaccggcggtggagacgacgaagtcgatctgcgcgatgtcgccagccctgccggtgccgacgttgtcgcgtccccggacctgcaaggtgtacgtgcctgatcgcggtggaacgaacgtggccgtggcattcttcgtcgaggaccaggcactcgcggaggacagtttgtactcgtacgacacgacgttcgtgtccgccgcattgggcttgaaagcgaaggtggcggtcacgcccgcgccaccttcgggcacacaggcattgggcacgcactcggtgtacggagacttgagggtgatcgtcggggcgcggggtgctgtcgcatcgatccggaagtagcagtcgtggtctgacacgcggctgctcagatgggctgacccgttgttgtagtaggaccaggtccaggcgtgataccggtacagcttgccgtcggtcagtttggaccacttcagcgtcacagccgcgttgtcaccgtagtagcccgtcgagggacggagttcgccgtttcctggtgtgacgtccgaccagctgtcgccgttttgaacatcgatgtcgaagaagacgcgcaactgagcgtccttctcaccgccgccctcggtctgcgccgtcgctttgagggtcggctccgggtcggagacgatcgccgggtcactggcgctgtgctcgcacacaggcgtcgcgctgctcccccccgcctaccaggccgaccgaggtgggccggtccggcagccccacgaagtcgaccgccaggaccgcgtcgttcctgaaccgcttccaggccgatgcgtccgactcgtcatgggcccggatctccagggtgagccgcgagaacttgcccgccgcgaagtcgcggattgtcggggtcaggttctcgttcggctcgtccgggttgtcatggaactcgatcggtgccttcggcgaatccgggtcacacagcgatccgcggccggccgatacattccggtcgcccatccagtccagttccctgggccgcgacgaccaggtcgtggacgaggagatgttgttcgtgcgcaccaggtcgacccagcgcggtgagcactggaacgcccacggctcggtcacccggaaggtggcgtcgaggaccttcttgcccttgaggtcggccggcgagaactcgtagtacagcttctgcacataccccggaccgcagtagtagccgctccaggtagcgcatttgcccgcgcccttgccctggtcgtcgtcgccgttgccccaggcgtaggactcatacccgtcactgcgcagaagggttcgctccgactcgccccaggtgatgggagggtcgatgaagacggggaacgccgatgcgggggtctggttcagcatgtccgcgtccggcacgaccgacagcgagtcgccggtgacgttcacatccatgtgtgcgaccgcgtcgccctggccgggctccacgccggagcccgacggcgcggactcggccgggtccgacggcttctcctcccccgcagccgcgaccctggccgtcttcagctgcgtctgcgtcgccgtgccaccggccgagtcccacatccgggcagggggcgccttgaagacagtgcggccgtccgcatccaccgccgccaggttgccggccgccccctcccggacgtccagcccctgggacttcaggccgaaggtgagcttcttcagctcatcactcgccgcggcctcgggcgtcttgacgacgaacaccgactggaaactctccggcgtcgccgtcaccttcaggtcgacacccggcagaacatccgcgtacagggcactggggccctccagacgcggcaccggcagcctccccggccacccgagttccagcgacttccccggctcagccacccgagccagcggcgctgtctcacctccgccggaaagcgacatccgcacagaggcggccttcggtcccaccgaaccatcggagcgcttctccagcgtcgcgtccggcgcctgccagccaccacccggcttctccacacggattggaacggccgactcctccagtgtgaacgtcgacccgtccggattggcatagacggtggactgctcggtgcgctcccccgtcacctccacccacggatctgctgcgggccgtgagaaaacgtcgccacgccgctgcgaccacttgcatggaggaggggctcatggccagccttgcggccggtcccgatccgtcgtgctgggggggggctgtggccacgcgcgggacgctgcaagtgacgtcggcgcgtctgagacctaccacccgcgccgaagtccgcaacggcgaagccctcaccgcccccgaactgccaccccaccgggcgcgtctggtaactccccctacgacgaccgctatatcagctggcccagtggcctgggcatcggccacctcgtccccctcgccgaagcctggccctccggcgccagcaccaggccccctgccgaacgtgaggcctacgccaacgacctcggcgacgaacgcgacctcatcgccgtctccgccgcctccaaccgctccacagccgaccaggaacacctggctccccctggccgccggctaccactgcacctacgccaccgactggatcgcagataaaaccggctggaacctgaccatcaacacccccgaacagaccgcactggccgaagtcctcgaacagtgccccggcaccccgatcaccgtcaccctcgcccggggcgcggacagttccgccccggcgcggcacctcagcgtcccggtaagtcgtgatcttgctggtgctgagcgcttcagatggcgggcctcgccgcctgaacagctcgatgtgagccgtccttcggtcacgcgccccgtgccgggccggtcctgcagatttgccatggacgggccgcccgcggctggcatatcttccctcagcgcgcgctcttccgcgggcgattccgtttccgtgcctgtggggggcccatcatcatgtccgcatccagcgatgtctgtccgcggcccgcgctgcccaaccgggtaccgcggtcaccacgaggcctcctggccggtctgtcggcgctgctcgcggccgtcgccctcagcgacctgttcgccgtctacgccggcgtccgggcatacatgctgatcgatgaggaccggggcctcgtttttgcctctcagcaggagctggaccgtgccgacgcgctgtaccagacggcaggacagctccagatggccacgttccttgcctgcgcaatcgtcttcatcgtctggttccactggatgcgccggaacgccggggtgctcgggccggaccggttccgcaaccgccccagctgggcgatcgggtcctggttcatcccgctggcgaacctctggatgccctatcgggtcgccgtcgacatgtggggggccagcacgcggctgccggccgacggcgagccgtacaaggtctctttctggccggtgaacctgtggtggggcctgttcctcaccacgaccctgttcaaccggtacgcctcacagcgctaccaggacgccgaaaccctcggaggcatccgggacgccgtgcttcaggtgatagcggccgacatcctggacatcgccgcggcggcggccgcagtacacttcgcggtccggctgacggccatgcagcggctgaaggcggccgaggggccgttcagctcggtctgagccgatccggggtagatccaaaacccagtgataggcgagcgcttcagctggtgaggcccgccaactgaaacagctggggtattagcagatactcagtccacacgatgcccagctcgcggatgccagccagaaacagcgctccgccatgaccgtgccccgcccgggcccggccagcgtcctatgcgctgcggggccgggggcccggcggctccctcccggccttcccggctgtctgcttcttcgccgtcttcttcggcaggcgcatctcgtgcacgtccgcctccaatctggtgactctacttaccgcctgtcggtaaacgaaggcgagctcaaacgaacagcatcgtccccgtcgccctcttccgggcaccgttcttccggacctacggcatcacagccccccggacggcgagaagcagctgtacggcggccggggggctgtgatgccgta

SEQ ID NO: 225 - DNA, 5575 bp, Unknown
  Kingdom: Bacteria, Phylum: Actinobacteria, Class: Actinobacteria, Order: Streptomycetales, Family: Streptomycetaceae, Genus: Streptomyces
cgacgtcctcgccgacctcgccgtagaacgcgagggtgaggtgccagccgggccgcccggtccagcgcagccgctccgccccgggcagcccgcgcaacgccgccacctcggcggcaagggcgtccaggacgtcgtccgggggcagcagggcggcgaagagtctcatgggaccagtgtccccaccgcaggcccggacgaggcctgcgtaccctcccccggaccggacgcgtccctggcaccgtgcgtaccactggacccaggaccgtccgggcaccgtgcgtaccgccggacccaggaccgacccggaccgtgcgtaccgccggacccgggaccggacgcgtcccgggcaccgtgcgtaccgccggacccgggatcgtcccggcggctcacgccgccgccgccagttcctctctgcgttcgcgcggtacgaagctgaccttcgggtggccgcggtgccagcccaccgacaggcggaggtcgcccatgcgggccaggaccaggccgatggtgacggcggcggtgaccgagatcaggccgccgagggcgaagccgacacgggcgccgtaggcgtcggtgatccagccgaccaggggggcgccgagcggggtgccgccgacgaagaccatcatgaacagcgccatcacccggccgcgcatggccgggtcggtggccatctggaccgtggtgttggccgtgacgttgacggtcaggccgaagacgccgatcggtgccatgagcagcgcgaacagccagtacgacggcgcgagcgcggccacgacctccagtacgccgaaggcggcggcggcgccgaccagcacgcgcagccgggcggtcccgcggcgggccgcgagcagggcgccgaccagggagccgaccgccatgacggtgttgaagaggctgtacgcgccggcgcccgcgtggaagacgtcgtcggcgaaggccgacagccacaccgggaagttgaacccgaaggtgccgatgaagccgaccaggacgatcggccagatcaggtcggggcggccggcgacgtagcgcaggccctcgcggagctggcccttgccgcgcggggcgcgctcgacgacgtgcagttcccgggcgcgcatcagcagcagtcccgcgatgggcgcgacgaaggacagcccgttggcgaggaacgcccagccggtgccgacgccggtgatcatgacgcccgcgaccgcggggccgaccaggcgggccgactggaagttcgccgagttcaggctgaccgcgttctgcagctgcttcgggccgaccatctcggagacgaaggactggcgggccgggttgtcgacgaccgtggcgaggcccatggcgaaggcggcgacatagacgtgccagacctggacgtgcccggtgagcgtgagcacggcgagcgcgaggccggtgaggcccatcgcggactgcgtgcacagcagcgtcggccgcttgggcagccggtcgacgaggacgccgccgtagaggccgaagagcagcatcggcaggaactgcagggccgtggtgataccgacggccgcggaggagccggtgaggctgagcaccagccagtcctgggcgatgcgctgcatccaggtgccggtgttggagacgacctgccccaggaagaacaggcggtagttcctgaccttcagggagctgaacatcgaggacttgcggggggtgtcgggggcggactgggagtcgtgggcggtcggtgcgggggcggaagctgctccggatcccgtactcaaaagggttcgcctccttgcggctgctgatgcgctgtgcagctgacgtacttcagagctgtcgtgcttcgagctgtgatgcttcgagctgtcgtgcttcgagctgtgatgcttcgagctgtcgtgcttcgagctgtgatgcttcgagctgtcgtgcctacggatggccttacagccggtcttacagatgtgcgagcttctccagcacgggggcggcagcgcgcagcttcgcccactcgtcctcgtcgagaccgtcgaccaggcgggccaggaacgcgttccgcttgcggcggctctcctcgagcatggtctcggcctgctcggtctgggtgacgaccttctggcgccggtcctcgggatgcggctccaggcggaccaggcccttggcttcgagcagcgcgacgatgcgggtcatcgacgggggctgcacgtgctccttgcgggccagctcgcccggtgtggcggtgccgcagcgcgacagggtgcccagcaccgacatctcggtggggctgagcgactcgtcgacccgctggtgcttgagccgacgggacaaccgcatcacggcggagcgcagagagttcacggcggccacgtcgtcgccacgggtaaggtccggcatgttctttaggataggtcattactctctctaaagaccacccgggacacgcacatggcccgtgactccggccactcctgtcggtccgcgtcactcatatgggtgatacgaacgaggaacgtgacacctcatgcggaaccgggccgcgaccctcgtctccatggggaccagcgtgctcagcctgcgcatggaccgcgagctgctcgaacggctccggtcccacgccgcgaaaagaggaatgagcgtccaggactatgtcgtccggacgctcattcgaaatgatttcgacgaacggttccaggccgccgtcgaggagacggaacggttctacggggtcacctgaacccctcgcctgaggggccccggtccgcctgcccgtggatcaggtcagacccagggccggcatcaggtagtagaaggcgaagaccgccgagaccacgtacatcgccaccgggatctcgcgggcccggccgacggccaggcgcagcacgacgaaggtgatgaagcccatgccgatgccgttggtgatcgagtacgtgaacggcatcatcagcatcgtcacgaaggccgggacggcgatcgtgtagtccgaccagtcgatctcccggatcgaaccggacaggatcaggaagccgaccgcgagcagcgccggggtggccgcctgcgacgggaccatggtggcgatcggggtgaggaacagcgcgacggcgaacagcaggccggtgacgatgttcgcgaacccggtgcgcgcgccctcgccgacgcccgccgtggactcgacgaagcaggtggtgcccgaggaggaggtcgcgccgccggccgcgacggcgatgccgtcgacgaagaggaccttgttgatgccgggcatctggccctcggcgttggtcagcttggcctcgtcgccgatgcccatgatcgtgcccatcgcgtcgaagaacgacgacagcagcacggtgaagacgaacaggacgccgttgagcaggccgaccttgtggaacccgccgaacaggctgacctggccgaccaggccgaagtcgggggtggcgacggggttgccgggccacttcggggtggtcaggccccaggacggcacgtgcgcgaccaggttgacgatcacggccagcacggtcatggcgatgatcgagatcaggatggccccgggcaccttgcgcaccagcagcgcgagcgtcagcagcgcaccgagcacgaagacgaggaccggccagccgttgaggtgaccgtcggcgccgagctggagcgggacggtggtgtgcgcctcgttcgggatgcgcgagacgaagccggagtcgacgaggccgatcagcatgatgaacaggccgatgcctatggcgatgcccttgcgcaggccgaacggcacggccgccatcacgcgctcgcgcagcccgctggccaccagcagcatcaccacgaagccggccaggacgaccatgcccatggcgtcgggccaggacatgcgcggggcgagctggagggcgacgaccgtgttgacgccgagacccgcggcgagcgcgatggggacgttgccgatgacacccatgagcagcgtggtgaaggccgccgtcaggacggtggcggtgaccagctggccgttgtccagctggtggccgtacatgtccttcgcgctgcccaggatgatcgggttcagcacgatgatgtaggccatcgcgaagaaggtggcgaatccgccccggacctcgcgggcgagggagctgccccgctcggagatcttgaagtagcggtcgagagcgccgaaggccgacggcgttcccggcttctggggggcggggaccttggcggtggccgaggtggacatgcggatgacctcaggggtgcggggagtacgtgagtaccgggccgggaaggggaccaaacgtgaacgagccccgccacttccgtcaccagcgggtttcccccggtcgccctgttggtgtttcctacgaagagaagtagccagactcagaccgtttcagtatgaacatatgaagcggaaaaggctatctccgcgcgtagaccccttgtcctgtttacgcgccgtccccctgtgaccggcgcggaccggcgccccggcccgcgtgtgccgggccgtaagctgagcgcatggcgaagtggacccccaagcacgaggcgccggagcccctggagggccccgtggtcgccaccatcaccggcggcacgatcgtttggttcgtcctcttcctggtccagatccccttctacggctggttcgacgaccacggccacacctggtggctgtggacctgcctggccggcggctgcctcggtctggtcggcatctggtacgtccgcaagcgggacgcggcgatcaagcgggcggcggcgcaccgcgaggcggccccggccggccgcccggttcgcgccgaccgtacagtgaggcagaatcgacacaggacgttcatacgcgacggccaaaacaccgcaacgatcaccggatcaccggatcagcagtccgccagatcaccagaccggcaagctcaccccgctccccaagacctccgcagacctgaaggtcccatgcccccgacgctcgcctcactcgtccaccactccgcgctgaaactgaccgtgcgcgcgggcggggaccgcctggacgtgcccgtccgctgggcgcacgtcagcgagctggccgaccccgtgccgtacatggagggcggcgagctgctgctgatcaccgcgctcaagctggacgcggaggacgccacggccatgcgccgctatgtgaagcggctggtcggagccggtgtggtcgggctcggcttcgccatcggggtgaactacgaggagatccccgaggcactcgtcacggcggccgaggaggagggcctgcccctcctggaggtgccgcgccgcaccccgttcctcgcgatcagcaaggcggtctcggccgccatcgccgccgaccagtaccgcgcggtcacggccggattcgccgcccagcgcgaactgacccggcaggcgctgaacgccggacccgaggggctgctcaccgcgctcgccgcccaggtcgacggctgggcggcgctctacgacgcctcgggcgccgtcgtcgccaccgcacccgagtgggcgctccgccgggccgcccggctcaccgcggacgtcgaacggctgcgcgaccggcccgcgcccgcctccgccgtcgccggcggcggacccgagaccgaggaccgcgtcg

SEQ ID NO: 226 - DNA, 4129 bp, Unknown
  Kingdom: Bacteria, Phylum: Actinobacteria, Class: Actinobacteria, Order: Streptomycetales, Family: Streptomycetaceae, Genus: Streptomyces
caggcgacctgcccggctgcctggaggccctgcctgctgggaggtcccggctgccaggaggccccgctgtcatgcgggcccacccggctgccagacggccccccggccgctacagcggcgggagtaccgggagtgcaccgcccgtcgtggtgagcgcggtcccgtcccgccgtccggcgagccagcccagcaggtccgccggcgctcccgtgacggtgatcgtccccgtttccttctcctcgtcccgctcccggcccgtgctccacgcgcgcgtgccgtccgtcagccgggtcgcggggacgtcggggtggcccgtgaaccgctgtgcgaggaaggcggtctcccgctccgtgaactcctccggcaggtcctccagctcgtagccgatgtcgaggtcgacatggtgcagttcgacctccgcccagcgccggaacggcagacgggaggcggtgtcggtgaccccgttgcgcaactccaaggtgcgcgaccagtcggccggcacgaggcctgccgcgcggaagcgggccgcgctctcgcgtacgtcggccaggtgcgcctccagcggacgcggcgcgtcgcgctcgatgtccgcgtcccgcgcctcggcggagaggtacatgggacggccttcgaggacgttgacgagcgcgtccgcgttgcgggcgaggtgggccaggacatggccgcgggtccagccgggcagccgtgactggtcggtcacagccgcgttgtccagtctggcggccgcgctgagcagtcgttcggtggcttcctgtacagacgccaggtcacgcgcgtgatcaatcatgagcccgaccctagcggcgccacaccttcgggtgaaggcggcggaacaccgccgtaaatcgaatgcgcgtgcgatatcgtcgccggtggcgtcgggcatgctggagagccggggattgttgagtatccgggcggatccgggaatcccacccggcgttgtcagtggctccccctagtctgaagaagcacgggggccccgcccctgtcacttctctcaagaaaggtgcggaccggcgtggccgaccgtctcatcgtccgtggcgcgcgcgagcacaacctgaagaacgtgtcgctcgacctgcctcgtgactcgctcatcgtcttcacgggcctgtccggttcgggcaagtcctccctcgccttcgacacgatcttcgccgagggccagcggcgctacgtggagtcgctctcctcgtacgcccgccagttcctcggtcagatggacaagccggacgtcgacttcatcgagggcctctccccggcggtctccatcgaccagaagtcgacctcgcgcaacccgcgctccacggtcggcaccatcaccgaggtctacgactacctgcgcctgctcttcgcccgcatcggcaagccgcactgccccgagtgcggccggccgatctcgcggcagtcgccgcaggccatcgtcgacaaggtcctggagctgcccgaaggcagccgcttccaggtgctctcgccgctggtgcgcgaacgcaagggcgagttcgtcgacctgttcgccgacctccagaccaagggctactcccgcgcgcgcgtggacggcgagaccgtccagctctccagcccgcccacgctgaagaagcaggagaagcacaccatcgaggtggtcgtcgaccgcctcacggtcaaggactccgccaagcgccggctgaccgactccgtggagaccgcgctcggcctctccggcggcatggtcgtgctcgacttcgtcgaccttcccgaggacgaccccgagcgcgagcgcatgtactccgagcatctgtactgcccgtacgacgacctgtccttcgaggagatggagccccgctccttctccttcaactcgcccttcggcgcctgccccgagtgcaccggcatcggcacgcgcatggaggtcgaccccgagctgatcgtcccggacgtggagaagaccctcgacgagggcgccatccacccctggtcgcacgggcacaccaaggactacttcggtcgcctgatcggggccctcgccgacgcgctcggcttccgcaccgacatcccgttcgccgggctgccgcagcgcgccaagaaggccctgctgtacggccacaagacgcagatcgaggtccgctaccgcaaccggtacggacgtgagcgcgtctacaccacccccttcgagggcgcggtgcccttcgtcaagcgccggcacagcgaggccgagagcgacgccagccgcgagcgcttcgagggctacatgcgcgaggtgccctgtcccacctgtgagggcacgcgcctcaagccggtcgtgctcgcggtgacgctcatgggcaagtcgatcgccgagatctccgcgatgtcgatcagcgactgtgcggacttcctgcgcgggctgaagctcgacgcccgcgacaagaagatcgccgagcgtgtcctcaaggaggtcaacgagcgactgcgcttcctggtcgacgtcggcctggactacctctcgctgaaccgcgccgcaggcacgctctccggcggcgaggcccagcgcatccgcctggccactcagatcggctccggactcgtcggcgtcctctacgtcctcgacgagccgtccatcggcctgcaccagcgcgacaaccaccggctgatcgagaccctggtgcggctgcgcgacatgggcaacacgctcatcgtcgtcgagcacgacgaggacaccatcaaggtcgccgactgggtcgtggacatcggccccggcgcgggcgagcacggcggcaaggtcgtgcacagcggttccctgaaggagctgctcgccaacgccgagtcgcagaccggccagtacctcgccggcaagaagtcgatcccgctgcccgacatcaggcgaccgctcgaccccgcccggcggctcaccgtgcacggcgcccgggagaacaacctccaggacatcgacgtgtccttcccgctgggcgtcttcaccgccgtcaccggcgtctccggttccggaaagtcgaccctggtcaacgacatcctctacacccacctggcccgcgagctgaacggcgcgcgcaacgtccccgggcggcacacgcgcgtggacggcgacgacctcgtcgacaaggtcgtgcacgtggaccagtcgcccatcggccgcaccccgcggtccaacccggcgacgtacaccggtgtcttcgaccacatccgcaagctgttcgcagagaccaccgaggcgaaggtccgcggctacctgcccggccgcttctccttcaacgtcaagggcggccgctgcgagaactgcgcgggcgacggcaccatcaagatcgagatgaacttcctcccggacgtctacgtcccgtgcgaggtctgccacggcgcccggtacaaccgggagaccctggaggtccactacaagggcaagtccatcgccgatgtgctgaacatgccgatcgaggaggcgaccgacttcttcgaggcggtcccggcgatcgcccggcacctcaagaccctcaaggacgtcggcctcggctacgtccggctcggccagtccgcgaccacgctgtccggcggcgaggcgcagcgcgtcaagctcgccagcgagctgcagcgccgctccaccggccgcacggtctacgtgctggacgagccgacgaccggcctccacttcgaggacatcagcaagctgctgaaggttctctccggcctggtcgacaagggcaacacggtcatcgtcatcgagcacaacctcgacgtgatcaagaccgcggactggatcgtcgacatgggtcccgagggcggcgcgggcggcggcctcgtcgtggcggagggcacgcccgagcaggtcgccggggtgccggccagccacaccggcaagttcctgcgcgagatcctgggtgcggaccggatcagcgacgcggagccggtgaaggcaccgcgcagggccgctgccaagaaggcggtggcagccgcgtcgaccgggcgcaagacggccaccgccagcgcgacggccggtggcacggcgagcaagaaggccgcgcccgcgaagaagaccacgcggacgcgcaaggcctgaggcgcacccggcggccaccacggcaaccaccacaggcaggcgccccgcgggacatcccgcggggcgcctgcctgt

SEQ ID NO: 227 - DNA, 5873 bp, Unknown
  Kingdom: Bacteria, Phylum: Actinobacteria, Class: Actinobacteria, Order: Streptomycetales, Family: Streptomycetaceae, Genus: Streptomyces
gtgcacgggggcgagcgggccgcgtacgggcagcaggacgagccgggcgcggaccgagccggggcccaggccgccgccgggcacgtccaccaggacggaaccggccggcggcggtgtctccttgtgctggccccgcagcccctcccagacctggagcgcgtcggcgccctccgggccggcgcccgccgcgtacagcagccgtccgtccggcgtctccaggaagaccgggttggagccgaagtcggcgaggatgccgaggacctgcgggatcccgccgccgccgagcagcgcctcggtgcagcggcggtgcacctcctcggcgcgctggagcagcgcgtagtggccgttgacgatctccgtgtggatctcttcggtgaccgtgacgaacggcacctcgcggtgcagctggacgagcgggagacccgcggtgcgggcggtctccacgagcgcggcgggcagccgggtgaagcgggggcccagctcgacgacgagggccgcgatgccgcgctcggcgagggtgcgcacgaaggcgcgctggtcggcggggcgggtgcccagaccgtagccggtggtcagcagcagctcgccgcccttgagcagcgaggcgatgttggggacctcgcccgcgtgcacccagcgcaccgtgcggcccagccggtcgccgccggccacgatctcgggcaggccgctgcggaggccgggcagttcgagggcgcgctgcacggtgatcccggcgccctcggtgtcgagtctgcggtccatgaaaccggacgctacctggggaaacgccaccgggacagtaccgggtggacggcaacccggcagccagtgggccaccgggacgccgccgtggcgcgcatcagcctccgtaggccccgctggccgtcaggcgcagtgccgtgtcgatcagggggacgtggctgaaggcctgcgggaagttcccgacctggcgttgcaggcgcgggtcccactcctccgccagcagaccgaggtcgttgcgcagggacaggagcttctcgaagagtttcctcgcctcgtcgacgcggccgatcatcgccaggtcgtcggccatccagaacgagcaggcgaggaaggcgccctcgtcgccggggaggccgtcgacgcccgcgtggtcgccgtcggtggggtagcgcaggatgaagccgtccgaggtggacagctcgcgctggatcgcctcgatggtgccgatcacgcgcttgtcgtccggcggcaggaagcccatctgcgggatgagcagcagcgaggcgtccagctcgcgcgagccgtaggactgcgtgaaggtgttgcgttccttgtcgtagcccttctcgcagacgtcccggtggatctcgtcgcgcaggtccttccagcgctccaccgggccgtcgacgtcgccggactccatcagcttgatcgtgcggtccacggcgacccacgccatgaccttggagtgcacgaagtgccggcgcggcccgcgcacctcccagatgccctcgtccggctcctgccagtgcttctccaggtagcggatcagcttgagctggagcagcgaggcgtagtcgttgcgggccaggcccgtcatgtgggccaggtgcagggcctcggtgacctcgccgtagacgtcgagctggagctggtgcgccgcgccgttgccgacccgcaccggcgaggagttctcgtagccgggcagccagtccagttccgcctcgccgagttcgcgctcgccggcgatgccgtacatgatctgcaggttctccgggtcgccggccaccgcgcgcagcagccactcgcgccaggcgcgggcctcctcgcggtagccggtgcgcagcagcgaggacagggtgatcgccgcgtcccgcagccaggtgtagcggtagtcccagttgcgcacgccgccgatgtcctccggcagggaggtggtgggcgcggcgacgatgccgccggtgggggcgtaggtgagggccttcagcgtgatcagggagcggaccaccgcctcgcggtaggggccgtggtacgtacagtgcccgacccactcgcgccagaagtcctcggtcgcctccagcgactgctcgggctccggctccggcggtgcttccttgtgcgagggctgccaggagatggtgaacgcgatccggtcaccgggagcgaccgtgaagtccgcgtacgtggtcaggtcctcgccgtaggtctccacggacgtgtcgaaccacacggagtccggtccggcgaccgccacggtgcgcgtctcgttgcggtgcacccagggcacgacccggccgtaggagaagcgcatgcgcagggcggagcgcatcggcacccggccggtgacgccctccacgatgcggatcacctgcggtgcgccgtcacgcgggggcatgaaatcggtcacgcggaccgtgccgtgcggggtgtcccactccgattccaggatcagcgagtcgccgcggtagccgcgccggtccgccgtgggcggctcggcaccctccgggaacgcggggccgagccgccagaagccgtgctcctcggtgcccagcagaccggcgaagatggcatgcgagtcgaagcggggcaggcacagccagtcgaccgtcccgtccctgcagaccagggcagccgtctgcatgtctccgatgagtgcgtagtcttcgatgcgcccggccacgtgcaactccagtcgaacggccacgtcaccccgcatagggggcggtcgctagtgcggtcaagggggttgtgatgcgtcgttgagcggttcagcagaccgccggtcggccgtgaggcagaacgacaacctttgctcaacgaactgacgagctctcgttgttccggtctatacgggcgggggtggtgccgttttgccggccgggctcggcagcgagtgtccgagcaggatacgacgcacgtagatgatctgcgcgccgctccggacaacccgcatgcgccgaacgggtgagccaagggtgagggatccgtgaccgtcgcgcacccgtgccgacgcgtgcgcggagcgtggccggaagccatcaccctccggcgctgataccctggtagcccgtggaccggtgggctcgaaacccccgaaccgcagcgacggcaccccagccggacaacccgggttccccgggccggacagccgtaccgccccacaatccgcgaccacgggagccccctcttggccatgccgcccaaatcaacgacgaccaagcacatcttcgtcaccgggggtgtcgcctcctcgctcggaaagggcctcaccgcctcgagcctcggcatgctgctcaaggcccggggcctgcgcgtcgtgatgcagaagctcgacccgtacctgaacgtcgacccgggcacgatgaaccccttccagcacggtgaggtgttcgtcaccaacgacggcgccgagaccgacctggacatcggccactacgagcgcttcctcgaccgcgacctggacggctccgccaacgtcaccacgggacaggtgtactccacggtcatcgccaaggagcggcgcggcgagtacctgggtgacaccgtgcaggtcatcccgcacatcaccaacgagatcaagcaccgcatccggcgcatggccaccgacgaggtggacgtcgtcatcaccgaggtcggcggcaccgtcggcgacatcgagtcgctgccgttcctggagaccgtccgccaggtccgccacgaggtcggccgggacaacgtcttcgtggtgcacatctcgctgctgccctacatcggcccctccggcgagctgaagaccaagccgacccagcactcggtcgccgccctgcgcaacatcggcatccagccggacgccatcgtgctgcgctgcgaccgcgaggtcccgaccgctatcaagcggaagatctcgctgatgtgcgacgtcgacgaggacgccgtcgtcgcctgcccggacgcgcgttcgatctacgacatcccgaaggtcgtgcacaccgagggcctggacgcctacgtcgtgcgcaagctcgacctgcccttccgcgacgtggactggacgacctgggacgacctgctcgaccgcgtccacaaccccgaccacgagatcaccctcgccctggtcggcaagtacatcgacctgcccgacgcctacctgtcggtcaccgaggcgctgcgcgcgggcggcttcgccaacaaggcccgcgtcaagatcaagtgggtcacctccgacgactgcaagaccccggccggcgccaaggcgcagctcgccgacgtcgacggcatctgcatccccggcggcttcggcgaccgcggcgtgctcggcaaggtcggcgcgatccgctacgcccgcgagaacaagatcccgctgctgggcctgtgcctgggcctgcagtgcatcgtgatcgaggcggcgcgcagcctcgccgacatctcggacgccaactccaccgagttcgacccggccaccgcgcacccggtgatctccaccatggccgagcagatggacatcgtcgccggtgagggcgacatgggcggcaccatgcggctcggcatgtacccggccaagctggccgagggctccatcgtgcgcgaggtctacgacggcaaggagtacgtcgaggagcgccaccgccaccgctacgaggtgaacaacgcctaccgcgccgaactggagaagaaggccggcatcgtcttctccggcacctccccggacggcaagctcgtcgagtacgtcgagtacccgcgcgacgtccacccctacctggtcgccacgcaggcccacccggagctgcgctcgcgcccgacccgcccgcacccgctcttcgccggcctggtgaaggccgccgtcgagcggaagatcggcaagtaacgcaccggttgtacggttgccggggtgcccactcgtgaagtgggcaccccggttgcgtacaggtacgcagtacgacgtggagcgtgcggaaggacagggcatgacgatcaaggacacccccgaggagtgggagatccggggcagccggacgccgttcaccggggccaagacctcgatgcggaccgacgaggtggtcatgcccgacggctccgtctcctcccgcgactaccaggtccaccccggctccgtggccgtcctcgccctggacgaggaggaccgcgtcctggtcatccgccagtaccgccacccggtgcggcagcggctgtgggagatcccggccgggctgctcgacgtgcccggtgagaacccgctgcacgccgcccagcgcgagctgtacgaggaggcgcacgtcaaggcggaggactggcgggtgctgaccgacgtctacaccacgcccggcggctgcgacgaggccgtgcggatcttcctcgcccgcgacctgtccgaggcggagggcgagcgcttcgcggcggagcacgaggagacggacatggaactggaccgggtgccggtcgacggcctggtgcgcggtgtgctcgcgggcgagctgcacaacaactgcctcgtggtgggcgtcctcgcgctcgtcgcggcacggcagggcgacggcctggacgcgctgcgcccggcgctcgcgccgtggccggcccgtccgttcgagtcctgagcgagtcccgcctcccgcctcccaccgaggccggtgtgaccatcggctgatccgatcgggcgacctcccgccgtgctcgtcccggaacgtcgcggagcgtgaactagggtcatcgaaaagggccaggccctgtcgtcggactcccgcctgcctcgcgacgccatgcacgccctctcgccgcaccgggtccggacccgagtacatccagtacgaggatcagggcccggcaccccccaagctctccgagcaggggccccagggcacgcacctgacgccgcgaggcccgccctgcgggcgggacgacgggaattcgacgacagg

SEQ ID NO: 228 - DNA, 6413 bp, Unknown
  Kingdom: Bacteria, Phylum: Actinobacteria, Class: Actinobacteria, Order: Streptomycetales, Family: Streptomycetaceae, Genus: Streptomyces
ccctgctgatcaaccgcctcggcgcacaccgcgaggcggttgatcagcagggcgttgcgcagttcggtgtggagttcaccggactcgttcgaggcggtgccgtcgacaccgaggccgacggggacgccggccttgagcatgtcggggacccgggcgatgccggcggccaggcgggcgttggaggaggggcagtgcgcgacgccggtcctggtgcggccgaaggcggcgatgtcggagtcgttcatgtggacgcagtgcgccatccacacgtcctcgcccagccagcccgtcgactcgaagtagtcggtggggcccatgccgaacagctcgtggcagaacttctcctcctccacggtctccgagccgtgggtgtgcaggcgcacgccgagccggcgggccaactcggcgccctggcgcagcagttcggtggagacggagaagggcgagcagggggcgacggccacctgggtcatggcgtcgaaggaggcgtcgtggtgcttcttgacggtctcctcggtggcggcgagcgcgccctccagcgtctcgacggcgaagtcgggcggcaggccgccgtccttctcgctgcggtccatcgacccgcgggccagcgtgaagcggacgcccatctcggaggcggcccggatgatcgcgccggacaggtcgccggagccctgcgggtagacgtagtggtggtccatggcggtggtgacgccgccgcgggccatcatggcgagcgacccctgggccgcggcgtacgccatctcctcgtcgatgcgcgcccaggtggggtagagcgcgacgagccagttgaacaggttgtggtcggtggccaggccccgggtgatccactggtagaagtggtggtgggtgttgaccagaccgggcgtgaccaggtggccgcgcgcgtcgatccggcgcaccacgttctccaggcccttgggggcctggccggagccgaccgactcgatcctgttcccggcgatgacgacgtgtcccgacgcgtactcggtgtcctccgcgtcgacggtcgcgatcgcacagttctcgatgacgatgcgctgggctgccgatggtgccattgcgcttccttgtctttcagtggcggcccgtggacagggagcccacggggagggcacggcaggaccctaggaggatttgagtgccggggccgtacggctccgggtgccgagatggtggaagaacaggttgagcaggaccgcgacgatcgctccggcgctgatcccggagccgaggacggtctgcgcccaggccgggaactcggcgtagaaggtgggcgcggcgagcgggatgatgcccgcgccgagcgcgacggccaccaggatgatgttggagctgtcgtcgagtccggcctcggagagcgtacggatgccgctgaccgcgatcgagccgaacaggacgatgcccgcgccgccgaggaccggcatggggaccagggagacgaccgcgccgagcaccgggaaggcaccgaggacgagcagggcgccgccggcgacggcgacgacgtagcggctgcggacccgggtcagcgagacgacgccgacgttctgcgcgaaggcggaggtggggaagccgccgaagacggggccgaggagggtggcgatgccgtcggtgcgcaggccgcgggtgatggtgcgggagtcggcgcggcggtcgcagatctcgccgagggcgagcatgccggcgctggactcggtcatcaggaccagcatcacgatgcacagcgacaggatggccgcgggctggaagacgggcgcgccgaacgcgaacggggtgggcagggccgcgacgggcgccgacttgatgccgctgaagtcggccatgccgaacgggacggcgaccagggtgccgatcaacaggccgaagagcagggcgacttgcttgacgaagcccttgccgaagcgctggatcagcaggatgacgacgagggtgaacgcggcgagcgcgaggttcttcatggcgccgaagtcggcggcgttcttgtcgccgccctgggcccagctgacgggcacgggcatgagcgtgacgccgatgagtgtgatcaccacgccggtgaccagtggcgggaagaacctgagcagccgtccgaagaacggcccgacggccaggcagaagactccggcgaccatcaccgcaccgtagatggcggggagttggtggcccttggagttggtctcggcgatcgcgaggatgggcgcgatgccggcggaggaggcggcgttcacgaacggcaggcggttgccgacgagacctttgactccgatggtctgcaggatggtggccacgccggcgatgagcagcgaggcggcgatcagccgggtgcgggccgcgatgtcgaggccgcaggcctggccgatgatgagcggaggagtgacaacgcctgcgtacattgcggcgatgtgctggagagcggcggggacgagccgcgaggggtggagcttctcgtccaccgggtgcacggacgtgacggcgtcctcggtgtgcaccggcggggtggaacaggagcccttcgccggctccgttgcaggctgtgccatggtgttccctccggtgtggcgcaccaccggcccgggcggccgggccggtggtgcgcgtcccgcgtcagaggttggtcatgtcgaccgggatgagttgctcggcgccgtcgcgcaggatggtggcctcgatcaggccgtaggggcggtcggcggcgtagtagacggcgccgtccttggcctcgttgtcgatcccgaagggcgacaggtccgagcggaagtggtgcttgttgggcatcgagaagcggatctcgtcgacctcgtcgcgggagttcagcacccgcacacccatctcgaagagggtctgctggagcgagtacgagtaggtctcggcgaacgcctgcagcgcgtgcttgcgcacaccgttgtaggagcggtcccagtcgggggcgtgcgagtcgatgccgtcccagttgtgccgccaccaggtggcgacggtggtggcgaggatgcggtcgtggtcttcctggagggtggtgtacttgtccttcaggaagccgaagaactcggagttggtcgagttcaggacggtcaggtccttgaatccggagagcacctggatgccgtggccgtcgtaggtgatctgcgcgacgcgggtctcctggcccttgcggacgaaggagtgggcgatctcctccgcgccgacgaagcgggcgccgcccttggcggtctcgatccgctcccaggagtactcctcgatgcggatgcgggcccggtggatgggctcgttgttgtccacgaagtggcgggcgagcttgacgccgaggtcctcggcgctgtcgatcccgtgctccttggcgaaggcgaacaccgtgttcttggtggtgtcggtcggcaggacgttcgcgttcgagccgctgcggtggacctcctccatgtcgccggagagggcgacggagacgttcaggtccttgatgtggtgcgtgtcgccgtcacgcgtgatcttgacgactcggttctcggccttgccgtactggttctgtcccaggacgaaacgggtcatggtgtcggtcagctccctcggtaaacggagtagccgaacgggttgagcagcagcggaacgtggtagtgctcaccgggcaccaccgcgaaggtgatggtgacctcggggaagaacacgggccgggcgttctcgctgtcccggagcgcgggggcgtcctgctgggccgcggcttgtttcttggcgaagtacgtctcggtctcgaagtcgaggcgtacgtgggtggtcccctccggcagtgccgggaggtccttgcaccgcccgtccgcgtcggtcgcggagccgccgagcgtctgccagtccgcttcccggcccgagcgggcggagagctggacggcgacgccttcggcggggcggccggcactggtgtccaggatgtgcgtggacactgaggcggtggtctcggtgctcatgttttcctcttcgggcgtcttcgagcgggtcgctcaggcgtcttcgagcaggcgcgcgagccggatacggttgatcttccccagctcggtgcggacgatctcccgttcctgctccggcgcgttgccgatccgctccttgaccgcgtcccgcatctgctcgccggtcctgccggtggcgcagatgaggaacacatggccgaacttctcctggtaggccaggttcagttcgagcatctccgccttgaggtcctcggaggcgccggccattccgctctgttcgcgggcggaggtcgggtcaccgggcttggggcggccgatcggcgggtggccggccatggcctccgcgaggtcctcggccgtcaggtcggccatggcggcgtcactggcggtgtagaggtcttcgctgccggagtagggacgagcggcgagcagtcgctcggcccacgccgtggaggcgcacgcctccaggagcgcggagcgggccgcggcatccgggagggtgttgaagcgggcgaggcccgacggcgtggaagtcgtagtcacgggagcctccgtggccttgaacggcctgtgtgctgaacgggctgcggatagctaacgccctccgaaacatcacgtcaacagtttgttgaaaattctggggaaaccctggaacacccgtccgcgctgctcccgctccgggcggttcagccttccttctcccggttgaggtagttgtagacggtgaagcggctgacgcccagcgcgctcgccacggtctccaccccgtgccgcacggcgaaggcgccgcgcgcctccaggatccgtacgacctcctgtttggccttgcggtccaggtccgcgagcggcatgccctcgcggcgctccatggcggccaggatgtggtcgagggagtcggcgagctggggcaggcgcacgcccacggcgtccatcccgtcccaggcgagcacgacgtcgtcgggtccggcctcgtccggcgggagcagctcgccgccgatcgcgtcgaccagcggtttgacggccgcgatgaacggctcctgaccggtcatctatcaccctccccgatcacgttgacctggagcgagatccgggtggcgcccgcttccaggctcctgcgcagcagggcgtccacggcggtcaggacggtgtcggcggcgccttcggcggtgttgccgaaggggccgacgtccaccgcgtccagttcggcggcctcgacgatctcgcgggcgaccagcgcgtgcgcgggtgcctcgtccaggtcgaagggttcggtcgtgaactccactctcaatcgcacgcgctcaacctaacgcgcaaggccggttttcgggcaggtcatggcggcccgcgcccgcccgtccgccggtcccctcttgacaagccccgacacccgacggcactcttccattacgcagaaacgaacttccgtcatacggaatagcgacacggaagggagcgcgaccctgatgggattcgcagaccagcgcttcaacgtcaacctgtcgatcctcttcacggaactcccgctcctggagcgtcccgcggccgccgccgcggccggcttcaccgcggtcgagctgtggtggccctggatcgacaccgccacccccgagcagtccgagctcgacgccctgaagaaggcgatcgaggacgcgggcgtccagctcaccgggctgaacttctacgccggcaagctgcccggccccgaccgcggcgccctgtcggtgcccggtgaggagtccgagcggttccgcgccaacatcgacgtggccgtcgacttcgccgactcgctcggctgcaaggcgctcaacgccctgtacggcaaccgcgtcgagggcgtggatccggccgagcaggacgccctcgccctggagaacctggtcctcgcggcccgcgccgccgaccggatcggcgccatcgtcctgatcgaggcgctgaacaagcccgagtcgccgctgtgcccgctggtgagcgcgcccgccgcgatcgaggtcgtggacaaggtgaacgcggccaccggcctcggcaacgccaagttcctgatggacctgtaccacctgtccatgaacggcgaggacctgccgcaggtgatcgagcagtacgccgcgaagaccggccacgtgcagatcgccgacaaccccgggcgcggcgcccccggcaccggctccctcccgctggaggagctgctcgaccagctgaagaaggccggttacgacggctgggtgggcctggagtacaagccgggcgagcggcccagcgccgaggccttcgactggctgccggccgaggcccgcgcggcccgttgaccctcacccgtaccgaagagtttttcagagaggcatccctgtcatgagcaacctccccaagatcgcgtgggtcggcctcggcatcatgggttcccccatgtccgagaacctgatcaaggcgggctaccaggtcaccggcttc

SEQ ID NO: 229 - DNA, 3422 bp, Unknown
  Kingdom: Bacteria, Phylum: Actinobacteria, Class: Actinobacteria, Order: Streptomycetales, Family: Streptomycetaceae, Genus: Streptomyces
gctcagggggcgcccccatggggcgctcagggcgcgcagcggcgcacggctccgcgcgcggcgtgccggtccagcgcccgcctcagttcctccagctcggtgtccgacagggcgccgccctgggcgaacttcacgatgtgctcggcgaccgtgcgcactttggtgttcgtgcgctgcgagacctcgcgcaggacccgccaggcgctctccggcgggacgcgcccgaccgccaccagggccccgatggcctggtcgatgacggcgtgcgaggtcagggcgcgctgcaactggtcgatctcctcgtgcagccgctcatgctccaccaccaggtcggtgacggacagcggctgcagcgggtgccgcctggacaaagcgaagaacgccatggagagcccctgggtcgtcgagcggccacagttccgactccagcttgctccatgagggccgcgcgcacgaccggaagcggcggtgcgcgcaggtcggcgccccgagccggccccgccgctgcggcaccggggccgaaacgggccaaatgacgtaccgcctttcggagtaggcaaacatcctttttccggggccgttcgggttgcgcgccgtgccttcccggatggcggaacggcttcttccggtgctggtccggggcccgccggccgagaagccggccgttcgaacgcagagctgtccacccgaacgggcgagcggtgagtaacaacacaaacatccggttccgttgggattttcggacatccataggtgaagatccctgtctgacgacaagcccccgccacaacggcggggcggtccgggcggacgccgagtcctgccgccgcccggatgaccggtcgacggaagtggatcggcaggagtggaggacccgagcacgacgggtcgccggaacggtcacgccatggccggtccgagcagcccttggggtgaagccgcacgccgtgcggccgggctacttcgccagcccgaatccgacaggtcatccttcacaggcggctgacgaagggttgcgcatgactgcgctcaatcgtgtcccgtcgctcatggcccgggccggtacggcctccgccctgaccctcgccgccgtcggcggctcgatcgtggtgcccggcgccgcctccgacgcctccgccgcgaccatggcgacgaaggcgctgcagatcgcggcgtccaagaagggctccccctaccagtggggtgccacgggcccgcgcaggttcgactgctccgggctcaccctgtactccttcaggaaggcgggcaagaagctgccccgcacggccgcgcagcagtacaacaaggcccggcacatctcctcgcggagccgccgggccggcgacctggtgttcttccactcgggctcgtacgtctaccacgtcggcatctacgccggctcgggcaagatctggcacgcgccgaagaccggggacgtggtgaagctggagaggatctggaccaagagcgtgtggtacggccgggtcagctgacccgcccgggagcggtggcggcgccgatgagcgccgccaccgccctcgggcgccggccggaggccccggcgaaggcgccgacagggcctacggctcctgcccgcccgtcgccgtggccggctgggtgtggatcggccacggaagatccacgctgaccgtcttgccgccctcgctggtgggccgcacggtcaccctgccgccgcattccgcggtgagccaccggatgatcaccatgccccggccgttgtcctgctggacagcggccggaagccgtctggggaagcgcgggtggctgtcggtgaccccgatgcgcagttgctcgtcgcggtcgaggatcaggtccaccctgaacaggggtgactggcccagggtgtgctgtacggcgttggtggccagctcggagacgatgagccgcacggtgtccgcggtgtccgtgtccgacggcaggccccactccgccagtgtgccgaccgcgtaggtacgggcggccgccaccgaggcgggatcactcggcagggtgacggatgcttccaggtggtctgccatggcgacgtcgtccctttcccacgggaccgcggtggacacggagcggatggtttcgagtacggtcccggactggtggttcgccgtcagattgccatcagcgggccggtcacggctggcgatccaccgagatgtgcatatatctgtccctcgaagcggtgaactctgcgacgggagaccgtatttgacgccctgctgggaagaagtgaggagccggttccatgcagcacggacccgcggtgcgccgccgcaagctcggcgccgaactgcgcgcgctgcgcaccgacgcgggtctcaccagtggcgaggcggcccggctcgtgggctggcaccagtcgaaggtgagccggatcgagacgggcgccagcggggtcaaaccggccgacgtgcggttactgctggacgcctacgcggtccgcgacgcccaactgcgcgagctgctccaggtgttggcgggctccgacgacggtgacggccggcaccactggtggcacgcctaccgcggcgtcctgccgccgacgtaccgggacttcatcagcctggagtcgcaggcgagcgcgatgcggacactggagacctcggtcgtccccgggctgctgcagacaccggagtacgcccgtgcggtgacccgggccgccgtggacggactcgacgacgaccggctggacgcgctggtggaggtgcggctggcccgccaggccgtcctgcgggccgatccgccgctgacactggacgcggtgctggacgaggcggtgctgcgccgggaggtcggcggccccgagatcatggcccggcagctggaacggctgtccgaggcggcgcggctgccccaagtctccctgcgggtactgccgttcaccgccggggcgcatatcggcctcaccggtcctttcgtcatcttctcattttcgaacacttctgatctggatgtggtcgtacttgaccacctgacgagtagccaccatctcgagcggaaagaagacgtagaggcctacaccgaggccttcgacacccttcggttccacgcactgtcgatcgaggactcgttggacttcatcgccggactgcaacggggcaggtgacggcgcgcgaacgggtcaagcgggtcatgcgttgtcagacgccaaggaggcatcatgtccgctctgcctcggaccgtaccttccacgaccgatctgcacggcgtgcgatggctgcgcagcagctacagcacgggagcgaacaactgcgtcgagacggcccggcccgccgcgcggccgtacgccgggctgctcgccgtacgcgactccaaggacccggccggacccgcgctgctcttctcgccggggagctgggccatgttcacggccgcggtgcaccacctctgagcagcgcgggtccggccgg

SEQ ID NO: 230 - DNA, 1672 bp, Unknown
  Kingdom: Bacteria, Phylum: Actinobacteria, Class: Actinobacteria, Order: Streptomycetales, Family: Streptomycetaceae, Genus: Streptomyces
ctcgggtacgcctcggccgccggcgccgacacggtcgtacgggccgacgacccggcggatcccgggtggccgtccgaggtggacgtggccgtggaggcctcaggggtggcggccgggctcgacacgtgcctgcgcctggtgcggcgcggcggggtgatcgtccagctggggatgctgccgcccgggcagtcgccgttcgccgggaacctcgtcgtcagccgggagatcgagctgcgcggggcgttccgcttcgacacggagttcgaccaggcgctgcggctgctggccgcggaggccgtcttcgacgagctggtcagcgcggtggtcccggtgcgggacgccgagtcggcgttcgcgctggcggcggaccgggcgcggtcgtgcaaggtgctgctggacttcgcggaccccgaggactcgggaaacgtcggcggcctcggagcctgaaccgccttcacggcttccacagcgggtgctcgtggtccgcccaggtgcggctcaccatgccggtgcgcagaccgcggcgggcctccgggtcgccgagggccatgccgatgtgaccggccaggacgacaccgatggtcagggcgagccagtcgtggacgaaggtggcgctggtgcgccacatcagcggcgtgaggtgggtgaaccacatcatcaggccggtgccgagcatgaccagggcggcgcccgcgatccacgccgcgtagagcttctgcccggcgttgaacttgcccgcgggacgcgcggcgggccgcccgtcgcggcgcagggcggcgcgcagccagaccttgtcgtgcgggccgaaacggttgaggaagcgcaggtcggagcggagcgcgcgggaggccaggcccagcaggaccggcaccgggagcgcgaggccggcgcattcgtggacgcggacgaccagttcacggcgaccaacgagcaccgcgagctgcgggatgtacaggcaggcggccgtcagcacgcacacgcccatcagcgcggccgtggtgcggtgcacccaccgctgggcggcgccgaagcggcggacgtcaggggcgggcggggcggcggtctcagctcgtggggtcatcgcggcgtccgttcgaacggccgacccaggcgtcgacgtcgtagccccggtcctcccagtagccgggccggacctcgtcggtgacggtgatgccggagagccacttggcggacttgtagaagtacatgggggcgacgtacaggcgcacggggccgccgtggtcgtggccgaggtccttgtcctgcatgcgcagcgcgaccagtacgtcggggcggcgggcctggccgagggtgaggctctcggtgtaggtgccgtcgaagcaggtgaagcggacggcccgcgccgtgcggcggactccggcggcgtccagcagccgggagagccgtacgccttcgaagggcgtgccgggcacccgccagccggtgacgcactggacgtcgcggaccatgcgggtctgcggcagggccctgaggtcggccagcgtgtacgtcgccgggtggtcgaccaggccgtcgacggtcaggcggtagtcggtggcgccttcgtgcgggacggaggcggcgaccgagtagtagcggaagccgccgccgttggggagcaggccggtcagaccggtggggtcgtcgccggaggcggcttccgctactactc

SEQ ID NO: 231 - DNA, 5741 bp, Unknown
  Kingdom: Bacteria, Phylum: Actinobacteria, Class: Actinobacteria, Order: Streptomycetales, Family: Streptomycetaceae, Genus: Streptomyces
gccgccacccgcgttccgtgcgcaccggtacgggacctgatcggcaccaccgacaccggcgcggcgtacgccgtgcagcagcgggtcacggcggcacgcatgacgcgcggcgcacgcgtcgtgggccacaagatcggattgacctcgaccgccgtgcaacaccaactcggcgtgaaccagcctgacttcggattgctgctggacgacatgggacacgcggacggcgacaccgtgccgtacgcgtccgtgctccagccccgcgtcgaggccgagatcgcgttcgtgctgggcgcggacctggccgagggtccgctggacctggcccgggtgcgggccgcggtcgatcacgccgtggccgccctggagatctgcggcagccgtatcgcgggctgggacatcaccctgtccgacacggtcgccgacaacgcctccgcgggcgccttcgtgctcggccaagagcgccgcggcctcgccgagttcgaaccgcggacggccgtgatggagatgtccgtcgacggccggaccgtgtccgagggcaccggcgccgactgtctgggcgacccgctcgccgcggtgctctggctggcccgcaccgcacgtgacctgggcgatccactgcgggccggccacgtggtgctctccggtgcgctcggtccgatgcgcccgctcgcaccgggcgcacaggtcaccgcggtgatcggcgggctgggcacggtcaccaccgccatcggggaaggaacggcatgacagagcgcgctgacggtgcgtcacgcaccaaggtcgcgatcaacggctcgggcaacatcggtaccgacctcatgatcaaggtgctgcgcaccgcccggcacctggagatgggcgccctggtcggtatcgacccggagtccgacggcctggcgcgtgccaggcgcctggacgtggccaccacgcacgagggcgtggacgggctgatcggcctgcccggcttcgacgagatcggcatcgtcttcgacgccacctcggcgggggcccaccaggccaacgcggcgaagctgacaccgctgggcaagcggctgatcgacctgactccggcggcgatcggcccgtacgtcgtccccgcggtcaacatggaggagcacctggacgctttgaacgtgaacatggtgacctgcggcggccaggccaccatcccggtggtcgccgcgatctcccgggtggtcccggtccgctacgcggagatcgtcgcctcgatcgcctccaggtcggccggtccgggaacccgcgccaacatcgacgagttcaccgagaccacgtcccgggcgctggtcgaggtgggcggcgcggaccgcggcaaggcgatcatcgtcctcaacccggccgagccgccgctgatcatgcgggacaccgtgctctgcctggtggaggctcccgacaccgcccggcacgccgccatccaggagagcgtcgcggcgatggtggccgaggtggctgcctacgtccccggctaccggctcaagcagcaggtgcagatcaccccggtccccgtggaccagccggtgcagacgctgctggccgagggcgcggccggccggccgacccaccaggtgtccgtgttcctggaggtcgagggcgcggcccactacctcccggcctacgcgggcaatctcgacatcatgacctcggccgcgctcagggtggccgagcggatcgcggcccgtgcggccggtgcctgcgaggtgacggcatgaacagcagcatcttcgtccaggacgtgacactgcgggacgggatgcacgccgtccggcaccggatcaccccggcggacgtgcggagcatcgtacgggcactggacgccgccggcgtcgatgccatcgaggtcgcccacggcgacgggctggcgggcggctcgctcaactacggccccggctcccacaccgactgggcgtggatcgaggcggcggcctcggtgctggaacgggcacggctgaccaccctgctgctgcccggcgtgggcaccatccacgacctgaggaccgcctacgacctgggggtgcgctcggtccgggtggccacccactgcaccgaggcggacatctccgcgcagcacatcgccgcggcccgcgaactgggcatggacgtctccggcttcctgatgctctcccaccgcgccggaccggcccaactcgccgagcaggcccggctgatggagtcctacggcgcacactgcgtctacgtcaccgactccggcggccgtctcaccatgaaggacgtcgccgaccgggtccgggcctaccgcgacgtcctggacgatgccacggagatcggcatccacgcccacgagaacctctccctgtcggtggccaacagcatcgtcgccgtggagcacggggtccgccgtgtcgacgcctccctggcgggccacggcgcgggcgcgggcaactgccccctggaggcgttcatcgcggtggcgaacctctcgggcctccagcacggctgcgacctgttccagttgcaggacgccgccgacgacctgatccgcccgctccaggaccgcccggtccgcgtggaccgcgaaaccctcacgctgggctacgccggcgtctattcctccttcctgcgtcacgcggagatcgcctccgagcgctacggcgtcgacgtccgcgccattctgctggagtgcggccgacggggcctggtcggcggccaggaggacatgatcgtcgacgtggccctcaccctggccggccgccgcgcggccggctgaccaggcggtccatccgccgccggcagccgcaccgccttcccgtcggctgcccctgccctgcctcgcgttgccctctgcactcaacgaccggcccaggacttcgggacgaccggcaagtccggtacgactgcccaagaacgatcaaggaggccttgtatgtgcctatcgtgcggacctgccaaggacaccggggtccgctccgtgatcgggcggcgtggtctgctgacgaccatgggaggagcaggactcgccttcgggctggcggcctgcggatcaccgggcgcgcctgaggccgccgccctcgcgcgccccgccccgcacgagcgggaagcgaagctccaggtggtgctgctcgggactcaggccgggccaccgccgacgccggaccgcgccgggatctccacggcgttgctggtcgacggccacatctacctgatcgactgcggccgctcctcggtcacccagttcgccagggcgggtctcgatttctccgcgatccgctcgatcttcctcacccacctgcacatcgaccacatcgccgactactacaactacatcgtcctgggcggagcccaggtcaacggcgggctgggcagccgtggccgggtccgggtctacggacccggacctgcgggcgggctcccgccgaagttcggcgggggcgcggcgccggtggtggcccccgcggacccgacgcctggcacacgtgcgctgacacaggagtggaccaaggccgtcgcctactccagcaacgtcttcatacgcgactccggtgtgaccgatccgaccacgctgctggaagtccgggagatcggtctccccgcggtcggggccggcttcacgaacaccgcccccctgatgcggccgttcgaggtgatgagcgacgacaaggtgagggtaagcgcggttctcgtgccacacggcccggtgttcccctccttcgcgttccgcttcgacaccgagtacggatcggtcaccttctccggcgacaccacccacacccccaacatccccgccctcgccgagaacaccgacctgctcgtgcacgaagcgatcaacgtgcagggtgccgacctcccacccgccctgcacaaccacatgctcgcatcgcatgtcgaggtgcagaaagtgggcgccatagcccgtgaagccggtgcgaagcggctcgttctcagccacctcgtcgacttcgcccacgactccctcgacgcgccgcaatggcaccgctgggccaagcagggctacgacggcgaagtcgtcgtcggctccgacctgcaacacctcaccgtgaagtaggggttgccgctgggccctcccccgtcgccgggggtgggccaggccgtgaagccgaccagtacatgctctgcgccgactccgcgcgggacctgctgccggcgcccgagcacacgcctccccttctcccggacgatcagcggggatgcagcggcgccccacggacccacctgctgcggctggtcgcccctgaggaagccggtgcgggcgacgaggcggacgccggtcctcgccgacagcgacttgtccgcgtcggcgagcgcgccggcgtcctcgacccggccgtacgacgtgcgggccgccgcctggaggcaggcgtcgctcataccgtgccacccgtgagcaccgcttcaccgacggccgccgacgacagcgggaccggggtgaacatctccggttcctggtccggcgtcagggcggtcgggccgtacagccagtcggtgaaggagtagtcgtaggtgtcgcgggcacgcagcagtgcgttgcgctgctcgcgggcgagaccgccgaggtgccacagctcgccccacttgcgggaggtggtcagcacgcgccggcagtgctcggggcggacggcctcgtaggcggcgagggcggcactccagtcgaccgtgtcgtccgcggtgcggttgcgggcgatgtgctcgccgagcacccagccgtcctcgatggccatgatcgcgccctgggcgatgtactgcaggggcgggtgcgcggagtcgccgaggagcacgatccggtcgtcgacccaggtcatgacggggtcgcggtcgaacatccgccaccacttgtcgcgccacatgaacggcaacccgtcccggacgaagtcgcaggccccggcgaaggcggcgtcgagttcgtcgggcgtgccccagtcctgctgtccggccagggccttgggggactcgaagacggcgacctggttgagcagtttcccgccgcgcaggccgtagtggacgaagtggcagccggggccgacgtacacggcgacctcaccgaggtcgacggaggccacgcggggcgactcggcggggacggtgccgcggtaggcgacgtacgcggaggagaccggttcgtcgtcgacgaggagcttgcgggcggcggagtgcaggccgtcggccgcgatcacgagcccggcctggtgggtggcgccggacgcaagggtcacgcgggcgccgcccccggtgttctcgtacgcgtccacctgggcgtcggtgatcagctcgacgccggcgcgctcgcaggcgcgcagcagcaggccgtgcagatcgctgcggtggatgaccaggtacgggtagccgtagcgcttctccagatcgcccaggtcgagccgggtcagctcgtcgccgtcgacggcgtcgcgcatgaccatggcgtcggggacgacgccgaggcttttcgcctcgtccagcaggccgtagtcgtcgaggatgcgggtgcagttgggggcgagctggatgccggcgccgacctcgccgaaggcgggggcgcgctccagcaggcggacgctcaggccctggcgggacagcgagtacgccgcgccgaggccgcctatgccgccgccgacgacgatcacatcagggtgggacatgctgcgctcctcagagccacgggccgagccggggggcgtcggcgagcgagtgggggcggccggccagccaggcggtgacctcgggcagaggtccaccgggcagctcggtcagtc

SEQ ID NO: 232 - DNA, 4342 bp, Unknown
  Kingdom: Bacteria, Phylum: Actinobacteria, Class: Actinobacteria, Order: Streptomycetales, Family: Streptomycetaceae, Genus: Streptomyces
tgcgcgacccggacggcgcgcagttcacggtgacgtcccgcagggaggcctgacgcgtacgtcgcggcccccgcacctgcgcaggtgcgggggccgcgacgtacgcgtcagcggggcgtcttcggcggccgggagagcaggaccaggctgcggggctccacgcgcaggtcacccgacggcttgtgctccgactcgtccggcgggccctgcggctcggcggtgtcgacgagcgtcgtccagcgctccccgtaggagcggcccggcaggcggaagtcgaccggttcccagtagccgttgagcagcagcaggaacgagtcgtcgaccacgggccggccctgcgggtcgggctcggcgatggcgtcgccgttgaggaagaccatcacggagtgcgcgtcggagcgctgccagtcctcctcggccatctcccgcccgtccggcagcatccacaccaggtcgggcagcggctggtcgtcacgggtggccgtctcgcccttgaagaagcggcgtcggcgcagcacggggtgggcggtgcgcaggccgatgacgtaccgcgtgaaatccgccagctcccgctgctcgcgggtcagccgccagtcgatccaggagacctcgttgtcctggcagtaggcgttgttgttgccgccctgggtgcggccgagttcgtcgccgtggcagagcatggggatgccctgggagagcagcagggtggcgatgaagttgcgctgctggcgcgcccgcagcgcaaggaccgccggatcgtcggtgtcgccctcctccccgcagttccaggaccggttggtgttctcgccgtcccggttgccctcgccgttggcgtcgttgtgcttgtcgttgtacgacaccaggtcgcgcagcgtgaaaccgtcgtgcgcggtcacgaagttgacgctcgcgcgcggacggcgccggttgtgcgcgtacaggtcggaggagccggtcagccgggacgcgaagtcgccgagcgtgtgctcctcgccgcgccagaagtcccgtacggcgtcccggtacaggccgttccactccgaccacagcggcgggaagttccccacctggtagccgccctcgccgacgtcccagggctccgcgatcagcttgacgcggctgatcaccgggtcctgctggatcaggtcgaagaacgcggagagccggtccacctcgtggaactgccgggccagggtggccgcgaggtcgaagcggaaaccgtcgacgtgcatctcggtgacccagtaccgcagcgagtccatgatcagctggagtacgtaggggtggcgcatcagcaggctgttgccggtgccggtggtgtcgtagtagtgcgcccagtcgccgtcgaccaggcggtagtacgaggagttgtcgatgccccggaaggacagggtcgggcccttctcgttgccttcggcggtgtggttgtagaccacgtcgaggatcacttcgaggccggccgcgtgcagcgccttgaccatcgacttgaactcgccgacctggccgccgcgggtgccgtgggcggcgtagtcgttgtgcggcgcgaagaaaccgatcgtgttgtagccccagtagttggacaggccgcggccctggaggacgccgtcgtgcacgaactggtggaccggcatcagctcgacggccgtcacgcccagcgaggtcaggtgctcgacgaccgccgggtgcgcgaggccggcgtaggtgccgcgcagctccggcgggacgtcggggtgggtgcgggtcaggccccgtacgtgggcctcgtagatcaccgtgtcggcgtaggcccgccggggcgggcggtcctcgccccagtcgaaggccgggtcggtgacgacgccgagcatggtgtgcccggcgctgtcggccggatcggggccgtgcggggcgcgctcgtagagcgagggatggtcgtccatccgcccgtccaccgccctggcgtaggggtccaggagcagcttcttggggttgcagcggtggccggccgccgggtgccaggggccgtgcacccggtagccgtagcgctggcccggtccgacaccgggcaggtagccgtgccagacgaagccgtcggcctcggtcagcggcacccggcggtgggcgccggcgtcgtccacgaggacgagttcgacgtggtcggcgacctcgctgaacagcgcgaagttggtgccttccccgtcgtacgcggcgcccagcgggtaggggtacccgctccacacgggaacgggcaccccttttccgcggctcgtgcgccgggtcaccgggccccctccaggacgccctcgggacggctgagcggtgaggcgagcgcggcgaccggcagcgcgcggggcggcttcaggccctcgcgcagggtcggggccggggccttcgcgaccagcgggacgcgcactccggcgcgggcgcgctgcgagaaccagatgatcttgctgccggtctcggcggcgcagcagccccagccgtcgctggtcgccgcgatgcgggccaggcaggtgcgcaggtcctggtcggggcgcaggtcgtggttgtcctccgcgaccgcggtgatgaggtgctggccggtccaccacatctcgatggacgtgtgcttgtcacgtgcgtgttcgtcgatggccttcagcagcatctcggcgccgccgcacacgggttcgacgaggtcctccaggtcccagaaccgaaggtgagcggccaggatgcgcctgacctgtccgacccgttccgggctgacttccacgtcgaggtggtagtagcagggcactgcggtcttcatcgtcgttcgctcctcaccggcgaggcccgcgctccttttcccgcccttgcggaccggatccccgagcacgaagcgtgagcatgtgttgcctctgagtcagatccacagtgcgggcactacgccattcgtgcaacacgagcggacgggacgaggcgggcgaaacggtgacggccgggcgggtgacctggttgaagatccaacaggacgctgtgtcgttgaacgtgcaccatgagtgaaagtctcgagcgccgtgaacgggacgcgtgcttcgcgtgcgcggtcgccgccccgaccgtcggggaaacgtgcccatcgagcgctcccgaaaggtgaacggcgccatgctgctacctgccaaagctgaagtcgcccggcatctgcggctctaccgggtgtgggaacgcgcgatgctcgcgtctcccgacgaccgcagggtgcgggccaccttcgaggactcgggctacacgctgtgcgtgctgatgggcaagcgctgcgcacgggaggcggcggacgcggcggagcgctatctgcgcaccaatctcgtcacctatctgcgcgaacagagcacgggccggccgcacgtcggcgtcgtcccggggcgcacgcggcgccggacggcgaaggaccggcgctcccccgccgacgcgtagggcacgctccccggtgcccttgctcggcgcgggggcaccgcggcacggccacaccacagcaccacggcagaccgagaagttcctggttcccggccgggcgtcagcccggcctcaagcacggtggaggtgacacccatgagttcgaccccgagtcatacccaggccgtcggccgcatccccgtacgggacgtgcgcccggccgtggagggcggcaggcgaccggccaaggcggtggtgggcgagacgttccaggtcaccgccaccgtgttccgggagggtcatgacgccgtcgcggcgaacgtggtcctgcgcgaccccgagggccgtccgggcccgtggacgccgatgcgcgagctggcaccgggcagcgaccgctggggcgccgaggtcacgcccggtgcgaccgggcgctggacgtaccaggtggaggcctggagcgacccggtcgccacctggcggcacatcgcgcacatcaaggtcccggccggcatcgacgccgggctggtgctggaggagggcgccgacctgcacgcgcgggcggcggccggggtgccgaaggggccggaacgggagaccgtgctggccgccgtccgggtgatgaacgacgacagtctgccggtgatgacccggtggacggcggcgttgacgccggaggtggacgcggtcctggcccgccacccgctgcgcgagctggtcaccgcctgcgacccgctgcccctccaggtcgaacgcgaacgcgccctctacggcgcctggtacgagttcttcccccgctccgaaggcacccccgagcagccccacggcaccttccgcaccgccgaacgccgcctgcccgccatcgccgccatgggcttcgacgtcgtctacctcccccccgtccaccccatcggcaccacccaccgcaaaggccgcaacaacaccc

SEQ ID NO: 233 - DNA, 8573 bp, Unknown
  Kingdom: Bacteria, Phylum: Actinobacteria, Class: Actinobacteria, Order: Streptomycetales, Family: Streptomycetaceae, Genus: Streptomyces
ggccgcgcagcgcggcggcggcgacccggccggggtcggcgtcggggaggtcggcggtcagctcggtcagggtccgcagcagcgcggcaccgggaccgtcgttctccaggtggacccggtctgagaccggatcggcgggcgcgatggtcacgtgtggctctccctcgctcggcacggggcctcaccgagggcagggggcagcacacgagcgcacacggcgccgcgtccaccggcccattccgcgaggcccggacgtcaggcacccggaccggacggccgggcgcactgtcggcaggtcctcggactgacgcccgtacacggccttgagggcatacgtgtgcgagtacaccgttgcgggacagttccggattcgcaccggattcccctgcgacgacagcgagcatgagcatacatcttgtgccgggtgaggaagccacccccatatcttgtgtcgtggcgactgcggcgcgtgtcagagtgtcaacgcgtaggtgagcagcgtgatgtcgtccagctccggcagcgggttccagtcccgctgcggggtgcggacgaagcccaggcgctcgtagaggcggtgggcggcctgcatggtgcgctgggtggacagcacgacgcgcacacagccctccgtggcccgcgcccgctccaggcaggcccgcaccagcgcctcgcccgcgccccggccgcgcgcggcgcgtgcgaccgcgagcatgcgtatctcggcctcgccgggcccggcgatgtcggccatggcgccgccggacggcacgaaggtgaccccgccgcgcacctccccgtccgccacggccaccagcacctcggcggcactcgcccgcttgcctacgtccctcagctcgcccaggtaggggtcgctctccccgaagtccagcagcccgccctggagataggcctgggcggtgatctcaccgagggtgccgtactcgccgggctcggccggcctgatcacgaggtccatgaggccgagtgtgccgcacgggtacgacaacgggccgccggtttcccggcggcccgttccccaggtgggatggctcagtgcgcgctgcccgcggtggccggcgggagttcgaccgcgacgccgggctcgcccgcgtcggcggtgtagtcctccggccgggtctcgtcgacgccctcgggggccttgacggccttgaggacgaaggtcaggacgacggcgacgaccacgttcagggcgaacgccgtcataccgatgtagccgatctcgccgatgcccgggatctccttggccgagccgccgaagtgcttctgcgtcggcgaggcgaccccgtaggcggcgaccgtgccgtagaccatgccgaccgcccagccggccagcagcgcccagcggtggaaccagcgggtgaacaggccgccgaccagggccgggaaggtctgcaggatccagatgccgcccagcagctggaagttgatcgccacggtcttgtccatggtcaggacgaagaccagcgcgcccaccttcaccagcagcgagaccagcttggagacccgggtctcctgctcggccgtcgcgtccggcttgatgaagtccttgtagatgttgcgggtgaacaggttcgccgccgcgatcgacatgatcgccgccgggaccagcgccccgatgccgatcgccgcgaacgcgatgccggtgaaccagtccgggaacatgtcctcgaacagctgcggaatggccagctgaccgttctggaccttcacacccgccgcgatcgccatgaagcccagcagcgccagcaggcccagcatcagcgagtacagaggcaggatcgtggtgttgcgtcggatcacctcacggctcctggaggagagcgtcgcggtgatcgagtgcggatacatgaacagcgcgagcgcggagccgagggcgagcgtggcgtaggtccactggctcgcctcgcccggcacgacagcgccgcgtggtttgccggtggccgggttggtctggctgaacgcgtgcgcggccttggcgaagatgtcgtcgaagccgcccagcttgatcgggatgtagatgatcgcgaccgcgatgacgatgtagatgagcgcgtccttgacgaacgcgatcagcgccggggcgcgcaggcccgaggagtacgtgtacgccgccagcacgccgaaggcgatcagcagcggcaggtccttcacgaaccagttggtgttctcgccgccgcccacgcccatcacgtccagcaccgcctggatgccgaccagttggagcgcgatgtacggcatggtggcgaggatgccggtgagggcgaccgccagggagaggcccttggagccgaaccggccgcgcacgaagtccgacgtcgtcacgtagccgtgcttgtgcgagaccgaccacagccgcggcaggaaggtgaagatcagcgggtagaccaggatcgtgtacggcaccgcgaagaagccggccgctccggtcgcgtagatcgccgcgggcacggcgacgaacgtgtacgccgtgtacaggtcaccaccgagcaggaaccaggtgatccaggtgccgaacgaccggccgcccagaccccactcgtcgaggctctgctcgttctccgcccggcgccagcgggcggccaggaaccccatgacggtgacgagcaggaagaagaagatgaagacgccgagtgcgacgccgttgacgccgtccttcaccgggccgcaccgcccttcggggacgtggcgtccgccgcacggcgaccgcgctggtcaagctgccacagccggtaggcgatcaccgtgaggaccgtggagatgatcacccacagcatctggtaccagtagaagaacgggatgccgatgaacgtggggccgaccttggcgtacgaaccgacccacagcatcgccacgaacggcgcgacgaggcacaggccgatgacgacccgcaggggtgtcaccacccctttgccctctcttggcccatctgacatgtgcggttccgtcccctcgctggtcagccgtgcgattgcgcaggcaatctaggtcacggtgacaggtaacggaaccccttgtccgcataccggttgcgtaaccggttgcgcataccgtttcgcgagggccggacgcaggcgcgcggccgggggccggcgaggtcagtcgatcggccgcttgagccgggccacgaacttgtagcggtcgccgcggtacaccgagcgcacccactccacgggctggcccgtgcggtcctgggagtgccgggagagcagcagcatcggcaggcccacgtcggtgccgagcaggccggcctcgcgcggcgtggccagcgacgtctcgatggtctcctcggcctcggcgagatggacgtcgtagacctcggcgagcgcggtgtagagggaggtgtacttcacgaggctgcggcgcagtgcggggaagcgcttggcggacaggtgcgtggtctcgatggccatcggctcgccgttggccatgcgcagccgctcgatgcgcaggacgcgtccgccggtggtgatgtcgagcaggtcggcgagccggtcgtcggcggtgatgtacccgatgtccagcagctgcgaggtcggctccaggccctgggcgcgcatgtcctcggtgtacgaggtcagttgcagcgcctgggagaccttcggcttggcgacgaaggtgcccttgccctggatgcgctccagccggccctcgacgaccagctcctgcagcgcctggcgcacggtcgtgcgcgaggtgtcgaactcggccgccagcgtccgctcgggcggcacgggcgtgccgggcgcctgcgtccgggtgatgtcgagcaggtgcttcttcaggcggtagtacttgggcacgcgcgcggtacggacggtcgccccaccctcgttctccgcactgctgacgtcggtgctcatgctctgccttcccggctccggtgccgaagcgaccgacgacccgtcggccacggctcacatcgtggcacggcttcttgtgtcgggtggtcacccgcacgctccgtgatctcctctgtataccgccgtgacccctgctggtctagtccatcgtccgtcctcgggacaggtggtccacgcgaacaggcgtgctgccagcgggaagtgaccgccggtggtccagtggagcgggggcgtccgtttgaccgcatgagcaatgaaaggtccctgcatatcgcggtcccataacggagcagctgagcaggtcggcgcacccttgacagccctattggtctgggccaagctccccgtactggtctacaccattggtccaggtcccggccccatgggcggtatgcgctgacgcttgcactgtcactcaaccgcggggaggcaggggggtttgtggcatccctgaggagggtggcgtgaagcgcaagctggttgctgcgatcggtatcgcgggcatgatggtctccatcgcggcgtgtgggggcggcgacgacaagaacgagggctcgaaggggaccgacgccaaggagctgaccgtctggctcaccgtcgacgcgcagaacaactggccggacctggtcaaggcggccgacgacgcgatcgtcaagaagcacccgggcctgaagatcaagcacgagtactacggctggccggacaagaacaccaagctggacgcggtgctcgccaccgacaaggcccccgacgtggtcgagatgggcaacaccgagatgctcggctacatggtcaagggcgccttcgccccgctggacgcgtcgaagttcgacaactcctccggctggctggacggcctcaaggcctcggtgacctacgagggcaagacctacggcgtcccctactacgcgggcggccgcgtggccaactggcgcaaggacatcttcgcccagtccggtgtgaagaccaccccgaagacgtaccaggaactgctctccgacctggacaaggtgcagaagaagcagggtgacaagttcagcgcctggtaccagcccagccgtgactggtacgcggccatgtccttcgtctacgacgccggcggctccatcgccaaggaggagggcggccagtggaaggccaacctgtcctccccggagtccctcaagggcctgaacgactacaaggccgtcctcgacaagtacatgcacggtgacaagaccaaggacgaggccgaccggccgatcgtctacggccagggcaagtccggcatgatcttcgccgccgcctgggagggcgcgaccgccgccgacccgaagaacgacaaggtcggcaagctcgccgacaaggtcgagaacttcgtgatgcccggcccgtccggcaagaacatgcccgtcttcctgggcggttcggacctcgccgtcccggtcaagtccaaggcgcaggcgatcgccgccgagtggatcaacgccttcaccggctccgccggccagaagggcctgatcgccaagggcaaccttcccaacaacaagaccgacctcgcgacgctgaagaacgacccgaagacggcggtcccggccaccgcggccgagtccagctggttcgtcccgatggcgccgggctggggccaggtggagaaggcccaggtgctgcagacgatgctgcagagcatcggcaccggcaagaagtcggtcgaggccgcggccaaggacgcggacgccgcgatcgacaaggtcatcaacacgaagtgacccgagcgcagggtcctgccgcgggcggggccctgcttctcgcacggccgctgaccgggacccgttccccgtgcggccgtgcaccgctttgccttgcttcgccttcgtaccacctgagggaccgctgaggagcgcgcgatgagtgccgcagacacgaccacccctgccaaggtgccgccaccgcggcaggcgccgccacccgccgcggccgaccggccccgcagaaaccgggcgtcgggcggcgcggcgaccccgtggctgctcctcgccccctgcctggtgatcctggccctggtcatggcctacccgctggtccgcctggtcaccctgtccttccagaagttcggacagccgcagctgtggggcttccaggccgccgagtggaccgggttcgacaacttcagcaaggtgctcggcgacggcgacttctgggcggtcgtcgtgcgcacgatcgtcttcgccgtcggctgcgtggtcttcaccatggtcatcggcatggcgctcgccctgctccagcagcgggtctccggctgggtgaagacgatgatcaacatcgtgctcgtggcgagttggggcatgcccgtcatcgtcgccaccaccgtcttcaaatggatcttcgactccgactacggcatcctcaacgcgctggtcagcaagttgcccggggtcgacatgatcggccacaactggttcgccagcggaccccagggccttgcggtgatcatgctcctggtggtgtggggcgccgtgcccttcgtggtcatcacgctcagcgcgggcctgacccaggtgcccaaggagctggaggaggccgcccggctggacggcgccggcgcgtggggcgtcttccgctacgtcacgctgcccatcctcaagccgatcatcgtgatgctcacgaccctgtcggtcatctgggacatgggcgtcttcccgcaggtgttcgtcatgcgcggcggccaccccgaggccgagttccagatcctcaacacctactcctacgaccgcgccttcgtggtcaacgactacgggcagggctcggcgatcgcactggtcaccgtgttgctgctgctgggtgtggtcgccgtgtacatgcgccagatgctgaagatcggagaggtcgaatgagcaccctgagcggcacgaacgccgccgcccccgcggtgcgccgccgccggacgccgaagctcggctggaacctgctcggcctcctggtcttcctcgtcctgggcttcccgctgtactggatgctcaacacggcgttcaagccggccaaggacgccatcgacccggacccgagcctgctgccgaccggcctcaccctcgacaacttcaaacgcgccctggacatcgccgacttctggggcccggtcgggcgcagcctgatcgtctcgctggtcgtcgtcgtggtcggcatggtcgtcggcaccctggccgcgctcgccatctcccggttcgccttccgcggccgcaagatcgtgatcgtgggcatcctggcggtgcagatggtgccgctggtcgcgatgatcatcccgatcttcctgctgctcaacgacctcggtcagtacgacaagctgaccggtctgatcatcacgtacctgaccttcatcctccccttcacggtgtggacgctgcgcggcttcatcgtcaacatcccgaaggagctggaggaggccgccatggtcgacggctgcacccgcaccggcgccttcgtccgggtcgtcttcccgctgctcgcccccggcatggtcgccacctcggtctacggcttcatccaggcctggaacgagtacatctacgccatgatgctgatgagccaggagcacgagaccgctactgtctggctcggcaacttcaccaccaagcacggcaccgaatacgccccgatgatggccggagccaccatgatggccgtgccgatcgtcgttctgttcctcctcgtacagcgcaagatggccgcgggcctgaccgcgggcgccgtgaagggataacgccacccgatgacgacattcgccagcggtaccactgcgtccggcgcgcaggacgacgctctcgcccgcgacgcgctgaccgtcctccagcccggcttcaccggcaccacggcccccgactggctgctgcgccacctcggcgaaggcctggcctccgtcggcctgttcggccgcaacgtcgccacggccgaacagctggccgccctcaccgcccagctccgcgccgaacgcgaggacgtcctcgtcgccatcgacgaggagggcggcgatgtcacgcgcctcgaggtgcgcaccgggtccagcttccccggcaaccacgccctcggtgccgtggacgacgtggagctgaccgagggcgtcgcccgcgaactcggcaggcggctcgccgagtgcggcgccaacttcaactgggcgccctcggccgacgtgaactccaaccccggcaacccggtcatcggcgtgcgctccttcggcgcctccaccgacctggtcgcccggcacaccgccgcctacgtcgccggactgcaggcggcgggggtggccgcctgcaccaagcacttccccgggcacggcgacaccgcggtcgactcccaccacgcgctgccgcgcatcgacgtggacgccgacgtcctccaggcgcgcgacctggccccgttccgtgcggcgatcgccgccggcaccaaggccgtgatgagcgcccacatcctcgtcccggccctggagccggaccttccggcaacgttgtccaagcgtgtcttgaccgacctgctgcgcggcgaactcggctacgacggcctgatcgtcaccgacgccgtggagatgaaggccatcgccgacacatacggcatcgagcggggcagcgtcctcgccgtcgcagccggcgtacggtttcctcgtccgcgaggccgccgcccacgcagatcgcgtcggcaccggctgcgacggcgaggacg

SEQ ID NO: 234 - DNA, 7279 bp, Unknown
  Kingdom: Bacteria, Phylum: Actinobacteria, Class: Actinobacteria, Order: Streptomycetales, Family: Streptomycetaceae, Genus: Streptomyces
  misc_feature (6989)..(7037): n is a, c, g, or t
ggctacggtcagcccacgccccccgccggctacggccagcccatggcaccgcccggctacggccagcagcctcagttcgggcaggtccccggccagcccgcgccctacggcgccccccaaggcggcggccacgcgccccagggtgcaggtgtggccggcgcgctccagaagttcaaggagacgcccaccggtcagcgctggaccccgcagaacggcaagctgatccgtgccgacctcggcacgggcggccagcccgtcctcgcccggcagggcagcatggtgctctaccagggcaaggtcgacttcagctacaagggcgcgggcttcgcgggccgcatcgtcggcaacgccaccggccaggagatgcagctcatgcgctgcacgggccagggccaggtgttcttcgccgagaactccgcccacgtacacccggtcgaactgcagggcgacgcgatctgcgtctccgcggagaacgtcctcgccttcgacgagagcctgcagtacgaggtccgccgcatcgaggggcacggcatccccggcggcgcgctgttcacgatgcagttccagggcaccggcaccgtcgtcgtcaagacgcacggcacgcctgtcgttctgccggtgaccccgacgacgttcgtcgactccaacgccgtcgtcgcctggtccgcggcagcccaggtgatcgtctccagccaggtgcgcatgcgccgcaacgcctacccggggcacaccggggagggcgtcaacctgcagttccgggccgcgcccggcaacttcgtcgtcgtccagccctacgaggtctgagggagcccgtcatgaaccagccgctcgcgggctacgcccccgcacccgtcaccgcccgcatggagaaccacggcagccacatgctgaaggtcgccatgcagaccggcaacgacctcttcgcgcgcgtgggctcgatggtcgcctacgagggcttcgtccagtacgagcccaacccgccggccgtgcgccagatcgcccgggactggatcaccggggagggcgcgcccctgatgaagtgcaccggcgacggcctgctctatctcgccgactacggcgccgacgtcgtcgtcatcaacctgggcggggacgcgatctcggtcaacgccaccaacctgctggccttcgacgcgcacctccagtggggcgtcgagcgggtcaagggactggcgaagttcgccggacagggcctgtggaacacgaagatctccggccaggggtgggtcgcgctgacctcccgcggcacgccgatcgtcgtcgactgcggcggcggggagaacgagacctacgtcgacccggacgcgctcgtcgcctggtcgccgaacctcaaggtgaagggcaagcgcagcttcaaggcgcagtccctgatcgggcggggcagcggcgaggcgtaccagatggcgttctccggagagggcatcgtcgtcgtgcagcccagcgaggacagcaccgaccgcctccggatccggggctgaggggaagagaaggacagatgcagagcccgcttttcgccttcaacgacgtccagagccaggagcgctggagcctgcagaacaagcagatgctgcgcgtcgtcctggagggccacgacgacatcctggcccgcaagggcacgatggtcgcctaccagggcatggtcgagttcgacgccgagtaccagagcaacaaccagggacgcgcgcgtgcctacaccggcgagggcctggacctgatgcgctgccacgggcagggcaccgtcttcctcgccaacctcgcccagtacgtgcacgtcatggacgtcgagcaggacggcctcacggtcgacagcagctacgtcctggcgatggactcctcgctgcaccacgaggtcatcgccgtcgacagcgtgtacggcatctccggctcggggaagtaccagctgaacatcacgggccgcggcaaggtggccctgatgacctcgggggcgccgctgatgatgcaggtgacgcccgacaagtacgtcaactgcgacgcggacgccatcgtcgcctggtccacggggctgcgcgtgcagatgcaggcccagacgcactcctcgggcgtgtggcggcgccgcggcaacacgggtgagggctgggagctgagcttcatgggcagcggctacgcgctcgtgcagcccagcgagctgctgccgccgcagaacgcggtgatcgggcagggcctcgccgcgcagttcggcatgggacagcagggggcccggggacagaaccagggcaacgtctggagctgagcgcacgtcccggagccagagccgccggcatgtgcaaggggcgaccgccctggacggtcgccccttgcttacgcccggctgtaccgctcggcctccggtccggcaccgcgtcagagccgggcgcgggtggcctccagcagcaggatgaccgacttgtccgccacgtcagggacctcgtcataggcgaaccagcgcaggtccagggactcgtcgctgatggcctccacggcccccggcggggcgatggccgcgtactgcacgtccaggtgccaggcgcacggcgtgtggtggcggtccagccggaccgggccgccgggcagcagcgtcagccccgcgatgcccgactcctcggtcgcctcacgcagcgcggcgtccgccagcgtgacgtcctccggctcgcagtggccgcccatctgcagccacttgcgcaccttcttgtgcagggtcagcagcacccggccgcgctccgggtcgatcaccatggcgctcgcggtgatgtgcccgtccgtgcaggccttccacatgccgtccggatgggtccgcagatgatccagatagagcgcggtcagctcttcctggccctcgtaccccgccaggacgagggccgcttcgtcgtggaggctcactcgccgtcgtcgcccttgtcgttctcgtccttcccgggtccgtccccggcggcctcgtccttcttgcgcaggtccggcttaccggcggggccgctcgcggcctcgccgagcatcttgtccagctcggagaagtccagctgctcgcggtgcacgaagccgtcggggtcgtccaggtcggcggcggtcggcagcatgtccgggtgggcccacagggcgtcgcggccctcgaccccgcgcgcgtccgtgagcgaggcccacaggcgggacgcgtcccgcagacggcgcggacgcagctccagaccgatcagcgtggcgaacgtctgctcggccgggccgcccgaggcccggcggcggcgcagcgtctcacgcagcgcgtcggcggacgacagacggggcttcgcggcggcgtgcaccaccgcgtccacccagccctccacgagcgccagagcggtctccagacgcgccagggcggccttctgctccggggtgtcctcgggctggaacatgccctgctggagggcgtcctgcagctgctcggggttctgcgggtcgaactggccgaccacgtcctccagcttggcggtgtcgaccttgatcccgcgcgcgtacccgtcgaccgcgccgaacaggtgcgagcgcagccacggcacgtgcgcgaacagccgctggtgggcggcctcgcgcagcgccaggtagagccgcacctcctcctgcggtacgccgaggtccttgccgaacttctcgacgttcaccgggagcagcgcggccttgcccgccggggcgagcggcaggccgatgtcggtcgagccgacgacctcgccggccagcacgcccacggcctgcccgatctgcgtgccgaacatggcaccgcccatggagcgcatcatgccgatcagcgggccggccatggcctgcatctcctcgggcagcacgtcgcccatggcgttgccgacgcgctcggcgaccggatcgaccagctcctgccacgccggaagggtcgcctcgacccactccgcgcgcgaccacgccaccgtggaggtggcgccggagggcagggacgtcgcgtcgtccagccacaggtcggccaggcggacggcctcctggacggcggtgcgctcggcggcgccgacgctggcgtccttcgtgccgtcggaggtgccctgggagaccgtctggcgggcgatctgcttggccatgtcccagttcaccgggccgccctcgtaggagagcatctggccgagctgctggaacgcggcgcccaggtcggtggggttcagcgagccgaacatcgctgcgagcggattgtcggcgccgggcccgccaaagcctccggctccgggcagcccgaaaccgaacgggttggccggtccctgcccaccgccgctctgctggtccttcttcttgccctcgtcgccgtcgtccggctcctccggcggaaggccgaatccgaatggggtgtcactcacggggttcctcggctggtaaggccaccggttctttccggcggcgcggctgcccgacatcaccacccagcgtagacaccatgagcggttcgggcctcggtgcttcgccgacagaacgcctgcggcaggatggatgccacctggtacgtacgcgtcgttcgcgcccgtatggaagacaaccgctggagacgcccggtgagttccccagatccacaggttcgcgcagcgcgaaaccatgaaagcacttccgccgtgcgcgggcccgtcgtcgcggtcaccggagccgcgagcggtgtcggcgccctgctcaccgagcggctggccacgtccgcagaggtcaggcaggtcatcgccatcgacgagcggcgcggggagtgcgcggcggcgcagtggcacgtcctcgacgtgcgggacccggcgatcgccgaccggctgcgcggtgccgacgtcgtggtgcacctggcgctcgatctcgacctggagaccgaccccgccgcgcgcagcgccttcaacgtccgggggacccagaccgtgctgaccgcggccgccgcggccggcgtgcaccgggtcgtgctgtgcacctcggcgatggtctacggggcgctgccggagaacgagctgccgctgtccgaggacgccgaactgcgggcgaccgcggaggcgaccggggtcggcgacctgctggagatcgaacggctggcgcggcgcgcgccccgggcgcaccccgggctcaacgtcaccgtcgtccgccccgccgtcctggtcggcggcaccgacaccgcgctgaccaggtacttcgagtcgccgaggctccttgtggtggccgggtcgcggcccgcctggcagttctgtcacgtcgaggacctgtgcggtgcgctggagtacgccgtgctggagaaggcggagggagagctggccgtcggctgcgacggctggctggagcaggaggaggtcgaggagctgagcgggatccggcggatggaactgccgtcggcggtcgcgctcggcgcggcggcccggctgcaccggatcgggctcaccccgtccccggccggggacctcgcctacacgatgtacccgtgggtggtcagcgggagcaggttgcacgatgccggatggcggccgaagtggacgaacgaggaggtcctcgcggagctgctggaggaggtcgccgggcggcacacggtggccgggcggcggctcgggcgcaaggacgcgacggcggcgggcgcggcggcgagcggcgcgacggtcaccgtcggcagggcggtcggtgccggtacgacggtcggtgccggtgcggcgggaggtgcggcggctcggcacgccgtcggcgtcgggcccggcgtccgggcggagtggggttcctggcataggccaaggctggtgaccgtatgtgattccctgtggaccgaaaggtcacagaaccgtaacagtgatcttgcgaggtttgagcgctgcgcccatatgatccttccgtaacagttcccgggcgggacggcccccgcggccgtcgcccgtcgcggcccgcacatactgatcgacatgccccggatcctgctcatcgaagacgacgccgccgtgcgccagggagtccagctcgccctgcgccaccaggggcacgacgtctgcgccgccgccaccggcgaggagggcctggaccagctcggcgccttccgcccggacgtggtggttctggacctcatgctgcccggcctgcccggcctcgacgtgtgccgccggatcaggaagcgcgagcaggtcgggatcatcatgatgaccgccaagggcgacagcctcgacatgatcgtcggcctggaggcgggagccgacgactacgtggtcaaacccgtgcaggccagagtcctcgacgcccggatacgcgccctgctgcgccggctggacgcgccctcctcggacatcgcccggccccgtgccgagacgcacggcgacctcggcatcgaccgcgccggactgcgcgtcacgcaccggggacagcctgtcgacctcgccccgtccgaactgcggctgctgctcgcgctgtccgcctcgcccgggcaggtcctcagccgccagcagctcctggaagcggtgtgggagcacagctaccacggggacatacgcctggtggacgcctgcgtgaagcgcctgcgcggcaagctcggtgaactgggcggcgcaccccgctacgtccacaccgtgcgcggtttcggctactgcttccgctcgccgtgagactccgcccgccctccctgcgcgtgcgcggcggcctgcggctccggctcgtcgcgggcttcaccgtcgtcgccgtcgtcagctgcctgagcaccggcgtgctcaccttccgcgaggcgcgcaccggagtgctccagcagagccaggacgcggtggtcagacagttccgggacagcgtcgacgcgcgggcgcccggcttcccggacgcgcccagccgctccgacctgaaccacatggtcgccgacctcgcctacacgcaccgctcacagcagtggcgcttcctcgccacctacggcgatgagcgcgccgtgtacggaccgcaggacagcttcgacgtcctcacccccgaactgctgcgttccgtacggacccggccggccgccgtcttccagcgcnnnnnnnnnnnnnnnnnnnnnnnnnnnnnnnnnnnnnnnnnnnnnnnnncggccgggcctacctcgtcgtcggactgcccgtcacctacgcctcctcgaccgccttcgcctccacccccaccggtctggtgctctacctggtggtcccgcaggagagcgaacagctctacgtcgaggcgctgatcaccgccatcgaacgggccaccctgcccgcgctcggcctggccgtcctgatcgcgctgttcgtcgcccgcggtgtgctgcgcccggtacgggccctgggccgggcca

SEQ ID NO: 235 - DNA, 1613 bp, Unknown
  Kingdom: Bacteria, Phylum: Actinobacteria, Class: Actinobacteria, Order: Streptomycetales, Family: Streptomycetaceae, Genus: Streptomyces
cgcgaacacgttgtcgtcggcggcgtccaccgcgacccagcggaacccctcgggccgcgtgtcgcactgccacagcgccggagtgtcccggtacagcgtgttgaggtcccgcaccaggtcccgcaccccgcggtgctcgcccgcgccgcagttggcgccctcatcgagcagccaccactcgggcccgtgctcctcggagaactcaccgccctgcgcgaactcctgccccatgaacagcagttgcttgcccggatgggcccacatgaaggccaggtacgcccggtggttcgcccggcgctgccaccagtcgccgggcatcttcgacaccagtgcctgcttgccgtgcaccacctcgtcgtgcgagatcggcagcacgtagttctcggtgtacgcgtacaccatcgagaaggtcatctcgtggtggtggtacttgcggtgcaccggttccttgctcatgtactgcagcgagtcgtgcatccagcccatgttccacttcaggccgaaacccagcccgccgtggtcggtcggcgcggtcaccccgccccacgcggtggactcctcggcgatcgtcaccacacccggcgcccgccggtacacggtggcgttcatctcctgcaggaacgccatcgcggccaggtcctcccggccgccgtactggttcggcgtccactggccggagtcgcgcgagtagtccaggtagagcatggacgccaccgcgtccacgcgcagcccgtcgatgtggaactcctcgcaccagtagacggcgttcgcgaccaggaagttgcgcacctcggtacgggcgtagtcgaactcgtacgtgccccagtcggggtgctcggcgcgctgcgcgttcccgggctcgtacagcgggtcaccgtcgaagcgggccagcgcccagtcgtccttcgggaagtgcgcaggcacccagtccatgatcacgccgatcccggcccggtggcaggcgtccacgaagtaccggaagtcgtccggggagccgagccgcgaggtcggggcgtagtacgaggtcacctggtagccccaggagccgccgaaggggtgctcggcgaccggcatcagctccacgtgcgtgaaacccaggtccttgacgtacgcgggcagttcctcggccagctcgcggtacgtgagtcccttgcgccacgacggcaggtgcacctcgtacaccgacagcggcgcctcgtgcacgggcgtgtccccgcggtgcgccatccactcggcgtcgccccactcgtggtgcgcggccgtcacgatcgaggccgtgtccggcggcacctcggtgcgccgcgccatcgggtcggccttcaggaaccggccgccgtactgcgaggtgatctcgaacttgtaccgcgcgccctcgccgatgcccggcaggaaaagctcccacacgcccgccgcgcccagcgagcgcatcgggaacgcggtgccgtcccagtaggtgaagtcaccggcgacgcgcacgccgcgggcgttgggcgcccacaccgtgaaccgggtgccgtcgaccccctggtgggtcatcggctcggcccccagcgccttccacaactgctcgtgccggccctcccggaccaggtgcaggtccagctcgccgagcg

SEQ ID NO: 236 - DNA, 563 bp, Unknown
  Kingdom: Bacteria, Phylum: Actinobacteria, Class: Actinobacteria, Order: Streptomycetales, Family: Streptomycetaceae, Genus: Streptomyces
gctcaggcggacccggcggcgcgggtcggtgcccccgcctgagcgacaccgggcggtacggcgtcgggcggcttaagtcccgtacgcgaccgggctgttgagcgccgtctcaggccaggtacgcgtgtgtctgggcggccttgaccgtggcccaggcggtggccccggggtggaggccgagttcggcggcggcgaccgtggtcaggtcggcggtcaggggcagttcgccggtgaggtcggcgcggaccaggtcgccgtgggtctccaggccggccacctcgcagcgccagaggttgcgggcgctggcgccggcgggacgctcccggtggagggtgaccgcgctgggcgggaaggcgacgaaggccgggccggtgaggtcctcggcggtcgtgacggcgggaccgccctggaggcgcacgacgtggccctcggcccgcccctggtagaggttgaggccgaccagccgggcgatgtagtcggtccgcgggtggcgggcgatgtcggcgggggtgccctcctggacgatgcggccgtcctcgatgacgacgagccggtcggccagg

SEQ ID NO: 237 - DNA, 3996 bp, Unknown
  Kingdom: Bacteria, Phylum: Actinobacteria, Class: Actinobacteria, Order: Streptomycetales, Family: Streptomycetaceae, Genus: Streptomyces
gcgctgaccttcgccgggttcgcccggctggccggggacgggctgcgggtcgtggccgatcccgtcggcccggccggcctggacggcaccatcggcccgggcggctccttcggctcggtggggcgggtcgggcccggcgttcccgaactcgtcgcggaggccgccctgttgcaggcccggctcgactggttccagacccagctggccctgctcggcgagcgcgggcccggcggcacgggcgaggggtagcggcggcgcccgaggggtacccggccctcccggaccgagaggaggcgggagaccgtgaccgggaccatcgatgccacacccgcacgcacgcagcttcccgcggcggacgaccgccgggtgcatgaccggtccgtgggcgaactcgtccacgacgccaccgaacagctctccctgctcgcacggcaggaagtcgccctcgccaaggaggagctgaccgcgaagggccggcgcatggggcgcggcggcggactgctgggcgccgcgggcgcattcgcgtacgtcgggctgttcgcgctcgccggtgcgggcgtggccgcgctcgcgctggtgctgcccgtgtgggccgccgcgctcgtcgtgaccggcgtgctgttcgtgatcgcgggcgtcctggcgctcgtcgggcgcgcacagatgcggcgtgccggaccgcccgcgcccaaggaggcgttcggcagcgtcaaggcggacgtcgaggaactcaaggaaagggcacatcaccgatgaccgacagcaggcagggggcgggcggcggggccgcacgggccctgggcgcgaaggggccggacgagctgcggcagcagatcgagcagaccaggagccggctcggcgacaccgtcgaggaactggcggcgaaggccgatgtgaagggccgcgccagggcccgggcagccgacctgcgggaccgggccggcgcgatgggcgtccagatgcgcagcggtgcggcacaggccgggcaccgcgccgaggaacgggccgcacacgcgctgcggcgcacgcgggacgccggcaaaggaccgatgagcgatgccgtgcgagcaagccggcgccgtccccggccggtgctcatcgcgggcgcggcgggcgtggtggtgacggtggtgggaatggtggtggtgctgaggcggcggggccggctgctcgcctgaccggtgcgcggctcggtcacggcagggcggtttccggtgccccgcgcctcgggcttgacctcaaccttggtcgaggttggagggttggggtcgtccgagcaagacgcctggcagcaaggggccgccgcaatgagttccgtactccgtacgacccgccgtaccgagacccaccccgtcttcggggatccgcgcgtgggcgcgccgctcttcagcacctggcgggtggggacgcccgagcgccagcggcaggccgtcgaggccatcgccgagacctggacccgccgtccctggcccgcccgcgacctgctctcctaccacgtctacaccggcgaggacggctccacgctgctccaccactcccagtgggcgagcgagcaggcgttcgaggggttcgtgcgggcgcaccggcaggagcgggtcgacgagatcgacaccgccgtcgccgggatcgagcgggtgcggctcgaccggtaccggcactaccgcagcggcgccacgggcgcctcgaccgacggcagcaccggcgcttccagcgggcgctccggacggacccccgggtgcatcgtgatcgtcgacgtcgagttcgacggccccgacccggaccggcagcgcgcctgggtcgacgccgtcttcgaggccctggacgaagagccgaacccgcatcccggcgggatcgccgcccacttccacctgagcaccgacggcacgcgggtcctgaactacgccgagtgggagagtgcccaggcacaccgggaagcactcgcggctccgggcgacggcgtcgggtcggagaccgggcagtggaagcgcgtccagacctggcccggtctcaggagcagcaccgtcaggcggtacgagcacgcgctcgggctcgtacccgcctgacggcggccggcgggggatgcgatgcagatgcggccgggcggacttgcgcgtgcgcgggcccgcccggccgccgcgtccgctacgggcggaagcgcagcacctgagggtcgtggtcgctgatctggtcgtggaactcggagttgatgtgcacgctgtcgtagtcgaagcggtggccgtgccggatcgacgggctgatcaggatctggtcgaggacctgcgcgttgccctggtagtcgtacgtgtaccgctcgctcgcgggcagcgacttgatcgccgaccacagctcgccgccgccctccaggatcttcgcggtgtcggagaactcgaagtcgttcatgtcgccgagggcgatcacgtccgcgttccgctgggccttcaggatgtccttgacgaaggagttgacctcggccgcctggaggtggcgctgcgtctccgagctgcgcaccggcggctggtaccgcgaggtcagcccctggtcgccgcccttggaggcgaagtggttggcgatcacgaagaccgtgcggccccggaacacgaactcgcccgccagcggcttgcggctggacttccaggcctcgctcgccgggtcgatgcggcccggtgaggcggtcagggcggccttgccgtgcacgcgggtgacgccgacggcggtggtggaggtgccgccgggacggtcggtgaaggagacccgggccgggttgaacaggaaggcctggcggatgttgccgccgggctcaccgccgtcctggtcgttgaccgggtcgatcgagcgccactcgtagcgcgggccgcccgccgcgacgatcgcgtcgatcagcttggacatcgtcacgcccgcggtgaccgtgccgtcgtcggtggcgccgttgtcgtcctggatctcctccagggacacgatgtcgggcgagcggaggttgttcacgatcgcggaggcgtgggccgcgaaggtggtgtcggacgggtccaggttctccacgttgtaggtggccaccgccagctcgtcccgggactgcgcgcgggtcgactcacgctgcaggccgccgctctccagcgtgccgagccggttcgcgaccagcgtgtagccgccgaactggttgtagtccagggggccggtggtggcgccctggagggtgtcgccgacgttcgccaccgggaaggccgcggtggcgccgagcgactggatctggagccggccggtgttctgggagtcgtaggagccgtacaccgtgccgccgcgccgggcggcgtgctcgtgcggcttcaccgtgacccacagctcggtgtacgggtcggtggcggtgaccacacgggcgtcggcgacctggacgttcatgccctccagggactcgtagtagtccagggcgtagcgctcggggcgcagcggcagggcgtcgaccgagccgttcgccgtgctgtcgccggccggggcgtaggcggccgggaccgactccgcgtcgatgacgaccggggccgggacggcgttgccggaggagagcacggtgacggccggcttggtgatctcggtgaccgactggttccctgaggaggtgccgccggggacgtactcggagacggtgccggtgaccgtgaccgagtcgccggcggccaccttgggggccgagctggtgaagacgaagacgccctcgctcgtggccgggtccgcgtccggctgcgggtcctgcatccagaagcccttcgaggcgccgtaggtacggaccccggtgacgattccggccacgtcggagaccttctggccggcgtagggggagatccgggtggtgccctggatgtcatggatgcgcacggagtccgcgtgcgcgggcgcgggaagcacgatcatctgcgtgaccgccgccgtctgttccgcggcggcggtcacgcagatgatcgtgcttcccgcgcccgcgcacgcggactccgtgcgcatccatga

SEQ ID NO: 238 - DNA, 1977 bp, Unknown
  Kingdom: Bacteria, Phylum: Actinobacteria, Class: Actinobacteria, Order: Streptomycetales, Family: Streptomycetaceae, Genus: Streptomyces
atctcgactacccggccgccgcggccctgtccttcgtcctcatgggcgcgctgctgctggccgtgttcacctacgcccggacgctgggcaccgaagaggtcctggaggcggccgggtagtcgagattggtgaagtactcggtctggatgatgttgccgatcatcgtcgtggaggggccgccgaggatgcctgcgttgacgtagtcggcgcaggcgggcacgaacgtcagcaggacgccggcgaagacgccgggcagcgacagcggcagcaccacccgcaggaaggtctgcgtccgggaggcgtagaggtcggtggaggcctcgatcaccttcgggtccacccgttccagggcgacgtacacgggcagcaccatgaacggcaggaagttgtaggtcaggccgccgaccaccgcgtagggcgtggccagcaggtggaaaccggcgggaagcagaccgatgtccttcagcggtcccagcaggacgccgtggtcggcgagcaccacgttccaggactgggtgcggatgacgaaggagacgaagaagggcagcaggagcaggaagaggaacaccgacttgtgccggccggcccggaaggcgatccaataggccaccgggtagccgacggtggcgcaggcgacggtggcgacggcgccgtagagcagggaccggaccagttgcacgtggtaggcccggaccacgtcggcgtaggtgctgaagtggaacgtctggcggaagccgtcgatgaagtcgccggtctgcagcgacagcgacaccatcacgatcaccggagtgacgaagaacgcggccagccacagccagcccggcaggatcatcagatacggagccagggcgccccctgggcgccgccgccgggtcaggcctggtagatcggctcgaacagtgcgttccactgcttctcctcctcttcgtcgagcacccgcagacggcgcagcttggactggtcggcctcggtcgggaagaccaggccactggtgctcagggcttcgagcacggtgcgccgcttgccggtggcggcggccgcgtcgcgggcgacggcttgccgcgcggcgggtacggggcagacgaactggacggtctcgctgatcctcgcggcgacctcgggccggtaggcgtagtccatgtaggccagcgcgtcgacgggatgggcggctgtggaggggatgcacaggttgtcggtccacaggagaccgccctcgtcggggatgacgaactccagccgtgagccgctctggttggcctggaagacgtcgcccgagtacaccagcgaggccgccaggtcgccgcgctggagggaggactggtaggtcgaggtggagtaggagcggaccatgccggcgtcgcgctgccggcgcagccaggcggccgccttgcgccagtcggcaggggtggaggtctccgggttcacacccacggccagcagtgcgacgttgcccatctgcaccgcgtcgttccacatcccgaccctgccgtgcagcttcgggtcgagcaggtcctgccagctggtgatcctccggccgacctgggccgggtcgtagccgatgccggtcatgccggactgccagggcacggtgtagacgttgccgtggtcgaagggggagttcttgaacgcggcgccgccgtagcgggcgaagttgggcaggcgggtgtggtcgagcggggcgaggtagccgagctcgatgtacttggtgaggtagctgtcgccgccgacgaccatcaggtcgtagccgatgccctggccggaggcgaattcgggctggatcttgccgaaccaggaggcgctgtcgtcgatcagctcgttgtaggtgaccttgatgccgctctcgcgggtgaaggcgtcgagagtggggtgcctgctctggtcggccgggtcgacgtcgatgtactgcgtgtagttgacgaagtccagcctcccggaccgcttcttccccttccagaagccggtgacggcggcggcgat

SEQ ID NO: 239 - DNA, 21367 bp, Unknown
  Kingdom: Bacteria, Phylum: Actinobacteria, Class: Actinobacteria, Order: Streptomycetales, Family: Streptomycetaceae, Genus: Streptomyces
gcctcgcccggcccggcgggggtgaggtcagggcgggagaggagggccggggtgaggccgtggccgggagccgggacgaggcgaggcctcggcggggcccggtgaggccggggcgagggtcgggtcggccagggccaggtgggcttgctcctccggccgccgcgggtccggtggccgagggggcggcgacgggaaccgccgggccggggtctagtctcgcgatgtggacaattctcgcatccggccgcgcgtcggccacatccagttcctcaactgcctgcccctctactgggggctcgcgagaaccggcacgctcctcgacttcgagctgaccaaggacaccccggaaaagctcagcgagcagatcgtgcggggagacctcgacatcggtcccgtgaccctcgtcgagttcctcaagaacgcggacgacctggtcgccttccccgacatcgccgtcggctgcgacggcccggtgatgtcgtgcgtgatcgtctcgcaggtcccgctggaccggctcgacggagcccgggtcgccctcgggtcgacctcccgcacctccgtccgcctcgcccagctgctgctcgccgagcggtacggggtgacgccggactactacacctgcccgcccgacctcagcctgatgatgcaggaggcggacgcggccgtgctcatcggcgacgccgccctgcgcgccaacctgcacgacggcccgcgctacggcctggacgtgcacgacctcgggcagctgtggaaggagtggacgggcctgccgttcgtcttcgccgtctgggccgcgcgccgcgactacctcgagcgccagccgcagatcacccgcaaggtccacgaggccttcctctcctcccgcgacctctccctggaggaggtcgccaaggtcgccgagcaggcggcccgctgggaggccttcgacgagaaggtgctggagaagtacttcaccaccctcgacttcagcttcggcgccccgcagctggaggcggtcaacgaattcgcccgccgcgtcggcccgacgacgggcttctcgtcagacgtcaaggtggagctgctgcggccctgacgggggcgcgtacgcggctgagggcctgggccggcgggccctgcggccccaggctgggccgcccgggcccgcagcccgggcggcccagcctgggcacctggggggccaggacacccgtcgtagccggcgtgacgggcgccgcgactacagcggtgtcgtgaccgtcgtgaactcgccgctgcccaggtgcagcatgcccttgccgggcgtgatggcaccgccgaccatgctccgggtggtacggatgccgatcagctcgcccgcggaactgtcctgcggggagagcagaatgccgcgacgggccttcttggcgtcgacctgccaaccggagaagccgctgccgacctcctcctcgtcaccggcgacgaccacggcgagtccctcttccgcgccccgttggatgatgcgtttgaacacgtcctcggcgtcgcagtcgtcgagcacctccgcgtcgtcgaccaggacgacgaccggctgctcgggggtggccgacccgatggcctcctccagctcgtcctcgtcgatgtcgcggtcggtgaacaccctcagcacgccttccgtgccgtccagctcgcgcagcggcgacggccggggcgcggccagcaccaggcgtacgccctgggcgaggtaggagcgcgcgaagttcagcagcaccgtgctgcggcccgacttcgccgggccgccgatcacgaacgccggcacgccttcggccaggtcggggccgaacgcggtgagctcgtcaccgcccacccccaccagtgcccacaacggggaggaactcgtggccgggtcgcgcatcttccacgcgtcggcgaaggagatgcggccgggcaggacgtcgacgcggaacgggcggcgggcgcgcggtactcccgtgtcccgggtcgccgccgcgtcgccgatcgccgccagcgccgcggcctggccctgaccggtcgtgtcctcgcagagcagggcgaactgtgtctccgcggcggtctcgttgcggaaggcacggcccggcgggatctcctccgggaccttgcgcgcgttgatgtcgagcatggagaagtcaccgcggtcggcgagcctcagcccgtacttgtcctcggtcagggaggcgatccggccggccaggacctgacggtcgccggtgatcaccacgtggatacccacgctggcgccttcgcgcatcagcgcgaagagctggtcggtcaggtccccgtggtcgtactcgccgagcgtgggcagccagccctcccaccggtccagcagcagcacgatgtgcggcagccgctcgtcctccgcgaccgcggcccgctgctcaccgatgtccgcgaagcccttctccgccagcaggtcctggcggcgggtcagctcacccgtcaaccggctgaacagacgtacgacacgctcgacctggttgcggccgaccaccgcgccgcagtgcggcagccgggtcagggcgttgagggcgccgttgccgcagtcgatgccgtacaggtggacgtcggcacaggagtgcgtacgggccagcgagccggcgatggtgcgcagcagctgggaacgacccgagcgcggggcgccgccgacgagcaggtgaccgaaggtggcgaagtccacggccaccgggcggcgggcctggtccgcgggcaggtcctccatgccgtacggggcggcgggcagctccccctgggcccgcagctccgggatctcgtccaggagcagggtctcctccagggcgggcagccacggggagtgctgggcggggatgccgagcgcctgattcgcctcccggacggcgtccaccagcaccttgaggtcggtgatctcgtcgtcctcgcgcgcctcggatttcggcttgcgcagtgtggcgcgaccgaggtcagtccagggcagcggggacgcccagggcgccagcgtcagtgggtcggccgcgcccgggcgacgtccgccgacgcggccggactggaaggggatcagcgaggcgtggccgaggcggacgtacgcacggccgggcgtgctcttggagatgtgaccggcctcgggggcgtcgatgacgtcggtcgactcgcccgcgtcggtcacgcgcagcgcgatccgcacgttggtgttggcgcggatctccggggacacgacgccgctcgggcgctgggtggccaggagcaggtggatgccgagtgagcggcctcgctgggcgatgttgaccaggccggtgacgaagtccggcaggtcgcgcaccatcgaggcgaactcgtcgatgacgatgagcagccggggcaccggcgcgtgggacgggtcccggcgcaccaagtcctggtagtcctcgatgtccttggcgtccgcggcggcgaggatgtgctcgcgccgtttcagctcggcgcccagcgactccagagcccgctcgacgagatgcgcgtcgaggtcggtgaccatgccgacggtgtgcggcagcttcacacagtccttgaacgccgagccgcccttgtagtcgacgagcacgaaggtcatgttctcgggggtgttggccacggcgagggccgccacgatggtctgcagcagctcggacttgccggaaccggtcgtaccggcgatcaggccgtgcgggccgtcgcgccggatgtcgatgccgaacggaccgtcgtacgactcaccgatgaccgccatggtcgactggccgcccgtccgccagcgcgcggcgaccgcgtcccgtgtcggcggttccagctgcagcacgtccagcagccggctggcggcaggcagcgcggagtcctcggtctcgccgctgatgtcccgcagcgcggacagtgcgcgcgacagccgcaggcaccaggcggcggagacgaagtcgggccgtacgtcggtccggcgcagggcaccgctctgctcgacccgcagccgcagttcgagcacctgctcgctgtgctcctgggcgggctgcgcggacgtctggtgccacgcgtggaaggaggggaacccaccggcggcggactgctgcacgctggccggcgccgcggagtcggtggtgtccgaacggcgcggctcggccaccactaccgcctggcactccccgggcaggaaccgctcttcctcgtccagacagatcgcgtacatggcgaccgccggaccctcccgcaggagccgcacgacacccggcagcgaacgcagccggcgcgatccgtcccagacgaccacgatgtcggggtcggagaaggccgggccgtcgttgttgcgtccgcgctcctgcagcgccttctgccgcgcggtcagcagctgggtcagctcaccgacgcgcgcgcccacggtctcggagtccgtacctatcaggacattgacgtcctggctgcccgcgggccgcgcgtggggaagccagcgcacccagtcccagcgctggtgggcgtcgttctccgtgagcacgtagaactgcacgtccatcgggctgtgcagcaccgcgctctgggcgagggcccaccggcccagtgcctgcgcggaatccccgggcccggcgatgccgacgaccccgaggtccttcagcggcagcgcgacgggcgagtcctccaggaaccacgtcaccttgcgcttgtggtcgtcctgctgcggatcgttgaggaccacctcggacggtacccggccggtgcccacgcgcagcaggaggtggtcggcgtcggtgcgcctgcgctcccacagccgggtacgcggaccggtaccgaaggccaggaccgcggcggggtcgggcatggcctgccgtcggtcggcacgctccgtgaccagcgcgtcctgggcgtcctgttcgatccgctccttgtgttccttgtactccttgacctgtttgacgtgcgatttccggccgtgcttcttgtccatgacgtagttgccgaccatcatgatcgggctcatcacggccatgatcaggtagtaccagcgcccgaagacgaggacggagaccaccgcgccgacgagggggaacagcgccatgagccagggcagcggccgggcctcgtactcgccgggcgggctgggcagctggaactcggtccggcgctccggctgccgcagccgcggcggccggttgtagtcgagtccggcgccgtcctcggaccacttgagggccgcgttcggcggggtgtaggcagcgatctcgaacaggctgttgccgagggcgagttggccgcccagcggccaggggcccccgtcgaaggcctccccgtcgagacgggggaggccaccggcgccgaggtcctccttggctccctttccggtcttcccgcccttcccgccgtcctcgccctgccggtccggcagaccgtgaagggcgacctcgcaggtaccgtccatggcgatggacaacgtggcggcccgctcggcgagttcggggtcgtcgacgcgaagctgtgcggccggaccgctgccgatgtcgtaccgccccacaccgagccggtgcaccgtcccggccccgggaccgccggccacccggaactccacgacgccggtcggctccccgaacagacagccagccgggtcgtgcaggctgacgacagcgccctcccgcaacggcgatccgacgacggtcgcgcccggatcgagggggtagccgtcgacatacgcctgcggagccccgccggccccgccggtaccctgatggtgcccctgcagcgagatgatctgcgcaccgccgctcagaccgacgtgctgcgccaactcccgagtgatgtccccgacggtcgactccggatcggcgtcgagcaccacgtcggcgctggcaccgccgagcgggtcgacgacggtcaggctcaggcgcacgttcgtcctcctcgcagggctcaggccccggaacgctgaacacagtgggaccacagtcgaagtgaccttagccgtccccgctttaccccgcgcaacgggatgtgcagcccttcacggtgcccttgccctacgtccctgtcctaccaacagccccgcccgtaagatctttgcgcatgcggacgaccggtcatccgacgggaaccgccgcacgacgcacgccacgggggacggccctgcggcgctacacgggaggagccctcatgggcaggggcggtaaggacgcagacctcacttactccgagatggagaagaaggcgagcgacctgatcaaggccatgcacgacatggaaggccagctgaagagcatcgagaagggggtcgagcagctggtggagcacggcttcaccactcagaaggcctccggcgcctacgagacctccatcaaggacttcaccaagggcgcgacgaagaccatccagggcctgcacggcctctccgagttcctgacgaaggccaagcaggcgtacgaggacctggaccaccagctggcccagggcgccaagggctgagcaggccccacggcttggacccggggtgcggaagaaggcgttcacgtctccctccgcaccccgctcttacaccccggcgccgctcacgtcgtcggcttgagattggcgcatcaggtacttgtggaggtcgctgcgccattcttctgtggtcaaggccagccacgagccgtccacgaaacggatacgcaacttgttgctctcgtacgtacctagagggtcttcgaggactgcctcggaggcgggaatctccgcaacgacacgcatgcgttccgtcctgcgcacggacacgcgcttgggcggtgccgcgagcacgatgcgtccctgggccagcaccacgaatcgctggtggtgggaagagtggctgtaccagtgcagcaggagcctgccggccgcaccgttccagtcaccgtcgaaggtcttgtccagtccgtgctcgactatggcttcatcgcgccgctccgccgcggcgtcctcagcgcgggcccgatcacgctcttcctttgtcgacagaaggcgtttgaggcgctcctcacccgtagccaggaggctgagcagcatgaggacggggacgaagggcgcggcgaccacggcaccgagcacgccgagtggtctgagaaccgctggtcgcagggggccgtcccctgaggcggcatgcacctcgggcgggggagcggggatttttccgatcttgcaccaggcgccggcatctggagtgacgccgaggcggttgcttaccgcgcggtcggtggtcctcgacaatccgtctcaccttcctcgttgttgttgagcgcaagccctgtcgaagtatctcatgacctggatgtggaaattccgcaatgactgacagaattacgtacgaccttgacatgatcaagagttgttcgcgaactctcgggaagattcaccgcgagttcgagcatcacggaaatccagcggacggttacgaagatgacctgggccatggaggtctgaaggacgcttttgatgaattcggtagcacttggaaaaaaacccgcaagaagctgactaaggaactcaagaagttggcggattacaccggggcagcggcgcagaagtacgaagaggtcgatcacgagttggcgaaggccattgccggagccatgggaaaggagaagaaatgagcaggcgatccagtgactggccgccactgtgggacggggatcccacccctggagaccctgatcaggtcgccgcgctcgggcgcaagctacgcaagatggcggatacgatcgacgaacaggcgagggttatcaaggctctgtcctccgtggagggatgggacagcgatgctggtcgggcttttaatgagattgctgatggcgccggcgatcgcctgaagaaggcattcgatcggtacgacgaagccgccaaagtgctcggcacaaaagtcgccgatggggaatcgaaggaattcgcaggcgaactccagcgagcgcagagaaaggccgacaaggcgctggctgactaccgggaagccgagagcgaccacggcattgccgaccgggaagtgaagaagttcacggataagtatctcgcaagtgaaattcccgcagcagataagccggaatatgagcggtggaaaaagaagcgggaggaagcgctacaccggatcgggcaggctcgcaaggacgtcaagggggcgcgagagatcttcgaagatgcaggagaccgtgccgcgagacagatcaagaacgtggtgcaccacgatgcggtccgtgaccccggtggatttatgaactggctggcggactgggcggacatgttctccaacatttccgcaatcatgtctgttctggctgttatatgcgcgtttctcccgccgcttgagttcctcgtccccatcttcgccaccatcgccgtgatttgcagcgcggcagcgttggccgggcatgcgtatgacatgagcgtccgcggcgggaaggtcaattggctgaaactggggaccgacgcgctgggaattctgcctggtttgggggcgctcaagggcttcagagcgctcgtcggcctcaagggaattgccaagctgagagcgtttgggaagctcggtacgctgggatcgttccggggcgtcgccgcgatcgacggtatcgggcacaatttcctcaatggccttagcgtgaccttgacgaacaagactttggctgcagggttgaagcttggcggcagacttaagattgccaatcttccggaggcgttcgagcccatcgccggaaaacagattaccgggatcatcaagggtgcggggcttgcaagcgctctgcaccggatgtttgagggaaagaatggtggaacgaccggttaccaggagccccggcaggagcgtgggcccagccccgctccgtccccctctcctgggccatcacctaagccgttccacgcagccctggctgcataagggtaaaatccaaaggtggtcgtaaacattgaaaggtcgcgtcccgcatggctgatttggtcgatcttggcgagtgggaattcgtcgggcgtagaggaactgagcccagacgactagtcccaggtgaagtgattgctgcagtaccgaaggtcagggagttggcggagcaggcaggcgttgatctacgtttcgacttcctcgacgaccgcagggttctgagcatgcttcggcgccgatatctcgatgagatggctatgttcaatgcgggactaaaggttggagcgccgctagcgattgtagggtttgctgccgttgcttactggggtggcgtggcccagtactgggaatcgagtgcggcccgcgccagttacgttaccgtggctgttgtgatcactctggctctgctgacattctatgtccgtacagcgatggaacactggggagatccggtccgacagaaccttcgggcacgagcgcgaaaatatcgtgaactggcgcacttggcacgcagggagggtgcgcaagtgcccgcccattatccgcactatgggccctaccctttcgcggccaccttccgtgctgaagtggaagacgtggaaaccatcgatggagatagccagtcgtgagttcggcaatagatggagacaacctcaagggcgtagcaggcggtgaggggatcgacgtccgttggatcatgccggaggggttcttcgagattccgatggatttcgagaacttggacgagaccgccgagcacttggttgagttggcccggaaggtgatgcccgaagcagacttcgacgtgcagctgcagtgggcgctcatggtggctgcccaatacgacaccttggtagagggaggagtccagtacgcgggcttcgtcatgacggaagtggacgggacacgctgtacggcgacggtgacagtgagcctgaccgatctcgacgacagagcaggatccaacccggcggggttcctaggttcatcgatgcgacacctcggcatcggacacgtcagcgacattgatctgccgtgcgggcctgcggtctgctgtatcggcaccagagaagccaaggtggacggcagcctgaccggctctggagtagccgagtctgtgcgcacctcattcatccaggttcaggtaccactgagcaatggaaccgtcattgtcatggagttgggcactccaacccaaatgggctgggatgttttttcttctatgttcgccggcgttgtgaagagtgtccgcttgttcgacgacaaggataggcctctcgtgatgccgtcatgacaggagaggcgatcgctgctgccccgccgaaggactacaagctgctggtgcctcgggactggttccgcatcgacctgacgcaggatcgttggcgtgcaaagttgaagaccttcgtggaccgccaggcggagggcaagagcgccgcgactgaagtgaagcaagaggtctggtccactctaaggaacaccgcagaggcgggcgtgagggccggtgcgatagagttcttcctcaggtcggaactagatgacggcagtgccatgcctgcctcgctcattgtctccttggttccgcggacgggcgccctcacgcctcacgaaatccaactgtcgttgaccaaaggtgagacggggaattcctcggctgacgtctcggtaatccgacttcctgctggtgccgcggtgcgggtgcttactgcaacgactatggacgtttatgtccagatgcccggttccgtcggatatctggtactggccttcgccgtgccaatcacgggcatgacggggccaatgcaccggctatgcaccgcaatcgtggagtctctgagttggattgtgtgatttgtggcgccgcagagctcctcgagggctgatggtgctctcaagggctcggcgtgtcggctgatctgccgggtaagtgggtgacctgctgtccgaagtggcggactggatcaagggccacgccgactggatcactgtcgcgggcttcggtggtcggtgtgagcgctatcttctgtccaactccgccgctgcttgtggtcggactgaacacgtcggcatttttcgtgcactcggcgtcttacggttgaagtcgacttatgctgcccaacggagggaacattgataactcgatgagattggtcggcgacgcgcgcggaaggcgcccggccgcagatggtgtcaaggctgggtgaaaagccgctcctgcggccggcggctcatcaaagacagcaaggtcacggcatagggaatctatcactctgagcaccttgaactgctcatcagcacgacgacttctgtctcaggtagagaaataagcgaggagaatatcccgccaggcgaggttgccagagccggaggaacggaggaacaggaatgagctcaggttctggtgaggagccagggcagaagcgtaccttataccgagtcccaatcgccataggggccggttgctatgtgttcgccgcgatagcggggatgttctttttggcggacgaccttggaacctttctccaggtcttcctgtggattgtgcacggcgtgctccttgccgttttcatcgataagctgggtgccaaggaatccagcttgtgtgcggcgcttttcattgtggccacctccgcagcatcggtatacgtgcttgatattgcatgcgacgacctcaccctccaacagcgaggagaaaaggtcaccgtaacagtcgtgaaggaatggcgtgatccacctcaaggacgcaagggccgcgactcccactacagtctggagcaccaggacggtacgagagttcctggacctgacatggaaacgacctcggacctttacgacgtcggtcaggtcctgacgatcgtcgaggatcccgagggaatactcggcccgcgtacgccgggacaggcagatcccagggctgagttgctgggggttggggcacttgtccttgctgcgctcagctccgtcgcctggatggcatggcgcggatcggacagtgcgaaacggcgagacgaggggaagccttcgtctgggatgcggaaggcttacaaggccgtcactcgtgatcactcctcgcatgaggagcaggaggcgcgactacgcgaggctctcagcacgtacccgccggaccggcgcggctacatcaaggtgcatcccgaggactaccccgacctgtcacagcatcgggctgcccggatagcttgggagatgggactccgtgctgaggctgtcggcaatcgcgggtcgtggcgtttcaaggagacagtgatcgaggaagtcccgcgtgagtgagccgtccggtagtgagtgagcaccggacggcaccggagaagattcgcgctccgaaggcggctgcgctgctccccggatgcttctccggcctgggccttagctcgtaaacgggaccttctggccaaccaggtagatcgtgctggatatcattgcgtcgagtgtcgcggaaccagcgcattccggcgactcgaggggcggagccagtggcgaaaacgatggagtctcgtgcgaggagggtctcacccggttctggggcccaggtcgtcatttgcttcatgccttcagcggtggcgaaactgcggaagagtggttgtcacttcactccgggccggaggactggcccgcctcgggcggcacttcgaaggacactgtgcgcagaacagctgtaaccatgtcgcagaattcaccccagtattcggtggacgccgtgtcaagcgtgaacacggcggtgtaaggagcggtcgggaacggcacatggacttggatctgtccggtgagcagctccctttccttaccgtcagcagtgatctctggagagagcgtgacctcgcgaagggtcacgcaggacaccgccggcccgcagggcagatccatccagcgtgcgtcacggtgtgggtcccctctcaggatgctgagaattccgtgggcagcggtctcggggtcggcttggtctgtttcgacggcggcgacggtgaaggcgcactgggcgacaccgccgtcgtcggtggagaaaaggcccacagccgagtaagagaggccgcacaacgtgagttgttcagcgagggcggcgtagtacggggcggcgggttcccagagggacgcgtcaccacgggagtagaggtcgcggacgaaagcgtcggacagagccgcacgctcctccggcgtggcggccaggggaagtgggaagaagcttgtgggggtgctgaaggagagcgggggaactccttcggcggccgatatagtgggcgttgtcactaggactttcgttccattcggctagatgtcgccttcttgatatttcacgtcttcgccattgggtcccatgaggcggaaagcttcgctggctgtcccgtaggaggggtccacattttctgtccgtcggtacgtgacgtagtagtttccgcttgggcgccgatagacgaaaaggtcgccgcccggttccttgcccctgaggagtttctgcacggtttcctgttgtccgggggtcagctcattcggtggcaccaaacgcaggggatcctcgagagcgcgtgtgatgtcgtcccggcagttcctgttccatcctgcaagcctgcaccaggagccgtcggtgaagacaagcgaaaagtcggtttcgtatctgctgaatttcttgcgtttggccgtggcgatggcggagcggtcggtttcccagaggatttcgtcatgggggtcctcattgctgttgagcaggccgaggacgagtacgcggcggtccgtgacgaccatgtgggtgcggtcggtgtcggaccggcgagctggatcgagctgccaggggagcgtgcgggcaagggttccgggggctgcccacaggacggggaagtcctctacttcgttctctggttcttccgggtttccgagtctcgcgatgttccccgtgctccctgatccggccagcgattcgagaaatccaagggtggctaccagcagcaggcctgctccgaaattccctccttggcgcagtcgtcgttctctcttggtgcgcacggtgaagtggggccccgcgggccagccgggcagctccttctggatgtcgtgtcgctcggtgtcgcggaaccagcgcatacctgataccggggtagcagcaccggtggcgaaacttacgccacgacgggccaggagtttctcgcccggtctggtttgccagttagtcatgtttgtctgcctcagtgtgcggtggcggactggtgaaggcgttccccagcatccgtggaacccccgccgtgcagggcgatgctgattcccttggggagaaccttgccggccacatcgatacccctgcctagtttgcttagcggatcgaaggtgaatttttcccccgcgagagccaagcccttggtgccgagccactggccctggtggtatccagcctcagccaggccggccagtcggctcatcgctccgctctcgtgactgagcagtccaagctccttgccggtgccccctaggacgacccttctgctcagtagcccaagtccgccttcgacggatttcgccatgtcgcccgtcgcgatcaaattgaaggcggacttgataccggaagcagtgaaccctgcaccgaactccgttatgcgttctgcggcggcggcctcactggctaccttggcacccttgccgaaggcgccgataccgggcagcagccccagcgcgtccgtccccattgtcagccagctgacatcggcgccgcctgccatggcaaccgagtgtgacagcagcgccagcccgcttgtcagcacggccgcggcgccgaagatggccccgagcggctcgaagggcagtgtgatgatggcgagcacgccgaggacagtggtgatgtcgctgaggatgtccccgatctccttgatcaggtcggcgtgatcctggatccattctccggtctcgtcccaggccttcacgatcccgtgccccagcttgtcccagaagccgggctcgtcaggggcgatgccagcggccttgtcgaactcctggccgatcttcccagcggctttcttgtaccggtcctcgaggtcgtggaccttgttgatgacaccgtcgaccgcgctggacgctttgccgagttcgtcgcttcccttgccgtcggccttgtgctcggccttcgccttggcgtcgagcttgtcgccggcttccttctccagccggtccgcctcgtcctggaagcccttgagctgctctgcccagctgtgtagcgcgcgggcggccttgtcgaaggagtcgtgacttttgcggacgaggggggtgagatcttttctgacgtgatcggcgaaggcaacagctgttttgcccttccaggcgccggactgaatgcgctccagctcccgtagggatgtgccgagctcggatgccaggccgccgagtttcttggcaagttcgcgggtgtcttcgacatcgcctggtgtggggtcccagccgatgtgtgggaaggccggccgcctgcctgtcacgtcacttgcccttcttcttgggggccttcatggattcggcgagatccaggtcgagcttgccgaacgactgactgatcttgttgatcattttgacggcgccgtgggtgtgcttgccgagttgcttgattccgtaggaccagtcgtcggcgaagtcgtggacgtcgtcgacgagtttgccctcgccgacggcagaggcgtccgtgccgtggagggtgcgacgggttgcctccatgcgttcactgatggtggagaacgtcttcttcaggtccgcgaagatcgtgtcttccaggtggaggtcactcatgtcgtggtcggtttctccggtggattccgggcggtgagtcgtggggccgcccgggttctggtcagcggttgactgcctggatttcctggaccgtgatgtcctgggtggcgccgaaggtgccgtcggggaggcggtcgcccttgccgccggttccggtccaggtgatcttccaggtgatcgtggctttgagctggaatgcggcgttgccggaggagcgcaggtacttcactccgcaggggggtgtcttgtcggcgttgccgggggtgtatttctcgccgatgtggcgtccggcgatctcgcagacgccggatgccgggtaggtctgcgcgtcaggggtgcccgggtcgatcttcagggagaccggttcggcggtggtggtcgcggagatgccgagcaccggtacggaggcggtgaccgagacgggtttgaactgggcgccgtcgagccaggcccaggtcggcaggttcaccttcgtggtgcctgccggtgccaggctcacttcggtggacgggacccggatctcggcgtaggcgagttgggcgaggacctcgggggtgacggcctgcgggacgtccgcgggcggtgcggcgcccttgtccacccagaaggtgggcttgtcgcacttgtcccaaccgggaggaaagctctcgttgacgtacgagtcccaccagtagcccttgccggccttgtccttgttgaagtccttgtacgggtgcccgttgacgtagcggtcccgctgctgcgcatcccactcccggccggtggaatcggccgcccagattggctccaacgtctttttcagttgttccggcgtgtacttcggcgcgtaccagcaggcaggcggcgtccatgaggtgacaggggcgaccggcccgaccgaactgccggtgccgttgtgggagcggtcaaagacgatgcccccggccgtggccgagatcgtgtccccgtcaactccgcctgacggctgtgcactactgggaggcgactgggcgccgccaccaatcctgttgtccgccgaggcaagagcggcgctcgagaagatcaaggtgagcagcgacagagggatcagtgtcctggcagtggctctcagggctgacacttcgagcttcccctctgagacatgagcttttcgatgacccagacacccttggcgctcttacgcaattgggtactgtaaagaacgtagctgttcttcgtggtcggggtcttgtcgactttctttgtcttgagatagaggtcgtacgccttgccctggtcctcgcagtagaggagcgaagccttgctcgcgctgctcacgtctaccaccgcgtcgtagtagcgataactgcccgtcgtacgggccttggccttcacgtaggcctcgatgaactgctgagtttgcgctgccgcttcaccttcgtagtagaagcggtaggccttgttcagcgggtcctggttggcgatcgccagatccaccgccttgatggactgctcgctgtctgccagtacggcgtcgtgatccttttggcctgtctttggccagtcaaaggtgtatgaaaggtcggaggggagctcgatcttcggacgtcctccggctggagccgtcgggctcgtattgggcgaagccgatgacccgccgtctcccgtgtccgcacccgcgatcttgtcgtgagccttggaactgtcgctcccaccgccgcatgctgtcagcagcagggcggcggccgcggtgaacgcggcagcaacgggcaaaggaaggcgcttcacagtgggctccccgtaagactagagatcagccagcgcactgaaggtatcggcgttgctggcgatcgtgccacggtgaactcatcacgcgtgccggaaaatgaggatcaaccggtgcgaaccggctgtgcaccgtggctcgatcgtgttcctctggggatgcgtttgaccccggatgcctggtgagcgcccggtggcgtacgcctgtggcagttcactggagttatcagggttggtggacgccaaggcggtcctggccgaactccctgcagagggaacgctgattcgccaggccgatgcggaggagggcggtgccagcaccggcagaagcttccaccccatgaggacgcgcacggccggctcgcccccccggaacggggtcgcttgggcgaccgggggcgctccacaggccccacgacgagcctgctgacacactgccaggagacatgctgcaccggcggttcgtccgctgctttcgccttcgcgcccctcccgaacgccacacctgtctcccggatcgatgttcgtggagtgtccgttcggctctatccacgggtggacgggtcccggcctctggtcctacgcgctcgtccgcctcagccgtaccgcctgccgggtcagcgcggacacctggaacaacgcccccgcgaactcgaccgtgtcgccgacccggacgtcctcgtagtcggccaccagtgcggccgcgcagacgccttggaaggaggtcgttccggtcgtggtgtcgatggcggagaccgtgatggacagcccgatcgggaagcgccagacgccgccgttgtggagcaccgacagggtgccgcccttggctgggaagcccgccgacgcggcggccaggacggcgggggaggtggtgaagcagaggccgttgtcggcctcgccgccggccggctccagggacgtgggggccgcggcggccgcggtcttgtccttggcttccccgggctccaggacgacccggtaggagcagatctggcggacggtgtaggggtgcccggagagggtgacgggctgtccggctcggacggttcgctccttctggtgcggcccggcctccaccccgtcgcgcagggtggcggtacgggacgtgccgtcggcgtgcgcggtgacgtaccgtacgcctccgccgcccggcagccggaaaccaccgccgcgcaggacgtgcagcccgtccgccggggcctcgccgtcgcagacggggcccccatcacgggcaggtgctgccgcggtcggcgtgtcactcccgccgccgctgccgtccgaggcgccacaccccgacagcagcaaagccgcggcgacgcccgcgatgccgtacctactcgccggcctgagcaccggtctcctccttctcgtcgtcacccgtaggtccagtacggcaccgggtgtgcgctgctccaccgcggccacgcgccacgcgccaccggtgacctcgatgacgcccccgggacaggtcgtcaggtcgtcgtacttcgcgaacgagcgagcgcatccgcagctgaccttgaacaggccgtgcacgggggccgcgcggagatgctcgcacgatccggtactcgcgccccccgtgggctactcgcagtcacgggtgcgcgggcgcgtgcgcagcaacgagaacggagctgctgaggctgggagagcgtcggtgaacccggccgggccgtcgaccggccgtcctgggtgcccgtgccggggccgccgctagggtgtggtgccggtaaggggccggtcgatgtgcgcacgtcgttgtccggtcggtgtcggtcggtatcggtcggtgcgcagggggagggccgcatggggatgtacgagatgtcgtcggtagtacaggacgccggggcggccagtgggggccggcgggagcggcggtccaccgggagcagcctggcgtgggctgtcgggctgcccgtggcggggctcctcgcgggggtggtcgcgcagtacccgtacgggatgtggatcggggtcgtcctcgggctggcggtggccgccacgaccgccgtcgtcgcggggggcgtctggcgccgggcgtgggcggcgacgttcgcctcgttcgccgcactggcattgccgttcttcgcggggcccgccttctacgagacgtacgccaagcagatcggtgagcgtgcgccggccgtcgtggccgggaccggggagcagcagggggtgaagaagagcacgaagctgtccgtctgccgggtcgtggacgcgtccggcgccgtgcgcgaggtctccgaacagtccaactgccacggtcagttcacggccggtgagcgggtcgtcctcttcaaggacccgctcggcgcgctggagccgtggatcgatgtggagcccggggaacggagcgccgacaccgtgggtctgggtgtcacggccgggctcgtcctgttgacgggatcggccctcttccacgccggacagcggcgccggtccgagcccagggtgcatccccggcggtaggcccggcccgaggtcagtgcgcatccccggcggtaggccctgtcgcggcattcccgtggacgccgccgtgagtgattcgtgcaggcatcatgagcgccgcgtgacgactgctccgctgtaccgcggtggcagtaactcctcggcgtggtcaccgattcgcgaccgtgtatgtcgaccgggtcgatcctgccgtgtcccatcaggcgtggcggggcggaagttgccgggggataacgcgcggggcccgcgcttcgtggtgccgggctcgccttgaggggcttatgtgcggctgataccgtgcgatcgcttgacactcgccaccgcgccgaatgcttgcgcggataattgccgaagtgtccgaatttaccgccgacgcagagcagttggcagacgatttcttggatgtacggggagcggttgcgtgaagatccaggagcgtacgggggcgggcgcggggcgttccgcggctccggctcaggcgccggtcggtgaccggcttcccacggcgcctcgcgagcgcaaacccgcgctcgcggccttggccgtgctgctcatcctcgtgggtgcactgggcgccaccatgctggtgctgcaggccggcaaccgcgtcgaggtcgtcaagctggagaaggaggtcgcggcgggcgagtccgtgaccggcgacgacgtgacgtccgtgatggtggccgccgacaacggggtcgactacatccagtggtcgcagctggatgccctgaagtccctgaaggcgaagtccacgctctacccgggcaccgtcctggtgggccagatgttcgccgccaaggccagtcttccggccggcaaggcgtccgtcggtgtcgccctcaaggagggccagtacccggcgaacgtcaaggagggcgacatcgtcgccgtgtaccgcgtcggcaacggctccaccgggtcgtccggttcgtcgagttcggccggttcctctggttccgggaagaacagcggctcctccggtgactcctccggcggcaacctgatcgtcgccaaggcgcgcgtcacttccaaggcggacacgagtgacgccgccgtcagcaccggcaacctgtcgctcaccctgctggtcgaccagtccgacgccgccgccgtcgcccaggccgcctccgcgggtgacgccgccgtcgtcatcgtcccccccggcaactgagagcggcgacacccatggccctcatcgcactggccgccgacaagggttcccccggcgtcaccaccgcggccgtcgcgctggctgcggtctggccgcggtggtgacgccgggggaacccttgtcggcggccagtgcgatgagggccatgggtgtcgccgctctcagttgccgggggggacgatgacgacggcggcgtcacccgcggaggcggcctgggcgacggcggcggcgtcggactggtcgaccagcagggtgagcgacaggttgccggtgctgacggcggcgtcactcgtgtccgccttggaagtgacgcgcgccttggcgacgatcaggttgccgccggaggagtcaccggaggagccgctgtt

SEQ ID NO: 240 - DNA, 1497 bp, Unknown
  Kingdom: Bacteria, Phylum: Actinobacteria, Class: Actinobacteria, Order: Streptomycetales, Family: Streptomycetaceae, Genus: Streptomyces
gatgccgcgcgcggcgacgtcggtggcgaccaggacgttgacgtagccgtccttgaagtcggccagggtgcgggtgcgggcaccctgggtcatgccgccgtgcagcgcgtcggccttcacaccggcgtcgcgcagctgctcggccacgcggtcggcgccgagctgggtgcgcacgaagatgatggtgcggcccttgcgggaggcgatcgccgcggtgaccggcgccttgtccttgggcttcacgaccaggatgtggtgcgacatggtcgtcaccgcgccctgcgccgcgtccacctcgtgcgagacggggtcggtgaggtagcggtcgacgagggtcttgatctcgttctccatggtggcggagaagagcatccgctgaccgcccgccgggacctggtccagcagctcggtgacctcgggcatgaagcccaggtcggacatctggtcggcctcgtccaggacggcgatccgcacgtcctcgagcgagcaggcgccgcggttgatgatgtcgcgcagccggcccggggtggcgacgaggatgtcgacgcccttctccagggcgtagatctggttgcccatggacgtaccgccgcagacgaccttcatcttcaggccgacgacgtcgccgtagggctggagcgcgtcggcgacctgcatcgccagctcgcgggtcggggtgaggatgatggcgcgcggcttgtgcttctgggtgcggccgccggccagcgtggccagggtcggcagaccgaaggagagggtcttgccggagccggtgcggccacggccgaggatgtccttgccggccagggcgtccgggatggtcgcggcctggatcgggaagggggtgctcacgccgttctgcgcgagcttgcgcacgacaccctcgggcagaccgaggtcggcgaaggtgatctcgggggcctgctcggagcggtcctcggccgccccggaggtctcctggccgccgtccaggttctcctggccggtcaggttctcgggggcgtcctcggtgctctcgggcacgacgacgtgatcagtactggcaatggacatgcgaatgcgaaaccttccggagtctcgtcggcacgcgcccgtcaactccgtgtttcgcaccacgaccgcctcgatgcggtccgccacggcaagggagagtacgcgccacacggcgcgctctgcgtgggcgccgggcaaatgggatcaaacgatctaccaccatacgcaccctccacccctcaaggcaaaccgacgccgtatgcccaggtcaggcgaggtcagcctcaggcccgtgcgtggaccggccggcgtagcgagcccggctcgggcgccggttcccaccgcgccggctgcggtcccgggccctcgtgcgccgaggacgacggctcggccaccgtagggtccggcgaggccggaaccgtcggtgtcgacggcggcggctcctgcggcggagcggacgactgcggcggcaccggcaccacctccgtcggcgtcggatcaccc

SEQ ID NO: 241 - DNA, 10682 bp, Unknown
  Kingdom: Bacteria, Phylum: Actinobacteria, Class: Actinobacteria, Order: Streptomycetales, Family: Streptomycetaceae, Genus: Streptomyces
cggcgggaccggctgggtcggctgcttcccgggcgagcagtgcggcgaccgtgacggcatcggccggtgcggcgctccggggagcgtcggccaggtgtggcggaccgaagcggtgccagccggtcggcgaccagtggtggaccggcaccagcagcgcggttccactggccggaagggggatgcgcaggaggccgtcatggaggtcggagaggccggtctcgcggacccagcagcgcagcaggttctcgactccggcggcctgggcggccgtgtacgggtcgggatgctccagcaggtcggtcgggacggctccgtcggcagcgggcgtcgctcgcggcggctggtcgggagagggggcgctcggctgatgagggactgtgtcgttcgtttcggttccggaaggaggtacggagtgaccgcggtgtgtgggggtggtgttcaaggcggttcctcggtgtcgtgggcgtccgcggcgcacgcgtcgcctgcgtcgtcggtgttctctgcgtcctcggtgtcgtctgcgtcgcttgcgtcgcgtatgtggcctgagttacctgtgtgacctgcgtcttccgtagcccttggatgtccggccgtgcgcgccttcgggtggggcgggcggctcggtgggccggcgggggctgccgaggtgggtcagcccgccgcgtccggacatccggtggacggcactcgttgccggagcgggcggaaccgcccgcccaggcctccggtgtggctccgggccgctgccgcgatcgcgtcggtcaaacggtcgagcaccgcctccgcctgctcgtcggtgagggtcagcgggggcaggagccggacgacgctcgcatgacggccgccgagttcgacgatgaggccccgcctcaggcactccttttgcacggcggcggcgatctcgggggcggcgggcggccgatgccaggcggggtcggccgggagcgcaacgggccgttcggtgtcacccgtagtggaagccgccgccggaccggttggcgccgggcacgcttctctctcaccgtccaccgccgcgtccgcctccacgccccgcttcgtggccgtccccgactccgtctccgggtcgaccagttcgaggccgagcatcagtccacggccccgtacgtcaccgacgcaggggtactgcccggccagctcgcggagtcgggcgagcatgcgggtgccgagggcggcggcacgttcggcgagacggttctcgcggacgtaggccagggtggcggttcccgctgccatggcgagttggttgccgcggaaggtgcccgcgtgggctcctggttcccagacgtcgaggtcgtcgcggtacacgacgacggccagcggcaggctgccgccgatggccttcgacagcaccatcacgtccggggtgacgccgctgtggtccaccgcccagaaggcaccggtgcggccgactccggtctggatctcgtcggcgatcaagggcacggaccgctcctcggtgagctgccggatgcggcgcatccaggcgtccggggcggggatcaccccgccctcgccctgtacgggttcgaggatcatcccggcgggcagcgcgaccccggacttggggtcgtccagtacggactccgtccagcgggcggcgagttcggccccgcgggagccgccgaggccgaagggacagcggtagtcctgggggtagggcagccgggcgacccgtacgtccggggcatgtccggacgcggcgagcgccgcgtcggtcatcccgtggtaagcgccggcgaaggccatgatgccggtgcgtccggtggccgtccggacgagtttgaaggcggcctccaccgcgtccgtcccggccggcccgcagaactgcacgcgtgcccggtcggcgaggccgggcggcagggtgcggaacagctcggtgacgaaggcgtccttgaccggggtggccagatcgagggcgtgcaggggtgcgccggagtcgaggaccttgcggatggcttccaggacgacggggtggttgtgcccgagggccagggtgccggcgcccgagaggcagtccaggtagcggcggccgtccgctccctcgatggtgagtccgcgcgccctgaccggcacgatcggcaggacgcgcgcataggtgcgtgccgccgactcgcgcgcggactggcgtcgcaggatcccgtcgtgcaaggggtgcgcgtcttccgacgcgcaccccccgtgcgcagactccgtcacggccacggctccctgtcctccgctgtcccaagacgccggcctccgcctctaccggtggggccggactccaggtcccgctgccgcacggcatcgagctgcccgcggtctcctcggccgcgtggcgtcgagggcgcgtgggtctggtcatggacagcgggaaccccaccgctataaccgcggatgatccgtacggttacgggtgggcgcgagttcgcggtgacgcgggcacgagatcacagtcgcggggcggcccggctcaggtcagggacgcctccgactcgacgacgatgccgtagaggtccccgatcgtcgccagggcgccatggtggatctggtgggcgcccagccgggtgcccatcacgtcgagagggcgcgtcgcgcacgcgtcggcgaccaccgtggcccggttgccccgcaggaaggcaccctcggcggtgaacagcacgcacatgtgcgtcatgaatccgatgacgatgacgtcttcgttgccggcggcgtcgacgcgctcgccgagctccgtgtcgacgaacgcgttcggcgccttcttcacgacgacgggctcgccctcggccggggcgacgctcgggtggatccggccgatctccgctctgatgtcgtacggggtgccttcgccgccgtcgtggacgacgtggatcaccttggcgccggcccgccgtgcccgtgccagcagggcggctgcggagtcgagcgcggcctgccagccttccagttccatcacaccgccgacgtaggtgttctggtagtcgacgaggatcagggtggagtgcgcgagtgacgccggtgtctcgtcgaggccgttgagttcgcggagagtcgtcgtagtcatgggaatacccctcagctgatgcaccgagcagtcggattcactcggattcgtcgtgtgtggccgcctgtgcggtgaccggccacacgtatgaacgtacgagccgccgccgcgtgtcggcaatgtcgcctaacatgcagatccagacatcagtccggaccgcggccccggacggcagccccggacaacggctcgggcgtcgcatcccgtaccgagtccgggcgtcgatttccggtcatcgagtccggacgtcaagtccgggcaccggcttcggacatcactcgtgccgaccgtgcggaggtcccttgagcgccgtggaacgactcgtcgtcatcgtcctcttcgaaggcgtcgacctgctcgacgtcaccggtcccccggaggtgttctccttggtacagcgcgagatgccggaaccgacgggttaccgggtgctcctcgccgccgagaccatggcgcccgtcatcacctcagccggggtgcgcctgctccccgacgccaccttcgacgaggtggcgggcggcagtatcgacacgcttctggtgcccggatcggtcgatgcggacggccggcacggcgtacgggcccgcaccgacccggcggtggtcgaccgggtcaagacgctcgccggccgggcgcggagggtcgcctccgtctgcgtcggggcgcacctgctcgccgccgcggggctcctcgacggcaagcgcgccaccacccactggtcgaccgcccggcaactcgccgacgagcacccggcggtgcaggtcgacgccgatccgatcttcatccgtgagggcgacacctggaccggtgcggggatcagtgcctgcctcgacctgtcactcgccctggtcgcggacgatttcggcgagacgatcgcgctccgcgtcgcccggcaactggtgatgtatctgaagcggccgagcgggcagagccagttcagcgttccgctggaacccgtctcgcggacacggcgggtggaagaactgcgccaccacgtcctgcggcacctcggtgaaccgctcaccgtggccgacctggccgagcacgcccacctcagcgaacggcagttgacccgtgtgttcaaggccgagctgggcatgactccgagcgcctacgtggaagcggcccgcgtggaagtggcgcgcggtcagctggagtccaccgacgccaccctcgaacgcatcgtgtcggtctgcgggttcgggacgacggacaccctcgtgcgggcgttccgccgacggctcggcacgacgccgaccgagtaccggcgccgtttccgctcccccttcggcgagccgacgccaaaccggtagatctacggatgattggccaggtcagacggcttgtagccgaaccgttgccgttccgtgggcagtggcccacagcgaccgcatagtgtgtggtgccgttccgaccgccgtggtcgagacccgccatcccgcccgggaccggtgcggcgacgcggcggcacacgcacgtccgttcacagcagggggagtcgaaacatgcgacccatacgcccatccgtcaccgctcgccggggaggacgcacccggcgcccggccttcccggcgctggccgccgtcgcactggtctcgacactggcgctcaccgccaccggctgcaactcggacgacaccgacgcggccggcaagccctccgcctccacggccgccggtgactcgggagccacgggcgacggcaagatcaagatcccggacgacctccgcaagaagctcaaagagcacgggatcgacatcgacaagtggaagaacggcgcctggaagaactggaacaaggacgactggctgcgcgaggcgaacgatttcgtcaacccgatcatccagggtctgtgggacccggaccggatgcgccgggccaacgacccggacaagggcgtcgacgacaacgacatctccggtgaccagggcgtcacggacccgacgccggcgcccgtgaaggcgcagaaggtggcaccgccgtaccacaccaacgcggcgacggcgggcaaggtcttcttcgactcccccgagggcacgatggtctgttcggcgacggtcgtcgaggacccggcccaccccggcaagtccaacctggtgtggacggcgggtcactgtgtgcacgcgggcaagaagggcggctggtaccgcaacatcgccttcgtgccgtcgtacaacgacgcgggccggagcaccgccgagttgcagggcgccacccgggagcaggtcgccccgtacggggtgtggtggggtgactgggcgcagacctccgaccagtggatcgagcagggcggcgcgaccggcgggcagggcgcgagctacgacttcgccgtcatccatgtgacgccggagaagggcggcaacggcaagtcgctggaggagaccgtcggttcggcgcttcccgtgaacttcaacgcgccggccgtaccgaaggtgcagaacatcaccgcgaccggatacccggccgcgccgccgtacgacgggcaggcgctgtaccagtgccaggacaagccgggacggctgtcggtcaagacctcggacccgacgatgtaccgcatcggctgcaccatgaccggcggttcctccggcggcggctgggtcgagaacggtgcggacggcaagccggcgctggtctccaacacctccatcggcccggtgacggcgggttggctggccggtccgcggctgggcacggtggccaagggagtctacgactcggtcagcaagaagttcgccggacagtgagcacgaccgcggcccgctgaactcgaccacggcggtggggcgtccgacggaaaccctcaccaccccaccgccgttcgtacccggccccacctgcagagtggggcagcacacacacgaaacaacgggggctcatacatcatgcgttccacacgtacgtccgccgcgccccggcgcgcacgccggggcactgtcctcgccgccaccggcctcgtggcggccctgacgctcaccgcgacggcctgcgacgacgcggccaaggacggcgcgagcggcaagtccggcgccaccgcctcgcagcccgcggacagcggcaacggcgacggcaaggtccagatcccggccgacctcgcgaacaagctcaaggagcacgggatcgacgtcgaccagtggaagaacggcggctggaagaactgggacaaggacaagtggctcagcgcggccaaggacttcgtcaacccggtgatcaagggcctctggaagcctgagcggatgaaatccgccaaggaggcgaacaagacggtctccaccaaggacgccgccgccgaccagggaatcagcgatccggcgccgcggcccgtccaggccgaggccgagaagaccccgtaccaccagcacgcggccccggtcggcaaggtcttcttcgactcgccccagggttcgatggtctgctcgggcacggtcgtcaaggacgtcaaccacccgggcaagtcgaacctggtgtggacggcgggacactgcgtccacgccggtcagggcggcggctggtaccgcaacatcgcgttcgtcccggcctacaacgacctcggccggtccgcctccgagctgagcggcgccagtcgcagcgaggtcgccccgtacggcgcctggtgggcggactgggcgtccacctcgggccagtggatccagggcggctcggagacgggcggtgcgggtgccgcgtacgactacgccgtgctgcacgtgaagccggagtccggtgcgaagtcgctcgaggagacggtcggcgcggccctcgacgtggacttctccgctccgcaggcgccgcaggtcgccacgatgggtgcctgggggtacccggccgcgccgccgtacaacgggctgaagatgttccggtgcctggaccggccgggccggctctccctcagcccgtccctgccgacgatgtaccggatcggctgcaccatgaccggcggctcctccggaggcggctggttccgcgtggtgggcgggaagaccgagctggtctccaacacctccatcggcccgtccgacaacacctggctggcgggcccgcagctgggcaagggcgccgaggcgctgtacgagaacatgagccggacctacggcggccggtgacaccggcacgacgaccggcatgacgcgggcccgtccccttccggtgaagggaacgggcccgtgtgctgttttcccggtgtgaccggcgagcgggtcagagcgcggagaccggcgtgtacggtgccaggtccgcggccagttcctcgtgcaccagtgccttgagcagggtgccctccgcggtgtgctcctcggaggtcacctcgccctcggtgtgggcccgggcgaccagcttgccgtgggtgtagggcacgagtgcctcgatcgccacggagggccgcggcagctcgttgtcgatcatggcgagcagctcggcgatgccgcggccggttcgggccgagacagcgatcgagtgcttctccacccgcagcaggcgctgcagcaccagcgggtcggccgcgtccgccttgttcaccacgacgatctcgggcacgtcggtggcgccgacatccctgatcacctcgcgcacggcggccagctgctcctccgggtcggggtgcgaaccgtcgaccacgtgcaggatcaggtcggagtcgccgacctcctccatggtggaacggaacgcctcgaccaggtggtgcggcaggtgccgcacgaagccgacggtgtcggccagcgtgtacagccgcccgctcggtgtctcggcccggcgcacggtcgggtccagggtcgcgaacagcgcgttctcgaccaggacgcccgcgccggtgaggcggttgagcagggaggacttgcccgcgttggtgtagccggcgatggcgacggacggcaccttgttgcggcgccgctcctggcgcttgatctcgcggccggtcttcatggccgcgatctcccggcgcatcttggccatcttctcgcggatccgccgccggtcggtctcgatcttggtctcaccaggaccgcgggtggcgaggccgccgcccttgccgccgcccatctgccgggacagcgactggccccagccgcgcagccgcggcagcatgtactgcatctgcgcgagcgcgacctgcgccttgccctcgcgggacttggcgtgctgggcgaagatgtccaggatcagggccgtacggtcgatgaccttgaccttgacgacgtcttcgaggtggatcagctggcccgggctcagctcaccgtcgcagatgacggtgtccgcgcccgactccaggacgatgtcgcgcagctcgccggccttgccggagccgatgtaggtggccgcgtccggcttgtcgcggcgctggatcacgccgtcgaggacgaccgcgcccgcggtctccgcgagggcggccagctcggccagggagttgtccgcgtcctgcacggtccccgaggtccagacgccgacgagcaccacgcgctccagccggagctgccggtactcgacctcggtgacgtcctcgagttcggtggagaggcccgcgacgcggcgcagggccgcgcgctcggagcggtcgaactggtcgccgtcccgctctccgtcgatctcgtggctccaggcgacgtcctcttccatcagggcatcggcccggagaccttcgggataggtgtgcgcggagcgcttggtggcctgggaagaggaagaagaggaggtcattgggtccttacgtcgttgggaatccgtggtgcggcggcgcagacgcgacgagggccgacgcgctacgacagccgttccgtcacttctcacaacgcacggatgccccgggagattcccgcgcaccgtgccgtgccgacctgacgatcgtcgcacggaacggcccgtctcgtcacggcgttattcacggccggccgccgccgctcaccgcttccgctgcgccatcagctcctgcctggcctgttccgcagcggtctgctccccagcggcccgctcccccgccgccttggtccgcgccaccttcttctgcgcggcctgtgcgggcggcacctgcttccagtccgggtggcccggcatgggcggcgtcttggcaccgtagagccaggccttgaagaagccgccgaggtcccgtccggcgactgcggaggccaggtgctcgaagtccgcggtgttcgccgtggagtcccggtggtcgcgcacccaggagcgttcgaggcgctcgaaggccggcttgccgatctcctggcgcagcgcgtagaggacgagagcggcgccgtcgtagatgttcgcccggaagatgccgatcttctggccggccttgggcggcttggggagggcgggcggccctccggcctcgcgccagcggtcggaggccccgtagccggccttcatacgggcctccatggacttgtgcgccttctcgtcggcgtacagggcctcgtaccaggtcgcgtgcccttcgttgagccacacgtcggaccagctgcgtgggctgacgctgtcgccgaaccactggtgggacagctcgtgcaccatgaccgactcgacgtaccacttgggccaggcgggatcggtgaacagctctctctcgaagagggagagggtctgcgtctccagttcgaagccggtggtggccgacgccatgagcaggccgtacgtctcgaacgggtagggtccgaccttgctctccatccaggcgatctggtcgggggtcctggccagccacggttcgagcgcctcgcggtccttggcggggacgacgtcgcgcaggggcaggccgtgcgggccggtgcggtgcaggacggtggagcggccgatggagacctgcgccagctcggtggccatggggtgccgggtgcggtacgtccacgtggtctgcccaccgttgcgggcgacaccggcgggcaggccgttggcgacggccgtgtatccctgcggggcggtgacgtggaaggtgaacatcgccttgtcggaggggtggtcgttgcaggggaacaccaggtgggcgacgtcggcctggttggccatggcgaggccgtccgtggtgcgcacccagccgccgtcccggcccttctcggacaccgggtcactggtgtggtgcaccgtgatgcgcgtccagccgtgctcgggcagcgggacctgcggagtgaccaccaggtcctcgcccgcggcggcgaagcgggccggcaggccgtcgacctccacggagtcgaccttcccgtgcgtgaagtcgaggttcaggcggtccaggttccgggtcagccgggcgtcgatggtggtgacggcccgcagcggcttgctgttgtccccggtgtaggtgaaggagaggtcgtacgacgtcacgtcgtatccggggttgcccagctgggggaagagccggtcgccgatgccgagcgcggtgggcggggcactcgcggcgaggaggcagacgcaggcggcggacgcggcggacgcgaggagggtcgccttgagggttctgcggcgacgcgggacgcgggatcggagggtgcgcggcatggaccacggctatcagcgcacggcgccgctacggcggcgacgcgcgcccttcccacccgaacggggccttcgggagtgcacgcggaccgcgccggcgcgcgggaggttcccggggcggacggaggtgagc

SEQ ID NO: 242 - DNA, 622 bp, Unknown
  Kingdom: Bacteria, Phylum: Actinobacteria, Class: Actinobacteria, Order: Streptomycetales, Family: Streptomycetaceae, Genus: Streptomyces
gaccgcaaggtcgccacgatcgccccgctggtcggcgaggcgtacgagctgcctttcgactacctggtcatcgcgatgggcgcggtctcccgcaccttcccgatccccggcctcgccgaccagcggggcgatcgtggcgaccttgcggtcctggtcgatggtggtgacccggccggtgaggacctccgccttggggagcacgcgtcgcaacgggacgacgacgtgacgcggggagatgctgccggcggcggcttcggggaggaagggctggtaggtcatgtacgaccgggggtcgacgaccgtgacggtcgcctctccgtagcgcatcttcttgagaatgcgccgagctgcgtacaggcctacgtacccaccgcctactacgaggatcctgggacgctccgtggtgctcatggcatcgagtatccacccgttggtggggggtacctcgtgcgccccttcacaaggttcgcaagtgcctgtgctaaactccgcggcccacgtgaccgagatcatggcggcggaggggaacccggatccggttcggaccgttgtcaagggcgcgtgagctgccgctccggcccgccgaggggtcgaccgagagccctcccaccccccgtccgcc

SEQ ID NO: 243 - DNA, 5371 bp, Unknown
  Kingdom: Bacteria, Phylum: Actinobacteria, Class: Actinobacteria, Order: Streptomycetales, Family: Streptomycetaceae, Genus: Streptomyces
gaccggcgagctggtgcggcgggtgacgggcgagtcgatcggcacctggatcgcgcgcgagatcgccgcaccagctcgccggtcagccagctgtacgtctgcgcgtggtagccgtggtcggtgcccggctcccacaccggtgcctgggccgccaccgcctgggcgcccagctccgggtcggcggcctcggcgggcgtgagcggccggtcgagcacgggtacgcccgcccggtgggcgagcaggtgccacaccagcgtctgctccttgcccgccgccttgaactcgggccagtacgcccccaccggcgcgtccaggtccagctccccgcgctggtgcagcagcaggagcacggccgcggcgacgcccttggtcgcggagcgcacgatctgcgcggtgccgtgctcccagggcgccgccgcgccggcacccgtggtcgcagcgtccgagccggtcgtaccgccagtaccgtccgagccggccgtaccgtcgacgtcgcgtatccccgcccacaggtcgacgaccttgtgcccgtcccggtacaccgagagggccgcgccccgctcgccgcgcgtggtgaagttctcggcgaacgcctccctgaccggctcgaagccctcggccaccgcaccgctcacgtccacgcccgtactcctgccactgatcactcgtatccgtccgccgcctgcgacagtgagtgcaacacagatgtggcgcctgcgattcctcggctcacgcgccggtcgtcaccgagcgcgggtcgaagccgaagggcagttccagacggtgggcgcgcatcagctcctcgtcgcagagcagggcgccggtcgcgtcgtccgccgcgatcacgccgtcgctgagcaccagtgcgcgcgggcacagttcgagggcgtagggcaggtcgtgcgtgaccatgaggacggtgacgtccaacgagcgcagcacgtcggcgagttcgcggcgggaggcggggtccaggttggaggacggttcgtccaggaccaggatctccggctccatggcgagcacggtggccacggcgacccggcggcgctggccgaaggagaggtggtgcggcggccggtcggcgaactcggccatgccgacccgctccagcgccgtgcgcacccgttgctccagcgcgggccccttcagcccggcggccgcggggccgaacgccacgtcctcgcgcacggtcggcatgaagagctggtcgtccgggtcctggaagacgatgccgaccttctgccggatctcggccatgtgccgcttgccgacgggcagtccggccaccgtcaccgtgccggcgccgccgccgaggatgccgttgaggtgcaggacgagggtcgtcttgccggcgccgttggggccgagcagcgccacccgttcaccgcgtgcgatcgtgaagtccacgccgaacagggcctggtggccgtcgggataggcgaaggcgaggccggagacctccagggaaggcgcagtcatagcgtccatcccagcacacagacgacgagcgccgcaccgggcagggccagcgcgtacgaccactgggcccgggaggccgtcacctcgtcgatgaccggcatcgaaccggcgtagccgcggctcaccatggccaggtggacgcgctcgccgcgttcgtaggagcggatgaacagggcgcccgcggacttggcgagcacgccccagtgccgtactccgcgcgcctcgaagccgcgggaggcgcgggcgatgcgcatgcggcgcatctcgtcggtgatgacgtcgccgtagcggatcatgaaggaggcgatctgcacgagcagcggcgggagtttgaggcgctgcaggccgagcagcagttcccgcagctccgtcgtgctcgccagcagcacggacgcggcgacgccgagggtgcccttggcgagcacgttccaggcgccccacaggccgttcacgctgagcgagagcccgaggacgtgcgtgcgctcgccctcggccacgaacggcatcagtaccgcgaacgccacgaacggcacctcgatcagcagccgcttgagcaggaaggcggcgggcacgcgggcggtcgcggcggtggcggcgaggagcacggtgtacagggcgaacgcccacagcgcctcgcgcggggtggacacgacgaccaccacgaacgtgaaggccgcggcgagcttggtgtgcggcggcagagcgtgcaccggcgatttcccgggccggtacagccggtgcgcgtggccggcgcccatgtcaggccgccgcctgggaggaactggtctccgggccggtcgtacggcgcctgcggacgacccagaagacgccgctgccgacggcgacggtgacgccgacgccgatcacgcccgcgagtccgccggacagccgggcgtcggagatgtccttgacgccgtagtcggcgagcggggagtccgcggaggcgtgcggctcctccttcttgtcgatgcccttgtcgtgggcgaccttctccaggccgtcggggctggcggaggcgtagaagctgacgaacccggcgaggaccagggaggtgaccaggccggtgatccacagcttgcggtgggacctggctgcggcgggcgccgggcccggggccggtgcggcggccggggcgtcgaccagttcgccgttcacccgcagcttcaggcgctgctccaggccgcgcgccccgtacaccagatccgggcgtacggcgatgacggcgccgacggtgagcgcggtgatcgcggcctcgccgacgccgatgaggacgtgcacgccgatcatcgcggtggcgaccttgccgatcgccacgtcggtggtgccgccgacggcgtacatcagggtgaaggcgacggcggcggccgggacggagacgagcgcggccacgaaggaggcgaccgtgacggagcggcggctgcgcggcagcaccttcaccaggccgcggaagacggcgtacgccacgaccgtggtgacgatcgccatgtcggtgatgttgacgccgagcgcggtcagcccgccgtcggcgaagaggatgccctgcatgagcaggaccacgctgacgcacaggaccccggtgtaggggcccacgagtatcgccgcgagcgctccgccgaggaggtggccgctggtaccggccgccaccgggaagttgagcatctgcaccgcgaagatgaacgcggcgaccaggccggccagcggcgcggtccgctcgtcgagttccctgcgggcaccccgcaggctcaccgccacggcaccggcggcgatcactccggtgacggcggaggtgggagcgttgatgaatccgtcaggtacatgcaccgttcgatgatagtggcgtattgcgaacgtcttgcaagagcgtggtcggacgcatctgcggcgcgtccgcggcatccctgcggcgcccggagagagtagcgggtcaataggagtgaatcggtaaatatgggacattcgtaataaaacgtaaaagcggagaagcgcctcctagtgaggtcactgagtgtgaggggccgtccgatggctgtagtcgaacagtacgcacgagcccggatcgtcaccgaggacgaccagcaggacgaccacgacgccgtgccggtcgtgctgcgctacgacccgcaggacgacccgcgctcggtccggatcgggctgcccgacgcgcacgagtggacgttctcccggtcgctgctcgaacaggggctgcgcgcgccgacgggcgccggtgaggtacgggtgtggccgtgcggccgggtgcaggccgtggtggagttccactcgacgcggggtgtctcggtggtgcagttcgagacgaagacgctgctcagattcctgcggcggacctacagcgccgccgcggcgacggagatggtccaccggtaggacccgccctgcttgcggttcgggtcgcctcaggcgcccttcttcagcagggccgccacgatcgggcccgccgtgtcgccgccgtggccgcccgcctgcacgacgcccgccgccgcgagatcgccccggtaggcggtgaaccagccgttcggcttcttctgcccgtcgacctcggcggagcccgtcttcgccccgtagtcgggaccgagcccggccatggcctgggcggcggtgcccgaggaggccgtgtacgccatcagctcccgcagctgggccagcgtggacgcggacagcgtgcgcgaggccgtggccggcttgcggtggtcggagtccgcggagaccaggtacggctggcggaaggtgcccgacttgacggtcgcggccaccgaggccatgttcagcgggttcatccgcaccccgccctggccgatgagcgaggccgccttctgggcggccgactgcaccggcaccgcgccgtcgaaggacggcaccccgatcgcccagttgtcccgccccaggccgaacacgtcctgcgcctgccgggtcaggtcgtcgtccttcagcttgcccgcctggctgatgaaggccgtgttgcaggagcgggcgaagctcgccttgaacgtgccgcccttgatctcgaagtcgtcgtcgttgtggaacttccagccgccgtaggtgaacgtcttcgggcacgggtgttccttgtccgcggacgccagcttcttgtcgatcagcagcgaggcggtgatgaccttcatcgtggagccgggcgccagggagccctgcaaagcgatgtcgaagccgtgcccgctgttcgccaccgcgaggatctcgccggtggaaggacgcaccaccacgaccgaggcgcggtcccgcttggacacctcctgctcggcggccgactggagcgacgggctcagcgtcgtgcgcaccgtgcccggggtgccccggctcagttcgacgagtgtcttgtcggacagcttcgccttcttcgacgcggcgccgcgcaccacacgcagttcgacgccggcccggccgcccgccgtcttgccgtacttcgcgcgcagcccgtccaggaccgagcccagcgacgggtaggccgcggtggtgatcgcgccgccgtcccggtccagcgccttgaccggcggggtgccggactcgccggtgaccagggtgtcgccgtccttcaggtcggggtggactaccgccgcgtgccagtcgacgaccggggcgccgtcggccgtgcggcgcacgacggtcagcgcgctgtcgtaggccagcggcttgctcaggcccttgtacgagaccgtcgccttcacggagaaggggaccttgccgccgctcggggtgccctgcgtcagcgtgacgtccttgaggtgcgcgtccttggcgtagtcggccagcagcgcgccggccgccgcggcgtcggtggtcgaggccgccgcctgggccggcctgccctgctgccaggccgtcaggaaccgcccggcggtggtctgcacctcca

SEQ ID NO: 244 - DNA, 2025 bp, Unknown
  Kingdom: Bacteria, Phylum: Actinobacteria, Class: Actinobacteria, Order: Streptomycetales, Family: Streptomycetaceae, Genus: Streptomyces
agcacgccaaggcgctcgcgggcggcggcccgaagtacgtcgagcggcaccgcaggcgcggcaagctgctcgcccgcgagcgcatcgagctgctgctcgatgccgacacgcccttcctggagctgtcgccgctggccgcgtggggcagcgagtacgcggtcggcgcctcgctcgtcaccgggatcggggtcgtggagggcgtggagtgcctgatcaccgcgaacgatccgaccgtgcgcggcggggccagcaatccgtggagcctgaagaaggcgctgcgggccaacgacatcgcgctcgccaaccggctgccctgcatcagcctggtcgagtcgggcggtgccgatctgccctcccagaaggagatcttcatccccgggggcgccatcttccgggatctgacccggctttcggcggccggcatccccaccgtcgccatcgtcttcggcaactccaccgccgggggcgcctacatccccggcatgtccgatcacgtgatcatggtcaaggagcgcgccaaggtgttcctcggcgggccgccgctggtgaagatggccaccggcgaggagagcgacgacgagtccctgggcggcgccgagatgcacgcgcgcacctcgggcctcgccgactacttcgccgtcgacgaaccggacgcgctgcgccaggcgcgccgcgtcgtcgcccgcctcaaccaccgcaaggctcaccccgatccccccttcgcagagccgcccgcatacgagaacgaggagctcctggggatcgttcccggcgatctgaaggtccccttcgacccgcgcgaggtcatcgcccggatcgtcgacgcctccgacttcgacgagttcaagccgctgtacgggacgagcctggtcaccggctgggcggccctgcacggctacccggtcggcatcctcgccaacgcccagggcgtgctgttcagcgcggagtcgcagaaggccgcccagttcatccagctcgccaaccagcgcgacatcccgctgctgttcctgcacaacaccaccggctacatggtgggccgcgagtacgagcagggcggcatcatcaagcacggcgccatgatgatcaacgccgtctccaactcccgtgtcccgcacctgtccgtgctcatgggggcgtcctacggcgccgggcactacggcatgtgcgggcgcgcctacgacccgcgcttcctgttcgcctggcccagcgccaagtccgccgtcatgggcccgcagcagctcgcgggcgtgctgtcgatcgtcgcccggcagtcggcggcggccaaggggcagccctacgacgacgacgcggacgccgcgctgcgcgccatggtcgagcagcagatcgagtccgagtcactgccgatgttcctgtccgggcggctgtacgacgacggcgtcatcgacccgcgcgacacccgcaccgttctcggcctgtgcctgtcggccatccacaccgcgccctacgagggcgcgcgcggtggcttcggcgtcttccggatgtgagggaccccgtgatttcgaacctgctcgtcgccaaccggggcgagatcgcctgccgtgtcttccgcacctgccgtgagctgggcatcggcacggtcgccgtgcactcggacgccgacgcgaacgccctccacgcgcgcgtggccgacgccgccgtacgcctgccgggggacaagcccgccgatacgtacctgcgcggcgacctgatcgtgaaggcggctgtcgcggccggcgcggacgccgtgcaccccggctacggcttcctgtcggagaacgccggtttcgcccgtgccgtcctggacgccggcctggtgtggatcgggccgccgcccgaggcgatcgaggccatggcgtccaagacccgcgccaagcagctcatgggcatcgcgccgctgaaggacgtcaccgaggccgacctgcccgtgctggtgaaggcggcggcgggcggcggcgggcgcggcatgcggatcgtacggcgcctcgaagacctggacgccgaactggccgccgcgcgcgcggaggc

SEQ ID NO: 245 - DNA, 4610 bp, Unknown
  Kingdom: Bacteria, Phylum: Actinobacteria, Class: Actinobacteria, Order: Streptomycetales, Family: Streptomycetaceae, Genus: Streptomyces
gcccgccgcaggccccgcagggcggtcagacgccgtcgtccccaccgcctcccccgcctgcgcagcagcagtagtaggtttccggccgcgaacacgtcagggcccgtaccgtctcccgacggtacgggccctcacgcatgcgcaggcagcaccgtcgggaaccggccgccacgctctcaccagggcggcgtcagtggtctccaccaatgggggccagggcgcgtctcatttgttatttccgcaggccacatggggtttgacataccgttgacgcgcgcagactgccgctgatagacacacacttcattccatcggcgccacccggtcaagctcgttcaagcacccttcacagctcgttccagcctgttcacttctgttcaagcccgcctcgcgcggggcgcgcagcgtcccgcgcgtgcgacgacgcgaggtcaccgagccatgaacacacacgatcagcacggcagcggacgtaacggcccccgtccgaggagagcacggttcctcgccgccgcgggcgccgccgcgctcctcctcgcgtccgggctcgccgccccctccgcctcggccgcgcagcggaacaccgccgcgcagcaggccggcaccgccgaggccgcccaggccgagcagagtgcccagggcggcgaccagggtgacaagggcggcaacaaggtgctcaccgtcgccgtcgcgcagagcgtcgactcgctcagccccttcctcgcggtacggctgctcagcaccagcatccaccggctgatgtacgagtacctgacgaactacgaccccaaggacaaccacgtcatcccgggtctggccaccaagtggcagtcgtcgccggacaagctgacctggacgtacacgatccgcaccgactccaagtggtcggacgggcagcaggccaccgccgaggacgcggcctggacgttcaacaagatgatgacggatcagggcgccgccaccgccaacggcagtttcgtcggcaacttcgcgcaggtcaccgcgcccagccccacccatctggtgatccggctgaagaagccgcaggccacgatgaccgcgctcgacgtgccgatcgtgcccaagcacgtctgggagaaggtcaaggacttctcgaagttcaacaacgacaagagcttcccgatcgtcgggaacgggccgttcgtcctcaccgactacaagccggacagctatgtgcggctgaaggccaacaaggacttctggcgaggcgccccgaagttcgacgagctggtgttccggtactacaaggaccaggacgccgccgtcgccgccctgcgcaagggcgaggtgtccttcgtcgccggttcgccctcgctgacgcccgctcaggccgcctccctcaagggcgacaagaacatccacgtcaacgacgcccccggccgccgtttctatgccctcgccaccaaccccggcgctcaggcgaagaacggcgcgaagttcggtgacggcgacccgtccctgttcgacgagcgggtgcggcacgcgctgttcatggcggtagaccgcaagacgatcgtcgacaaggtgttccagggacacgcggtcgaagggcagggctacatcccgccgcgcttcacgcagtacttctacaagccgacggccgctcaggaactggcgtacgacccggccaaggcggggcagctcctcgaccaggccggctacaagaagaacgccgacggcaagcgggtgggcaaggacggcaagccgctgaactaccgcgtcctgtgccacgccaccgacccgaacgacaaggcggtcggcaagtacctccaggagtggtggggcaagctcggcatcgggatcaccctcgactgcctggacaacgtgaccgacccgtggctggccggcaagtacgacctcgccttcgacggctggtccgtcaacccggacccggacttcgtgctctccatccacacctgcgccgcccgcccgcagaccccgaaggacaccggcgccaccgacaacttcatctgcgacaagacgtacgacgacctgtacgcgcagcagctcgccgagtacgaccccgccaaacgggcggacatcgtcaagcggatggagtcacggctgtacgacctggggtacatgaacgtcatggcctatccgaacgcggtggaggcctaccgcacggaccagatcaagtcgatcaccaccatgccgtccgcggcgggcaacatctacgggcaggacggctactggagctggtggtcggccattccggcggactccggtgactcctccggcggttcgtcctcgaccggtgtcgtgatcgggatcgtcgtgggcgtcgtcgtcctcggcggactcgcggtgctcttcaccatgcgccgccgtacgacggccgaagaccgggaataggaccgcgaccgtgtccccatgtacgtgtacaggtgcaggtgctcatgaccactgaagcgacatcctcgccggccggcggtgcttccgccgccggtccggcgggacccggtccggcgtgctccggggcggcggccggggcgcgggcagccggtccttcccgcaggctcctcgcctccggctatccgcgctatgtggcgggcaaactggccggagcggccgtctccctgctcgccgtcctcgtcaccagtttcttcctcttccggctgatcccgggcgacccggtgaagttcatgaccggtgggcgtccggtctcggccgagcagatcgccgtctaccggcgggagttcgggctggacctgccgctgtgggagcagttcacgcagtactgcggcaaggcactcaccggtgacctcgggacgtcgtaccagttccgggcgccggtcgtcgacaagatcaccgaggcgttgccgaacaccctgctgctcaccggcacggccttcgtgctgtacaccgcgctgggcgtcttcctcggcacccgctcggcgtggcggcacggcaagctcggtgaccgtgtccacaccggactggcactgacgctgtactccatcccgtccttctggctgggcctgctgctcatcatcgtcctgtcggtcggcgtgggcccgatcccgggtctcttcccgaccgggggcatggagtcgggcggcaaggagggcttcgcctacgtcgtcgacgtcgtccaccacctgatcctgccggtggtgacgctggtcgccgtcgagtacgggcagacgctgctggtcacgcggtcggcgctgctggacgagatgggcagcgactacctgacgaccgcgcgggccaagggactgcgcgacgacctcgtacggcgccggcacgccgtgccgaacgcgctgctgccgaccgtgacgctgatcttcgtcaacctgggccggaccgtggccggtgtcatcctcgtcgagacggtcttctcctggccgggtctcggcgggctgttctaccaggcgctgagtgtgcccgatctcccgctggtgcaggggctgttcttcgtcttcgccgcggcggtgatcgtgatgaacaccctcgccgacctgctgtatccgctgctcgatccgagggtgggccgatgaccgccgagaccaccgaagccccccggagtccagagggcgccgggagccccgggaagaagccgcccgccgcgcccgggccgcgcgctctcgcgtggcggcggcgccgcgcctccgccgcacgcttctggaaggagtaccgcaagcaccgcgccggcgtgttcggcctcgccgcgctcgtgctgttcgcactcgtcgcgctgaccgcaccgctgaccgtcggctcggacgtggacagcgtgaccgacgccccggggcagccgctgcagggccccagcggccgtttcccgctgggcaccgaccagttcggccgcaacctgctggggctggtgatctggggttcgcgcgtctccctcctcgtcgggctgctggcggctgtgctgtccgtggcgatcggggcgctcatcgggatcaccgccgggcacttccgcggctggtacgccacggtgatgatgcgggtcacggactggttcctggtgatgccgacgctggtgctcgccatcgcgctcgcgaccgtcctgtcccgctccctcggcacgatcgtgctggcgatcggcgtgaccacctggcccacgaccgcccggctggtgcgggcgcagacactggccgtggagtcacggccgtacatcgaacgcgcgaaggcgctcggcggcgggcactggcacgtcatgtcccggcacgtgctgcccaacgtcatgccgctcgtcctcgcccagacgaccctgatcatctcctccgcgatcctggccgaggcgacgctcgccttcctcgggctcggggatccgacggtggtgtcctggggcggactgctgcaggacgcgcgggaggccggggcggtcagctccggcgactggtggtacctggtgccgccgggcatcgcgatcgccgtcgtggcgctggcgttcacgctgtgcgggcgtgcggtggaagccgtactcaacccgcgtctgggggtggcccgttgagcctgctggaggtccggaacctggaagtgacgtatcccggcggtgccgccgccgtgcgcggggtcgacctgtccctcggcgcgggcgagaagctcggcatcgcgggcgagtccggctgcggcaa

SEQ ID NO: 246 - DNA, 11133 bp, Unknown
  Kingdom: Bacteria, Phylum: Actinobacteria, Class: Actinobacteria, Order: Streptomycetales, Family: Streptomycetaceae, Genus: Streptomyces
gggccagggccgggcgggcgttgacggtgcgggagcgggtccggctccggcgggggcgggcagtgcgctcaagggtcgaaaaagacatctggactcctcacgggcggagcggtgggggcgcgggtcgcgatgctctctccgccctccgggccgcacggcacaaggccggcgtcccgcaggacagacagcgcacagcgctgcgacgtgcacacagtcgtcgcggccgtcaggctccgggggagttcgatggtgctctcaaccccggccgccccgaggggcggacgactactgcggtcatgcggtggtgctcactcggtgctcacggaggatcaccgacgccttacctacatcaggttgcatcaggtaccctcaggtgtcaagcggtatagtgaggcacccagagggaatttcgaaggaggcgaaggcacatgtcagggcagccccgagccgacaatcggccgccgtacgcgcgcatcgcgggccactaccgcgacctgatcagctctggcgagctctcgccgggcgacctcctgcccagcatcaagacgctggcgaccgagtgggaagtcagcacagccaccgcggaccgcgcgatgcgactgctgcgcgaagagaagctcgtgcagggcattcccggcgtcggtacagaggtgatggcgcgtcccatctccctgtcctccggggcggagcgccacgaccgcagcagcaagacccagtcgtcgtggggcgttggcgagaagtcgtccggccacaccgccggcatggtcagagctcccgaagacgtcgccgatgtgctgggcatttcgcctggtgaagacgtgattcgccgcagccgtgtctaccgagacggtcatggcatcgtctcccactccacctcatggatcccggcggagttcgcccaggccgtccccgagctggcgcggagcgagcgactcaagggagggctgtcgctcgacttgatcgctggggcgaccggacggcacgtcgtgaagcgcgtagacgaagagacggctcgcattgcgacggaccgcgacctcgagctcctagagctggaggccgacaccgtggcggcgattcttgtactgaccgcgcgtttcctggacgccgacggcgagctgctggagtacggcgtggacttgggcgccccgggccgcacccgccgcacgacgtcagaggtgctgcgttgaccacgcagaacgtcgccgttaccgacgacacgctcgtctcctgcctcgaagcccgtctcagtcagctccttcgagccgagcacaccgacaccctcacgctggaaggacgattcgagatcacgcgcatctctgccactttgtccggccgaccggaccccgcgcctcgcgcgatcctcatgtccggcctccaggggtccggcaagacaaccctcgcccgcgccctggaggaggccggcttccggcgcctgtgccctgacgaggagatgttccgccgctacggccactacggcagggacttcccccgcgggcagttcagggtccgggaggcacctgtactcaaggacatcgcccttgagctccaggaactcctggccgccggacacgaggtcgtggtcgaccacggcttctggactccggaagagcgaggccagtgggcagcggccgtgatggaggccggcggcgagcctgtgctcatctacttgccggtgccgcatgaggtgcgctgggaccgaatccggaagcgcaacaagcagtcgctggtcgacccgaacagcatcgagttcagcgaggaagacctgatcaggcacgcaggccgctttcacccgccgaccgctgatgagccgcacatcctgtacgacggtcacccggaaaacgtgctggccgcgctccgccgtgcgcgtccctccatggatggcggtcgacattgacttccctctcctacccgccccaccaggcgcttattggctgtcttgtgggggccatcacactggcgggagccagatcgcaacatcacaaagccttgtcgaagctcgtgcgcacccgtgttcacgggttttgaacatctacatacacatgggatttgcaagcctggctctaggctcacggccatgacgatcacggagggtcacagggtggggaagcaccgagcgggctggcgtccggacaagctgcgcgagcagcgcgaggctcacgggctgaccctggagaaggccggtgagcgcctccgtcaggttgctgagcaggccaaactcaagggcatcccggccgcgaatccccagactctctggcagcacgagcagggcgaggtctatcccgggccccactaccggcgcgcttactgccttctctaccgggccaccgagcccgacctgggcttccgcaccgccctgcctggtgaggagacgtccttcaagctcacgccgatggacgatcgcctcaacggctcgcatgtcttggcagttgagcgagctattcaccgcatcgcgccgggctccggcgaagccgaccacttcaacttgcagcagcggatcatcgacgcgtggaagcgccggcacacgggcggcgacccccaccgtcccgtactcatcctggtcggcggctttgcaggcagcggcaagacggagctcgctcgcttcttcgttcagctcaccggctggccgctgctcgacaaggacccgctcacccgcccgctcgtggagcgcctcctggtcgcgctgggcggcgacgcgaacgaccggcacaccgagctctaccgcgagaaggtccggcccgtggagtacgactgcctgatgcagtcggccatggccaacatcatgtgcggcatctccacagtgttgaccgctccgttcatcgccgaaatgactgactcggactggatgcagcgcctggccaaccgtgcgggctcgatgggtgtcgacgtcttcccggtgtgggttcgctgcgacgaagagtcgatgcgcgagtacatcggattccgctcagcggcgcgggacgcgtggaagctccagcggtgggacgagtacatggccacgatcgacctcgagctgcgcccggcggtgccgcacatggtcgtcgacaaccgcttgggcgccgcggtgacgctcgcggaccaggcccggcaggcgatgggggcgatgtacgcgtgacggagaagcaaggcgtgatcctctacggcccgccggcctcgggcaaggacactgtcgccgccgcgctcagcgaactcgacgccaggtacgtacagttcgcgcggctcaaggtcggaacgggcaaggccgccggctaccggatgggcacagcggagcagctgcgcgagctggaggccgtgggcgacgtcgtctacgcgaacgcccggtacggcaacacgtacgtcatcgacgcgcccggcctggacacggcgttcaaggccggggtgccggtggtgcacctcgggcaggtcgacggcatccgcgcgctggtcgacggttatccggctggctggtcggtggtgctgctgtggtgcccgcgcgaggtgaccgagcagcggtcggcggggcgtggcgacagtgacaccgcggcgcgcctggcggcgtgggacacgacccgcgaggacctggccgcgcatccgagcatggcctgggacctgaccgtggacaccacagcgtcggcgccgcaggacgcggcgcggctcatcgaccaactgctggcgcagcgggcgggagcggcgacagcatgagcgcgggctacggctgggcgagtcggtccaaggcgtcggtgagcgtgagcgagctgtcgtccttggcgtcgtcccaccgtgccagcgtggccgcggccgcgcgcagcatctccggtggaaggccggcggccgcgagcgtgtcagcagcttcctccagctctgggccccagcgccaggcgcgggccgcagtcttggcgacgtactccggctcggacaggtacgagtcggtacgccgagaggcgacctcaacgagctcctggtcgacgccgtgcttgcgtgccattccgatcgcgagcgccaccagcacccggctggtcttctggaacgaggcgtacgccagcttcagcgccgacgccttcccgacctccgtgcccagcagggccgtctggactgcggtgccgacgaacagcgcctccaccctctcggtcacgccggccgggccggacaggtacaaggccggtgtcttgccgcgcaccggcggggagccgacgacgccgccgtccacgacgatcgcggtcggttcgagcattccggcgatccgctgcgtccgctcggggttgatggcgttggcctccacgtacaccccggtgaagcggtgcgcggcgacgtcgcgggccaggtcctcggcagcggccggcgggcagaggctgatgacgatgtcgctccggtccagcagctcggccagcgtcgccacgggcgtcagcccgaactcggcggcgcgctccacggacgcggtactgcgcccggtctcgcaccacaggaccgcagcggcgttggtcgcggcgcaggcggcgacggcggcgcccatgctgccggggtggaggatgccgacgacgggttggtcggtcactgatctactccgtggagtgggtgagcaggtggtcgacggcttgggtgacgtcatcaaccgtatggtgtggggtcgtgaggcccacgggccagggtcggccgcgtacccagattgctcgcaggccggccttgtagccgccggtgatgtcggtttcggggttatcgccgcacatccagtctccaggggtcagctgggtaccgcagcgagccgcagcaagctcgaacaaccgcgggtcgggcttgcgagcatcgatgtctcccgaagctgcgattccgtcaatcaggtcggcgagaccggtagcgcgtaccttggctcgctggatgtcgcttgctccgttggttgccacaccgatgctccaaccggcctctttgaggcgactcaggcttgcaagcacggctggtcggcaggtgacagcagccgccatgcggtcgatgtaaacccgccacaagtggtcgggatcctcagtgaggttgaaggctgcgcgaagacgaacgaagtcgtgacggtcggctcggtcggcgagttctcgcagcagccattgctcaatctcggcgccgtagcgatggtcgtggctcaggacggctatggcatccgcgaaggccgcggtgcggtcgaccaaggtgccgtccaggtcgaagagggcgaggcgcatgcggttgaccctaatcgaggacatgtgcgacacgccgtcaacttcacgtcggcaagtgcagagttatgtatagttatagatcacgtagggagagggggatcagtgtctgagctacttgatgcagtcgatgccctactcgcgaggccggacgccatgccaccgccagacgtgcgggcccggctgcggaaggccgacggattgacccaggaagaagtcgctgaggctctcggtgtcacccgcgtttcctttcatcgttgggaaactggccaggcgaaacctcgtcgacgtcaccttgaggcctacgttcgcctgctgaacggttgggccgcgaagcatcccgaggcagcacagttcacagggccagagcaacaggctggacgaggagactgatgccaatcagcccgtaaacgccgaagcggccccgtcgccacaacgggaccgcttcctagcgatcgactcgcacccttccaaaagcccgagtcgtgagcagcgaggtgacctcgtctgccgggtgatgcccgtgggccctagggcccgcgtggtcacctatacccagagtatgcgcattggattgcgcaacgccactactccggggtcctggctaggtcacactcgccggtcgcggctccccgtctggggagatgacccacccttgcgagaccgtaacgatcattccactgggccggatggcctcttcggtggatacgacgaagactccgacaccagtcagcgtgccgagttgctgggtcctgatgatgacggcttctacaccagtcagctccgtgactggatcccgctgtgcccggaactgcgggacagtgccgtgcggttctactggatcctgcgcgcgctggtgatcgagaagcatggtccggtgcgcaagctcaccctgttgcagatgtgctacctgctgccgtcgaagcagatgcggccgggggaagcggcgctgccgtcgagtctggcgcgggtccgctcgctgctgtccgagctgtccggggtcgggctgctcagtacgccggagggcgggccggtcaagacgtccagccgtgcgggtgcgtcggccgcgccgcttcggatccggatcaatgaccgccctcaccgcggttacgcagggccgcggaacgcgttcgccctgctggacgaggtgaagcggccggctgccgaggcggcccggaaggctatccagaaggagcgggatcgctcggcgcgcaagcgggctctgcgtaccggagtagcgggccagatttctagcccgctcgatgaggcgggccagatttctagcccgcggggccagatttctagcccgcggggccagatttctagcccgctttcggggtctgacctgcaagatcgcgacctcccgttcagtccttccgctcagactttccgttcagagggtgggggtaccgtccgtccgtccgtgcaggtagaggacgcgcacgcaacggacggacggacggcgggcagcgacagcggaggcaaggcgaggaagcggtctgcggctccgggggaggacacggcacccgcccctgcctcgtcaggcagcaccgatgcggggacggctccggagcgcgccagcaggtcaagtgccggtcaccgggagacgacgcccggcatggaggtcctgacccgggtcgctcgggtgaacgactcgctgcgcctggcggggcgggtgctgctggatcaggcaggcgagttggacaagctcatcgcggtgtccgaggcggcgggtgagccctggcggctccaggacctcgtgacggtcctgagcgcccccctggacgggcccatccggatcagcgcgggcgccgtgatctctggccgcatccgccagctcccgctcaccccccgcaccgcgatgctccccgctcaggccaacgggaagagctggacggagaagagggccgaactgacccgcgagccctcctccagcctggccgccgaccggcccgtcgatgaatcggtgacccggcggctgcgcccggaatgccccggctgcggcgcggactccccgggcagcgccctgtgcccggactgcctcgggtggccgctgtgcgagggcggctgcggccggcgactggaagccggcggcacctgcgaggcctgtcacctggcggagcatcaccgggccatcgagcgcgagcgcaacgaggacggcacctgccccggatacgacggcccgtgcggccgcccggtgctcaccctcggcctgtgcgggaagtgccgcattaaggcagaggccgcgaaatccgccctcgatgagcagtgggcggctcaggtagcagcggtgaccgcgatgaccgacgaagaacgcgctctcgccgaagcccggatgcacgacaacgcccgcggtctctgagcggcgaccggcgacaacgtccccgccctgccctctgaaggcccatcagggggccgatctcccgtcccgccgggacgggagatcggcccccacagccccctacaacgatcacgacgaaggaaagccagatgcccgaacgcacccacgagttcggcctgtacggcgcccgcggcatcaagggccatgaggccgtcgcccgccgcctggaccagctcgccggattcatcaccaccccggtcaccacccggcgcggcctgatagcccgcctgcactacctcacccgcagcgaccgcgcccgccaggctgcccgcgccgccggcctgaccgtcaccgaccgcaccctcaaagcctggttggagggccgccgttctccctcccgcaagaacctggaccgcatcgagcgggcctaccggaccgtgcggcgggagaacgtcgcccgctacctcctggcccgcctcaaccggggcggccgcggtacccgtgtggagatccacccgctcaaccagtcccaggtcgaccggccccgccagcgcgtcgtcgagtaccggacgatgaacgtgcggaactgggacggcatcgtgcaggcctgggccgccgacgacgaccaggcactcgacgacgcctgggtggaccacatcgtcgacctcggctcccagtggggccagtacgagtacgtcaccaacgtcggcttcgccgcctgactcacgcccgaactgccgcggaccgtcggccacgccgcacggcagggcacatccggcgtgccgactgtgccgaccgcactcattacaggcgtgtacgacgggctgcagcagaaggaggtcaccacctggatggccctccggaacagcgcagcgcacggggactatggagactacgaccaggcccaggtgcgtcgtttcctcgaaggcgtcgaagcattcatgaagaagttcccagcgtaagcgaaccgtgattgggctgcggcccgcaccacggccggggagctgcgccgaggcgcggcctgctggcgggcgggtacaacccgacgaccgtgtacgcgccgcagagtcgcagctgacgcgcggaaggaaggcgagcagggcgtgcacccacccgggtgcacgccctgctctcatacgcccatgctcacctctggtcgaaggcgccgctcgctctcacatcacgcgtgtctggagcgtgagtcgttttacggtgccgcctctccggtcccaagtgccatcgccgccccactgactcgtggtcccaggatcctgatgccgccgctggaggcgtccggtgagtgcacctcggagagatacccgccccgtcagactctgcgggatgccggtgaaagccgcgctgcgaggccctcgccgactttcaacctgctgctggaacaactccgcgaggcgcggctgttcggccgtcagatcgctgtacagcgcctcgggaggcggccgagtcaacccacggggcttcagcagctacccgatgaggcccgtcttctcttcgagcatgatggccaggccggtcgttgccacgaaggtggcagctgcccagacgatggcctcggcggcgtccttcatgaggtgagcgccggcgatataggcggccagggccgcagccaagcccgtcatcaccgccaggagtaccgcgaggatcttcaccgtcgtgccctgcgcctgctgcacggggctcggagcgctcgtagtgtgcgccaacccactgccggcggcaggcatgggctgtccttcgctgtgtaccgtcatggatatgggccccttccgggtctgggggcctgctcgccacgatccgccaagattccgacgggcaggccccaactcatccccgaccagttgtgccgaggtgtactgctgtcgcaacggctccgcccagcaggcgtgaccatgccacgcccaccatgcggactgccgacggtcgcacgagcatcaggacagtgcagcccgccgggagtacatcgacagtagctccgaacgggccgtcagctggggcaggaaaacagctcacttactagtcagtagcaaatacactggacgctacgcgtgcgcgcgtccacgcgcgcgagcacgcgcgtgtggcggggatcacttctgacggcgctttcggcgctgcttggccccaccgagcgagggtttcttcaaccagcgagcagcctctggctccttgagctgagcgcccctcgccctccgcgtccgtcgtgactggagtccattccttcgcagcacccactgtcgccttctctcagcatcaagaagccaccgttcacgctcggctggcgacagatgctggggcggccgacgcctccgcccccgacgagcagacgcgatctcacgctgccgttgagcctgctccagagcaccacgaactgaggcaaaccacttatttactgccttaggcgaataaccggtcacctcggcgaactcctccaccgcgatgcctacttccatcgccctccgcacgagtccccgagctcgtgcggagatcttcagttcttcccgagacgcatggcggtggcgctctctcactcgatccagctgctcacgggccctctcgatcggcaccgatcgcacggcatttcttctcttgcccagccacttcgcaactgtctcgggcttgtaaccggtcaccgtggctgcttcctcggcactgacacctgccgcgatggcctcgacgatgcgcttccgcgcatcgcccagaacatgcaggtaagcggtgcggaagcgttggcgacgtcggctgatccgggtcaagttgacccgtacctctcgagctacttcctcgcgtgtcttcccatgactgtatggacctttaaccatgaacaccccctcgatggcatcttgccaaacaagtggtcggcctcgaggaaagttgggtacttaagctgaagtgttaggtgcgtcgcgggcgctgctggcccctgcggccgcccttttctgtggcctctcggctttgcgtcggtggcggtgagagctcggcgggcaggattgaggccatttggcggccgaatggaagacgtttcgcgggacctgagagcgggacagattgcgaattgatacagatgcgaatctgcatgagcgtgacccgggctctgcatttgctgtcactgtgtctgggctgcgcggtgacgtcctggtgcagattgtcctgtgtcattatggtgccatttcaggggacatcgagatgcagattacaaggcggatagttggcctgtagggggacccgagtacgatcccaaatttatcgggccaccttggagtgacgcacattgggttgttggaaggtggtgcgatgtggttgagtgtgtgcactctccggggccggcgccggacgccgggggagtgcggggtgacgggccgtcactggctcccccgtgggaagttgacccggcgtcaatctgctacgcccacggaccgcaccccctgcccctccttgctgctgcccagttcggggcgcggagcgtcccggactcctccgggtgcggcggagccgtgcccggactgccgggccacggagtggaccggcagcgccggaacggagttccggcctcccggcgcttgcgccgggacagcggcgcgtagcgccgccgcgtcgcgt

SEQ ID NO: 247 - DNA, 1972 bp, Unknown
  Kingdom: Bacteria, Phylum: Actinobacteria, Class: Actinobacteria, Order: Streptomycetales, Family: Streptomycetaceae, Genus: Streptomyces
cgccgtacgtcgcgacgtacgcctggcccggagggagcgggaccgtggccgtcggcccgccgccggcccgctgctggagcgtcacgtgcggggccggggtgtcggcgtagacggcgacggtgtcggagccgtggccgaagtcccccggctgctgggtgaagcggtagtcgtcgacgtcgtactcgagcggcttgggcagccggtggtcgaggacggtcgtcgcaccggtggcgtagtcgatccagcggaggcggtcgtcgccctcctgagcggtgaggaagccggtccggccggcgttcaggacgacggtggcgcggggcacgaagcgtgcgcccgcgctgacgacgacgggatcggcggacgagccggggccgtcggcgacggccgtcccggcggcggtgccgactccggctccggcggtcacggcgagcgtgacggtgagagcgatacggccgagcgcgcgctggtggcgcgcgccccgtccgttcagcggacgaatcacgagaagagtccctccccagggcagtcgacgcaggaggggcgcacacgcaaccgccgctcgtccctgcgtgagcagggcgacagtagcaggattgatcaccgcacggcagcacggtttcgaacccgttcaggagggtgcgggggctgtggcgttacggccgcacgggcgctgtggccttacggccgcacggtccctgtggccttacggccgcacggggagcaggggcttgcgggcgcaccgggccgcggcctcacggctgcgcgtgcttcacggctgcgtgtgcttcacggctgcgtgtgcttcggcagggtgaggatgtcggctccgtcgtcggtgatcgcgatcgtgtgctcgctgtgtgccgtccggcagcccgtcgcgctgcggagcgtccatccgtcgtcgtccgtgacgaggcgagcggtgtccgccatgacccacggctccagcgccagcagcagcccggggcgcagtttgtatccgcggccggggcgcccggtgttcggcacgtgcgggtcctggtgcatcgtcgacccgatgccatggcccccgaactcggtgttgaccggatacccggcctcaccgaggaccgtgccgatggcgtgggagatgtcgccgatgcgtgccccgggccgggcggcggcgatccccgcggccagcgcgcgttcggtcgcgtcgatcaacgcgacgctctccgggtgtcgcgcgtcgcccaccacgaagctgatggcggcgtccgcggcgactccgccgagcaggacggcgaggtcgagcgtcagcagatcgccgtcggccagcgtgtagtcgcggggccgcccgtggagcacggcgtcgttcacggccgtgcagatgtagtggccgaacgggccgcgcccgaaggacggcgcgtagtcgacgtaacaggacgtggcgcccgccccgatgatcagttccttggcccaccggtcgatgtccaggaggttcgtgccgaccgtgctgcggcccttcagggtctgcaggatctcggcgacgagggcgccggtgtcccgcgcccgggtcatcagggtggggttgaggatctcgatcatgcggcgcccttctcatgcgaccaataactataccggtaaccaataactataccgtcaatactgtaccggtactagaatcgtggtcatggtcaggttgccgctcactcccgaagaggtcgaacgcggacagcgcctcggtgccctcctgcggcgggccaggggagagcgctcgatgctcgatgtcgcgctcgccgcaggtgtctcaccggagaccctccgcaagatcgagacgggccgcgtggccacccccgccttcccgaccatcgcggcgatcgccgacgtcctcgccctctccctggacgcgctctggtccgagatcagcagccccggacctgccgccgaggcgacgggcgccgctcaccgcgcaccggagcggctggcctcgtaggtcccgccccccggg

SEQ ID NO: 248 - DNA, 1177 bp, Unknown
  Kingdom: Bacteria, Phylum: Actinobacteria, Class: Actinobacteria, Order: Streptomycetales, Family: Streptomycetaceae, Genus: Streptomyces
gtggagaaggaacacaccggggcagaaccggaaccgcacgcggacacggtggtggccgccgaccacgtgacgatcgtccccgcccgccccgaccccgcccaggccgtgccctggggagtgcgcgtggccgccgaggccggctggcgcgtcctcgtcctcgccggcaccgtgtgggtgctgatgaaggtcatcagcgccgtgcaactggtggtgctggccttcgtcgcggcgctgctcatcacggccctgctccagcccacggtggcccggctgcggcgctacggactgccgcgcggaccggccaccgcgctcaccgcgatcctcggcttcgtcatcatgggcctgatcggctggttcgtgacctggcaggtcatggagaacatcgacaacctctccaaccagatccaggccggcatcgacgacctgcgcaagtggctgctgcacagccccttccacgtcaccgacaagcagatcaaccagatcgccaagagcctgagggaggccatcggcgcgaacaccgaccagataacgtcggccggcctggaaggcgtcacggtcatcgtggaggccctgaccgggatcctgctgacgatgttctcgacgctgttcctgctctacgacgggcggcggatctgggagtggacgctgaagctggtaccggcggcggcccgtccgggcgtcgcgggcgccgggccgcgcgcctggcgcacgctgacggcgtacgtgcgcggcacggtgatcgtggcgctgatcgacgcgatcttcatcggcctcgggatctacttcctgaacgtgccgatggcggtgccgctggccgtgttcatcttcctgttcgccttcgtcccgctggtcggcgcggtcgtgtcgggcgcgctggcggtggtcgtcgcgctggtcacccagggcgtgttcaccgccgtgatgaccctcgtcgtcgtgctcgccgtccagcagatcgaggggcacgtcctgcagccgttcatcctcggccgcgcggtgcgggtgcatccgctggcggtggtcctgtcggtcgccgcgggcggcatgatcgcgggcatcggcggggcggtggtggccgtaccgctggtggcggtgaccaacacggtggtcggctatctgcgccagtactcccgggaggcggcactgcggcaggcaccgccgcccgggagtactggcg

SEQ ID NO: 249 - DNA, 3089 bp, Unknown
  Kingdom: Bacteria, Phylum: Actinobacteria, Class: Actinobacteria, Order: Streptomycetales, Family: Streptomycetaceae, Genus: Streptomyces
ccggtggcatccgttcgcgtaccgggacgggctctgcgggccgcccgcggtgcagcactcccgccgcgacggcgagggcagcgaccagagagcccggcaccggggagacggcgccgaaggcggcgccgccctgcacaccgcccgcgccggtttctggcatgcgcgcgtcggggcgggcgatggcgctgtgacgggtgacccgtgaaaggatgggacgcccgcgcaccggagcaggccggacctccgctcctgaccgggcgcgcgggagcgggtcggacggcttgaggcgaaaggaaccggagcacacgtgagcgagaatcagaacctcctcgcggagcagcggcgcgccctgatcctcgacgaggtccggcgacggggcggggtgcgggtcaacgagctgacccgcaagctcggcgtgtcggacatgacggtccgccgtgatctggacgcgctggcccgccagggcatgctggagaaggtgcacggcggtgcggtcccggtcgtcgaggccagtacgcacgagcccggtttcgaggccaagtcgggcctggagctgacggccaaggaggacatcgcgcgggccgccgccgagctggtggcgccgggctcggcgatcgccctctcgggcggtaccacgacgtacgcgctggcccatcatctggtggacgtgccggatctgacggtggtcaccaactcggtgcgggtcgcggacgtcttccacacggcgcagcgcacctccggtcagcgccccggcgcggcgaccgtggtgctcaccggtggcgtgcgcacgccgtccgactcactggtggggccggtggccgaccaggcgatcgcggccctccacttcgacatgctcttcctcggcgtgcacgggatatcggccgaggccggtctgtcgacgccgaacctcgcggaggcggagacgaaccggcggctggtgcagtccgcacggcgtgtcgtggtcgtcgccgaccacaccaagtggggtgtggtgggcctgagttcgttcgccgcgctggagcaggtggacacgctggtgacggacgcggggctgccggcgggggcgcgcgccgagatctcggagcacctgcggctggtggtggcgggcgaggccggtcaggacgcggccgactgaggtcgcgcggcacctgcccggcgggaccggcgccccgtggtcacaggggccggcgtcccgtggtcaggaaggtgtcgatcgccgccgtgtacggcgcgctgtccaggccctgctcggccagccaggtgtccgagtagtacttgtcgaggtagcggtcgcccgggtcgcacagcagcgtgacgacactcccgcggcggccctgctcccgcatctcggcgacgatcttcagcgcgctccacagaccggtgccggtggagccgcccgccttgcggccgatgacccgttccagggcgcgtacggcggcgacggcggcggcgtcgggcaccttcatcatccggtcgatggcgccgggcacgaagctcggttccatgcgcgggcggccgatgccctcgatgcgtgagccgcggtcgcaggtgacgtccggatccttgctggtccagccctcgaagaaacaggagttctccgggtcggcgacgcagacgcgggtgtcgtactgcatgtagtggacgtagcgcgcgagggtcgcggaggtgccgccggtgcccgcggtggcgacgatccacgcgggttcggggaagcgctccaactccagctggcggaagatggattcggcgatgttgttgttgccccgccagtccgtggcccgctcggcgtaggtgaactggtccatgtagtggccgtcggtgtccaccgcgagccgcgcggcggcgtcgtacatcgtgcgcgggtcgtccacgaagtggcagcgcccgccgtggaactcgatcaggcggcacttctccgcgctcgtcgtacgcggcatcaccgcgatgaagggcacgccgatcagcttggcgaagtacgcctcggagacggccgtcgacccgctggaggcctcgatgaccgggcggtccggccggatccagccgttgcacaggccgtacaggaacagggagcgcgccaggcggtgcttgaggctgccggtcgggtgggtcgactcgtccttcaggtacaggtcgacatcccactcgtcgggcagcgggaagcggagcaggtgggtgtcggcggagcggttggcgtcggcctggaccttgcggacggcctctttgagccagtcgcggtagccggtgtcgctgcggtcgacgtcgagggtctcgccggtgtggcgctgctcgatggtgctcacggcggtactcctcatactgggcatacgacgcccgcgacggcgtgtcgcacggcccgactccctcgatgatagacaccttcggcacgcttctcacctgcataaacgccactttgggcggatcaaaggcagccctggggtgcgacgcgccagagcgcgtcggcggcgcactgcgggcatcggccggggcgcgttcgcgcgagtgctccgggtccgggccggccggcgttccgcgtgctctggtgctgggtgccgaagcggggcagactgcaccgcgcgggacgaagagccccgccggggccgcaccgggtcctggacgaaccgtgccggtccacggctcagtggcaccacgggccggcatgtcgcaagggggcggtcagggatggcggagccggagttcacggccacgggcgtacggatcgccagacggctgcgctcactgacccgggccggacgggtgcggatcagcgacggcaggctggaactgctcaccagctacggcagcgagatcgacagcgcgccgatccgtgcggtgcgcgcgtccaggccgtggctggcgccggaggaccgggcgctcgccgacctcaacggccaccgctacgtcctcaccctcggcaaggacgggccgccgccgggcgccccactggcccgaggcccacagagcgcagaggaagccgtcccatgcaccagccgactccgccctgcccccctggcgacgcccccgccgtcgccagggccgtgctcccctccgagacggggacggccgggccggcctgccgccccgtccacgcg

SEQ ID NO: 250 - DNA, 5151 bp, Unknown
  Kingdom: Bacteria, Phylum: Actinobacteria, Class: Actinobacteria, Order: Streptomycetales, Family: Streptomycetaceae, Genus: Streptomyces
gcgctggccagcgcggtcagcagcgcctcgtcctcgtcgtggaacggcgtcccgtcctccttgtcggcgaggtacaggttcccgtacacggttccgcgcaccgtcaggggcacgccgaggagggtgcgcatcaccgggtgcccctcggggaagccgaccgagcggggatcggccggcacgtcgtcgacgcgcagcggtctgcggtccgcgatcaggctgcccagcagcccgtggctctgcgggagcccggactcggccttgagctgctcggcgtccacgcccgcggtgatcaggtcgacgaagtctccggcgtccccgaggactccgagggcgccgtagcgggcggcgacgaggtcggtgcccgtgtccacgatgtgctggagcagggccctggtgtccatgtccgcgctcatggcgatcacggcgtccagcagccggcgcagcctgcgctggccgaaggtcagccggcgcacctgggcgctcagctcctcgaaggacccggtcccggcccggcggccgatctcctccagcgcggcggccatctgcccggccgcctcgtccgcagcctccggcagccatggatcgtcggacatgcccggcacctcctgccaaggaccggagcccgttcgtccccctcagtgctccggcacgatcaccttacgccgcccccgggaacgcggcttttccggtgattcgcgcgattgggtgcttgtgacccggacggtcacgatcaagactgacgacggccggatcccgacgtgcgcggggcgcgtccggccgggtccttgcgcgagagaggcgagagtgtgagcaccgaccgctcgggtgaggccctcgaacgtctgatgcgctcggcccagtacttcttccccgggaaacagtcgcccgaccggcgcgtcctctaccgggacggcggccgggccgccgacgagttctaccgggagcggtggcggcacgaccgggaggtgcgctccacccacggcgtgaactgcacgggctcctgctcgtggcgggtgttcgtcaaggacgggatcatcacctgggagacgcaggccaccgactacccgtccgtgggccccgactcgcccgagtacgagccgcgcggctgtccgcgcggcgcctccttctcctggtacacgtactcgcccacccgcatccgctacccgtacgtgcgcggcccgctcctggacctgtggcgccaggcccgcgcccgcaccgccgacccggtcgcggcatgggagtggctgacctcggaccccgagcggtgcgcgacgtacaagcgggcccgcggcaagggcggcttcgtgcgctgcacctggcaggaggccaccgaactggtctcggcggcgcaggtgcacaccgtcaagcggtacggcccggaccgcatcgtcggcttctcgccgatcccggcgatgtcgatggcctcctacgcggcgggcagccgctacctgtcgatgatcggcgggacgatctcctccttctacgactggtacgccgacctgccgatggcctcgccgcaggtgttcggcgaccagaccgacgtaccggagtcggcggactggtggaacgccggctacctgatcgtgtggggcaccaacctgccgatcacgcgcacaccggacgcgcacttcatgacggaggcgcgctaccgcggccagaaggtcgtcgtggtctcaccggactacagcgaccacaccaagttcgccgacgactggctcgccgcggcccccggcaccgacggcgcgctcgccatggccatgggccacgtcatcctcaccgagttctaccgcgaccggcaggtgccgtacttcaccgagtacgccaagacctacaccgacctgccgttcctggtccggctgcgggagcgcgacggagcgcccggcgcgtacgtgccggacaagttcctcaccgccgcggacctgcccggggcggccgaggaggaggcggcggcgttcaagaccgtgctcctggacgcccgtaccggcgagccggtcgtgccgaacggatcgctgggcttccgctggacctcgcccgaggacggcccccgctggaacctgcggctcgacggcaccgacccgctgctgtccctgcacgggcggcccggcggcgaggcggtgccggtggacctgccgcgcttcgacgccgggccgggagagtccgggggagtgctgcggcgcggtgtgccggcgacccggatcggcggccacctggtcaccaccgtcttcgacctcgtcctcgcccagtacgcggtggcccgcgagggcctgcccggccagtggcccgccggatacgacgacgcgagcgtgccctgcacccccgcctggcaggaggccatcacctccgtgcccgcgaaggcggcggcgcgggtggcccgggagttcgcgcgcaacgccgagcgcaccggcggccggtccatgatcgcgatgggcgcgggcaccaaccactggttccactccgaccagatctaccgggccttcctctccctggtgatgctgaccggcagccagggcgtcaacggcggcggctgggcgcactacgtcggccaggagaaggtccgcccgctcaccggctggttccacctcgccttcggcctcgactggcagcggcccacccggcacatggtcggcaccccgctgttctggctggccaccgaccagtggcgctacgaggccttctgcgcggacgtgctcaccagcccgctcggacagggccggctcgcgggccgtacgctgcccgacttgggcgcgctcgccgcccggctcggctggatgccctcccacccggcgttcgaccgcaacccgctcgacctgtgcgacgaggcggagcgggccggcaaggaggtcgccgaccacatcgtcggcgaactcaaggcggggcggctgcggttcgccgccgaggaccccgacgacccggccaacttcccccgcgtcctgctcatctggcgcgcgaacctgttcgcgtcgtcgatgaagggccacgagtacatgctgcgccacctgctcggcaccgacgacgccgtgacggcccccgagaccccgcccggactgcgccccgaggacgtcacctggcgcgaggaggcaccggtcggcaagctcgacctgtccgtggccgtcgacttccggatgaccagcacctgcctgttctccgacgtggtcctgcccgcggccacctggtacgagaagcacgacctgtcctccaccgacatgcaccccttcgtgcacgccttcaacccggcgatcgcaccgccttggcagacccgcagcgacttcgacatcttccacaccctcgccgccgagttctcccggctggccgccacccacctcggcgtgcgccgggacgtcatcgcggccccgctcgcccacgacacccccgacgaactggcccagccgcacggccgggtgctcgactggagggccggcgagtgcgaaccggtgcccggccgcaccatgcccagactgaccgtggtcgagcgcgactacaccaaggtcgccgagaagatggccgccgtcggaccgctgatcgacaccctgggcacctccaccaagggcctcacctggaaacccgaccaggagatcgcctacctgcgcgagcgcaacggcacggtccgcggcggcgtcgccgacggccggccgtccatcgcccgcgacgaccagttctgcgaggccgtcctggcgctgtcgggcaccaccaacggccgggtggccgtgcagtcgctgcgcgccctggaggaacgcaccggcgtcccgctcgccgacctggccgaggagcgctgcggcgaccgcatcaccttcgaggacacccgcgtccagccccgcgccgtcatcacctccgcggagtggtcgggcaccgagtccggcggccggcgctactcgcccttcaccgtcaacgtcgaacgcctcaaaccctggcacaccctcaccggccgccagcacttcttcctcgaccacgactggatggccgagttcggcgagcaactcccggtcttccggccaccgttgaacatgctcgcccacgtcggcgaccccagccgcggcgtgccggggcacccggaactcgtggtgcgctacctcaccccgcactcgaagtggtccatccactccgagtaccaggagaacctgcacatgctcacgctgttccgcggcggtccggtgatctggatgagcccctcggacgcggagaggatcggcgccgccgacaacgactggatcgaggcgtacaaccgcaacggcgtcgtcgcctgccgcgccgtcgtcacccaccgcatgcccgagggcaccgtgttcatgtaccacaccatggaccgccacctgaacgtaccgcgcaccgagacctcgaacctgcacggcgggggagacaactccctcacccgcctgctgatcaaacccacccatctgatcggcggctacgcccagttcagctacggcttcaactacatcgggcccaccggaaaccagcgggacgagatcaccgtcatccgccgccgctcgcaggaggtcgacttcacgtgaaggtcatggcgcaggtggcgatggtgttgaacctcgacaagtgcatcggctgccacacctgctcggtgacctgcaaacagacctggaccaaccggccgggctccgagtacatctggttcaacaacgtcgagaccaagcccggcgccggctacccgcgccgctacgaggaccaggagaagtggaagggcggctggaccctgaaccgccgcggcaggctcacgctcaggtccggcggccgggtgcgcaagctgctcagcctcttctacaacccggaactgccctccctcgacgacttctacgagccgtggacgtacgactaccagagcctgaccaccgcgcccctgtccggcagtttcaccagtgcccgccccaagtcccagctgaccggccgggacatgcggccggtgcacggcccgaactgggacgacgacctcgcgggcgccgacgagtacgccgcctccgatcccaacctgaagggcctttccgagcgggtccggatggagttcgagcacaccttcatgttctacctgccgcgcatctgcgagcactgcctcaacccgtcctgcgtcgcctcctgcccgtccggcgcgatgtacaagcgggaggaggacggcatcgtcctcgtcgaccaggaccgctgccg

SEQ ID NO: 251 - DNA, 629 bp, Unknown
  Kingdom: Bacteria, Phylum: Actinobacteria, Class: Actinobacteria, Order: Streptomycetales, Family: Streptomycetaceae, Genus: Streptomyces
  misc_feature (257)..(280): n is a, c, g, or t
cgtcgaccaggaccgctgccgcggctggcggatgtgcgtgagcggctgcccgtacaagaaggtgtacttcaaccacaccaccggcaaggccgagaagtgcaccttctgctacccgcgcatcgaggcgggcgagccgaccgtgtgctcggagacctgcgtgggcaggctgcgctacctcggcgtcatgctgtacgacgccgacaaggtaggcgaggccgcctccgtcgccgacgagaaggacctctacgaggcccagnnnnnnnnnnnnnnnnnnnnnnnnctgcacccggagtaccgcaccatgcccatggtctggtacgtgccgccgctctccccggtggtcgacgcgctcacccgcagcggccacgacggcgagcacccggcgcccctgttcggcgccatcgacgcgctgcgcatcccgctggagtacctggccgggctgttcaccgcgggcgacaccgcacccgtggaggccgccctgtgccggctggccgcgatgcgcgcccacatgcgccgcgtcaacctcggcgagccgcgcgatgcggcgatcgcccgcggcgtcggcatggacgagcgcggcctggaggccatgtaccggctgctcgcgctcgccaagtacgaggagcgct

SEQ ID NO: 252 - DNA, 1445 bp, Unknown
  Kingdom: Bacteria, Phylum: Actinobacteria, Class: Actinobacteria, Order: Streptomycetales, Family: Streptomycetaceae, Genus: Streptomyces
gaccaggacttcccggccgcctcggaccgcgtcggaaaggtcgccctcggccatgacgcccagggccgtcagatcgcgggcggccgggaagtcctggtcgaagctgctgtcccgcatgccgagcggatcgagcaccaggtccctcatcagttcggcgaacggggtgccggtggcgtccgtcatggcctgctggagaaccgagtagtggacgttggccttgcggaagacggtgccgggcgtcaggtcccggccgaccggcggggtcgtcgcggggccgctgccgtgcagcaggtcgagcagcgtgggcacctcggtgccgggcaggaagcccttgccgggggtcggcgtcagcccggccagatgcccgagcaactgccgtaccgtcacgggcgcttcgccgtccgggacccgccagccgcgcaggtaggtgttgacgtcctcgtcgagggcgagcaccccgtcctcgaccaggcgcagcgcgcccacggcggtgacgtgcttgctgagcgagccggtctggaacggggtccgcggcgtgaccggcaccccgtccgcggcccacccgtgcgcctccacggcgacgagctcaccgccgtcgagcacggcgaggctggcaccgggcacgtggaaccgcgccatgatctcggtgatcccgtccgcttcccgggcggccgggacggccaccggggcggccaccggggcggccaccggggcgggggcgggccgcggtgcggccgcctcggccacctcggccacctcggccgcctcgtcgacggcggcggccagatcggccagcgtctcgtgctggtacagcatgaacagcgacagcggcagccgcgcctcgcgggcggcggcgaccacctggatgacgaggatggagtggccgccccgggtgaagaagctgtcggttgctccgatccgctccacgccgagcacctgcgcccagatcgccgccagcgcgatctcggtcggcgtcgacggctcgacgaactccgcctccgcctcggcctccgccgggtcgggcagggccttgcggtcgaccttgccgttggcgttcagcggcatcgcgtcgaggaccgtgaacgtggccgggaccatgtagtcgggcagtccgccggcgcagtgccgcgccagctcgccggccgccgcgtcggctccgaggacgacgtaggcggcgagccggacgtcgccgggcgcgtgctcgcggccggtgacgaaggccgcgcggaccgccgggtggccgaggagcacggcctgcacctcgccggtctccacccggtagccgcggatcttgacctggtcgtcggcgcgaccgcggaactcgacggtgccgtcgggcagccagcgggccatgtccccggtgcggtagaggcgggcgcccgccgggccgtacgggtcgggcaggaacctctcggcggtcagggccgcgcggccgaggtagccgc

SEQ ID NO: 253 - DNA, 6770 bp, Unknown
  Kingdom: Bacteria, Phylum: Actinobacteria, Class: Actinobacteria, Order: Streptomycetales, Family: Streptomycetaceae, Genus: Streptomyces
  misc_feature (198)..(349): n is a, c, g, or t
gcgccgcgccggcccaccgcacgcgggtgcctgcacgcatgggcgcctcctcgggtacgggacacggcacggtccggccgacggctcgtcccacatatcagcacataagccgtctatatcccgtacgcctcaccggggaccgcgcgactccagccggatgcacgcccgccggggatgcggaaacgccgatgcccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggacgatgtccttctcctcggcgaagtggcacgccgactcgtgggccgccggggagtccgaggacttgaagcgctcggggatcgccagcagcggaacctcctcggcgcacttgtcctgggccttccagcaacgggtgcggaagcggcagcccgagggcgggttggccggggacggcacgtcgccggtgaggatgatccgctcgcggtgctcgcgggcgtccgggtccggcaccggcaccgccgacagcagcgcctgcgtgtaggggtgcgtcgggtggtcgtagatctgctcgtccgtgccgatctcggccatcttgccgaggtacatcacgcccacgcggtccgagatgtgccggacgatcgacaggtcgtgcgcgatgaagatgtacgacaggttgaactcgtcctgcagccgctccatcaggttgatcacctgcgcctgcaccgacacgtccagcgcggacaccggctcgtcgcagatgatgacctcggggttgagcgcgaggccgcgggcgatgccgatgcgctggcgctgaccgccggagaactggtgcgggtagcggttgatgtactccgggttcagaccgacgacgtccagcagctcctgcaccttgcggcgccggtcgcccttcggggccacctcggggtggatgtcgaagggctcgccgatgatgtcgccgaccgtcatcctcgggttgagcgaggtgtacgggtcctggaacaccatctggatgttgcggcggaccgccttcagcgcgcgcccggacagcttggtgatgtcctggcccttgtagaagatctcgcccgcggtcgcccgctccaggttcatcaggagcttggccaccgtcgacttgccgcagccggactcgcccacgatgcccagggtctcgccctggtacaggtcgaaggagatgccgtcgacggccttgaccgcgccgacctgcttcttgaacaggacgccctgggtcagcgggaagtgcttcaccaggtcgcgcacctggaggatcggctccccgcgctggacgggcgcctcgatggcgtcgaccgcctcttcctcggtggccgccttgacgacgtccacctcggagacgttcggcgtggcgtcctgctgctcgtcgttcttgctgagctcagccatggatcgtctccttccagaagtggcacgccgatgcgcggcccggcagctcgccgccgtcgcgctcggtgacctgcagcagctccgggatgtccgtacggcagatgtcctgggccttggggcagcgcgggttgaaggcgcaaccggtcggcacgcgcagcaggttgggcggcaggcccttgatcgcgtacagctcctggcccttctggtccaggcgcgggatcgagtccagcagaccccgcgtgtacgggtgcgccgggcgcttgtacagctcgtgcaccggcgcctgctcgacgatgcggcccgcgtacatcaccgcgatcttgtccgcgacgtcggcgaccacgccgaggtcgtgggtgatcaggatcagacccatgttgtactcgcgctgcagctccgcgagcaggtccatgacctgggcctggaccgtcacgtcgagggccgtggtcggctcgtcggcgatgatcaggtccggctccagggccagtgccatggcgatcatgatgcgctggcgcataccgcccgagaactggtgcgggtagtcgctgacgcgcgccgcggcggccgggatcttcacccggtccatcagctcgatcgccttggccttggcgtccttcttggacaggccctggtggacgcggaacatctcgccgagctggtagccgacggtcagcaccgggttcagcgacgacagcgcgtcctggaagatcatcgcgatccggcggccgcggatcttgcggcgctcctcggcggacatggtcagcatgtcctgcccgcggaagcggatctcgccctgcgggatcttcgccggcggcatgtccaggatgcccatgatcgcctgcgcggtcacggacttgccggagccggactcgccgagcacggcgagcgtctcaccggcgctcacgctgtagttgacgccgttgacggctcgcacgacaccctcacgggtgtggaactcgacgtgcaggtcgcgcacgtcgagcagcggcccgccgtccgcgccgccgtcgcgcggcgacggcaccggggtgacttcttcgatggtggtcacgtacgcctccctcagcgcgtcttcgggtcgagggcgttgcggacggcctcaccgagcatgatgaacgccagcaccgtgatgctgagcaggatcgacgggtacagcatgatccactgggcaacgcggatcgagttgccgccgtcggagatgtcgttgccccacgaggcgccgttcaggccgaggccgaggaacgacagcgtggcctcggcgccgatgtagacaccgagcgagatggtggcgacgacgatcaccggtgccaccgcgttgggcagcacgtggcggaagaggatccggttggtcccggcgccgagcgccttggcggcctgcacgtagtccgtggacttgaccgtgatgaccgcaccgcgcatgacacgggccgtctgggtccagccgaggaaggccagcgccaggatgacgaccgggatggtgcggtcggtgaaggcgttcagcagcaccagcgcgccgagcaggaacgggatgcccatgaacatgtcggtcacccgggacagcaccgcgtcgatccagccgccgaagtaaccggcgaccatgccgatcaggccaccgagcagcgtcaccgcgagggtggtgccgccaccgaccagcagcgaggcacgcgcgccgtagatggcgcgggcgtacacgctgcggccctgggcgtcgtagcccagccagtcgaccctgaagacgtggctgtagtgcgggtgcgccaggtagtgcccggccaggtccttgttgttcgggtccccgccggtgaacaggctgggccaggcggccatcagcagcagcaccaggatgaggaccgcggagaggatgaacacccagttggtgcgcaggtcctgccaggcgtcgccccacaggctgcggctcttctccggcttgggctgcggcagttcggcgcccgcggctgcggtcgcggcggcgctgggggcttcgtcagcggaagtggtcagctcaggcataacggatcctcgggtccagaaccgcgtacagcaggtcgacgatcaggctgcagaagaggtacacgaggaccaggatggtgaccaggccgacgagcgtggtgccctcccggcgcacgatcgagtcgtagatcgtgccgccgacgccgtggatgttgaagatgccctccgtgacgatcgcaccgcccatcagcgcaccgaggtcggtgccgaggaaggtgacgaccgggatgagtgagttgcgcatcaggtgcacaccgatcacccggcgcttgggcaggcccttggcgatggcggtgcgcatgtagtcggcgcgcaggttctcggcgaccgaggtgcggctgagccgggccacgtaggcgagcgaggcgctggccagcacgatggccggcaggatgaactggttgaggtcggtactgtccgtgaccgatggctccagccagcccaggttgatcgcgaacaccgtctgcaggatgtagccgagcacgaagaccggcaccgagatcagcagcagcgtcacgaagaggatgacggtgtcggcggccttgcccgcgcgcatgccggcgacgacgccgagcacgatgccgacgacggcctcgatggcgaaggcgagtccggcgagccgcagcgtcaccgggaaggcctcaccgaggatgtcggtgaccgggcggccgctggcgatctggtcgccgaagtcggcgtgcagcacgatgccgcgcatgtagtcccagtactggaccaggaccggcttgtcgaggccgtactggtgccgcagtgagttgatcacctgcggcgtcgtggccttgtccccgaagagcccgcgcacggggtcgccgggcagagcgtagaccatcaggaagatcagcagggttgtcccgatgaagaccgggatcatctggagcagtcgtcgtgcgacatagcgccccatggtgcctccatgtcagtgacagcggcaggcccttttcgccccatacgagcggcttccctaggaattccgtacgtacgcggcgaaaagggccccccggccgttcgtcggccgctgccgcgccgcaccccggtggagggtgcggcacggcacacgctgttcgtcagcggttacttcttgacctgaacgccggtcaggatcgggtcaccactctggttgtacttgacgtcggtgaccttctccgagtagcccgcgttgaccttgtagtaccagagcgggatgctcggcatgtagttcggcagctgcttctcgatctgctggtagagcttctccgactcgtccagcgtcttggccgcgtccgccttggcgatgaggtcgtcgatctccttgctcttgaacccaccctggttgccgtcggccttggagccgaacaggtcgcggatgaagttcgagatgaaggggtagtcgagcacccagccggagcggtacagcgacttgacctggtggttgtcacgcgcgttggtgtcggcctggaagtcggccttcgagtcgcccgtgcacgccacgccggtggccttggtgatggagccgcagacggcctccacccactccttgtgaccgccgtccgcgttgtactggatggagatcttgttgcccgggacgccgccaccgtccttgatgagctgcttggccttggccgggtcgtacttggtgatgtcaccgacggcgttcggctggtagcccaggacgcccttggcgacccagccggtggccggctcacgggtgccctgcaggacggtcttggtgatggtgtcgcggtcgatcgccatcgaaaggccctgcaggaccttgacgttgacgttcttccactgcggcgcgtagaaggccacggcgatggtctggatggccgagtacgactcgtccacggcgcggtcgccgaggtcctgcttgtagaccggcaggtcacgcggggcgacctggcgcatcacgtcgaggttgccggacttcaggtcctggtacgccgtctccagcttggcgtagttcttgaagaccacgccgccgttcttcgcggcgttcgggcccttgtagtcgtcgtacttggcgacctcgatcgactgcttgtgcttccagctgacgaacttgtaggggccgttgccgatcgggtgctcgcccgcggcggccgggtccttgtagaaggactccggcagcgggtcgaagacctcgtagccgagcttgtagacgaagtacgggatcggcttcgacagcgtgatggtgaaggtgttgtcgtcgacgaccttcaggccggacatcttgtccgacttcggcttgccgctggccggggcgacgtcgtcgtagccctggatgtcggcgaaccacgcgctgttggtctgcttgttggccgggttggcggcccagttccacgccttgacgtaggacgtggaggtgaccggggtgccgtcgtggaacttccagcccggcttcagcttgaccgtgaaggtcttgttgtccttggtgtcgaccgactgggcgttgaccatgacgatcttgccgctggagtcgtagtcgacgagcccggagaagagcgacttgatgacgatgctgccgttggactccatggtgttcgccggctgcagcgggtgctgcggctcgcccacctcgacggagaactttccgttggggtcgaccgcggccttgctgtcgctgcccttgccaccgccgccaccgcaggccgtcgcacccagcgccacaaccgcggctatcgcaacccacttggcgctcttggcaccacgcatggggctcctcctcatgagtccattggttcaccgcatggaggggcacttgacgcatcaccgttaccggtgcctgaaatgctcaggtgccccctggctcgtgagtcggcgccgccagcagcgcgtgacccgttgatccgagctctacgcgcctaactatctgccatccgaaccgtaccgaaccacaccttccaggtctcggttcgatcacacctgccgcgtacatcttccaaaatccggacaaagggtttggtgaaagatccctgcgaaacggacttgttacacaactatcgggcgtgactgtccgaataacggacaggtgggccggaaaaacccgttgcgcaggacggcggcgcgagcgtgcctggaggccggttcgggttcggtgggcggaacagaccggcacgaggacccgacaagccgtagattccggtcactctaacaatggcgtgaacccgtacaggagatggaggagcggccggggcccggatgtagggaaaaccctgtacggacctgacagcaccgggggggggggcgggaaacgcgccgggtcctgggg

SEQ ID NO: 254 - DNA, 4752 bp, Unknown
  Kingdom: Bacteria, Phylum: Actinobacteria, Class: Actinobacteria, Order: Streptomycetales, Family: Streptomycetaceae, Genus: Streptomyces
tgcgcatacccatcgacgtcgcctacctcgaccgcgacctgcgggtcctcgccgtcgtcacgatgcggccgggccgcctgggcctgccccgcctccgctcccggcacgtcctggagtcggcggcgggggcgatggcggggtgggggctgcgggcgggcgtgcgggtgacggtggaggcggatggggaggtggaaacggaggcggaggcggagtgagtgcgcgctacggggtgcgggcacggtccgggatgcgggcgcggtccggttgtcgggggctgtcgcctctttcctacaggggccagtggtaggcgagggagaaattgaccgcagcggcgtacgccaggtacatgagccagcagccggtcacgatgtggaagaagcccagggcgctttcacccagctttatcccgatcgaggcgaagaagtcgcagaagtagatcgcgaacagcccgatgaaaagcacgccgaccggccagtcgcctgccgtgaagaacacggtcccgcccatcgcggagatgaccatgtaggcgacacacatgccggcgttgggccgcggatcgttcccgcggtaacggttccagccgatcgcgaaccagtggattccgtacgccgcgaaagccagtgccgccatgtacagcggcggcgacttggtgaatacctggaaccagctcagcccgatgaagaggatcaggccggtgatcagctgacacaggcccggcatccagataccccagacgcccatcgcccggtccgccgattcggccttcttcggatagtggaacaattcgtgggggccgtagatcagatatccggtaccgagaccaaagaaccccagcgccagtggcgggaaagccgagggcgcgaatgacacgtccatgctcgccctccttcgaagacgaaccgacaaggaatgtgttcgcggcgcggcgcgggcgggtcacgcgcgcgtacacgtgcacgcccctcgccgcccgtgttgggacgatatatgtcctgaggtgacctttgtccgctgtagatcatattacccctttgcggggtgtgtcggccggatgggcccggtcgctgccggccggacgggccccggtagctgcgggatcggtcagctctggcggtcagctctgagtgcgcgggaaggtgatctccactcggcggttcttcttgcggccgtcctccgtggcgttgtccgcgatggggtagtcctccgcgtagccgcgcacgtcgaaggtgatgttcggatcgttcagctcctgggagaggacgtcctggacggcattggcgcgctgcttggacaggacgacgccgtgttcatgggtgccgaggttgtcggtgaaaccgaagacccggacctgggacgcgtcctgcttcttgatctcctgggcgatcgcgtcgatacgggacctcgcctggtcactgagtttcgcgctgtccttggcgaacagcacctcggcctgcagcgcgaacgtcacgtccgtgttggtgtcctcacggcgttcctcaccgccctggtcctcgaccaccgacttgatgtccagcaccttgggcgcggcgagggtcgccccctcgggcagcttgaggtccgggtcgttcgggtcgaccttcacggggggcgcggcggaggactcggtgcccggggggacgctcggagcggtgccgtcggcgcgggccgcggcggctccgcagaggttcaccgcgagcaggagggcgagggcggtcccggtgagggtggagcggggcggggtgcgggtcatggtggccacctcacccggagatcttgatggtgccgctggagaaggtggggagttggagggttacttcggtggtgctgggtgggggggctgggaattgcatgaagacggggattgtttggcctgactcgatggtggtgagccccgttgtcgtcagtggcctgccatccgtgtcgcgcaacacgtaatagcgcttcttgccctgggaatcgacaagggttgcacctcccaaggacgtgccgtgcttgaggatctcggtctcatcaccacgcaactctgatgggatgaccagtgactgggacccgtcgttcttgaactgcccgttcacagtgataaagccacccgagtcccgttgcgccgtggtgatctgaagaagcaggccgttctctcccttgagttccgccagcggcgtttcggactgcccctcctgcgcgctcggcttcgacccgctggcctttgacgacgtcgccgaggcgtccgggctcttaccgtcgcccccacctccgcctccacaactggtcatacccatggccagacctgcagccaacgccagcgcgaccagccccctgcgggcttgcgcagtgaaccgaatactcatcgctctgaatccttcttcgctcgtcgttgcttgtcagtcggccagatggacatcgaacaggtcctgtggctgggggaggtcggtgaggtgcttcggatccaggtcccagtacttgtcgcccttgcaggtcagccggggcagggtgccactcggggaatccgcaggcagcggctggaagccacagagagactcgatcacggcagtcgcatgcgctgtcgaccgcgtgctctcggtgacgggcacaaccgacttgcccatggtcttgttggttctgactgtgacggtatagcccaacaggccactcggggcgcacccgagcacataagcgtcattccgtgcggcgagttcgtccgcccgcccgcacgaaaggtgaagtccctgtccgttcccgtcgaagatgctctgccacttcgtagggtcgagtacgctcctcgtccactcttccgcaagctgcttccgggtgtcctgggctgccgcgagtgccgcggcatctgcggcggtctgagcgctgctccggttcaccgttgcttggccgaccgcaaaatacgcgaacgcgagaaagagcaggcccgccaccactgtgatgtatatggggaaggcctgccccgcatcgccggaacgtccggctggcgtcaattccctaccttgttgatcagcgacgtgatcttgttcaggatcgtcgaaccgatgctcgtgcccgtgatcgccagcacgatcgccaccacgaccgcgatgatgcccagatactccaccgccgtctgccccttgtcccccgcgcggcggcgcatcgcttctgttgtcgtgttcttccagccgttcacgcggaccttggtcgccaccacggtcttcagcatcaggttgctcatggtgttcccctccgggttcgggcgcggtgccggttgcggccggggcaccgtacggccggggcggcggggtgggcgagggtccgtgggcccatttccgggcccaggtccgtacgggcatcccacgtcacctcgcttccggtgacgcggagtcgggggccgtgcccagccacttcgcggcggcctcggcgcggctggtgctgtgcagcttggcgaagatgcggttgatgtggttcttgacggtcttctcgctgatgaagcaggcggcggcgatctgctggttcgtcatgccggatgcgatgaggtccatgatctccgcctccctcgcgctgagttggaacctcgacctgtcgaccggggacgactgtctcacagatggttgcatttgcgaaagacgtttggcagaagtacctgggctatggtcagttggagggggccatgcgtgtgcattcgcattttccaggtcatccgggagggcgccctccgcgggtgccgggctctggcgcagctgggtcagcagtgctcctgccgccgtggtggtgaagtgggcgtggccgcgtccgatgtcccgtacggcgtccaccaactggtcggccgtgaactcgccgtggaccaggtagccgcccgcccccctgcgcagcgcctcctggacgatcccggcctcgcggctgtaggtgagcatcaggaccggggcgagcggggccaggtacgggagggcggagatgccgtcgacgccgggcatgcggacgtcgaggaggacgacgtccgggcggtggcggtgggtggcttcccaggcctcgcggccgtccgccgcctgggcgacgaccgtgatgtccgcgcggccggagagcagagctgtcaggccggcgcggaccaccggattgtcgtccgcgacgacgacgcgaaggggcgcggagggcgggttcggcggtgtctcgtacggcatcgggcctcctctcggattcggggcttcaggccagggcgcgggcgggcgggggctggagggcgtccagcgggaggtccacggacactgccgtgcccttcgcgtcgcggccggggccgatgcgcaggcgggcgcctatcgccgttgccctctccgtcatgccgaccaggccgaagtggccggtgcggcggagttcgtcgagggtggtgcctgggggcaggccccggccgtcgtcgtggacgttgaagcggagcagaccgccgtcgaggcacacccgcacctccacccggcgggccgctccgtggcggtgggcgttctccatcgcctcggccgcgatggcacggagctgccgggccacgccgggcgggacgcccgggacgcccccctccgctgcggtgccctctgccgggaggcaggctgccggcaggccggtccgggcggtgaacgcccgcacatccgccgccagttcggccatcaggtcgctcgcgcggggcgagtcgtgtgcgcaccgcaggtccgtgagcagttcgcgtgactcggccgctgcgcggcgggccgagcgggccacgaggtccgcctgctgccggatcagggccgggtc

SEQ ID NO: 255 - DNA, 12335 bp, Unknown
  Kingdom: Bacteria, Phylum: Actinobacteria, Class: Actinobacteria, Order: Streptomycetales, Family: Streptomycetaceae, Genus: Streptomyces
cgtcgtcgagaacggccgggttcactgaacccggccgttctcgaccacggcgatcacgtccgcgtcgtgtgccgtgtggagccggtgggcgatcgccacgaccgtgcgcccgtcgaggacacgggccagggaccgctccagatggcgggccgcgcgcgggtccagcagcgaggtggcctcgtccaggaccagggtgtgcgggtcggccaggaccagccgggccagcgcgatctgctgggcctgggccggagtgagcgtgagggcgcccgagccgacctcggtgtccaggcccccgtcgagggcgcgggcccagccgtcggcgtcgaccgcgcccagcgccgcccacagctcggcgtccatcgcgtcggtgcgggcgagcaggaggttgtcgcgcagcgagcccacgaacacgtggtgctcctggttgacgagggccacgtgggagcggacatcttccgcgggcatccgggacagttcggcaccaccgagggtgacccggccgtcccggggcgcgtagataccggcgagcagccgtcctagggtggacttgccggcgcccgaggggccgaccagggccaggcgggtgccgggtgcgaccttcagggagacctggcgcagtacgtcgacgccctcgcggtagccgaagtgcacccggtccgcgtgcacctcccggccgtcgggcgcgagcgaggtgtccccggcctccggctcgatgtcacggacgccgaccagccgcgcgatcgacacctgcgccacctggagttcgtcgtaccagcgcaggatcagtcccaccgggtcgatgagcatctgcgcgatgagggcgcccgtcgtgagctggccgaccccgatccagccctgcagcacgaacacgccaccgaccatgagcacggaggcgagcactgtcacgtgggtgacgttgatgaccgggaacagaaccgacctgagccacagcgtgtagcgctcccacgccgtccactccttgatgcggcgctccgacagggcgatccggcgctcgccgagccggtgcgcctccacggtccggcccgcgtcgaccgtctcggtgagcgtggcggcgaccgcggcgtatcccgcggcctcggaacggtaggcggacggcgctcgccggaagtaccagcggcagccgaccaccaggaggggcagggccagcagtacggccgcgccgagcggcggcgcggtgacgaccaggccgcccagcagcagaaccacccacaccacaccgatcgccagctggggcacggcctcgcgcatcgcgttggcgagccggtcgatgtccgtggtgatgcgcgagagcaggtcgccggtgccggcccgctccagcacccccggcggcagaccgaccgcccgcacgaggaagtcctcacgcaggtcggccagcatccgctcgccgagcatcgcgccgcgcagccgcacctcgcgcacgaacgccgcctggacgaccagggcgaggaggaacagcgtggcggtgaggccgagacggagttcccgggtcccgtccgagacccgctcgaccaggtcgccgagcagccacgggcccgccatggaggcgaggaccgagacggtgttgacggtgacgagcagcacgaattcccggcggtgccgacgcagcagttcggtcacataggcgcgtacggtcgccggggcaccgacgggcagggtgtcggccgtcgtcggggccgccgggtcgtacgccggcggggccacgccgatcatgcggtctcctcgatttcttccagctcgtcttccagctcttcttcttccagctcgtcgagcgcgcctcggagggaggactcgcggccagggtccagtgcgtcaccgaccgcgcgcgtctcgtcgcagaggtcccccacgtcgcccaccgcgcgcgtctcgccgccctcggtgcgttcgtcgtccgtctcgcgcgtcaccacggaccggtaccgggcgtcggtgcgcaccaggtcacgatgggcaccggccgcggcgaccgtgccctcgtggagcagcaccacccggtcggcgcgctccaggaccagcggggacgaggtgaagaccacggtggtgcgcccgtcgcgcaggtcccgcaggccctgtgcgatccgcgcctccgtgtgggagtcgacggcggaggtcggttcgtccaggaccagtacctcggggtcggtgatgagggaccgggccagggccagccgctggcgctggcctccggagagggaccggccgcgctccgtgatccggacgtccatggggtcgtcggcggccggcgatgcctgcgccagtgcctccaggacatcagcgcactgcgccgcctggagtgccgcctccgcagtgacgtcccccgaggcgggtacgtcgagcagctcccgcagtgaaccggacagcagcaccggatccttgtcctgcaccaggacggccgtgcgcgccaggtcgagcggcagtgcgtcgaggggtacaccgcccaggagaaccgacgggcccggcacgtcggggtggccgccgaggcgttccgccagtcggcccgccgcgtccgggtcgccgcacaccacggcggtcagccgtccgctggggaccagaagtccggtcgccgggtcgtacaggtctccggcgggggtctgcgcggggaaggacgcgtgctccgggacaccacccgtggcgagcgaaccactcggttcagggggagttccttccgtggtgagggtccgctccagtgacaggacccgtgccgcacgtgtggccgacggccgggagaaggagtacgccatggcgatctcctcgaagtgccgcagcgggtaggtgaggaccatgacggagctgtagacggtgaccagttcacccacggtgatccggcccgcgcgggccaggtggacgccgtaccagacgaccgcgatcagcagcagtcccggcagcagcacctggatggcggagatcagggaccacatgcgagcgctgcgtacggctgcctggcggacctcctgggaggcgtggcggtagcggtcgaggaagagttcctcgccgccgatgccgcgcagcacccgcagaccggccacggtgtccgaggccagctcggtggcccggcccgccttctcgcgctgcaggtcggcgcgccgggtggcgcgcgggagcagcgggagcacggcgagcgccagggcaggcatgcccacggcgacgaccacaccgagcgccggctggtagacgagcagggcgacgcacaccagcaggatggtgaccgctgccgcggtgaagcgggacacggcttctacgaaccagccgatcttctcgacgtcaccggtggagacggccaccacctcgccggcggcgacccgccgtgtcagcgcggagcccaactgggcggtcctgcgcgccaggagctgctggacgcgggccgccgcggtgatccagttggtgaccgcggcgcggtgcaggaaggtgtcgccgagcgcgttgcccgcacaggcgagtgcgaggaggccgccgctgagggcgaggcggctgcccgaacggtcgacgaccgcctggacggcgaggccgacacagaacgggagcgcggagacggaggagaagtgcagcagcccccaggccagcgctctcagctgcccgccgagctggttccgccccagccaccacaggaatcggggacccgagcgtgcgtccggcacgcccgggtcgggatacggaaggtcttgaatctgcatgacgtcccagtggttcgggtcagggagcggaggggccgcggtggcggcgacgaaccgtgacaggttcgcttcgccgcgttgtcgaaagcaagcggttttccgctgcggggcaacggggttgacgaccccgaaggccggatgcgcgccgaccggacgggcgtccaccggggcgtcggaagcgtgcaccacggtcccgggcgtgtgcacggggcactggagtctcgcgcgtgtatcgcggcggcccccgggagtgcgtctgcggccgtccgggtgtcccgccgggtgtccggacgcctcctggccgtccgggtccagagggccgtgttcccgtacctcctcgacccccgctccgggcccgtccggcacgcccggcaccctccaaagagaagcgaataaggctgtttggaccaatctcgagtagatcatcaggatatcggtggccaccatgggttcatgcgaagaggcggcgtaaggcatgcgatggtcgcgatgacggcctgtggattctttctgacggctctggccgcgtgtggcggcccgcggaccgaggtccgccacggagacgtcccccggccgggaggcccctcggggaccgcccggcccagtgcgccggcgaagccggcccgtgtcccgggggtgggcgagcggatgtggcagcgggttccggcgggcacccggcaggtggtggcggtgtacggagagggcaagaactcaccggactccaccctcgtgttgtacgagaaacacggcacggcgtggcagcgggtcgacagttgggccgcgcacaacggcaagcaggggtggaacccgaatcaccgtgagggcgacgagcgcagccccgtgggggtgttcacgctctccgacgccggcggtctcctcgacgaccccggcaccaggctgccgtacacccaggacgaggacgccttcgagaccccgtactactgggacgaggcccactggcacgacttcgactacgtcatcgccatcgactacaaccggcggcccggcacccgcccggacgatccgacccggccgcaggggcagggcaagggcgggggcatctggctccatctggaccacggcgacggcacgttgggctgcgtgagcgttccggagtccgccatggagtttctgctgcgcaggctggacccgaaggacaagccggtggtcgtgatgggggacagggcggaactgcgggcgtagccgccgcagaccgatcgacgggccgttcgccggtccacccgcgagaacggttcagcgggccgttcgccggtccacccgcgagagcagttcggcgggctgttcactggtccccacgcaagagaagttcggcgatccggttcaccggtccacgtgcgagaacagttcgcggaccattcatccagcttcaccggcgagaacagttcggcggtctccgtgcagaccgtcaggcgcggcccccgtgctccggccaactggcctcacggacacagccgttgctcacccgccacggccacgccacccgtaggcgcctcggcgtgcgccctcaatgcgcttccgctcccccgttcagcagcggtgcccccgtgcgggcaccgtgcccacgagggtgtccaggagttcaccgagggccgcacgctgccggccggtgaggggttcgaggatctcctcggccgcggaccggcgcgccccgtgcaactcgcgcagcgcgccgcgcccgtcgtcggtcaactccacgcgcgtcacccggcggttggccgggtcgggcaccctgcgcactttcccgctcgcctccaggccgtccaccagtgtggtcacagcgcggggtacgacctccagcgactcggcgagatccgccatgcgcggcggctccccgaagtgcgcgagggtgcgcagcagccgggactgcgccggggtgatgccgagggcgcgctcttccagatggtgcttctggatgcggtgcacccggcgggtgagccgcagcaactgctcggcgaggaggccgtcggcgtcgggggtcgtcatacgggaacaataacaggatgaggttcattatgagcgtaggtaacaatgagctagcatccggaaagccgtcgccgaccgcacgtgcggcggccggtgtccgcagagcccactcactcccgtaggagcccatgcaccccgaccgtcacccctcctggaccccgcccgccgacgcgaaggaacagccccggcaggtccgccgcatcctcgggctgttccgcccctaccgcggccgtctcgcggtcgtcggcctgctcgtcggcgccgcgtcgctggtctccgtcgccacgcccttcctcctcaaggagaccctggacgtcgcgatcccgcagggccgcaccggcctgctcagcgtgctcgccgcgggcatgatcctcagcgcggtcctcaccagcgtcttcggcgtgctgcagaccctgatctccacgaccgtcggccagcgggtgatgcacgacctgcgcaccgccgtctacgggcgcctgcagcgcatgtccctcgcgttcttcacccgcacccgcaccggtgaggtgcagtcccgcatcgccaacgacatcggcgggatgcaggccaccgtcacgtccaccgccacctctctggtctccaacctcaccagcgtggtcgccacgatcgtggcgatggccgcgctcgactggcggctgaccgtcgtctccctgctgctgctcccggtgttcgtgtggatcagccgccgcgtgggcaacgagcgcaagaggatcaccacacagcggcagaagcagatggccgcgatggccgcgacggtcaccgagtcgctgtccgtcagcggcatcctgctcggccggacgatgggccggtcggactcgctgaccgcgtccttcgcacaggagtcggagagcctggtcgacctcgaagtgcggtcgaacatggccgggcgctggcgcatggccgtcatcaccatcgtcatggcggccatgccggccgtcatctactggaccgcgggcgtcgcgctccagctcggcggcccgaaggtctccatcggcacgatcgtcgccttcgtctcgctccagcagggcctgttccggccgaccgtgagcctgctgtcgaccggcgtgcagatccagacctcgctcgccctcttccagcgcatcttcgagtacctcgacctgccgatcgacatcaccgagcgcgaacggccggtccgcctcgaccgcgtcaagggcgaggtccgcttcgaggacgtcaccttccgctacgacaacaaggagggcgagggcgacaagagcgaccagggccggcaagggcaccggagggaccagggccgtgaagtcacccccatcctcgaccgtatcgacatcacggttcccgcgggcagcagtctcgcggtcgtcggtccgaccggagccggcaagtccacactcggctatctggttccccggctgtacgacgtgagcggtggccgcgtcaccctggacggcgtcgacgtgcgtgacctggacttcgacacgctcgcccgtgcggtgggcgtggtctcgcaggagacgtacctcttccacgcctcggtcgccgagaacctgcggttcgccaagccggacgccacggacgaggaactgcacgcggcggcgaaggcggcccagatccacgaccacatcgcggccctgcccgacggctacgacaccgtcgtcggcgagcgcggccaccggttctccggtggcgagaagcagcgcctggccatcgcccggacgattctgcgcgacccgccggtcctcatcctcgacgaggccaccagtgccctggacacccggaccgaggcggccgtccaggatgccatcgacgcgctgtccgccaaccgcaccacgctcaccatcgcgcaccgcctgtccaccgtccgtgccgcggaccagatcgtggtcctcgactccggccgcgtggccgaacgcggcacgcacgacgaactgctggaactgaacggacgctacgcggcgctggtccgccgcgacgcccggctggagccgacgagctgaccggagcggatcggttcgaagctgatgagctgatgagctgatgagctgatcggtgccgacgagctgaccggagtcgacaagatgacgatatgccgggtttgtgaactccggagcgttaccgtgcccgcatgcagacgaacactccgtcacggaagaccgtcacactgacgcgccggggccggctggccctcctcgtgtccggggccgtcctggccggcaccgccgtggtggtgccgctgctgaccctgcgcgacgacggagcggtgcgcccgcgcacgctggtgatcccggaaggctggcgggccgcccaggtgtacgccgccgtcgacaaggcgctcgtgctgccccccgggagcacgaagcaggcggccgccaaggcaggcctgaagctgccgaacgcggccgagggcaatccggaaggctatctgttcccggcgacgtaccccgtcgacgaccggacgacgccgcagtcgctgctctcggccatggtcgacacggccgaccggaagttctccgcggcgccggtcgccgcgggcgcgccccgcaccgcgatgaacctctaccaggcggtcaccatcgcgagcatcgtccaggccgagtccgccaccaaggccgacatggggaaggtggcgcgggtggtcttcaaccggctctcgcagggcatgccgctccagatggactccaccctgaactacggcctcggccgcagcaccgtccgcaccaccgccgaggacacgcggatcaacagcccgtacaactcctaccagcggatggggctgccgcccacccccatcgacagccccggtgaggacgcgctgcgcgccgtgtacaacccgaccccgggcgactggctgtacttcgtcacggtcaagcccggcgacacacgcttcaccgccgactacgccgagcaccagcgcaacgtcgaggagttcaacgcgcgccggcggagcctcgcccagcagcaaagcgaacggcagagccacagcccgcgaccgaccgggaggtgaacctcttccgcgcccgccgcccgtcgtccgctgctagtggtccatcgcccgccactggccacggggaatccatcgtccgtcactggccacggggagtccatcgcccgccactcgtcacgaggcgcatcgcccgtcactggccacgaggagtccaacgcccgtcaccgcgagccggtcaacctcaggcggcgagagccggcccctcggccagcagccgccggatgtcgcggacggccgcacgcccggcccggttggcgcccacggtgctcgccgaggggccgtaaccgaccaggtggacacggggatcggcgacggcacgggtgccctcgacgcggatgccgccgcccggctcacgcaggcgcagcggggcgaggtggtcgagggcggctctgaagcccgtcgcccacaggatgacgtcggtcgccacgcgccgcccgtcgcgccactccactccgtcgggggtgatccggtcgaacatggggcggcggtccaggacgccgtcgcgcagcccctgtcgcacggcgtcgttgagcgggaggcccgtgaccgagacgacactgcggggcggcaggccttggcggacccgttcctcgacgagcgcgacggcggcacggcccgcgttctcgtcgaacggcccctcgcggaagaccggcggccgtctggtcacccaggtggtggcggccgcgtagggcgcgagttccagcaggtgctgggtgccggacgcgccgccgccgaccacgatcacccgctgcccggcgaactcctgcggacccgcgtactgcgcggtgtgcaactgacgtccccggaaggtctcctggcccgggtaacgcggccagaacggccggtcccaggtgccggtcgcgttgatcagcgcgcgcgccgcccacacgccgtccgaggcctccacgagcaggcgcccatcggcaccgtcgcgtacggcgcgtacgtccacggggcgccgtacgcgcaggtcgaactcgcgctcgtagcgggcgaagtactcgccgatgatgtccgacgacggccgggcggggtccgcgtccctcagttccatcccgggcagcgcgtgcatcccgtgcaccttgccgtacgtcagcgagggccagcggaactgccaggcgccgcccgggccgggggagtggtcgagcacgacgaagccacgacccggctcgaatccggtgcgccgcaggtgatgggcggcggccaggcctgcctgaccggcgccgacgacgaccacgtcgacctcgcgtgtgctgttcacacaggcaccaaccgagtgggcggcgcggatcttccccgggatcgaggaggatgggcgcatgtcacatgccttcaccacccgagtgctgaacgtcgcttccggctcgcgggagcgggtcgtcgacctcacccacgactgccaggccttcctgcgggaggccgccgacggccgtgacggactgctgaacctgttcgtcccgcacgccaccgccggcatcgcgatcatcgagacggccgcgggcagcgacgacgacctcctcgccgccctgcacaccctgctgcctgccgacgaccgctggcagcaccgccacggcagccccggtcacggccgcgaccacgtcctgcccgccctcgtcccgccgcacgccacggtcccggtcatcggcggccggctggaactgggcacctggcagtcggtgtgcctggtggacaccaacgtggacaacccggaccgccaggtcaggctgagcttcctcgcctgaccgggccagagcctgacggatggccgccggtcctgccggagccggtcgtccgcgatcagggccgatcaggtccgacgccatgacggagatgtcctcgggcacgctgagcccccgttcgcgcagggcccgcaacgggccgagcgccatctggtcgttgtccgcgaacaccgccgtgcagtcctcctgcccggcgagccggagtcccgcgcggtagcccgagtccgccgaccggtcgccgcgcaccagcggaggcggcacccgcccgcctcggtgagcgccgcccgccaggcgtccgccctgcgctgcgcggcgagcgactccccgggaccggcgagatgccacaccgtgcggtgtccgagaccgagcaggtgccgcacggcgtcacggggcccgcccgtctggtcggtgtcgaccacggtgtacctgtcgccggcgtccgagtccgccacgaccacggtgacgtggggcggcagggacggcagggccgcgtcgagcagacgcacctccgtgatcgcgacggcggcgtcgatggcgagtccgccgctcgccgcgcgccgaggtgctgtctgctgctgccgccgtctcccgcatccgtgcaccggcaccggatatttacgtgaacgtatcagccggcccgaccgtgccgctcccgcgcgatcccgcggccgggcatcgcgggcccgtccctgtccgtgggaatccggtcaggctttacccagtgctggtacgtttccgcgcctgccggtacgtttccgctaggcggattcaacgctcgaagacttctggaagtcggcccctcggcctctttgcctgtggcacgctagcacgaagcggaacctgaggtaccgcgtaccttgcgaccttcacgcggatgagtggacgtccacatcccccgtttgctgatgttccgggcaggacattttcccgggtgacgggcggagggatttcgtggactgttctgaagagttcaatcgttcaaaagagttcccgcgggaattctcctgggatgtcatcgccggccaccgcgaacgcctgatgcggctggtgcgccgccggcttccgaacgcccaggacgcggaggactgcgtacaggaggcaatgctccgggccgccgcgcacggcaacctggaccgggagcggatcgggccctttctgacgtcagtagccctgcgcctgtgtgtcgatcactaccgtgaacaggaacgacgccgtcggctgctgcggcgcgcggccgatgcgcgcgttcccgagatgccggacgaaggcgtctgcgaccaggacttcggccgctggctgctcggtcaggtcgacctgttgcggggccgggagcgccaagtcgtgctggcgcgggcccaggggatctccacgctggaattcgcgcggatgcaccagatctcggtgaaggcggcagagggtgctttcactcgcgggcgggcccggctgcgcctggtgtgcgcccgcgcgctggacggtgcgatggcctgaaccgtaaacgatcgcgtgcgatcgacagcgcattccttgaatttcacgagtccagtgatcgatacggcaagtggaattcgtggaaattgtctctctggctgaggggcggcgtttccgggcttcgaaaatcaggcacatgaaaaatcgtgaacatgaaagggaagtggccgtggggaagaacaatacgcaggacaccatcaaggacctgatcggtgacatcgccgacagcacgaagaaggcattcgacgagttgctcgaccggaaggacgacgaccgcggtgccctcgactggctggggccggtcaacccgtaccaggcgctcagcggcctgcccggcgacgtgctccggacggtcagcgcgctgtccgccctcggcggggtcgccaaccccgtcgccgcgctggccaatgc

SEQ ID NO: 256 - DNA, 5520 bp, Unknown
  Kingdom: Bacteria, Phylum: Actinobacteria, Class: Actinobacteria, Order: Streptomycetales, Family: Streptomycetaceae, Genus: Streptomyces
ggcggtgcgcgcccaggcggtcgtacgaagcctgcgcgacctgctggcagccctgccgccggcctcctccagccgccgtgccgtgcgctcgttgcgggcgtagccgaggaagtgcacgcccgcctgccgggcggccgccaggtcggtgggggtgtcgccgatcatcagggcggtcgagggggccgcccccatggcgttgagcgcgcggtgcaggcagtgcgggtcgggcttgaggtgccgcagttcgccggtccggccgtacaggtgcggcaggaagcacggcagtaggccgcggccctggaggtaggcgcgcaccacggccggtgagttgttgctggtgacggccagccgtgcgccgaccgcggtccaggtgcggatcagcggatcagcgtacggcgtgggcatggccgtgcccgcggccttcagctcctcctgggtgaggcgctcctccagttccgtcaccaggtcgctgcgcgggcgtcggcggtccaccgtgcgcaacagggcctgcgggtcgggcgactgccgttcggtgtcgttcagcagcccgtgcaggccctgctcctccagccaccgcagcaggccgcccgccacccgctccgccgggtgcccggcgaagagccggcagatcgggccgtcgaagtcccacaggaccacctgtgcacgggagaccagttcccgcagcgctccggggctcggcgcggtctgccgcgcggagccctcggcctccggttcggccgacttcgcgccggaggcatccgtgaccgggtcgatcgcctgccgcgcgttgcgagagccaagcacgggcaactcctttgccttggtcggcaaccgggcagatgccgtccggccggtgacgagagcgggagggcccctaggagagtgtcaggtccctggtgatggtttcccagagggcgtcgaaccacttctgggattccgtcacgaaagcggcgtcgcgccggcccccccgctgaacgaaggagaacagcagggacttggcgcccaggacgtcatacatgtccagggtctcgtcgccccagtcctcctcgcgccgggtgagcgtgtagtagcccatgagggcttcctcgccgcccagcaggtagagcttgacgggcggggtgaagggcagcgcgcggaaggcgacgtgcacgtcgatgccgtgggtggcgcgcagcgacagcaggttgtgccgcagcacctgcccctgcgcgttgcgcatggcgagccagcgctggtggaccacgtcgtcctcgccgcggccctccacgggcacagggaaggccagcgcgatgtccctggacggcaccaggacgcggacgtcgatggactcggggcgtaggcggccctcgtggatcagccggagcggctcgcccatggccagcatcagggtctccgccgtgtggcagacgacgtcgatgcgcacccggcgggcggcgaacgcctccgtcagacggggcgcgagcgcgaccatggtcggttgcggcgcctcccgtacgggggcggcgtcggcgaccctgggcgggctgcccttgctgacgttgctgagcaggccgtcatcctgcagggaccgcagggcctggcgcactgtgccgcgctccacgccgaactcctcggcgagttcggcctgggtcggcaggcggtcgccgggtttcagctcgcccgcgcggatgcgctcacgcagggtgtcggcgatctcctgcggcgagttcctccggctgccgtccacggccaggttctcttgggtcacgaccaaacgctacaacttcaatccagctggcgggagttgttctagagctgtttcgaacacttaccaagcggggacaacaaagaacaagttggctgccaacttcggtgagttggcgatcgaagggggaatcgccgtgcctgtcctcgcactcctgtcagccctctccgtcgtcgcattcgagcagatcgtccagtggaagtacggcgcggcgggcatcgtcggcctgctgctgctcaccgtcggcgtcaaggccagggtgccggccctcagctccgccggtgcggtggtcctcgcggtcctggtcgccggccccgccctgtgaaccgccggcgtccccgacgccggccacccggctgcctgcggtcctgccgaggagacggtcagctcgtgagcaccagctccgagctgatcgtctcccacagcgcgtcgaaccagacgtgcgactgctcgacgaacgtcgtgtcgcgcggcccggcgccctccccgaaggagaacagcatcgaacgggtgccctgcgcgtcgtagagctcgagcggctcgtggtcgatctcctcctcacggcgccgcaccgtgtagtacgcgaacagcgcctccgagccgttgaggaggtagagcttgacgggcggggtgaagggcagcgcacggaaggtgacgtgcacgtccatgccgtgggtggcgcgcagcgacagcaggttgtgccgcagcacctgcccctgcgcgttgcgcaccgccagccagcgggtgcgcagccggtggtcatgcgcggaggggttcaccgccgccgggaaggccagttcgatgtcccggctcggcagcagcacccgcacgtcgatcttggccggtttcagtcgcccggcgtggatctggcgcagcggctcgcccatggccagcgtcagcgagacagcggtcaggcacagcgcgtcgatctccacgtgggaggcggcgaaggcggcggcgatacggggcgcgagcgccaccgtggtgggcagcggcggggctgcggggccgcgcagcgcgcgttccgggcgggccgcgacggtcggcgggctccctttggtcacgttggtgagcaggtgctccgactgcaggatgcgcagggcctgccgcacggccccgcgctcgacgccgaactcggcggccagcgcggcctgcgtgggcatgcgctcgcccggacgcagcgcgccggtcctgatccgctgccgcagttcgtcggccacctcgcggtgtgacctctgtggccgttgtgtcctattccgcccaatggcggaggcgtgttccgggtccacgatcgaacggtacaacttctcgccatctttgggcagttcccgggaaggtggttatgagacgcgcccaagaggagataacaagagagaagttggtggccaacttgtccgacctggtcgaacctctggccggttggtatcacggtgacacagggggtacgtcggaccgtgcttccctccggaggggagccgggagcacggtcagcgacgccgcacagccacaacagaacagcgtctcgcagcaccgccacaaccgaagaccgtccccaccgcacagtcacaacagaagatggcagaacgaggcagcacagagcaggacagccacgacagaacagctcgctacggatgcgtccgcggacgcgtcgcccctgtcacggtcaccggcaggaaggggcgttcagaacatgtccgggcaccacggtcgcctggacgtacgcagcagggcgtcggccactcgggcggcgcccgctcgttcttcccggaccctgccgagcgcggcgagccgcaccgccgactcgtcaccgagccacagcggcgccaactccccgacgtccagcgtcagatcggcgctctgtgtcgtcggcgtgcaggacgccccggcaggcgacgcctccagccgccagcggccccgtgcccacccgctctcgtcggccacctccagcaccagcgtcccggtcccgtcgtaggtccgcgcctccagcgcccgtacgacgtccaggacccgcacccacagccagtccgcgtgcgtggtgatcacggccgcgcgcgggtcgggcaggaggagcgggagcaggtcgtccggggcccgccagccgctcttgaccttcaccacgtagtccaccgagcacacgtggagccagagcgcgcgctcggcggccggggacaccgcgatcaggttcttcaccgtggccgtgttcaacggctgtttggcgtccgaccaggtgtcgtcgcagacgtaggcggccagaccctcgaccgtgccgtccggcgcgcggtacacggcgtagaacggctcggtccacgggctgtgatccaggcgtacggctcccgtgttgacctgccaccagcgctccggacggtcgatcgcgccgggctggacgcggcgcagccgctcgtgcagttcgggaccgagtttgcggacgtcgtcgccgtcgacgaggtcgatccggccaccgccgtccggggccggcctgcgggggtcgaggccggcccggggcacgtcgatcgtccactcggtggtccaggtggcggggccgaagccgtagcggccgtagatcgggtactcggcggcgatcagcgtggcgacgacgtcaccgcgttccttcgccgccgcgaggtcctggctcatcatgcgggtgagcagaccgcggcggcggtgcgtggcggtcacggtgacgttggagatggcgtcggcggggacggtcgcgccgccgacgacggtgagctgctggccgaaggagcggaacgtggccacgcaacggccccggtcgaaggcgccgagcgtccggtccggaacgatgtgcgggccgcgagcggcgatctcggcatcggagacgaccggactgcgcaggaagccggtgttcagcgcacggatccagtcgggaatctccgccgcgcagatcggccggacgtcgatgccggtggggtgatggtcagaggccgggtccgtgggcaggtgctccgcgtcgtcggagcggcggtcggtgtcggtgcggtggtggtcgccggtcatggctcgacggtaggtggccggggcggacgtgtcgcggccttttcccgggaccggcccggagccgggaacggcccggagccgggaacggcccggagcacaccacccccggccgttcccgtcccgtcagagaagcaggtcgtccacctgggcctcgccgtcgcggtagcggcgggcgatctccgcgctgcagccgtcggccgtgtgctggagctggtggcggcgccgggacacctgctgctcgtaccgtacgagccgtcccatcgccgcgcccagttcgaggtcggtacgggcgcccaggtccgacagctcgacctcggcgagcatctccgccgacagccgccggtactcctcgccctgcggggtgcccagcgtcacgtgccgggccgaggaacggtgacgggccggcgcgtcccggaggatctccgcgagccgttcgaccacggacgacgccccgccgcgctccgcggcgggcacggagcgtgccccggcgtcgtcctcgccggatgccgaccgtgccccgcagccgcgccgggccagctcggcgcgcaggatgtcgatccgtccctggaggagccgccgtacgtaactcaggtcggcctcgtcccgttgggccctgcgacgcagcgcgcgcagttccggcaggctcagcacggtcagatccggctcgtccggctccatggccagcagtgggtccaccacaggtaccaccggtaccccctccgtgctcgcgggccggtccgcgagcacggagggggtac

SEQ ID NO: 257 - DNA, 6898 bp, Unknown
  Kingdom: Bacteria, Phylum: Actinobacteria, Class: Actinobacteria, Order: Streptomycetales, Family: Streptomycetaceae, Genus: Streptomyces
  misc_feature (301)..(336): n is a, c, g, or t
gtgcgcgaggaggtggccgccggccaccaggcgtacgtcgtctgcccgcgcatcggcgacgaggaggacgaccccaagaagtccgccaagaacaagccaccgcaggagggtgccgacaagcgcccgccgctcgccgtcctcgacgtggccgagcagctcgccaagggtcccctgcggggcctgcgggtcgaggtgctgcacggcaggatgcagcccgacgacaaggacgcggtcatgcgccgcttcgccgcgggcgacaccgacgtcctggtcgccaccaccgtcatcgaggtcggcgtcnnnnnnnnnnnnnnnnnnnnnnnnnnnnnnnnnnnntggtgatcaccgacgccgaccgcttcggcgtctcccagctgcaccagctgcgcggccgcgtcggccgcggctcggcgcccggcctgtgcctgctcgtcaccgagatgcccgaggcgagcgccgcccgccagcggctgaacgcggtggcggccaccctcgacggcttcgagctgtcccgcatcgacctcgaacagcgccgcgagggcgacgtcctcggccaggcccagtccggcgcccgcaccagcctgcgggtgctcgccgtcatcgaggacgaggagatcatcgccgaggcccgcgaggaggccgccgccgtggtggccgccgaccccgacctggagcacctgccaggcctgcgcacggccctggacgccctgctggacgaggagcgggagcaatacctggaaaagggctgaacatcaccgacccggggacgcgccgaaccgcgcgaccagccacactgaacgcaaagccgcccacgaccaaggacctcagatgacccgcgtgatcgccggaagagccggcggacgtcgcctggccgtcccgcagtcgggccgcacccggcccacctccgaccgcgcgcgcgaaggcctgttctccacctggcagtccctgctcggcggcccgctcgacggcgaacgcgtcctcgacctgtacgcgggctccggcgccgtaggcctggaggccctctcccgcggggccggccacgccctcctcgtcgaggccgacgcccgcgccgtccgcaccgtccgggagaacgtgaagtccctcggcctgcccggcgcagaggtgcgggcggcgcgggcggagcagatcatccagacaccgcccccggccgacccgtacgacctcgtcttcctcgacccgccgtacgccgtcaccgacgacgatcttcgggagattctgctcacactccgctctcaggggtggctcgccggacaagccctcgtcaccgtggagcgcagcaccagaggcggtgagttcgggtggccgcccggcttcgacgcgatccggtcccgtcgctacggcgagggaacgttttggtacggtcgcgccgcctctacgtgcgaagacgcacgatgaccggaccggagagcgagggatctcaagtgcgccgtgccgtctgtcccgggtcgttcgaccccgtcaccaacggacacctcgacatcattgcccgcgcctcccgcctgtacgacgaggtctacgtggcggtgatgatcaaccagtccaagaagggcctgttcgagatcgaggagcgcatcgacctcatccgccaggtcaccgccgactacggcaacgtccgcgtcgagtccttccacggcctcctcgtcgacttctgcaagcagcgggacatccccgccatcgtcaagggcctgcgcgcggtcagcgacttcgactacgaactgcagatggcccagatgaacaacggcctctccggcgtcgagacgctcttcgtgccgaccaaccccacctacagcttcctgtcgtcctccctcgtcaaggaggtcgcggcctggggcggcgacgtcgcccatctggtgcccgacgtcgtcctggaggcgctgaccgcgcgcctggagaagaagtgacgtcctgacggaccgtcacccggtgtcgggcggctgcctcgtggtcgtacagtcgtcccgtccgttacccgcaacatcggtagggagtggcgagcacaccgtggacgtgcagaagaagctcgacgagatcgtgaccacggtctccggcgcccggtccatgcccatgtcggcgtcgtgcgtggtcaaccgtgccgagctgctcgcgctgctcgaccaggtgcgccaggcgctgcccggctcgctcgcgcaggcccaggagctgatcggcgaccgcgagcagatggtcgaggaggcccggcgcgaggccgagcggatcatcgagaccgcgcacgccgagcgcggctcgctgatctccgacaccgaggtcgcccgccgctcccaggccgaggccgaccggatcctcggcgaggcccgccgcgaggccgaggaggtccgcgccgaggccgacgactacgtcgactccaagctcgccaacttcgaggtggtcctcaccaagaccctcggctcggtcggccgcggccgggagaagctgctcggcaccggccccggcctgaacgaggacggctacgcggacgaggacgcccccgagcgcagccacgacccggagaccctgcgccgcgacgccgacgcctacgtcgacgccaagctcggcgccttcgaggccgtgctcgccaagaccctcgaggccgtcggccgcggccggcagaagctgcacggccgcatcgccaccgacgacctcggcgccctcgccgacgacacgtccaccgtccagcactccagcgacgccgactacctcgccggcctcgcggaccacgccgagagccccgccgccccggccgccgagcggccccaggtgcccgcccagccggcgtacgaaccgcagccggcctacggctaccagcagcagcccgcacagaccgacccgtacggcggctaccagcagggctacggcggccagcaggacccgtacggctaccagcaggccgacccctatggctaccagggctacgacccccagcagaccggcggctacgacccgaaccagccccagcagtcgcacgagacccaccagggtcaccagccccagcagcaggaccagccccaccagggctacgcgctcgacgagaccagcctcttcgacaccggcatgatcagcgccgagcagttgcgggcgtacgagcagggccgcgggctgtagccgctgcccggcggtcgcccggtccgggggccggattgggccgagggcgaaaggtcaagtatcctggctcttcggtcgcgcgtaagtgcgcggtcagcgctgcccgggtgcaccaccgaggcggcgtccctccgagttcggaaaccgaaagcaggaatggctcacagctcccgcctcgaccaccgcaaccctctcgtgttcgacacacatgagctggggcggcggcctggcgcgctgcagcgcctgacccgcgaggtcccggccccccgggacctcggcatccacggagtgatcggagtgccggaaggcgccccggtggaactcgaactccgactcgagtcggtcatggaaggtgtgctcgtcacaggcaccgcccgtgcacaggccgagggggagtgcgtaaggtgtctggagccggtcgggcttgagctcgaagcggacttccaggagatgttctcgtaccctgacgccgacgaccggggccgcgtgatcgcggaaccgggcgacgacgccgaggacgacgaggacaggctcctcctcgaggacggactcttcgacctcgaacctctgctgcgcgatgcggtggtgctcgcactgccgatgcagccggtgtgccaggaagactgtccgggcctgtgctcccagtgcggagcgcggctcgcggacgacccggaccaccatcacgacgccgtcgacatccgttgggcggctttgcagggactcgccggcaccacgtcggacggcgagaaggacgagatgagcggcgctgacgcggaagcgggcgtcgacgagaagcaggagaagtagccgtggctgttccgaagcggaagatgtcgcgcagcaacacgcgccaccgccggtcgcagtggaaggctgcggtccccaccctggttgcgtgcgagcgctgccacgagcccaagcagcagcacatcgcgtgcccgtcttgcggcacctacaacaagcgccaggtcctcgaagtctgagcggccaggtgagaggcactgtgtccacgcccaagaagagctcctcccgtgcgagcgggagcccggcggacaaccaggcctcgtccccgacgcttctggaagggcggctcggctaccagctcgagtccgcccttctggtgcgtgcgctgacccaccgttcctacgcgtacgagaacggcggcctgccgacgaacgagcggctggagttcctcggtgactccgtcctcggtctcgtcgtcacggacacgctgtaccgcacccaccccgacctgcccgaaggccagctggccaagttgcgggccgcggtggtcaactcgcgtgcgctggcggaagtgggccgcggactcgacctgggttccttcatccggctcggccgcggtgaagagggcacgggcggccgggacaaggcatccatcctcgccgacaccctggaagcggtgatcggcgcggtctatctcgaccagggcctcgacgcggcctccgaactggtgcaccgcctgttcgacccgctgatcgagaagtcctcgaacctcggagccggcctggactggaagacatcactccaggagctgaccgcgaccgaagggctcggcgttcccgagtacctggtcacggagaccggccccgaccacgagaagaccttcactgctgccgcccgcgtcggaggcgtctcgtacggcaccggcaccggccgcagcaagaaggaggcggagcagcaggccgccgagtccgcctggcgggccatcaaggccgcggcggacgagcgcgaggcgaccgaacaggccgccgcccaggacggcaacgcgccgtccgccaccgcctgaccgacaaacgcagcacaagcagtacgagcagtacagcgtgaccgagcgcccgccccgagcccacccggcccgggacgggcgctcggaccgtccacggaccgtacggtcccgttcctcacgggggtcccgatgcccgagttgcccgaggtcgaggtcgtccggcgcggcctggaacggtgggtcgcccaccgcaccgtcgccgacgtcgaggtgctgcacccgcgcgccgtacgccggcacgtcgcgggcgccgacgacttcgcgcaccgcctcaagggccaccacatcggcacggcagcccggcgcggcaagtacctgtggctgccgctggaggagaccaaccagtccgtcctcgcccacctcggcatgagcggccagctgctggtgcagccgcacgagacgcccgacgagaaacacctgcgcatccgcgtccggttcgccgactccctcggcaccgagctgcgcttcgtggaccagcgcaccttcggcggtctctcgctgcacgacaacaccgcggacggcctgcccgacgtcatcgcgcacatcgcccgtgaccccctcgatccgctgttccacgacgaggccttccatcaggcgctgcgccgcaagcgcaccaccatcaaacgggccctgctcgaccagtcgctgatcagcggcgtcggcaacatctacgccgacgaggcgctgtggcgcgcacgtctgcactacgagcgccccaccaccggcttcacccgcccgcgcacgaccgaactcctcggtcacatcagggacgtgatgaacgcggccctcgccgtcggcggcaccagcttcgacagcctctacgtcaacgtcaacggcgagtccggctacttcgagcgctccctggacgcctacggccgcgaggacctgccctgccgccgctgcgggaccccgatgcggcgccgtccctggatgaaccgttccagctactactgcccgaagtgccagcccgcaccgcgcacccgccccgcgcccggcacgaccggccggggctgagcgtcaggcccggcgggcgtcgtaggtctcgcgggccgcgatgacctcgtccatccggtcctccacacagtggatgaggttcagcagccgctcggcgaccgcgcggccgaatccggtcagctcgtagtccacgcggggcgggttggtcggctgggcctcgcggtgcaccaggccgtcacgttccagagcgtgcagggtctgcgagagcatcttctcgctcacgccgtcgacgcggcggcgcagttcgttgaagcgcagggacccttcgtacagggcgcccagggtgagcgtgccccagcgtcccgtgacgtgctccagcgtgccgcgcgaggggcaggccctggcgaacacgttgtacggaagctcccgctcctcggcgcgctccggcatgatgctcataccctgagcgtacgcgaccacagcgcgaaccggcaggttgcgctaactctgcgttagtggcgagggcgggcgcgggccggtcagtagccgaagtcctgcgtccaccacgggccgcccgcgccgaagtacacaccgacgcccagggtcttgaagccgcagttcaggatgttggcgcgatggccggggctgttcatccaggcgtccatcacggccgccgcgtcggcctgcccgcgggctatgttctcgccgccgaggccggtgatgcccgcctccgccgcgcggtcccagggcgtcgcaccgctggggtcggtgtgcgcgaagaagttctcgtcggccatggccttgctgaacttctcggccagcgaggtcagcgcgctgttcgcggagaccgcgctgcaccccaccttggcccgctcctggttgaccaggctcagcacctcggtctcggccgccgcccgggcggagaccgtcaccgcaggcgcgctgtgctgcggcggcggtacggccttgcgggccggggcgctcggcttggcggcgccggacgcggccggggtggtc

SEQ ID NO: 258 - DNA, 9681 bp, Unknown
  Kingdom: Bacteria, Phylum: Actinobacteria, Class: Actinobacteria, Order: Streptomycetales, Family: Streptomycetaceae, Genus: Streptomyces
agcacctcggccaagaccgagctgctgcaccggctgctcggcggccgggccaagccggccaccgagcgtctggtgacgcgcctggtgagcgcgccgcggggacgtagcctggaagcgggactggagtccctctccaagctcgccgccgaccgccgcaaccggatggtcgccgtcgtcacctcggcggtcccgctgagcgacacccagaagcgacgcctcggcgccgccctcggcaagctctacggccgccagatgcacctcaacctggacgtcgaccccgagctggtcggcggaatccgggtgcaggtcggcgacgagatcatcaacggctcgctcgcggaccggctcgacgacgccgcccgccgcatggcgagctagcagcaactcaacacgcaagacgtacacgacggccctggttgggccgtgcagaggattcacctcttactggggggagtcccgaactcgtggaacaccccccaagtgaaacttcgggcccaacaaggagagcagggaacccagatggcggagctcacgatccggccggaggagatccgggacgcgctggagaacttcgtccagtcgtacaagccggacgcggcctcgcgcgaggaggtcggtacggtcacccttgccggcgacggcatcgcgaaggtcgagggcctgccctcggccatggccaacgagctgctgaagttcgaggacggcaccctcggcctcgccctcaacctcgaggagcgcgagatcggtgccatcgtcctcggtgagttcagcggcatcgaggagggccagccggtcacccgcaccggcgaggtcctgtcggtcgccgtgggcgagggctacctcggccgcgtcgtcgaccccctcggcaacccgatcgacggcctcggcgagatcgagaccgacggccgccgcgccctcgagctgcaggcccccacggtcatgcagcgcaagtcggtgcacgagccgatggagaccggctacaaggccgtcgacgccatgaccccgatcggccgcggccagcgccagctgatcatcggtgaccgccagaccggcaagaccgccctggccgtcgacacgatcatcaaccagcgcgacaactggcgcaccggcgacccgaacaagcaggtccgctgcatctacgtcgccatcggccagaagggctccaccatcgcgtcggtccgccgcgcgctggaggagaacggcgcgctggagtacacgaccatcgtcgccgccccggcgtccgacccggccggcttcaagtacctggcgccctacaccggttccgccatcggccagcactggatgtaccagggcaagcacgtcctgatcgtcttcgacgacctgtcgaagcaggccgacgcctaccgcgccgtctccctgctgctgcgccgcccgccgggccgcgaggcctacccgggcgacgtcttctacctgcactcgcgtctgctggagcgctgcgccaagctctccgacgacatgggcgccggttcgatgaccggtctgccgatcgtcgagaccaaggccaacgacgtctcggcgttcatcccgaccaacgtcatctccatcaccgacggccagtgcttcctggagtcggacctgttcaacgccggtcagcgccccgcgctgaacgtcggtatctcggtctcccgtgtcggtggctccgcccagcacaaggcgatgcgccaggtctccggccggctgcgcgtggacctcgcccagttccgtgagctggaggcgttcgccgccttcggttccgacctggacgcggcctccaagtcgcagctggagcgcggccagcgcatggtcgagctgctgaagcaggcccagtaccagccgatggccaccgaggaccaggtcgtctccgtctgggccggcaccaacggcaagatggacgaggtgcccgtcgccgacatccgccgcttcgagaaggagctgctcgagtacctgcaccgcaaggagcagggcctcatgacctccatcaaggagggcgccaagatgtcgaacgacacgatccaggcgatcgacgacgccgtcgccgagttcaagaagcagttcgagacctcggacggcaagctgctcggcgaggacactccggccgctgccgccaagtgacgtaaggaagggacctgactcatgggagcccagctccgggtctacaagcgtcgcatccgatccgtcaccgcgaccaagaagatcaccaaggcgatggagatgatcgccgcctcgcgcgtcgtcaaggcgcagcgcaaggtggtggcctccacgccgtacgcgcaggaactgacccgcgcggtcacggcggtcggcaccggttcgaacacgaagcacccgctgaccacggaggcggacaacccgacccgtgccgcggtcctgctcctgacgagcgaccgcggtctggccggcgccttcaactccaacgccatcaaggcggcggagcagctgaccgagcgcctggagcgcgagggcaagcaggtcgacacgtacatcgtcggccggcgcggtgtggcccactacaacttccgcgagcgcacgatcgctgagtcgttcacgggcttcaccgacgagccgacgtacgcggacgcgaagacggtggcggcgccgctgatcgaggcgatcgagaaggacacggccgagggcggtgtggacgaactccacatcgtctacaccgagttcgtctcgatgatgacgcagacggccgtcgacccccggctgcttccgctgcgcctcgaagaggtcgcggccgaggcggcgcccaagggcgagatcctgccgctgtacgacttcgagccctcggcggaggacgtcctcgacgccctgctgccgcgctacgtggagagccgcatctacaacgcgctgctccagtcggccgcttcgaagcacgccgccacgcggcgcgcgatgaagtcggccaccgacaacgcgggtgagctgatcaacacgctctcccgtcttgccaacgcggcccgccaggccgaaatcacccaggaaatcagcgagatcgtcggtggcgcgagtgccctggccgacgcgaccgcggggagtgacatctaatgaccaccactgttgagacggccacggcgacgggccgcgtcgcgcgggtcatcggcccggtcgtcgacgtggagttccccgtcgacgcgatgccggagatctacaacgcgctgcacgtcgaggtggccgacccggccaacgccggcgagaagaagacgctgaccctggaggtcgcccagcacctgggtgacggcctggtgcgcaccgtctccatgcagcccaccgacggcctggtccgccaggcccccgtcaccgacacgggcgcgggcatcagcgtcccggtcggcgacttcaccaagggcaaggtgttcaacaccctcggtgaggtgctgaacgtcgacgagtcctacgacggcgagcgctggtccatccaccgcaaggccccggccttcgaccagctcgagtccaagaccgagatgttcgagacgggtctgaaggtcgtcgaccttctcaccccgtacgtcaagggcggcaagatcggtctgttcggtggtgccggtgtcggcaagaccgtgctgatccaggaaatgatcatgcgtgtcgccaacctccacgagggcgtctccgtcttcgcgggtgtcggtgagcgcacccgtgagggcaacgacctcatcgcggagatggaagagtccggcgttctggacaagaccgcgctggtcttcggccagatggacgagcccccgggcacccgtctgcgcgtcgcgctggccggcctgaccatggccgagtacttccgcgacgtccagaagcaggacgtgctgttcttcatcgacaacatcttccgcttcacgcaggccggttccgaggtctccacgctgctcggccgcatgccgtccgcggtgggttaccagccgaacctggccgacgagatgggtcagctccaggagcgcatcacctcgacgcgtggtcactcgatcacctcgatgcaggcgatctacgtccccgcggacgacctgaccgacccggctccggcgaccaccttcgcccacctcgacgcgacgacggttctgtcccgtccgatctcggagaagggcatctacccggccgtggacccgctggactccacgtcccggatcctggacccgcgctacatcgcgcaggaccactacaacgcggccatgcgcgtgaagaacatcctgcagaagtacaaggacctgcaggacatcatcgcgatcctcggtatcgacgagctgggcgaggaggacaagctcgtcgtccaccgtgcccgtcgcgtggagcgcttcctgtcccagaacacccacgccgccaagcagttcaccggcgtcgacgggtcggacgtcccgctggaggagtcgatcgcggcgttcaacgcgatctgcgacggcgagtacgaccacttcccggagcaggccttcttcatgtgcggtggtctcgaggacctgaagaagaacgccaaggagctgggcgtctcctgaactcgttgagttcgtgtgagggggcgggcgcgtcccgccccctcactcacgcccatcgctgcacttcccggggggcaacccccggacccccggccgacgctggggcgggccccgacacctgggtgctggaagcccactagacttgtaaccaacacccggtgatcccaccgggtggtgacccgaggagccactcttggctgctgagctgcacgtcgagctggtcgccgccgaccgccaggtctggtccggcgaggccaccctggtcgtcgcgcgcaccacgtccggcgacatcggcgtcatgcccggtcaccagccgctgctgggtgtgctggagtcgggcccggtgaccatccgtacgagtgaaggcgcgacggtcgtggccgcggtgcacggcggtttcgtctcgttcgccgacgacaagctgtcgctgctggcggagatcgcggaactctccgacgagatcgacgtccagcgcgtggagcgggaactcgagcgcgccaaggcggagggcgatgccaccgccgagcgccgcgcggacgtccgcctgcgagcggcgacggcggtgcgctgaaccagcgacaccatgtgatgacaccactcagccgcggccggtaccggagcaatccggaaccggccgcggctgaggcggatgtgggtgttttttccgttccattacccagttcccttacctaggagacgaggaggtcggtgccgatggtcctcgctctgactgtgtgctcgatcgtggtcgcgctcgtggtggtgggactgttcgtcttcggtctgcggcgcaggctgatccagcgttccggcggcaccttcgactgcagcctgcgctgggacgtggccgaggagcccgacaccagcggcaagggctggagctacggcgtggcccgctacaacggcgaccgcgtggagtggttccgtgtcttctcctacgccccccgcccgcgccgcacgctggaacggtcctcgatcgaggtggccggccgccggcgccccgagggcgaggaggaactcgccctgctgtccgacgcggtgatcctcacgtgcctgcaccggggcacgcgggtggagctggccatgagcgaggacgcgctgaccggcttccttgcctggctggaggcggccccgcccgggcagagggtgaacgtcgcgtaggcctgccggcccatgacaagaagaagctcccccggtccgccgtccgggggagcttcggtgtttcaggcctgccggtccttacgccaggccgctgctgagggcgctcaccagttcgccgttgctggtgtcaccgctgaactcccagaagaacgcgccgccgaggccctggctgttggcccaggccatcttcgacttgatggtcgacggggtgtcgtaggaccaccagttgctgccgcagtgcgcgtacgccgtgccggcgatggtgccggtgacggggcagctggtcttgaggaccttgtagtcctcgatgcccgcctcgtaggtgccgggcgccgctccggtcgccgtgccgccgggggcgtcctgggtgacgccggtccagccgcggccgtagaagccgatgccgagcagcagcttcttcgcgggcacgccctgggccttgaacttggcgatcgcgtcggcggtgttgaagccgtccttcgggatgccggagtacgaggtgagcggggagtgcggggcggtcgggcccttcgcgtcccaggcgccgaagaagtcgtacgtcatcacgttgtaccagtcgaggtactgcgaggcgccggcgtagtcggaggcgtcgatcttgccgccgttggagccgtccgcggtgacggccgcggtgaccagctccttgccgaacttggcgcgcagcgcggacaccaggttcttcagggcgtccgggccgctggtgtcgcaggtcaggccgcaggcgttcgggtactcccagtcgatgtcgatgccgtcgaagacgtcggcccagcgcgggtcgtgcaccaggtcgtagcaggactgggcgaaggccgccgggttcttggccgcctcaccgaagccgccggaccaggtccagccgccgaaggaccagatcaccttgaggttcgggtacttggccttcagttcgcgcagctggttgaagttgccgcgcagcggctggtcccaggtgtcggcggtgccgctgacggactggtcggcggtgaacgccttgtcgtagtcggcgtaggagtcgccgatcgcgcacttgccgccggtgacgttgccgaaggcgtagttgatgtgcgtgatcttggcggcggagccggacgtgaccaggttcttgacgttgtagttgcgtccgtagatgccccactcggtgaagtagccgagcttgaccttgtcgccggtgggcggggtggtggagccgccgccggtggtgtgcacggcgaccgggccgctgaccggtccggtctggtcggcggtgtcgcgggcctggacggtgtaggagtagtcggtgcccgccgtcaggccggtgtccgtgtaggacgtggccgtgacggtggcgaccttcttgccgtcgcgcaggacgtcgtagttcttgacgcccttgtcgtcggtggcggcgctccaggagagcttgaccgaggtgtcggtgacgccggaggcggtgggggtgcccggggcggagggagggttgtcgccggggacggtcgggccgccgtcgcagctgccgccgttgagcgtgcagccggagggcgagccggagccggtgccgttgtagccgaaggtgaccgaggcgccgggggcgatggtgccgttccagccgacgttcttggcggtccagtggttgccggagttggtgacggtggcgtcccaggcggaggtgaccttggtgtcggaggggtagtcccactccacggtccaggagctgatcgccgaggcgccggtgttcttgacggtccaggatccgccgaagccgctgccccagtcaccggtcttggtgaaggtggcggtggcggtggacgccgcgtcggctgcggcctgggcatggcccgagatgccgacgattccggcgagcgggagcacgagggtcgccagccccgccgcggctctgtgtctgaagcgcatgcgcgcctccttgtcgggggagaatgtcaggggcatgactgagccttcacgccccgcggtgctgcgagagtagaaaggtctggaccagaggtcaataggtctggaccaatgcaccactggtccggctggatccccaactcctgcgccagtacggccgcttggacgcggctgcacggctccggcttgcccagcagacggctgacgtgcgtcttcacggcggcctccgccgtctccggggggaccgcgatctctgtgtgggacagcccctcaccgagacacgagagcacctcgcgttcccgccgcgtcagcgagtcgagcgcagaggggacggccttctgctccgccgccggccgcccccgctacggcctcgcccgcgcccgtcacgagggcaagccctggctgcgcaccctgtgctcgccccggccgtcgccctcgccctgctccaggcggcgatctggtacgtcggcgacggcgcgcgccgacccgctcgggtcctggcgggtgaccacgctgcggatcctcgccctccacgcggtgatcgccctgaccggcctggtgttcccgaagaaaacgcctggcaccagccgtccccgccggggagggtcgtacgctggccgggcggtgaggagggcgagtgacggatacggggcgcccaggaggtgtgctggtcgtcgacgacgacgcggcgatacgtcgttcgctggagcgcgggctcaggctgagcgggttcgcggtgcgcagcgcgggtggcggggccgaggcgctggacgccatcgggcaggcgccgccggacgtgctggtgctggacgtgtcgatgcccggcatgagcggcatcgaactgtgcgcccggctgcgcgcggacggccaggacctgccggtgctgatgctctccgcgctcgatgagaccgccgaccggatcgccgggctccaggcgggcggtgacgactacctcgtcaagccgttcgccctgcaggagctggtgctgcgactgcgcgcgctgctgcggcgcaggccgccgaccggccgcgaggtgctgcgggtggccggcctggtgatcgaccccgccgcccgcaccgccgagcgcgacggccgggcgctggagctgacccggcgcgagttcgagctgctccaggtcctcgcccgcaacgccggactggtcctgacccgcgaccagctcctggaacgggtgtggggctacgacttcgacgtgcgcaccgacgccgtcgacacgttcgtcagctatctgcggcgcaagctggaggcggacggagagccccggctcgtccacaccgtgcgcggcgtcggcttcgtgctccgcgacgcacgcggcccgcgggacgcgcggggcactccgtgaggctgtccacccgcatcggtctcgccgtcggctgcaccgtcccgctgctggtcgccgcctccggctggctgctgctgcacctggtgggccgcgacctgcaccgagtggaggacgaccacctgcgccggcgcgccgccgccgtcgcccccgacgcccgcgccctgctgcgggccgccgagaacggccgccccaaggccgccgacaccagggaacggcacctgttcagcgccgccctcgacgtcggcgtccgcgtcgtcggaccggacgccgtcttcagcggtggaccgcagcccgacgcgtcggtgccgctgcccccgcaggcccggggacccgtcaccgtccacgcgggcggacgcagttggcgcgtgctgtcccggccggtcgaaggccccgtcgtcaccggcaccctgtgggtgttctcgcccgacaccgccgacagggcccaggagcaggccgtccgccggcgcgtggtcctgaccgcgctgctcgccgcgcccctgtcgggcctgctcgcctggggcctggccgcgggcgcgggcgcgcccctgcgccgcctcacccgccgcaccgccggactcgatccgcgcacgtccgccgcccggcccgaacaccgccccaccaaagtgaccgaggtcgacgaactcgccgccacgctcgccaccgtcctcgcccgctacgacgaacaggccgcccggaccgccgaggccctggacaccgcccgctcgttctcctccgccgccgcgcacgaactgcgcaccccgc

SEQ ID NO: 259 - DNA, 19693 bp, Unknown
  Kingdom: Bacteria, Phylum: Actinobacteria, Class: Actinobacteria, Order: Streptomycetales, Family: Streptomycetaceae, Genus: Streptomyces
cagatcggcgcgctgcgcgccaagggcggcgacgtgcgggtctccttcgggggcgcctccggcaccgagctggcgacggcctgctcctcggcggacgcgctggcggcggcgtacggcaaggccgtcgaccggttcaagctcaccaaggtcgacttcgacatcgagggcggcgcgctgccggacaccgccgccaacacccgccgcgcccaggccatcgccaggctccagcggcagcacccgggcctggacgtctccttcaccctccccgtcatgcccgagggcctgacccaggacggcgtcaacctgctctccggcgccaagtccgccggcgtgaggatctccaccgtcaacatcatggcgatggactacggcgcctcgtacaacggcgacatgggcacctacgccacccaggccgccaccgccacccaggcccaggtcaagggtgtcctcggcctgtccgacagcgccgcctggaaggcggtcgccgtcaccccgatgatcggcgtcaacgacgtctccgccgaggtgttcaaggtcgacgacgccacccagctggtggacttcgccagggcgaagggactcggcggcctgtccatgtggtcggccacccgcgacaagcagtgcgccggcggcaccaagcccaccgccgacgcgacgtgcagctcgatcacccaggaaccgttcgccttcaccaaggcgttcggcgccttccgctagaccggccttccaccaggaggccggccttcggtcggaccgctgcgcggcgccgccgtgaccgtccggttctctcgcccgccgcctgagagccgacgggtcgcgagagccgggctggaagactgccaaagaggcgcggcaaagccggcgtaagggcgcatgagacggacatgaagatcattgcggccttggagcgaccgcctgcaccctggaggccgaggcgcccgcgccggagcgccgtggagaggtggtctggtgtccgatgagaacagcggcccggccgcgccgggacgcgcacgcaccgcccggtggagtgtccttctgacgcgggtggcgatcgccgtggccgccgcctggctcatcctggtcgtcctgcggccgctgctgggcggccgggtctggtggtgggtgctggtcgacctgctgccgccgctcactctggtcctggtgccggccgcgctcctggcggtggggctcgctgccatggtgcggcgaaggggccgcttggcccccacgcaccggtggttcaccggactggccgcgctgggcctggtcctcgcggtaccgcagtccggtctgaactggcgggcactcgggccgcaggacccgacacccgccgacgccctgaaagtggtctcctgggacacgctcgagtggcaccagggcaacgacgcggacgcgttctaccgctacctggcccgcagcaaggcggacgtgtacctcctccaggagtacatggagatccggaacggcgagccggtgccggtgaacgacaccgcacggctgcgcgccaccttccccggctaccacttcgcgtctgccggggaactgctcaccgtgtcacgcttcccgatcaggtaccgcagcgtggtcagggcgtccctgcccgcgccggtgacgtcgtggcacgactactggaacatcagggcgctgcgcacggacatcgccgtcggcggcaccgcggtctccctctacaacatccacctcccggacctgttctccctggagtccagcccgttgtccacggagttctacgggatcgtccacgacctggatcagcggcgcacggcggtactgagggcgctccggcgggagttcgcggacaaccgcgcccccaaactggtggcgggcgagttcaacgtggtgcccggctcgggcgaactgcgcccactggacggcctgacggacggggcgcggtcctcgcacagcgtctacccggtgtcgttctgggtcgggaagttccaggcctggcggctggactgggccttctccggcaccggcgcccggatccacgactaccgtctcaccgatccgggaccgctgtcctcgcaccgggcacaggagttccgcctgtccgtctgagcggacagtcggccacccgacaggcagacacaggacgcacgaacaccgactcgacggcgtccgactcgacggcgtccggcacgacggcgtccggcacgacggcgcccggcgcgtcgccgcgccgggcgccggttgcgccgtggatcagtcggtgccggcggtgttctccggcagccaccgcacgccccggacatccagccgggccggcccctccgtgtacagcatgaacggcacgtccacatggcgcagatccgcgccgatcgcccgcagcgactccaccggcacggccaccgtggaccactcgcccgagggcaactcggccagcgccgcggagatgtccacggccggctgcgcgggatagtcgtcgtggcaggcgaggaacaaccggtccgtcggcgcctcccacacccgcacctcgaacgacaccgacgcaccggcctcggcgtaaccgcgcaggtcgacgggctcaccggaggcgaactgcgcgtagacgaaagccgggtggccctggcccttgaagcgcagcgcgaggccgcaccccgcgtccgtggcgttcagcggctcgctgcgcaccaccaggacctccgtcggctcctcgaaggagatctcggggcgcgaccaggtgttgtggccgccgatgcggaaggcgaagccggaacccgcgccgcccagcacttccagtggaccgtccaccggcggcacgggcgtctcgtcgcggaaggtgtcctcgggcagcgggccctcgggcgaggcgtcggacacgctcagcccgtggccgtacgggaagagcggctcgtgctcgccctcgggcgcctgctcctcgtcgggcacccggtagccggggatgtgcggcgggatgcggttgaccgcgtgcgaacgggccgtgcgcggccaggagcaacccagcctgccctggaagtcgtggccggccgagccgtcctcggcgcggaacagcacatcggtgatcccgccggcctgcgtgcccggcagccaggccgccacgaaggcgtcggagaggttgatctcctccgtcatgtacagagcgcgtccgccgaggaacacggtgaccaccgtgacgccttcggcgcgcagccggcgcagcgtctgcaggtcgcgggcgtaggagcgcttcaggccggcgtaggacagggtgccccacggcttgatcgtgccacgcatctcggcgtaggagtcctcgcccagcaccatcagcgcgacgtcgtgccgtgccgggtccgcggtgctcagatcggggtcgacggtgcagcgggcgtcacccaccacgtcccgcacggcctgggccacggtcgtcgcgccgggcaggtcgtcgacggtgacgtcgttgccctgccaggtgagggtccagccgccgacctgcttctggatgtcgtccgcgccgctgccggtgacgagcacccgcgcggagcgggacagcggcaggacacccgcccggtgcttcagcaggacgagggacttgcgcaccgcctcccgggccagcgcccggtgctccgcgcagccgagcacgtccgtgcggacggcgagggaccgctcccggggccgtggcttctcccacagtccggcccgcgccttcacccggagcacccggcgtaccgcgtcgtcgatccgctccatggggatccggcccgctcggacgtgctcgcaggtggtgcggtggacggactgccaggcggtgcgcccggcaatcatcagaacgtcgatgccggcgccgatggcgtaccccgcgtcgccgacggtgcagccggcgacctcggcatgggcgtcccagtcgctgatcacgatgccgtcgaagcccatgcggtccttgagcacgtcggtgatcagatagcggctaccgtggatcttgtggttgtaggccggtccgctgtccggggtgtggtcgtagttggcggcggcctcccagctgctgaacgaaaccatgacggactgcgcaccggcggcgaggcccgagaagaagcccaccgcgtggatgttgcggaccaggtcctccgggcagcgggcggtgccgcggtcggccccgtacgccgtgccgccgtccgcgacccagtgcttcatgcaggccacgacccgggtgtccctcgcgatctcatccgcatcgccctgcagcccgcgcaccatggcgggcgcgtagtcgtggacgacctcagggtcctcggcgtagccctcgtagtagcggccccagcggcggtcgcggggggtggtgacggtgggggcgaacgtccagtccatgccggtggccgcgatctcgcgggcggtcgcggccccgatccggcgcagcagttccgggtcgcgggcagcgcccagaccgatgttgtgcgggaagatcgtggcgccgcggacgttgttgtgcccgtgcaccgcgtcggtcgcccacatgaaggggatgcggaaaggccggccctcgtacgcgccctccgcggcctcccagaaggcgtccaccgtcttgatccagtcggcctggccggcctgccggttgttgccgggccagatgccggcgccgttgagcgcggaaccgatgtggtagtcccgcacgtcctcgggcgtcaactcggccaactcgggctggatcatctggccgaccttctcctccagtgtgagctgggagaggatctcttcgacgcgctgctcctgcgtcggcgacggctcgatcgcggagcggatcgcgggccactcggcgtggtacggcagtcggctcatccgttcctcctggggctgagcggttcgggacgggacgcccggcgtgccgggccggctcctcggtcagtggtcggcaacccagaactcctcgacgtcgcgctcgcagatccgctcgatgaacgccggcgggacgacggtgcgccgctggcccggcgcgaacagcgtcacctgggtgcggtgctcgccgagcgccgcccgcttggtggcgagctggggcatgatgtcgcggacgaggagccgttcgtccgtggcctgaggggcggccggctcattgcggttgacgaacacgaactcggcttcggtctgctcgtcccacaccacgtacttgtggatcttcgggttcatgcccagggaggcgaggcactccagcacgatctcgccggtgagccggtggtcggcgttcagctccttcacgtcgtgcggcaggtagacctcggccacctcgcggttctcggccagcagcttgaggacctcggtgcggaactcgggcagcgactgggccagggcggtgtcggtgaagcccaggaagcgcaggtcggcgccgtccacgccgagccgggcggcggcggcccgcgcctcgccctcgcggatgacggtcagttcctcgggggtgggggtgtccatgcccaggacggcggagtgcgagcgcgagccgtcggtggagaagacgacgccgacccggacgccctgcgccgtcttccgggcgatggtgccgccgcaggcgatgacgtcgtcgtcggggtggggggcgaagaccagtacggggcccgcgccgggggcgggcacggagaggtattcggggcaggacggcagtccccgctcggcgatgatgtcgttgatctcgaagaagtggttgccggggaccagccgggtgatcggggtgtcgtacttctccgcgaagtaacggtagttgccggcgaccgcgcgcatgttctcgctgtagctcttggggtgcggcacgtggatggcggccgcggcccggttcagcacgaagcgggcgccgtcgcggtgcagccggtagctcaggtcgacgtcctccgcgccccaggagcggtacgcctcgtcgaagccgcccaccgctcgcagctgctcggtgcgcgccgagacgttgcaggtccaccagaccagccagggcgcgggcagggtggcgaagtcgtcggtgtacttggcgtagaactcttcgcggatgtccagccacttcccctgcccggcgagatccgccatggtggcgtccgggtcggcgtagtcgatggcgcgctcgatctgcgcgccgtcctcgttgtcctcgttgaagcagtagacgtacccgcacaccgccaccgggccggacgggtcgcggtggctgtccaggtgcgcggccagggcgcccgagtgcagaatcacccccgagtccacgaacagggtgacgggcgcctcggcgtgggcgaggcccaggttccgcgcggcggcgacccggtagccctggtcctcctggcgcaggtaccgcagccgcagccgctgcccgaactcggccgccacgtcggcgctgtcgtccgtcgagccgtcgtcggagacgaggacctcgaagctgtcactcggcagcgtctgccggctcagtgactcgagggtgagccgcagcagtcgtgcccggttgtacgtcggcacgaccacgctgcactgcggtgcggtctgttccatgtcccctcccgagggcgagtagcagggtggccgccgacgtcagcagggcgcacacccagaacacattcgtgaatccggcccactcggtgaccaccccggtggtggcgccacccagcaggatcccggccttgaacgcgccggagtacagcgaggaggccactccgacgcgttccgtcatggcgtcctggaggatcgtcacgggaacgctgaggacgaccgacgtccagaaggcgttcagcagttggagtgcgatcagcgtgggtgccgatgacgccagcggcagcaggcagaagaacagcgtcgcgcagacgcccgcggcccccgtcaggcgccacagtccgatgcgctcggcccgtgccccgaaatagatcatcaccggcacctcgagtgccgcgctcacgcccagcagcacaccggtgaacccggtgccgagtccgaggtccttggtgacgaacagggagatgtcgatctggtaggcgctgttgacggcgagcagcagcacgatcgccgccagcagcagccaggtgcggcgaccgaggttcgcgtacggccgccgtacgctgcccgcggcgtcgtcggcgagggcgaggttcggcagccgccacaggcaggtcgcgccggccgcgaggtagaggacgccggccgtgcagaacaggaaggcgaacccgcgggcggcgatgaggaagaacgccagcggcgggccgacgatccaggcggccgaggtgaccgagcgcagcgccgcgttgaagaaggcggcgttcagggcccggtggtcggcgaactcccttgtgtaggcgaacagctgggagaagcaggcgctgccgaggccgaagaagacggcgccggcggcgaagagcaggtagtagttgcgcaacaacatgtaactgaaggcgccggtcgccgacagcagggagcagaccgcgagcagcgtacggcggttgccgatgcggtcggacatcactccgagcacgagttcggagctgatctccagcacggcccggccggcgaagaagaggccgatcatcagcggggcggccttcacctcgtcggccaggaagaggctgaccgaggaggtgaccatcgcgccgccgacgccgatcagcccggtggtgccgaccaggccgcccagggcccgatcggtgatcatctcggcggcgcccgtgcgcacggccgccaggcgcccccgggcaggcggggcgcccttcgccgtcgcagtcacggccgctccagggcaccgctgtggcgctgtcggtagggcagttccgggtggatccggcggtggggcgggacgcggtcggccgcctcggcctccgcggcggatatctgctccgcggccagcagggcggcgcgtgccgcggcgggcagcgcggccagcacccggtgcttgaggtccgccatgtcgaacagggaactgtcgtgcacaccgggccgcggcccgggggcgccggggcgcaggccggccgggtcgacctcgtgggagacgatgcgccagtaccgcgcgaagtcgcgctcggggtcgggcagagtcccggcggccagtccgattcggatggtctccagccagcagtcgtagtaccgcttgtccgtcaggcgtctcatgtgccgcgcgcaccaggcggcccgctcctgctcggcgggtaggacggcctcgccggtgaacacccgcagcgcccagcccgctatggcctcgaagtacgggcccgcggtcccgaacgcctcggtgtcgaccggggtgttgatcaccgcgagagtcgggtccggcaggtggaagaagtgctcgtacagctcctcgcgccgcagtgcgggaacgaaactgtagtcggggggcccgtagcccatgcagagcaggacggtgtcgtagcggtccgccgagccgtcggcgtacacgacaccgccgtcctcctcgaaacgctcgaaggcggggacgacgccgacggcgccgctgtgcacggcaggcacgatccggtcgttgacatggacggcgccatggaagccttccgagggcagcagccccgtcgcccggtacatggcgaagtagtccggcagcagggtctccagccacttcaggtagtccccgtagggcatctcctccacggcgacgcggccgatgtaggacaggagggcgtcgttgtagtggccggcgcagtagcggggcaggaacagggcgcggcggcgcaccgaccagtccaccggggtgccgtgggcggcgagttcggccgcgatgtcggcgccggagaccccgccgcccaccacgagcacccggcggccggtgacgtcctgcgggcgccggtagtccttcgcggtgaggacccgtacgccggtcgaggtatccgggacgaaggccggccggcgtgactcccacagctcgccgctggccaccatgacggcgtcgaagccgtcggtgaccgtgttcccccgggcctgggccgtgacccgccagacgccgtcccgtttgaccacctcggtcacggcgtggccgaaccggatgacgtccagcgccccggactcctcggcgtaggccctcaggtagccgtggacctccgcgcgggtggcgaagccggtgtcgaaaccgggcgagaagtcggagtaggggaagctcatccgggagctctgcatgcgcacgctctcgtaggcgccgcccgcgtcggggttccagatgcccccgaccgtgtccgtccgctcgtacacgacgacccggtgtcctgccgccagtgcctgcttggcgctggtcagcccggccgggcccgcaccgatcactgcgattcgcaacagtgtcactccttccagtcaggtgaacagtccaggtgcgagtggtcaggtgcgtcagatgaaagggtcgaagtcgggcacgagcgtgaccggctccgctcgccgggcgaagccgccgaccgtcacgttcgtctcgtgccgggcgcactggaaccggcagtccttgcgcggatcgatgaccgaggtgtcggcccgccgccacagctcctcgaacgacgtctcgcggatgtccccgatccgggccttgtcgttgccgcggtggtaggggcagacgtatacgcccgtcggagtcacggtggtgcgcaactcggcgacggcacaggtggcgtagtccttcggctggtgcgggtcggcgccgtgccgcacggcctcccagttggaggagcgcagcaggtggaacgagtcgtcctggagctccttcaggcgcccccactgctcgttgaccagctcgatggaccggtcgtcctggttgaccgtgaagtggtcctggtccagcatcgccttgagctcgaagtagtcgcagccgatctccttggccagccgccccgcctcgtacacctcctcgtagttggaggcctcgagcgagccgtcgggcgcgaagcgctgcatcagcaggaaggagtagcccagccggcccgccttgcgtccggcgagcatgcgcatgttctccaccaccagggggaacatgctcttcccgccccggctgggacggaagagggggtacgtctgctcggtgccggcgtccaccgacacccgcacccacgacagcattcccgccaggtggtcgatgtgccggtgtatctgggtgccgttggtgaccagtccgatccggatgccggcgcggtacagggtcccgatcacggtgtcgatggcccggtgcagcagcggctcgccgccgccgatgaggatgacggcccgcactccggtccgggtcagttcctcggcgagctcgacgatgcggtccttcgacagctgcccgtggtggagcacgttggagctgatgcactccgggcaggccagatcgcacaccgtcgtggggtccaggtcgaccacgagcggtgagttcagtcgcctgcccttggcgacctccagcgcgctcgggtagaccgactcctggtagatcttgccgaccaggtccaggttgtccgcgacctgggcggcggcgagcggaacgtcgggccgtgccgggaggccgggctgccgccgtgtaccgggttccgggggcatgtccgtctcctgccggccgggtgcgggcggtgccaccggaggacgccgccccgctagccaggcggcgcgcacggaggcgccgtgtgtgaagtcgttcggtgtggattccgtgttctgccgcgtgggcatggcttcctcttccggatcaacagatggtgaatttccggggtattcgaagatgcgattcttctcgtttgggcagccgtatgcggccgcgcgagaggaggaactcggcgggcgcccttgaaggattttcgtgaagtgggggggctacgtgctgaactgtaggtcccggtagtcgattcgattcaaattcttcggtcttgatttgacgatttcctgctggagcagggtcagccgggccgacggctccaggcccagttccctgacgatgcgcttgcgcaggcagtggtaggtctccagcgcctcgttgcgccggccggcctggaggagggcgagcatcagctgcccgtgcaggttctcatgcagcgggtggctggccgcgagctcgcgcaggtcgctgagtacttccaggtggttgccgagctggagttcgagcgcgatgagcttctcggtggtgttcagccgggactcgtcgacacggtcggcccacgtccgcaggaccgggccgcagttgatgtcggccagcgcgggcccgcgccacagctgcaacgccgcgcggtagtgccgcaccgcctcctctgcctgccgggcccggcgggccgtgtccgccttctccaccaggcggacgtactgcgcggagtcgtgccgctcgcagggaacccgcaggaggtagccgccggggtgggtggccagtacccgttccgcgatgtactgggaggtggtctccatggcgcctgccagggagcggcgcagctggccgacgtaggtctgcaccgtggcggcggcggtccgaggggggctgtcttcccagagttcgcggtagagatcttcggtgagagtcagcttgttggcccggaccgataaaagggccaggacctggcgctgcttcggagcactcggggaggcgctgcgctgcgcggctgaaacgagtaatgccccgagcacgttggcggatatgtccataatgcactctcccccttgtcgtgacccgtcgggcgggccaggtcttgcgctattggatcgacgctgcggagacaagcccatcattcggagatcaacatgcggaagctatcacgtcctcagaggtgcaggcgatatttttccgcttccttgacattgctctcagttgactggatcgcgttcttccatttgatgtcggcgacgggattcaagggaattttcggggcattgtcgtcgcgatatcccgtgggccgtgagccgccgtccggggcgccggggaggcctcccggcggcaggaggggccggtcggcgtgggtgaccgtccagcggtccgtggcaccgccggaccttgcatacgaacaggtcggaaggcatatgcgacgggcggtgccgtgtccgtggggcgcagggctggtgtgagcgctcccacgactgagaggggagcgctcccacgtgtatcggtgacgccccgtccgctcaggcgccgtcgattttccgccgccggcacggcgcggcgggtggcgcatcagcgacgtccgagtcgcccgctgtgccctgatcccctacagtccggacgccgacgcccccgtgagccccgtgcggccgggcggcgtcctacccgtgtgagcgaaccgagagagggcggcgaatgaggcaacgacggatcggcggggagtcgggactggacgccagcgccctgtgtctgggggccatgcacttcgggacctcgacagacgaggccaccgccttcgctgtcctggaccggttcctggaggccggaggcaccttcatcgacaccgccaacacctacgccttctgggtcgagggcggcacgggcgaggagagcgaggcgctgatcggccggtggctgcgcagccgcggggtgcgcgaccaagtggtgctggccaccaaggtgggcgccctgcccgagccgctgggcgctccgtggcccgaggccgccgagggactgtccgcgcaggtgatccagcgtcaggtcaaggcgagcctggagcggctggggaccgagtggatcgacgtctactacgcccatatcgaggaccggagaacgcccctggaggagaccgtgggggccttcggagaactcgtcgagggcggctccgtccggctgctgggctgcagcaaccacgccgcctggcggatcgaacgcgcacgggccctcgcgcgggagacgggagtggccagctacacctgtattcagcagcgagccacctacctccggccgcggccgggggccgacttcggcgccaacccgcatgtcagcgaggagctgctcgactacgtcgccggtgaaccggatctgacgctcctcggctactccaccctgctgggcggggcgctctcgcgtgcggaccgtcccgttcccgagcagtacgaccaccccggaacctcggcccggctgaccgccctggcccgggtcgcggacgagaccggcaccacgcgcaaccaggtggcactggcctggctcatgcggagcacgcccagtgtgcttcccgtgatcggcgtgagctcggtggcccagctggaggaatgcctcgccgcggtcgacctggacctggaccccacccacctcgaatgcctgaacaacgcctgatccatgtagcttccaccacgcgagagcccggcccccgacgaccgtgtgtcgccgggggccgcggcatgtccgggggcgtatcggagtcggccgcgggggccgttggaccggcatgcgccgaccggagcagcatgcgatgccgatcgagtcacctgagtcacctgagtcacctcgagcggccgggctgtggcgtcccgagccgccgtacctcagaatcccgagccgccctgaccgcctggcccgcgcgggcccccgttgcgacccacttccgtcgatcgaaccccgggggcgccgtccgcctgctcgaagctcacgagctgccgagacccgcttcagcggtcccagcgccccaccgggccccgccttgccgacctcaccggttccatcggcctctcctctccggcatctccgggcgcggaacccgcttcccaccagcctgtgccgcgaccggccgggcactgaaggctcccgaaagtcccgctcactcgtgcccgcaggaccgcccaagggccggcgaaatgtggccgcagccggtccagtgggccggcaggcggggggctggagagcagccaggggcacagtggaagacggccgagtgcggttccgcgccgacggcgcgggagggggcccggaaaccctctctgaccggtggcttcgagcaccgcccgggtccgacgccggtcccggtcgccggagccggacccgcgccgtgccgccggcccgcatccgtgacgcagcgatcgcggcgggcttgtcggccgccctggcgccctgcactctctgcacggccacccggaccgtcgggccacaacggcgcgccccggccccggtcgccctcaccgcacgtgtcacctccgttcgcacgacccgtcgcgggcacggcccccggcccggcccgcgacgcccgcaaaggagagccatgagcacgcgcaacgcccccacaccagcagcgcgcccctccggtgggctcccactccccgaggccgccgcgcgatgccgacccggatgcccccgccggcgcagttacgaccccggtggagcggcggcatgaccttcaccacggaaccgcggctgcgcgagcccacggccgcccacggcaggggagcgcgggacctcgtgcggctgctgcggccccggcagtggccgaagaacgtggtggccgtcgccctgccgctgtgcggcggcgcccactggacctggtacaccctgtcccggatgagctgggccatcacggtgttcgtcctggcctcctcgatcgtctacgtggtcaacgacgtggccgaccgtgaacgggaccgcctgcaccccgtcaagcgcctgcggccgatcgcctccggcaaggtctccgtccgggcggccctgctgtgtgccgtcgcgctcgccatgacgctggccgcggtcaccgcgctgggcccctggcggaccgcctggcccgtggccgggtacgtcctgctcaacctgctctacagccaccggctcaagcacgtcgccctcgtcgacgtgttcgtcgtggcggccggcttcggcctcagggtcgtcatgggagccctcgccggcggcataccgctgtcggtgtggctggtgctgtcggtgtacgcggcttcggtgatgatcagcctcggcaagcggcgccacgagctgggcctcggcgcgggtgccggtcgccaccgccccaccctggagggctactcgcgccagctcctcgaccaggcggtgctcgtcaccgccggcgtcgcgatgctgggctacacctgcttcctgcgcagcgacgcgacccagcccttcggccaggtggccctgctgctgaccattccgttcgtgctgtacgggctgttccgctacctccagatagtcatgacggagggcggcggcggagatcccgcggagacgctgctgcgtgaccgtcgggtcgttgtgagcgcgctgctgtgctgcgcctgcctcgccctcacctcgttcctgtccgcgcatccggcactcgtgagcgggcttccgagccgatgacgagcggcccctgggaagccctgggaaaggcgagatgaaatccgagaccccgaccgtttccgtcatcatccccaactacaactacgagaagacactgcccgcctgcctggatgccgtcttcgcgcagaccctccagccactggaggtcgtcgtcgtcgacgacgccagcacggacagctcccgggagatcatccgcagatacacctgcaccctgatcgagaatccgggcaacagcggcgtttcggcggtgcgtaaccgcggcgccgcggccagccggggagacatcctcttcttcgtcgactccgacgtggccctcgcccccgacgcgctggagaacgcggtccgcgtcctcaccgaggatcccggctgcggcttcgtgcacggcgtgcccgccgccgagcccctcttcgacgacggcctcgtcgagcggtaccgcgtactgcacgcccaccacttccaccgccgcagcgtaggcgtcgtcgcctcggcgttcttcgcgctcggcgcggtgcggcgcgaggtcttcgaggcggtcggcccgctgaacgaacggctgcgcgactccgaggacctcgagtacagcaaccgtctgcacggacgctgcctgatccggctgacggacaccattacgggccgccacgacgacgccgacagcctgcgctccctgctgcgcgaacaggcccggcgcgcccagttgctcatcccgttcgccgccgcgcaccgggcgcgtaagaacgcgatccgcgcgcacagcatggtgggtgtcctcgccgccgccctcaccctggcgacgctgccgctgctgccgtacgccccgctggtaccggccctgtgcctgctcgccgccgtcctgtccgatcccggactctcccgcttcgtgctgcgcgagcgtggcccggccttcctcgtctacttcaccggcgtccacctgctggtgcagatgtcgatcgcgctgggcgccgcgtggggcggactgcgaatgctggccgaccggcgcttcggacggccggccgtcgccgcggcgggccccccgaccggggcgtccgcatgaccaccgtcaccgagtccgcgccgaaggcggccacgaccgggcggagcctccggcgcaccgcgctgtcagccgcgttcttcctggccgcctcggccgggctgtggttgtcgctgcgcggccgcgtcggcgcgttcgccgacctggcgctgcgtccggccgccgcgccctacctgctggccgccttcgccgccaacggcgccggcgtgctgatctccctgttcacctggcgcgccttgctggccggcctgggaccgccgaccccgctgccggtcgctgcccggatctacttcacctccttcctcggcaagttcgtccccggccgggtctggggcctgctcgcccagctacgcctgggccgggccgcgggcttctccaacgcggtcatgaccggggtcttcttgctgaacctcatggtcggcacgctcaccgggctcgccctgggcctgatctgcgggccggagctgctgggcggccaggcctggtggctgctgctgccggtctgcctccttgcggtgtggaccgcccggcccggcctgctcaacagcgctgtcgccatggcactgcggctggcacacagaaagcctcccgagacgggcgcgagcgacgccggcatgcggctcagcatcgccgccgcgactggctcctggctggtctccgggatccacctgtggctgctggccgtcctgttcggcgccgacgcgccgcgcgcgctgccgctgtgcgtgggcggattcgcgctggccaccgcgctcagcagccttgccgtcgtcctgccggacggctggggagcccgtgaggcgatcctcatgctggcgctctccgccgtactgccctggtccacggcgggcgcggtggcggtgagcagccgcgtcgtgtgcaccgcgagcgagatcgccgtcgccggcggcgccctgctgtacgcccggcgcgccgcccggacccgcggtccggccccggccgccgtgtcctcctcccgaccgagtcccgtacccgacgcgcacccgaagacaggggaacaatgacaatgaccaagctgctgaccatcgacgacacccaggccctgacggcgaagcaggtgcacgacctgtaccgtcggcatgtcaaccgcagccaggtgtccctgatgacgtccttcgggttcggccgggaactggtcgagcgcgccgagggcgcctacctctaccagcgcgacggccggcgcatcctcgacttcaccggcggcgtcggcgtgctcaaccacgggcacaaccacccgcgcatcctggccgcccgccggcgcttccaggaagagcagcggatggaggtgcacaagacctacttctcgccctacgtcgccgccctcggccacaacctggcccagctcctgccgggcgacctgaacatgtccttcttccccaactccggcgccgaggcggtggagggcgcggtgaagctcgcgtacaagtaccacaacggctcccggcggcgcgtcctgcgcgcggacatcgccttccacggcaagctgctaggctcgggcagcctcaccgggcaggctcaggagacgttccgcttccccgggatctcaggagtgaccgcctacccgtacggcgacctcgacgcgatccgtgcggaagtcgccaagtcccgtacggccaagggcgagagcgatgtctacgcgatcctggtggagccgttcagtgcctccaccatgcgctggtgctccgaggagttcctgcgcggcctgcgcgccctgtgcacgcgcgaggacatcgtcctgatcttcgacgagatctacaccggctggggcaagaccggcagcctcttctacttcatgcgccacccggacctcgtcccggacatcgtgacgacgtcgaagtccttcggcggcggcaagtcctccgtctccgcctacgtcgcccgggagcccgtcttccgccgcgcgtacgacaacatgatggacgccctgctgcagagcaccagcacgacgtactacggcttcggcgaggagaccgctactgccatcgaggcgatcaacgtcgtggtggaggacgactaccccgcccgcgcccgggcgatcgagcgcgtcctcgcccccggtctcgaacgcatcgccaaggaacacgcggagaccgtgaccgaggtgcgcggcgccggagcgctgcacggggtcttcctgcgggagggcccgaaactgctggagcacgcggccaggctcgtgcccggcggcatgaccaaggacccccggttcctgaccaagctgatcacctcgtcggtcgtgaacgcgctctaccgcgagcatgacatctacacctactacacgctcaacgggcgcaacccgctggtcgtcggtccctccctgatcgtggagcagcccgaggtcgagcggttcctggaagccctggacaagacccttgccaaggggcttccccgtctgctcaccaagttcgtccaggagaaggtgtcgtcgctgtggtgaacaacgtggtggtgaccggcggagccggcatgctgggctccagcctgatcgcgcggctgctcgacgagggacaccgggtccgctgcgtcgacctgcgcgcccccgacacctcccgctgggccccggccggcgcggacggacgcccgcgcggcgaactcgacgtcacggtcgccgacgtccgtgacggcgccgcgatgaagaacgccctcgcggacgccgacgcggtcgtgcactgcgccgcagcgctgcccagctacccggacgaccagatccgctcggtgatcgtcggcggcacccgcagcgtgctcaccgcggccgccgcccagggcgtgccccgcttcgtccatatttcctcgacggccgtctacggcctgccgaaggtcgtccccaccaccgaggagtacccgcggcggccggtcgacacctacagcgcggccaaggcagaggcggaggaggtgtgcgagcagttccgcggcggcgacatgtgcctgccgatcctgcgccccaagaccttcctcggacccggtcggatgggcctgttcgcgatgctcttcgaatgggccgaggagggccgcaacttccccgtcctcggacggggtgacgtccgcatccagatgttcgacgtcaacgacctcgtcagcgccgtgggcaccgcgctgcacgcacccgccgaacaggcggacgacaccttcaacctgggcgccaccgccttcggcaccctgcgggaggacttccaggcggtgctggacaccgccggccacggcaagcgggtggtgtcgctgcccgcccggcccgccctcgccgcgctgcgtgttctggagcgcagccgcctctccccggtctacggccgcctgctgcacaagctgctcgacgactccttcgtcagcaccgacaaggccaaggagcgcttgggcttcaaaccccgctactccaaccagcagtccatcctgcggacctacgagtggtggcggcagcagcgcctgaagtccgcggcccggcccgccgccggaggcgtcaccagcgt

SEQ ID NO: 260 - DNA, 7039 bp, Unknown
  Kingdom: Bacteria, Phylum: Actinobacteria, Class: Actinobacteria, Order: Streptomycetales, Family: Streptomycetaceae, Genus: Streptomyces
gcggtgcggttcgtacggccccgcacgcccgcccagcaggaggaaggggtacgccggtgaacctgacgatgcccgtgctggtcggcgcggtggccggcctcgggatctacgccctcgtacgcgcactgatgcccaccaagcgcagctccgtcgcgcaggtcgcgcggatcgacgccatgcgggcgcgcggcgcggcgtacgagaccgcgcaccggacgccggagacgagcggccggttcggcgcgctgcgcgcccaggtcggcgcccgcgtcgccgagttctacctgcagcagggctgggagcagcgttccctgcgcgctgacctggcggtgctggagcgcggctgggagaggttcctggcgacgaaggcgctgctggccgtggccggcctgttcttcgggccgctgctcttcgccgtcgtctacacgctcggcttcggccgcagcccggtcatcccggtctggctggcgctgacgtgcgccgcgctgttcttcttcctgcccgacctggaggtacgccgggacgcggccgacaagcggcgcgacctgcgccgggtcatcggggcgtacctggacctcgtgtcgatgagcctggccggcgggcgcggtctgccggaggcgctgatggcggcggccgagatctccgacggctgggccaaccagcgcatccgcaacgccctcgccgacgcccgcatcaccggtgtcagccagtggcaggcgctcggccagctcggtgaggaactgggcgtggaggagctgaaggacctgtcggcctcgctggccctggtcgcggacgacggcgcgaaggtacgcgaatcgctcgcctcccgtgccgagaccatgcgccaccgtgaactggccgagatcgagggcagcgcgggcgagaagtcgcagtcgatgctggtggcccagttgctgctgtgcgccggcttcctggtgttcctgatcttcccggcggcaatgcgggtgttccaggtgtgagtcgtcgtgtgaaccgtgctgcatgccaactgccctgcccactgcactggccccaagccaagtcgagaggaaaaccgtcatgaacgcaaaggacgcgagggacttccggaccggaatcccggccgtggatttcctggtcaccttcctgcacggacgcgtccagcgcgcccgctccggtgaactggaccgcggcgcctccgcggtcgagtgggtcatcatctccgcggtcgtggtggcgatcgtcggcgtggtggccgccatcatcaactccgcgctgagcgagggcgccaacaaggtcggcaactgcatcaagggcgcggacgcgggcaagacctgctgagcgcggcgtacgaggacgtacggcaggcgtacgacgaggatgcaacggggttgacggggatgctggcggacgtgggcagacgggtgtgccgcgggatacgccgtggcgtgggccgacgggtgtcggccacgcgcgaggcggtcgccgtccgcggcgactccggcatgacggcgatcgagttcgtgctgctcacgccggtcctgttcttcatgatcttcgccacgatccagttcggcctgtacttcttcgccgaccacgtcgcccaggcggcagcccaggccggcgcccgcaaggcccgcgccacggccgacgagcagcccggcgcctggcgcggcgaggcccgtgacaccgtggacgcctacatccgccagctgggcccgcagctcgtcctctccccggacgtgaagatgctccagccggagcagaacacggtgggcgtggagatctcggcgcgcatcccgacggtgttcccgggcctgaacctgacggtgcacgcccagtcgtcgggcccggtggagcggttcgtgaaggagggcgggaactagatggacaccggtttcctgacgggccgcccgcgctccgcgggccgtctgttctccgcgagcgccatgcgctcggccgaccgcccgggttccgcggactccctgggcggcgacaggggcctgtcgaccgtcgaggtcgtgatcctggcccccgtgatgatcctcttcatcctcgtcctggtcggcctgggccagctcgtcgacggccgcggcgcgatcgacggcgcggcccgggacgcggcccgcgcgggttccatccagaaggaccacggtacggccctggccgaggcgcgcagggcggcggaggccgacctgtccgacgtctgctccggcccggtctccgtcgtacagaccagcgccggcttcgaaccggacaccctcttcacggtcgaggtcagctgccaggtgcggggcctggcgatgctcggcctgaacatcccgacccggctgtcggcgagcttcagctctccgctggacccgttccggaggacggtgtgaggcatgccccgcgggccttcgtgcaggcccgccgctcccggatggacgaccgcggctcgggcgccggcgcggtcatcatcttcgcgctggtcttcctctccctcgccgccttcgtcatcgacggcggcctgtccgtctccaagcgcgaacgcgccgccgacatagcggaacaggccgcccgctacgccgcccaggacatcgacaaggaagccctctacgacaaccagaacggccccgcccccatcaagtaccaggactgcgacgcccgcgtacgcgccttcgcccgccagatgggcatgacgggctcggacatcgccgcgagccactgcgtggcggcctccgccgaccaggtccaggtggagatccagctgacctactcacccgtgttcacaggggtgttctacggcgggagcgtggtggtccacggggagtcggtggcgaagaacgaggtggggtgaggtgcgggacgatgagtgatcgggaagcggacatgaccgacgacctttcccggctcggcctggagtgctcggaggactgggtgccgttcccggtcgccgggagcgtggacctggactactgggccaggcaccaggccgcagaactcgtcgaacgctacgcgcgggacggacgggagggtgacgcccggcgcctggcacgcgacctcagacgcacggcagccgactgccacacgcgcgacccgctcgccgccttcgggtggtacctgagcggccacgactcggtggcggccatcctggaactcgacgccatccacccggacgaaacgttccccgaggttacgctcgacctgctggccgagcgcatgacggcccatgacctcggcgagccggaggtacgcgaggtacggcttccgctcggcgaggccgtccgcatccgtcagaacctcatcggcgagaagaagggcttcttcggcccccgcccggtgatccacacggtgttctacggcgtccgcccaaagggcctggaagtggccctcacgctgctgacctcctggacggagccgatcctggacgagccggccgcacagatggccgacaacatcgcgcggacgctttcggtgtgacggcgcgaagatgcccgacggacatccggtgggcgacctcgctgcgtggcgacgccctgactcccgtcagacggctgggacggcctcgacccgagtgcgggtggccgttgccgcaccgccgcaacgacgggtgtcgttggcacagaccgtggacctggcggactggcgtgggggtcggcgcgggtccaggccatcggcgtgggcattgctgccgctccactccactgcgacggcagccatggccaccatgagccgtgaagtcgccgacggcctcacgcctggcactccttcgccttgccgacgacctcgatcaccgatgccttccaggcggtggaggaaccggacggcggcatcatcaggaggctgtacttcaggtagctgttgaggctttccttcgtgtagaggaccttgccggtcttgatctccttgccgtagaacttggcctggttctcgcagaacttgaccaggacgcccttgccgtcactcagcgtcgtggcatgcccgttgtagtacctgtcggtcccgtagggggtccagcctcctttgacccaggactggatctgggacttcacatatcgcgccgcctgactgcccacgatcgagtagtactggtacccggggtcctccgggttctgcgccgccaagccgtgggcgagcgcgcggaggtagttctgggcgtcggcgagtgccgccgcctggtttgcgtccgacggcttgccgaagtcgaagacaatcttcagccctttggggaggccgatgtcggggccgtcgccttcggctgtggcgggcaccgaagccgaggggctgcccgtctgcgtgtccgcccccttggtggcatccggcttggagtcgcttccgccgccgcaggcggtgaggagcagggccgccgtcgcggtgagtgcggcggtggtggcggtcagggcgcggcgggccacggttgatctccccccggggggtttgatgggtcgcgggtggtgggtgagcggcaggaaccgaaagtacagggtaggtaacgggtgggcgtggccatgttgcgatgtcggtcgggctgagagctgatcagagactgccggaagccgggtaggcatgcggtctgccgagccgtacgccaggagaccgggaattggcccctggaatcacggactcgaggcgcacttcgaagaggttgccttcgtggacgaccaggtcagccttcttggcttcagagggccttcagcctctagccttcaagccttcagttctggagaacacaaggtggaaccgcaatgcggtgaagtgtttcgcggaccattcttccttgccgaatcaataacgggctgatgctgaaagggggaggcaaagttcggtgggcgtggtgcgtcaggggatctcagcggttgaccgactggatttcctggacgttgacgtcctgggtggtgtcgaaggtgccgttggggaggctgccgccggtgccgtcgctgcccttccaggtgatctgccaggtgagggatgccttgagctggtacggggtgccgttggtggcgcggaagtaggtgatgccgcagggcggggtcttgtcggcgtcaccgggttcgtagggggcgccgatcgagccgtcgctgttgaaggtgcagtcaccggaggacgggaaggtctgggcgtcgtccgtgccgggggtgaggtgaagggcgatgggcttggccgtggtctcggcccacaggccggcgcgggggagttcggcgcggacggtgatcggctggaaggtgtccttgttcagccagacccaggttggcaggttgaccgtggactggggcgctggtttcagctggatctcggtctcagggaccttgatcttgttgtaggcgtagtcggcgagcatcttcggagtaggcgcgtgagggtcgttgggtaccttgccggcgtcgacccagaacatgatgcgcccgcagtcccaggagtccgggttcgcctcgttgggcgcgacgccacgccagaagtagccgttcttaccgaggttgtagtccttgtagccctcagcgctgctgttgccgggtgagttcacatcgaagttgtcggccggcttgccgtcacggtagtgatcggtccacagttctttgccccaccaggactcatggataccgacatcgccaccgccgtccgtgtcgacgaacttcttcagctcggcaggtgtgtaggcaggctcgtaccagcatgccgggggcttccaattgggatcgaccgtgccgaggctaccccgctttccagtgccgttccccccgcgaacgtatcggatctggatatgggaaaccgaggccgaaagagttccgttgccgctgctgttcccgcttggatggtcggccggcggcacggtggtgttgtcttccgggcctgccgcgtaggccatacttcccgaccacaggacagccgctgctgtcagaaacgttgcggaccagcctcgaaggggccgtgcggacgtcatcgccggcactccgacacgcgcccctgcacctcgatctggatgaccttccagatctttcggctaccgttgggcggccccatgaggaggcgatactcctgatagtcgtcgaggctcgccttcgtgtatttgatcttgttcgtcttgacgttcttgccgtagaacttgctctggtcgcggcacatcctgaccagcacaccgccggaggagccgacgttgtcggtcctgaccttgtagtagctgtcggttccggtcgctgtccacttgtcgttcacccacgcctggatctgtgtcctggcgtacctggtcgcatttccaagtgaatagaactgatacgcagggtctttggggtcctgggcagtgatgccgtgattcagggcaaggatgtagttcttcgcgttctccagggctgccgcatgtcccgcgccggacgactgctggctgtcgaactccacgtgcaggtcgctagggaggctcaggtccggcctgccggaggcgggcgccgacgccgaagccgaccccgaagggcttcccgcccctgtgtccgcccccttgatggcatccggcttggagtcgctcccgccgccgcaggcggtgaggagcagggccgctgtggcggtgagtgcggcggcggtggcagtcagggcgcggcgggccacagttgatctcccccgggttcgacggcttgcggacgactgtgcggcagggatcgaagctaccagggggagccgaggggcagtcgagtggttcaggggggttcgtgggggaagtcgagaggattcgtgcggggggtgtgagcggtcgtggtggtgctggacgccgaggagagggcggggagagatcgggaggacggcggcgtcgcccgggtccataagatctctgtaggctcagaacacctttctgccgtgccctttcatcacacgacccaggacacccgccatgccgcgacgtcgtagttccagctcgtcaagctcgtcgggaaacgcgtcggctccgaggaatcggacgccgcagccggtgcgggtgaggcgacgtacgttcggggacttcgtgaaggcgttcttcgccttcgtcgcgctgctggtcctgctcgtcggtgtgccgggagcgctcgcggtcgagtgcgggtggccgttgccgcac

SEQ ID NO: 261 - DNA, 4489 bp, Unknown
  Kingdom: Bacteria, Phylum: Actinobacteria, Class: Actinobacteria, Order: Streptomycetales, Family: Streptomycetaceae, Genus: Streptomyces
aggcgctggtcctgggcggcggcgcggcggccgtgtacggggtcggccatccagcgccggcggtcgccctggccgtcctggtcgtcgggaacacggcagtggcggagacgtcccggcgcacgcgacccgcagcccccgggccgccgcccgcgcccccgtcaccggaccgctgaagcggagcccttcccctggggagcagtgacaccgacgtccaggaaccggccccgcactcctgctttcgtgatcagcctgaccgccgcatccaggccgtgagttgccggtgccttttcagcgcgagcgcaacgtccgtcgtaccgcactgacgaggttgtgagcgtcaacgccgtacacggctccaggtcgcacggtgccgtgccggtggcaaggaattccgcgtagccaggatcctcccggtctgacgcgtagccccgccgtgtctccaggtgccaagccgagtggtcgaacgtctcaaagagccgcccgaactcccccaggtcgatcagcttgggcacgcgggtgacctccttgggcccgtgattgacgaggagttcacgcggcacgatcactgcggcatctccgggacagaagtgctggagacgggcgatgtccttggggtcggtgagcgggtgtgccctccagaaccgtaaggatcacggcctcgttctcgtcgagagtcagggcccctgggcgcccgctgccactcggtcaaggccgctcggaccaccctcggcggactgccctggtgaaggcgtcccacgccgatgcgtctacggccgccacgtgggtgtcgccgagcttggtgtcgcgcaggagcacccgatcaccgtgacgagcgcactcgacgcattcgccccccgcgccgttgctgtaggacgacttgatccatgagcgcagggtctcggtgttccctcgggtgatgctcatcgcgcgtactccttcacaacgttcttgaggaactgggtggtccgtcgtgggctcagggccgctgcccgcaactcgtcgaaggcacgtgtgtactcacggacatgcggctcaccctccaagtacatcgcatcggtgattccgtcccggtacacgacgtccgggtcctcagcgtcggggaagcccaacatggtgaacgagcccgtggtcgggctcgtgccggcgtcgaaggggagtacctgaagcgtcacgctgggctgctccacgacgtcgagcacgtgctccaactgcgcacgcatcacctgccggtcaccgatgactcgccgcacggccccctcactcacgacgaaccagcagtccggggcgccggtgctcgcgagcatggactgtcgctccagccgtactcgtacggcacggtcggtgtcctcgggggacaggtgcgagccgcacgtgtgaagctcgcgcacgtagggctcgatctgcatgaggccgggcagcacctcgcactggtactgacgcaacgtggacgcgtcttgttcgaggccgatgtagatggagaaccactccgggactccggagccgtgcacctgccaccagccgcgcgtcttggcctgtcgggcaagtgacttgaggaactcccgcagttcgccgctggtgtcgtagaagcgacacagcgcatcgatgtcggagggctggacccgcccgctgccggtctccatgcgattgaccttggagccgctccagtcaagggcggcaccgacctgtgcgcaggtcaacgcgttcttctcccgcagcttcttcagctcgatggagagacgacggcgacgtgccgtcggtgatccggccatctgttctggatcccttcgtgtcgaacggccctcagtctccgcgccgttgccatctgccgccagtcactcgatcgtgggattctctgcgtgcacattgcacgacgggattcgcgctggccattctggcggaggaaaacgaccgatgcgggactggtccccggttcggtgtcgtccgcgcggaccggaaagcgttggagggttcggaagtgatcccaggaacatgcatggtgcgaacgccgtgggtcgtggagttcacggccctggaggcggaggtggcggccctgcggcgcggggtgcgggaccacctcgacgcatgggggttgcagggcctggtggacgaggcgcagctctgcgtgagtgagctcgtggccaacgtcatcagtcacgtgggtgccggaaccccgacgaccctggcggtgctgatgaacggctcgttcctgcgcatcgaggtgcacgaccccgacagccgcgccctgcccacgctcgtcgatgcggacgccgagtcggaaggcggccggggcatggcgctcgttgcggcgatcagcgaccgctggggcgttcgcctcctcgccgaccggaaggtgacctggtgcgaactcgagacggacctgccgtcgtcgggaggccacgacggaggcgcccgggtggcccgtgccgaggcgatgatcgacctctacggtgcctcggggccacagattcgttcgcgcatcggcaggctgggcgttgccgagggggaggaggcggcgatcttcatcatcaccgacctcctccactggctccggacgcacggtcgtgacgcggacgaggtgctggaccgtgcccagatgcggttcgagacccaggtggccgaagtcggctcgtgacctgggtccgcggacgtcagggggcgagggcggccccgaagaaccccagagcgggctcttcgggcgtccccaccagcagcgcgcggtcgagcaggatgttgttgtgttcgcagcttgtctcggggagcatcacgcaggcgtggcaggcggcgaggttggtgccgtcggcgccggacaccgcggtctccatgcaaagaggatcggaggaacaccactcggcacggcggacggcggaacggatcgtccggtcgaggtcgtccggctcgccctgcgcgacaagaccaccgaggctgcccgccgagtcgctcgtcgccgtgtagatgagcactccggccatatcatcggcggcgtacaggcgctcacgcaaggacgcggacgggtagcccgcctccaggctccactcgttgatgaggacatgggccaaggtgtgcaacagcaccatgcggggcgtcgccggggacggcacggcccgactcgggtcgtcggcccgctgttcgagcacccgctggtgagcggtacgcatgcgttcgacccgggccgcggccgttgtcgccttctcccaggcgtccagtcggttctcgtccaggcgcaggaagactccctcgccctggacctccatggccggcagccagcgcaagggcttctcggagagcgccatctccttcgcgtcggtcgtcgactcggcgtcgacgagtcgggtgaacgccttcagagcccgcacctcgcggagcttcttgactagcatcgggccggtgatcccgagcggctggagcacgttcgggtcaccaagcggcgtctcgcagacgaactgttcgtcgcgggagtgctcgctctcgtcgttgcccgagcgcaggcgctcgtactccttgttgcgcagggcgcggtagcggtggtcgaagctcggctccgtctcgccctccgggtcctcctcgcgttccgcgtcgagcagggccatgacctcgtccagcggaatcggacacgcgcccttgaaggcgcccttgaggtagatcccgatgtgctcgcggttgtcgaactgacgaagagcgtcccagtgttcggcgagcggatccgcgcggccgttgctccacggagggatggacagcgccgacttcagtaccggctgccataccgatgaagaaccgcgttgcagggtgcgcaaggggagtccgcaccccgcagggtccgtggcggagaggccgagccacgggcgggcacctcggcaggtgagacgcaggtccttcagcgcgttcctgcggaaggagccctccatcgagacctcgggcacctgaccgcaggtgcaggagatgacgatggagcgcagcgaggcagtgcgtcccgtcgtgcgcatcctgagcttgccgccgcacttcccgagcctcgtggcatcccggtcgggcgagcgatgcacccactgccagtaggggaactcgtcgaggtgcccggcctcacaggcgacgacgaagcgggaggggacgaggtccacctcgcacgcgccacagacgcttcgaccggccggtggtgagaagtcgcggtgcggttgcagttcgttgcactcgggacacgagtgcatcagggggaagcgacggacccgaagaccgtccttgctggtgtcctcggacgccggcggcagccgaaagtggtcgacgtcgagcagacgggccaggcgtcgctcatggacgacgggtgactcgtccttgctccagctccggtcggcctcgtccagacccgagacgacgaaggactcgtggtccacggcgatgagcgatccgacgccgtaggtggtgatcacctgggcgcggcggaccgtgccgcggcggggaaagttgtgggccggggcggccccgttcgctgcggtcc

SEQ ID NO: 262 - DNA, 1689 bp, Unknown
  Kingdom: Bacteria, Phylum: Actinobacteria, Class: Actinobacteria, Order: Streptomycetales, Family: Streptomycetaceae, Genus: Streptomyces
ctggtgtcgaaggcgttcaccccgcggacggtggagcgcctgaagccgtacgtccaccgcctggcgggcgaactcgtcgccgggctcgtgcgggcgggcggcggcgacctgctggcggacgtcgccgagccgctgccggtcgcggtgatcgcggagatgctgggcatcccggagcaggaccggtaccggttgcggccctggtcggcggacatctgcgggatgtacgagctgaacccgtccgaggagacggcggcgaaggcggtgcgggcgtcggtggagttctcggagtacctccgtgagctgatcgcggtccgccgggccgagccgggcgaggacctgatctccgggctgatcgcggcgcacgacgagggcgaccggctcacggagcaggagatgatctccacggccgtactgctcctcaacgccggtcacgaggccacggtgaacgcgaccgccaacggctggtgggccctgttccgcaacccggaccagttggcggcgctgcgcgcggaccactccctggttccgtccgccgtcgaggaactgatgcgctacgacacgccgttgcagctcttcgagcggtgggtgctggacgagatcgagatcgacggcacgacgatcccgaggggagcggagatcgccatgctcttcggctcggccaaccacgacccggacgtcttcacagcgccggaccgcctcgacctcacgcgcgccgacaacccccacatctccttcagcgccggcatccactactgcatcggcgcccccctggcccgcatcgaactggccgcctccatgacggccctcctggaacaggccccgaccctgcgcctgacggcggacccgcagcgcaggccgaacttcgtgatgcgcggcctgaaggggctgagcgtggagctgggctgatcacccgttcggctgatcactcggaggaaccaccgcgctggtgatcaaccgctcggcaagctggtgcgcgcctgcggagggaggcaccatgacggttatggcagagcgcacgtcgcggacgtcccagatgtcggtggaggagttcgagcggatcgcccggttcgcggccacggagaccgacgacgccgtcaggttcgagttcatcgacggacggatcggggtcaagaaggtggctgacggagaccacgacagcattctcgtgtggctgagcaagcgctgcatgcaggctcgtcctgatctcgacctgtaccagggccgcgggctgcgcgtggagaagtaccgcgagggcagggcacgtccggacgcggtgctcgttccggaggaccatttcgccgggcacggggagtgggccgacccgagtggcgtcctcctggtcgtcgaggtcacgtcgtacgactccgacaccgaccggcgcgaccggcaggagaagcccgtcgcgtacggggcggcggagatcccgttctacttgctggtcgaccgggacgcctgtgtggtgacgctgtacagcgacccggatccgggtgtggggtaccgcaacagccgcagggtccgtttcggggaccagcttgtgctcccggaccccctcggtatcgagctggacaccgagaggctgaagcggtacgtcgattgagcccggccggtcaaccggccagatcccgccgccgcacccccgtcagccccgtgcccaccagcactgccgccaccccgagcagcaccgtcacc

SEQ ID NO: 263 - DNA, 672 bp, Unknown
  Kingdom: Bacteria, Phylum: Actinobacteria, Class: Actinobacteria, Order: Streptomycetales, Family: Streptomycetaceae, Genus: Streptomyces
cgtccatcgcggcggccagcgccaccgaacgctccaacgcgccctccaggaccggcagtcccacgtgcagcagcccgcgcacgccacggtcgggcctgccgcgcagtctgcgggcggcccgcagcctgcggccgtcggccaccaggtgcggggcgaaggtgagcgcgacgacgacggccacacccatctcgtacagcgcgccgggcagcgacttgagcaggcgggccggggcggcgagcgcgttggccgcgcccacgcagatcagcagcgcggccagcttcaggccgtcgtacagggcgaacagcagcgcctcggccgtgacccggccgcccagccggatgccctgcgcccagtgcggcagcgggacttcggggagcgtgacgagcacgtgcgtgccggggatgggcgagccgaggacgacggcgaagaacagccggatggcgaggacggcgagcgccagccgcaggaaggcggtgtaggagcgcgccgagggggtgttcgggcggcacgtgacgacgacgtagccggagaccgtgaggagcagggcgagcagcagcgggttggtggtgcgggtggcaccggtaccgagcgccagcgcccacagccaccaggcgcccgcgtgcacgccgggtgcggagcggtgggcgcgcggaccggccaggggggtgcggg

SEQ ID NO: 264 - DNA, 21136 bp, Unknown
  Kingdom: Bacteria, Phylum: Actinobacteria, Class: Actinobacteria, Order: Streptomycetales, Family: Streptomycetaceae, Genus: Streptomyces
gcgggcgcaccggtgcgcccggtgcaccgccccgagcggacggattcgatcggtcgttgcaacgctggttggtgggagccatccgaggtcggagcgcatgcggccggcgatcgcccagccggccaggcgccgggaagcacggtcgctgaccgtggccaggcacagaaatttcccgccggccagcgggaggtaggtgatgtctccgacgtacttgcgtgacgtcgccccgtccgccggtccggacggccgccaggccggcacgggcgggcgggcggagcaagacggcgaacggccaacgtcaggacgcccgggccgtcgtcgctgctggccaaggccgaccgggaggggaccggtcctccgcccgtccttgctgcgcgctgctcgcatgacggcgtgatcgtttctgcggtgaagccgttcgcccatccggacgggaccagcactgaacaccgcccaagctcacctgtggtccggctatgaacatgccaccacgccacccgggcgctgctgcctccctacaacgtcctgctgcgcctgctgctggcggccggccatcccgaggcatcccgggacatccgcctggacggactgacggaagccctccccaaggcccaccgggtgccccgggtgaccgtcgacggcaccctggtcgtcagcccggccacctggcgggtgccccggcgcttgctgtggcggcccggggacagcgacttggccaaggtacgcgcgctcaccggcctgcaccgcgacgccgccctcccccgcttcgcgttcgtcagggccgccccaggggcgagaccggtacccgtcgacttcgcagcgctgaccgccgtacctctgctggagcggctgtgctcgcagctgccaggggaggacctcctggtcgaggagatgctccccggccccgagggcctgctgttgcgtgacccgctgcacggtgggaccgccgtcgccgcgcagctactgctccggcttcccatcggccggggcgccgcagaactcacgacgctcgccgccgccgcactgcgcggcgcatctgacgtccccggtgcacccgcctccagcaggcgggccgccggggcggccacccatcacccctcctgaaggagaagaaccatgccggtaaccaccgaattcaccgacctcgacgctctgatcggtgacctggacgagcgcgtcaccgagagcagccgaccgacggcgcaggccaacagggaggagcgtgccacgcttctcgacggcgactgcggctacagctggcatacgtgcgcatgagctgctgacgtcacctcagacggcctgagagctcaccccagagcgcctgaaccggcggctaccttgatgccgtcacaccggcgccccgcccgttcacccgacgctgttggcgaattcaggcgcggcgtgacgtcggccttcacgacctggttggggtcgtgaaggccgatgcgcgttgggggtgggtgcgtgtcgatgcaggcggcgctcagccgctgtcgccctcgctacgcccacccgaaggcggccggccaccgcctgcaccgctacctaagacggtgtgctcagcctggtcggccagcgcggtatcgccgtacgccccgtgcagtagcccctctggcttccccaccacggtcaagatcaggtggcaggaaccgtccggtggtcaagatcggatggcaaccggtcaagatcatctgtcagaggtctcgtacggaggcgcggccgcgagtaggtacctcacggcctcaacgctcaccccgtcgccgagtaacccggggggaatttcacctcccggccctcacagaaccgtgcgtaacagcctcccgttacacggctcttgtcgtcctgatcatcagaccagtacggcgcttggggacagggaggcaccagtgcgtgaacatgcagggggtatcgcctggccatctcctgcagcttggccagcgccttccgcttggccgagagccgtttgcccttcttgcggatccagcgcaacaggtaggtgttgatgcgcgtcaggagagggatcagctcccagggccggtaccggccgtagtagttgatccagtccgcgaccttggggtttacccttcgggcgagctcctgggaggtcagatcggtgcgggtgtgaaggtgccagtcccgcacctcccggctggtcttcttcagtttctccgggcctgcaactcgtaccgcgcggtcaggaacgccgcgttcaaggaccgcagcgcccccagttcgatcgtcgtcagcgagccgcgctcatcgaacgccttggatctacccggcggccggcttcaagcagaggcgtgggcccgtgtgagggtggtgcgcccgcggggcccaggtaggacatggacgactaccatgacggacgaatcactggtggcgcccccggtgctctggagccagacttcggaacaggcccgtgccgccgaggcgatgtcgctcagcgaggcgccgtcgggccgatagacccgcaggggcagcctctctctgaaacagctccgggcccaggcgccggacggtctcccatccttcgtcggtgaggccgccctgatgcgtcaggtggtgcagggcgatctccccctcggtggcggcgatcttctgcatgagttcggtggcgctcatctccagcgaggaggacatcaccttccacccgtcttggcgaccgcgacggcggcgttgagcccgaacgtggacctgccacgccggactgcgccgccacgacggtcacgttgcctggccgcattcctgacatgagcgcatcgaggtcggcgaacccctacgtcagaccgaccttcctgccgttctggaggtcctccgggtccacgacgaaatcgaggtacaggtcgccgaccgtgggcggcgcctcgtgcaggcccggcgttcccgcgatgatctcggtgagctgctgctcgcccagaccgcattcactatccagttcaccgattttctgtgtatctgcgaggccgaaccgttgatatagtccgcacttgctgccctgtacggggtggcgggacggcccgtccgaccaccttgtctgcccctgagcggcttacatccgcgaggcagccagccgttgtgatgccgtggcacttccgggccaatgacgcccgtgcccctcttgcagacaccgctgcgtacccatccgagctgcaccatgccgccttcgaggccaatcgcccgctcgccgcttcttgctcatcgcccgacagatggaggagatccacatgaacacaggactcgtgcagcgcttcgccccagccaggacggtgctcctgggtgccgtcctggccctggccgtgccggcaaccgcgtacgccaacaccgtgagcgtgaccgtgaggacccccggggccaccagcggtcctgccacttccaactccgagatatcgacccacggggactgttccagtggcctcgtgtcgggcggtggcatcaaccaggccatcggcgccggtacaggggtgaacggcaaccacgtcaacggcacctcacccagccccgacggcaccaccgaatacaccggttccaccggtgtcgtcggcagtgatgtgacccactggctcggcatcggcggaagcggagggcaggtcaacacctccttctccaccacgccttacgccatgtgcctcaccagcaacctgatcacccacacccaggtcgtcatgaacaaggccaacgcgcccaccgccggatcgacggtgggcgccgtcacggcgacctgcccggccaatacccgcctgctgggcggcggagcccggaccaccccggggcccacaggcaccctcaagacgatcgccggcttccccaccttcaacaactccgcccacaatttcggcctgaaggccgcagcggacggagagtccaaccccgactcctggacggccgtcggctgggactccggccccgacagcgccaacaccacctacgcctacgcgatctgcagcgggagcggcatcgacgtcagcggcgcaacggtgaaggtccgctacgcgcaggtgagcggcccgacgtccgggagcaccgggcagacggcgaccgtgggctgcgccgtgggggacgggaatctggtcagcgggggcgccgccatgagcggaggcagcgtgacctccacgaacttcaccggcccggcttcgggcggcgaccatctcaacggaagcttccccagcacctccaatggcgccgcggccggcgacggggccacgacggcagcgtactggacggccgccgcgcacaccggaggacagtcatcgcccggtacctacaccgacgtctgggcgctgtgcgccaacgacggcgtctgaggcagcggtagcagacaaccgatcaggcacgaggaaacaagagagagaatccgatgagcacgacacttcggcggggctccgccctcggcaaagcactgaccctggccgccctgctggccgtggcggtaccgcaagccgcgtacgccaaaaccgtggacgccaccatcagcaccccaggcgccaccatgggccccgcgacccccttcaccggggtctcctcgcgcgcggactgcgcggaaggccttgtctccggcggcggcgccgaccagaccatcggaaacgacgagagctccaacggcaaccacgtgatgggcatggcaccgagcgctgacggcaccacggagtacaccgagacccccgggatcgtcggcaccgacgccacgcactggatggccttcggcggaagcgggagccacagcagccccgacttctccaccaccccctacgcaatgtgcttgcacagcaacctgatcaggcacacccaggtggtcatgaacaaggcccccgggccctccgtcgggctgtcggcccgcatcgtgacggcgacctgcccggccaacacggtcctgctcggcggcggcgcccgcaccaccccggcgagcgtcggcagcctgaagccgatcgctggcttccccaccttcaacgacgcagcacaccacttcggcaccatcgccgcgggcgagggtgaaaccagccccgactcctggacggccgtcggcgggatcggcggcggacgcgacctgaacaacatgacctacgcctacgccatctgcaccacggacgacatcaagttcaagcacgtctcgacgacggtccgcttcaccgaggtcagcggccccaacacaagctccacgggtcagaccgcgacggccggctgctcccgcgaggacgggcagctggtcagcgggggcgccgccatcagcggcggcaacgtgaccacgaccgacttcaccaaggcgacttcgggcggcccccacctcaacggcagcttccccagcgacgccgccggcaacccgttcggcgacaagaactccaacccgtcgtactggacggcagccacccacagcggcgggtcaccctccccgggcagctactccgacgtctgggccctgtgcttggacgtacagcacgggcacaagcggtaactcccccgagcggcttcccccggggaggctcgcggtgcgccaggagcgtccccgcgcgcacgacgtccgggcgatccgggccactctggatcggcaggtccggcgcccggacctgccttccaacatcgacggcgccggccctgcgcgccgccgaccgatggaggctgtgatcgggatccgctgcggcgcagcaaccgcatctgatgacggcgcagcgcccacgattccgcccactgcgcgtcgttgggtccatcgtgacgatcaccgccttgaccgaagccctcgagcgagacgcccgcacagcgcgcgcccgtcagggagcagcgggaggcctgcggcctgccgcacggcctcgtcgactgcgcaccggccgcagatccgcgccgggtgcctaccgtccgcgggcgacctggatgccgctgcctggtcaccgtcgaacgcggtccgcgggtcacggcaccgggggcacaacatcgcatcgtccatgccgggggcgctcctggactgcgccgcgtgagccaaccgtcgcgcgagctaccgcagttgatcgctcagccgaccgcttttccggtcggcggtgcgctgatggcggcggtcgttctctccccctacgacggcgccgggcgggccgagatcgacgccttccccgcgtaggcctccctcaccccgttcaccgggcaggccccagccgacgggggactgtggcacttctggcaggaaagcgtcggccccgtggtcctggcgctcaacaagcccggtcaggacgaggccgtacacgtcgtcatggagctggccgagcccccggccctgtggtgggatcccgcccggcagcacgcgcagatggccgtggtcctgtttccccacctgcgccaccccaccggccccgagatgcaggccgcactcaacgcccggtccggacccccgcccggtgcgtgccgcccgtggaactgctgtaggcccccacatgccgaaaaggggcgggtccggtcaccacacggtgaccggacccgccccttcgtcgtggcactgcgggtcagatgccgagcaggccgcggtcgtccagcccgtccaggccgtccactggtctctgctcatgcgggaggggcccggcacgctgctgagcgtgccgggcccctcccgcgtcaccgcgtggcctacaggccgccacgcttggacgggaacttgtgcaagacagccaccacctggtccggattctccgggtcgacaaggtcgaccggattctccagctggtacaggtctccgcgggccgggtactgcgtgagcgtggcgcgcaggaccatcggctccttgctcaccagcacgaccggctccgagtcgggctcctcgatcgtggcggtgaacgggatcacgtcgcgttcctcgaaccggggtgggaactgctgcgtcacccgcagggtgctttgagcttcgacgtccacatcgctttgttcgaaggtcactgttcccccgtcagggagttccgccgtgacgcggaacccgacagtccgcagtcggacgctgttgatcgggtcgtccgggttgacgtcgacgcgctgcctgatgccgcccctgaagtcgagactcacaaggcgcgtcccgatctggaacggggtgttgatcgcgagcatcgaggaggggatttccgcgccgatgggcggaagcggggcggcggcgcgttgcgcggcggatgaggccaccgccggcgctgccgtcgctgtgcccatggcggcaggagacgcggcaagggccagcaggacggtacaggctgcgaacacgcagcgcgaacgaggggacatggcttcctccgagtcatccttgaaagatcaggccagaaggagtgcagcgcacgtaggccgcgccacgcccggcttgagcggataagccacccaatggtgtgagggagccaagtggtggtttgccaagggcagtgggcctcgtcgtgtcgtccagcaggactggtcccgggccagcgctgtcggggtcctgacggatcgaccggacaggtctccgaatggatcgaccggacaggtctccgaatgctcgccagactcattgccgcgcgccccgcccccaggtgcacgccgtccctgcctgatcggagcggtcccggcacggctgcaaacggtggtggacatggctgcgacgcccgcggagcgctcgccggcagtggctgttcctgcccgcgaagtcatccgggccgggggtcgcggacgggcgtcgagctggagagccttctgggcctgcttgacgagggcggcgcacgccaacggggggaccggggcgctccgctcaggggtggcggacggggtagcaccgtcgccgtaccgggcggtgcggcgaacgggcgaggaggcgcataccgtcaccggccgcgcgttgatccgcgtcttggacaacacacaggggcggatccacagcctgctctcactcgtccggcatgaggtccgacagttccaacgccaccgcgtccgccgggggacgggagaggtgaagcgtggtgtggaagtagccgaggtcctccttgccctggggatcctcaccctcggcggtgaccgctttgatggcgtgccgccgttcgtccccgctggtgaagcggcgttgcgggaacgtgcggtcggcggccttctccgtgaccagtccgtacgaggccaggcattcggcgatcgacgcgtaggaggtggtgcgcagcacgaacgcggcgaccgacaccggggcctgggcagccgccagaagtggctggaaagtacgtgccgacaggaaggtggtgccgccggtgatcgtgatgagccggacgtctcgggcggcgtgcagcaactcctttgacggcggcgcggtttcgaggttctccgcgaacccgtctgccaacagtccgaccgcgcgggcgtaggcgatggcgtgcggggccatgtcgaggccgatcacccgggccggggcctggcgtctgcggtccgcgtagtagcggcggtcccactcgatcagctcggcggtgctcagttcggcggcctccggcgaggtgtagtggtcgtacaactcgtccagcgtcacgtcatggttgagcagggcggcgttgatgccgtacgagcagcagatgtccagcacggtcaccgcttccctgccgtgggccgcggccgcgcgacggaagacactctgggcgtgatggggtgtctggtactccagcgggccgagggcacggaagtaggccctgggatccggccggtcgtacacctggtcgaacgacgtcatgccttcgggcacgggagcgtacggtgtccgcacgccgtcgactgcggacggccccgcgctgatgtgccgctcaccggtcatcccatagctcccgtcgttcacgtcctgacgtctgccggactcagcagtgtcactccatcacccacttcgcaccagtccaggatgtgccaaccgggcacgtcttccccccacatggcgcaaacacgacgctccggcgtgacctcgacccgaaggacgggtgccaggccccctcgcgagcttcttacgtcgctgggagacgggtggccaacagatggccggcctggaggtcacgcctcatgaccatccggttcagattctccaggagaggacgtgcaatgcccgctacccgcgatctcgctcgtccctagaagcagtccgtctggctgcgcccggctggcgtcggccgcaggctgagtgtatggagtgcgcgcgtcgccgagcacgatgggatcggtgccctcccgatgaacacgcatcctcagccggccgccctggtcgagtacggggtagggccggccggccatggggacgcgctcttgaaggacatacgcatgagtcaaggcgtggcgcagggcgtcggtccaaacctggtcagtggtctcccacccgcacgtcacgccgcggcctctgtaggcgtttcagggtttgaggacgaagctccggcggtgggagcgggccaggccgaggaggtccacggtgtcgccctggtatgtggtggccccctgacgtaccgcgcgggtccacgggacatgggagcgcacagcgtcggcttggtcgcggggaagccaggccagcacgcgttcgtctcccaacagggcgaagaaggttttgcactgggcgaggtctgcggtgaagggcgtgatcacaaggcatgcgccggctgcaccggcgcgtggaccgccagcgcgaactgtcccccaccgagttctccgtgctcctgcgcaaggacctcacgcccgcccgatgaccgcgcaccgcgcggcgctcaccgcggacagcacagcgcaccgcagacgcggcaccgccacgggcgttgaagaatgaagcggggtgggcgctgcgccgggctcaggcctgggcgccaccgccgcgcttgtgccggcgaggaggtcgcggtggcggtcggccagggtcccggcccgcaggggcacggggctctgcgcccggtcccgtgccggtccgtatcgctctgtcaggggttccgggctgccgtggagggcttgacgtcggagccatccgggctgagatgccctccccgccggtctgaggcagcgcggtggcggaacggatcgctgacgcgcctcactgcctgcaccagtgatgtggtcaggtacgcgaccgccggtttgccgctcacgcaggtctggcgctcactcggcgaggtctacgtgggcgttctccgccggctggtcggccttgtcctccttgggcaggcccaagtcgccgcactggttggccggtgcgctcagctgcacggccgccagcaacgcacccaatccgccggcggtccggtctgatacagcagaggtgcgtgccgaaccggcgttggcgcagtggttgtcgtgcgcgctgttgccggcaccgatgacactggtcgccgccgcaccgtgagccccggcccccaccagagcggccgcaccggcgacgaccacaccccaccgcttcgagcatgactgcatgaacatgaagaacctctcccattccctgtgatctgcgcctggtcaacgagacggtcctggaaaagtcgcagtcccggaacccggactcgcggtgaggcggcgtcaggcggcaacacagaagggcatgcgggaacccgccgtggccggcgaggggggaacggcaggcgtggtcccgaggtcggcgcgccgtggtggggggggcatgacctgccgggcggagcgcccgtgcgggcaggccgacggcctccgccggccgctcagcacccggaggcaacggccgagggaagtgcgccccgctgcaaggtccctgcctgtcagttcggctgagaccggcttcgcgggggtggcggacggacggctcggtgtgcgctgcggtcagcaggtgatcaccgagcacacgaggatgctcgggacggtctgaggtgtaccggtgggcagttcggactcggcgatgcgctcgtccatctcgtcgatgagcgcatcgaggtcggcaagtccggtgacgggcatggctgcctcctcatgtcttccagtcggtgacggggctgcgccccctcgccccggccatggcggagcgaaggggccgttgtgacgctgcctcgtggactggcgtcattgaggacgtacccggtctgcacctggcggaggtccctcacaggtgtatgggggagcacaaccgaggccgtcctccggtgcggtgtggccgacgaggcgcagcacccggtcgccagggccccggcgtcctggacctcgtacgtctcggtccagcggggtggccccgtaggtgaccaccaggcggtcaccggccgccgggtaccacggcgcaccggtcagtgacccgtgcccgccgagcagggcgtccacttgcccttccaggtccccgcgatgaggcagtgtttcaaccctgcgctattcggtgtcctggcaggcggcggtggacactgacccggctcaagatccgggtgctgtcgtggcgttcctcttcgcggcgggtcgcgggcggggaccaaatcgcgggcgaggactaccgtgacgggcacgttggagcaccggccgggctggtcggacagggcctcacgctcgacggcgtcgatgctcaggcccccagcgcatcttgtccgccacccagtcggtggcatactggcagcggtagccgtccgccggcggcagccaggtggaagggtcctggtccgccttcgaccggttcgacgccgccgacaccgcgatcagcgcccggctgtccccgaggtcgttggcctaggcctcccgctcggccgcgctccactcgtaggcgccggagtcccaggcctcggcgagcgggaccgtgtggtcgatgtccaggccgcgggcaccgctgatatcgcggtcgtcatacggcgagtaccactgccctccgctcagcatgcagcgcgggccctgctcaggcgcgatgaccgcttcagccttcaggacgtcggcccgggtgttgcagccgtccttgtccgcatcagtccagtgtttgaactacgagcgctggtagccggtacggtcctccgcccgcaccggcagccgaccgagcgcgtcccgcaccggcaacgtcaccgactcccccaccgcccgcgcctgcggaggcggtgcggtggccgcgacagcggcgtgggcggtggtgaccggaagaagaagagcggcaaggacagcggccgcggcacgagcgaaacgcatggaataggggcccgtcaccgacacccaccgcaggggcgctggtcccgttccgggcttgggctccacggtgcgctcacgcttgctcaggcggaggcgtctcctccgacgcggctgccggttcggaggggcctccgcccatgccgaacccctccgaaccgatgacccccgtcggtacccagcccctccgccggggcacgttatgcgttgacatctgcgccggtacgcgtacaagcagccactttgaggtgtaagcgcctcgcttccgtccttccaggtggtttgcggcgacggcaggttcgagccccctcgcaccgcgcaggagcagggtaatgccagcgagaggaggtgaggggtaatgcgcaagattcccatgaacgccaaggtcgtcgtccggtccgatcgtggacgggcagccaagcggtactacatccacgagtacaagtagtaccggccagacaggggccgggagcgctgctctcggcccctgtgccttgcggcaacgttcgtattcctggaggactgatgcgccatcgtcgcgcccgcggcctggtctgctactggtacgacagccagttcatcgtgcacccctacccgcacggcactgtcaccgctgtgcaccccgccgccgccgaagtgctggccgcgtacgaagactggaccacgccgaaagaagccgggaaagacctggcacacctcagccccgacacgatcgcagacgccgtgtccgtcctgaccgaggccggcgccctggtctgcgaagacaccccgcgggcagcccgggacgaggaaatcgaccgccactggggggcgtgggcgcccgaagccgcgttcctgcactacgcgtcccaggacatctacgacgacagcaccgtggaaaccgaccccgaccgatccgtgccggccgaggccccggagccggccttgttcaccgagtacccgaacgccgcccgggtgctgttgccccggtcgggaagccagccagaactggacaccccctacaggcacgtgttgtacgggcggcgcacccaccgcgacttcaccgccgaacccgtagccatcgagacgctggccacccttctggctacctgcttcggaccggtcgacttcatcgactccggccgctccgcgctctaccgccgcaccagcccgcaaggcggttcacgacaggaactcgacacctacctgggcgtcctgaaggtaagcggcctggaagccggctggtaccactacaacgggctgcagcactccctcgaactcctcagcgaaggcttgacccccgaggaagccagcgcactgtgtgccggccaggagtgggccggtgaggccgccttcctcgtcgtcctggccgcgcgactggagcgcatgagctgcaaatacgccaccccgcgggcctaccgggtatctctgctcaacgccggtcacctcgggcagacattcgcgatgaccgccaccgcactcgggctcggtcccttccagaccggagccttctgcgacacacccctggccgaacgctgcaccctcaacaacaccagccatacccccctctacgtcctcgccgcaggacatccgtgctcccagccacagcaggccccgcaccgggccaccgccgccaccttcgcctccacccggatcaggccggaagccgcggactgacaaaccaacgcgtgacgacgtccgctgactccactacgcccggtcctgtaccggtgcgggtcgtactgcctgcccacccgctggggcaccccgaacaggagatcgtcgcgcggttgtggagacgccggcagaccgaaaccggctggtgtccaggtgggccaggttcgagatgcctggaagcccgcgtggagggccgctcagaagtgggtggcgataccgaacgcctgccggagctgggccatgtcgtggcggtcgtgatcagccggttcgtagccctggtggaagtagacctgctgctccggtgacaggcacgggacggtggtgtccaggatcgtgccggtgacgaagcacgcggcaggatagacgaacggatgctccgggtcaggcgacgcctgcacagcggacccgtccgccgcaaagtccagaggatgaagatcgatctcccgcccgcggggcccggtgacgacgaaccgtacggggcgccagtcgagggtctcggcgaatccggcatccctgagaaccgccacgagatccggttcctggctcctgcggtgcatcaggtccaggtcgcggtgccgtcgcgtctgccgccccaccagagcgtcgatgccccagccacccccgatccagatgtcgatgcccgcatgccgcagcacaccaaggatggacaacacgtcgtcagccgtcatcaccccgcgcacgctagccgctgtcctccgggcagggcgagccgtttggccggtcatgcgaggtcagggcctcccgccgccccagcagccccgctcccccacccggccagagatgcactgtcttcaagccggccgattccccacacagcaacctgatgcgggagtgagctgggatgggccgagggccccggtcgggtgaatcaccaccactcgcagagctcccgcccgccacacacgtcctgtgacgcgtggatgcgatcaacgaagtacacgtcgtcgtagacttggcccccggtccaccgctgcgtgcccccgctcgcccgcgtagaagaggtgggccgcgacctgggcgttctcgatccgtccggccgtgccggtgtactggcgctggaccccgacggtgcgggtgccttcttcacgtcgccggtctcgtcgacgagcagcaccgcggcctcgtcacggaggtactcgcgcgcgtcgccacggatggcatcggcgtcccagaccgcccggcacagcaggtgctgcataccgtgcgggctagcctccccagcccactccgcaatggttcagcagttcttgcaggcaggtccgacagcaggcccagcaccaaccgcccggctcgcaggcggggttcaacccggacgaaccgtcccgcgatccccccatcaggccctcgaacgcctcccgccatcgggcgggatctatgctgtgacctgcggccaccgtctcgtcgttagtccagacaactcacgatgatcaacggcggccgcacgcgtttccgcaccggccccactgtggctgagggccctacttagccgtttgacaaaccgcaacgcccaacagcagaggcctacggtgccgacagggctgtgcgctcggctttttccagccagtcggtgtaccagcgggcgaacgtcaccggcgtaccgtcgtcgtcgagcagcggggcgaggtctacgtcgtccacccggcagtcggaccagatcgtgccgcggtggctgccgctgatgatcagccattctctctgggcgcagcccaggtgggagatcacgatggcgccggcggtgcgctccggcgcgaacatgacggcctcccaccgctcgtcccacgcctcgatggcgtcgtcgaagtcctcgatgtcgtcgaagtcctcttcctcggggcgttgggcaagaaggtcgtcgagcagcttcgggtccgggccctggtcgggaaacggctcggcaagccttgacaggccggccaggtccgcgccgtcgccttcccaacgccagcggccttgcacgcgccgaaccgggaaaaggccgtacgcggggccggcgccgcccgcgccgacgtggagcaggaaggtccggtactcctctggcagccgcacgcccgtctgagcctcaagttcggcaagctcgccctgggtaagcgggtcctccacgatccatcggtgtcccaatgccccgaacaccttgctgccggaaggccctgcacccgccgcctcgacccgctgacgcacgcccacccaccactgatcagtcatacgcagaccgtacgtgtagccaccgacacctgggtcgcggggcccactgctgccgtcccgacgggctcaagaacggcccgacgccccaggcccctcggcacaacacgcacatcggccagctgagcccctcggtagccagccagcgttcagatcagcggggggcgccccaagcgcgtcatccgccacaccgtgcgccacttcatggccttgcggggaccgcacggattgcgcagcccctccgcgaagccgccgcaccacgctttcagcccgccgagggaccggatgcgcgccagggtgagcacgatccacacgcccagatagagcgggatcaaggggagaggcagtcgccgccgggccagccagactcgatttcgagcggtgaaacggtagtagacggtatgccgggccggggaggtcttggggtgctgaagaacgaggtcgggctcataaaggatcttccagccgtcgtccagcgcacgccatgcgaggtcggtctcttcatgcccgaagaagaactcgccggcccaatcgccgatccgctcaagcatcgggacggagaaggcgtggccgcccccgaggaaggcagtgaccaggccccgacgcatcggatcatctgcacgaagacgcggcacccagcgtcgctctgtgtgtccgtgctcgtccgcgacccggaagccgacgatcccgagcttggggtccgtcgcgaacagctgctggatcttgcggaacacgtcatcggcgatgaggagcccgtcgtcgtccagctcgacgacgacgtcaacgtcgcccgattcgcgcagcagcttcagcccgacgttacggccgccggggcagcccaggttctcctcaagcgggaccttggtcacgtccgccgcgatgtccgtgagaggcgtcgcgttccccaccagcaccacccgcgctgccggaacatcctgcttctccacggaggccaggagagcctccagttcatgcggtcgagtgcccatcgtcacgatgacgactccgaggcgcggcaacgacatagcggcaaactccaggtgtcggcgaacacgccgatgctactgaacttgaactcgtgatgtcggccctgagtctggctgtgccgccaggacgtttgctctacgattccgtgcttgccaggcgtgaggtgacgagcgctacgaagtgctggaggacggcgaacggcggcgtttgcgttgcgtcgaagtagacctctgccggcttctcctcctcgggcgcgtaggcaatcaccgtcacggccgtcggtcctggagccggtgaagcaggcgtggaagagggtccaccaggaaccatgcgggcctcgctgagctcgaaatgtgtcatccggccctcgcccgtacccgtctcggtggtgagggtgcagaacagatcgccgtcgtggccccaggtcagcaaagacatggcgatgatgctgccatgcctggcgtcgtcagccctcgagatcgggagcgtaggtaggcaactggaacacggtgagccactcggcgctcgcgtcgatgaactccctcatgccggtggtcaggtggaggcggacgttgtcccagaccagcacgctcggtccgccgagctggatgcggacgcggacgatcaggtcccggaagtcttgccagccgaagcccttcggctcatgcttgcggccccgtactcacggctcgtgtagatgagccgggaccgctggcctgttttgccgcccgcgagcgtccctctcggcgtctgtcagcccgccaccctgcgcatacctcacgcccccggactaccggtgcccgaacgccggctgtcaggcgaacgggccgacaacacccattcaagttcagtagtccagatactcagcggcgaggcagggggggacgacgctcctggcgccgtctctctgcccttcgtcagggatcagcgccgggaactcgcggcttgcccaggcgctgctacgttcacaggcgcggcggtcgattgtcgggtgccgatgggccacctcccaatggcggatttggcttcctcgtggtcccgaactcgccttgtgcggccgatggttcaggtgcgtaatgagtgccacgtcacagcggcccatctcagcgagatgcatgggaacgcccgcaacgccgccaccgagaccatccgaaccaccggtaccgccccgcgcgtacgcggccgcaggcgcgcccggggcgagcctcccgccgcgcggtgacctggtcatcagcgatcggctgctctgggtgaacagggccgcaaggtctcgggttgattcccagatcggcagcgacctgccggatcgtcgcctcgggccgcgactggtacagcgcgaccgcgtccgccttgaactgcggcggatagttcttcatgaccacgagatgtccgttctcagatcctcaggatccagtgtctcgtgtgtccaggatcaagggtcaaggcccgcacagctgggtccaggacctggtcgtcggggagcgcgtggccgtacagctcgagcgagccgcggcgcagccgctccaggtggaggtcgagtccgcggatccgactgtcgcgcgcctgcatggccgtgaagtgcgcgaatcccatgaaggcgagcgggacgaggtccacggcggtgggcgtctcgccgtctcgccatgcgaggggacggggggtcgttcggctcatgtcccggagaacgactccctttccgggaagacacatcaagcaccgtacgagtgaggtgaactgactaggcgacagatgtgtgcctctcccgtgtcactcgcccgtcacgctcccttcgcctgccgttcgagcccgtcgaggagcacctcgagacccgcctcgacatcggcctcggtgggccggatcggtgactgcgcgggctcgtcgcccccggggagcagctgctgcgcgacgcactggatggaggcaccctggacgtaggaccacacggtcagcgtcagcgtgcgggccagttccgggtcgtccgtgaggccggacaaggcgtccgtcatccagtccagacacgtcgtgtcgctgaagtggcgggcggaggcctgggtgaccagggtccagggatgcttgcggtagacctcgcggtcgagggcgacggcgagccggaccgcgtcgcgccactgcgcaggggcgggggtcggatagggatgctcctcgcagaccgcgcgggtgatcgccgtgagcagttcgtccttgttggcgatgtgccggtacagggacatgacgcccgagtcgaggtcgttcgcgagccggcgcatggacagcgccgcgatgccctcggcgtcggcgatgcggatggcggcgttgatgatggcgcgccgggtgagccctggtgaactcgcctgacggccttgcgtcttgatggccatgctgtagcctaacagcggcgtgggtacagtgtacgcacctgcatgcgtacactgtacgcgcatgcctcatgtagggcacccacgcccgcccggcacccgccgggcgcctcttccgatgcgcacctgcatccttccgtacgcccttgtgcgtacaccgtacgcagtgtaggccgaacgagacgaccacgatgcgcaccaccgcgcaccgcctcctgaaaggttccctgtgactttcctggacttagtcgcggagcgcgccgaccggcgcgcctggctgggcctgctgatcgtgctcggcccggtcgccttggtcgcgatggacggctccgtgctctatctcgcgatgccgagcatcacctccgcgagcacccccaccacggaccaggcgctgtggatcctcgacatctacggcttcgtggtcgcgtcgctgctcatcgcgttcggcaatctcggtgaccgctacggccggctcaagttcctcctggcgggcgccgcggtcttcggggccggttcagtgggcgcggcgctctcgccgaccccggaggtcctcatcggctgccgggcgctcatggggctcggcggcgcgacgctgctgccctccggcctcgcgatcatcagtaacctcttcctcaaccccaagcagcgggcccaggccatcggcgtcttcgcggcgaccttcgcggcgggcttcgcgatcggccccatcgtcggcgggctgctgctcaaccacttctcgtggggttcagtcttcctcatcaacatcccggtcgtcaccctgttcctcgcgttcgcgcccttcctgctcaaagacgtgcgcgagtcgagtcccggccgggtggacgcgctcagcgtgctgctgtccgccgtcggcatcctgctgaccgtctactccgtcaagtcggccgccgcctcaggcatctcccccacccagatgggcatcggcatcgtcggcctggcgatcgtgacgctcttcgtgcgcaggcagttcggcctgccgcagccgctgctggacctgcggctcttccgcgaccgggtgttcaccgtcgcgatcctcaccggcctgctctccctggtggcctgggccgcagccggttatctcagcggcgtctacctccagtccgtccttgggcacagcgtgctgagcgcggcgttgctggcagtgcccggcgcgaccgtgctcaccgtgacctgtgtcgggaccagtgcgatcgtcgaccgtgtcggcaagcgcgcggccctgatcacctgtcacttcgtcatgggcatcggtctctccctgatgctgctcaccggggtgctcggcggggtgacggcgttcgtcgcctccaccgtggtcgcgggcatcggatacggcctgtccttcagcctcgtcgccgagacggccgtcgcggcggtgcccgccgaacgggccggatcggcggcctcgatcgccgagatgagcaacgagctcggcaacgcgctcggcatctcgctgctgggctccctggccgccgtgtgcttccggctcctcggccccgacctcgcggggacgctgcccgagaccctggagcggcccggcatcagtgcggccgctgccgaggacgcgaagaacgccttcgtctccggcatgcacgtggcgatcgtcgtcgcgagcctgctctcgctggggctcggctacctcgccctgcgctgggtgccgcgcgagaaggcgccggccgcgtaggcggcgcgccgccgggtgcggcgtaccggcaggtgtacggcgtgcggcggcgggcggcggggtacggcgaccggtggtgtgcggcgggcggcagccagtggtgtgc

SEQ ID NO: 265 - DNA, 7782 bp, Unknown
  Kingdom: Bacteria, Phylum: Actinobacteria, Class: Actinobacteria, Order: Streptomycetales, Family: Streptomycetaceae, Genus: Streptomyces
gcggcaggcggcaggcggcagaaccagctcagcggaccggtggcggcccgaacaggtccaccgcggcgcgcacctcggtgagtccgctccgcagggcgctgaccgaacctatggaaccggcgatcagcagcagggcgcggcgcagccggtggacctcgggcgtgccgtgggcggccatcgcggcaagtgaggtgagttcgtcctcggctatggcacggtccgggaactccctcgggtacgcggcgagttcgcggcgtaaccgggacacgacggtacgcagttccgccacccgcggatcagtcgtccgcagatccgtcatccgtggatccgcagcccccggatccgcagcctccggatccgccacccgcgggtcctctccgctgccggccaccggtctctgtcccaagctccgcaacgcagccctccccctcgcacgtcatcgtgcgcagtccccggacccgggtcagtaaacgccaccgggggctcggcgcgccaccgtacggagggaaattcagccccgcgtggcgggcgtgggcgacggaccgtcaggtatgcaggacgcatgacacctgtgaacgacatggatgacgaggtcgccggcctcgtcctggccgccggtggcggacggcggctcggcggccggcccaaggcgctgctcacgcaccggggccgcccgctggtggagcacgcggtgggggtgctgcgggcggcggggtgcgcgcgcgtgcacgtggtcctgggcgcgcgcgccatggacgtacgggagcgggcgcacctggagggctgcgtcctcgtggacaacccggagtgggagcaggggatgggctcgtcgctgcgcgccgggctggaatcgctcgcgggttcgggtgcgcgggcggtgctggtctcgctcgtcgaccagcccggcatcgggccggaggcggcagcccgggtgcggacggcgttccgggacgagacgtcgctggtctcggcggcctacgacggcgtgcgcgggcacccggtgctgttcggcgcggcgcactgggcgggcgtggccgcgagtgcgggcggggaccgaggggcacgcgcctatctgaaggaacacgcagggcggatcacgctcgtcgagtgcggtgacgtcgcacaggcgtacgacatcgacaccgaggcggatctggcccacctggagtgaacgggatggcaccgagcgccacctttcctcgacccagagaatctcgacatcaacaaaccttgaagttccacgatgaggaaactactatccactgatcagaagcacccgaccgcacagcgggtgcgaatcgctccattcgtcccccttggcacccggtgccaccgctgaaggaagtgacagctcatgtccgcaccagcgccgtccccgctggccatcgtcgacgccgagcccctgccccggcaggaggaggtcctctccgacgcggcgctcgccttcgtggcggagctgcaccggcggttcacgccgcgccgcgacgaactcctcgcccgccgtgcggagcgccgcgccgagatcgcccgcacctccactctcgacttcctcccggagacggccgcgatccgcgcggacgacacctggaaggtcgccccggcccccgcggccctgaacgaccgccgggtcgagatcaccggtcccacggaccgcaagatgaccatcaacgcgctcaactcgggcgcgaaggtctggctcgccgacttcgaggacgcctccgctcccacctgggagaacgtcgtcctcggccagctcaacctgatcgacgcctacactcgcagcatcgacttcaccgacccgaagtccgggaagtcgtacgcactgcgcccggccgaggaactggcgacggtcgtcatgcgcccgcgcggctggcacctcgacgagcgtcacctcaccgacgccgacggcaagccggtccccggcgcgctcgtcgacttcggcctctacttcttccacaacgcccagcgcctgctcgatctcggcaagggcccgtacttctacctgccgaagacggagtcgcacctggaggcccgcctctggaacgagatcttcgtcttcgcgcaggactacgtcggcgtcccgcagggcagcgtccgcgccaccgtcctgatcgagacgatcacggccgcgtacgagatggaggagatcctctacgagctgcgcgaccacgcctccgggctgaacgccggccgctgggactacctgttctccatcgtcaagaacttccgtgacggcggcgagaagttcgtcctgccggaccgcaacgcggtgacgatgacggccccgttcatgcgggcgtacaccgaactcctcgtgcgcacctgccacaagcgcggcgcgcacgcgatcggcggcatggcggcgttcatcccgtcccgccgggacgccgaggtcaacaaggtggccttcgagaaggtccgcgccgacaaggaccgcgaggccggcgacggtttcgacggctcctgggtcgcccaccccgacctggtgccgatcgccatggagtccttcgacaaggtgctgggcgacaagcccaaccagaaggaccggctgcgcgaggacgtcgacgtcaaggccgccgacctgatcgcgatcgactcgctggacgccaagccgacgtacgcgggcctggtcaacgccgtgcaggtgggcatccgttacatcgaggcgtggctgcgcggtctcggcgcggtcgccatcttcaacctcatggaggacgcggccaccgccgagatctcccgctcgcagatctggcagtggatcaacgcgggtgtcgagttcgagaacggcgagaaggccacgccggagctggcccgcaaggtcgccgccgaggaactggacaagatccgtgaggagatcggcgacgacgccttcgccgccggtcactggaagcaggcgcacgacctgctgctccaggtctccctggacgcggactacgccgacttcctgacgctgccggcgtaccagcagctcaagggctgaccggcgcagcagcacagcagcacagcagcacggcggcccgggagccgacactcccgggccgccgtgccgttcacctctcttgccccaggtgcacggaccagtcctgctccgcggccggttcaccgtgcaggtccgggacctgtttgagccagtccggccgtccctgccgggtccgcgccgcacgccgggcctcctcggcggccagttctgcacggcccgggaagtcggtgggcagccaggctgaggaggcccgcacgcgcgcgtgcaggtagccgacgtaggcgtcacgcacctcgtcggtcgtggcgaaccccgtctcctcgcgctcctcgcgcagccacgcgtccggcacctgggcgacgatctcacgcagcagcgtctcggtcacgcgcggcgccagctcggcgtcggccgcgcgcacgtcgggcgcgtactggccgagggcgtggtgccggaagtcgtacgccttctccggcgcggtcaggtcccagcggtggtggaagacgagcgccgcaccgtgatcgatgagccacagacgcggcggcgtgacgccgagcgtcggccagatcatgagattggaactgtggacggtccggtcgacgttcacggtgagcgcgtccagccagacgatccggcccgcctccagcggatccacccggaacgtcctggcgacctcgggggtgaagtcccgcgcccccggcaggtagtccatcccgaggttgatcccggcgctcgcgccgtgcagctcccgcacctcctggtggatctcgtgcgcggcgatcgccgggtcgaagtgcaccagaaccagctccgggaaccgcagcccgagcgcccgcgccagctccccgacgatcacctcggcgaccagcgccttgcgcccctgcgcactgccggtgaacttcacgacgtacgtaccgaggtcatcggcgtcgacgactccgggcaccgagccgccagagcggagaggttcgatgtagcgagtggcggcgacctccctcaacattttcgaggactctcgcactcatcgcccttgcattccacgaccacctccaaggtgctgcaatccgggaaaacgcccgcgatcagccctgggagaacctggggagtttcgactggcacactcgtctccctgtctccccagcagtccgtcgatggcggtacgacccttgcttccggcctccggcatgaagtgagcatagtaaccaagcgtgacagccggggaggaacgcccgagccatcccgctgtcgtcacctccgcccctgacctcccccacggaagctcgacctccaccggcgggaacgcctcggtcgacggcggcgaagtcttcccgacgccatcgccggccccgccctgcgcggtctggccggcactgaagccgcccagatccaccacaccgagaaccagctgttcgacctcaccggccccgagtccgagatcggttacgcgtccttcatcccccatcaccgccgggcacgtactcaagcgaaagtggttcaccgaggacgccatcgcccgccgcgagcaactcacccccggcctggacatcacccccgaccgcttcgagacgtccctgcgcgaagaccctggcctccaggtccgggccatgccgcccatccagcgcgtccgccacgacatccagtgcgagccggaccgcctgctcggtcatctcagtttcctccgatgccgagggcggtgagcaggaccaggacgagggtcgccacggcgaacaggccgtgggccaggacgaccgcgacggggaagtgccgttcggcggggacggtcccaccagctcccgagaccgttgcggcggccggtcctccggcggtggcacggtcacggtagacggggatccagcgggccagcatcacgaatcccagcagggcgacaggcaacagcaggccgaaggaagtccaggccagggcgttcttgtcggccaccacgtagacgatccacaccaccagtccgatcgcggccagggcgaagtggccgaagatcacgggcgcgggaaggcggctggtgccggtttgctgttggcggattccgccgcgttggatccaggtgccgagcatgtagaagccgccgagggcggtgatcacccaggtgatcagtgcggcgatgtccatcaggaactcccgaacgatgtgatgtcgaacgcggccggcaacccggccgggggcggggtgtgcggtttcaggcggcagggcgggcgtttcgcgcgctggtgccgggcgtgtatccctcggcctgggtgctctcgtcggcgacgcggacgccgtagcggtaggccagcttgccaccgaggaaccccgacacgcccagcacggcgaggctgaccgcggacagggcgagccggccccagccgacgctccccccgctggtgtaggtgctgtggcgccacaggaagttgaccgcgtaggcgatggtcaccagcaggttcagcgtcatgtggaccagagcggtacggaaggccggggtgccggccgggatcgcgaacaggtcgaggaagccgaccatggccgccagcagggcaccgatcacccccaccgcgatcagccactgcgagccctgggtcaggaaacccggccggtcgaccacgtgggaggcgatgtcgaacaccaggctggtcacccaggcgccgatcggcacagtgaccaggatcgggtggaacgggtggccgtacgggccggccagcgaggcactgaccggacgcttcgcctggagccgtgatgcatcagtcatcgcaacctcctcttcctgtttcaccaacaaatcttggtcttattactgaggggcgtcaagatgtgcaggaaatcagggcagcaggaacgcttgtgcctacgcacatgggggttacggtggtcttgtggcttccgatcagacagctccggccgacacggtcggcagcgccatcgactccgtcagcgtcctcagcgaggactcacggcggcacatgttcacctacatccgccgtgccggccacgccgtcacccgtgacgaggccgcggcgagcgtcggcatatcccgcaagctcgccgccttccatctcgacaagctcgtcgacgccggcctgctgcgcgcccgctacgagacgcccggcgggatccgcaaggtcggcaggcggccgaaggtctacgagcccagcgacgcccagatcaccgtgagcatccccgaccggcgccaccaactcctggcagaccttctcctggacgccgtcctgaccgaggaggccgacgagaacgccacgcaggcggccatgcggaccgcccggcagcgcggccggcgactgggggaagccgcgcgagaggagagccgccccgggcgcctgggtcccgagcgcgggctgaccgcctgcgaggggctgctggaccaatacggctacgaacccgtccgggaaggacccacccggctgcggctgcgcaactgcccgttccatccgctggccgcgaaagctcctgacctggtatgcggcatgaaccaggcgttcctcagcggctacctcaccggcctggaggtcaacggcgtccaggccgtcctggccccggagcccggcgaatgctgcgtacgcctggacccgaacgacaccgatcgcgatgaccagatgccccaggaccactgacacagcaccggccgcccgcccccgcggaccaccgacgcggtgagcgcccctgcccgcggcagaaggatcaaaggcgcgcgcgaacgcccgcgatcccccgcggggcgcaccccgtcaccggtgctcgacgtcccatcgagctgggggaagacgcccgtactggcgttccaaccggagcatcgtcatgttgaccaaatacatcctgaaccctcctgccgcgtccaccgaaccggcggcccggcccgctcccaccggcgcgccgatgacggccgccgccgacttcggactgctgctcatccggctcaccttcggcctgctgatggccggacacggggcgcagaaagtgttcgggctcttcggcggcccgggcctgaccgcgaccggcaaagggttcgcggccctgggctaccacccgggccggctcttcgccctcatcggaggcgcgtccgagacgctcggcggcctcggcctggccctggggctgctgacgccgctggcgtcagctgccctgatcggtgtcatgatcaacgcgatgaccacggtcaccggagctcacggcctgtgggagacgaacggcggcgtggagtacagcgtgtgcatcgccgtcgtcgcgctggccgtcgccgccctcggtccgggccggctggccgtcgaccgccccttccgctggggcaagggcggctggaaggaagcggccttcgccctcggtctgggcggcatctccgccgcgatcacactcagtctctagagccacaacagcccatccgcccccctgccccgtgcggcttcgcccgcactccggcctgccgccggtggcagcgcgggtccaggttccgcggtcccgtccctgacccgtccctgacccgtccctgacctccagctcctcaaaggcacgccatcaccgcgctggggttcgcagctctcgccggtgccaccccggaggaacggatcgggcagacgatggggggcagccgaactcggcggcgaactcgacgatgccgggggtccgctgctcgtcgccgcggtcgccgccaccgtttccctcagccggtgctacgccgcgctcgcgctgctgaccactttgctgctgctcgtcctggccgcccgccgcactccccgctgacgcgcgcctgtcagcgcgccgcggcttccgccgcttcgtccgcagccgcctcgcggccgaca

SEQ ID NO: 266 - DNA, 1061 bp, Unknown
  Kingdom: Bacteria, Phylum: Actinobacteria, Class: Actinobacteria, Order: Streptomycetales, Family: Streptomycetaceae, Genus: Streptomyces
ccctcgtcgaccttgcggcgcgaggcggcgtgagtgcgccacagttcgtcatcggagccgcagtggcctacgaatgggcgctgggccggatcggagatcctcccgtgactgggtggggtgggcggggagcgcgctcgatttccacctgccgacctcaaaactgcgtgcggctgcctcactgctcgagaaccctgaggaccagtcgggaagcccggatttcgtccgcggagtacggacggccctggcccggttgtgcggcgacccgcccggttccgcgtcggacacttcccgctggagttgatgcggcgcgtggggcaaatagggtacgaagagggatgaaagggactgcttgccgatggtgcgggtaacgggaggcgaacccatcgcagggaggagcggtatcccgtgacagcaactcaggacatcgtcgagctgatcctcaaggaccaccggatgatggaagacctccttcgccgtatgcgcagcatcgaggaagaccgccaaagcgcgctgtgcgacttcgcgcacctgatgatcgcgcaccgggaggccgaggaggcatcggtgcatccggtactcagcgtcttcggcgacaccggcacgctcgaacgaatggaggcgacgcaccgggaggcccttgagactcttctggcgctccttcaggtgagcgagaccggttccgccgaatgggacttgaggctgcaactgctggcctcggtcaccggccgccacaccgaagaggaagagcgcacgctcgtcaaccacgtgtccgcgagcctgagcagccgatgccgggccgaactcggggccggttacgcgaggacacgcgaggacctgctggacgcgcggtgcggcagcgttgccaacgtgcaccgcctgactcaggccgacgcaccggtgtgagacgcgcgctgccgctgagcgaggaggaggtgcggctgcggcggctgcggcatgagctgtcgcgcgggggagtgccgcgcagggccgcattcctgccctgccgcagccacctgccgcggggccgccctgccgcagagcgccgcgcgccgcagcccggc

SEQ ID NO: 267 - DNA, 11472 bp, Unknown
  Kingdom: Bacteria, Phylum: Actinobacteria, Class: Actinobacteria, Order: Streptomycetales, Family: Streptomycetaceae, Genus: Streptomyces
  misc_feature (10942)..(10943): n is a, c, g, or t
gcagccgcgacctcggccgaccaggcgtcgacgggctctccggcggcgggaagggtgcggccgagcagcgcgatgcgcgggcggatgcccgtcgcggcgataccgcgcatggtggccaggccgagcccgcccatccccccggtgatgacgtacacgcccccggagcgaagggccggtgtgtggtggggtgacacccgcagcggcgtctcccggcgcacccagcgctgacgcccgcgcagcgcgacgacgaggtcttcgtcggcacggcagagttcatcgcgcagttcgccgacgggggtgttggaggagaggtcgatgaccttgcagcgttgccgcggaagctcggcggccagcgtgcggacgagcccgtggacgctcgccttcaccgggtcgaccggatcggctcctgagacgtcgaccgcccccgaggtcagcgcgacgagttcggggatgcggcccgtcccgctggtccgcagcccgtgccggaccagcgcgagcaggctgaagaagctgtcgtccagctgccgttggacggtggccgtggaggccggcggccagggagcggcggccacggcgtgcaccaggaggtcggccccgatcccgcgccgggcgagttcgtcgaagacctgctcggtgtcggcggtgttcccggggcggatcgcgaactcgtcgccgtcgtgccggtaggcggcggccggacgtacccggatcgtacgcatctcggcgcgctcgagcgcggccaccacgtcgttcgcgcggtcctcggcggcggggaggaagacgacggctgtcgcgcccgcccgggtgagacggggtggtgtcggagcggagacggtccagtgcagggacgagaacgggttcggctgaccggcttcgagggcggtgcccggacgtgcgggcggtgccgatcgtgccgtgtgcgcttcggcgttcgcgtccggcgcggccttggcgcgggcgggggctgccggcgcggtcatgaggtcggcgggggctgccggcggcgcgtcgacccagtgccgcttgcgctggtaggggtagccggggagcgggatccgatggcgcagcggagcctgcccgacggcttcccacgagaggtcggcgccggccgtccacaggcgtgccgcggcggtcagcagggcggtcatgtcctggtcggtatggtctgcccggtcaccggcagccgttgtgccacgccgtttcggcagcgtcggcgctacggcgacggaggtgccccggacccgctcgtggcggcgggccagctcggtgagcacctgcccggggccgacctcgaccagcacatcgggcccggtctcgaccagcgcgtcgagtgcggtggcgaaccgtacgggctcgacgagctgatcgacccagaaggccgggtcgacggcctcgtccgcggagatgacgcgtccggtggcggccgagtagacgggcagggccggcggcgccaacgtcatgccggtgaaggccttttcgaaggtccgggcggcttcctggagcaggggcgtgtggaaggcactcgatgtgggcagccgggtgcatgcgacaccgcggtcggccagctccgcggccacatcggcgaggtcgtcgtcggacccggccagcaccacctggtcggctctgttgatcacggccacggtgacggtgccggtgagaacgtcgcggagcgcgtccgcaccggtcgcgacagcgagcatgccgccgggggcagggtgatcgcgcatcgccctggcgcgggccaggacgagtgcggcggcgtcgtcgggttcgaggatcccggccaccgtggcggccgacagctcgcccaggctgtgaccgaggagtgcggcggggcggactcccgcttgctgccacatgtgcgccagggcgagttccgtggcgaacagcagaggctgcgcgagggaggtctcggtgatgtcgagccccgcggtgccccgccagcagtcgcgaagcggcaggtcaggggcgtccagtcggtcgagccactcgtcgagtgcgcgcgcgaaactcggcacgcgccggtagaggccctgggccatctccacatgctgggaaccctggccggggaacagcaggcagacggagggcgggctggtcagcggctgccgcgagacgaggatgcggccggtgtcggctgccgtgagggcggtggccgcgtcgtgcgcgccggtgcagacggcggcagcccggaccggatgggtctgacggccgtgctgcagggttgccaccgcgtccgcgaacacctcttcccccagctgcaggaaggcatcggcgaggcgggtgcggacggtcggctcggcgtccgtggtggggctcgaccagatgaccggacgcggttcctcctgatggcgggtgaggggcagggcggggggctcctccacgacgacatgggcgttggagccaccgatccccatcgcgctgacgcccgcgcggcgtggccgctcgggatcgcgcggccaggcggtgagccggtcctgtacgcggaacggggaggcgtcgaggccgagccgggggttgggcgagcggtagttgacgctgggcggcaactgctcgtgttccagggcgagtaccgtcttgatgaagcccgccaggccggccaccggccccagatgcccgatgttgcccttcaccgacccgatggcgcagctgccggccgccagccgctccccggcgagtccggtgaaggcgtcggtcagcgcgctgacctcgatgggatcgcccatgaccgtgccggtaccgtgcgcctcgacgtaggagatgtcgcccggtcgtacaccggccaccgtcagtgcttccctcaccaccgcacgctgcgcggccgcgttgggcgcgccgaaactgaccttgtcggacccgtcgttgttgaccgcgctgccgcggatcacggcgcggatgtggtcgtggtcggcgagtgcgtcgggaagtctcttcagcatcaccgcacacgcgccgccgccgaacacggtgccgtcggctcgctcgtcgaagggtctgcagtggccgctgcgggactggactccgccttccgtccagaggtagccgtgcccgaacgggaagtcgatgctggccccgccgacgagagcggtgtcgcagtcgccgacgcgcagcgactggcacgccatgtgcagggcgaccagggtgctggagcaggcggtctgcacggtcacgctgggtccgtgcaggttgagtttgtacgaggccatggtggcgatgtagccgccgaggttgagggtcgcgacctcggagagcggaaatcccaccgcgtccttccgggggcgcaggtggtgttcgtcgtagagcggcgcgccggccgaggcgaagaccgcggtgcccgcgctgagggtggtcgggtcgtagccggcgttctcgatggccgtgtgggccgcttcgaggaacagccggatctgcgggtcgcaggtctgcgcttctcgcggtgtcatggcgaacaggtcggcgtcgaagtactcggcgtccggcgccagggcggcggccttgacgtacgcggtgttcgcgagcagttcttcacggacgccgtggtcgcgcaggtgctcgtcgctcagcgccgccacggactccttgccccggacgaggttcagccagtaggcgtcgacgcaagacgcgccggggacccgtgccgcgacaccgaccaccgcgatcttgtcgtcatcgtccactgaggcctcctcgatcaacgacgtgcgacctcttggaagctacggccccgggcggggatcggtcgtgtcgccgaaacaggcgaccgatcaccgttctcggggcggtgtggtggggatgaggagggatcgcaggggctgcagccggcatccgcgcagacgcttggcggacagggatccggtaccgaagtcgatcagtgcggcgccgtcggcgatggcgcgggcgatgggttcgtaataggtcaggttgaagtactgactgtggtccggtgccgcgtagtcacggcccacggccctgatcgcccaggtgccgccgctgcggtgtacgaccgagaacgccacgggtctgccggacaggtgacccaccagcgcgcgtacctcggaacccggggtcatcgcgagcatggccaggtagaactccgcctcgagcgggtccgcggtgtcgccgtggcgctgctgggtctgcgccagcagcggggcgacctcggccgccacctcggacagcggttcgtcgcgtacgacgatcccgctgtccgcgaaggcgcggcgctcctggcggacctgccatctgcgtttgcgcgggagtgcggccagatactccgagaagtggccccatgcgatcggcaggacggccttgtcgcgtgaggcgaccgcgagtgcctccggctcgaattcggccagccagcgggcctgtgccgcatcgaggtccgggatcaggacctgtgggcagccggccgccgaggcgacgtcccgggcggctgagatcaatgcgcgtgcggcgccggcggcgcacgcgggctcgatcgacgcccgcaggaccaggtggttgcggtagccgccggcgcctccggctgaacacagcagggagccggtagcgggagccccgtcatcgaagatgttctccggggcgagggaggcctcgtaggggcgcgagaactgatagacgggaagcagcccgagagcagcgcccgacgtgccgcgcaccaccaggtaggtgatacgggcgccacgcctgcgctccactatgtggtggcgttccagttcccccaggacgtggtcggacgccgtgacgccgagttcgtccaggaggccgatcgacaccttgtcgacttcctcggtgcgcattgctctcaccccgtcgcctgcgggccctggggacgggcccccttgtaggggacatcgcagggcgggcgggaggccagtcacccgaacgagcggcatgacgctccgtgcggcgggcccgagactcgcctcacaggtctgcccgttgaacggctcggatcagcagtgcactcggcgggggagtttcatatcttacggaacgccgactcatcctggaaacccccgctcgatgaacacggcgcgaggatcgctgagttggacggacctactgtggaggaaacctgatgactgttcacctgctcagtcgtgcggatgcgcggcggatcgcggttcgcgcgcagctcctgcacggcgagcggccgacgtcgttgaccgacatggtccggcatctgacgctgctgcagctggatccgacggcggcgatcgcgcctgccgcggatctggtgtcgtggagccggctcggtgcggcctatgcgccggagcttctggtccaggcgctcaaggagcggcaactcgtcgagatcggggcgaccatccggccggtcgaggacgcggtgctcttccgggccgagatgatcgagatgcggcgccggccgcccgtggccgactgggagaagcggttccacggctggctggaggccaatgacgcatgccggcgggacattctttcccggctggaggccgatggcccgctgctctcccgcgacatcccggacacgtgcgtgctgccgtggaagtcgacaggatggacgaacgaccagaacgtgatccggctgctgggcctcatggctgacctgggagaggtggccatcgcggggcggcagggccgcaaccggctgtgggacctggccgaccgcgtgtacccgcaggcgccggtgccggacccggaggaggcgctgcgggtacgcgacgagcggaggctgcgggcgttggggatcgcgcgcagcaagtcgaccaaggtccccatcgagccctatgacgtcggcggggcgggcgaggccgccgtcgtcgagggagtcaaaggcgagtggcgtgtggaccccgtgtatctggggcacccgttcgaggggcgggccgcgctgttgtcccccttcgaccgcctgatccatgaccgtaagcgcgcgatggaactctttgatttcgaatacggagtagagatgtacaagcccgcggcgaaacgccgttggggctatttcgcgctccccatccttttccacgagcgcctggtgggcaagctcgacgcgaccgcggaccggaagaagggcgtcctgcgggtcaatgccgtccacgaggacgaggttttcacgaaggagatggcggcagccgtcgatgcggaggtggacgcgctggccgcatggctcgaactggaggtggagcgtccctgagcggcacactcggtggacgagcggcgcattcggtggacgaaggggaggcagggcgatgcgaagggcgccaccacccttcgcgccgcggtctatggcatgcggagtcggcgcgctctgacgtcatgaaacggatactccgtcccgtcccaggtgagactcggcaggagagggcacgcggggggacaggatgtccgcggtaccgctggattcctggtgttccgtcgaggtgacgaacttgccgaggagagcggcgcgggtcagctccgccttgtttcccacgtcgagtttgacgcgaatgcgtttcacatacgtgtcgacggtgtgctggctgatgcccaggcgggtcgctatctggccgtgcgttctgccctgggcgatctgggtgagaacctgctgctcgcggtccgagagcgtgggctggcccgcctggaccgggttgccgacggggccggggctggggctgcggctgggtttggagcgggtcaacgctatgcgaccggctgatccggcggcggcgagctggacggcgcgcacgatcccgggccccggctcgtccttgctgatgacggctgccgcaccggcgttcaagtaatctttaccgtttgcggagaggccgttggtgaggacgagcaccgccatcgaccgggcggcgtccgtgacgatgtcgaggtccgcgccggcgaccgcgtcggcgtcgatgaccgccacgtcggcgagccagcagggctccacgtgggccgaggtacgggtggcgacgatcctgaccccggccgctgtgaggacctggctcaggccgagcaggaagcagggagaggtcacgagcagatctgtacgaatcatgcgtgtcccaaggaagaaggcggccactggcggtagcgcggtagcgcgatcgacggacgtcaggtgggctgggtgatgctcgctgcgctggtcgcggcgtcaggtacatctgtgagacgggactctgacggggaacatgcgtacccctgttcggacatgtcaaccttcgagtcgtcggtgaggtgacctgcgtagcgtgcaatgggcagggtcggcctgtcgagcacccgtgaggtgagaggttgtcacgtgacgggtgaggggctagcgttttgatgcgtttcaggaacaggcgatcagtggatcaatagatcagtcgatcaatagacgggatgagaccgcagacatggccgaggttctgctgtaccaccacatccagggcttgaccgacggggtccaggcgttcgccggggagctgagacaggccggccacaccgtgcacacgccggatctgttcgagggccgcaccttcggcagcctcgaagagggcatggggttcgcgcgggagaccgggttcgacaccctccgggcgcgtggggcggcggcggccgaggacctcggtccggagcttgtctacgccggtttctccttcggcgtgaccatcgcccagaaactcgcgcagacgcgacccggtgcgcgtggcgcgctgctcatgcactcgtgcatccccgtcgcggagttcgggggatcctggcccgagggcgtacctgtgcaggtgcacggtaaagaaggcgacgagttcttcgacgaggacctgcccgccgcacgcgagctggccaagtccgcctcggctgcggagctgttcgtctaccccggcgatcagcacctgttcaccgacgcttcgctcgacgccttcgacgcggaggcgtcgaagctgctgatggagcgagtacggaccttcctcgcgtcgatctgatcctcgccgcgaaccggcggcgggtctcacgccgactcggcgtgagatctgccgcaggcgcgcacccgcgtcccggacgggttggccgtccctggtcaacgcggccgagtcccgggcggcaggttggtccggccttggtcaacgcggccgagtcccgtgcggcaggttggtccggccttggtcaacgcgccgcagtcccgggcggcggattggttccgccttggtcaacgcgccgcagtcccgagcggcaggctggtcggggccttggccaacgcggccgtatccgaggcgggttgaccggcctggtcaaagccgtacgagcatcttgcccaggttgcgcccgcgcatcatgtccaggaaggcgcgaggggcggcctgaagcccctcggcgaaggtttcccggtactgcagctctccgtcgtgcagccacccggcggcctccgtgatgaactggtcccgcaggtgtgcgaagtcgccggcgagaaagccccggagggtgagccgtttgcccatggagagcgccagattccggggcgccgccggtggttcgccggcgttgtacatcgagatcgcaccgcacatggcgacccggccgtgcgggcgcatggctccgatggcgacctcgagctgccgcccgccgacgttgtcgaagtagatgtcgatgccgtccggcgcggcggtgcgcagggagcggcgcagggcgccgtcgtggtagtcgaaggcggcgtcgaacccgatgccgcgcaggtactcgaccttttccggcgagccggcggacccgaccacccgcgcagcgcccctcagccgcgcgatctgtccggccgcgctgccgacggcaccggcggcagccgacacgaagacgacctcgccgggttgcagggcggcgacctccaggatcccggcgtaggcggtgaggccgggcatcccgagcacgccgagatatgccgagggcggggcgaggccggggtccaccttcgtggcggcgtcctcggccaccaccgcgtactcccgccagccggcattgtgcaggacgacatcgcccggtgcgaagagcgcggacccggactcgatcaccgtgccgacggtgccgccttccagcggtctcccgatgtcgaacggcgctacgtacgaggggatttcgttcatccgtccgcgcatgtaggggtccacggacatcacctggttgcggacgagcagttcacctgcctgcggttcggccaccacgacttcggccatgcagaaatcgtcttccgacggccagccgagcggccttgaaaccaggtggatctcgcggcctttcatgggtctcacggtaggcgcagcctgaggatcggcgtcgccccaagttccggtgacaggacgcctcgccaggcgttgcctagggtctgtccggcggatcacgctgcaggtcagcagcggtgcggatcagcatcggtgagcgggtcctggtgcgtgcagctgcaaggcggaggagggagtcgatgcgatgggggtccctccccgcgcgagcgaagccgagcgtgggggaatcggcgagtgacgacaacgccgcagaggtgcctgccaggacccgcgtctgccgcatgatccgccggacagaccctcacttcagttgtcccgacactcggtcaccgacagcggtgccgtcgcgcacgcgcgggtgggtgtcgcccctcttgctggaggttcaccgtggcgccgaaggaacagctcgtgcttgcgcgcaccgtctccgagctgttgcgggagcgtatgcacgagcggccggactcgatcggctacacctatctgagcgacggcgaagccgagcgggagacgctgagctatgccgacctggaccggagggcatccgcgatcgcggccgcgctccatgccgcgggcgccggaccgggggaccgcgcgctgctgttgctggctcccggactcgattacgtgtccgccttcttcggctgcctctacgccggagtagtggcggtaccgtcctatccgcccgaccccttccggcgcgaacgcaccctgccccggctcgtcgccgtggtggacgacgccgatcctgtcatcgccctgacgacgtcggatctgctcgggttcatcgacggtctcggcgagcatgcgccgcccctgcgcaagctgcactggatcgcggtcgacgacgtgcccgaggaggcggccggccccgtcgcggtcgctccgggctcgacggctttcctgcagtacacctcgggatcgacggcggcaccgcgtggcgtgatggtctcgcacgggaatctgctgcacaacctcggcatgatccagaggtacttcggcaccgaccccgacagtcgggctctgatctggttgccgccgtaccatgacatgggtctcatcggcggtctgctgcagccgttgtactcgggctgcccggtgacgctgctgtcgccactgcacttcctcgagcagccgatgcgctggctgcgggcgatctccagcctcggcgtgaccgtcagcggcggccccaacttcgcctacgagctgtgtgcccgccgggccacccccgaggaggtggcccaactggacctgagttcatggcaggtggcgttcaacggggccgagccgacccgcccggagacgctggacaggttcgccgctgtcttcggtcccgcgggattccgggcggacgcattcctggcgtgttatggccttgccgaagccacactgatcgtgagcggcacggaactgggcaagccggtgccccgcctccagatcgaccgcgacgcactggccggcaataccgccgccgtctccggcgcgggctcggaagtgtcgctcggagacccgcaagcgtcgctcgggggcccgcaagcgtcgctcggcggctcggaagtctcgctcgtctcctgcggatccggcgccgcggaccaggagatcgcgatcgtcgacaccggcacggggcagcggtgccccgagggcgtggtgggcgagatctgggtgcgggggccgagcgtcgcccgcgggtactggcggcnncgcgggcgaggacaccggctacttgcgcaccggggatctgggattccagctggagggccggctggtggtgaccgggcggagcaaggacctcctcatcgtccgcggccgcaaccactatccgcacgacatcgagttcaccgccgaacacgcgcatccggcgctgcgggtgggctgctgtgcggcgttccaagtccccgatgacgatgccgaagaccggctggtcctggtgatggaggtgcgcgcatcgtccgggaccgccgacggcaccgagatcaccgcccgggtccgtgaggcagtggccctggtccacggtctgcgagcccacacggtcatgctggtgcgccccggcacggtgccgaagacgtccagcggcaagatccagcgcagtctgtgtcgcgcgcgctatctggcaggcgagctgacccaggccgtgcagcacctgccggcggcgaccgcgcccatggccaccgtgcccatggccaccgcgcccgcggccaccgcgcccgccgtggacgcgctgcccgtgccc

SEQ ID NO: 268 - DNA, 23783 bp, Unknown
  Kingdom: Bacteria, Phylum: Actinobacteria, Class: Actinobacteria, Order: Streptomycetales, Family: Streptomycetaceae, Genus: Streptomyces
gctgccgctggagcgggccttggacgcagccgagcagccgggagtgcggctgtgcacgctgtgcggcgccgccgccgagctggaccctgtcctcaagggcttcgaccgcggcttcaaagagacctgagcgcaggtcagcggcggacgacggtgtaaccggcgtcgttgacagcgcgggtccacacgtcgcggtcgaaccacttggtgacgttgggctgcatctcggtgatggtgcgcatcctcgcttcccagtcgtgtccggccgggccgcggctgccgtcgcggaccagggcgagctcggggttgtcgatcggtggcatcggggcctgcccgacgcccttctcgctgctgctctcctcgtaggaggcctggctctgcgcgaggcgttcggcgagggcggcggcgtcgaagtaccgccaggcggagcgcgtctggatcccgagccgttcggagacggtggtgatctgcttctcgatcgtgtcctcaaccgtcgccggcgcgagcgtcacccctcggtgggccagctcggtgagcgtctgggcaacggcttccttgaacgccttcgtgttccgcacgactgcatcgtaggcgcgctggagcagccgccggacggcttcacgcgcatcgcccccagggacacgcagtgcagggggagttgtcagtggctgctgccacccatccggtgagcaggggcctgatgtctggcacccctgacctgcgtgtctgcgacgccagtcgtaatacttaaaatcgtcaacagttacggcagatcaggctctgccacgattcccgacgccacgtcttcgaggacgaggtccggaatgatggccagtcccagactctgaagatccacgttcgggctggctgccttctctgcgacgcggggcgaccaggaggccagccggtccagtgcaggcaccaagccttctcggtcgtcactgagcagggctgccacgagcgacatgacatcggcgcgggaactgcctgctggagccgagagagcggccagccctgtgagtacgcgctggtcatgagtgccacagagcgccgcgagggcggtgagagcgaatcggacggcatcgctctcgtcttcccagcgggacagcagcctcggcagctcgctgccgatggcccgccgtgtcagatattcagccgcagactcctcccagacacccccgagggcggtgatgcgatcggccagcgagactgcggttgccggccccgaagcggcaagccgcaacaggtcgccgagcagaaccagccggctgccgggcgcgacattgtcatcgcagaccagctccatgaggaatgggacagcctcgacggtggtgtcggtgcaggtgccttggtgggccgcagcgtccgcgaggtcgccgaggaactcgcctgttgactcgtagggctcgccgaacgcgaactcctcatcgagcagccaccccacgacatccggaacgtcctccgcgctgccgtacatgcgctctgcgaccgccaccacggcctggaccagcgcggcgggcttaccgacctcaatgcacttccacggcggaccggccggaggccaggcgggatccttgggcagaggacacggaagggcgacctcggcgccggcccgctcgtggaccaggccgtcccgtgtgaagactccttcgagagtcgcggcatgcccctcgctgtacccctgctgaaaaccgccgtgggcacgggccacgccagccactcggatccgttcactccgaaagaacggctcgagagccatgcgttcgtacccgctgtagacggccagcgagaagacctgccaccacccctccagctccgggtccatcgacggtcggccgtaccagaagctcgacggaacgaaccggaagtgatcgtggacacgcactgctgtcagacggtgcccctgcccggacagctcggccgcggcggcgcgggcagcgccctcacttggcaggctcagcgtgtactggactccccaagcgggaggtgccgccgtcatcagctgcactgccaggtgaacatggcccgctcgaagcgccgctcggccagatcctccgggcggatcagccagtacagggctccggcatcgccccacatcatgtccgcggcgtccacgctgtcgaactgggcgagcagcacccagttgcccgcctcctcggacagccgcgggtcgccccaggacgcctcgccgtccaggatcgcctccgcgatttcgatctcgaccgggttctggaccgagtgagcgtggccgccgatctggtgccccacctcgtcgtcgaactcccacagcgcgtcgaggaactcctgggagcagacggggtggtcgtaccggttccccagcggggcgtccggggcaaaggcggcccggacggacggatgccagggctcggtcgccgtcatctcctcccgagcggtcagcggcactatcggatacggcttcagcccggcaggcgccctacgctccgccacctcctcctcggccgccacgtagaggacgcgggcgcccgcccagctctcccggtcctcggccagaacgagggcctcgccgtcgtccagctgaccgtcgaagtagaagaacagcagcgttcccgcctcgggcagatcgatgtccagcgcggctgtcggcagacgcgcgcagtcgattgaggcgacgaaggagagcggaccgtgcccctcccacactggccactccgcgtcggccggcaaggcgggaagaccaccgaggcgacccacggcgccgtcagtgtcaattgttacctcaagacccagtccagggcgaagcagaccgagccacttctcagcatcctcgggcgacaggtgctgcaaggcgagggattgaagggcttctcgggaaccatgtgtcatgcgcccgatcatccacggtgccactgacagagaccttggcggccctcccgctgcacacgcagccgctcagtccgtggccgtggacctccaagcagcggtaacgcacccttcttcccagtgccaccagccctccgccgcaccatgttccaggagctttcggatccgcggcaggtccgcccctggcgggaacccaccaaggagagcccacccgtgcagaagactgccctcattccctacgcccacctcccccaagcgcagcacaaccgccacgtcctgaccagtaccgtcgacgtcttcggcgccgcccactggctgcttgccgtgcgagccatccacggccttgaccccgcggctcaaccgtgctggcggggtggatggcgggcagtccccttcttgacgtccaggtgcaccatgtggcccggcgagcgggcagtgatcttcccgggctcccggttgctgtccccgcacgggtcgaggaaccggcggtgtcccagccctagcttggccaagtgccgggtgagggtgcgtcgattgacggcgtgagcgatcccggccagctcgtgagtgatccgctgtgcggaccacttctcctgccgccgccaggattcgatcctctcgatcacccacgccggcgtcgcacgtggactgtggtgcggggtcgatgagcggtcgagcaggccgaggtcaccgtgacgacgccatcggttgacccacttggaggcacatgcccatctcggcggcgacgtgcgatcggacgagtgcggcaccgttcaacgagccgccgtgggccctcgatcgtaagaggtgcattacggtgcggcatgcctagatcgctccgcgcccggcggcggattgccaagcaggttggctcggggcagctgtgacgagcccaagagcggcccgtgccgcgctgcgtgccgcagcggcaggcagcgcggcatctgcagagcgcgggttcatcgggtgatcggcgtggcgccggtcacagcgacggacaggtcccagagccgggcggcagaagcgctcagtgttcggtagcagtgccgcagaatcagagcgtgagcacaggccgtgtggagaagtcctcgcagaggtcttcaccgtccggtccgtacacgaactcggccatagaagggttgcggttggcggtggccaggggcagccacgccagcatgcggccgtaacccccgcacaccgactcgccgccatctccgccatggaccgcggtcacgtcgctggtcagctccgcgcggtaggtgtcgtaggcgatgcgcaggccaaaggcgctcagctgctgctgaggaccggtgtggtcctcgtatgggatgcggtcgagtggacagtcgttgccccaccggaacagtgtgtccgcgccggctccacaggcgtgctcccattcgtcggaactcggcattcgcaggccacgagccgcgagggcagctggcatgtcggtaggcggctcggtcaggttctcgtcctccacggccatgagcaccgtggccagggtgacattcctgcgtggactgagcacctgcgcgaggtgcgcccgcagatcggtgccatggccgaagccttgatccagactctccgcgtagtcggtagcctgctcaggcgtcggctgccaggcgtcgaggtcgaatccgagtgtcagtgcaccaccggggatcagagcgaatgcctgtgaattccgctcgatacgaacgcggtgcagcggagcaccgaggtgctcaatggtctcgaggacggtcacacggccatccaccaggtccgccgcctcctgagcgacacgacgtgcggtgggcagctcgagtgaccgccactgatcaaggctgaggtcggcaagggacatgcgccgcagtgttgcacgcacctctgacgcaccccgcggcctgggcctcggagccaggcggcgcccgccaactgaagcggtgaatcccgccaacccaggtgctcatccgccaagtgaagcgctcagtcacactgagccgaagctcaggacttgtcaccagcggcaccggctgagctggagattcagtcgcatgaagcagagcggtggtcaccggatcggcgcgccacttgtcaccagcagcgcccgaagcacgacggtgtcaccggccgcggcgctctctcggtcgtaccgcaccgcgtcgcgtcgagatgtcgacaggtgccccggcccggtcgaggtcacggggctctgtgtaccgtgccgttccgcatgacgaagtccacccgccggaccgcttcgatttgatcgagtgggttgcccggcagtgcgatcagatcggcggtcgcccccggctcgacgcggcccaggtcagggcggcccagcaggtcggcggcgacactggtcgccgcacgcagggctcgtagcggggtgataccggacttcaccatggcggggaactctcgccagttgtcctcgtgagggaacattccggcgtcggtaccgaaggcgagccggacactactggaggcgacgttgcgggcggactcacgcagctggtcggcgtagcggtggaacttctcccgttcggcggggtccttgcccgtccagtaggagtcgtcgtcgaggtggtcgagggcgtcgaccaccatgaactgggtcggcaccaggaagacgccgcgttcctgcatcagtgacagtgtctcggcggaggccaggttgccgtgttcgacggagcgcactccggcgcgcaccgcccgcaagacgccctcgtcgccgtatgcgtgcggcgtgcacggtacgcccaggtcgtgggccgcggccaccagggcgttcatctcctcctggctgtaggtcgcctggcccggatcgtcggagggggtggcgaaccctccggtcccgccgaacttgatccagtcagcgccggcgcggatgtcttcccgcaccgcccgcagtactgcgtccgggccgtcggccaggtggccgatctcccgtccgaggtgcggggcgagcagggtggagacatcgccatggccgccgcgtgccgagatcaggtgtggcgcgaccagcatccgcggaccggtgacgacgccgcgggtgatcgcgtcacggaggtacagcgtgaccggttcgccggcgaaggtggccaggtcccgcaccgtggtgaaaccgcggtccagcaggtcgcgcagtaccggcagcgcgtgcagggcgatggtggcggaggactcggagacgaaggcgttcagaaggttgcgagggtcgacggtggtgtggacgtggcagtcgatcaaccccggcatgaggacccggtcgcccagatcgatcactcgggcattccttcgatcgacagcggcgcccacctcggcgacccggccgcgacgtaccgccacctcggtacgcccgccgaactgttccgccagtccgtcccagaaccggtcggcgatcaccaccacgtcctggctctcgtcctgtcctcccaccggtccggctccctccgtcatccgctccgtcagtgtccccttcacgcgcgccggccgcgcgccgcccgcagcggacggatgaacgctgagatcccgtagtcatggacgccccgtccggtggccccggtgacggcatgcccgccttgatgacaaccatcgcgcttcggctcaataggcggaaatgtgactgagcgcttcagttgaccagttgagcgtgtggatctcgccgacggggccgcggcgggcctgcaactattctcaccctgcgcgggtcctccacttcaggccccgggtggggtgcgtggcgcgtggggacgggggaacgctgtgcgagtccgacggatagcgaaaaggatcagcgagttcctgctggagtcggtcggcgaagccgtcgccgaggtgatcctcaccctgctcgcctgcgctctactcgccggcctggctctgatcgtctacctgagctggtcattcagcccgctcctcacggtggcgggcgccggtctgctcagcctgttcctcgcccacggcgcctggagaatcttccgtgatcccgcgaagggcagcggccatcggggccttgccgccgcgaccacggccgggttcacgttgacagccgcgacggccgtgttcctgctgctctacggcacaggatgcggctgcctgtgaaagcggctctttgacgcagggctcgtcgccacgcggcctgacctgtgcggatgtcagggctcaggccggcaaactatcgcgctcagtggccaactagaacgctcagtgacacgcgatgtaactgagcgctagatcttttcaatgagcactggacttgtcgtgctgcgcattcgagttggcggacaggctagccctcgttgagagcctgaggttctccacggcgcttccatgagcagccctggcctgacgagcagccggacaacgtcggaggcgggctcagccgacggatggccgtgacccagcggggcagggtgccgtggtcgagcgcgtggtcgtggtgccgggggcggtggtgtgctggtcgaggccgccgaggatgagtgcgaggcccgcctcgaacgctgcttcgtgatcgagtgcgggaacgccgtccggcaggcctgcggggtccggtgcgtcggtgtcggcctgttcctccagtacgcagccgatggtgaagcggctggaggccagcatcgccatctgcgcatgctgctcggggacgcctgaggcgacgaggaaggccatcttgcggcggatgcggtccaggtcgccggtcggggtgctgccggcgtgcaggcgggcgccgtcacggcgcatcagcagggttcggcggaagcttcgggagttgtccaggaaccaggcatgccagtcgtccccgggctggggaagcggcgcggtggcgtgcggggccatggccgcctccgccatcgcggtcagcaggtccttcttggtcttgaagtggtagtagagcgacggctgctccacgtccaggcgcttggccagccgccgggtgctgacggtttccagccctacctcgtccagcaggtcgagcgcctcggcgacgacggtctcgcggttcatcttggtcacgttgacaatctatcgctgatagaaaaccctggaaagacagtttcaatcaccgatagattttggggtgggtcatggcatgcgagaacgcgaagcggtctttgcggatcctggtggccggcggcggtgtcgccggccaggcactggccttctggctctcgcgcggtggccacgaagtgacggttgtcgagcggttcccggcgctgcgcgcctcgggggcgcaggtggacctgcgcgggcagggcatcgaggcggtggagcggatggggctgttggaggaggtgcgcagtcggctggtggacgaggccggggtggcgttcgtcgactcccgcgggaagccgaaggcgacgatcatggcgaacacctccggcaagggccgtcagacgctgacctcggagtacgagatcatgcgcggtgacctggtgcgcatcctgcacgaggcgacgaaggacggcgccgagtacgtcttcggtagaagcgtcgacggcttcgaccagcgcgcagacaaggtaaccgcgcacttctccgacgggacctcgggcgagtacgacctgctgatcggcgccgacgggcagggctcgcgcacgcggcgggcgctgctgcccgagggcttcgacccgtactggcgggtgggcatccacatggcgtactggttcgtgccgcggatcgcctccgacaccaacatccgcgacacctacatggtcccgggcggtcggcagatcatgcggcgcagccacaacgcgaccgagacacaggtgtacttcgtgatgcgcgaggactcgaaggaagcctccgcgatccaccgcacgcccgtcgaggagcagcagaggttctgggccgagcggttccaggacgcgggctggcagaccgggcggttcgtcgccggcatgaaggacagcccgttcttctattcccaggagatcgcccaggtgcgcatagacagctggtccaagggccgggtggtcctggccggcgacgctgcgcactgcgcctccccctacagcggcatgggcatctccggcggcctggtcggcgcctacgtcctggccggggagatcaaccgcagccctggcgacctgacggcggcgctggcgaactacgagcgggtcctgcgtccgttcgtcgacgacatccagggcgaggtgaacccgaagatcctgcgggtgggcatgccgctgagcaagcacgccatcaccgcgttccagaacgtcacggcgctggcctgcttcctgcacattcccgacctggtcgcccgcatgtccaaggaggaccgcggcggcgactggcagctccccgcctacgccgaagccgcctgatccggcccgctctgcatgccggtcatccgccgccggtgccgtcgggccggtcaagcagtgaccatgccttgcgaccgcacggtccaagcgggcgcggtgacggggcgcgtgtggtgctggaagacggcaaatcaagcggcactctccagcatcgtgcactgacgccacgcatcaaagccacgcgggatcacggccgcctcaggggccgtgatcccggctgggcccaggtgccgcctcccctcgtcgccatcatgagccctccaagggagccgaccatatgccgtcgatgagctgggatcgggcaaccggctccgggccgcgggagaactggtccccgccgccccctgccatccactgcgcccattggcgcgtcgcggcccgcagtccactccgccacctggagctgcgggtggtccttgctgtccgcgaactcgatgccgcccatgaaggggctcatggacggcgcaggctgacgcggcgaacaaggaggccgccaccgcggtcgcctccgctgccaaggcggccggcttcgcctatgtcaccgcccaggccgccgtcgatgccggcaaggccgccgaacaggtcgccgatcccgccaacgacgcgatccaactcggctccccgtacgtcgacaccgactccgccgccgctctggtcgtcctgaccggacagggctccaagacgatcgccgagcagcagcaggcggtcgccgatgcccacgccaagaacgccgccgccgaggcccaggccgcccagaacatcgcggaccaggccaagggcgacgccaaggaggcctacacccatgcggcgggtgccgccaagtacgccgccgacgcccgcacctactccaaggaggcgctcggctacgcggccgacgccgccagggccgccgcggcggcttccgcgtccctgacccgcaccatcgcctacgacaaggcggccgccgaggacgccgcggcggccgacaaggcggccggccaggccgagggctatgccaaggaggcccgcgactccgccgacgccgccgaactggacgcggcggcggcccgctcggcggctgcccaggccgagcaggacgccaaggacgcccgcgccgccgccacccgcgccgacgccgccgcgaccgaggccgaacaggccgccaaggacgcggccgagtacgccgaggaagcccaagcggcggccgaccgcgccgagaaggccgcgaggacccagcagatcgacacggggaccgtccccgacggcaacggcggctcgatcggcaacgtgttctacgtcgtcgaccacatcgagaaggtcggcgacccgcagaccgtcagcaagacggacggctgcgacggctggatcgacaagctgttctaccggggcgactgcaccatcacctcgaagatccggtacgtggctgtcctcgacctgtacctgtgcagcgcccaggacctggacccgcagaggttctcctgcccgtccgaggccacggactacatcggccagatccggaccaaggagctgtcccagacggtcacgcacaccatcacgatggaggagtaccagagcaacatcgacccggtcgacatcctcttcggcagctggatcaagtgcgcccagaagctcacccccggcgggcagagcggaagctggggcggctgcgcatgggcggccgtggacgtggcctcgatgttcgcgggcaaggccatccagcccatcgcagacgcgctgcgcgccgtagacgccgccttcgccaccggcatcggcgtgcgagacgccgtccaggcgctcaaggccatcgacggcatcgacgcggtgacggtcgccgcgatcgagcgcgaggtgtcgatctacgaggagctggtgacctcctgcaaggtcaacagcttccccggcgccaccgaagtggtcctggccgacggcggccgcaaggcgctgcgtgacgtacacgccggcgacctgctcctggccaccgacccgaagaccggacacactcggggcgagcccgtcacccgtaccttccggcacggagccgacgacctggtggaggtgacgctaaccgacggcggccgtctcaccagcacccccggtcaccgggccttcgtgcccggccgcggctgggtcctggcctccgcactccgccccggggacgcgctgcgcaccccgagcggcacgcgcaccgtggcggcggtgtccgaacggcacgaggcgacgccgcggacggtgtacgacctgaccgtctccggtctgcacaccttctacacggtggcgggtgacagcccggtcctggtccacaactgcaacgacctcgtggccgacgcgcagaagttctccgggcaggcccacacgcttgacgaacacacggccgggatcgtcagcccgcagcgggccgtcgagctggccaaggcgaaaacgctgaaactcggcaagcccacgcccaacagcctcttcgtcgaccagcagaccgcccagcaggtcgtggactacgcgctggccaacaacgcgaaccggatcaagaactggctccagaagagcagggaaccgcaactggacttcaccggtcgcttcggggcgaagaattcgctcggcacggtctactatccggacgggagggccgcgacggcggcgggcaacgggttctacatcaagctcgtgcgcgccaagggccacaaggccggtttctacgtgcagacgtgctacccgaagtgaggaggcgagttgtgatgccacgcttcacgccgttcgacttcggtgtgacgactgtcatgggtctcttccatcaggactggatttacgacggggacacggctgccgacgtcgtcgccaagtatctcggccagtcgcaggacgagcaggccctgtccgtgcgccgtgacgcacggctcctcgccgtcctcccctctacgacgctggaagtgctgtgggaggccgggtctcagtacatgccggccttccaccttgtgggaggcggagccgggtggacgcgcacggtcgccggcctgtgtgatgcccggctgtcggccagcgccgaggtgcacgcgctcacgggggcggacgcagaggaaggcgccgcctgcctcgacgcggtcgtcgcggagatcgagggagtacggctccttccggccgaggtgcgctccgcactcaccgagtgcgcgcgcctctgcagcccggacctggcgttccgggtgctgctgagagccatggcctacacggatctcgatgtctcgctgtccgcggcgcagtacgcgaggatggaggccatcggttcggctctgcagtacggcgagttcgtcgtcgacagtgtcaagtacctggccgaagaagcctgacgccgagggcggacggagtacgagcgagccccggacccgcattggtccggggctcgcgagctgttcggggcgcggactgctacagctcgaactcgaggtccagcacgtcgttgatctgtacttcttggagcgagccgacgcgtcggccgccgtcttggaggtacacctctttgagcgcttcggtggtgagctcgcgcagcccaggcggggtctgcgcgcgcgggtttaacggcctcgggactgcccctgcgcgcgaggacggcacaacggctggcacccgcacatgaacctgctggcgggactgcccccgcgcgcgtggacggcacgaggagttccagggcaagggctactgggacgccgcgatgggactgcccctgcgcgcgtggacggcaccctaaccgacctgctagttctgttctgtccgcgcccgttcagcaccacttttgaggattccgtcatacgcgtgcaacgcgatatttttcgcgtaggttacgtccgctgaagtggtgtatcggcggccactcggtgatctcttctttgaggctatgcggtgagttcggtgggcaggacggtctcgtcggtttctgactcgatcgggtggaggcgggctttggcgaggagttcgcggcccatgtagcggcggccctcggtccactcgtcgttctgctcggccagcaccgcgcccacgagccggatcacggcggtgcggtcggggaagatgcccacgacgtcggtgcggcgacggatctccttgttgagccgctcctgcggattgttcgaccagatctgccgccagatctcccgcgggaaagcggtgaaggacagcaggtcgtgctgagcggcgtcgaggtgctcggcggccttggggaacttggcctccagagcgcccaggacgtgtcgcatctgggccttcacggcgtcggcgtcgggttgttcgaagaccgtccgcagcagggtggccacccacggctgagccgacctggggacctggctcagcagattgcgggcgtagtgcgtgcgacagcgctgccaggacgcgccgggcaggacggccccgatcgcatcgaccagaccgcagtgggcgtcggagacgacgagctggacgccggacaggccacgggcgatcagcgagcgcaggaaggccagccagccggcgccgtcctcggcggttgccacgtccaggccgaggatctcgcggtggccgtcggcgttgacccccaccgcgatgagcgcatgcacgttgatgatgcggccgccttcgcggaccttctgggtcagcgcatcgacccagacaaaggagtacgggccggcgtccagcggccggttgcggaaggcggtgacctgctcgtccaggtgccgggccatggccgagacctgcgacttcgacagctgggtcaccccgagggactcggcgagcttctccacccggcgggtcgagacaccgagcagataggcggtggccaccaccgagatcagggcctgctcggcgcggcggcgccgctcgaggagccagtgcgggaagtaactcccagacctgagcttggggatggccagttcgacggttcctgtcctcgtgtcccactcgcgtgggcgatagccgttgcggtggttgactctctcctcgctgacctggccgtattcggcgttgcagagggcgtcggcctccgcggacatgagcgcgtcggcgaacgtcttgaccatcgcgcgcagcagatcgggactcgccgcggcgaggttctcttctgcgagggcgtgcaggggcacactgtcgggtgcggccatcgtgctgatctccttcgagctttcgacacctcgaagatcagccggtggccgttcttgtatccgggcactcactcagacgccaggccaaacacccggatcaggtgggagcccgtacaccacttccaaggacgcaaccttcgcgtaaagggggcaggcggtcggttgcccggccgcgccgactgccatcaggtggcagccttaccgtttctttccacccgtagtgggatggtttttcctgcccttgcctgaaggctggtgcagtccgcggtcgcgctactcccccgtccaggggacgagtccgccgcgtcgacaacgaagcggacaaacacaccatagacgctgtcgcaacgaacctcacgcgtgacacatcggtatttttcgggcaattcgattgtcagtggtgagtgcaaagctgcgtgacatggacaaaagcaccgtcaccgttgtggtccgcctgccgctcgatccgactcgggagcaggctgagatcctcttccggtacgccaacgcctcccgctgctccttcaacttcgcctacggcatcaagagggccgcccagcagcggtggagcaatggccgggaccagctgattaggcaggggcagacgcctgcggaggcgaccaggaacgctccggccgtggcggtcccgcggcagttcgacatccagaaggtgttcctcgaggtgcgtgagcagcctctgccgggaccgttgctgccgggacaggaaccgcggttcttctacccctggtggaagggtgtgcacgcgatggtgtgtcagcaggcgttccgcgacgccgataccgcgttcggcaattggctgagtgcgtcgaagcgtggagtgcaggtcggctatccgcggcccaagcggcgcgggcgctgccgggacagtttccgcatgttcagcgtcaagctggtgccgggcagtttgcggcacgtgaggatcggcggtgagcaggcaccgggaggccagaaggcgttcgtggtgcgtctgcaccgcaccgcgcgcccgctccgggtgggttcgtgcacgcggtcgatgacggtgttgatctcttcctgttcgccgaggacggcgtggtggaaggcgagggccagctcgaggagagcctgggccgagctcctccaggggtacgggtacgtacccgtatcctgatgggtgtggagaggagcatgctgatgtctgatgcgaacgttcgtatcccggaggaggcccgggaccggctggcggcgatcgcggctgccgagggtatgtcgctgcgcgcgtacctggcgcggctcgcggagaccctgctgacccccgaggagcgggcggagcgggctgagaaggcacgggccgctctgaaggagtggaccggctacgccccgagtgacgctgaggagcgcggcctggacagcgagctggaccgccggctggcccaggcggcggcccggtgagcgaggcgatgcacatcgtcctggacgacacggccatggccgccgccggccgcggcaacgtcctcgtctcccggctgatccaccgcgcccacgcggagaccggctggtacctctacgcccccacctgcgcgctcgtcgaagccgaccgggcccggccagggacagcagaacacctggccgccctgccgggcatcaccgtcctggacctcgacctgcccgccgctctggcggtggcccggcaggacggctgggccgcagctcatgcgcagcacgccgcgcagcccacgcccgaccgccccgacggtgcgatcatcgccacgaccgcccctgagcggtggaccggcggaccggtccgggtcctcgacctcaacccctgactagcagccctgtctggcccggctgcgcgaggaggtcttcctgggcccggtggtggcggcgctcggtgacgagggtgcgccaccggttgcgtacggcgtcttcgccgtcgatccaatggctgcccggcctgcgtccggctggattgccgggcgtcggccggggctgctcatgctgcggtcgcgccgggctcttcacctgggtcagtgtcctgctctgaggaagccgacggggtgccgtcgttctccggagcatcctccgtgcgggtctcgcgcgaggcgtctggggctgcggtggtgcggtcgtcgagggtgatggtgactgcctcaccgctggtggtgagactggtcaagcccttatcgatccgctcgtacaccgtggcggcgagttccaggtcaccgtcgccgtcgtcggcggtgcgcatgatggagtacaggctgatcagcaaggcgatcagagagcggccggacagcgcggcaccgatccgctcggcgccctcgtcggcgacctgcgggggcactcggaagtgggggtggcggccggcgtgggcggtgatgagaccggcttctcgctcggaatgatcagctacctgggccgacgacatgacctgcccggtcgccggcccgcccggaagggctgacctgccgcgtcacgcggcggggtcgtcgtcgagcgccagctcagcaacccagttctgggcggcggcaaggttcggcgcggtgccgaccacctggtaggtgaagccgtcccactcctccaggacccgcggctcgtcgggccggaggtggccggcgctgccgtgcaccggacggctacggcgccagaggtctatcggcggccggcgccgcttgtggtacgcggcgagcgggtcgtcggcgtccacgcgcgggacggctggttcggtggtccgggtcggcggtgcttgcccatacgttcgatgctctcaggcagcgatcgtcgtcgggcgtgcggcggcgagttccttcgccctcctgcgcacctcatcgacggcggcggtctcgtacgggcgggccgcctcgagcagcgtgttgagccgggaggcgacgagggtggagtcgaagacccgtacgacgcctacagtccggaacggatcagcgatgccccccgaggaggcgttccacctgcggttcctcgcccagagcgcagtgcccgacgcacagaggacgaccgtgggcgaggtcgtgcacctggtcgacgtcgtcaccagctccgccgccaccctcacccccggcgaggacggctgggccgtgcgcgagggcgggccggtgaagttgtgggagcggatcgagcgcgtcctggatgcctacgacgcggctggcgccccgggcccggacaccttcacgctgcacgtgtacgaaggcgggcagcacctgcgccaccggcagatgcccggcctgccgctgcccaggccctgacagggccgtacgctccaggcgcccgggcggggagagcgacggcccccgcccagacgcctggcacatttacctggcggtgccgtcggctcctactcgagagccacacctggattgccagcttcgcggctcggggagccgcactgagccgtggacgtggcccaaatcatgggcccgttgtggtggtccactgcaattggttgttgcgccactcatagtgataggtccgggtctccccagtcgggcagcagaccgggtcgtcgggcttcgcgaagtgcacgctggccgtcaccgtgttcccgtcctgggcttcgatgtgcggaaagctgtatgtggggccgttgggcaccatgccgacgtagcggttgccgtagaagagaaggatgtcctgggccgagccgtcgccgccgcagttgctgcagacctggacggcccgcagggggcctttcagccctttcacctcactgaccggttcgtacccccacttctcaaatagtgaggccgatgcggggtggaggggcgctcgggcggctgccccggtggcgctcgggcagacgaagtccatcagccctgcgggtgtgttcatcgccttcatttgggcgcactgactgctgcgcttcgaatcgccagcaggtgcgctcgtggagcgcatggtcagagccggcgtgagttggtctccgctgcgcttgaacacgaccgtggacacgcgctcggattggaacgtcggaacccagtccgccacggcccattctttccagcactttctggcggtcacgacccggtcttgagaatctgcgccagcatcgaccgctgccacggctgtcgacatggtgctctcggccgggcatgtcgtctccttctccttggcggctttgtcggcggcggactcctgccaggtgaaggtcttcaggaccttgtccatcgccaccagggtcctcgttcctgccctcgatcccgtcctcagcgtccacaccatccaccatgcgggggtggcgccggccgtggagtcagctgaggatgggcccgtgtcttgaagtgaactcgcgggtcctttcgcgagaatcggggtggtcgacccgccggttcgccgtgaggaaccttcagtttccgcgaactcgcggggctctacgggcgtgagtagttggcgtacagaaagtgccgctgagattgttcttgctggagtcggtcctcgacggccccggcctcgccgcccggctcaaggctctgcgcccggtcctcgaccccgtggacggcgagcggcccgccgccggcaccgcggccgccgccgcccgcgtccaggtcctcgtgctcctggacgaactgctcgccgcccgccacagcgtggacacccgggcggaggaatggccccattgagcccaatgggtctaaccatcgctgacctgtgccagcgttccgctgatgctttggccccataacgtctgggcggtcggcgcgtttggcaacgcgtgacgaacacaaggctgacgcagctgcgtcgcaccacccgtacggtgcccgcccgggcacgggcccgccacgcggcgcaggagaagccggagccggaggccgccgtgagcaccgaagctgctgcgcccgcccggcgttctcgccgcaccgctcgccagcgcggccctcagcgggtccagatgtccgtccggctcctgctcgaggacgacgcccgcctcgacgtcgcgctggagaagaccggactctccctgcaggacggcgtcaccgaggcgctgcggctgtggttcaggaagctgaagattcccgtgctgcccgtacccgagccgtcctcacgcgactgaagcccgcggttcgaccctcggtgggcggtgcgccctgttccgggaagccgccgggcaagaccggcggcagttctgctcagcgcacggggccgggccagtgcgccaggccgtcggcggtcggtgcccggcgggtagcctcctgcggcgagtcgtagaactcgtaggcatcgcccaggccacccattgcgaagacctggagtatccgggccgaagggcaggtgatccgcagcgagccctcgtgttcccggatgcgtttggtgatcgccacgacggcgcccaggccggctgagacgaggaagggcacggggcacaggtccaggacgaagttgcggtgcccctcggcgagcagccggatgactgcttgccggatcacggtgtgggtgtggatgttcacctcaccgtcgacttcgacaacggtccagtcatcgacgaggtcgcagtcgacggtgatctgctcggttcgggcgatggtccggctcatggcccgtcctcctcgcggctccggacgcggacgaggcccccctgcgacgcgttgcacgcctgccggtcttgtgccgggtgcagatgccgcccgcctccatccaaggcgctcgtcggatgatcgcaagcccggggccccagagccaggggcgacggccgatcccatgaaccccacgaggccggcgcctgatcggcactgcccgccgacgagcaggcgatggccgcccgggtcaacccgggcggtcatcgtgtggccctcttcatgagggcgtattacgacgttcagggccagtgggccgctgtggcggcgtaccgtcacctccaggcgatgcagtgaccggccggtcacatgaggttgcaacctggggaggggccgaacatggtgaacgccgggacgtactggctgtggcagcagctcgccgtgagcgacgcgctgccggacgaggcgctgcccatggtgatcgaggcactgtgctcgacttccctcgccccccacagcggcgggggccgcggcgaggagcgccgtaccaaggccctcgcggacgcaatgcccgccctgctcagccgcgtcacccgccccggacttcgccgtcggctccttcagcaggccgacgacaagcagctcgccgaactcgccggccaaggcgtcgttgtagccgccgacctgccgacgatcctgcgcacccaccgccccacccccggcctggtcatcggcctggcccgccaccccgaccaggtcgacgccgcgatcggcctgctgcccggcatgcacgacaccgacctcgaggacgtcgtcaccgactgggaccccaaccgccaccgataccagccggatgccgacgccgcccctcccatccctccggcgctcttcgacgcagtcctggagcacgccctcgccccgctcgcccggctactgaaggacccgcaccacgaggaatggcagttcgcgcaacgtaccgacctgggcctgccccacgagttcggcgaaggcgccccctggcgcatcctcgcgacctgccccgaccgctggcacgacctggtcgaacaccccaccctcggcaccgccgtccagcacctcctgctggaccaggccgaggtggaggcgcgccgcagccgcatgatggcgtccagcaactcctccctcacccaggacacagacgacgacggcccggccgaacagcccgagccgcagccggcgctcgacgccgccctgctgcgggcctgcctgcctgccctgtgcctgccggagatggccggcctgcccaagccgagcgtgaccgcccgccaccggctccaccacatcgccgaccgggtccgctacaacccccgcctcaccgacatcgcagccgcccagctgcaggcggtcgccgacgaatgcgtccgccgcggccgcctgctcaccccgccccgtaacgacgaccgcaagcaccgggccgtcgccctcgctgaggacctggctctgctcagcaccaaccccacgcacctggccaaggcctgcgccctgctggccacgctggaacaacccgccgtcgtctccacgccgcccagcccccgcttcgcccgcatcaccgccggcaccgacctgctcgatccggtccgcctcctggagcacaactaccagcaccggcgggtcgccgccctggccgcactcgccggcaatccgcacaccccgcgctccgcggtcaccgacaccctctccgcgctgcacccgctcgaacttgtctggatcggccaccagaacgacgtccccgactggctgcacgcagccgcagccgcactcgccccggccgacaccaaggaagccgtgctgcggctgctcactgacgaggaactcgaccgccactccgacccggccgccgtgctgcagtcctggctcaatgcccccgaatccgaagggctctggtcacggcgggacgtctaccgtgccgtcctcgactcccgccaccacaccctcgatcacctgcgccagctgcccgcagatgagatcctcacccgtaacgaaccccacctcgccatcccccacctgctcgccctctgcggcacccagccggaacgatggaccgccctgctcaaggccctcgactacggccccacggacgaaaagatcacctttggggaactgctcgacggtatccaaggtcccgcccccgctccggccagcgcggtgtgaggacgcggaccgcccggcccgcgccgttggcgccatgccgcattcagtcgcggcgcagatggtgacgtccgaagtcgggacggccggtcgtccgccgggagctgcgaggcagccgaatacggctgccccttcggaccaggaccctgatgatcacgcttcggcatgaagggcagcgcagcagttcgaccttccgaaagaaaaacagagacttcacaccagcgttcggcccccaagtgtcctgcccagggacaaagatggccgcatgacgtcactccaagaccccgtcatggacctcgtacgcgcatcccttgacccggccgcgaggacggcgcggctgcgcacggagtcgccggtgtgccaggtggtcattcgggcagccgaagccgacctggccgcaggcggcgccgacaacgtcaacctgctcgcggtcggcgccggggtggctgcggccggactgaccgcctggctcgcccaggaacgtgacgtcgacacgggcgtcatcattgccgacttcgagaagggcgccgcgatccacggcatcccgcacgacccgctcgtgcagatgctcaagaccctgctgaccggccccaccggcatggagcagaccgcggagttcatggtccacctcttccacgacgacgaagaggccttctacgacctcatcgttgacctcgcgcactacatcgccacctgcgtcggcctgctcgcctcacaccgcatcagcaaccgcgacgacaccctggaagctctggacgacatgctggaggccttctgcaacaactaggacctgtccggtcgatcatgttcgaagccagatgacgattgctgcggcggtcacggtgccgaggtagacgtagccgcgcttgtcgtagcgggtggcgaccgcccgggactgtttcaggcggttgatggtccgctcgacggtgttgcgcttcttgtaccgctcctcgtcgaagccgggtgactgtcctccgcgtgagcctttgcgcaggcgggcggcctggctgtcggtcttctccggaatcgcgtggcggattcctcggcgccgaaggtattcacggacgggcccgttgctgtatgccttgtcggcagcgaggctttccggcttcacgcgcggtcgccccggcccgagtctcggcactcggatcttctccatcacggcgatgaactgcgtgcagtccgcccgctggcctggggtaacaatcagagacagtgggcggcagtggccgtccgcgcccaggtggagcttggtggtgaacccgccgcgtgagcggcccaggccctcacctcctgcaccacctccaccaggcgggcgacgagaccccaccacggcgtctcgtgctggtgttctgccgctgcgtccccttttgaggcgggggccggcggcggttcggtgcgggcgccagccgcgtgctgatgtgcccgcgcgatggtggggtcgaccgagatgtcccagtcgatctcaccggccgcgtcggccgcggcctgcacctgctggagcagacgttcccaggtgccgtcggccgaccacaggcggtggcgttcgtagaccgtcttccaaggaccgaaccgttcgggcaggtcacgccactgaactccggtccgcacccggtgcagaatcccgtcgatcacctgccggtggtcccgccacctgccgcaacgcccgttgctgaccggcaggaacggccgaagccgttcccactcggcatccgtcagatcgccccgccccatgtccataagaacgatcagcagcaagagccagtcgcatgctctgccggatcagtcctaaacgacgtcccgtaagc

SEQ ID NO: 269 - DNA, 8238 bp, Unknown
  Kingdom: Bacteria, Phylum: Actinobacteria, Class: Actinobacteria, Order: Streptomycetales, Family: Streptomycetaceae, Genus: Streptomyces
ggcagtacgggcaggacggcggctggcgagtgctcgccgtcctgcccgtactgcccctgacggccgaggaggagaaccggtgatccgtgtgacgctcgccgacgaccaggcgctggtgcgggccgggttcagggcgctgctcgacgcacagcccgacatcgaggtcgccggggaggccgccgacggcgaggaggccctgcgcatcgtgcgcgaactccgcccggacgtcgtgctgatggacatccgcatgcccgtcctggacggcctggcggcgacccgccgcctcaccggcgacgcggatctcaaggacgtcaaggtggtcatgctcaccaccttcgaactcgacgagtacgtcttcgaggcgatccgctcgggcgcctccggattcctggtcaaggacaccgaacccgaggaactgctgcgcgctgtacgggcggtggtggccggcgacgcgctgctgtccccgggcgtcacccggcgcctgatcgccgagttcgccgcccgctccaaggagccggccaccgccgaagccctcactcggctcacggagcgcgaacgcgaggtcatggccctggtcggtatcggcctgtccaacgaggagatcgcccgccgcctggtggtcagcccgctcaccgccaagacccacgtcagccgcaccatggtcaaactcggtgcccgcgaccgcgcacaactcgtcgtcctcgcctacgagtcggggctggtccggccgggctggctgggctgaggcggtacggcgtcgcccgtgtgccggtgtctgtgcgcccgcgttcgcacgctgtcgcacccgtccggctcagacgatcaccgaggtctcgtgccacagggcggccagcgaggcgtcccccgtcacctgcggcaccgggacgcggttccacagggcgaggtacacctggtcagcgggaccggcgagttcggcatcggcgtcggtggccgccgcggtggcgcagttccgctccgtgaccggcggcccgtccgagagccgtacggtccacaccgcctcgccgccgtccgcttccttcacaccctgcgcgcggatgcgcagcacgcgcggccgggccgtgcggacccggctgcgggaacgggcgtggaagccgcgcagcagctcgtcgatgccgtcgacggcgaactccgcgtcgatcggggacggggtgccgccgcgtgccgcctcggcgtcgaaacggtggaccgccgtctcgtgcgcctgccgccgggcccagaagagcagcggcgagggtgagggcaggggcgccgggtggaacgtccagcacgtcacgtcgtccggagcccggcccagggtctccacgagacggcggtggctgtcccggtaccagtccaccagcgcggcgccgtccaggtccgggggatcgcccatggggcgcgcagaggggtacccgtccgcgacgaaggccgccgcccaccggtgcaccacgcccgtgtgccgcagcaggtcacgcacccgccacccggggcagcccggcacaggcgccccgcactcggcctgctcggccgccgccgccagcagcccgccctcccgctccagcgtgtcgaggaacccggcagtctccatggccgtaagtgtgccggacgcaggcgtccccgggaacgaccggtgggtgtcccgaaggctcggaggaagggcccggccgccggcaggctcccggtacgggaccgggtcggcgtataccgcgttgcggtgggccgaatggtgggttgggctggtggggactcatttccccacgctgcggacggcgatcatgacgatgtcccccttcggcgcctcgttcggtggcccggacccgttctccgagatcctcaaccgtttcttcggcatgaccccgggagcctcgccgccgcaggtgcagcgggtgccgatcgggcggctgctcaccgagtcggcgcaggacctgctcaaccgcgccaccgggaaggcggccgaggacggcagctccgacctggacaccgagcacctgctgtgggcctgcacgcaggtggagcccgcccgcggcctgctcgcccaggccggcgccgaccccgaccgcctcgccgccgccctcgacgaggcactgcccggggagagcgtcaccccttcggcccagccgggcctgaccccggccgccaagcgggtgctgctgcgcgcctacgagcactcgcgggcggccggagtgtcgtacatcggcccggaacacgtactcggagccctcctcgacacgccgggcgccgcgccgtcccgcgtgctcgcggcgcacggcatcgacaccgagcaggtccgccgcggcgccgagacggcggcccgctccgaggccgcgcccggcggcggcgaggcaccgagcgacacgccgaccctcgaccagtacggccgcgacctgaccgaggaggcccgtgccgggaaactggacccggtggtgggacgggcgatggagatcgagcagaccgtggagattctctcccgccgctccaagaacaatcccgtgctgatcggcgagccgggcgtcggcaagaccgcgatcgtggaggggctggcgcagcggatcatcgccggggacgtgccgaagacgctggagaacaagcgggtcgtcgccctggacctgaccggactggtcgccggggcccagtaccgcgggcagttcgaggaacggctgaagaacgtcatcgacgaggtcaaggccgcctccgagtcgacgatccttttcctggacgaactgcacaccgtcgtcggcgcgggcgccaccggcgagggctccatggacgccggcaacatcctcaaaccggccctcgcccgcggcgagctgcacgtcgtcggcgccaccaccctcggcgagtaccgcaagtacgtcgagaaggacgccgccctggagcgccggttccagcccgtgatggtgcccgagcccagcgtcgaggagaccgtgcagatcctggagggcctgcgcgactcctacgaggcccaccaccaggtccgctacagcgacgacgccctggccgccgcggccgagctgtccgaccgctacgtcaccgaccggttcctgcccgacaaggccatcgacctgctcgaccaggccggggcccgggtccggctgcgttcgctgggccgctccaccgaggtcgccgagcgcgaggaccgcctcgccaagctgcgccgcgagaaggaccaggccatcgccgccgaggacttcgagcgtgccgcagagctgaaggagcagatcaccgaggtcgagaccgagctggaggggctcgccgagcgccgcgagggcgtcctcgaggtgaccgtcgacgacatcgccgacgtgctgtcccggcgcaccggcatccccgtcgcccagctcaccgagagcgagaaggagcggctgctcaagctggaggacgccctgcatgaccgcgtcgtcgggcaggacgaggccgtcaccgccgtcgcccaggcggtacgccgcagccgggccggcatgggcgacccgaaccggcccgtcggatccttcctcttcctcggaccgaccggcgtcggcaagaccgaactggccaaggcgctcgccgaactcctcttcggcgacgagaaccgcatggtccgcttcgacatgagcgagttccaggagaagcacaccgtctcccggctggtgggcgccccgcccggctacgtcggccacgaggaggccggccagctcaccgagaaggtccgccgccagccctacagcgtgctgctgttcgacgaggtggagaaggcccacccggacgtcttcaacaccctgctccaggtcctcgacgacggacgcctcaccgacgcgcagggccgcaccgtcgacttccgcaacaccgtggtcatcatgacgtccaacatcggcgcccagcggatcctcgcccaccacggcgacgtcgccgccatcaaggaccagctgatggaggacctgcgcggccggttcctgcccgagttcctcaaccgcatcgacgacatcatcatcttccacggcctgggcgaacaggagctgaaccggatcgtcgacctgctgctggacaacagcaggcggcgggtgcgcgcccaggggctggaactgcgggtcaccgacgcggccaagaaactcctcgtcgcccacggccaccagcccgagttcggcgcccgcccgctgcgccgcaccatccaggccgaactggacaaccgcatcgcctccctgctgctgagcgactcggccgaccccggcgacacgatcgtggcggacgtcgagaacgacgccctggtgtgccgcgtcgaacgtccggcgccgtccgacgccaaggtctacgcggacgggggcggcgcggaggcggctccctgacgggtccgaccggccggctcaccggcgtgtggctcgtacgccgaccgtcgcgtcgcgaacccgatcgcggcggcgacggcggccaggacggcgacgctggtgagcgcggcccgcagggacagcgcgtcggccatgaagccgatggccggagggcccaggagcatgccgccgtagccgagggtggaggcggtcgcgacaccgctcggaccggccagggcgccggcgcgctccacggcgaccgggaagaggttcgcgagcccgagaccggtgacggcgaagccgagcagggccgtccacacggtcggcgcgaggcagccgagcagcatcccggccgccgcgatggacccgccgcccacgatcgtgcgggtgcggcccagccgttcgagcagggtggtcccggtcagccggcccacggtcatcgcgagcgcgaagcaggagtagccgaccgccgcgacgcccggcgaggcggccaggtcctgggtgaagtgcagcgcgccccagtcggccatggccccttcgccgtaggccgtgcacagtgcgatgagaccgaggacgaggacgaccgcgcgggtccgtccgtcgaggcgccgcgcgtcccgctgcccggacccggcccggtccgccggctcagggggcgcggtccgcagcagcgtacggcccgccacggcggtgacgagcaggccgatcacggtgagggacagcaggtggcgggtgggggagaggtgcgcggccacgagcccgccgaggcccgccccggccatgccgccgaggctgaaggcggcgtggaaggtcggcatgaccggtcgccgcagcgcggccaccagatcgacggccgcgctgttgaaggccacgttgatgcagccgtaggccgcgccgaacacgagcaggacggcgcccagcgccggggcggagtgggtgagcggcggcagggcgacgctgagggagagcaggacggcgcaaacgaccgtgaccggatggctgccgtagcggcggcacaggcgcccggtgagggtcatcgtcacgacggccccggtggagaccccgagcagcgcgagaccgagcgcaccggcggaggcgtgcgtctgctccttgatggccgggatgcgcaccacccagcctgcgaagacgaagccgtcgagggcgaagaacgcggtgagggcgatccggagtcgaacgagcgagcggtccggcacgacggtgtgcgaacggactttgtttattagcggcacaaactcaggttatgagcgggtgtgcggcgtggcaagggcggtgtggagcgcgtccaaagcggggtgcgccgtggcacgggcggcgtggcgcgtgtggcacgctgctctccgtcgtccccgtcgccgagcacagccgcgccggggtcgtgcagcgcgtgcggtgtgcggcgtggcaaggcggctcagcccgtcatgcggccccagcgggtgtccatgcgggcccattcggcggcccactggtcgaagcggtggtggtccaggcgggactgggcgagtttcgcggtgccgatgacgagccccacggtcgccgttccggcccacaggccgcccagggtcgactggaaggcggtgtcggccgcggaggcgggcggggaggtcagggcgccgtggccgttggtccagacggtgatgcgggaaccgggcgtcgcggtggccgggacccgggtgcggtcggtgtggcccgcgccgtccggctccgtccagtggaccgtgccccagaccagggcgccgccggccggccgggcgcttccctgggggccgtcctgggtgagcacggcggtcaccggatggctctgcgcacgggcgcgttccgcggtctgctgcatcgcaccgaccgtcagcagcccggccaccagaccgcccaccacggcgaggatccaggccgcgagcaggatccacgcctcgacgacgtcgctggtccgccggagcggattgcgccgccatcgccacagccacactcccgcacgacgtgtcactttcgacaccccctcgtgccagacctacggcccttactgccagtgtgcctccagaagcgatcagaggctcccgcgcgggcgggcggaaaccagcgacaccgcgacaccagaggcttccgtgcgggcgggaggcggcgatcccggaggctcaccggagtaccggaccggagcgtgccgcgcgggcggaaccagcggtactccaggggtacccggaacgagcggtgtcaaaggagaaccagccaaaggagaaccaaggagaaccacggagaaccacggagaaccgcggaacccggcggcccgcaaagagcgcgcagggatgggcaagaagtgcgcgggacacggacatccgtgggcggggcggccgtcaggccgtggcgaccggcagctcctccgcggccgccgggcgcagcccgtccgtgcgccccgcgaagtagcgccgcgccagatcctccgccgacacgtgccggacctgcgcgaaccccgcctcgcgggcgagagcgagcatctggggcggggagaagaagctgaggaacggcgtcccggacgcccgcgccaggcgcgccgtgttctccagcagctcgcgcatctccggctccaggagctccgcgggctgcatgaacgtcatggccagtgtggagccgggcgcgagtcccgcgacctggcgcagcgtccccttgatcgcctcccgcgtgagatacatgctcacgcccgtgcaggccaccaccgccgggcgtcccgcgtcgaagccggccgcgaccagctcctcccaccaggagccgcccgcctcgaagtcgacgggcaccagccgcaggccctccggcacgcccagccccagctcgtccaggcgccgccgcttccacgcctgcgtccgtggctggtccacctcgaacacccgcagtccggcagccgcctcgggccgccgctggacgaaggtgtccaggccggcgccgaggacgacgtactgcgtgacgccccgcccggactccgccacgaccaggtcctcgacgaagcgggcccgggccacggtgcccgcccggaacgcccgcgtcccgtccgggtccatgtccggccgccggcgccagtcgtcgccgggatccgcgagccgaaggcccacctcgtcctcgaagacgtgcggcggcgcgtcggcgcgcacgtgcagcgcccgccacagcgcgacccgtaccgccgtgtggtcaggctcttccgcccgactgccctgcatgcgtccaccactcctccgcgaccggccagaggagcggtcgcccctcgcggacaagggtgatgcctcctccgcgcggcgcccactaccgtgccggtgcgccctgcggcaggtctcgcccgaacgggtgacgccgcgcctgtcgtggacacggatccggtccgcgcctgtggtggacgcggtccggtcggtggctgttttggacacggatcggttaaggcttcctcacgtgtcggttgccgtgtggtgagcgcgtcatgatggggccatgacgctcgccgcgcgtgctctcgcccaactggccacctggcccgatctgatggaagcggtaccaagctgtggcaccggacaggcgctcggctcggcgcacggggagatcgcccacttccattccgaccgcgacgtcgacctcaagctgaccgaccggaccatacgccgcctgtcgggcgacctcaggcgcttcgccgccgtccgtgtggtgccgggctcctcctgggtgacgatccgcctcgacgcctcggccgacgtcgacctcctgctgtccctcatgagcgtcgcgctcaaggccgatcaggcggagccgggggaggagcggccggttccggcaggctgcaacgacggtcgtggtgtgggtttcctgcgcacctgacgcgccgggaccccggccgccgttcgagggggcgatcggcgaccccggcaccccggccgcggccggg

SEQ ID NO: 270 - DNA, 4808 bp, Unknown
  Kingdom: Bacteria, Phylum: Actinobacteria, Class: Actinobacteria, Order: Streptomycetales, Family: Streptomycetaceae, Genus: Streptomyces
ccgtgggaccgctgctggcgggcggcctgatcgcggtcgccgcgcccctcgcctcgatgatcgcggtcatggcgctgatcgcggccggtaccgcctgcttcgtgctgtccgccagcagcggtcccacggtgaacaccacctcctcggtgaccgagtcgagggcataggcggtgtgcaggaggggccggcggccgtgcaggatcttcgcccacaggacgcgcatggccggcccgagcggcggcgcgaacacgcccgtgaccgcggcggcgacgagcagcgccgcggtgggcgcccccgcctcggcgcacgtgatcagcgcggcgagccccagcagatagaggacggtcagccggaccagtccggtccgtgagcccttgcagtcgatcagccgggcgcgggcgggcgcgaacagggtgagcgtggccgacaacgcgccggaggtgagtccggcgacggcgaaggatcccgtcgcctcgcggaccgacagcagcagcgacagcggcagcaccgcgaaggacatgcgggccaggcagctgccgaggagcggcgagcgggcctcgcgcacggccagcaccgccaggaaggtgggttcggtgggtccagggcggtccgccagttggtcccgccgtcgttccgcttccatgggttcaccatccgtcggggcgtcgtcccggaaccgttcgttgttcgaccttgcttgctcagcgggggccgggcgcggtgctcacggcgtccacgagccgcgccagcgcgtcggcgagcgctcccaggccggggccctcggccgggccgcccggctcgcgcatgtacacgtcccgccggatctcgatcatcagcgcggcgacccgctggtcgatcccgtagtactccagcggtacgtaggcccctcggaacggactgttgatcccgatcccggccccgacgagcccttcgaaggtctccctggcccggcccagcaggccggccggggtgtggaaggcgtcgtggcccaggcagaccgggggacgcggtccctcgccgtgcagttcgtaggggaggcgttcggtcgggtacgagtggacgtcgatgatcaccgcccggcccatggccgccagccgctcgccgaccgcgtcggacatcgcggcggcgtagggccggaagtaccgttcgacgagcgggcgcccgtcgaacgcggtcggccgcagctcctgccggtgcgtggtccgcgtgtacacggcacccatgccgacggccagcatctcctcacgctcgtcggggaagcgctcgggatcgaccaccagccgcgagagccggttcacgaaccgccacggcgtgacggcgcagcgctcggcggcggctgccgcgaggtccgcggtgtgcgcgtcggtgatgtggtccagttcgagggcgagtgcggcgtcgtcgagggtgatgccgcgtcgcacgtcgtgcgggacggtccgcgcggagtgcgggacgtggaggacgacgggggagtccggcgcgccgggcaggtactcgaaggagggggacgaatcgttcatcacgaagtgccaatggtgcaccgtgacctgaagttgagcaacacggaatcggtcatgtcaggtgcggggcggtgcactgtgcccagaccgtcttgccgggaccgccgtcggcgcggggtgtccagccccagcggtcggccagggcgtccacgaggaccagtccgcgtccactgtcacgcggctcgtcctcgggcgcggggccggcggcccggtggggcatccgctccccacgggtgtcggtgacctcgatccgtacggtgccggtggccggggtcgcggtcaggaggacgcggaagtcgcggccggacacctgcccgtggcgtacggcgttggcgcacagctccgccgcgacgagcgtgatgacgtcgtgagcggccgtgccgtacggaacgccccacgcgtcgagccggtgcccgcacagtcgcctggccaggcgcgcaccgcgcggggtcgagctgaagcgcatcgcgaactggtgcaccgtgaggggtgattgtgttgcggtcatgcactcaccgtggcgccttgtggcatagcgtgaccagtggtgacgcgctgacgcggcttcttcgtccgcgggcgtgcgggtcgtgtacgtgacggtacgtcatggggagaggcgcgagtggtgaccgtaggggaagaagagtccgggcaacagccgaagcggcggccggacgacgatccggggagcggggtcgtcgccgcgttcggacggcagttgaagctgttgcggatgcgggcggggcttgaccgcgcggagttcggcaggcgcatggggtactcggcggagacggtggcgtcgatcgagcaggggaggcggattccgcagccacgattcatcgagaaggcggatgaggtgttgggggccgggggagttctgctggcgctcaaggaggaggtggcgagggcccagtatccggcgttcttccgggatatggcccggctggaggcggaggcggtcaccctccacgtgtacggtgctttggccgttccggggctgttgcagagcgaggactacgcgagggccgtcttcaccatgcgtcgcccgctcctcgacgaggagactgtggaacagcgcatcggagccaggttggcaaggcaggagatcttctcacggaggccgcttccaacgctgagcttcgtcatcgaggagtcggtgctgcggcggccggttggaggccgagcggtggtgcgggggcaactggagcagatcctcctccatggacagcggaggaacgtggagatccaggtgatgcccaccgacgcaacagagcactgcggtttggccggaccgttcaccttgatcgagatccgggacgggcggaggatggcgtacgtggaggtgcagcgggtcagtcgcctccacaccgagcgcgcggaggtgcgggatgctgaggagcagtacggcatcctgcgggctcaggccctgactccgcgcgaatcgctggccttcatcgaaggactcctgggagagaaatgacgcaccgggtgagtgagctgacggtttctgagtcagcgtggttcaagagcagttacagcagcggcgagggcggggagtgcgtcgaggctgcttgggtcaagagcagctacagcacaggaaacggtggtgaatgcgtcgaggtcgccagcctccccgccagcgtactggtgcgggattcgaagcaacccgcagaagcgaggctgtccttcggcgccgacgcctggagcggcttcgtgcggatggccgccgggcgctgagccggcgggcgtacgaccaccggggccccgtgcgcgcagcgcaccgggccccgcttcggtcaggcggcagccgaaaatccggtgcccgactgcctgatcctccctagactcatcccgcaccgcgcgctcctgccgagcgtgcccgccgtgaaccgaggggagtcgaccatgcgtgtccgtaccgctgtcgtcgtcgttcccccgtcgcggttcgaggtgatcctggtgtcttcggggctccggtgcccgctgcgcggccggcgccggatgtccgtaccggggaactgaccaacccggcttcgggttcgaccgaacccgaacccgaaccgtttcactcctcgtacggaagatcgcgctgcccttttccggatcgtcccgaaaggccacgggccgtgcgtaaccctctcaacccactctcgaccatccgcaacatcggcatcctcgctcacgtcgacgccggcaagacgaccgtcaccgagcggatcctgtacgccaccggcaccacccacaagcggggcgaggtgcacgacgggaacaccgtcaccgacttcgatccgcaggagcgggagcggggcatcaccatctcctcggctgccgtcagttgtggctgggaggggcatcggatcaacctgatcgacacccccgggcacgtcgacttcgccgatgaggtggagcggtcgctgcgcgtgctggacggggcggtcgccgtgatcgacgcggtcgccggggtggagccgcagagcgagtcggtgtggcggcaggcggaccggcacggggtgccgaggatcgtgttcgtgaacaagatggaccgggccggggccgatctggacgcggccgtcgcgtccgtccgcgagcggctgcatcccgccccgctggtcgtgcagttgcccatcggcgcggaggccgggttccgcggtgtggtggacctcgtccgcatgcgcgctctggtttgggaggacggcggcgacggcgtcgacatcgttcccgttccggacggtctgcgggcgcgggccgctgcccggcggcgggcgctcgaagaggcggtcgccgaacgtcatcccggcgcgctggaggagttctgcgctcaggagacgctcaccgccgccaccctcgccgccgcgctgcgcgatctgacccgtaccggcgacggtgtcgtcgtgctgtgcggctccgcctaccgcaaccgggggatcgagccgctgctcgactccgtcgtcgcccacctgccctcgccgctcgacgttcccgcagtgcggggcacgtacgacggtgcggagcaggagaggacggccgacccggcggccccctttgccgcgctcgccttcaaggtgaacgccacgccgaccgggcggctgacctacctgcgggtgtacgcgggaaccatcgagaagggagcggtcgtgcgggacgtgacgtcgggccgcagcgaacgggtcggacggatcctgcgggtgcaggccgaccggcagacgccgctggagcgcgcgctcgccggtgacatcgtcgccgtcgtcgggctgaagggcgcccggatcgcacagggtc

SEQ ID NO: 271 - DNA, 6003 bp, Unknown
  Kingdom: Bacteria, Phylum: Actinobacteria, Class: Actinobacteria, Order: Streptomycetales, Family: Streptomycetaceae, Genus: Streptomyces
ggggagggcggcgggctgccgtacagcggctgctgcggcgcgtacgtgcccgggggcggtggtgggtgcgcggcacggtcgtacatcgcctcgccgaccgggtcctgggcggtgaggtcctgcgcgcggtaggggtcctcggcgtaggcgtcctggaggtacatgtcggccggaggctgctgcggcacctggccgtgctcgggcggcggggtgccggggtggcccgagctgcccgcggcctggccgcggtcaccgtcgtacggcgcgttcatggttaccccacctcatcgtcccgggccctccgggccacgacatcctcaacggtccactttctcacccgtgccggacgggtcggcgctttcggatgcggtgtccggtgtcgggtcactcggctgctcccggtcctctgccggggtctggccggccgactcctgcgtgagacgtgctgcggggcctgcggggttctccggaccgttgtcgtccgggtcactcgtggtgcggccgggcgtctcggggctgtccggggcgtcggaacgggcgggagcgccggggcggtcggtccggtcggggccgtccgcggtggccgccgtgtcctccgcctcctccttctcgccgtccggtgtgtcctgcgcgttctcgccgtccggagtgtcctcggagccctgggtctcctcccgggccgccgcgcgcttgcgctgggtgtacatgcggaaaccggcgaggacgaggagcaggacgccgccgccgatgaccagcatgacggtggcggtgacctcggtgaccttgacgtcgaaggtgacgggcgcgccgtactcctggccgtcctgcgtgtacagctgggcgatcaccgacaccgggccgttggcgttggccgacgtggtgaacttcacggactggctgtggccgccggagacggcgatcggctgttccgcgtacgccttgccgccgatcttcagacgggtggggttggtcgaggtgagccgcagcaccaggtggtcgacaccctgcaccaggttgttctgcacggtgacggggatcatcgcgctgtgaccggagagcttggtctccgacttgtcgatcagtctgacctgtccggagaggtcgtcgaggtaggcctgcaccccgtcccggaagctctccgccgcgctgctgcggccccgccaggacgtggacatctcccggttcagagcgcgtccgaacggtgtgacgacccgggacgcataggtgaggaccaccttgaagttgtcgaccttgtcctgtgtcgcggcgatctcggagaaggccggacgccgcagctcctgccggcgcagcgaggagggatagtccgaggtcgaggggaccctcgtcgtggcgtcggggtccggcttggccttggcggccgcggccaggtcctgggactgggaccaggtgccctgctgcagggcgagcagcgcctgcgccatggcctgggcctggctggtgctgggcatgcgctgcggggcgacgacgatgctgcgctgcttgctcgtctgaccgttgagttcgaggctctgggcgaggaagcgctgcacggcgagcgtgctggcaccggcttgcgacaggtcgccctcgaacgcggtcgacaggcgtgcgtccgcgacgaccgccgtggtgccgccgccgatcgggcgggccgcggagggcgtgtaggtcaggctgtccggttcctcgaggctgtcgctgcgcgcgatgaccttgtcggccccggcggaggtggcgacccggacgatcgcagggtcgacggctccgttcaccggccaggcgaagtcggtggccggtttgacgtggagcaccgtctccaccgtgctggcggcgacgtccgtggcgtccttgagctggctcagggagccggagacgctggtgccccggtgggcgagcgcggcgaggtcggggtcggcgaagggcagcgcgacgacctccttgcccgtcaccgcctgctgcagttcggcgagccactgcttggccaccgcctggtgggttccggcgacggagtccttggaggggtccgtccggatgcggtagttacgggtcatggcgtcgacggacgccagcaggtccgggtcgatcacccaggtgacgtcgagatccttgccgagggcgagcatccgctccagccggccgccgggggcgaggtccttggcgaggtcgtcgtcgaggaagaccggtgtctgcagttcaccgggtccggtctccgccgtcatgtggacggtggagacgaggggccacagaaaggtcgtcttcgtcttcgtgtccgcctcgccgggctgccacggcaggaaagtgtgctggatgcccagcacctgctcccactgctgggcggacgtctgtcccgacagcgagacggagaactcgtagacgccgtcggcgccgaggtccagcttggaggccggcacggcgatgctgaagtgctgggcgacgccgggctgcagcgcggtgaacttctgcgtgtacttgccgccgagttcggagccgtcgacaccgggctcgaagtcggtgcgccgggcgacggcgtcgatctcggaacgggtgtccaggtgcggccccacccgcagcccgacgtgggcttcggtgaccggctgcttgctcttgttcgtcaccgtgcccgacacggtcagcgtgtcccctgccgaggggacgctggggctgagggcgtcgagggacaccgccaccgtgcgcgacccggagaccgccacgggtgcttgccgaccggaggcgtgcgccaccggggcggcggagaactggagcagcccggccagcaggggtgctccggcgagcagtgcccctgctcgccgcagccagcggcgggcaggtgagggactcgtccccaggaagtctgccgcctcggccacgcgctcgcccgtccctcgtcgtcagtggtcgtcggaatgtgcgtccacgcatggtaacgaggtgtgcggagcggaagtgccgcggaggcggccacaagatcggcgggaaagaggggcacgccctggatatgcgcgtatccggggatgctgttcgttacgtcacgatgaggtgggcttgagcgggtaagaaggggcgcggcgcccgcggacccggggtgcgctcggaggcggcggacggtcccgggtcacgacgacgcgtcgtggccctccggacacgtaccctcttctgttgtgccgaacgccaacgatgacactccccctgccctgagccaggtgcagcagcgcgcggtgagcgagctgctgcgggtggcccctgtcgccgacgacctcgcgcgccgtttccaggaggccgggttctcgctcgccctggtcggcggctccgtccgggacgcgctgctcggccggctcggcaacgacctggacttcacgacggacgcgcgtcccgaggacgtactgaagatcgtgcggccgtgggcggacgccgtgtgggaggtagggatcgccttcggcaccgtgggtgcgcagaaggacggctaccagatcgaggtgacgacctaccggtcggaggcgtacgaccgcacctcgcgcaagccggaggtgtcgtacggcgactccatcgagcaggacctcgtccggcgtgacttcaccgtgaacgcgatggccgtggcgctgccggagaagaggttcatcgacccgcacggtggacttgaggatctggcggcacgggtgctgcgcactccgggcacaccggaggagtccttctccgacgacccgctgcgcatgatgcgggccgcgcgcttcgccgcccagctcgacttcgaggtcgctcccgaggtcgtcacggcgatgacggagatggccggacgcatcgacatcgtctccgccgagcgcgtgcgcgacgaactgaacaagctgatcctctcggcgcacccgcgcaagggcctgaccctgctcgtggacaccggtatcgccgagcgggtgctgcccgagctgcccgcgctgcggttggagcgggacgagcaccaccggcacaaggacgtctacgaccacacgctgatcgtcctggaacaggcgatcgccctggaggaggcgggccccgacctcaccctccggctggcggccctgctgcacgacatcggtaaaccgcgcacgcgccgcttcgagaaggacggccgggtctccttccaccaccacgaggtggtcggcgcgaagatgaccaagaagcgcatgacggctctgaagtactccaatgagctggtgaaggacgtctcgcgcctggtcgagctgcacctgcgcttccacggctacggcacgggcgagtggacggactcggcggtccgccgctatgtgcgcgacgccggcccgctcctcgaccggctgcacaagctgacccgctccgactgcaccacgcgcaacaagcgcaaggcggtcgcgctctcccgcgcctacgacgggctggaggagcgcatcggccagctccaggagcaggaggagctggacgccatccgtccggacctcgacggcaaccagatcatggagatcctgggcgtcgcccccggtcctgccgtcggccgcgcctacaagcacctgctggagctgcgtctggagaacggcccgatggagtacgacgcggccgtggcggcgctcaaggagtggtgggcccggcagggctgacggcttgctccgaggcccggtgagggagccggtgtttcacgtgaaacacccaccccctcccgcggggccggaacccgaggacggcgaagggcgggtgtttcacgtgaaacacccgcccttcgcgatggacctccccgtcgccggggccggtcagggccttacttgacgtccttcaggcagagcaccacgtcgtgaccgccgccggactggaagtaggagatcgtcgcgtccgcgacggtcttgcacttgtcctcatcggtggagccgtcgaacttctcgaccaccttgtactgcgccttgtcgcccgagcagtcgacctccttgaggtccggcttggacatggtgccgtcgttgtgcatgcatgagcccaccgacgtggtctcggcgtcgtcacggcccaggaaccagcccagccccagggcgccgccgaacttcagcaggccgaggatgaccacgacgaggacaccgccgatggcgcgcagtgccttcttgccgcctcgcttggccggagcgggcggcggcgggaccggggcgccctgctgcgggaagggggcgtagggctgctgcggcgggtacggctgctgagggacgccgggctgaccggcctgctgccccgggggaggggtggggccctgggcgtacgggttctggccctggggcggcggcggcatggtcacttgggggtccccctagaacgtaggcgctatgacgcggacatggcgtcgaaataagacgcacgtaagctacagccccccgctgacatccctgtactccacgacggctctgtggctttgatgtgacactcagcggcgcgcaaagcggcccatagccacagcaaccgctccgtagatcagggcgatcgtgaccaccaggggcaccgaccgcccgtccggcggcagcatcacggccgcgacggccgccgcggccacgaacgcgacgttgaacagcacgtcgtaaacggaaaagatccggccgcggaagccgtcctcgacgcaggactgcacgaccgtgtccgtggcgatcttcgcgccctgcgtggtgagcccgagcacgaaggccgcgagcagcagcgggccggtggtgaacggcagaccgagagcgggttcgagtaccgcggccgagccggcgcacgcggcgatccagcgggcggggccgccgagtgtcccggccgccgacggggtcaggagcgcagcggcgaagaatccggcgccggacgcgccgagcgccagcccgagcaggcgcagcccgtgctccgcgttcgacgtgaggccgtagcggcagagcatcagcaccatgaccgtcagcgcgccgtagcagaaccgcatcagcgtcatcgcgcccagcgcccgggcggcggcccggcgcgacggtgcgccgaggtggcgcacgcccgccagcaggt

SEQ ID NO: 272 - DNA, 2649 bp, Unknown
  Kingdom: Bacteria, Phylum: Actinobacteria, Class: Actinobacteria, Order: Streptomycetales, Family: Streptomycetaceae, Genus: Streptomyces
acggagtgccgccgccggacccggagccgtcgctgccggaggagcacgcggaggcgcccacgagcagggcggcccccgccgccgaggcgagcagactccttctgcgcgggcccgagggggcctgcgagggtgaggggaacggcacggcagacgtcctcgggtgcgtgggtacgtacgtacgggaaacggagggcggctcgcccgtgatcaccgtacccgcgcgtgccccgggcacggctcagcggcaccaccctcgcccaggtggacggcaacaccccttgggaccggataccctttgaccagacacgcgaaccgtcccacaacagcacacgcggccgaggagtcacccggatgagcaccacccagagcgagaggctgcgggagctgctggaaccgctcgtcacctcccaggggctggatctcgaagagatcgccgtggactccgtaggacgcaagcgggtgctgcgcgtcgtcgtggactccgacaccggagcggacctggacgcgatcgccgatgtgagccgcgcgctctcggcgaagctcgacgagagcgacgcgatgggcgagggggagtacaccctcgaggtcggtaccccgggcgccgagcgcctcctttcgcagcaccgccactacgtgcgcgccacgggccggctggtgaagttccagctggccgagggcggcgagctgatcgccaggatcaccggggtcgacgacgaaggactcgacctcgaagtaccaggagtcaagggccgcaagcccacggcccgccgcgtcgccttcccggacgtcgtcagggcgcgcgtgcaggtcgagttcaaccgcaaggacgacaaggccggcaaggccgagaagagcatggccgagaaggacatgaaggaagaggaggaggcgtagccgtggacatcgacatgagcgccctgcggggcttggtgcgggagaaggagatctccttcgacctgctggtcgaggcgatcgagtcggccctcctcatcgcctaccaccgcaccgagggaagccgccgccacgcgcgcgtggaactgaaccggcagaccggccacgtgaccgtgtgggcgaaggaggaccccgaggacctcgaagagggccaggaggcccgcgagttcgacgacaccccgtccggcttcggccgtatcgccgccaccaccgccaagcaggtcatcctgcagcggctgcgcgacgccgaggacgacgcgacgctcggcgagtacgccggccgcgagggcgacatcgtcaccggcgtggtccagcagggccgcgacccgaagaacgtgctcgtggacatcggcaagctggaggccatcctgccggtgcaggagcaggtccccggtgagaagtacccgcacggcatgcgtctgcggtcgtacgtcgtgcgggtggccaagggcgtccgcggtccttccgtcaccctttcgcgcacccacccgaacctggtgaagaagctcttcgccctggaggtgcccgagatcgcggacggctccgtcgagatcgcggcgatcgcccgtgaggccggtcaccgtacgaagatcgcggtgcgctccacccgttcgggcctgaacgccaagggcgcctgcatcggccccatgggcggccgggtgcgcaatgtcatgggcgagctgaacggcgagaagatcgacatcgtcgactggtcggacgacccggccgagatggtggcgaacgcgctgtccccggcccgtgtctccaaggtggacgtcgtggacctggcggcccgctccgcccgggtcaccgtgccggactaccagctgtccctggcgatcggcaaggagggccagaacgcccgcctcgccgcccgcctgaccggctggcgcatcgacatccgtccggacaccgagcaggccggggaatagatccggtccgcggagcgctggaaacacgacaacaagcgttcgaatcctgccccaaaggggtgaggtgtgcgcggggaggtagacttaacggtgtctggccggacgcgggcccgcgcatgccctgagcgcacctgtgtggggtgccgggagcgagcggccaagacggatctgctgcgcatcgtggcgatcgagggcgagtgcgcccccgatcctcgcggtacgctgcccggccggggtgcgtatgtgcaccccgccctggtctgtctcgaccaggcggtgcgccgccgggcgttcacgcgggcgctgcgcgccccgggagcgctcgacacaaaggcgttgcgcagccacgtcgagcggacaacagttgccgagcaggcaacacggtaggaagacgagtcgtgcggaaccccccgtgcggcctggtacctcgcgagtcgaaagcaggtcgagattgcgatgagcactcgatgagtacgcgatgagtacgcccatgaactagcgacggtccggccgcaacccggacctcaaaggagcgaagtggctaaggtccgggtatacgaactcgccaaggagttcggtgtggagagcaaggtcgtcatggccaagctccaggaactcggtgaattcgtccgatcggcatcctcgacgatcgaggcgcccgtagtacgcaaactgaccgacgccttccagcagggcaacggcggcggcaggtccgccaagccgggtgccccgaagaaggccgcccccaggccccccgcgccctccc

SEQ ID NO: 273 - DNA, 7608 bp, Unknown
  Kingdom: Bacteria, Phylum: Actinobacteria, Class: Actinobacteria, Order: Streptomycetales, Family: Streptomycetaceae, Genus: Streptomyces
tcctgtacggcgtcctcggcctcggtcaccgaaccgagcaaccggtaagcgacgttgatgagttggcggcgctcgccggctatcccgtccgtgctggtcccgacagtccccatgctttcggccgccccctcgccttacctttcgcgggcccgcgtcgtcgggctggtgagaccttatcgatccactgcccgcgggcggaaaaggggactgtgacatggccactgaggtgacgacggacgcacgccgcggcgtctcgttcctgcgggtcgcgatcgccctgcagaccctgaccatcttcctgcaggcaatctccgccggactgctgctgacctcgtcctacggggagacgctgcacagcgtgggggcccgtgtgatgtacggggcgtccatgctgtacgtgctcgcggccgtactggcgtggaagccgggcggcggctcgccccgccccgtgtggcacgcgtcagggttcctcgtcctcgcctcggtccaggtggtgctgggcatcgcgcacgtcccgtcggtccatctcccgctgggcgtcctgatgttcggcctgagtgtgctcgcgctggcccgacgctgaagcggacaccggacaccggaccccgggccccggaccccgacaccggacacagacaccggacgctgtgccgctcggcgccgttcagcgtctcagcgggtcgaacgggacgccgctccacagtgcgcggacgccggaagcggcgtcgtccgtcaagtggtcgcccgggacggcccaggtcttcaccgtggtggcgtcggcggtgaccgggggccatcccgggtcaccggcggtcgcgaagtcggcccatgcgcggagcatgcgccgggacagggcccggtcctggtcgtcggggccggcgccgatgaggaaggcggcgccctccgcgtccaggttgccgaacgcgaaaggaacgtcggcggtgtgccagggccgggtctcgccgcccgggatgcggcgtctgcgggcgaagcgggagaggtacgcccgtccgccggcccgcgcgtggtgctcggcgagccggctgctgtactcgccgaaccgggcgtcgccgaagagcgcgaggtaccggtcgaggaccgcggcgccgggccgcagcgcccggtagccggccacgagaggggcgggcaggccgagggcgccggcgaactccaggagtccgggctccgaggtgacctcccgtacgctcccgatccggtgcaggaaccagtactcctccagcgcgtggcagaccaggaggtcgacgtcgcggcaggcaccggcggcgagcgcgccgagcggatcggcggtcagcacgtcgccgtcgacgacgggctggaagagcaccgggtcgtacgcctggaccgccgtcacgggatcgtccgcgcactgtgcggcgacctggtcgcaggccgtcaccaggcgccgcggcgaggcggagagcaggccctcgcgcgtcggggcgacaccggcctcggccgcgatccgcgatgtgatctccgcggcgacctcggtggtgaagaaggcgctgggcacgctgtgcgcgatggccctgcggaacaggccgcgcgcctgctccatggccatcaggcaggcgaccgatcccgctccggaggagtgcccggcgaccgtgacgttgccggggtcgccaccgaacacggcgatgttctcccgcacccagtgcagcgcggccacctggtcgagcagcccgcggttgtcggggagacccggcacgtggccgaaaccctcgaagccgacccggtagttgcagctgaccacgacgagtccggcacgggcgagcgcggaaccgtcgtagtcgggctgggcggaggagccgaaggtgtaggcaccgccgtggatccagaacaggaccggcagcgggccgccctcctgggcctcgggcgcccacacgttgacggtgagcacgtcctcgtcgccgggccgccacaccggcgaggcgggcagccgcgccgactgcggagcgatgggcccgaagtccgtgcagtcacgcaggccgcgccggccggcgacgggccgcggccggcggaagcggcgggggccgaacggcggtgcggcgtacgggactccgaggaccgccaccaccccgtcgaccggccgcctgccgcgcacccggccgctcgtcgtccacgactccggccccgcctcccacgtctcccccatgagccgcaagcctgccacagcccctcgcaggctagccccgcgctacgacgtccttgacgaacacgaggccgtcggtgtccgccaggtgggccgggtcgaggggggcgtagccgaaccacggggactcgcggtgcgcgggccgggtggtggagagggcggtggccaggcgccgggtgtcgatgacgcagcggtcctcggggagggcgtacaggagcccctcgacggtgtccggcggcggtgtgtccactccctggtgccggatcgtgccgagggcggtggccacgaacgcgtactgttcgccgagccgggcactcgccagcgcgccggcgctccaccattccaccggcccctgccacatccgcaccgtgctcttcgcccgctggagatgggagttgtgggcgtgcaccagcaccgggccgcgttcggcgagggcgaggaggttgcgggccatcatggcgtcccgcagcgcgcacagccgggccatgcgggccggtgaggtgtcggccgtccgggagtggtagcgcagcaggccggtggcggtgcgcccgtacaggcgtgcccggtcccagtcgtcgcgcgaggtggccgcgagcaggtacggcgtctgctcgtcgagcagcgccaccaggtcgtcggcgagcagccgcagccggccggcctcggcggaccgtcccacggaccgggccgggtccgtcatcacggcggtgtcggtccaccggtcgtcggcgccgagcaggcggtcgagtgtctccgcggcgcaggggagcaggtccgcgtccaggtgggcgcggaggtagccgtggagcgcggtgagggcctggcgggggctcgcggcgccggtcatctccagcgggccgtcgaagccggcgaagcggagccgctcggaggcgggcctgccgtcgttgtgggcgcgcatccagcgcaccagttcgcggttgggctcggacgcgttgaaccactcgtggctgaagccgcgttccatgacctcgtcgagggtgcccgtgcccgaggtgacgtagtcgtcgacgaccaggcccttcacgcagtcgctctcgatcgcgatggtgcggtagccctcctcctcgacgagttgccggaagacgtcgttgcgcagccggagcaggtcgtcctggccgtgggtgggctcgcccagggcgagcaggcggggccgggccgggagcagcgccatgacggcggcagcatcgacggcatggacggtgtcctggatgtcggtagccatgccttccacgctatcgttgaagcctcggttgagactttggcgcggcaagggcgggggcagggcgcggagcatgacgcgaaaccttcaaaacgatggcagacggctacggctcaggccggtcgatctggcgcgcggacacgggctgtccacccaggccatcaggaactacgaggaggccggcatccttccggccgccgagcgcacgcggcacggctaccgcgtctacacgccgctgcacgcggaggcactgcgcgcgttcctcgcgctggtgcccggccacggccacgggacggcgacgtcggtcatgcgggccgtacaccaggacacggtcgacgaggctttgcgtctcctcgacgtcagccacgcccagctcctggaggaccgacggaccctgcgggccgtggagagcgccctgcgcgacctgaccccggcgccggcgcccgggccctccgccgcggcccccgggcactccgctgcgaccgccgggcccaccgcgcagtccgggcgcggcgccgggttccgctccgggtccgggtccgattccgggaccgggtccggttccgggtccggttccgggaccggttcggggtccgggtccgggtccggtggcatgttcatcgggccgctcgcgaagtcgctcgggatccggcccgcgacgctgcgcgcctgggagcgcgccgggctggtgcgcccgcgccgcgacccgctgaccgggtaccgcgtctacgacgacgccgacgtacgggacgcccggctgtcccgtcagctcaggcgtggcggctacccgctggagcagatcgcgccgctgatcgcgcaggtgcgggcggccggcggactggagccgctggaggccgcgctggccgactggcacggccggctgtccgcccgtgcgcgggcgatgctgaccggcgcagccgggctggaggcgtacctgcgcgagcgcggatgcgtgtgagcgagcagttcaagctcgcctccacgcggcggacggccgctcctgccactcccggtgtccgaccggtcctgcccactcacggtgaccgaccgatcctgccactcacggtgtccgaccggtcctgccactcaggtatccgaccatcctgtcatttacggtgaccgaccgatcctgtcgttcacggtgaccgaccggtcctgtcatccgcggcggccggccgcccctgccgcggcgctcacctgctccctgggcgtccggcccaccgccgtcacggcgaccagcgcacccgccaggaagcagcagccgctgatcaccgacccgacgcgcatgccggtgacgaagtgcgcctgggtggcgacgagcgagccgagcagggccactccgatggcgctgcccacctggcggctcgcgttgagcacccctgaggccacgcccgaacgctccggtggcgccgactccacgaccgcggccaccgccgcgggcatggtgaacgccgttccgaagccgatcgcggccagcggcagcgccagcaccccgtagggggtcgagccgccggcggccaggagggcgaagaagccggccgtgccgacgagcagcccgagcgtcatgggagtgcgcgggccggtgcgcgccgtcatccgtccgccgagtgcggaggcgagaccggccatggcggtctggggcaggatggcgagcccggcccacagcacggcgtagtgccggtactgctggaagtagaaggtgaccacgaacaactggccgtagaagccgatgttgagcagcaggcccacggccgtcgcgccggagaaggagggatggcggaagagggacagcggcagcatggggtcggccacgcgttcttcgaccagcaggaacgccgccgcgcacacggcgaatacgacgagggccgccacgaccggcggggccgaccagccgcggtggccgccctcgatgatggcgagggtgagggcgccgagggccaggatgccgaggatctgggcgggcaggtccaggccgcgttcgccgcgcggcctcggcgcgctcacatgacgggccgtcaggaacaggccgagcagcccgaacgggaggttcacgtagaagaccgagcgccagccggactccgagaccagcagcccgccgagcaccggcccggacgccgccgcgatgccgccgatgccgccccacaccccgatggcgcgcgcacggtcctccttgcggccgtacgaggcgtggatgagcgccagtgacgtgggcacgaccagcgccgcggacaggccctgcagcagccgcatcaccaccaggaaccacagggacggcgcgatgccgcagcccacggaggtcagcacgaacagaccgagcccggcctagaacaccggtttgctgcccagccggtcaccgaccgagcccgccgagagcagcagcccggcgaagacgacggtgtagccgtcggcgacccactgggcgccggtcaggtcgccgccggtggcgaagtccttgccgatgggcggcagcgcgaccgtcacgatcgtcgcgtccagcatgaccatgaagaagcccaggcagagcgcgaccagcggcagccgggacgcggacttcggcgccccgggggcagcggtggcgaccgcggcgggagggttggcgtcgtccagggacatcgacgttccttcgtttcgttccgggcggcccggcgtcaggccagtcgtgccgtcacctcgggcgagccgctgacggcgatcgcgagcccgcctctgcccggcggtgcgcacagggggaagcggtcgctcgccaatctagtgccggaaagcttcgggccaggtcgaaatgtgcgcgcggcggccgtctcgggcgccgtgccgggcagacggcgggaaatcggcgcggggaagcctccggcggttcggccgctgccggcccggtgacagcatggacccacgagaaggacacggcaccgaccgttcgggagagtcatgcgcgacttggcgggagacgcgaacttcctcacaccggcctccctcatcggggaccggaccagggcccggatcctgctcgccctcctggaccagcgggcgcttccgatgacgatgctcgcggcggaggccggcgtggcgccgtcgacggtcagcggccatctggcccagctggtcgacggcggtctcctgacggtacgtcagcaggggcgccaccggtactacagcctcgcgtcggccgaggtcgcccacgcgctggagtccctcgccaacctggcgcgcccgttcaccccgcggtccctgcgctccgggacgcgggccgcctcgctgcgcctggcccgtacctgttacgaccatctggcgggccatctcggggtcggcgtgatgcgggtcctgctggagcggcgggtcctggtcggcggcgacggactgcacgatcccgcccgctcggtgcgcgaccggctgtccgcgccgggctgtgacctcacctacgaggtcacgcaggacggctggcggatcctggacgaggtcggtgtgaaaccgccgcggacgtcccggcccagcgtgcgctactgcgtcgactggaccgaacagcgccaccatctggcgggcgcggtgggcgccgcgctgctcgaccggctcctcgaactgggctgggtcgtccgggcctccggcagccgggtgatcagggtcccggaggaaggggcacgcggcctgcgggactggctgggcctggacctccaggaactccgtacccgcgcgactgcctgaggcttgccgggggcggctgcccgaggtgcgtggccgggccgaagtcgccgtccagccctggccgcccggcccgtgcggagggtccgagagggtcatgtccgcgctggtggtagggggttggactccgctcacgggtccgttgcatgtgctttactttcgccggacgggaggccatcgggccttgcagcgcggggggcgcttcgctccctctcggcttcgagaagggaaccacatggcgataccccctgctgctggagcatggccggcgagcccggtgcccgcacgcacctgacctggcgccccggcagggtgctcaggtcgtgtccgccgtcgtcctcgtccgccttctcgcgcggccggtcccaccagcctgccccagcgctccggtcggggccgccccgcgcaccgcgaccccaacgggagaggttcatcgtgtcaagatcccgctcaacgcccgcgagaagcgccggcctgctggccgccgcggtcctcgcgg

SEQ ID NO: 274 - DNA, 13456 bp, Unknown
  Kingdom: Bacteria, Phylum: Actinobacteria, Class: Actinobacteria, Order: Streptomycetales, Family: Streptomycetaceae, Genus: Streptomyces
cccctaccccgcccccgcgcggcccccgccggtctcagtccgcgagcggcaggtacacccggttgcccgcggcagcgaactccttggacttctgggccatgccctcctcgatctcgctccgactggtgccgtgctcccggcggatgtcctgcgagatcttcatcgagcagaacttcgggccgcacatcgagcagaagtgggccgtcttggcgggctcagccgggagggtctcgtcgtggaactcccgtgccgtgtccgggtcgagggccaggttgaactggtcctcccaccggaactcgaagcgggcgtcggagagggcgtcgtcccactcctgggcgcccgggtgccctttggcgaggtcggcgacgtgcgcggcgatcttgtaggtgatgacaccggtcttgacgtcgtcccggttgggcaggcccaggtgctccttgggcgtgacgtaacagagcatcgccgtgccccaccaggcgatcatggcggcgccgataccggaggtgatgtggtcgtacgccggagcgacgtccgtcgtcagcggcccgagcgtatagaacggagcttcatcacagatctcctgctgaaggtcgatgttctccttgatcttgtgcatcgggacatgacccgggccctcgatcatcgtctgtacgtcgaaacgcctggcgatggtgttgagttccccgagcgtcctcaactccgcgaactgcgcctcgtcgttggcgtcggcgatggagccgggcctgaggccgtcaccgagggagtacgtgacgtcgtaggcggcgaggatctcgcagagttcctcgaagttctcgtagaggaacgactccttgtggtgcgcgaggcaccaggccgccatgatcgagccgccgcgcgagacgatgccggtcttgcggttggcggtcagcggcacgtacgccaggcgtacgccggcgtggaccgtcatgtagtccacgccctgctcggcctgctcgatgaccgtgtccttgtagatctcccaggtcagctcctcggccctgccgtcgaccttctccagggcctggtagagcggcaccgtcccgatcggaacgggggagttgcgcagcacccattcgcgggtggtgtggatgttgcggccggtggagaggtccatgacggtgtcggccccccagcgggtcgcccacgtcatcttctcgacctcctcctcgatcgaggaggtcaccgcggagttgccgatgttcgcgttgaccttcaccaggaaccgcttgccgatgatcatcggctcgatctcggggtggttgacgttggccgggagcaccgcgcggcccgccgcgatctcctcgcggacgatctcgggagatacgttctccctgatcgccacgtattccatctccggcgtgatctccccgcgtcgcgcataggcgagctgcgtcacggcctggccgtcacgtccccgccgcggctgacgcggccggcccgggaacaccgcgtcgaggttccgcagtcccccgcgcggcgaggtgtgcttgatgccgtcgtcctcgggacgcaccgggcggcccgcgtactcctcggtgtcgccgcgggccacgatccagttctcccgcagcggtgacagaccgcggcggacatcggtgtcgacgagcggatcggtgtacgggcccgacgtgtcgtacagcgtgaccgactgcccgttcgtgaggtgcacctgacggaccggcacccgcagatcggggcgtgagccctcgacatacgccttgtgccagccgatggacttcccggcctcctgggactgttcgtcctggacggaggcaggcgtgcgtacgtccttgttggtcatgagacctactccctacgccggcattacccggtaacaggttcggcggtcgacgcagcggcttccgtccggcggcggttcgcgcggaacgtctctcgttccacgtgaaacatcgcgaagacagaggtcagcgccctctcagcccggtgctccgagctcccgcgtgtgcaaaggtgcctccacgctagcgtcatccagggcgcggtgaacagtaggcccctgccgttcttgcgatgatctggcggtgaccacgacgcagcggttccctcatccaccgcccgaaccacggcgcggatccgatgccgagcacgagcacagacacgggcacggccagggaaccgatcaccttcacagccacgagcacaaccatggaagcgatcacgctcacgggcacgagcagaaccagcggaccgatcacgcgcacagccacgcgcacagtcacagccacggtcctgccgccccggtctcgcagcacctccgcaaggtcatcgccgcgatcctgattcctttcgccgccgcggtggtggtcgggctcgccgtgctctggccgggcggcgctcccgcgcacgagcgcaccggcgtgggcttcgaccggcagatgcagcaggccacggtcaccgaggtggcggcggtgagctgcaaggcggtgaacacctccggtgacacaccgaccggtgacacctccaccgccgagggcgcctccgcccaggcgcagtcgtccggaacctgcaagaaggccacgatccgcgtcgacaccggaaaggacaaggggcgcaccttcaccgagatcgtgcagccggaccagtcgcggcagttgcaccggggcgagaaggtcgtcgccgcctacgagcccgccgcgccgagggatctgcagtactcggtcacggacgtggaccggggtttccccatggcattgctggccggggtcttcgcactcgccgtcgtggtcgtcgggcggatgcggggtgtcatggcgctggtcgcgctggccatcagcttcctggtgctggacctcttcatcctgcccgccatcctgcagggttcgaatccactggtggtggcggtggtggggtcgagtgcgatcatgctgatcgcgctgtacatgtgccacggcctgtcggcccggacctcggtggccgtgctcggcacgctgatctccctggtgctgatcggcatcctgggttccctgttcatcggctgggccgcgctcaccggcaacaccgacgacaacaccggcctgatccacggcctgtatccgtcgatcgacatgagcggtctgctgctcgccggcgtgatcatcggctcgctcggcgtcctggacgacgtgacggtgacgcagacgtcggcggtctgggaactgcacgaggccaatccggcgatgggctggcgcggcctgtaccgcgcgggcatccgcatcgggcgcgaccacatcgcctccgtcgtcaacaccctggtcctggcctacgcgggcgcggcgctgccgctgctgctgctcttctcgatcgcgcagagcagcgtggggaccgtggccaacagcgaactcgtcgccgaggagatcgtgcgcacgctcgtgggctccatcggcctggtcgcgtccgtaccggtcaccacggccctggcggctgtcgtcgtctcggccgaccgtccgggcaccgcgcggcccggggccgcggccgggctccccgcaccggcacgcggcggcaggggcagacggcgcaagcggtgagctgcccccgcgacatgcggtgaagcgttactccaccgcatgcgcccgattgaagaaacgcttcagccagcgctctgttcttccgccaggatgcggtccagcgcctcgtcgagatgcgcgtcgaagtcggccagagcaccctcctgacccaacggcaccagtttgtccgtgcggtcgaggaacgccacgaggggcgccgtggaggagcggaacagcgcgcggtcgccgcctacctgaaggcggatcaggacctcggcgagggagtcggagtcggcgggcgagacacgcacgtccccgtccccgctcggcctgcccaccccgtcgaccagcagctcacgtccgaaggcccaggtgaccggggcgtctccgggcagatggaacgtcaggcgtacggcatagggatcacaggcctcgtaccgcagttccaccggaatgcggaaggacagctcctcggacacgagaaagctcatcatgacctctgcctgtacggactcgcccatcactaccccgtcatctgccgtcgactggccgggaatgatccccataacactggtggcatcttgctgaacgtatatggcagatcacaaggagtgagttttcagatactgatagcgagcgcgagggagccgacacgccgccccacctcgctctgcagctgccgtgccgcgggcagcagacggtcggcctgatgtgcggggagtgagagggccatcgtcgcggccgtggtgcccacggtgatcggaatggccgcgcagaccgtccccagtgcgtactcctgtcgctccgtcacaggatgcatccgccgcatccgttccaaacgtcgcagcaggatgtggtcgtcacggacggtgtacggggtgagggactgcaccggatagcgggcaaggtggtcacggcgggcgtcgtcgtccagctgcgacagcaggcactggccgatcgcgtgcgcgtgtccggtctcccggaagtcggcccactccgctacggccgggttccctggggtgtcggagacgcacacgacctcgatctccccctcccggtacatcgcgtagtacaccggaacaccgatcagatcacgccattgtgcgagcgagtcgacgaccgtgctgcgacgtttctgcgccgccccactgctgctcagacgttcggccgcctcaccgaggaagaagagtcctctgtcgcggtacaggtagccctcgtggaccagtgtccgcagcaggtggtaggcggtggggagggcgagacctgtctcgcgtgcgagctgtttggcgggggcgccgtgctcgtgtccggcgacggtctccagcagacgcatcgcgcgttgcacggatccgatgagggtctgcgtcgcaggtgcgggcggttgctccggaacaccgacgtgcgggcgctccaccataggggcggagcgcggctgggccggaagtcccgtggaaccggacggcgcccgcggggccggtggcgcgtgcggttcggcaggtgcggtgtcaaccgtggccaagggtcactcccgtagcgcgagggggcagcccgtgcggggaaacacgggtgggggaaacgctgcccgcgggggccggcccccgcgtcgattcccggaccctatccgcctgtcaccgctccaggacggcctgtccggaaaacttccctcccgcgagggaaccggcgttgcccgtcagggtgcacccgtgtcccggaagactcaccagtcgccgtgcgacgacgaattcgacatgaacttccgcacgatgtagatcagaccgccgatcagcgcgacgaagatcagcagcttgaacagcagaccgatcacgaagccgacgaccgtcgctatcaggctgccgaagacgaccagggcgatgaccggcaccgcgatccacttcacccaccacggcagacccgtgaagacttctcgcattgccctcgtccttacctctccgccggccctgcgccggattctcgaagggcccgcactccgtggtgcggggcctgtcgtacgtcctgtcttcgatgctagggccgacaggggtccgggcggggctttcgcatcccttgtccgtccctgaccctccccctagggaaccctgagacggcgcctcaggcttcgggcggagagaacaccacgaggacccgcagatcctcgctgatgtggtggaacttgtgggcgactccggccggcacgtacaccacgctgccgcgcgccacttcggtcgtctccagtccgaccgtgatggaggcacgcccgctcaccacgaagtagacctcgtcctggcggtgcgggctctgcgggtcgttctcgcccgcgtcgagtgcgtacagccccaccgacatgttccgctcccgcaggaactggaggtacgcaccatcgttggcggcccgctccgtctccagttcgtccagccggaatgccttcatcgccctcgcccgtgttcgtcgtcgatctggtctgccacgatcagacacatgaagaatttcgtagtcaagacgatcgccaacgcaggcgccctggcggtcgccgtctggctgctcgacaagatcaccctgaccggggacaacacggccaaggagaccgcgaccctcatcggtgtcgcgctggtgttcggtctggtgaacttcctcgtcaagccggtggtgaaagtactgaccttcccgctgttcatcctgacgctgggcctgatcaccctggtcgtcaacgccctgatgctgctgctgacctcgtgggtggccggcaaggtccacctgagcttccacgtcgacggcttctggaccgccgtcgtcggcgggctgatcatctcggtcgtctcctgggcactgcacatggtcctgccggacgaggactgagcgccacgcccgcccgtcggcccgcgccacgggagacgcaccacggcggatgcgccacggttacggctgctgtgtcctgagagggtggagacggtgagccacggactgctcgccacggcacctgagcatgtgaagggacaggcggcatgaacgattccgctgcgaacgccccggagggcacgcacaagggcacccgaacgcctgccgccgccggtgacggcacgcgcgccgtccgggccggacttcccgagccggtcaaacacgaacccacgctccccggacccgtgttcgccgcccacttccacctccccggcgacccgacgggcccgtacacctacgggcgtgacgagaacccgacctggaccctgctggagcgcgccatcggcgagctggaggcgcccggcgaggacgctgtggagacgctcgctttcgcctccggcatggcggccatctcctcggtgctcttctcccagctgcgctcgggggacgcgctggtcctgcccgacgacggctaccaggcgctgccgctggtccgcgcccagttggagacgtacggcatcgaggtgcgcaccgcgccgaccggcggcgacgcccagctcgccgtgctggacggcgcgcggctgctgtggatcgagtcgccgtccaaccccgggctcgacgtgtgtgacatccggcgactgaccgaggcggcgcacgcgcgtggcgccctggtcgccgtcgacaacaccctcgcgacgcccctgggccagcgaccgctggacctgggggcggacttctccgtggccagcggtaccaagcagctcaccgggcacggcgacatcctgctgggctacgtggccggccgcgacgcccaggccatggcggccgtgcggcgctggcgcaagatcgtcggcgccatccccggccccatggaggcatggctggcacaccgttcgatcgccacgctgcagttgcgtgtctcccggcagaacacttccgcgctggccgtcgccgaggcgctgcgcgggcgccccgaggtgacaggactgcgctaccccgggctgcccgacgacccctcgcacgagatcgcctcgcgtcagatgcggcgctacgggtgcgtggtgtccttcgtcctgcccacgcgcgcgcgtgccgagcgcttcctgaacgcgctacggctcgtggacgacgccacgagtttcggtggtgtgcggtccacggccgagcggcgcgggcgctggggcggggacgcggtacccgagggcttcatccggctgtccgtgggcgcggaggacccggcggatctggtggcggacgtcctgcgcgccctggacgcgtcggcgcgctgacctgcgtacggcggacggtccgagcctcccccctcgtggctcggaccgccctcggttccgcgcgcgaagaaccgtgcgaaccaggctagttgactgtgagtcagtgtccaatcacagtagcgacagagacctatcgacatatttatagttgggcacggtcggcgggcagagcggaggtcggcgaagggagggggcgggccgtggatctggcgttactgcgcaccttcgtgaccgtccaccgcgccggttccttcacccgggccgcagcgctgctgggcctctcccagccggccgtcacctctcagatccgcactctggagcggcagctgggccgcccgctgttcctgcgccgggcccgtggcgtgacaccgacgtccatcggcgaggaactcgcccacaaggccgccccgcacctggacgccctggtggagatcgccgagtcgggcctcgacgacgagtcctcgttgcgcacactgcacctggccgggccgcccgagttcaccgcggaacgggcgctgcccgcgctgagcgggctgaccggggacgacggtcaggggctcgccctgcgcgcttccttcggaacggccgaggaaaccctggaagggctgtccgccggccaccacgacatggtgatcagtacggcgcgtccacgcggcgccctgctcacagcagcgccgctgtgcgacgaggagcaggtgctggtcgccgcaccgcgctgggcggaggagctcggccccgtggggcggggcgccaaagacatccctgccctggagggcgtcccggtgatcgaggtccacgagtcgctccccttcgtcacccgctactgggcctcggtcttcgattcccggccgagcggttccggcacggtgatcgtcgccgacctgcgcgcggtcctggcatgcgcggtggcgggtgccggagtcgcggtgctgccgcgctatctgagcgccgccgccctggaacggggagacgtggtggccctccatgagccggtggtcccaccgctgcgcacgtacttcctggtggtacgtaccggcaccctggccatgccgcacatcgcgcgggcccacgagcggctgatgcgcgcggcgggcgactggggctgagccgactcagcacgggagtcgcgccgggtacacgacccgcgcccggcaactgctcgcggcgcccgacaggcctgcgcacgatgacgtgccgcgatgtttcacgtggaaccagccgggccacatttctcccatgaccgtccgacccgtggtcaagcgcaccgctcgagccgtcctgctcgacggcgacgacctgatcttgatcaagcgcaccaagccgggagtcgatccgtactgggtcactccagggggtggggtcgaggctgacgacacgaccgtcgtcgacgccctgcatcgagaggttcatgaggagctgggggcgaagatcaccgacgtcgtcccctgcttcgtggacaccgtggagcacatcggcgaggacggcggcgcgaccggcgtgaaggtgcagcacttcttcgtgtgccgtctggagtcgatggaccccgccctgcgccatggaccggaggtcgacgagcccgccggagagtacgagatcgtgcgcgtgccgttcacccgggtcgggatcgcctcggtccacctcgtcccgctgtccctgaggcactacctggacgggaacatcgagggcgtccgggccatgcacgccccggatctcggctgaccgtccacgattcaagggtgacgctgtcgatccacgtttcacgtgaaacagcccatacctggttacccggtgcgggcacgcgccaaggttgtctcacggcgtccgccgatccgtcggccgccgggacatggccaaaagcacgtacgtgtcttacgaaacgagtggacgccgacggcatccgtcgtacagcctgacctgcgtgtcgactccttcccctgcctcttcgcccatccgctccctgacgcgtcatgacctcaccgcctgcgcagacctgtccgaggaccggggctggcagcgtgaggaacacaagtggggcctgctcctctccgccgggaaggggttcggcatcgacgaccccgacgggggactggtcgccgcctgcgtcgtcaccgggtacgggccgcccggacgtccagacctccacgccatcggcatggtcctggtcgccgagcgtcacgcacgccagggcgtcggccgccggttgatgcgtcacgtcgtctcggcggcgggcaccacaccgctgaccctgtacgccacccccaacgggcgtccgttgtacgaggaactgggcttcaaggtcaccggcaggtcggagatggtcctgggacgcttcgcaccggaggagcggctgagcggtccggccacgcgtccggcttccgccgaggacatgaccggcatcctccggctggacgaggaggtcttcggagcagaccggaccccgctgatcacccggctgcccgcgttcgccgaccagctccgggtggcggaggagaacggccggatcaccggttacgcggctgcctggccgaacatggacacgcacgtggtcggcccgctgatcgccagggacacggagaccgcgaagtccctgatcgcctccctcgccgcccacaccgagcgtccgttgcgcaccgacatcgacgtgcgtcacgaagagctgctgcactgggtgaagcagcgcgggctggcgtccgtcatgaccaacgccgtcatgacctacggaatcgcggagctgcccggggactggacccggcggttcgctccgctgaccgtggcggcagggtgagtcaggagagcttttccaccgcggtgacggcgaaggcgtgatcctgttccggtgcgccgccgccgaccccgaccgctccgatcagccggccctggcgacgcacgggcacgccgcccgcgatgaacagcagtggccggtcgagcgcggtgggcagggtgtggaaaaggccccccggctgtacggcgtcgacgagatcggccgtcgcggcatccagttgcagggccgtgtaggccttgcgggtgctggtctccccggagatgaggacggcccggtcgtcacggcggaaggcgagcaggtgtccgcccgcgtccagcacggtgatgctgacggcgacaccggccgtctctgcggcacggtgggccgcggcgacaaggacgtcggcgtcctgggcggtcagcgggactatggcgtgggtggtgctcatcgtaggtttctcctggtggtgagtgcgtgaggaccggcccggtgagggtcggtccccaggtgggcgggcgcccgagcaggtgcttgcctgcaggtcacgccccggtcgggtgacgcccccgtcggggcgagtggtgaggcgcggtggaccgagcgccgcggcgccgggcggcctcgggtcagtgaggaacgggcgtgggccgctcggccgcggcggacccggtgacgaccgcgccggagacgccgtcccggcgttccagggcggcggagacgacggcgagcaccagggcaccgaccgcgagcgcggcgccgacccagttgggagcggtgtagccgaagccggcgtcgatgaccaggccaccgatccacgcggacagtgcgttgccgaggttgaaggcaccgatgttcacggccgaggccagggtcggggcgccgtgtgcctggtccaggacccgcttctgcagcggcggtacggtcgcgaagccgaacgcaccgatcaggacgatggtcacggcggccgcgatcttgtcgtgcgcggtgagggtgaagagcgcgagcaccacggcgagggcgctcagggagacgtacagcatgggcatcagggcccggtcggcgaacctgccgccgacgaggttgcccgcgaccatgccgagaccgaagaggaccagcagccaggtgaccgagccgtcggcgaaaccggtgacgtgggtcatcatcggcgcgatgtaggtgatcgccgcgaagacaccgccgaagccgagcacggtcatcgccatggcgagcagcacctgggtgttcttgaaggcggcgagttcgtggcgcggacggacgccttccggccggggcatctcggggacgaggcgggcgatgcccgcgaggccgacgacaccgagggcggcgaccgcggcgaaggtgacgcgccagccgacggactggccgatgagcgtgccgagcggtacaccgacgacgttggcgagggtcagaccggtgaacatcatcgcgatggcaccggcccgcttgccgggggccaccaggtccgccgcgaccaccgagccgatcccgaagaaggcaccgtgggcgagcgaggcgaccacgcggccgaccagcatgaccgagaaggtgggggccagtgccgagagcaggttcccggcgatgaacaggcccatcagcagcatcagcatccgcttccgggagatcttggtgcccagaacggccatcaggggggcgccgagcatgacgcccaccgcgtaaccggtcacgaggaggcctgcggtcgggatggagactccgaagtcaccggcgacttcgggcagcaagcccatgatgacgaactcggtcgtgccgatgccgaaggccccgatcgcgagagccagaagcgcgagaggcatgaggagagaccttcccagaagattgcaggagcgctttacggtcatcgacaatagttgcagacgcttgttaactgcaaccgcaggcaatcgcggcattgctctatccttgaggcacccgcccggggatggaggaaaagccatgacagcgacggaccccgcgctcaccgccctagcccagggctggtgcgccctctcactgctgcacagcaggatcgaggcgcacatcgagcgcgccctccaggcaggtcacagcctgagcgtgcgcgagtactcgctgctcgacgtgctcagccggcagcacgacggcgacggcggccatctgcagatgaagcaggtcgccgacgcggtcgtcctcagccagagcgccaccacccggctcgtcacccggcttgaggaccgtggcctcctcgagcgctatctgtgtcccaccgaccgccggggcatctacaccaacgtcaccgaggccggtctccgcctcctggaagaggccaggccgacgaacgacacggctctgcgcgaagcgctcgacgaggccgcggagaacacggaactggcgcccctggtccgcgccgtggagtcgttgcacgcgcctgccacggcatagcggcacgctccggcagcggcgcgcataagctccggggcatgggagatcttgagatacgtgcggccgtcgccgaggacgttcccgccatcgtcgccatgctcgcggacgacccgctgggcgcacagcgcgagtcgcccgacgacctcgcgccgtacctggccgcgctggaacggctccgggccgatccgaaccagcatctggtcgtcgccctgcggcaggagcgcatcgtcggcacgctccagctctcggtcatccccggactgtcccggcgtggtgccacccggtcggtcatcgaaggcgtccgcatccacgccgatgaacgaggcagcggtctgggcacacagctcatcgagtgggcgatcgacacgtcacggcgcgagggctgccgtctggtgcagctgacctccgaccggtcccggaccgatgcccaccgcttctacgagcggctgggcttcgaggcctcgcacgtgggttacaaactgcccctgtgaacaacgccgccgccaggaccgcgtgttcacgaagacggtagggggcgtttcacgtgaaacgcc

SEQ ID NO: 275 - DNA, 624 bp, Unknown
  Kingdom: Bacteria, Phylum: Actinobacteria, Class: Actinobacteria, Order: Streptomycetales, Family: Streptomycetaceae, Genus: Streptomyces
ggtccagggggacggcggggaaccaggggagcgctggcgctggtctccggcgcgctggtcctcgcggtcagcgcctgcggcggcggcgactccggcacggagaacgggcagggcgcggacaagggctccggcgcggccgagagcaagcagtcgcaggcggtcgtcaccatcgcccccaaggacggcgcgacgtccgtcgacaccagcggcgccctgaaggtcggtgccgacaagggcacgctcacccaggtcgtcgtcaaggacgccaagggcggcgagatagccgggaagataaccggcggcggcaccacctggacgccgtccacccacctggccgcctcgaccaagtacacggtccacgcggtcgccaaggactccgacggccgtcaggcggcccaggactccagcttcaccacgctgacaccgaagaacaccttcgtcggcagcttcacccccgaggacggctccaccgtcggtgtcggaatgccgttctccgtcaacttcacccggggcatcacgcacccggaggccgtcgagaaggccatcgagatcaagaccgagccggccgtcgacgtcgagggccactggttcggcaacgaccggctcgacttccgtcccgagcac

SEQ ID NO: 276 - DNA, 10686 bp, Unknown
  Kingdom: Bacteria, Phylum: Actinobacteria, Class: Actinobacteria, Order: Streptomycetales, Family: Streptomycetaceae, Genus: Streptomyces
ggagatgaggcgcacgcggcctgcgcgccggccgcgtgcgcctcatctccttcccgagcggcagctccacgctcgttcccaccgccctcgccgccctgcgcgcggcgcaccccggcacccgcgtctcccttgaggaggccgagccgccacactccgtggaactgctgcgcgcgggcgactgcgacgtggccctcgccttccgctacgagggcgcggcgggcgccgaggagtgggccgacctggtggtacgcccgctgctcaccgaccggctcgtcgggctcgtacccgaagggcaccggctggccggcgccgagtccgtcgccatcgcggaactcgccgacgaaccgtggatcgcgggctgcccgcgctgccgcggccagctcgtggaggtgtgcgcgagcgccgggttcaccccgcgcatcgacttcgccacggacgactatccggcggtggccgggctggtgggcgcgggactgggcgtggccgtgctgccccagctcgcgatcgagtccgtacggccccgcggcgcgagcaccgtggcgctggagcccacggtgcgccgcgagatcgtcgcactcaccctgcccgacctggcccaggtgccggccgtggcggccacgctcgacgaactggtgcgcgccggggccaggggagcgtagaagagccagggccaggtgagcggagaagaagggcacgcgtgcgcgtgcccttgtcgtttgtctccgttgcgtccgtatgggtaagaagaaacgttccttcaggtggtggaagcggtgtcgccgcttgatgacgaggccgtcaccagtcggttccgtgcccgccccatgagctcctcgcgctcgtcctcggtgaggccgccccacaccccgtacggctcgcgcaccgccagggcgtgtgccgcgcactccgcacggaccgggcacctcatgcagacctccttcgccgagttctctcgagcgctccgagccgccccgcgctcgccctcgggatggaagaagagcgagctgtccactccgcggcaggcagccagcagctgccagtcccacaggtccgcattcggtccgggaaggcgggagaaatctgccattgcgtgaccccttgtagccgttcggtggcggatacggtgccaacgaccgtacatccccggtctaaggagatgaaaatatgactcattgcgaatctagcgccagacacctagaaacgggaagaaaaggggctgaatggggcatagcttgtgatgaaaagttgagggtatgacgtctgtgtctgcactgtgtccgctccctcacgtagagtgccgaaaacggcgtacggccccgtaactctttcgagtgaccgtcgttgagagtgcggaggcggttgaaaacacaagtgctcgggcaggcgtccgagacggtcgaccgcacaggtgacgatttcgtaccagcctggaggctcaaggtgacgcgcatcagctgcggagggcggccatgacatccgtcctcgtctgcgacgactccccgcttgcccgagaggcgctccgccgcgcggtcgcgaccgtgcccggtgtcgagcgcgtgacgacggcggccaacggcgaggaagtcctccgccgctggggtgccgaccgctcggacctcattctgatggacgtgcgcatgcccggactgggcggcgtcgagacggtccggcgcctgctgtccgccgaccccggggcgcggatcatcatgctcacggtcgccgaggacctcgacggtgtggcgctcgccgtcgccgccggtgcccgcggctacctgcacaaggacgcatctcgtgcggagctgcgcgccacggtgacccaggcccttgccgaccccacctggcggctcgccccacgccggctgcgctcggccgagatgggtgccgcgcccacactcaccgcgcgcgagatccaggtcctggaaggcatgagccacggccgctccaacgcggagatcggccgcgagctgttcctttccgaggacaccgtcaagacgcacgcccggcgcctgttcaagaagctcggcgcctcggatcgtgcgcacgcggtggccctcggcttccggtggggtctggtccgctgacccgtttccgggccggacggaccggaccagcccgggtgcactacccgggcagctgcagctgatgccggcgccggcgctgatgccgaaatcgaggcccggtgcgcccgcgcgtgaggtccggcgcgagcggcgcagggcctggccgtacgaccggaccggtcactcgggacgagacgtccggctcatgccgtggcatcccgctcatgccgtggcctccgcccgggccgttccggccggtccgtggcgctcagcgcgggaagcggtcgtacggccccgacggggcgcgcgcgggtgcgcggccgggcggcgtcctcgcgcgaccggcccggcggcatcgtcccgcgggtgcttctccgacgtgcagcggcgtgcggtggcggcctgcggcggcgtagtccgaccgggggcgtcgagggcgaggacgcggagcccgaacggggtccttgagcggggcggacggtgccgcataccgcaccccgggtaccactgaccatgcggcccgccggacggccggtgctcgtttcgccgcggatgccgcatccttgaggtgtggagttcctcggggacgagtcggtcgagcggaatgggagggcgcaggggatgggttccggcgcacccgctcataacgcttcagtgcacaaccgcgaaggcggtgccacgcagcagacgacgccaaggcacgatggaccgatgcgcgacgacgaggcggcagttgccccaggggcgatcggtgcgctggtgcaccgtgccgtcgacggcgacgagcaggccacgcacgatctgctggcccgcgtccatccgctcgcgctgcgctactgccgcacccgtctgtcgcggctcccgggcgacgcgcgccacttcgtcgaggacctggcgcaggaggtctgcgtcgccgtcctcctcgccctgccgcgctaccgggacaccggccgccccttcgaggcgttcgtcttcgccatcgcctcccacaaggtggccgatctccagcgagcggcgatgcgccaccccggttcgacggccgtgccctccgacgagatgcccgagcgtccggacgactccctggggcccgaggagcgcgccctgctcagcagcgacgccgagtgggccaagaagctgctcgccaacctccccgagaaccagcgcgaactgttgctcctgcgcatcgcggtcggcctgaccgccgaggagacgggccagatgttgggaatgtcaccgggagccgtccgggtggcccagcaccgggcgctgagcaggctgcgggcgctcgccgagcagtagcccggcccccgttgaccggcgacgcgccgatttcataggaagatacgaagctcagggcggcccttcgtcgtggaatgagacgcctccgcttcccgttagcatggacatccgcaccgatcaaggccatttggggaaggtgtcatgactgcaaacgtcgacggagtgcccgagaaattcgcgacactcgggctgacctacgacgacgtgctgctgctgccgggcgcatccgaggtgctcccgggcgcggtcgacacctcgtcccgcatctcccgcaacgtccgggtgaacatcccgctgctgtcggcggcgatggacaaggtgaccgagtcgcgcatggcgatcgcgatggcccggctgggcggcgtcggcgtgctgcaccgcaacctctccatcgaggaccaggccaaccaggtcgacctggtgaagcggtcggagtccggcatggtcaccgacccgatcaccgtgcacccggaggccacgctcgccgaggccgacgccctgtgcgccaagttccgcatcagcggcgtcccggtcaccgacccggccggcaagctgctcggcatcgtcaccaaccgcgacatggccttcgagaacgaccgcggccgccgcgtgcacgaggtcatgaccccgatgccgctggtcaccggcaaggtgggcatctccggccccgacgccatggagctgctgcgcaagcacaagatcgagaagctgccgctggtggacgacgagggcgtcctcaagggcctgatcacggtcaaggacttcgtcaaggccgagaagtaccccaacgccgccaaggacgccgagggccggctgctcgtcggtgccgccgtcggcgccagcccggaggcgctggagcgcgcccaggcgctcaccgaggccggcgtcgacttcctcgtcgtcgacacctcgcacggtcacaacagcaacgcgctgagctggatgtcgaagatcaagtcgagcgtgaaggtcgacgtggtcggcggcaacgtcgccacccgtgacggcgcacaggcgctgatcgacgccggtgtggacggcatcaaggtgggcgtgggtccgggctccatctgcaccacccgcgtcgtcgccggcatcggcgtcccccaggtcaccgccatctacgaggcgtccctcgcggcccgcgccgcaggcgtcccgctgatcggcgacggcggcctgcagtactccggcgacatcggcaaggcgctggccgccggtgccgacacggtgatgctgggcagtctcctcgccggctgcgaggagtccccgggcgagctgctcttcatcaacggcaagcagttcaagtcgtaccgcggcatgggctcgctgggtgccatgcagtcccgcggccagggccggtcgtactcgaaggaccgctacttccaggccgacgtgacctccgacgagaagctcgtccccgagggcatcgagggccaggtcccctaccgcggaccgctcgccaacgtcctgcaccagctcgtcggcggcctgcgccagaccatgggctacgtcggcgccgccaccatcgacgagatggagtccaagggccggttcgtgcggatcacctcggcggggctcaaggagtcccacccgcacgacatccagatgaccgtcgaggcaccgaactacagcagcaagaagtgagcgggaagtggtccacgcgcgcgtagaggcgcgctgggggcacggctgaccccgtccgagggcggctccgggagcaccggggccgcccttgtcatgggtgtcggcgatactggaagacgctgcaacgcatcagggaaaggccacagacgtgactgagatcgagatcgggcgcggcaagcgcggccgccgggcgtacgccttcgacgacatcgccgtcgtccccagccgccgtacgcgggacccgaaggaggtctcgatcgcctggcagatcgacgcctaccgcttcgagctgcccttcctggccgcccccatggactccgtcgtctccccggccaccgcgatccgcatcggcgagctgggcggcctcggcgtgctcaacctcgagggcctgtggacccgccacgaggacccgcagccgctgctggacgagatcaccgagctgcccgccgaggccgcgacccgccgcctgcaggagatctacgccgctccgatcaaggaggagctgatcggcgcgcgcatcaaggaggtgcgcgacgccggtgtggtcaccgccgccgcgctctccccgcagcgcaccgcccagttctccaaggccgtcgtcgacgcgggcgtggacatcttcgtcatccgcggcaccacggtctccgccgagcacgtctcctcctcgcacgagccgctgaacctgaagcagttcatctacgagctggacgtcccggtgatcgtcggcggctgcgccacctacaccgccgccctgcacctgatgcgcaccggcgcggccggtgtcctcgtcggcttcggcggcggtgccgcgcacaccacgcgcaacgtgctgggcatccaggtccccatggccaccgcggtcgccgacgtggccgccgcccgccgcgactacatggacgagtccggcggccggtacgtgcacgtgatcgcggacggcggcgtcggctggtccggcgacctgcccaaggcgatcgcctgcggcgcggacgccgtgatgatgggctccccgctcgcccgcgccaccgacgcgcccggcaagggccaccactggggcatggaggccgtcaacgaggagctgccgcgcggccagaaggtcgacctcggcaccgtcggcaccatcgaggaggtcctcaccggcccctcgcgcatccccgacggctccatgaacttcttcggcgccctgcgccgcgccatggccacgacgggctacagcgagctgaaggagttccagcgcgtcgaggtgacggtcgcggactcccagcacaagcggtagggccaccgccctgcaccgaaggggcccggtcactcgctcaggcgggtgaccgggccccttggcgtgcgggcagtgagggggcgcgttcggtgaggtcagggcgcatggtcgcattcggggcggatgcgccggggacgggcgtgagggagggtcacgcgtccgcgcgccccctttcacaaccggtgcgccgcccccagcggggccgcaccgcgggtgtccaggaggagctgggccttcaccgacaggccttgcaggtcgtacgtcctgtggtgctggagcaggatcgtcaggtcggcgtcggccgccgcctcgtagagggcgtccgcgcgcgggacggggcggtcctcgacgctccaggcgggcacgtacgggtcgtggtagctgacgcaggcgcccaggcccgtcagacggtcggcgatctcctcggcgggagtgccctggaggtcggcgaggtcaggcttgtaggtgacgcccaggaggaggacgcgggcgccgcgcgccgacttgccgtgctcgttgaggagggcggcggcgcgctggacgacgtagcggggcatgcggctgttgacctgctgggcgagttccaccatgcgcaggccgcgaccggccgtgccggacatgtcctgggggaggccggggccgccgacgccggggcccggacggaaggcctggaagccgaacggcttggtctcggcgcagcggaccacgtcccacaggtcgacgccgaggtcgtggcagagcacggccatctcgttgacgagggcgatgttgacgtgccggtagttggtctccaggaggtggacggtctccgcctcccggagtccgcgcgcgcggaccaccttgtcggtgaggcggccgtagaaggcggcggcggactcggtgcaggccggggtgaggccgccgatcaccttgggcgtgttggccggggtgatgtcgcggttgccggggtcgacgcggctgggggagtaggcgaggtggaagtcgcggccggcgacgaggccggagccctcctccaggagcgggcgcaggaacgcgtccgtggtcccggggtggacgggtgactccaggatgaccgtggtgtgcgggcgcaggtgtccggccagggcgcgggcggcggtctccacctgccccaggtcgaacccgccgtcggcgccgcgcggggtgggcgcgcagatcacggcggtgcggacccggcccagttcggcggggttggtggccggccggaagccccccgagagcatccggcgcagttcggcggcgctgagcgagccgggttcctccccggtgcggtacccgagcgtggggacaccggcggcgacggcggcctgggccaggggcaggccgagtggaccgagtccgatgacggcgagatctgcgggcatggcgtgggccgtccttcccaataaccgaggtggtgcgggcacgcaagtcctgtggacaggacgagcgagagcaatgtcagactaggagtaaatatgaccgttttgcgggattgaccagcgtgtttctcggtgaaccggtgggagttgtccacaggctgcgggcgactggtggctgaagacgggcaaccccgtcagaatttgggcaggggggaacgcgaggggtacctggagacgtatgggacggggcttcgcccgacgggtgcggccggctcgaccgagagcgggaggcagcagtgaggacagcgacactggggccggcgcagcgcgccgagtcactggcggcaatggccgagcgtgagctggacattctggtcgtgggtggcggcgtggtgggtgcgggtacggccctggacgccgtcacgcgcggcctgtccaccggcatcgtcgaggcacgcgactgggcgtccggcacctcgagccggtccagcaagctgatacacggcgggctgcggtatctggagatgctcgacttcgccctcgtgcgggaggcgctgaaggagcgcggcctgctgctggagcggctggctccgcacctggtcaagccggtgccgttcctctacccgctccagcacaccggctgggagcggctgtacgcgggctcgggcgtcgcgctctacgacggcatggcgatggcccgcgggcacggccgcggtctgcccatgcaccgtcacctgagccgtcgtcacgccctgcgcgtggcgccctgtctgaagaaggacgccctggtcggcgccctgcagtactacgacgcccagatggacgacgcccgcttcgtggcgaccctggtgcgcacggccgtgtcgtacggcgcgctggccgccaaccgcgcgcgggtcaccgggttcctgcgtgagggcgagcgggtcgtcggggcgcgggtgcaggacgtcgagggcggcggcgagtacgaggtccgcgcccagcagatcgtcaacgccaccggcgtgtggacggacgacacgcaggcgatggtgggcgagcgcggccagttccacgtccgtgcctccaagggcatccacctcgtcgtgcccaaggaccgcatcaactcctccaccggcctgatcctgcgtaccgagaagtccgtgctgttcgtcatcccgtggggccggcactggatcatcggcaccaccgacaccgactgggacctcgacaaggcgcacccggccgcctccagcgccgacatcgactacctgctggagcacgtcaactccgtgctcgcggtgccgctcacccgcgacgacgtggaaggcgtctacgcgggcctgcggcccctgctggccggcgagtccgacgccaccagcaagctctcgcgcgagcacaccgtggcccacccggtgccggggctcgtggtcgtcgcgggcggcaagtacaccacctaccgggtgatggccaaggacgccgtcgacgaggcggtgcacggcctcgacatgcgggtcgccgactgcgtcaccgaggagacgccgctgttcggcgcggagggctaccaggcgctgtggaacgcacgggcgcgcatcgccgccgagaccgggatccacgtggtgcgcgtcgagcacctgttgaaccggtacggggcggcggcgcaggaggtgctcgacctcatcgccgaggatccctcgctcggggcgccgctgaagggcgccgacgactatctgcgcgccgaggtcgtctacgccgcctcccacgagggcgcccggcacctggacgacgtcctcacccggcgcacccgcatatccatcgagaccttcgaccggggcacgcgctgcgcgcgcgaggccgccgaactgatggcgccggtcctggggtgggacgcggaccagatggcccgggaggtcgagcactacgagaagcgggtcgaggcggaacgggagtcgcagcgccagcccgacgacctgacggccgacgcggcacggctgggggcgccggacatcgtgccgctgtagcaggcaggagacggacacggcggaccgctgtgaaagcggcccgcgctgtggcagaggggaggaagcgggagagaagggggcgagggagcgaggtttcgtcaccggccgtcatcaccctgtgtggtacgcgctgttcagcggtgggtccgctgtgccccggggtgtccgcggagggcaccctgggcgtcgagcacttgtcgggtgagggacaatggagcctctgtcagggcgggttgcatgaggggacgcatgtcggaggcggagcgggcgggggcatcccgtcaggacactcgtcaggacaacagcgagcgtcttctcgccgggcggtaccggctgggagacgtgctcggccgcggcggcatgggcacggtgtggagggcagaggacgagaccctggggcggacggtcgccgtcaaggaactgcggttcccgacgaacatcgacgaggacgagaagcggcgcctgatcacgcggacgctgcgcgaggccaaggccatcgcgcgcatccgcaacaccagcgcggtgaccgtcttcgacgtcgtcgacgaggacgaccggccgtggatcgtcatggaactggtcgagggcaagtccctggccgaagtgatccgtgaggacggcctgcttcagccgcggcgggccgccgaggtcgggctcgccgtcctcgacgtgctgcgttccgcgcaccgccagggcatcctgcaccgcgacgtgaagccctccaacgtgctcatcgccgaggacggccgtgtcgtgctcaccgacttcggcatcgcccaggtcgagggcgacccgtccatcacctcgaccggcatgctcgtcggcgcgccgtcctacatctcgccggagcgggcccgcggtcacaagcccggcccggcggccgacatgtggtcgctcggcggtctgctgtacgcggcggtcgagggctccccgccgtacgacaaggggtcggccatcgccacgctgacggcggtgatgaccgagccgctggaggaacccaagcacgccgggccgctgcgggacgt

SEQ ID NO: 277 - DNA, 13131 bp, Unknown
  Kingdom: Bacteria, Phylum: Actinobacteria, Class: Actinobacteria, Order: Streptomycetales, Family: Streptomycetaceae, Genus: Streptomyces
atcacgcaccaactcgtaagatctgtcgggtgactgccgggtcggccatgggccatacaccagtggggcacccggccttggcgtgagcacgaggcgggcccgagccccgccttcctcttcgtgtcttcacctccggcgcccccacgcggcgcttcatccctcgggatccaagacccggagaggcatcacacatgtcgcacgaccagcaacggcaccacgagcagctgcccatcacggtcgcccagctcaaccacacggcggtctatgcaacggaccggcggctgtcggccgacttcatcgcaacgatcctgggcttggaaatcggcgcccagttcggccccttcctgcccgtcgacctcggcaacggcgtgacgctcgacttctacgagaagcgcgacgagccgatccagtcgcagcactacgcgttccttgtacccgacgagcagttcgacaccatgatcgcccgcctggaggcggtcgcggtcacctactatgccgaccccaaccacaccgaacctggccagatcaatcgcctcttcggcggtcggggcgcgtacttcgccgacccggacggccacaacatggagatcatgacccggccctacgcccggccctagccgcacaggttcacctgcttcgggtcatgccgcgttggcgtgggggcgtccgctccagcggatgcccttctcgctgcgggtgcgggtgcgggtgcgggcgcgctcgcgccgctgggccgcgaggatgtcggggtggtgagcgttggtgttgcgccagcgcaggtaacggtgcagctcacgcgtctggacggtgtgacgtgctcctcgctctctacgcgaggtgcgtcgccggccggctggcgaactacctgaagcagatcgaaggcatccggtacgtcgccgaggcgggttgaacaagaggtgatcagggcggtgtggggcccctgaaggtgggtcccgcaccgcccttcagcgttgtccgacacgggcctttcgggtgtttttggctgatgacgcatgggggcaggcattcgtagaggcccagtttccgccggggtcagccgcacttcaggaccttccggcgaagcggcgtacgctggaaagtgatgaatctagcttgctaggatgctagcatcggcttgtgagtgatgagggagtcaagcagttcaacgtgtacctgccgatcggactgatcaagcaggtcaagtaccgcgccatcgagtcgggcatgtcgttgtcggcgctcgtcgctgacgcgctgcgggcctacctcgacgacgcccaagggaacattcagcaatcgcccgggaaggagacctgacatgacgaccgaaggcatcgaggccgtgttcctgacgacacataactggggcaaggcgacgaaattcttccaggcgctgggatacgagctggagttcgcgacggaccacaactccggccggctccgcaacggcgacggtccctacgtgttcatcgctgaggttccccaggaccaggagccccagacgcggatcgtgctgaaggcgccggacgcagacgcattccgccccgatcctgtcgtcgaggtggtcacgccgttcgaggacacccattacgggacccaggagatggccgtccgcgaccccgacgggcgcctgtggagcctccaggctcccaccaagaactgactgcgacgacaggggaacaccatggcgcgcgaacagaccgagacaccggacaacaccgcggtgcggaccgccctctggcgggcgctgcacctccaggtcgacccacccccgcatgtggtcgaggacgagatcggactgcgtctggcggcccccggcgccgactggcgcaaccgcccggacatggatccgcaggccaccagcgggttccgggcggccatcgtggcccgcgctcgtttcatcgaggacctggtcgctgagcaggccgaccgaggcgtgacccagtacgtcatcctgggagccggtcttgacaccttcgcccagcgcaagccggagctcgcctcccgcctgcagatcttcgaggtcgaccagcccggcacccaagcgttcaagcgccaccgcctggccgaactcggctacggcatcccggactggctgcacctggtgccggtcgacttcgaggccggcgcgtcctggtccgaccagctgtccaccgcaggcttcgatcccggccggccggcggtcatcgtctccaccggcgtcaccatgtacctcaccaaagacaccaccgctgccaccctgcgtcaaattgccgggcttgcacccggctcaacgctcgccatgaccttcctgctggcgaccgaactggtcgacgccgccgaccgccccggcctccggtcgagtggcgacggcgcacgagcatccggaacgccgttcatcagcttctacaccccgcaggagatgctggcgctggctcgcgaagccggcttcaaagactcccgacacgtgccgggagctttgctcaccgaccgctacttcgccgatcgcaccgacggccttcgcccgtcaagcggagaagacctgctgctggccaccatctgacgccccgagccccggcgtacgcctcgcggcgccgccgtgtggtcgcgcgacccgccgaggcccttacgtatccaccttgaccagcacactcggcctcaggctacgactccaaccccaacgggcgcgagctgcgcaaacggcggatcctgccggtcatttcccgcaaaggtccccgagcaagctccgctacgtcgtccagcagaccttcgccctgctccaccagcacgagcgcctcgccgtccgcagggaacaccgagcccggaggattctcggaacaggtggcgtcgacgaggggccggttcatctcggtgtacgtacagcgtgaccgccgcgcgtgatcgtgcacggattgacgcctgctgtgacggtccccaagctggagaaggagctgctggaaggggccgtggccgtgagcggtgggcagagtgggcttccctggctgctgaccgcagcggagagggcggcgccggtggacgccgtcgcggtggtcgccgaggatctgcggcggcgtttcggggccgtgaaggtgtcgttcctcatcgtggacctgacagggaaggcggtggcgcggctggccactgccgtcggtgtggagggcgggcgggaagcagagcggattcccctgttcggcagcgtctacgagcaggtgatccgtacccagcggctgtatcagaaggcgactggccaggggcagcgggtgatcgttccggttaccaaccgcggggacgccatcggactgctggaactgctcctgcccgccgcccccggcgacgacgtccttgaggaggtcggtgaagccgcccacgtcctggcctacgtggtgatcgccaacgggcgcttcaccgacctctacacctggggcaaacgctccaggcccccgacgctagccgctgagatccagtaccagttgctgcccccgtcactgtcgtgcgaggccgcgcagttcactttgtgcggaaatttggagccgtctgaagacctcagcggcgacaccttcgactacgcgctggaccgcgacaccctgcacgtgtcggtgaccgaccccatgggccacgacatcgatgctgccctggccgccacggtgctggtgggcgccctgcgcggcgcccgtcgtgccggagccggcctggccgagcaggcccacctggccgaccaggccctggccgatcacggccacggtcacgccaccgggcaactgctgcgcatcaacctccacaccggtcacgcccagctcgtcaatgccggtcacccctggccactgcgcatgcgcgagggagctgcggaagcgatcgcctgcgaggtcgaccatcccttcggactgcccgtgtccgtgccccacccctaccgtgttcaggacctcgatctgcgccccggtgaccgtctgctcatggtgaccgatggcatgctcgaacgtcacggggaggcggtcgacctgctcgccctgctggagcgcacccgggatctgcacccgcgggaggcggcgctgacgctgacgtccgcggtccgggacgctgccgggggccggctcgccgacgatgccaccgtgatgtgcctggactggcacggtcctcaggggaccctgcggcacgtcagctccggcgcggacacagagcaggcttcagccggccgcacgaagcagtaaccgtgaccgggacgctctcctgacggtcccagacggccgttgtgtggctctcgcgcctggaccgttcatgcgagcttgagtctccaccttgcccatgggctgcaggcggcctcggcgcccttgcccggatgagacatcacgaggcggcggccgcccggccggcgccccggggtgaccttcgtgcggagccggactgtggcgaaggtggactcgatgggatccgtggcccgcaggtggattcggtgctcggcgggaaagtcgtagaacgggaggagtgcgtccgtgtcgtcggtgatcttcttgacggattgacggccttggggaacttcaccccgtaggtcttggcgaacgcgtcgacagccttcagggcatgctcgcggtcttcggcgttgcagatctcccgcagggccttcttcgcgccgggctgggcggacttcggcagagcgttcgcgacattggcggccttgtgaacccagcacctctgatgtacggccgttttcatgtaacgggccagtggcacagcactcttgatcgtcttcagggcggcgcctaggctctcatgctcatggagatgggggaaccgggccgcgggcggcgggcatggcgcaacgggctggtcaggcgtcgtgtagccgcaggtctgctggccggggcggtggggctggtcattctgggcacggtgttcgtcgtactgccgggtgtggtggtcgaccacgatctcgccggggcgagcgtcgccgcacaggatcgactgaaggcggtgaacgatgtccgcacgacgcttctgcaggtggtcggcggcctggtcgtgctcttcggcgcgtacgccacctggcggcaactgcgggtgagtcaggacgggttgcgtgccacccaggagggctacgtcaccgaccggttcagccgggctgtcgaccaactcggcagcgacaagctggatgtgcgcatcggcgggttgcacgcgctgtggcggatcgcggagcagtccgcccgcgaccgggaggccatcatttccatccaggccgcgtatctgcgtacacacctgccctggccacccgccgggccggaatcaccggcggcagacgtgccgatcaacgacatcgcacccctggagacccgggcggccgatgcccaggtggcgctgaccgcgctcggcgtgctgtgccagcatcgggagcagtcctgggtcaatctcagcatcaccgacttgcgccgggccgactgcgacggactgtggttccccgaggtcaacttcgaccgcgcttgtatggaggcggcgggcctgtaccacgccaatctgacccaggcgtccctggtctcggtcaacctgcggcacgccgacctcacgactgcgattctccgccgggctcgctgcattctggccgacctacgggccgcgaagctggtcgaaaccgacttgcgtgacgccgacttcacccagaccgacctgcgcgaggcaaacctgcgcaaggctgccgcccacggcgcggtcttccaccgcgctgacctccgcatggccgacttgcgcggcaccgacttgagcaccgccgaccttgtcgaagcccgcctgaccggagccctcgccagcgagcacacccgctggcccgccgacttcgaccacacggccgccggagtcgtcgacaccgaggaccccggacccgagccctcgcccctcctccagccgcccgggatgacgtggcaggcaccgccgctgcggtccgctccctgaccaagacgcgccggtcaggactgcggtgaccgcgatccgcctgaccgacgtcactcctcctcagcggtgtccttcgtgcggtgcggccagggctacaccctgcgcgtcgccgcagtcccggccggtgcactgccggctcatcgccctacagggccgggcgcagcaggatcggagggcagcgtcacggtcacccccgtatgcagccgtgcaggaacgctccgatcgggcagggatggcgtgcccctggggcgcggcgcgcgggaataggtctggcgagcactgccaggagcacgacgacgtccacggtcccggccatgctgcagaactacggcggagacaagtttcggcgccggacgtcgccggcgatctggtctgctgcgcaggtcgcaggtcgcaggtcgcaggtcgcaggtcgcagggctcttcggggcctctctccgaggccggcgatccggtgctcgacgactcgctttcgccagcggcccaccgcatgctgtgtcgaaccgagttgcgcggccacgtccttgttggacgcccccgacgcgcagggcaggatgatccggcaccgcagggcccacgcctgcggcgtggagcggcgccgcacccacccttccagcgccgcccgttcctcatccgacaggatcaactcggcttaccgggcgggcggacggtgtccgggcgggcagtggtggggatgacctttcgtgcggcgctgctcagcgtacgacgtggctgatcccgcggcgccccgcagattcgtcggagggtccctcctgcgcgaggcggcacggggggcggtcccccagctcgctccctgctacgtggcggatccggcgcgggcaggcgccgggacgctgaaagcagcgttcccgagcagcgcttcggccagcaccccccacctgatctcacggcggtcgtgccattcggcgaccagggacaaggtggtgacggggaccgtcaccggcccgcccggaagatcggacagcagcagcttcagcacactgcggtcggccaggtgtccgtcggctccggcgtaagcgtgcgtgacgtgcggtacgggctggccggaatgagcggccaccggtcgcccaccactgtctgctgcacctgccatgtcatctcccacagcctgcgcagcggagcgccagggtatcccttgctctcgaccgctgcgttcccgatgtccggccgggacagcaccacgtcgaacggttcaagacgggccgcttgatgggtgacttcggtgaccagccggttgatctcagcgggagtcccgctgtcctgcgggccggcgtggagcacggtcatgtgcatccactacggccgcaccggacacagccctggctgctcgaccagctggcggcagggctcgtagaggatctttcgagcgaactccttctccggaatgatcagccagtgcaggtccttgcgccccggcggccaggcattgctccgcttctccacccgcgcgaaaaagtcctccacgaccgcccccgttgctgtcggcacatactcactggctgcgtaagcgtccgccggccctcagcgggcgtcagcctcaactggtgtgctgcgctacggcgaccttggctcacatctgtgccagtgcgatcgcctgctcgacatccatccggcagcgaggccgcctccttcgcgggctggctcgcgtgggacaagggcgaccacgggtcggcccgctcctgggacggcggagccgtcaaagccgcacgcgcggcccagaacccgctcttgacctcgtaccagataggcacgctcgcccagttcgaggcacacgccggcaacggcgtggaagcgctgaatctcgcccggcgcgctcggcgggttctcggcgagcagcgcccggccgtcgccgacgcctggctgctgaccgtagatgccctcgggtacgcggtagccggcgaccggcgcggggcggaccgggccctggtcgagtcccgcacagtcgccgagacgctgaccgccgagcaggaaccgtcaccatggccgtgggtgttctccttcacccccgacaaggtggccgcctgccgcgtcacctgcggcgcacgcctggggctgcccgcgcgggtactcgccgaggacatggaagccctcaccaccggacacgcgaaacaacgcgcgctgctcgtactcgacatcgccgacggtcacctcgccggcggaagggtggaggccgcgttcgcccttgcctcccgagccctcgatgccggcctgcagtaccggtccgggcggatcgtggaacgcgctcgtgccaagcgccgtagcctcaccactgcctcaccgcccagggtggtacgggacttcgacgagcgcctgcacggcgtctacctgtaggagggaacaccgcatgagggtgggaatcaccgggcaccgcggactgagcacacaggtcgaggcccaggtacgggcgcttgtggccgagtacgtcacggcacacgaccccgccgacctggtcggcgtctcgtgcatcgccgacggccccgactcctggttcgccgagaccgtgctcaagcacggcggtcgtctggaggtcgtcgtcccggccgccgagtaccgccagggcctgcccgactggcaccacccggtctacgaccagctcatcgcccgcgcagccgacatccaccacacaggcatgaccgagtcgacttccgaagcccatcaggccggatccgagatcctcgtcggcctggtcgacgagctggtcgcggtatgggacgggaaaccggcccggggatacggcggcaccgcagacgtggtcgactacgccgaacggaccggcgtcccggtgcgagtgctgtggcccgagggcgccagccggtgacatcagcaggccgggcactgctcacggttgctcctcccgctaagaacgcatggccccggctgccccgtacggccccgcccgctggctcagccgtccgggtaccggtgagatggaacacgaccttcctcattgtcataccggaaagcgagcccccgctgtgatcgtcaagaaactgcacgagtccgggatccgtgccgagcacgcctacgcggccgggttcgccgccatcggcatgtcggtcgtctcctggtgcgcatcgctgggcctggagaagaagggcgaagaacgcgccgaccggctgggaatcttcgtcggagagtgggcaccgaccttcttcgctctgggcctcgccctctccacctacgagtagagactgcgcctcgcccgggacgccccgccgatttccccttgaaggccgcggccggagggggcacctgtgctgtacggcatcgtgttctcgcctgacgagcagggcaggcgttccacatgcaccctcccagctgccagaccgtgcggaccgcgtccgccgacggcgagtggcaacgatgcggccgggagcgtagccgtgccgggcgttgacctcgacatggacccggtcgggagacttgaagcggagaatggccggctcaggcaagcgatcaggaaccgcccggagatcgacctggcccgcagcctcctgatggcatgcttcaaaaacgcaggtcaagagcctgccgcagccatccagtgccatgatccgtactggttggtgccaaccccctgagcggtcacacgaagaagggggaactctcgtggtacgtacagtctccaacgatcttcagggcctgcgaccggctcgctggtactggttgatcaccgtcgtcatcgtcattcttgttgcatccgttccctgggcgggagggcccgtggcagtcgctgcactgggccttctgacggctgcgctcactctggccatgcgggtccggccgaaggacagcggccagcggttggcggaccccggcgcagtctcgtaaccggtgggcgctggggcgcagcggcgcctcggctgcgctgcgggcgaccctggagacatgaggcgccaggagcaggacgcccgcggcgccgtgcccgcgcagggcacggcgccgcaaaggggccacggcggccggggaccgggcacctcgcccgcctcgacctctccctcaccgcatgacgcgaagtaggtgcagctctctcgaagggattggctgatccgggaggttgccggtcggaccgcagggccgggccgatcgcgtcagcgtgatcgagggcgcccgctggcatcaagggcggatggggccgacgcccctgaccggccctcgcggcaaggtctgcaccggtgccccgactccgtgcagcagggtgtccaccacacgtgcggccagctggtcgacggcgccgatatcgacggcctcccgtccttcttcggccgcctcgtggatcagggcgtagtagacccggcgggcccactccaggtcggtgtccgcagacagtaggccggcctcctgcgcgcggcggaagagctgatcgcactgggccaggacgtcggcgtgcactcgcgctgtctccgggtcggacggagcggtccggctcatcgcgaagctccagccgatcttcacctgaaggacgttggcggtcacctggtgcagggcaaccagcggcggggaggtgagtgggcgggcggcctccacggcctggtggaaccgctcggtcgcccaggcagccagcgcctcgaccaatgcctcgcgggtggcgaagcgtcggtgcacggtggtgcgggccaccccggcctccgctgcgatctgttccatggtcgctgccgggtcggcggccagcacgcgttcggccgcctccaggatcgtccgcaccgtccgctccgcatcggcgcgtagcgcgcgccccctcgtctccatggaccagacagtacaccggggtaaccaatcacggactagttgcgtcattgatgttgcaactactagctttactgcgtcgtttaagtcgcgactggttccttgccatgacaggagtgcatccatggatctgcagctgacgaacaccaccgccgtggtcaccggcgcgagccgcggcatcggactggccaccgtccaagcgctcaccgccgaaggcgttcgcgtggtagccgccgcccgcaccatcacctcggagctgaaggcaaccggcgtcctggccataccggtggacctgctggcccccgacgcccctgcccagctgatcgaccgcgccaccaccgaactcggcgacctcgacctgctcgtcaacaacgtcggcggcggcgacagcggagagggccaaaccggcggcttcctctccttcaccgaccagcagtggcagcagtccctcgacctgaacttcctggccgccgtgcggaccagccgggcggcgctgcccagcctgctgcgccgccgcggggcgctggtcaacgtctcctccaacggcgcccgaatgccgcatgccgggcccgtcacctacaccaccgcgaaggccgcgctgaccgccttcggcaaggcactcgcggaggagttcggaccgcagggcgtgcgcatcaacaccatctcgccgggcccggtgcgcaccgcgatgtgggagagcccggatggctacggcgcggagctggcccgctccatgggggtcacccaggagcagctgctggctcagatcccggccgcgatgggcatgaccaccggccgcctgctggaaccgtccgaggtcgctacagccgtcgcctacctcgcctcgccgctggcagccagcatgtccggcacagacctgctgattgacggtggatctgtcaagaccgtctgacgcaacgtccaggacgtagcccggcccgcggcttcccagctcaagcaggccccttcaggcgggctacacccacctcaattggccagcaggatcggtgacacggttcttgaaggcacccggcatgcctgaatcgccgctcaacagggccgaggacgccaagcaccgcggggacctggaagggcacgtggacgccttggtcagcgggcacggcgccttgaccggtgcgccgtggtacccggcgcgggccggtgaccgcctggggtcacctacgcggccaccgaccgcgatccgcgctggaccgagacgtacgaggtccgggacgccggggacaccggcggccgggtgctgcgcccccggcgttgttctggcgaaagttcggagcgcccgcattcagctcggcagccactgcggttccaccgcgctcacgcgccacgaactgcggctttacgggggagtggggcagggtgccgggtgcgccggtgcacccccgcccatcaggcactttcggtgttcagtcaattacgcagggaaaccggaagtgcaagtggaggataggcctccagccatcgaactgcgcggtttcgcctctccggccgaggtgttgagcacgtgtgctgtgctgcgggacacggccgggcaaggcgccgccgggaaggaagaacgacatggcgaatgagaaccggcaggtactgctgaagaagcagctcacgttcaagttcgacgcgaacaggaaggcacagacgcagaagcaggaacagcaggtcagcttctcccgcggcctggactcggtggcggccgtggtcagcggcttcgacgttcgctaccccgccccggaacgcgaagacttcgggcggctgtacgtccgggccaacgcggtccttgcagaccgcggcgacgaggatgtgacggtgagctgtgagttcgagctgagcccgaacatcgacggctacccgggcatgggcgaggtctacgtcaccgtactcggtgtctgagggcggcatccgctgaccgcaggaaacggtgcccccgctgctcggcgcgggggcgccgtccggcccgacgcaccacgggctccggagggtcggcagctgttggatggtccgacagcgccgcgtagaccaccggtggcgccatctcgacgttcacccaagtcacgtcccgtcgcccttcccgggcgccgcgccggtaccggaccatccgccaggggatcacggccccgtgactacagccaggcggtgcccgtcgtcgtcaccaaggcgaccacgggcccgggtgcgcagggctgcacccgcagcagacctgggtaggtgggacaggcgggttcggagggtgtgtcgtcagggccgccgccggaaccagccgcggctccggcccggctcctggtcgtcctccggccccggtggcctggaggatttcgcgccggaggcgtgaaatccggtgccggaggcgccatttccgcccagtacggcatcgtggcgccgtcacggcactcacctgaaagagggggcgcagcagcggctgctgcgccccctctttca

SEQ ID NO: 278 - DNA, 15585 bp, Unknown
  Kingdom: Bacteria, Phylum: Actinobacteria, Class: Actinobacteria, Order: Streptomycetales, Family: Streptomycetaceae, Genus: Streptomyces
gctcggggccgggacggggagggacgggaccgctcatttcgcggtcagcccgccgtcgacggcgaactcggcgccggtgacgtacgacgaggcgtccgagaccaggtacagcaccagctccgccacctcctcgggccggcccgcccggcccagcggcacgttcggccaggtgcgccgcccgacgtccgctccgagcgcgcccgcgatcatgggggtgtcgaccatgccgggatggacggagttcacccggatgcggtgcggggccaggtccagggcggcggacttggtcagcccgcgcagaccggacttcgtggccccgtaggacgcgtgcccctcgatgccgaccaggccggcggtggaggagatgttgacgatcgacccgccggcgccgctctcgcgcatggccggcacgacggcctggatacccaggaacggcccgacgaggttcacgtccagcaggcgccgcaggttgtcctcggtgtcctcctcgaccggggcggtacgccacagcgccgcgttgttgaccagcgcgtcgatccgcccgaaggcgtctcgagtcgcccggacgacgcggtgccaggcggccgcgtcgctcacgtcatgggcgacgaacagcccctggccgcccagctccttcgcgaccgaacggccctcctcctcccgtacgtccgtgatcacgacccgtgcgccttcgcgcgcgaacagccgtgcctctgccgctccttgaccgcgtccagcgccggtgacgacgacggccttgccctccagccgccccgtcatgccgccgtacccttctccagggcacggaagtgcgggatgaccttctcaccccactggcggatggtctccaggcacgcctcctggggcacggtgcccatctggaccaggcacatgacctcgtccacgccgatctggcgcagctggtcgacgtaggcgatggcggtctccgcggtgccgtacgcgtgcttggcgttgaactggcccgtgtcggccgggcggacggggacgttcgcctcgtgcagcttggcgaccagggcgtcgcggtcccgctccatggcggccacgtggtcctcgccctcgtcgtacccggtgggcgcgggcccgttgccgtaccagtgggcgatggactcggcgaagaaccgctgcccgcgggtgccgatccggtacgcccgctccgcgtcgtccagcacgatcgtcgggcacagtgcggagaagtggttgttgacctcggtggagacgaaccggtccccgccgcgggtggcgactgcctcgtcgtagatcttgcgcatctcgcggatgtcgtcggcgccggcgaagcccagcaccagcgcgccgatgcccagttcggcggcgagcttgagggtgtcgtgcttgctgcaggccatgaacagcggcgggtgcggggcctgcacggggcggggcaggatcgcccccgggccgatgtcgatcgacccgtgccactcgaactgatcctcgcgccaggcgctgctgaagatccgcagcgcctcctccatctgcgggtaggtgtcctcgggccggaccccgtacatggacatctcctgcttcgtggcaccgcggccggcgccgatgtcgacccggccgccggagaggacgtccagcatggcggcgcgctcggcgacccgtaccgggtgctggtagccgaagggcatggtgaccacgccgtggccgatgcggatgcgggacgtcttcgccgcgacccaggtgaggaacacctcggacgcgctcatgtgcgcgtactgcgtcagcgcgtggtgctcgaccgcccagacccggtcgaagcccatctcctccgccagcacggcctgttcgacgcagtcatggatgacctggcgctcccgctcgggggtcgggtccgcgatctgcgcctcgaagatcatcgaaaacttcacggcgactcctcctcgctgtttccgttcgctattcctgttcgatatatgcctagcagtaatacatcgggaggagggggagtgcacagcgtccgatcccgctcagcgggaggaccgggttccggcgccgggcacggcggccgtacggttctcgcaccgtggacgcggggacagaccggacaggggagtgtgcatgacggacctccggggcagaacggtgatcatcaccggcggagcgcgcggactgggcgccgaggccgcccgcgcggccgtcgaggccggcgcccgcgtcgtgctcaccgacgtgctgggggacgagggccgcgacaccgccgccgaactcggtgacgtcgcccggttcgtcccgcacgacgtcacctccgaggcggagtggcggcgggtggcgcagtacacggtcgacgagttcggcacggtcgacggactcgtcaacaacgcggggatctcaggcggttcgcatctgctcgaagagcagtcggtcgacgacttccgccgggtcctggacatcgacctcaccggcgtcttcatcggcatgcgcaccgtgatcccgctgatgaaggagcagggcgcgggcggctcgatcgtcaacgtctcctcggcggcaggtctgatggggctggccctgaccgccggctacggagccgcgaagtggggcgtgcgcggactgaccaaggtcgccgccgtcgaactggccgcggcacggatccgcgtcaactccgtccaccccggcatgatctacaccccgatgaccgcccacgtcggcatcgagcagggcgaggggaagtacccgcacacccccatggggcgggtcggtgagcccccggagatcgcggcggccgtcgccttcctgctgtcggacgccgcctcgtacatcaccggcgccgaactcgccgtcgacgggggatggaccacggggccgacgctgcggcagcccgccgcagggtgacgtgtgcgcggcggccgggtccgctgggcggcgcgaggagctacatcaccgcgtcggtctccaacgggcctgcggtgatgcggagttcacggacgcggaccggctcctcgtcggcgaggtagaagatgtgcatgaacggagcgcgcaccacgcggtccggatcgctcttcctggccatggtcgcctctccccgcagcaggcggacaccgtcgcccgcggtccagaactccaggacctcatgcgtgatgtccagcggctcgtcgatcttgacgaagaaggccttgatggcctcgacgccgtggatgtgggcggtgccgaagaacatgtcggtgtcctcggtcagcggcgcgaagccctcctcgaactccagtgagtcgatggcgtccatgaacttcaggacccattcgggcacactcgctgcgcgtgcagtgttcgccatcaccatcgcctctcgacaccgcctttcgaacgagccgccgtccaccgtaacgcgaggctccgaaatggatccgcggcggcgcctggaaggacgtgcgcaaggcgttccggtccgcggccggctgcacgcggtaccgccgcacgaacaccacagaggcaaccgcggcaacgcgcaggccgcgtacaaggccgtcaagaagaagggctacgactggctcggcgacacctgcgcatcgccgggaccgaacagcgcaccgttcaccggtggccgccccggagctcacaccgcggccgccgggtagcgcacgaagaggatgccgtgcgcgtcgccgtgcggggcgctgtagaggtgcgtcgtgtcggcaggccagcacaccgatgtgcccggcccgacgctggtcggcgcgtccagggtccccacgacggccgtgccgctgaggatcatcaggctctccgtcgtcccggcgacgtgcgcggcggactcctgcgtggcaccggcggcgatggtgatccggaagacgtcggtgaccgcctcggcgtcctcgtgccgctcgatcaggaccgccgtgaccgcactgccggcgacggcgctctcctgtcgtcgggcgcccggcggcaggtcgtcgctgagtaccgcactgagcggccggttgagtgcggtggtcagcgcgtagagggtctcgagcgtggggttgcgggtgccgctctccagctccgagagcgtgcccttgcccacaccggagcgccgcgccagctccgagagcgtcaggccccgggcagtgcgcagctcccggagcctgcgtcccacttcgtcgttcagccccatcgccggatcgcgctcccgctctcgtcgcccgtggttgacgggtctcggccctcctgcctagtgttccacaaacagaacgttccgtttacggaacgctcgcgggccgctcctgccgagcgcccgccgcacgtcgccgtcccgcgtcccgcctcggaagttgccctctatgtcctccttcaccgcccgcatacgcgcggccgccccgccgtcggccgtggccgccggcctgatcgccgtcaccgtcggcgtcaccagttcggccgcgctcgtgttcaccgcggcgaaggcggcgggggccggcccccgggagatcggctcctggatgctcgcgctcggcgtcggactgtccctcacctgcataggcctctcgctgcggcatcgcgcccccgtcgtcaccgcgtggtccacacccggcgcggccctgctcgcgaccagcctcaccggggtcccgatggggcgggccgtcggcgcgttcgtcttctcggccctgctcgtcctcatcaccggcctgaccggatggttcgcccgcgccatggaccgcatccccgtaccgctcgcctcggccctgctcgccggagtgctgctgcggttcggcaccggtctgttcagcacgatgcacgacagcttcgcgatcgccttccccgtcttcgtgctctacgtcctggcgcgccgcatcgctccacggtacgcggtgctgctcgccctggccggtggcgtcctcgcctcggtcctcaccggaggatggcgcctggacaagctgcgggtctcgctcgccgcaccggtcttcgtcgcgccggacttcgactggaaggtcctgatcagcgtcggggtgccgctcttcgtggtcacgatggcctcacagaacctgcccggagtcgccgtgctccgcgcctcgggctacagcgtgcccgtgtcgccgctgatgacgtggaccggagcggtcaacgtcctgctcgccccgttcggcgcgttcggcctgaacctcgccgccatcaccgccgccatctgcaccggcgaggaggcgcaccccgaccggaacaagcgctacacggcagccgtgtgggccggggtcttctacctctgcgtcggcgtgttcggcgccaccgtggcctccctgctcaccgccatgccgcaggccctggtgctcgccacggcgggcgtcggtctgctggccaccatcgaaagctccctgacgacggccctgtccgacaagggctcccgggaggccgcggtcgtcacgttcctcgccaccgcgtccggtgtcacgctcctgggcatcggctccgccttctggggcctgctcgccggcgccctcaccgccgtcatcgcgaacgtcggacgacgcggcagagggacgccggcggcaccgacgtccgcgtccctgacgccacccgcacggagccgcccggcggacgctccctcgccgtacagcgcgccgtaaaaacgtgccgtaagacgtcagcggttgaccgcccgcatccccgcctcgtcgtaccggtcgcccgccgcctgcggcagctccgcgtcgatacggtcgaggtcctccttggtcagctcgatgtcgaccgcggcggcgttctgctccaggtaggtgcgccgcttggtgcccgggatcggcaccaggtcctcgccccgcgccagcacccaggcgatcgcgagctgggccggggtgacgtccttctcggcggcgatctccttgaccttcgccgccagccgcaggttcgcctgcaggttggcgtccgtgaagcgggggttgtggcggcggaagtcgttctcgtccagctcgtccggtgagctgaagcggcccgccaggaagccgcggcccagcggcgagtacggcacgaacccgatgcccagttcccggcaggccggcagcacctcggcctccacgtcccgcgtccacagcgagtactcgctctgcacggcggtgacggggtgcacggcgtgggcccgccggatcgtctccgcgctcgcctcgctcagcccgatgtgccgcaccttgccctcggcgaccaactcgccgagcgcgccgaccgtctcctcgatgggcacgttcgggtcgacccggtgctggtagtacaggtcgatgcggtcggtgcccagtcgctccagcgaaccgtggacggagctgcgcacgtgctcggccgagccgtcctggcggccgacgctgctcatgtcgcccggtacggcgtcgtccatccggtagttgaacttggtggcgatgacgtactcgtcgcgatgacccctgaccgcctcaccgaccagcgactcgttggtgagcggcccgtacatctgggcggtgtcgaggaaggtgatgccgagttcgagggcccggcggatcgtcgcgatgccttcgtcctggtcggtggtgccgtagaaggcggacatccccatgcatccgagcccgatggccgatacctggaggtcccgcagactgcgctcctgcatgacggtcctttcccgcactctcgatcgtcgtacgtccggcacgagggccttcttccatctagcgacggtttccgtcccccggcatcccgtgacaggcgcccccggacggcgctccgcacgccggacgtctgcgacgctacgagttggagtgcgcgcgaagtcaacccgcaccccacgcgcgggaggtactggagaggttccgggcggcccaccgcacatcctgaccgcctgcgggccgcggcgccgagtgggccgagcacgaaggtcagtccttcctcgccgaggcacgtcgaggacatggtcgcggcgctcgccggactggccgcaccgtcgcccaggtccccgtcctcgtcgccatcgcccagggcgacctgtcgaagaagatcgacgtcgacgcatgcggtgtgatcttcgagctgaagacgaccatcaacacggtggccgagaccctctcctcgtcctcctccgaggtcaccgcgtggcccgcgacgccggaggcgagggcccaccgggcggccgggcccgcgtcgagggcgtccacggaacgtggaagcggctgaccaccgacgtcgacgaactcgccctcaacctcaccacccaggtccgcgacctcgtggaggtcgccgacctgatcctgcggcgcgagcccgctgcccggctccccgggccccggacgtgcacgtcgtggcccggccgacgcaccggcacggcgacatcggcaacctcttcgacgaggtcgagccggggcggcatgaacagtgctgggacgcctaccgtcggctggtgcggctgtccgccgtgcgctcctgcgcgtctttcgtcagggcgatggccgccgagatcaccgcgaggtgcgtgagcgcctggggaaagttcccgaggagttcgccactggccgggtcgatctcctccgtgtagagcccgaggtcgttggccctgccggcgaagtcgtcgaacagtcgagtggcttcctcggtgcgtccggtgcggtgcagcgcttcgatgagccacccggagcaggccaggaaggcgccctccttgtcctgctgtccgctgtagcggtacaacaggcagccacccgccccgagttcggcgcggaccgcctggatcgtgctgtacaggcgcgggtcgtcgccgggggagaagccggtgcgtgcggcgagcagggcggtggcgtccaggtcgtccgtgccggcgtagaaggtgtaggactgtttggcgtccgaccagcagtgctggttgatccatttgcgcaccgcgtcgcgctccaggcgccagtgctctacatgagggctggtcaggcagccggtggacgccagtcggacggctctgtccagtgccgtccagcagctgagtctggaactggtgtactgccgtggttcgcccagttcccaaaagcccgcgtcgggtgattgccacaggtcgcagacacggtctgccatgccgctgagcatggtgttcgtggcctcatcgagatgaccgcgctgccggcagtagtgccagacggcgtcgaaaaggtctccgtaggcgccgagctgcgtctggttggcggccgcgttgcccacgttgaccggggtggaacctcggtaaccgggcgctgcggagacctgttccatgccgccggacaccggccggccgctgatggcgtacagcggccgcagggccggagcctcctgggcgaccgcgtccaggagccaggagacccccgcgtgcagttcctccgccaggccgagctgggacagggcgtccagagcgaaggagccgtcacggacccaggcgaagcggtagtcgaaattgcgcttagccccgatcttctccggcagcgaggtggtggccgcccccgcgatggccccggtgacccgcgaggtcagcgccttcagcgtcagggcgctgcgcaggaccagatcccgtcgccgcccctcgtggcgtacggtgtctgcccactgccgccacgccgcgacggtgcgctccacgcggaggaggatctcgtcgggccgggggacgtgcagtggttcggcgtccaccgcgaccagggcgagcagagcggtggcgccggcctgcggcgctgccgtgccgtggacggtcccgccgtcgcagtcgggctcgcccagcccttccgtcacgacggcgagctgctggtcaccgaccgtcagcaggggaaggccccgctcggtgcgggcccggggcctgctgccctcggacaggcggtagccggggcgtacgctccaggccatgggcacccggccggactccacggtgacgacgcgggccagttccgtccacggcagctgaccgagtgctcccaggttcagggcgtcggtgacccgggccactccttcgcgcgtgatgtaggtggtctccaacaccatggtgccgtccaggtagcggcggctgacctcgtagggcaccgtgggcgccagcgtcacacagccgccgccgtcggggtcgaggagcgcggcgcagaccggtggggcgtccagggcgggcacggcgagccagtcgactgccccgtcccgggcgaccagggcggtggcgcggagatcgccgagcatcgcgtagtcgcgcagcggagcgaagccttctgttctggttgaggtcacgcatcttccgctaccccgatgaacggcgagcgggcactcacggcctcgctcgtcgtgaactcggcccatgggattcacaccgtcgcccggtgatccgtttgcccatgccccggtcgcgggtaacccgggagctccggcggcgatcaggcagccggcaccccgcagctaggagacggatcactcatgccgagcaggacagggcgaaaagtcgccgtggtgaccggcggaaccgccggagtgggccgtgccacggtgcgcgagttcgccgcccgcggctacgacgtggccgtgctcgcccgggggcaggcgggcctggacggcgcggtgggagacgtcgaggaggccggaggcacggggctgggcatccccaccgacgtggccgaccacgaggcggtgcgcgaggccgccgaacgggtcgagcgggagctcggtgagatcgatgtgtgggtcaacgtggccttcgccggttccctcgccttcttctgggacacctcgcccgaggagtacgagcgcatgacccaggtcacctatctgggtcaggtcaacggcacccgcgccgcactcgagcacatgcggcgtcgtgaccggggcgtcatcgtcaacgtcggctcggccatggcctaccgctccatccccctccagtccgcctactgcggggccaaacacgccgtcaaggggttcaccgagtcggtgatgacggagctgatccacgagcggagcaaggtcaagctctgcatgatccaactgcccggtctcaacaccccgcagttcaactggaacctcagccggatgccgaagcaccccatgcccgtcccgcccgtcttccagcccgagctccccgccaagggcatcgtcttcctcgccgagcacccccgccgcaacatgtgggtcggcgtctccaccgcctacaccgtcctgggtgaacgcctggcccccaagctcctcgacctgtatctcggacgcaagggcgtcaccagccagcagaccggtgcggacgccccgcgctgggagccgaacctcgaccagccctccgacgcccgggccgaccgcggcgcccacggcgcgttcgacagccaggcacacgcacacgacccggtgctgtggatgtcacagcgacgcggcagcctgctgtgcgccctcaccgccgccgctgccctcggtctgactgccgccgccatccggaaccggcggtaacccggcgaacaaggaacggacggccggctggacggccggccgcgcgggcggtggagcggatgaacaggcgggcaggcggaccggcgagtgccggccgctcccgccacccgaacggcgcccccgcccctggccgggggtgcgcacggccgcggcttgaggttgcctggcagcaccacccttgaacagcgggagaactccatgaccaaagtcgccgactacgtgctccagcgcctgacgcagtggggcgtggggcgggtgtacgggtatccgggtgacgggatcaacgggctgctcggcgccttcgaccgggcgcagggcgagccggagttcatccaggtcaggcacgaggaaatggccgcgttcatggcgtgtgcgcacgccaagttcaccggcgaggtcggctgctgcaccgccacctcggggccgggcgcggtgcacctgctcaacgggctgtacgacgccgcgctggaccaccagccggtggtggccgtgatcggtcagcagaagcggctgagcctgggcgcccactaccagcaggagatccacctggaccggctgttcgccgacgtctcggagtactgccagatcgtcatgcaccccggccaggcccggcacgtcatcgaccgggccttcaagacggccctgaccacgcgcggtgtcgccacggtcatcatccccgaggacgtccaggagtcggacgccgtgccctcgccgccgaagatgcacggctcggtcttctccagcgtcggctggagccgcccccgggtcctgcccgaccccggggaactgcgcaaggcggcggacatcctgaacgccggttccaaggtcgcgatgctcatcggccagggcgcggcggaggccgagagcgaggtcgtcgaggccgccgaactgctcggtgccggcgtagccaaggccctgctgggacgagaagtcctccccgacgacctgccgttcgtcaccggcccgatcggcctgctcggcaccaaggccagcgacaacatgatccaggaatgcgacaccctgttcatgatcggcagcagcttcccgtactccgagtggctgcccgacgagggccaggcccgaggcgtcgagatcgacatcgacggccggatgatcggcatcaggtacccgatggacgcccacctcgtcggcgactccaaggagacgctcaaggccctgctgccgctgctcgagcacaagaaggaccgcaagtggcggcagaagatcgagaaggacgtccgggagtggaacgcgctctgcgacgaccgggcgagccagcacttcggcggaaagatcaaccccgaggcggtggcgagcgagctctcgccgcggctgccggacggtgccatcctgaccgccgactccggctcggggaccaactggtgggcgcgtcacctgaaactgcgcaagggcatgcgcgcctcgctgtccggcaccctcgccaccatgggtccgggcaccccgtacgcgatcgcggcccggttcgcctaccccgaccggcccgtcatcgccttcgtcggggacggggcgttccagatgaacggcatgaacgagatgatcaccgtcaagcgctacctggaccggctctccggatccacgccgttcatcttctgcgtcttcaacaaccaggacctcaaccaggtcacgtgggaacagcgcgccatggccggtgacccgaagttccccggctcccagcacatccctgacgtgccctacgcccagtacgccgaactcctcggcctgaagggcatctactgcgacaagcccaagaaggtcggtgaggcctgggacgaggccctggcctgtgaccggcccgtcgtcctggagttcaaggtggacgacgagatcgcccccatcccgccgcacatcatgaagagccaggccaagaaggccgccaaggccgccgtgcgcgaccccgagcggaccggcatcgtcgccaagggcgcccggcagaagctcaccgaactcgcggaacacctgccgggccgccacggatgaccgaaccggtccggaccggaaatccgaccggacccgacaacaggagcgcacccggtatccggaccggccccgggcgaccggaccgcgactccccagggacgcaagcctcgttaaggagagacacacccgatggcgaaggcgacacgccgcacggccacccgtgacatcccggccaagacacatccggagatcgcgggcccgccgcgcgcccggcagaccctcgacgtcggcaaactggagcgggccctgcgcaaggcggtcgagggcgaggtccgcttcgaccccggctcgctgggcctgtacgcccaggacgcctcgaacttccgccaggtcccgatcggcgtcgtcgtgcccagaaccctggacgacgtcgtcgccgtacacaaggtctgccaccgcttcggcgccccgatcctcaaccgcggcggcggcaccagcctttccggggagaccgtcaacgaggccgtcgtcatcgaccactccaagtacctgacccgcatcggcgagatcgacaccgaacaccgcctggtcacgtgcgaaccgggcgtgatcaacgaagaactgaaccgccacaccggcaagcacgacctggtgttcgggcccgacccctcctcccactcccgctgcgtcatcggcggcaacatcggcaacaactcctgcggcatccactccgtgcagtcgcagctgtacggccccggcccccgcaccagcgacaacgtgcacgccctggagatcgtcacctacgacggcgcgcgtttctgggtcggcgtggacgaggaggaacacctcgacgacatcatcgccgccggtggccgcaagggcgagatctacgcggccctgcgcgacctgcgcgacaagtacgccgacgccatccgggccggcttccactcggcggaggaggtgccgcgccgcgtctccggctacaacctcgacgaactcctgcccgagcgcggcttcaacgtcgcccgcgccctggtcggcaccgagagcacctgcgccaccgccctgcaggcagtcctcatgctcacccccgcgctgctgcagcgcaccaccgtcgtcgtggagtacgacgacctcgccgaggccgccacccactgcacggagatcatcgagaagttccggccgatcggcctggaggggctggaccaccagctcatcgaggaccagcagctgaagaacatgaacgtcgaggacatccaggaactcccgcatcccgagggcggcgcctggctcgtcgtgcagttcggcgcggacaccaccgcggagtccgtcgcccaggccgaccgcttccgtgactggctgaccggcgagaaggactacgcccccgaccggatccgcgtcgccaagagcaagcaggagggcgggaccagcgagcacctgtgggccatccgcgagagcggcctcggctccaccgccttcccgcccgacggcaaggaccactggcccggctgggaggactccgcggtcccaccgtcccgggtcggcgcgtacgtgcgcgaactgcgcaaggtcatggaccggcacggcatcaccggtgccatgtacggacacttcggccagggctgcatccactgcaggctcagcttcgacctgcgcaccgccgacggcctggcgacctaccgggcgttcatggaggacgccgccgacctggccgtctccatgggcggctcggtctccggcgaacacggcgacggccagcagcgagccgaactcctggaaaaacagtacggacccgaactcctcgacgccatgcggcagttcaaggcgatctgggacccgcagcagaagatgaacccgggcaaggtcgtcgacccctaccggatggacgagaacctcaagctgggcacggactacaacccgccccggccggcgaccaagttcgcctaccagcaggacggcggcgacttcgcgcacgccacgctgcgctgcgtcggcgtcggcaagtgccgcgtcccgcaggccgagaacacgatgtgccccagcttccaggtgacccgggaggagaagcacaccacccggggcagggcccgcctgctgtacgagatgctcaagggcgacgtcatcaccgacggctggcagtccgaggaggtcaaggacgccctcgacctctgcctggcctgcaaaggatgcaccaacgactgcccggtcagcgtcgacatgcccacctacaaagcggagttcctctaccaccactacaagtcaccgagccgccgccgtccccgccacgcctacgccttcggcttcatcgaccaggccgcccgtatcgcctcgcgcatgcccgcgctcgtcaacctcaccactcagacacccggcctgtcgcacctggccaagtgggcggcgggcatcgaccgccgccgccccctgccacggttcgcgccgatgaccctccaggagtggttcgcccggcgcggaggcaccaccaacccgggcggacgccccgtcgtcctgttccccgacaccttcaacaaccacctgcacaccggcgtcggagtggcctgcgtggaggcgatcgaagcggcgggctggcgggtgatcatgcccgagggacacatctgctgcggccggccactgtacgactacggcttcctggacaccgccgaacgctacctccagcacgtactcgacgtcctgcggccctacgtccgggagggcacaccgatcgtcggcatggaacccagctgcctcgccgtcttcaaggacgaactcccagggctgctgccccacgacgacgacgccaagcggctcacccggaacgcctaccacttcgccgagttcttccagaccttcggcatcgaaccaccccggctccgcggcaaggccctgctgtgggggcactgccaccagcgcgccaccgggggcatggacgccgaccaggaactcctggagaagatgggcctggaggtgagcaacctcaagggcggctgctgcggcctcgccggatcctggggattcgagtccggcaagtaccggatctccatggactgcggcgagcaggccctgctcccggcggtccgcgacgccgacgacgactgcctgatcgtcgccgacggcttctcctgcaagacccagatcaaggacgcaggcaccggccgcggcgccctccacctcgccgaggtgatgaagctggcgcgcgagggcacccacgcggtgagcggaacaccaaaaccgcccgagcgcggcgcggcgtccccgccgcgcccgccgctgcac

SEQ ID NO: 279 - DNA, 8347 bp, Unknown
  Kingdom: Bacteria, Phylum: Actinobacteria, Class: Actinobacteria, Order: Streptomycetales, Family: Streptomycetaceae, Genus: Streptomyces
gccgagcacctcgtgccacacctgggcgacgctgcgcgccacctcgtcgtcgggccagtcgtcggccgcgaaggcttcggcgcggacgacgacttcttcgcactcggcggcaactcgctgttcgccatccagatcgtcgcccggctccgcgagctgcacggcgatctgcccatgaacgtcatcttcgaggcggcgacggtgtccggcgtcgccgcggccatccgcgcgcagcaggccgagagcctcgacgacgacgaactcgaggcgctgctgcgcgaggtggaagccctgtcggccgacgaagccgcggaccagttgggggaggaccatgtctgacatcgccgacaccaagcgcgacctgcggcaacgggtggagtcactgagcgcgcgacagcgcgaactgctggagcgcagactccaggagaagcgccgcaccctgccgtggctgtcccggccggaagcggcggccggaagcgcgaccgcccgtcccgcgcgcgcccgccgcacccggcggcccaccagccgcatggacttcagcctgttcttcttctccagcgacggctcgatcgagggcccgggcaagtaccggatgctgctggactgcgcccgctacgccgacacccacggatacgacggcatctgggtccccgagcgccacttcgtcgacttcggcggcctctacccgaacccgtcgctgctggccgcggcgatcgccgcggtgaccgagcggctgccgatccgggccggcagcgtggtcgtgcccctgcaccaccccatccgcatcgccgaggagtggtcggtggtggacaacctctcgggaggccgggtctccgtctcctgcgcctccggctggcatccggacgacttcgtcctcgcccccgacccgagcccggagcgctatacgcagcgccgcgccgagatgttcgaccagatcgagctggtgcggcggctgtggcggggcgaggccgtgccgatgcgccggcccgacggcgagacggtgcacctgcgctccatgccgcgccccctccagcccgaacttcccgtgtggatctcgtcgtcggggaacgtggagacgttcatccaggccgggaaggccggggcgcacgtcctcaccgggcttgtcgcgcagcaactgccggagctcggcgagaagatcgccgcctaccgcgccgcgctgcgcgacagcggccacgacccggagcgcggcaaggtcggcgccatggtccacacgttcgtgggcacctccgacgacgaggtgcgcgatctggtccgccgcccgctcatcagctacctcaccacgttcctggcgcagcaggagagcttcggcagtacgtactcccagatggacgcggcggaacgggaggccatgctgaacgtcatgttcgaccgctacttcgacaccattgcgctgctgggcacgcccgacaagtgcgagaccctgatcgaggacctggtcgacatcggcgtcgacgaggtggcctgtctcgtcgacttcggcgtggacgacgaccgggtgcgcgacagcctggaccacctcaccgaactcaagcgccgctacgccggtccgcaaggtgacgtgctgtgaccgacatggcggaacgcctcgcgaaactgacgccccaacagcgggcgttgctcgaccggcgactgcgggagcgcggcggcgccgtcccgaccgaactgccgatctccccgcgcggccacgaccggccgagtccctgcacggtcgaccaggagcggatctggctcatccaccagttcgacccgagtgaccccgtctacaacgtcctcttcggctggcggctgcacggccccctgcgcctggacgtgctgcggcgggcgatcgccgcgctggtgcgccgccacgaggcgctgcgcacgacgttccgcctcgacggactgcgaccggtgcaggtggtgcacgccgatctgccgtacgagttccgcgagttcgacctgaccggcctgccgcccgccgagcgcgaggcgcggatgtgggagctcggcaacgccgaggtgcggcgcccgttcgacatcgtggccggcccgctggtgcggatctccgtgatccacctcgccgacgacgagacggtcatggtcggcacgatcgaccacctcgtctgggaccggcgctcgttgggcatcttcggcgccgaggtggccgagttctacaccgcggagatcaccggccgcgacccggtccttcccgaactccccctccagtacgccgactacgccgagtggcagccgcaatcggtcgaggagcgggtgaagcggcgtgaggtcccgtactggcgcgagcggctcgccggctcgtcgctcgtgctggagctcccggcggacaagccccggcccccggtacagacgttcaccggagcccggtacgagttccacctcaccaccgacctcacgcaagctgttcgtgagttggctgtccgtgagggcaacaccgtctacgtcgtcatgctggccgcctggcaactgctcctgcaccgcctcaccgggcaggaggacatcgtcgtgggcaccacctcctcgacacgcagccggtccgaggtggagaacctcatcggctacttcctgacgatgctgccgctgcgcaccgccatccggccggagatgacgttccgggagctgctgcgcgccgtgcggcggacggtggtggacgccttcgaccacaaggacatcccgttcgggacgctgctcgacgagctcgacgtggagcgcgacccgagccgcaaccccgtctaccagacgtcattcatgttcgtcgacttccacgaggagcccgtgcggctcgccggcctgcggctcgaagcgctcatcttcgacaaccacacggcgaaggacgagtgcatgctctgcgtcttcgacgacgaggtgctggccgaccacctcttcgggctgttcgagtacaacaccgacctgttcaccgaagagaccgtcgcccgcatggcccactacctgcgccggctcctcgaacagggcgtggccgacccggacgtgccgatcggccgcctctcgctggccgacgacgccgacctggccacgatgctgacggagtggaaccgcacggacgcgccccggcagcccgggctcaccctcgactcgctggtccgccaccaggccgcggcgactccggacagggtcgcggtgtcgagcggcgacgaccggctcacgtacgccgaactcgtgcggcgcgccgccgaactggccgccttcctgcgcgaccggggcgcgggaccggaacgcgtcgtggccgtctgcctggagcgctcctgcgacctgatggtcggcctgctcggcgtactgatgtcgggcgcggcctacctgcccctcgacccgggccttccgccgctgcgactggccgagatgagcgccgacgccggcgcggccgtcctgctgacggaggcggccctgcgccccgccctggcacagtgcgccggggacgtggtctgtgtggacctcgaccgggacgccatcgcggcgagcgagccgttcgcggcggacgcgacggacgcgacggacgcgacggacgcgacggacggggaactggccgacgagcgcctcgcgtacgtcatctacacgtccgggtccaccgggcgccccaagggcgtcgaggtctcccaccgcgccctggtgaacctgctcctcggcatgggcgacgagatcggcgtggcgaccgacgacgtcctcgccgccgtcacctccgtctccttcgacatcgccggcctggagctctacacgccgctggtgcgcggcgccgaggtcgtcatcgtgccgcgggccgtggcccaggacgggggcgccctgcgcggcctgctcgccgaccgcggcgtcacggtcatgcaggcgacccccgcgacctggcacctgctgacggagacgggctggcgcaacaccggcggcctgcgcgtcctggtcggcggcgaggccctgcccccgggcctggcccgcatcctcgcggacggccccgccccggtgtggaacgtgtacggcccgaccgagaccaccatctggtcgacgagctggcccgtcgagccgggaaccgacgaggtctccatcggccgcccgatcgccaacacccgcctgtacgtcctggacgagcacctcgacccggtgcccgccggggtccccggcgagctgtacatcggcggcgccggagtggcgcgcggctaccgcgcccggccggggctcaccgccgaacggttcgtgcccgaccacctgggcggtcgccccggcgcccggatgtaccgcaccggcgaccgggtccgctaccgtcccgacggcacgctcgtctacctgggccgggacgacggccaggtcaaactgcgcggctaccggatcgaactcggcgagatcgagacgcgcctcgccgagcacccgggcgtgacccgcgccgtcgccatggtgcgcgaggaccggcccggcgaccgccgtctggtcgcgtacgtacaggtccgcaccgatgccccgcggccggatcagctgcgcgaccacgtgcgcacccacctgcccgactacatggttccggccgccgtcgtcccggtcgccggcttcccgctcaccaccagcggcaaggtcgaccgcaaggcgctgcccgcgcccgccgtcgagcgcgacagcgccgccttcgtcgcaccccgcgacccggtggagctggccgtggccgcggtctgggaggaggttctcggcacccggccggtcggcctgcacgaccggttcttcgacctcggtggccactcgctcctggtgctcaagctgatgacggagatcgagcggcggttcggccggaagctgccggtcgccgcgatcttccagggcgcgaccgtcgagcgcttcgcccagctgctgcgggagggctaccgcccccaggaggaggcgcacctcgtcgagatcagggccgcaggcgccggccgcccgatcttcttcgcgcaccccgcgggcagcgaagtggtctgctacatgccgttcgcgcggctggtcgagcccgccgaccgcccgctgtacgcgatcgcgccgccgccgctgcgcgacggatccctgccgtacgcgacgttcgaggaacgggccgccgcgtacgccgagttgatccgcgccacgcagccgcacggcccgtacacggtcgccggctggtgctacggcgggaccaacgcctacgccgtcgccaaggagttggagagcctgggcgaggagacagagctggtcctcttcgactcgcacccgccggtgtacgtcaccgccgacgaggaaccggaccgcgcggacatcgtggcggcactggcgcagaacctccaatgggactacggcgagggcctgttgacggtcgaccggctgcgcggactcaccgacgaggagcacctcgactacctgctcgacatcgcgcgccgaggcgactacctgccccccgacgccggacgcgagcggatggcccaggtgatcgacctgtggatcgcgaacctgcacctcgtgtggcggtaccggcccgaaccactgaaggcgccctacacgctggtgctcgcgcgcgacgaggatcccgagcagtaccgcaggtgggacgagctcgccgccggcggactcaccgtccgcacggtcgagggcaaccactacacgatgatgcgcgaaccgctggtcaccgcggtcgcggccgtactgaacgagacgaaggacgcaccccgatgaccgccgagacactgcccgcgttcgccgcccagcagcgactgtggttcatggccgagatgcggcccggggacccgttctacaacattcccttcacggtgcggctcgacggtgccctcgaccccgtggcgctgcgccgcgccctgaccgaactggcgcggcgccagcccgcgttgcgcatcgtcctgcgcgcccgtgacggcgtcctggagcaggtcgtcactgcgcccgcccccgtcgtggtggaggacgccgacctcaccgggctgcccgcggcggaggccgaggagcgcgcggacgagctggccgccgagttcaccggccgcggtttcgacctctccgccggaccacccgtacggttcctgctgacccggctgggcgaggcggaccaccggctggtcgggtgcgtccaccacgtcgtcttcgacggcgtctcgctggagctgttcctcaccgaactgaccgccctctacgagacgttcgcgcacggcacggaaccggagccccaggagccggctgactatgccggctacgcccgccgccgcgccgccgccgtggacgacacgtcggcccggttctggaccacgcacctgaccggcgcgccggaggtgatggacctgccgctcgaccgctcccgccccgcggtcacctcgcaccggatggcgtacctgagccgggtgatcgggccaaagaccgccgaccgcctcgccccggtggcccggcggctgcgggccaccgagttcatgctgacgaaggccgcctgcgacgtcctgctgcgccagcacggcgtgccggacccggtgaccgcgctggccctgtccgggcgcgacgacccggcggtggcggggctgatcggctacctggccaggcccgtcgtactgcgcaccgaactctccggcgacccgggcttcgacgaggtgctcgcccgggtgcggggctccgtgctcgacgcgctggaacaccccgacctgccgttcgagacggtcctcggcaacctcggcgtctcgcacgacgccggctactacccctactaccaggtgatgttcggttacgaggaccagatcgcgccacgcagcgcgggcgggctgacgttcagcacgtcgtacctgcccctgccgaccgccaaggtcgagctggacttcgccctgacgcgtacggagcagagcctgcgggtgcggatcggctaccgcgaggacctgttcgacacggtcaccgcggagcggctgctggcccgcctggagacgatcctcggccggatcgccgacgacccgcgacagccggtctcgcggctgatcgcggccaccgacgccgacgtgcgcctggtcctgcacgactggaacgacaccgcgcgcgacgtacccgacctgctcatccaccagctcttcgaacggcaggccgcgcggacccccgacgcggtcgcggcgcgctccgacgaccgggtctggcgctacgacgagctggagtccgccgcgaaccggatcggccacctgttgcgcggcctcggtgtcggccccgaggaccgggtcggcgtgtgcctgccgaggtccctggagatgctcgccacgatgctcggcgtgttcaagtccggtggcgtatgggtgccgttggacccgaccctgccccagcggcggctcgaacagatcatgacggacgccggcctgtcggtgatcgtcgcggcgccgcagtacgcggacctcgtcgccggacatccggcgcgccgcgtggaactcgacgagggcggggcgcgggcactggacggcgtgcccgacgggccggtcgactcgccggtgcggccggccaacgccgcctacatcctcttcacctccgggtcgaccggcggcccgaagggcgtggtcctcgaacaccgcaacctcatcaacctcatcacctgggcccaccgggaactgggcgaggagaccttcgcctcggtgccgctgatcagctcgatgacgttcgacgtctgcatgtgggagatcttcacggcactctcaggcggcgggaccgtcgtcatcgccgaggacgccctcgcgctgccgcgcaccgccgggtccgagaccgccacggtggtcaccgcggtgccgtcgatctggagcgaactgctcaagatgggcggggccccgggctccgcccgcacagtcgtctccaacggcgaggtgctgtccccgtccgtgctgcgcggcctggccgcgcttcccggcgtggagaccgtctacaacatgtacgcccccaccgagaccaccacgttctccctcttcaacatcgtgcacccggacgaaccgatcccgatcggccgcccgatgctcaacacccgcgcctacgtcctggactctttcaagcggcctgtaccgcccggcgtggtgggcgaactgcacctgggcggcgccggggtcacccgcggctacctgaaccggccgggtctgaccgccgaccggttcgtccccgacccgttctcggccgtgggcggcgaacgcctctacgccaccggcgacctcgtgcggcacgccgccgacggccgcatcctctacgtcggccgggtcgaccaccaggtgaagctgcgcggcgcgcggatcgaactgggcgaggtcgaagccgtgatgctcgcccatccggccatcggcgaggcgtgcgccatggtgcgccgcgcaccgggcggcgacgagctggtggc

SEQ ID NO: 280 - DNA, 4288 bp, Unknown
  Kingdom: Bacteria, Phylum: Actinobacteria, Class: Actinobacteria, Order: Streptomycetales, Family: Streptomycetaceae, Genus: Streptomyces
tgctcggtggcacgcgcgcgggtgaggaccggcagggccgcgcggagagacagggtgacggcagggacggtcacctgcgcgaccgtgtcgccgcggggaaggacgaccgtcaggtccgtcaagggcgcctcctcggcaggcggcgcgggcgcggagccgtcgggccgccagaaggcgacccggccggtgcgcgcggggtcggatggcaggaacacggcacagcagtgggcgagttcggggagatcgggcggtgttgccggagagatcctctgcacagcgacgctgattcctcaaatttgactactgggtgaggcgccgagggtacagcaccgtggcgcccgccagggaacggtgcgacagtgatgtgcgacaccgacggcaggggtgttgccagcccccggccgtcacgggggcgctcccccgtcccgccgggaggtggccccccttcgtacccgggtgctgacgccatggtcggcacagggcttcgattcgtacgtttcctcaggtcaggccatttgccgagagaccggagaccccgccatgccacagcctgccgcagccgtcgcggacggtatcgccgagagggccggcgggtcgtccgccggctccagtgaattcgcccccctgctgcgcactgtcaagggccaggaactgctgggacggcgctacggctggtacgcacgggtcatcgcgggcaacgcgctcgccctggccgcggtcgtcgccgggctcttcgtcgtcggggactcctggtgggcgctgctcctggcggtgccgttcgccgtgctcttcgcccgcaccgcgttcatcggccacgacgccgggcacgcgcagatcaccggcgacaaggcggtgagccggatcatcgggctggtgcacggcaacctgctgctcggcctgagcttctcctggtggaacgccaagcacaacaggcaccacgccaaccccaaccacatcgacaaggatccggacgtcgccgccgacgtactggtcttcacgggtgagcaggccggtgtccggcagggcttccgccgctggctcacccgcaaccaggcctggctgttcttcccgctcaccctcctggagggcgtcgccctcaaggtgcacggcttccaggacctgcgccgccagtccccccgggagcgcgcactggagggcacgctcctcgtcgtccacgtggtggcctacacggcgttgctcctggcggtcctgtcacccggcaaggccctggcgttcgccgccgtgcaccaagcgctgttcggactgcacctggggctcgccttcgcacccaaccacaagggcatggagatgcccgacccgaacggagaccggtgggggcacctgcgccgtcaggtgctcacctcccgcaacatccgcggcggcgtcctgacggactggttcctgggcggtctcaactaccagatcgagcaccacctctttcccagcatgccgcgcccgcacctgcggctcgcccagcccctggtgcgtgcccactgccgggaactgggcatcccttatgcggagaccggcctcgtcgactcctaccggcaggcccttcgccacctgtacgaggtgggggaaccgctcagggcggagtagccggggcggccaccggtcggaccgggcggcccgcgtccggggcgacccgtaggggatacacctcagggatctctcaggggcatctcggggacgacttgggggtgcggaccggaaccgccgaagccgcggggccgtttccacgacagagagcggcagtggccgcgaaggaggcgacagatgtcgaagaacgcgaagatcgccgcaggtggtgtggcagccggactgatcctgtggatctggctgccctggtgggccgcggtcctcatagtcctgggcgtcccggccgccgcctacctcgcgctggacccctcccagcgccgtcggctgcgccgggtcacccgcaaggagctcggccgctgaggcacggccgccccggcgagcccggttcagctggggtgtacggccagtctgtcgagggcctggagcagaccgggcagctccggtccccggccgaccggaaggacctcgccgggctcctcgtcgaggaggacgaaggcgatgtcgtcggtccgcgccaccatcgaccatcccggtccgtcggcacgcagggtccgcgcctcgcccggggcgaaggaggagcggacgcggcccagcggcggaggcgattccacgtacgcatgcgcctccgccaggacacgccgaaccccctggtgtcccctgggagcttcctctccggccctgcccgagggggcaccgtccgccgcgggcccttgccgcgtgccgctctcctgctcgctcgtctctccccgggcggcaccggcctcctcgccccggtccgcgtcggcgccctcaccggtgtcgacgggtgcgccgccggtctgcccgcgcggggcgaagaaggtggtgtcgtcgatctgctcgcgccacaccgtccagcgcagagcgatctcgtcggcacccatgcgccgctgcgcgggcccccagacgctggtgtccggtggcgccagcaggggaccgtcgcccgtctccggggcgggatcgtggggtgccggcacacccggtgccgccacggcgacggccagcggccagcccggcagcgcggcgacgaccgtgcgctcgtcgggggacaggtcgtactccatgccgcagtcccaggaggcgatggccacggccacgagtgacacgtcgtcgacgacgaccgtccaccgtgctccggcgccgtcctgacccagcaccagcccgtacccgtccgccgacggggccagaccgagcgccgcgcaggcctccggatagtcgtcgcccagcacactcgggaactgcgccggcgtcagcagtaccgccgtgagcacatagagcgcgtcgtccgcggcggtgacggcatcctcttgcgtcccggccatcccagcctccccatggttcgtccaacggcgcgcaccctagtgcgcgggggaggcggttgtcacgactcgcgatacctctcggacctgcagttttcctccctcgaaggggcaaacggccgcacctcgtgcccgtggctgcccacttcgcgcaccgcttctccaccgatggctcatatgtggctacgcacagtagagtcggagagcgatcgggaaaaaggggtggggcgtggcgaagcggttcgagcggctcgagcagatcagccggatggacccggtggccgaggcgaccgagatccaccggctcaccgcggcgtacgagttcccctgggacttcacccgcgccctggagctggctctctaccggacgtacgccgtaccgagcatcggcagactgctggccgagacggcggaactcacggaccgcgcccagaaacgctacgacgacacggcactgctcctggacaccgtcgtcgagcacggtttcgcgagcgaagggggccgcaccgcgatccggcgcatcaaccagatgcaccgcagctacgacatcagcaacgacgacatgcgctatgtgctgtgcacgttcgtcgtgatgcccaagcggtggatcgacgcctacggctggcgcaggctctcccggcacgagaccgtggccgcggccgtccactaccgtacgctcggccggcacatgggcatcaaggacatccccgagtcgtacgaggagttcgaggcgcatctcgacgcctacgagacgacccacttcgggtgggacgagcaggcccgcacggtctccgacgccaccctcgacctgatgacctcctggtacccgcggcccctggcgcccctgctgcgcggcgccaccctcgcgctgctcgacgaaccgctgctcagggcgttccggtacgacccaccgtccgcgctgacccgcacgctcgtgcgccgcgcggtacgcgcgcggggccgcgccgtcaggttgctgccaccgcgccgcgcgccgcacttcgcgcggcagaactgggagatcaagagctacccggacggctaccgggtggccgacctgggcactcacccggtgcccggactccggggctgccccgtgcggcacaccggcgactccgcgggccgcaccggccggtgaacggaccgtggcgcccagcgttcgggtgggcgccaggcgctcgggccggtgtcagtcctcgcggacggccagtgcgaggaagcgggcgtcctcgtcgacgtacgacgtcatgcgccagcccgaacccgtcagcagcggccggaggttgggttccgcgcgtcagggacgccggatcacaccgggcgatctgcgcgcggaacccaacctccggccg

SEQ ID NO: 281 - DNA, 11476 bp, Unknown
  Kingdom: Bacteria, Phylum: Actinobacteria, Class: Actinobacteria, Order: Streptomycetales, Family: Streptomycetaceae, Genus: Streptomyces
ctggcacggttcgcgcggtcgcgcggaccgcgcgaaccgtgccagacgcggccgcgcggaccgctccaggcgtgccagccgcttcctcgcggcctgccagcccctcagctccggcacgaccaccagcccctttcgcgatcacacacctgcgtgagggacacttaatcaccagaactatgtgctgatcatggaggagccaccggtggagttcgacgtcacgatcgagattccgaagggttcgcggaacaagtacgaggtggaccacgagaccggtcgtatccgcctggaccgtcgactcttcacttcgaccagctacccggccgactacggcttcgtcgaggacaccctcggcgaggacggcgacccgctggacgcgctggtcatcctggacgagccgaccttccccggctgtctcatcaagtgccgcgcgatcggcatgttccggatgacggacgaggccggcggcgacgacaagctgctgtgcgtgccggcgtccgacccgcgtgtggagcacctgcgtgacatccaccacgtgtcggagttcgaccgcctggagatccagcacttcttcgaggtctacaaggacctggagccgggcaagtcggtcgagggcgccaactgggtgggccgcgctgacgcggaggcggagatcgagcggtcccgcaagcgcttcgaggagcacggcggtcactgaccgcaccacgtccacgggccgcgtccacccgaccgggtgtgacgcggcctttggcatgcgggcgggggtacccgcgcatactgaggcttacggaaggtgtcgttcagggagcgttgcccagtgacggatgcggaggaccgcaaaccgcagtcggacgaggcgaggagtgactacacgtcccccgccgccccggcgtccacggactcggcggtgacgcaggcgacgcaggtgattcccgtggtgtccgcgacccaggtgattcctgtgtcgccggtgtcgccggtgttgccggtgactcctggggccgacggcgagtcgtcgacgacgtccgagttcgccgtcccgcaggggctggcggtgcccagggccgggaccgagtccgagacgacgtcggagttcgccctcccggacgggctggaagtgcccgacagcgcggccgccgagcccgagggatcggcgttcaccccgccgagcacctacaacgcccgcgaggcgccctacgcgttcaccccgccgggcggcaccccggcggtcagcctgaccaaggacgcgccctggcaggaccggatgcgcaccatgctgcgcatgtcggtgaccgaacgcccggcgctggagttcgtgcagaagacggaggagggcggcccggccgtcccgcgtgtcctcgacctgaccctgcgcatcggcgagctgctgctcgccggcggtgagggcgccgaggacgtggagacggcgatgttcgcggtctgccgctcctacggcctggaccgctgcgagccgaacgtcaccttcaccctgctgtcgatctcctaccagccgtccctggtggacgaccccgtgacggcctcccgcgtggtgcgccgccgcggcaccgactacacgcggctcgcggccgtcttccagctcgtcgacgacctcagcgacccggagacccacgtctccctcgaggaggcctaccggcggctggcggagatccgccgcaaccggcacccctaccccggctgggccctgaccggggccgcgggactgctcgcgggcgccgcctccgtgctcgtcggcggtggtccgctggtgttcgtggtggcggcgatcggcgcgatgctcggcgaccggctggcctggctgtgcgccgggcgcgggctgccggagttctaccagttcacggtcgccgctacgccgccggccgcgatcggcgtcgccctcaccgtggcgaacgtcgacgtgaaggcgtccgcggtcatcaccggtggtctcttcgcgctgctgccgggacgtgcgctggtggcgggcgtgcaggacgggctgaccggcttctacatcaccgcctccgcgcgcctgctggaggtcatgtacttcttcgtcggcatcgtcaccggcgtgctgctggtcctgtacttcggcgtgaagctgggcgcgcagctcaacccggacgcggcgctcgtgggcagccagcggccggtgctccagatcgtcgcctcgatgctgctgtcgctgaccttcgccgtgctgctccagcaggagcggtccaccgtgctgtgggtgacgctcaacggcggggtggcctgggtggtgtacggcgcgatgcactacgtcggcgatatctcgccggtggcctccacagcggcggcggcgggcctggtggggctgttcgggcagttgctgtcccgctaccggttcgcctccgcgctgccgtacaccaccgcggcgatcgggccgctgcttccgggttccgcgacgtacttcggtctgctgtcgatcgcgcagagccacgtcgacaaggggctcgtgtcgctggccaaggcggtgtcgctcgccatggccatcgccatcggcgtgaacctgggttccgagatctcccggctgttcctgcgggtgccgggtgcgggcagcgcggcgggccgccgggcggcgaagcggaccaggggcttctgagccggccggccccggcggtccgggtgcggcctcagggggcgcggtagtagccctggccctggtcgtagggctggtactgctgcgggggctgccggcggtcgtagccgtcctgctggtcgtcgccgtacggctgctgctgcggaggctgctgctgtgggtggccctgcggctgctggggaggctgctgctgggggtggccctggggctgctgcggaggctgctgctgggggtggccttgcggctgctgcgggtgccggccgccgtagtactggtcctggccctggccctggtcgtagccgtacgtctgctggggctggtgcgggggctgcggctggtgctgctggtacggcggctcgatgcggcgcagctgggtggtcgcgtcgtccatcgccggccgctggtactgctgctggtacggctgcgcgaactgctgcccgtacgggctcgcggcggcgggctccggctcggccgcggcggcctccggctcgttcttcgccttggcgcgggcgcgcaggaactcgatggcgatcgggacgacggagacgaggacgatcaggatgaggatcgcctcgatgttgttcttgacgaagtcgatcttgcccagccaggagccgagcagggtcacccccgcaccccacagcacaccgccgatgaggttgaacgtcacgaacgagcggtagcgcatgccgctgacgcccgcgatgatcggcgtgaacgtccggacgacgggcacgaagcgggccaggaccagggacttcgggccgtacttctcgaagaactcgtgggccttggtgacgttctcctgcttgaacaggcgcgagtcggggcggttgaagagggacgggccgaccttcttgccgaacatgtagcccgcctggtcgccgaggaccgccgccaggcagatcagggcaatcgccgcccacagcgggaagtcgagctggtgcgaggtgatcagcaggccgcaggtgaacagcagcgagtcacccggcaggaagaagccgatcagcaggcccgactcggcgaagacgacgaggagcaggccccagatgccgaaggtgtccagcaggtagttcggatccagccagctcgggccgagggcaagcgtcgtcacggttccgggctcctgagggggtgggggcggtcggcggcgggtcggcctccgtgtactgccgcacaacgtatcaacggatggtgtacggctcaggttccaccgggtgggaaggggtgcgctgtgcgccgccttggtccaggctgtcccccatgggtatcgaggattacggcggcggccaggggccccagtcggatgtcatggtcgtgaccaccaacgacgtacccggccaccgtgtcgaacaggtgatcggcgaggtcttcggcctcaccgtccgctcccggcacctgggcagtcagatcggcgcggggctgaagtcgatgatcggcggcgagctgaaggggctgaccaagacgctggtgcagacccgcaaccaggcgatggaacggctcgtcgagcaggcacgcgcgcggggcgccaacgcggtgctggccttccgcttcgacgtcaccgaggcggccgacgtgggcacggaggtgtgcgcgtacgggaccgcggtcgtcgtggtccgggagtagcccgcagacagacgcacagcagacgtacacacagatgggcacagatgtgaggggcgctcaccagggtgggcgccccttaccgtcagccttgccgtcatccctcgtgacgggcggcgttcgcgaggatcgcctccttgaggtgttcggccatgcccggccgcatggcgtcgtagaacgccttgaagcgctcgtcggcgatgtacatctcgcccaggcagcggtgcatcgcgtacgggcactcgaagaaccacctgccgatgtggcgccggtgctcctcggccaggtccatggccgccccgccggccggcggctccccggcggccaccagggcggcgtactgctcgctccaggcgtcgacctcggcctggatgcgcttccagtcctccttggagtagcgggcggcccggcgccgcgactcggcgtacgcctcggtgccgccccagcgctgctcggcctcctccgcgtactgctcgggctccttgtcgccgaacacctcgaaccgttcctcgggcgtgaggttgattcccatcctgcgtgcctccatggcctgctccacggccgcggccatcttccgcagcttgtcgatccgggcggtcagcaactcgtgccggcggcgcaggtgcgcgcgcgggtccgcgtccgggtcgtcgagcagcgccgcgacctcgtcgagcgggaagccgagctcccggtagaacaggatccgctgcagccggtcgaggtcggcgtcgctgtagcgccggtgccccgcgtgactgcgctcgcccgggacgagcaggccgatgtcgtcgtagtggtgcagggtgcgcaccgtcactgcggcgaaaccggcgacctggcccacggtgtagctcaccttccgctcccttctcggtacgcgctccacggtcctgcctcacgtcgcgtgaggtgcaagcctgtttccgtcctgactgtgttgcgcgcgttcatccaggtacgccggattcatccgcttatcgtgtgccggtggcccaggacaccgagcagcaggcaccggccggaccggcggccccggcccgcgcactcctgcccctgatcctgcccgcactcgtcaccggcatcggctccagcctgctgttcctggtggtgagcggggcggcggagcggttgcagggcccggtgtggggagacctgccggacgcgctcggcatcggccggttctccgtggcgtggatgctgatcgtgctgaccgcgacgggtgtcctggtggggctcgtggtgtggaaggcgccggggcacgcgggtcccgaaccggccacgctcggtctggcggctgccccgatggcgcccgtcgtgctgccggggctgctgctggcgaccatgctgatgctggccggcggacccagcctcggtcccgagaacccgatcatcgcggtgaacgtggcgctgacgttttggctgggacgcaggctgctgccccggctgccgggggcgctgtggcccgcactggccgaggcggcgaccatcggggccctgttcgggacggccgtggccgccgcgctggtcatctccgaggcgctggccgggcggccgatgaagggtgcgctgtgggacaacctcttcgcgccgctggccgcgggcgcggcgggtgccatgaccacgagcctggtcgcccaccccaccttcgacctcgggctgccgccgttcgggcgcccgcactggggcgatctgctcgccgccgtcgtgatctcctcggcgggggcgctgctcggcctcgccgccgtgtacgccttcccgtacgtccaccgcatcttcgcccggctcggccatccgatgatcgcgctcccggccggcgggctcgtcctgggtctgctgggggcgctgggcggtcatctcacgttgttcaagggactcgcggaggtcgccgagctggcccggcagcccgagggccacacggcggggcagttcgccgggatggccgtggtgaaactggcggcgctgctcgtggcggcgtcctgcggcttccgcggcggccggatcttcccgtccgtcttcatcggcgccgcgctcgggctggccgcccacgccctggtgccctccgtgccgcccgcgctcggcgtggcggcggccgtcctgggcatgctgctggccatcacccggcagggctgggtgagcctgttcacggccgcggtcctcgtctcctcgccgaccgtcctgtccctgctgtgcttcgcctcactgccggcctggctgctggtgaccggcaggccgcagatgcaactgcgggaggacgggacggcggtgcgctgaccgcctctcagtcatcggtcacccttgatcacctgatcacttgatcaacggacgtctcccgggtgcggccgtcccgtggcgtacgggttctcctggccctccttcagtacgccggagaacggctcgccctcgccagcgaaggtgtacgctccgccgcggacgcggtcgatgagggcacgtgtccactgggcgccggagtcggcggagtgcacccagaagttcatgatctcgccgatgtggccgaaccggccggggccgtcctcgggcgtgtagtactcggtgaccgacctgcgccactcctcgatgctgcgcacccgctcctccaggagtccgagtgcctcctcccgccccaggtcgaccatgaagccgagcgcggcggcgagcacgtcgggccgctggtcgtaggcggtgaggtacgcgcgcagcagcgagaagtactcctcggtgcccttcccggtgatctcgtactcgacgcgcggcgggccgcccgccgtggagggcgcgctctcgtgcgcgtacagcatcccctgcttcgccatctgcttcagggcgtggtagatcgagcccggcttggcgttggaccactcgtgggcgccccagtactcgaggtcgttgcgcacctggtagccgtgggcccgcccgtgctggcggaccgagccgagcacgaggagacggatcgctgacatgcgctccaggttattgccggggccccggccgcccgcgtgagggccgccggggcggggcccgggtcagaaggggaagccgctccggccgtgctggaccgagatccacttcaccgtggtgaaggcgtccaccgtcgtctcgccgttgaggcggccgatgccggagtgcttctcgccgccgaagggcaccagcggctcgtcgtgcaccgtgccgtcgttcacgtggaacatcccggtgtcgatccgcttggcgaaggccacgccccgctcgatgtcgccggtgtggacggcgccgctgaggccgtagggggtgtcgttgacgatccggaccgcctcctcctcgccgtcgaaggggatgaggaaggcgaccgggccgaagacctcctgctggagcagtgccgagccggcgggtacgtccgtcaggacggagggggcgaccaggttgtcggtgacggaaccgtgcaccagcgcggtggcgccctcggcgatcgcctgttcgacgacaccggacagggcgttggcctgggccgagttgatcaccgggccgatgatcgtctgcgggtcacgcgggtcgccgaccttcagcgacttcaccttggcgacgaacttctcggtgaacgcctcggcgatcgaacggtccacgaggacccggttcgccgccatgcagacctggccctggtggacgtagcggctgaagacggccgcgtcgaccgcgtagtcgaggtcggcgtcgtccaggaccacgatcgcgctgttgccgcccagttcgaggaccgagcgcttgaagtgcgcggcgcagacggtggccacgtgccggccgaccttgtcggagccggtgaaggagatcagcttcgggaccgggtgctcgatgaaggcgtcaccgatctcggcgatgtccgtgacgacgacgttgagcagcccgccgggcagccccgcgtcctcgaagatcttcgcgaccagggtgccgccggcgatcggcgtgttctggtgtggcttgagcacgacaccgttgccgagcgcgagcgccggggcgaccgacttgaccgacagcaggaaggggaagttgaaggggctgatcacgccgacgacaccgaccgggacccggtagaggcggttctccttgccgtcggacggcgacggcaggatcttcccctcgggggcgagcgccaggtggaccgactcgcgcaggaactccttgacgaggtggagttcgaaggcggccttgaggtgcgtgccgcccagttccgcgacgatcagctcggtgatctcctgctcgcgctcctcgaccaggcgcagcgccttctcgaagaccgcgcggcgcgcgtaggggttggtggcggcccactgcttctgggcccgggccgccgcccggtacgcctcgtccacctcgtcggccgtggctatggtgatcgaggccagtttctcgtcgtcgtacggattgaagtcgatgatgtcccaggagccggtgccctggcgccactcgccgtcgatgtactgcagggccaggtcggtgaagtaggacgacatgtgatccctcgaatcccaggcgctcgctgactgatcggacgtcatcgtacgtgcgcacgagggaagttgggcgggagtcggggacgtactccgacttcgccggaggtcctacgagagctggagcaggccccgcaggacgtcgcggctctcgtccggtccggggctgtcgtgctggagttccttgagcgccttctcgtactgggtgacgtcctcgcgcttgtccaggtagagcgcgctggtgagctgctccacgtagacgacgtccgacaggtcggactcggggaagctgaggatggtgaacgcgccggactcgccggcgtgcccgccgaagctgaacggcatgacctgcagccgcacgttgggccgctcggagacctcgatcaggtgctgcaactggccgcgcatcacctcgcggtcgccgtacgggcggcgcagggcggcctcgtcgaggacgatgtgcagctccggggcgttctcggagacgaggtacttctgccgttccaggcgcagcgccacccgccgctccacatccgcgtcgctcgcgctctgcatgccgcgccggaccaccgcgcgggcgtacgcctcggtctgcagcagtccgtgcacgaactgcacctcgtagacgcggatcagggacgccgcgccctccaggccgacgtaggtggggaaccagttgggcaggacgtcggagtagctgtgccaccagcccgcgacgttggcttccttggcgagcgagagcagcgaggtgcgctccgcgtcgtcggtgatgccgtacagcgtcagcaggtcttccacgtcacgcgtcttgaagctcacccggcccagctccatgcgactgatcttcgactccgaggcgcggatcgagtaccccgccgcctcccgcgtgatcccccgtgcctctcgcagtcgcctcagttgcgagccgagcagcatgcgccgcaccaccgatccgggctctcccgcgctcacgttcgccagcctccccaaccgtcctcaagggccgaagtctgccactaaaacacttcgagcagtactcgaacgattacggaaacggaaggagatcacagaaaacgtgcagtcagcggcaagaaggaggcaaggggcggtcgagaagacggcggaaaaaatggccaacaagcggtacgtgtgcgtccaattcggtcgcgtgcacgtgcatctgcccttgcatctgctctgcgcatccgaaaccatggtcccgcgccaccgctgcatcgcaatgaccactgcatcgcaacgatcgcgatttcccgggagtgcctcgcatggggacgaatggatcgaccatgctccagccgttacggcagggccttccgccactggacccgtcggccgtgtgcgacgccgcctcccgcgctctgccctcccgctacgaagcggtgcgagaggcacggcagttcacccgtgccacgctcgaccagtgggacctcgacgaccgtttcgacgacgtctgcctcgtggtctccgaactcgtcacgaacgccctgcggcacgcgctgccggacacgtcggtggcgcgcgtgtgcgaacagggcgcgtcggtgcgtctgcacctgatgcgctggaccgagcggctggtgtgcgccgtgcgcgaccccagccaggagagtccggtcgcccgcgacacggacgacttctcggccgagtccggtcgcggcctgttcctcgtcgactccttcagcgacggctggggctggcacccgctggccggcacgctgggcggcaaggtcgtctgggcgctgttccggctccggccggtgggctgaggctcctggacggtcgccgaccgggggcgggcgggtccgcgatgtccgctcccaccggcagccgtcagcgggcagccgggccgcctgagtgccggccgcctgagtgccgggccgccggactgccggtcggtgaccaggccgtcagccggcgaccaggtggtcgaactcgccgtccttgacacccagcagcatggcctctatctccgcgcgggtgtagacgagcgcgggtccgtcggggaagcgcgagttgcggacggccacgtcgcctccgggcagccgcgcgaactccacgcacgaaccctgtgagttgctgtgccggctcttctgccaggccaccccgtgcaggcgtgtggccgccatgccgttgtgcacgtcgcactccccgtacacgccctcgacgtcgtgattcacaggtcgctccccggtggtgcactggctggtgtggccatagatgcattggtcaactgaaccggatcataaccttgttcatgtgcgcttgcatgagcagatgcacgtgcacgcggagtgctgtggtgattacaactttgacgagcgctttaccgaagctgcttccgcgtctgcccccgaaagcgctgggcatgcgtgccggttgcccgcgcccccgcaccgggggccggccctcgcgcccttgctgacacgtgcatgaaggaaagacgcacgacgggcccgcggtgttccgtccgccaccgatgagcttcgcgcgggcgaccgctagcctgctgaggtcgtaccggccgccggacggccggcggttccaggtggggggatctcagtgaccaggacgaccacagcagggcggatcgccgccgtcgggctgatcggcgcactcgcgctgacggcgtgcagcagcggcggggacagcggttccggcggtgccgccgccaagggcgacgccaatgcgtccgcctccgccaccggtgcaccctcggcctccggtgggg

SEQ ID NO: 282 - DNA, 8569 bp, Unknown
  Kingdom: Bacteria, Phylum: Actinobacteria, Class: Actinobacteria, Order: Streptomycetales, Family: Streptomycetaceae, Genus: Streptomyces
ggatgtcctgcggcgaggacgtagagggggtgtggctggtgttgttgagggtgcagcgttcggccaggggtgtgtcgcagaaggctccggtctggaaggggccgagcccgagtgcggtggcggtgagcgcgaatgtctgcccgaggtggccggcgttgagcggtaacgaagatcttgaaacggttctcgatcttcgaagggacccctgttccatgcgtttcgctcgtgccgtggccgctgtccttgccgctcttgcgcgctcataccgccgtccctcgtacggcgcctgtccggtcgtggtgcggcacgtcccgggtgaaggtggcactggccgggaggcgaccctgccgagggcgcgcccgtcgtcagagagggagatcggcatgccccagacctccgggggaaggcctgcggaacccggcatcgcggcggcgaaccaggcggtgcggcagcggttcgccttcgacgacgagcaggatctgaaggacgcgcaccgcggtttcatggggacggcgtcacagagcgtcatccgggacgccgaggggtactcggtggtggaggacctggagacttacggtttcctcgcccggggctgccccgacaccgctgacccgccgagaccgacctgcgggccgtgccgctgggcaccacggtgccggccggcctcgcggtccgggacgacgtcaaggtcaccggtgacgccagcaggcttcccgggccgctcgaccacctcggcgcgcccgacccggacttcgccgtcgtcaccccgtgaaccgtcggcgcggtgctgaggagcggccgtgttccatcccggcacactcgtcctgatcatggtggccgccgtcctcgcgccgctcctcgcgcagggggcggcgcgccggatccgcgttccgctcgtcatcttcgagatcgccctgggcgtcctcatcggcccggacgtcctcggctgggcccatcccgacgaggtcgtcgacacactggccgacctagggctggccatgctgatcttcctggccggatacgagatcgagttcgcggccgtccgcggtgccaccctgcgccgcgccgtctgggcgtggctgatctccctcggcctcggtatcggcctcgccctctggatcagcggcggcgagacctaccgggcgttcgtcatcggtacggcgctgacgagcacggcgctgggcacggtgctgccgatcctgcgcgatcgcggtgtcctgcgcggccgtttcgggacggtggtgtcggcgttcggcgcggtcggcgagttcggtcccgtcgtggcgatggcgctgctgctcagcgggcgcaagccgggggagtcggcggcgctgctgatcgccttcgcagtgatcaccgccggcaccgtctggtgggcgctgcggccccggccggcctggttctcccgaatggtcgacacgaccctgcacagcagcgggcagttcgcggtccgcttcgtgatgctgctgctcgtggggatgctggccctggcggaggcgttcggtctggacatcctccttggcgcattcgccgctgggatcctcacccggcttgtgctgcacggcgcctcgcccgcacacagcgccgatgtcttcgggcgggtggaggcgctcggattcggcttcctggtgccgctgttctacgtcgtcaccggcatcgagttcgacctgcgggccctgctcgacggtggacaggcactcgccctgctgccggtgttcctgctgctgttcctgctcgtgcgaggagggccggtgtacgtcctcgcaccgcgcgacctcgatgccggcgaccggcgggcgctcaccctcttcgcgtccacctgccttccgctcgtcgtggcgatcacgacgatcggcgtcgaccagaaggtcctcggcagcgacgcggccgcagccctggtcggcgccgcgatgctctccgtcctcctgctgccactcctggcgatgcggctgcgcgcccgcggcggtcgcaaggagccggcggcgctgtcctcggaggagtcggaagcctggtgaggcggccggtgcgcggcgccggtccggcgacaacacggctcaaccggcatgagcaataactgatcgtttcagaatgccgtgcgacggagacgctgacggcctcatggaacaatcccttcagccacgggctcaggggggatgacgccgtatggagcgggttgaggctgcacgggaagtcgtgctcggttatgtccatgcgctgaacgcgattggcgaggccacgagggcggcgatcccctcacttgagcgactcgcagatgtcctcgacctggtccgtgcgcgccggatcatcagccggagtgggcgcgtcggtacctactcctacacggtccacggggcaggctgccgcttcatcagcgacgacggcacggaggtcgatgtggacttcacagccgacgggagtgaagccttcgacctctggcggctgcgcctgtacgggctgagccttccggaggctgttgacgtcacggatgaggacctgcgctccgcagcacggtcgctgcaaccgcttctgaccgaggtgcggccggggtggttcagcgtagccaagtgattgcttcaggatgaggttcgcgggcggcgcaggtatatgagactgcaggccagttcaagcaggccctgatggagatcagctcgtcgctcgtagcgggtgcggagccgcttgaactggtgaagccaggtgaaggcgcgctcgacaacccagcgctccttgtccagtccggagccgtgggcgacgccgcgccgggcgatcagcggcttgatgccgcgcttccacagcaggcggcggtacttgtcgtagtcgtagccccggtcggcatacagacgccggggtgtgcggcggggccgtccccgcagacctcgcatcggtgggacggcgtccagcaggggcaggagctggctgacgtcgtggcggttgccgccggtgagggtgactgcgagcggggttccgtggcggtcgacgatcaggtggtgcttggagccgggacgggcacggtcgacgggcgaggggccgacatggtcccccctttgagagcccggatgtgtgagccgtccacggcacagtcgtccaggtccaacgagtttgcgcggcgcagctcggtcagcagagcggcgtgcaagcgcggccacacaccggcctcggtccattccctcagtcgacgccaggccgtgactccggagcagcccacggtctcggccgggacgtcgcgccaggcgacgccggtccgcaggacatacatgatcccagcaagagccgcccggtccggaacgcgaagccgcccgggatgccggcggcgtcgttcgggagcggctgccagcagcggggccacccgctcccacaggtcgttcggaacaagatcaatacgcactcgcaccctgccgaccaagatcgccgagtgcaagacccacagctcaactcattctgaaacgatcagtaagcagatcagcggaacggggcctatgccgaatccgaccgccgaggcaatgcccggcctgctccgcgaagacctcgcgcagcttcgaccatgcgtcccggccggctacccaggaacagccgcgactacgacgccgcggagaagatcaacggccgcaagtgacatattggacacgctcggtctgccatgtaccggctgcactccctgatgcggcgccagacgcgctcggtcctcgtggaccgtccgggaaccggatggagcgacctgggccccttcccgcgcacgacgacgggagaagccgtcgaactgctcacggcgctggagcgggcaggcgagaacgctccctacgtcttcgtagggcactcgttcggggggctgctcatggccaacgccgcccggcggcgccccgacctcgtggctgggctggtactcctcgatcccaccccgcccgacgccatcgccttcggcccggcgctgccgggcatgcgccgcgccccgagggaccaggcagtcctcgtgctgcggcacctcttcggcctccaccccctcgcagaccggaaggggacaccgccctccgacgatccggcacgaatcctcgcgacgatcgaactccggaccagggcgaactgcgcggcggcgtcgatcctgcgagagctgacaccgggcggcatcaccagagacggctggcacacggccgtccatgacggcgaactcggcgccctgcccctgctgctcttggcgccaggcgacctcacggggggtgacgcgctcttggacgcggtcgacgacccgcaggagagagcccggctgcggcacttcttcctcaccgtgcgggaacggttcctcgcgacctccagcagcgcacggaggatctataccccggaaggaaccggccacgacttcccggacgtcgtgcccgagttcgtggtgcgggtggtggactcgctgctcgaccagtgccaggcggggacgcggaaggcgtaggacttgcgcggaccgcttcaccggcgccgtcactgccgaaggatcgcagcctcatgctgcgcaccgcgcgtggtccccgaacgtgggaagccgcatggggagactgcggcgcggacgtgccttgccccgcgtccggaatgtgaagccacccggcactcctgcgggacgacccttgtggccggctgtgtgtggaggagggttgcacgacgtccgtgccgtggtcgacgaagggcgggccggcaagtccacgcggttgtccgtcaatgccggtcacaagtgcccgagaagtcgactctgtgatgggccgtccaggccaatcatgagtcttggcgcacgccaggccggaggggaggtaggacatggttcggctttcttccgcgacgcgcacgccgcccgcgtctgcaccgcggagttggcatcagccgcgcgcaggcgtaccggctgctgaacgtcgtccgtgccctcgcagcgatccatgatgccctcgccgccggcaccaagacttcttccacacgagtcaccggcccggcggccgtgtccagcgaggcacacggccgtcggtaggagagttggcgacggtgaggatcccccggtgaggggtgccaactgtcggtcgcctcttcccgagccctgctcctgcggcgcggacgggagacagggcgtcgagggcgtcgttgtccccacggcccaccggttgtacggtccgaccaccagtgaccgactgctgagaggaaccgcacgtgaaagtttggactcgaccgttacgtcgaaaggtccccctgttcaagggcgtggtcgtcgctctggcttctcttgccgccctgattgttcatgcgtccccggcggccgcggacgacatctgtggcacgccggtcggcggagcgatcctcgccaagtactccgagctgggccgcgagaccgggccgctcggatgcccccgcagcatcgagctggacaacccggatgggcgcggaaagcgccaggagttcgggggcggcaccatctactggtccaccgccagcggcgcgcaccctgtatggggcatgatcggcagcaagtggggggcgctcggctgggagggcgggaagctcggttacccgatcgacgacgaacgcaccaaccccgacggcgtcggcaagcggcagcagttccagggcggcacggtctactggcatccgacgctgtcgaacggggcccacccggtctgggggaacatcggccagctatggggagagtacggctacgaacgcggtccattcggctacccgacgtccgacgaattccaggacaccgagtacaagtcgatcgaccagaagttctccaacggccgcaccctctattggagtgccggaaatggcgtcgaaggatgccacggcgaatgcgtgggctacttcggcaccaacgggaccgacttgttcaagcaggtccgggttgagatcccctacgggaccagcaacgtcgtggtccgccccttccccaccgagaagggattcaatgtcgcccgtacggatttcacggcgtcctggaaccaactgtggcaggtagttccgtaccccaacggagtggacagcaccgagcacaactcgctgtatgagcagttcgcctgccatgcgaagttcgtcttccccgatccaaccgacgacagcggatggagcacgggggcgagctgggacctggagtcgtggcacagctccgtcggcatgggcaatgccacgagcgaggtctactttctgagcgaacattgcaactgggactgaacgtcaccgacgtggcacaggaaggtctctgccctggcgaccgacattgttagggttgttctgccccgctgaagatcatacggcgggcggaattacagcctgtgtgccgacccgtggacgaaccaggacatagcccagcaggccgttgatcgggtggtgagcgactacttcagcaagcgaaccgccaacggccagaaggttctcgacgaagagaagtggaaaaagttccagaactgggcggcgaaggccagggacggcgagcagtacccggcgatcactggcacgtgggatgcctatccgtctctgggtaagaggtactacccggacggcagaacgatcgacaatgccggcaatgaagttgtggtgatcttgatgaaggtcaagggccacaacgggcagggacgatatggattcgtagtcaagactgcctacccgaagtagaagatcacgcaccctgaaggaaatggttcatgccgcagggatcatcaccagctttccagggctcgggtcactcaccggcgcccgggtgctcgccgagatcggcgacgaccgatcccgcttcaccgacgcgaaaggcctcaaagccttcgccggagccgcaccggtcacccgggcgtccggaagaagcctcgcggtcaggcccgcagggtccaaaaaccagcgtctggcctcggtcggctacctttgggcgttcgccagcctgaccgcctccccaggcgcccgagcccactacgacaggcgacgagccgacggagaccgccacacagccgcccagcgcaatctcttcaaccgcatgctcggctgcctccaccactgcctcacccagcgcagcgtctacgacgagggcacggccttcccgccctctgaaactgctgcgctgagggccgccgttgaggcgttcagttgggcagcgggagcaacctgccgctccagcgctcgtcgccaacctcttcgggttgcctcaggcggatgtcaaaagcgttctccaccagtgccaggacgctgtgcaggggcgcgacctggccagggacgagcccgaggggcctcatagcgtcatcaagtcttgccgggtcaagcccggtcggctcgatcgcctggagcgtgtggaagtcgacgatgatctcgccgcctaccgcgtacttgaaccagtgcatcggcttctcgttgtagtggagcaccacggcctccgtgcccacggagacacgactcaagatcctctcatcgagtccgtgcacgccgccttgttcccatgcccacgtccacggaccgtcgataccgctggtgacgacgggttcttcatcgtcgaaaaggtcgtcgcccaagtcgtccgagaggtctacggcgtcgcgaagcgccaaggtctccggatccacccccatgcgggtgagcagctcggcagggggcagatcccgtacgaaggtcagcgtgtagatgggaaaatcgccctctcggaacaaatccagtccgcggcccatccctatgctcgtcatgccgtggatgctgccacacaccaccgacactcctaccagagtgccgcccttgacagatcaactgcatcggatgtctctttccgcggtcctgacttccatgcccggcatcggagtcaggaccgccgcccggatcctcatcgacgtcggcgacggcagcgccttcgccaccgtcggacacctcgctgcctatgccggcctggcgccagtcacccgcgcctccggctcttccatccgcggcgaacaccccgcccggcgaggcaacaggcaactcaaacgtgccttctacctcgctgcgttcgccttactttcgcaaccagagtcgcgggcctactacgacagaaagcgccgcgaggggaagcaccatgtggcagctctgattgccctcgcccgacgacgcatcgacgtgctcttcgccatgctccgcgacggcaccttctacgaggccccagcccgcgtcgcggcttgacgaagaccataggggcactttttcgccctcacgtgggcggtgtcgagcacgacacgggtgacgtcgatcaggccggcgtcgtccaaccggtgcagcacggcctcgtggaggcggccccagacaccggctcgcgaccagatcaggaaacggcggtgagcggtcgacttcgaaatgccgaagcagggcggcaaagcgcgccaagcgcagccgctgaccagcacgtagataatggccgcaaacagcgtctcatcaggggtgtcctgcgtcccgccaccctgtggccgcaccttcgacggcgggatcagcggcttcgcgatctcccacagcccgtccggaacaatccaactccacgtaccccgccccatgaacggaccaacgaccgcctcaccacataggacacggtctaacgagttggtgcgtgata

SEQ ID NO: 283 - DNA, 3705 bp, Unknown
  Kingdom: Bacteria, Phylum: Actinobacteria, Class: Actinobacteria, Order: Streptomycetales, Family: Streptomycetaceae, Genus: Streptomyces
taggtgaagaccgcggtcgccctcctggcgaccgcggtcttcacctacatggaccggcaggcgacacgccaggccgccctgatccgcgacctggtgcgcacccgccgggaactggccgcgaccgagcgccgcgagggcaccctcgccgagcgtcagcggctgtccatggagatccacgacaccctcgcccagagcctgtccagccagcagatgctcctccaggccgccgacctggtgtggcacacggacccgcagcaggcgcaggcccatgtccgcaccgccgcctcgatcgccgagagcagcctcaccgaggcccgccggttcgtgcacgacctggcaccggccgatctcgccgagggcggcggcctggaggaggcgctgcggggcctcgcctcccgcgagagcacggcggaccgcaccgtgacctgcctcgtcgacggcacaccgggaccgtccggcctgccggaccgggtgcagtccgcactgctgcgcatcgcgcagggcgccctcgccaacgtccgcgagcactccggcgccacccgggccgccctcaccctcacctacctgggtgaccaggtccgcttggacatcgccgacaacgggcgcggcctggacacctcggcactgcctcagcgggcgtccggggtccgcggacacggtctgcccgcgatccgcgcccgggtcggccagctgggcggcaccctcaccgtcgagtccgcgcccggtgacggcaccgtcgtctccgccgccgtaccgctccatcccactcccagcgccgcggaggtcccagcgcagtgacccgccccgaacccaccgactccaccgaacccaccgactccgccgaagccaccggatactccggatccacggaatccaccgccgggccgaccggctgggtctcccactccgcctccgcccccgagcggccggcccccgtgcggatcgtgctctgtgacgatcacgccgtcgtccgcgccggtctgcgcgccctgctgggcagtgcccagggcatcgaggtggtgggcgaggcggacagcggggcggaggcggtcgcgctcgccgcgaagctcgctcctgacgtggtcctcatggacctgcagctgggggaggggatggacggggtcgaggccacccgccggatcaccgccgcctccggcggttcggtgcacgtcctggtcctgaccacgtacgacacggacgcggacatcacccgcgccatcgaggcgggggccaccggctatctgctcaaggccgagcgcccggacgagctgttcacggccatccacagcgccgcgcagggccgtaccgccctgtccgcacccgtcgcccaccgggtcatggcccgcatgcgcagcccccgccccggactcaccgaccgcgaacgcgacatcctcgggcagctggcccgcgggctgaccaaccgggacatcgccaaggcgctcttcctgagcgaggccacggtcaagacgcacctggggcgcatctacgacaagctcggcgtcgacacccgcgcgggcgccgtggccgtcgccaaggagcagcgcctgctgccctgaccgccgtcctcaccgcgcgcggccgatccccgtcctgccccgcatgagggcggcgtagagcacggaggcgacgacgaggcccaccggcagggcgaggtccacgccgcccagggcggtggcgaccggcccggtgtagtacagggtgtccacgcacagcgaggccgcggcggtgcccgcgaggaccgcgaccgcgccggcccagttcacgccgcccgcgtaccagaagcggctgcccggggtctcgtccatcagggccaggccgtcgtagcggttgcggcgcagcaggatgtcggtggcgtacacggccatgctggggccgagcagcgcgacggtgagctggaggacgttgttcacggtgtcgaggaagttggacacgagcagcgcgtacagcgtcagggagacggagacggtgccgtcgacgagcacgctgagggagcggcggatgcgcacgcccacggcctggagcgccaggcccgcgctgtaggcggtcagggcgttgatggcgatcgtgccgaggatcagcgccagcaggaagacggggttgaaccaggccgggaggatcttctgcagcgcgctctgcgggtcggtcatgtcgaccgcggtcgcggcgaaggcgcccagcgcgcagacgacggtgcccggcaggaacccgcccagggcggtccagccgacgatcgacttcgcggaggtggtgcgggggaggtagcgggagaagtccgcgctggtggtgtacgacagcgggcccgaggcgaccagggcgaccccggcgaagacggccgcccacaggctcgtgccggtcagcggccggtcgggggcgtaggagaagtcggtgtggccgaccacggcgacggcgacgccgatgaaggcggcggtgaggaccagggtgatcgggaggtacagcttcatgatcagcgcgtgaccgtacacgctgatggtcagtgtcagcgccgcgacgaccacgaccacgacgatcttgaccccggtgttcaccggcaggccggccttgccgaccagggagaaggccgccgtcgcggcggcggcgaggttgagcgcgaagtagcagacggagatcagccagccgacgacggcgttgttcacgcggttgccgcggactccgtacatcgcacgcgtgatcacctcgctcggcgtgcccgcggccggacccgagaccgccagcaccccggtcagcagccagaaggcgttgcccaccacgatcaccgcgagcgactgccacaggctcaagcccatcaggaccagcgcgccgccgaccaccagactcaggtagttcacgttcgccgcggcccacacggagaacaactcccgcgggcggccccggcgttcgctgtcggggatgtgatcgatgccgtgcgcctcgaccccgccggaacggtccgcggacgtcggtggaccgggacagtcgtcgacgtccgggttcgggtcgggggtcgtggacaccattgtcgctccgggggcttgcaaagcttgcttattggtcggccactcaataacatccgccgtatgtcgtcaagcgtcagcggtaaacgagttcgcaaagacccggccacgcgacgtgcggaaatcgtcgacgccgccgcggcgatcgcgctgaccgagggcctggaatgcatcaccctgcgccgggtcggtgaggaactcggcgtccggccgggtctgatcagccactacttcccgtccgcggacgatctggtggccgaggccttcggcagcgccgcgaccggcgaactggacgccctgatcccgcccgagcggcccgagggtactccgacggagcacctcgcgcgctttctcgcccgcacggccggggacgcctacgacacgatgagccggctgtggatcaacgcccggcacctcagccgctaccggccggtgctgcgcgaccgggtcgccgagcaggaggccgcctggcgcggacggctcggggacctcatccggcacggcgtcgccgccggtgagttccgcacggacgacgtgctggtggcggtcgtccagatcctggtcgtcctcgacgggctcggcgcgcacgccaactccggtgtcacggaaagcctgccggcggtgagcggcatggccgtcagcacggcggaacgcgccctgggcctgccggccggcgccctcgccgtcgcccacc

SEQ ID NO: 284 - DNA, 5329 bp, Unknown
  Kingdom: Bacteria, Phylum: Actinobacteria, Class: Actinobacteria, Order: Streptomycetales, Family: Streptomycetaceae, Genus: Streptomyces
ccttgtacgcggtcgcgaccgtccccggactgacggccagctcatcggcgagccggcgcaccggcggcagcgccgcacccggcgccagcgccccctcggacacgccccgctccaccgacgccgcaattgccttggccgtcgtaccgctgatcgcataatgtactgccacgttattgattatgtatcaatacataactcggggcaagggggagcggtgggaaccacccgcggaacgaagaccgggaccactgacacgcaacggaccacaaggacgggacgaccgcggatacccggagggccggacggccgccgcatgctcctcgtcgccctcgtcgaccgcaccggcagcggactgtgggcctccgtctccgtcctctacttcacctacgtctcccacctctccctcgcccaggtcggcaccctcgccgccctcgccggagccgtcggcatcgccggcgcccccatcggcggccgcatcgccgaccggctcccgctgacccgcgtcctcatcgcactccaactcctgcgcgccctggcctccgtcggactcctcaccaccgaccgctacggcctgctcatcgccttctccgccctcggcggcctcggtgaccgcgccgccagcatcctcaccaagctctacgccacccgcgtctcaggacccgaacgcgtgcgctaccaggcgctcaacaggaccgcggccaacgcgggctgggcccttggcggcctcgccgccgcggccgccctcgccctgggcaccaccgccgcctaccggtggctgctcctcggcgacgcgctctccttcgtcgccgtcgccctcctcaccctgcgctgcggcgaaccgccctcgccctcccgcaccatcgccacctccgacacccccgcgcccaccggccaccccgccaacccgtggcgcgaccgcacctacctcgcctacgtcgccaccgaaacggtcctcttcctcgacgacgccgtcttcaaggtcggcctgcccctgtggatcgcccacgcgagcaccgcaccccacggcctcgcacccctgctcatggtgctgaacaacgtgatggtcgtcgccctccaggtgcccctggcagggttcggcgccaccaccgccgcggcccgcaccctcctgctcccgctctccctcgcctatgcgctgggcggcaccgcgctggccctctccgcgaccggcggagccgtcacgtccaccgcgctgctcaccgccgcggccgccgccttcaccctcgcggagatgctccacgccaccgtctcctgggaactgtccgtcgccctcgcgcccgacgtggcccagggcgcctaccttggcgtgcacggactggcccagtccgcccagcgcagcatcggccccctcgccgtcaccgcggccatcgccacgggccccgccggatgggccgtcttcggcgccaccatcgccctgacctgcgtcatccagcaccgcacggtccgcgaccggctcgcagaacccccgttgtcagtggcgcccgttactgtgagtgagcattgatcgaccgtgcacacacggcgaaagcagcacggcaaccaacacggggaaaccatgggggagaacatgacgcgcaccgaccaccgggccatgcgacgcgtactgcgccgggaaatcgccggcaccatcggcctgctcaccgacgaacacgacttccgcgccatgcggcgctaccgaagcttcagtttcgacgaccatcccacctacctccgacaagtggaagcgctcctgcggaccagggcagccgtcggcggccacacgacggtggcgctcttcgaccccgaggagtacgccgaattctgcgcgcgcaccggcctcgaccccgacgccccggccagccgcgcccgctacaccgccgagatcgcggccctcggcccgaccgtcgcctacgacggccggccgctcaccgaactggtccccgtcctcgtcgacgaagccgtccgccaggccacctgggagtacgcctccaccctcctcgcccggctcggcccctgcgcctcctgcggcgaggacatcggacgcgccgccttcacccgcgccgcaggcctcctcgcccgcatcctcgacaccgccccacccggcaaccggcacctggtctgcagcgtctccaccgcaccggaaacgctcctcgccgtactccacgccgacgacgagaacggcgacacctcaggcagcgcctccccgcaccccgacgccacccgcctcgacgaggccgaagccctggaattcaccaccgtcctggccctcggcctcgccacacacagccccggcggactcgtcatgcgcacgaccgcaccgaacacacccgaccgcatctacggctggcgcctgcacggcgacggcctggaaccgctcaccgcgggcgaggtcttcgacgcctactgcaccgacatcgaatcgggcggcctcgtcgcaccggagtccggcgtcgactacggcacaccgcccgacctcggagacgaaggacccacaccacgacaccggccctgaacacgcgaagggcgctccacccgaaggtggagcgcccacacgaccagccggcgaccggcccggtccggaccggcggaccggcggatccgtccgatcactcgccggacagcaccgcctgcgccgcgtcccgggcctcctcggcactgtccgccgcacgcgccgccgcggcggcccgctcgcactgcgccagcgtgtgcttggccagcgtcgcccggacataaggcagcgacgccgcacccatggacagggaggtgacaccgaggccggtcagtacacacgccagcagcgggtcagacgccgcctcaccgcagacaccacagctcttgccctcggcccgtgccgcctcggcggccagcgcgaccaggtcgagcagcgcgggctgccacgggtcctgcagccgcgacaccgcacccacctgacggtcggcggcgaaggtgtactgggccaggtcgttcgtgcccagcgacaggaactcgacctcctgcagtaccgagcgcgcccgcagcgcggccgacgggatctcgaccatcgcaccgaacttcgcccgcagccccgccgcgcggcaggcgtccgcgaacgccttggcgtccgcccggtcggcgaccatcggcgccatgacctcgaggtagacaggcagcccctcggccgccttcgcgagagccgtcagctgggtgcgcagcacctccgggtggtccagcagcgtgcgcagaccgcgcacacccagagcggggttcggctcgtcggcaggcgtcaggaactggagcggtttgtccgcgcccgcgtccagcacccgcacgacgacacggccctccgggaaggcctccagcacctgccggtaggcctcgacctgcttctcctccgacggcgccttcttgtcgtcgtccaggaagaggaactcggtccggaacagacccacaccctccgcaccggcctccacggcggccgccacgtccgcgggaccaccgatgttggcgagcaacggcaccttgtgaccgtcggaggtggcgcccggacccgtcgacgccgccagcgcggccctgcgctcggcagcagccgcctccaactgcgccttcttctcggcactggggttcacgaagatctcaccggtgctgccgtccaccgcgatcaccgtgccctcggccagctcgcccgcgccgggcagcgccacgacggccggcacaccgagcgcccgcgccaggatggcgctgtggctcgtcggaccgccctcctcggtgacgaaaccgagcacaagcgtgggatccagcagcgcggtgtccgccggagccaggtcccgcgcgaccaggacgtacggctcgtcactgtccggcacgcccggcatgggcacgcccagcagccgcgcgacgatccggttccgcacgtcgtcgaggtcagcgacccgcccggcgaggtactcacccgctgcggccagcagatcgcggtaggcggcgaacgcgtcgtacaccgcgcgctccgcggtgctgcccacggcgatgcgccggtcgacatccgcgatcagctcggggtcctgggccatcatggcctgcgcctcgagcaccgcctgggcctcaccgcccgcgagattgccgcgtgccgtcaggtcggcggccacagcctccacggcctggcgggcgcgcccctgttcacgctccgcctcgtccggcgctatctgcttggccggcggttccagcaccgccgtacccatgtgccgaacctcgccgatcgccacaccgtggctcacaccgacgcctcgcagcgttgtctccatgtcacccgtctccggatagtgcggcgggtctcgccgcggtggtcgttctgtgtgccgtcccggggaacggcggggcggtcactgccaggcgaagaggctgtcgccggccttcacatcgccgctgtcgcgcagctcggagagagattcggcggtggcctccagggccacgaccgggcacacgggggacttgccggcggcttcgacggcggcggggttccagcgcaccaccgcctggccgcgcgtcaccgtgtcgcccttgttcacgagcagttcgaagccctcgccgttgagctgcacggtgtcgatgccgaggtggatgaggacgccgtgtccctcggcgtcgacgacgacgaaggcatgcgggtgcagcgagacgatgacaccgtccacgggggcgactgcctcggagggttcccgcacggggtcgatcgctgtgcccgggccgaccatggcgccggagaagacggggtccggcacggcagccagtccgatggcgcgtccggcgagcggggacgtcacggtggtcatgggaagcctcccaggggtggagattcgtatgggccgtcactgcttgtcccggacggcgcactgtgcagcagggtatgtcacggtaagtaccggatccgggcgagagcttacgacagctcacgatagtggtctagaccaccaatcccatcgatttgcacccgctccacgggcccctgtacagtcgtactcctgcctgggggtgagcggcgcgaacacgcgtcctcgacccgagcggaacccaacctgtcagatcctatctctggatcgccttccgcatgctcgcgagacggtggtcaagagggccggaaaagcctgatagagtttggatcaccgaagggaagcgcccggaggaaagcccgagagggtgagtacaaaggaagcgtccgttccttgagaactcaacagcgtgccaaaagtcaacgccagatatgttgataccccgtccgtcggacactgttccgatggtcgaggttcctttgaaaaatacagcgaggacgctgtgaaccgggagaacattccttctcctg

SEQ ID NO: 285 - DNA, 949 bp, Unknown
  Kingdom: Bacteria, Phylum: Actinobacteria, Class: Actinobacteria, Order: Streptomycetales, Family: Streptomycetaceae, Genus: Streptomyces
ctggtctggcgccagaccagccgggtcgtgggggagcaccagcgcgggcggggcagccgcagggcacggcgggtgaggaggtcgtccagttcccgctccagcggtgccagccgggcgtacgtccgccaggaccgccgccactgcgcgagcgggggcccggccagcggcaccaggatgccgaccgaggtgaccagtgcgccgagccccgctgcggccggcgacacgtcggtgctgagcgccgaccagtcgcgcccgaaccaacgcgccgccaccgcgaccgacttggtcacgccgtaacccgcgctgcacagcgaccccaggcccagcagcaccagtccggcgcgcagccagccccgcacgtcgcgggcccagcgcagcgccgagacggtggtgacgctcaccgcggcgatgtgcgcgaccaggtacagcacgatcatctcggagatgaacggcgtcgtcgcgtagtacgtgtccaggtccgtgcggcgctccaccggcgcccggccgagcgcgaacatcgcggcgatgccgaccgccacgcacgcgtacgcgaccacccagcggcgggtcacccggcgcacccgttccccgccccgccagtgcacgacgaggacctgggaggcggcgctgtaggcggtgatcgacgcgtaggtgagcggtgcggcgaggttcggtacgccgctgagccggttgacggcgccgaccgtgggcgcggcgccgaggaagaagcaggcgcccgacagggccagcaccacgcagatcgcgcgcaggtaggggtcgcgccggtggcggacgaggtcgggggtcttcaccgccaggcccagccacagcgcgccgcagctgacgtagttgatcaggccactcatcgccggtgcgccccgcggtagttgagcgcggacccgatgcgtccggcgatgtcctcctcggtgccggtgccggtgccggtgcc

SEQ ID NO: 286 - DNA, 622 bp, Unknown
  Kingdom: Bacteria, Phylum: Actinobacteria, Class: Actinobacteria, Order: Streptomycetales, Family: Streptomycetaceae, Genus: Streptomyces
gacggggacggggcgtacgtcgacgtccggcgggcgtgtcatggtctcgtcgaccccggcaccgagcacggcctcccactccggcggaacgggattatcgcaactggtccgcacgagggcgccctgggcgcgcagcagccgcgcgagtgtgccggtgacgacgagggcgcggggttcggcggcgcagtgcaggctgagtacctgcccggcggcttcctgcccgtacccgtaccgctcaccgtcgtgcaggatctcctcgaccagccggccggaggcggcgccggcaccggcgtcatggaggctgatgttgaggaatccgggcccggtgacggcgacactctcgatgccatcggcggccaaggccatgaggtgtgcgcggagcacatctgcgacccgcagcggggtctgcccggcgggccgggcgagctgcagcgcgatggtggtggcgtagtccccgcacccacccggcccgggcggcgtgaccacgacccgctccggaaccgccacgctcagctcccccgcgtcgacagcacgacgcaccgcgcacagcacggtacgggagagctccacgggggtcacgggacaagcgtaggggaggaggggggcgggtaggcgaacgggt

SEQ ID NO: 287 - DNA, 825 bp, Unknown
  Kingdom: Bacteria, Phylum: Actinobacteria, Class: Actinobacteria, Order: Streptomycetales, Family: Streptomycetaceae, Genus: Streptomyces
ctagggtccgtcttcaaaccgatcttgcccagagcagtagtgacgcgagagtgaccgctgcctcgtatgaggtggcggtcttgtcgtatctggtggcaatgccgcggaagcccttgagccggttgaagcagcgctcgacgaggttgcggcggcggtaagtctcccggtcgaattctggcggtcgaccgccgcggttcccgcgctgcagccggtgccgccgttggtcggccttctcgggaatggtgtgcgcgatgccgcgtcgccgcaggtaggcgcggaaaccgcgggagctgtaagccttgtccgcgatgacctggtcgggtcggcagcgtggccggccgaggccgttgcggggaacgcggatacgttcgagcaggatgcgtgcgcagacactgtcatggcgctggcccggcgtgacgaggagggccagaggacgacccttgccgtcgcaggcgaggtggaccttcgtggtcagtccgccccgggatcggccgagggcgtgatcgtccggttcgtccggtcggcagatcccccttttcggccggtggcggcggcgtgctggtgggcgcggacgatggtggagtcgatctggaccagccagtcgatgtcacccgccgcgtcggcccgggcctggatctgctgcagggcccgggtgaacaccccatcgatcgcgtagcggcggaagcgggtgtagaccgtctgccacggcccgtagcgttcgggcaggtcacgccaggagatcccggtccggatcttgtagaccatcccgttgatgacctgccggtccgacacccgcggccggcctgtcgcggcccgcggtatcag

SEQ ID NO: 288 - DNA, 15666 bp, Unknown
  Kingdom: Bacteria, Phylum: Actinobacteria, Class: Actinobacteria, Order: Streptomycetales, Family: Streptomycetaceae, Genus: Streptomyces
cgaccactacggcccggacgacatcgccgacgagcccgggatgcaggtgcccccgcatccgcacatgggcctgcagaccgtgagctggctgcacgagggcgaggtcctgcaccgcgactcgaccggcagccgccagctgatccgccccggcgaactgggtctcatgacctccggccgggccatcagccactccgaggagagccccaggccgcacgcccgcttcctgcacggcgcccagctgtgggtcgcccttccggagccccaccgccacacggacccccacttcgaacaccacaccgacctgccgaccgtcacggcccccggcctgaacggcaccctgatcctcggcgccctcgacggcacggcctcgcccggcacggcgtacaccccgatcgtcggcgccgacgtgtccctcacccacggaacggacgtacgcctccccctggaaccggacttcgagtacgccgtgctgtccatgtctggcgagacccacgtcgacggcgtgcccgtcctgcccggctcgatgctctacctcggctgcggccgcaccgaactcccgctgcgcgccgggtccgacgcgtccgtgatgctcctgggcggcgaaccgttcgaggaagagctggtcatgttctggaactggatcgggcgctcccaggaggagatcgcgcaggcccgccgggactggatggagggcacgcggttcggcgaggtgaagggatacgacggggacccgctgcccgcgccgaccctgccgacggcgccgctgaaaccgcgcggaagggttcgctgacctgcgggaatgggggacgggctggttgcggccggtcagccggccgccctccgtcgtccttcacaggctcctagcgggcgctggacggctggcgatgctgcaagcccgatacgctgcgccgtacccgtcgaggatttatccatctgcgggtggctgtggcaggacacttgctaaccctttgctgactcaactgacgagtcatcaagtgtcggtggagtccgtggcccacctctgccgttggtggcgttgtcgttgcaggctgggtgaccatcggaccacctttgcaccctcagtctttcgaagaaggaacacgatggagatcgagtcccgagaggacatccctgtcctccttcaggaaatcgttcccgaggtcggggatgtggcggcaggggcttccatggatctgtacgatttcctgaaaaaggttttcgtcgaaggttttcttgttcctcggcttcgatccgcggatgatgcggggggtgacgttgtgaaccggtgtttccggtttgtcgaagttctactgtcgagtcccgttccctctattcggtctgcggcggccttccagatcatcgagccgctcttcgacgatgagcgactgttgctggccgcctttcccgtgatgggggagaaggcgctggccttggctgtggacaccctcgaccccgaccgcatctccgcggctgcgcgatccgcgctgcggccgtatctgtgagcgtcaacactgaaaacgctcactgaactgttttcatcctaaatatgtgcaggtcagcagggtgtggacggcttggacggctgtgccgatgcggcgggtggaacagcgggctcgccgcaggagccgccaggttttgagttgggcgaaggcgcgttcgccgggggctcggagtcgggcgtggtcgcggttgaactgctggtagtgctcgggttgttcgctgtggtggtagtacggggtgcggaaggtggcgccggcgccctggtaggcgcggtctgcgaggacgaggatctgccgggtgaggcaggcctggacgatgccgtgggcgcgggccgcggtgaggtcgtgggtgcggcccggtgtcgcgggggagaaccaaagcggggtgccgtccgggcgggctacgacctggacgttcatgccgtgcttgcggtgcttttgggagtagtacggctcgtccgcggcgacgcggtcgatggggatcagcgtgccgtcgacgatgacgaagtctccttcgcccaggccgacgagagcctcctggaggcccggtgcccaggaggccaggacctcgagggtctcgtcgacgtaccgccaggcggttgcggtggagatcccgaagccggctgcgagctggggcagcgtctcgttcttgcgcaggtgcaccagcgcgagcaggcctgatggaagcagcccagcttgcgccaccgtgtgccacgttcacaccttcgggcatagatgagccaggagacgtgctcgaccagctcatgtgggacgtcaagcgtggcacgatacgggaccaagcgaggctcctcgggcgaagcgtggtgcgtagagaacaccaccgcaacgaccaggagcctcgcctcgtcacaccatcccgctgacctgccccctcacccctgcaggacaggatgaaaacggttcactgaacccttctcaccctgtggttcgcgggtgagggctgctggtggagggggtccgtaacgcggcagggctcctggtcgttgcgctggtgatctcactcgccaccgtctcgacacaggagccctgttggtcccgtatcgtgccatgctcgatgtcccgtatgagggcgttgaacacgtttcctggcgcatctacgcccgaaggtgtgagctgaactcccgctggcgcaaactcggctgcttccggcaggccctgctcgtcctggtccacctgcgcaagaacgagactctggcccaggtcgccgcagggttcggcgtctccaccgccaccgccggccggtacgtgaccgagacggtcgaggtcctcgccgaacacgctccgagcctgcacgaggctctgcgcgagctgccaccggaagggttcgtcatcctcgacggcaccctgatcgccaccgaccacatcgcggcggacgagccgtactactcgatgaaacatagctgccacgggatgaacgtgcaggtcgtggccgcccccggatggggcaccgctgtggttctcgcgggccctgcccggccgcacgcacgatctgaccgcggcccgcgcgcacggtgtggtccaggcctgcctgtcccggcaactccttatcctcgccgaccgggcctaccgtggagccggcgtcactgtacgcaccccctactacggccgggaccttcccgagaagcacgcccaattcaaccgcgaccagcccgcctgcgggcgccgggagaacgtgccttcgcccgcctcaagcaatggcggatcctccgcaaagcccgctgcagtaccaataggatcggccgcacggttgccgccgtccacgccatcgagatcggctggcgcccagggtgataagcgttcagtgagtcctgctggaattctggattccatgttgcgttagcagcgggacgatcggctgatctttggcaatcgtgccgtccgccgggacggaccgttggactgaggtccggtgcaaggagccggagaacctgcctcgcctcccccggggggggggcgtcgccgagctcatcagtctgctcgcgcccggcgacgcccgacgtctgcggtggtcaggccgtgttggagcggatcgaggtgatcacgacggatgtgtagggcatggtggcgtggccgccgagcttgtcgatcgcggtcccggcactgtccaggacctccgccattttgtctgcggggagctgggtgaggccgccgaaggtggggagttggtcgagccactcctctcgggagtaggtgcgttcccagctgaagcgccactgttccggctcactgaagctgccgatctgccggatcccgtcggcgattttcgcgaacagtggctggtatgcgtccacggccgatcctctcagcaggccggggttgaacggggagccgggcgcgacccgttggagggcttcggcgagggcgtcgatcacctcggccgggagctgggggacgtggtggaagggagcgagccggccgccgggccggagcacctgggccgccttggccgcgccggcgacggggtccacccagtgccaggcggtgccggcgatgaccgcgtcgaactgccgcccggcaggctgccagtcctcgaaccgggcgacctcaacctcgacacggctgcgtcgtgcgaaggcggccatccgctcgtcgggctcgacaccgagcaccgtgcagccggccgcctggaattgccgggcctcgatgccggtcccggctcccacgtcgaggacgtgccgaccggggcttgccgcgacgatcctgtccaccagggcctggggatacggcggtcgggcgcggtcgtagcgttcggcgtccacgccgaacgactcggccgtctgccggtggcggtggggctcgggtccgggtccggatgtgtccggctgtccctgcgataaagtgggcatgcgcccacactaatgggcggttgcccacttgttaaggcggggcggcgcggaaagggagacaatgccgtcaggggtgcacatccacaacgtgcgcggccagttgttcgaagccgccgagcgcgtcctgcttcgggacgggcccgacgcgttgaccagccgggcggtcacggaggaggcgaactgtgccaagggtgtgctgcaccggcacttcaccgacttcgacgctttcctggcggacttggtcctcgaccgcgtccgcggcatcgaggaccggaccacgactcttcgcgcggccgccggcaccgggagcgtggtggacaacctcgccgacgcgctgcaggacctgttcggaccggtcacggtggcaatcgtcgcgctcatcaccttccgcgacggcctccgcgcccgactgcgcgaggccggtctgaccggcatcccgctggccatgcagggcaccgccatgatcgccacatacctcaccgccgagcgggagttggggcgcctggccggtgacgccgacatcgacaccctcgcccccacactcgtcggggccgggcacctgctgttcgccgaccggacaagtgccccgccgcagaccgccgccgtccgcaggatggtgaccaccgtcatcgccggcgccttgcgaccaccccagtcgtaggtcgggccaccggtcaggtgacggaggatcgcgctgcgtccaagccggatgaccgagaagttccgggcactgaccaccaccgaccgcaggtgctgccaacgccacccggaagattgctagccgacagccggagatcgaccgacactgctaacgcgaacccggaacctacagcacgggcgacagtcgattgggccgatccgggtcggtgccgtacagttcacggtaccgacgcggggtggagcagctcggtagctcgctgggctcataacccagaggtcgcaggttcaaatcctgtccccgctacttacttagatgtgaaggcccggcatccaccgggccttcactgcgtgggggccggttccgacctcttggcgaacaggttctcggcacctaggccacagcgggcgtcaacgtactgggctgagccgaagccgtaggccgcctcggcaatcggaccccgcgacctggcgcaggtcgtcgggcgaggcgccgtcgagcgcgatcacggcctcccacggtacggactgccgggtgaggctggcgtgcatgtcggtcaggtagtcgagccggtcttcacgcaggtggctggcgatgacgacggtgatcaagggcttgatgtgtgggggcaggggaggctccggaaagagggggcgcagttagcggcggccggccgggcgcggggtggcggccttcgtcggggctgcggcgggagcgtggaccgcggcgaggcggtacgaggcccgggctccgggcggccgggtggtcgttgaaggcggtgcgtgggtcgatggcccagtccacgaccgggccgttatccgcgtggaggaggctgatcacctcgatgccttcctggtgcaggacgtagccctactgcatgtcctgcgcgtcggcggtcttttcggtgaccgacatgcgccccggtggcgagccgtcaggagtgatcaggtggtcgagggtgcggctgggccagtggtcgccaccggtcagcgcggccacgggcgcgggcggggcgtcgtcgaggaggtcggtgcccagttcgtccgagccgacggcgacgtcgtcgatcaggtgccgggacatggcctccacgtcgcgtccgaacttgaaccggcaggcggtcaggaggagggggaggtggtggctgggcatgccgtcgagctggacgtgaatgccgctgtacccggtgccggcggtagggcgggcgatgaaggagcgagtggacagacagttctccggaacgagcaggggcgggagatgttcggcggccatcaaggtggcgcgggtgcgcctacgcgcggtccggccaggagcgaccgggggaccggaggcgtcggtgcaggcgcaggtgtagccgatcagccgggacggttcggccttcgcggggacggtggcggcgtcgttgcacacgaacgtgtacgtgacggaggtgcggggcacatcgtggagccaggcccggtcgtccttgccagggttgatctgcaggcccgggtgtgcgacggcgtcggtctgggtgtggcgtgggggagaagaagatcagcgcaccgccgtcggtggtcttcagggcataggcgtgcgtgtagcggttggccgcgccggtgaagacggcggtgccctgatccccgtagcgggtgccggtcttgtcgtggacctcgaaccgccgctcgctcgccttggtcggctcgaagaccttgcttccgctgttcgtgcctccggtggcgaagttgtcgagcaccgctgtgcgcagcacgtcggcgtcggctgccagatgcttgttgccgctggcggcgacggccgtcgcgtacccgtcccggtcgagggcgatggccggcggcttctggctgccgaggtcgacaatggagaccatctcccagcgcttgtgctgggggcgttcggcgaacacggcgagtcgcgagggggcttgcccttctggtccgagagagcggcggcgaaccagcgttcctgcccggcggccaggcgggggatgtacagcttggcgttcgcgacgtcgtatgaccacggttgtatggcttgcgatccgccgtggggagtccttcggtctcggtgtagtccgagacggacatcgcgtacagcgggccgtcctcgaccgtgtcgagcaggcgccggtcgcggtcggcgtcggcctcgttgttgatctccgagtagcggctgatgacgccgcgggcctgggcggcggtgaggaccggcgcgggcttcacagcggtgccggcgctggggggctgccgggccttggcggtgccgtgtccgtcagcaccatgcgccgcagcagcctcccgtcggctggcgcctgctcgggctccgcggagttcgatggaacgtacggcggtgtcgccatgctgcgtgaacaggctctcgccttgggcgtcggggttgcggcgcggctccaggcaactgttccccgtgctgggacagtcatccggctgggagcgaccaacctctccaggatcacttgtgcccccttgaagctgtccgtacgggccagtggtagccgtggcggggagtgaggacgccctcgccgtgagttgcactgtgcaaggctatgcgtactgcgttcacctctgctttccgcagggttccagtgatcgcagcgagggagctggcggcttggtgggtctcgggggcggcgccatggcgtgccagtacagcgagcaccgccgacagagcctccgtgggggcttcggagcaccacacggatgcgtgtgctctggttgatcatcgtagtcgggacgcttctcgtcgccggcctcctgacgtacctggagcaacattgcggaagcaggctcctgtagggctgagcgcgccccacgagtacttctcgacaggatgcctgcacggcgagcacacctgttgccaggcgatgaccgggtaccagggtgagaagcggcccggccgctgccaattctgcgacgcgcagtgcgtctgctcctgtcacggggagggcgcacggtgagcgcaggatgatgtgcgcagcacgcaaccgagacgcacacgtccaggaggccctcacacacgctcctcggagcggcggtcagccgttgtgacagagctgctgatctggccccaccacctgcacgccctgatgcgcgccaccctgcgccgcaggcgaccacgcgtcagcccacatggagaacgcgctgtgagcgcgagcgtcaggtaccctgcgcggcccccgaacggtggctcgcgcggtggcgggtggccaccgaaggagctcaactgggccgcctcggtggaccccattcttgtgcgcacccctcagcgcacgggagggcctgcccccaagggaggccctcccggcgaactggtcgatctgatcgcccaatcaagatcgattgaagccacgaccaggcgtgccagtctcagctcccgtgcgttgcggccgcctcgcgcctcggctcgtcggtcgagttcagctccggtgtggggcgacggaaaccgcgggtgagccagagcaggtacgcgcatccgaaagccagccagcatccgccgatggtgagggcgacggtgctcagctgggtcatcagatacaccgtgacgcaggcaccgagagcgggcgcgacgacgtaccccaacaccgtgacgccgggcgcgccccggtggcggacgaagtggacgatgacgcagacgttgaccacggtgaagccgaggaaggcaccgaagttgatgaacgaggtcgccgtcgccacggagatgttcaagcccaccaggcagaccgtcccagtgagcagcaggcacaggacaggcgtgccggtacgcggattcagcctcccgaagaagccacgaggcagcactccgtcacgacccatgatgaacatcagccggctcgaactcagctgcaccgcgagcccggaggcgaagccgccgacgatcgcggccatattagtccagtcagcgaacgtctggccgccgacctcgatggacatggtgtacgacacgatctccggatcggcgaaccggccgccggggtgcaccagttgcatgatgtacgccaccgcggcgaagagcagaccgccgatcgccaccaccaggacgacggcgcgcggaatggtgcgctcggcgtcccgcgtctcctcggacagcgtcgtcacggcgtcgaacccgaggtacgagtaggcggcgacggcggccgcgaccgagatcccgccgaggctgctctctgcgttccagaccggcgcggtgtacgacgcgggggcgtggtgggccaggtgcacgaggcagtatgcgacgaacaggagcaccaggaagaccgcgaggccggtcagaagcttgttgacgcggtcggtcagagtgagcccgatgatgttcacgagtgtcgtgagacccgcgttgagcagcagccatgcccagacgggcaccgcggggaactgcgcgtgcagatacaccgactgcaccagccaggcgaccatcggcaagaagaggtagtcgagcagcaccgtccagccgacgaggaagccgacgggggacccgatcagcttcctggcgtagaagtacgccgagcccgaggcggggtggtgccgggccatcttggcgtagctgagagcggtgaggaacattgcgcaggtcgcgacgaggaacgcggtcggcgcggtaccggcgctggccgccgagatcactccgaagatcaccatgaccaggctgggtgccatgtaggcgagaccgaaggtcaccaccgaggcgagcgagagccgttcggagagctgcggctgcggggcggtcatgccgtcgtcccgtcggtggccgtcgcggcgccacccgtcccgttggcagtcggcgcggcggtggatgccgcgctcgctgccgggcgctggtgcacgaccggtccttcggggcgcaggtcgtccggggtctcgggagagatcgccggacgccaatcggcgggttctatccgcccgttgtagagcggcagctccagcggggtgtcgtcggcggtgaagaacttccacggccaggagtcgccggacgtcccgaacttccgtgtggcggcgacccggtcgaagtcgacgaccccgacgagggtggcgtcctccatgccgctcgtggcgagctggatgtgaccctcggggtcgacgagcaggctctgcccgtgggctgtggggctcgctccgttcacgctcgccacccagacctgattgacgatggcgttcgcctggttgatcgggagttcctgcgctcggcccgtcgtcggggtctggaccacgttgacgatcagctcggcacccatccaggcgaggtgccggctgacctcggggaaccaggcgtcgtagcagatcgacaggcccacccggccgtgtcccggcatgtcgaagacgacgaagtcacggcccacgcaaaccggttcgtagggccgccaggtgaagattttccggtaggccgcgacgagttcgccggccgggttgtagaccacggcggtgttgtagaccttgccgtcgtcggggtcgcgttcgaggacggtgccggggatcagccaagtgccgagttcgcgggcgagcccggcgagcaccttgccgcgcggcccgtccagcggctccgcgtaggcgtcgtagacctcctgcgtcgacatcgactcggtgttcgccgagtacaggtgcgcctcggggtagaccacgaggtcggcggcattgggggacttcatgcgcagccgcagaccttcggcgaactcgtcgagggactgggcgggcgcctgaacaagggccaggcgtagatgccgactcatgagggtcctcactgtgcggacggggcggggagtgacgccggacacagaacctgaaaatcagcgctgatgtcaacggtgttgtcatcattgatgtgggtgggcgtcccggtagctccggtcgttgctagggtcgtggtcgacggaactgaggagatccatggcgaagaagacggcgggcgcgggggacacggccaggcggcccggtaggcgtgagcgccggacgctgaggcaggaggccgccgtaaacgcggcgttccaggtcgccgcacgcgaaggcgtcgcggggctcacgatgcgcaagctcgggcaggagctcgacgtcgacgcggccgtgctctaccgcctgttccgtgacaaggacgagttgctgctcgccctctgcgagcgcatcatcgagctgtccctcgagcagatcggcgccgtgtccgagggggagccgtggcaggacatcctgcgccggttcgccgaggccacctggcaactccagacccggcacccggcgatcaccgtgctgaccttcgcccgcaccaccggcggcccggccgagcgcagaatggtcgaactgctgctctccgccgtggcccgctcgggcctgccgcccgaccgggcggtgctgttctaccggactttcgtggacaccgccctcggcctctgcgcccacgcggcctcgctcgcctcgctggaccccgaggcgcagcagaccgacgccacggtctgggcccgcgtctacgcccgtctgcccgaaggggactaccccgcgacccgcgcccacatcgacgcgctgagcaacgtcgacgagaaggcgctctacgacaacgcgatcgaggccttgctggccgcaggggagcgggaggctggcaacggcggagcgtgacgaccgtttccctcagagggcaattcgctgagacccaacgccctcttagattcactgtcacggaggccaaaaagctgagttcgccgtcaaacgactcgattggatgacgaaagacagttcgccgggggcagacaggaaagagcgcggaaagactggccaacgtgtgtgagggccagagaggtgattgcccgtgaccgtggctcccgtgagccctggtttctccacgactgtcgaagccctgcggctgcgcgagtggcagctcggtcccggccaggccacgctggtcatggaccaggcaaagggcgacgaccctcggcacgcggtggtgctcggccatcgagcgctggacgacgccggcaggctcacctcgtgccgggccgccgacgaccggagagagctcgctcgattcgtgggccgataccggaagcttcccgatgccgcagacctgcgcgagcacatcgcggctacggtgcaggcgtgaccagtccatctacgcctacccaagccgtacttcaggcggcgtgccgcgccgctggcctcaatgcgactggcgccaaaccgatcggcctcgccgaaaatgctatctggcgtcttccgcaggaagtggtggcgcgcatcgcccagcctggacagtccaccgccgcgacgcgcgaggtccaggtcgcccgctggctggccacacaaggcgtgcccgccgtgcgcgcccttgacctgcggcagctcgtagcggccaacgggcacacggcgacgttctggcatgagctgccaccgcacaagctcgggaccgttgcagacatcgtcgtgctcctcaagcaactgcatgccctgcctgaaccagatcttccgctcggcgaactgaaccccttcgtccggctggccgagcgcatcgacgcagcgagcacagtctccgacgatgaccggcagtggctgcaccaccggctcgaagacctcaaagcccagtggctatcgaggccgaagggcctgccggagtgcgtagtccacggggacgcatgggtcggcaacgtggcacgcacggcggccggcccgttgttgatgggcttcgaacgcgcttcgttcggtccgccggagtgggatctcgtgtcgactgcggtgaagctcaccaccaccggtgcggtgactgccgaggaatacgtcgcgttctgcgagagctacggcgccgacgttacggagtgggagggggacgaactcttcgcaggcgcacgcgagtcgcggatggtgacgtacgccgcacagcacgccgctactcgcccggagtggcagcgcgaggcgcagcaccgcgtcgactgcctgcgcggccgggccggggctccgccgtggcggtggaaggggatcatgtaatggggttcccagggcggtccctgccgtgagcgggagggcgccgtcaccgtacccgcggtggcctcgccggtccacgcagcgacgccatcccgtctgtcagccgggcacaaggtcgggggaacaagtgcgcttgggagaaggactcgctgtgttgtctcctctccgtgctgggacggtccaggaagagcagtgcacgctgagcggggatggagggcactgccgactcgattcgtcggggagcaccaactcgtgaagcaccacacgaggccacggcgtccagcggcatcgacagcatcggcagagtcatcgccgcctgggccttcactggtgagctctccacagccaatctgacgctgttgcctcctcccggtccgtgacgcaccgtcgtccgcagcaccacgcaccaaaatccgcaacgccgccccagactgtcagcgagttgctcacgctgatcgaccgcgagcatgcagccatcctcggagatcccttcgagaccgcccagacactgctcgaagccgttggcgccggcgacgcggctacctgcgggcatcgggcaccggtcgccccgacaggcatcgagtagcagggcaggccgcggccgaggcggcgctgcgctgcctgcggtgcgcaagccgggggatacggacacggctgccgacagcagccgggagagcgagctgacaaaggccacttcctgatgttgtgcttacgcctggcaaaggtaaggtcaaggtatggcaatcgcttggtctttggtccgtggcggtcggccatgcgcaggacgaagtcgtcacctcgggcttccggaactggcgtggcggcccgggctcaccggaacccaactgatcggcaggggatgtcatgagcaacgcgacgagctaccgcacgcaggccgaggaactgtccgagaccggcgcgccgttcgagctgagcgccgtgccgatcgaccccaaggtgatagtgaagctcgccgaggtcagggtgccgatccaccagtcggtcctcctggggtgggtggacgtgcctcccggcgacccccgcggggcgaccaaccacgcggtctacctcactcccggtggctatgcctaccgggtcacgacctacctcggtgacaaccggagcaacggcgtggactccagctgacccacagtccccgcccagatcgacggctggatcgcgatcggggaacggcgtgaggcggagcagcgccgggcatggagatgcggcctgccccgccagactggctgatccattacagcctcaaccgcaccagcgtggacgcgatgcgcaccggcgacccgctgggcggcgaccaagggcggccggggccgcccggcaacccggcagcaggcactcgacgccctgtgacaacaggtaacgccgtacctccactgtcgaccgctctgcatcgacgaactcggctgtgcgccacgaggcgctgaggaatcgagtgggaagaggagcccaccaccggggaaagtcatgcttcgcgtcgtgcaaatggtagtgacggcgtctgaatcggccagctactcgaaagagtgcacttctgctggtgagagtgttctcatctgatcattgctgaggtggcgtgaccgcgtggctttacgggtggccgcgggagacgtgctgggctgtgaccgccgcactgtgtgcgtcgtgggcgttacgggcgatatcttgacgatgaaatggcgctcgttctgatggagtgacaggcccatgttcggcgggccagaccttggcaaggtggcgagcgctgatggggcgacgagagcgggcgacgctgagtgcagaccgactcagtcctgctggtcagttgtcccggaagagaacaggcggccccgtgacctgctgcgatgcttagctgcgggacactgacctgcgaggatggtctttcggctgtttcacggtcatgcccgttgatgaggccggaagtcccagaaaagtcccaggggttgtcagtcctcctcgggatcggccgagggcgcgatcgtccccttcgtccggccggcgcctccccctcttcggccggtggcggcagcgtgctggtgagcgcggacgatggtggagtcgatctggaccagccagccgatgtcaccggtggcgtcggcccgggcctgtatctgctgcagggcccgggtgaacacgccgtccagggcgtagcgacggaagcgggtgtagacgtctgccacggcggtccgtagcgttcgggcaggtcacgccaggagatcccggtgcggatcttgtagaccatcccgttgatgacctgccggtctgccacccggggccagcctgtcgcggcccgcggtatcagcggatcgagcaactcccacccctgatcagtgagttcatggcgacgcatcacgccaccatgatccaccagccgatgatctttgaagacggacactaaacgacgtcccgtaagccctgatcgggcatgtgatgatcttggtgtgggtgcggtggtgacggcggctgagccgcagtgggtgggcctgttcgctgggctgaacggacggcagttccgcaagctcgtcgggctcgtgcggcgccggggtggcggcaaacccaccggcggtcggccgtgggccttgtccttggaagaccgcatactgctggtggcggcctactggcggacgaacctcacgatgcggcagctcggccccttgttc

SEQ ID NO: 289 - DNA, 4029 bp, Unknown
  Kingdom: Bacteria, Phylum: Actinobacteria, Class: Actinobacteria, Order: Streptomycetales, Family: Streptomycetaceae, Genus: Streptomyces
ggcccgggtgaacaccccatcgatcgcgtagcggcggaagcgggtgtagaccgtctgccacggcccgtagcgttcgggcaggtcacgccaggagatcccggtccggatcttgtagaccatcccgttgatgacctgccggtccgacacccgcggccggcctgtcgcggcccgcggtatcagcggggcgagcaactcccactcgcgatcggtgagttcatgacgacgtaccaccccaccatgatccacgacctgatgatctttgaagacggaccctaggctgcggatgtgcccgagcggatcggcaccggtggtcagcagaagaccagcaccgagcagcggaggacgctgagggtctcggatgtgtgggcggccagttccgtctcggcgatgcgctcgtccatctcttcgatgagcatgtcgagttcggtgagttcggtgagttcggtgagttcggtgatgggcatcggctgcctccttgggtcttccagtgggtgatggggatgtacccggtctccgtctgacgaaggtccctcacaggtgtaagggaggggcaccaccgcgtgttccgtccctttgcacgcacgccctgcacgcgagaagggggcgccgtctgcgagagggtcgtgctacgtacggtggtgaccgtgacgacgccccctgactctgctgctcccggtcctgtgccggtgcgggttgtgttgcctgccgacccgctgctgggatatcccgagcaggagatcgtggcgcggttgtggaggcggcggcagaccgagaccggctgggtgttcctggtgggcctgccctcctacgagggcaacgaggacgggaccgtgcaggccgcagagtaccgggtctgggtccgcgcccccgagcacgtgcggccggtcgacggcaccgactacgaccaggtccccaccgaccgcttgaaggtaccgacgccaccgtcggccgtccgcgagatcctcggcgagcgccggcccaccggctgggtggtgcagaaagtccgcgcccggcggggcccggcccggcgtgtgctgcacgcgccggactgcaccgaggcgccgcccggcgccccggtgctcgacctggaacgcgccctggacgtcgcggagaacccggcgacgaccttgtgcactctgtgcgggtgcgcgcaggaactcacgccgatgctgagcggtttcgaccacgccggcgaagagccggatccctccgcgtaggccggggggctaccggcgggcgagtgccgtccttgctcgcgtcgaggcaggcggtcacgacggctcgggccaggccgccagcacgcgccggtggtctcgtcgaccaagcagacgcgagcacgtggcaggccgccgtactcgcccgcggtgaagttcgctgctgatcccccgccattcggcctggccgatggcccaggtgccaagaaggaccagcacttgacttcgtcataacccgcttagctgtttgggcctactgccgcgccgtctacttgctgcgactccaccgccctccccggcaccaggacggcaagcgtgctgcgcgcttcacgccgcagcgtgcggcgtgaagcaaaggtcgcagtaagagcgaggaccgagacggtgcccccgtagaacacagcagcaatcgtggagaggagcccgatcgtcatcgggcacgcacctttcttcccccgttcggcccgcccggctacagcccggggcgggcgttgatgcgtttcctctccaccatacgagtgccgtcaacccctgctttcaactcatcgatgtctcccgcccagccatcacgcgggacccctccccaccagcccatgcggcaagacggcccgtctgcgctcggtgcctgcccccggacgtacgcctggcccacccggcgaaccttcgcggtcacagctagcattgcgaaacgagtgagagatcctgctggctacggaactggatgagctttccttgtcgagtgcgctcctgctgccctgaggatttcggcggtgtcgggatgggggccattgtccgcccagtccagcggggaccagcctgcgccttggtcttcgcggaggttgggatccgcgccatgcgccaacagttcccggaccgttgcggtgtgcccccagcaagcagccgcgcacagcggtgtgccctgcgagccggggccactgctttcagtgtcgggggaagccccggcctccatgagcagacgggccacttcggcctctccctgcaccgatgccaggtacagaggagtggtgccgtcagcgttccttctctctggacttgccccactgcgcagcagggtcttcgcgctcctggcgtcacctgacaggatcgcctcgaaaagacggtgggagagcttcttctgctgccgctgcttcacagcgggcgaggctagcgatcacgggtacgccagagccactcaaatccattcgttgatcatttggccactcacatcgttgcccaatcgaacccgatcaagtccgccctcgacctgatcgccagtgcataatgcgactggtgagcggcccgccgtccccccgtcggcgggccgctccccgcatgcccaaggacctccggtcaccacggtcaccgactcccggcaagctgctcccgcggccaagaatccgcagccgctgacctggacctgaccgtctgatcacatcagctggcggcccgccggatcaccgccctgatcatcggccaggacgacagccgccctgatgcgcttcccgaccggctcgcggtgcacctcgaagctgcggcagaccgccacgacgatctccagaccgtgccggccgacccgggccgcgtccggcgccaggatcagcgggaccgtcgtgctgctgtcccacacgctcaccccgacggcgccgtcgctgacctccagcgtcagcaaacacgggcccggagcgtacttgcgggcattggtcaccagctcgctcaccaccaactggaccatgcccatcgcccgcttcgacaccggcaacccatacacagcccccaccgaagtcaggaagtcacgggccaggtcacgggccgcggcaatctcctcgctgcccccgaacgcagcagacaccgataccggacgctcaaccaacggctgccgaccctcaccctcccccaccagccccatacactccgcctcacgtccgaagcgcgccgccaattatccgccgccatgtacccccggaacgccgccacactccgcacaccagaagcgcaccgggccctgccgcggccccgccgacccacccaaccgagaacggggaagggccgctcgacctccccaggtcacggcccttccccggccagcgccagccgcctacccgggcaattcggatgcatgcgtagttgctgcccttcgcgccatcgcggtgttcaggcgatggcgcaggtcctgcccaagaggctccctgcccgtcacggccgccaaaatcatctccgcaacgaaacgcacccggatgttgctgtgctgggacacctccaccaagatctcccacgactcctccatcgagcagccgagctgagccatcaggatcccccggaccacatcaatccggggccgactctccatagcccgcttcagctgctcgatctccttctgcaacagcatgatctgcccagtaccggactccgccggactgtcacccgtgtcctgcggagcctcagcggacggcgggactgcccccgcatgctgctctcgtatgtcctgggaaggtcgcatacaagacgcctgccccctgcccccagcgacacacaggtgatccccctaactccggcccgcccacctcacacggccccacagcagaccaccaccgaaaaagcatgaagtgcaggtcgagagcgactgctccgcgttcagtacgggccgccgaccacccagcagaagagcgagcagcagaccgagacctacgagaccgcctggcgcgcctggcgcgacctcgcccgcgacgtccaggccgccatcaccgagcacgccgcgacggagggacagtcacgcaccgaggtcaaggccggcgtgagcttgtcgtttaacgttcgg

SEQ ID NO: 290 - DNA, 6211 bp, Unknown
  Kingdom: Bacteria, Phylum: Actinobacteria, Class: Actinobacteria, Order: Streptomycetales, Family: Streptomycetaceae, Genus: Streptomyces
cgccgtgttcgtcggcggcggcaactcgttccggctgctgagcgccctgtaccggacgggtctgcgcgaggcgctgcggcaggcggtgcacggcgggctgccttacatgggcgccagcgcgggcaccaacatggccgcgcccacgctgcgcaccaccaacgacatgccgatcgtgcagccgccgtccttcgaggcgctgggtctggtccccttccagatcaatccgcactacctggaccccgacccgcgctccacgcacaagggcgagacccgcgaggagcgcctgacggagttcctggaggagaacgacgtgccggtcctggggctgcgcgagggttcgtggctgcgggtggcggacggccgcgccacggtcgggggcgagcgcccggcacggttgttctcgcgcggcaccgctcctcgggagatcgccacgggatcggatgtctccgaactgctcacggtgtcaccggtgttcgaccgagggctgatcgcacgctgacggcgaagacgaggatctgtccgcgcgggagggtgaccgtgcggacgatctcgccctcgggcctgcggcggggtcggccgagggcggtgcgcgggacccggatgcgttcgagaagcgggcgtacgcagatgttgtcatgccgccggcggcgtcagcctggccctggatgtgctgaagagcttgggtgaacacaccgtccagggcgtagcggcggaagcaggtgtagaccgtctgccaggatccgtagcgttccggcaggtcacaccaggagatccggtgcggatcttgtagaccatcccgttgatgacctgtcggtccgatacacgcggacgtcccgttgtggcccgcggtatcagcggagcgagtaactccctctccagttcggcgagttcatggcgacgtttcaccccaccacgatccacctttcggtgatcttggaaggcggacccgagatgatcgattccaaggggggagtggtcgatcacctcttgacctcaaccgcgcttgagccagcaccgtggttcacatgaacacggaatccactgcccccgcggccgacctccgagtctgctgcaacacccgcgccgaggtcctcagggccgaagccgtcaccgctcccgagcagggcccgaagtgccgactcaccggaggtgtctggtactccccctacgacgaccgctacatagaaggacccagcggcctggacatcgaccacctcgtcccctcgccgaagcctgggacttcggcgccggcacctggacgcccgcggagcgcgaggcctacgccaacgacctcggcgacgaccgcgacgacctgatcgcggagtccgcagcatcgaaccggtccaaggccgaccaggacccctccacccggctcccaccggccgccggctgctgcacctacgtcaccgactggatcgccgacaaaacccgctggagcctcaccatggatacccccgaacagaccgcactggcagagatcctcgagcagtgccccgacacctcctgctgaggtccgtggtcgacggggggcgcaaacacgtccgcccgggccggagcggcgaggccgtcgcgcagtgggtgttcgagaacaacgcacagcatgtctatgggcctgccccgtctcaaccccacggagtggagtgtcggtgcggttcgcttgctgctcgggacctaccgctgtcaccccgtggtggtgaagcgtttccggtactgggtcggtgtgatgcccatatggcgggcgaaggcacggcggagggtctcgtcggtcccgagcccgctgtggtgggccgccgaggtcacaccgtgtccttcgaggagcaactgccgggctcggtcaaggcggacccgctcgacccagcgtgcgggggtggtgcccagttcggcgcggaacagccgggccagatgccgagggctgacagcggctgacgtggccatggccagcaggctgtggtcggcggccggatcggcgagcaccgacgcgatcagcgagcgcagcgggtcgctgcgggcaggcggggtggtgatggccgtggagaactgcgactgcccgccggggcgttgcatgaaaaccaccagttcgcgcgcgacggccctcgccacgtcggagccgcggtcgtcctcgaccagggcaagtgccagatcgatgcccgcgctgatgcccgcggaggtgaggtaccgaccgtcacggatgtgcatggcatccggctcgacacgcaccttggggtagcggcgggcgaacgtggccgcgtgccgccagtgtgtcgtcgcgcggcggccgtccagcaggcccagttccgccagcacaaaggcgccggtacacactgaggcgacccgtggcgcccgctcggcgagagcacgggtctcctgcagcagtccgtcctcgatccgctgctgggcaagccggtcgcctccggcgacgacgaccgtgtcaatcgggcccgcgtcggccgctgggactgtgccggtcagcgccagcccggcggaggtggcaactgtcccgccgtgtggggagaccagcaccaactcgtaggagggagcgagcctgctcgcctgatggagcacctcagcaggaccgctgacgtccagcatggtcactccgtcgaagaccacaaagccaacccgatgcgccatgtcccaatccgtggttttcctggcagcaaggacatggcccagtctaggacaccggccgatcctggaggcagatcaccagtcctacagggagacagacaaatgacgagcaggggaatcgcagacgtggagatcccggacaccgcgctggtgcgggaagcgaccgacctggtccgcgaggcggccccgccgctcctgtttcaccattcccggcgggtcttcctgtggggcgcgctgctcggccggcagcagcggctgagcttcgatcccgaactgctgtacgtgggtgcgatgttccacgacctcgggctcaccaagggcttccgtcgcaccgaccagcgcttcgaggtggacggcgccgacgaggcccgccgtttcctggaggcacatggcatcaccggtgagccggccgaccgtgtttggacgagcatcgcgttgcacaccactccggagatcccgctgcacatggcgcctgagatcgccctggtcacccgcggtgtcgagctggacgtcctcgggatcggctatcacgcggtctccgacgaacagcgcgcggcggtcgtggcagcgcacccgcgcccggatttcaagaaccgaatcctcgacgcgttcaccgagggcacccaggaccgtcccgatacgaccttcgggaacgtcaaggcagacgtgctggctcattacgtccctggcttccggcgtaccgacttcgtcgaggtcatcaagaactccgactggcccgaatgaccagggggccccgccccggctgcaccgagtcctcctccctccccggagtggggctcggcggccctggacagtccaaggctccgcaggtcgtcagggcgagccactccttcaagcgcgccgaggatgtgccgcagttcgtgagactgaggcgtgtgtcatcgccgtgatgtcattcgaaattggccggtcaagaacgcggcctgtgccatgggcggcgagatcctacgattgtgtgggatctcaagtgtcgcgccgttttctccgccgctgtctcacgcccgtgtcatgcggcaggtcagcagctcgcgtcgaacgggagcgctgaggacatgacccgggagctgaggcgactgccggatgacatggcgtgagacgcttaacaaaaccgcaggtcacgacctctgtggatgacacggcgactgagagcctgctgcggggtgagggccacgagatcctggacgaggacgtggtgcgactgtcgccgctgaagcacaagaacctcaacgcgctgggttctctcgccagtccaggagcgttgcgggactgctcagatgtggtggtgcgacgggttgaatcatcactggacggggagaagagttccccgttcagtcgccggacgtgggccgaagatgcgtcgctcttcttcggtgatggagacgtcgttgatgctggcctcccggcggcgcatcagtccgtcctcggtgaactcccacagttcgttgccgtaagcgcgccaccactggccggtcgcctcgtggtactcgtactggaagcgcaccgcgatccggttgccccggaacccccacagttctttgcgcagggcgtagtcgagctcccggtcccacttctcgcggaggaaggccacgatctcctgcctgccggtaatgaaccggtcccggttccgccagacggaatcctcggtgtaggcgagcgcgacacgttcgggatcgcgggtgttccaagcgtcctcggcggcctggaccttctggagcgcggtctcctcgtcgaacggcgggaacggggggcgtggcgccacggcgtgctcctctccttgtgatctcaaagctggagaacgatcgttctcccggtgttggctactctagagaacgatcgttctcgatgccagtgggaggtgcggtggaccacgacgaggctcgctcacggctgctggatgccgcggagcgtctgttctatgagcgcggcgtccaggctgtgggcatggacgagctccgcgccgcctccggggtttcgctcaagcggctgtatcggtgtttcccctccaagtccgagctggtggagggctacctgcgacgccgcgacgagcgctggcgcgccgccctggccgactttgtcgcccggcatggcaccacgccagaggacgggctgctggcggtgttcgactggttgcacgcgtggttcgctgctcccggctttcggggctgcgctttcatcaactccttcggtgagctgggcgccacctcgggcggcgtggccactgctgctcgcgaccacaagcacgccgtccgggagtatgtggccgatcttgcacgcgacctgcgcgtcgatgacccggctgcgctggccgaccagctcctgctcctgatcgacggtgccatcaccacggccgccatcagcggcaaccctgccgctgcccggcacgctcgcgtggcagccaaggccctcatcgcgtgtgcgacgcccgccggggcggcggagacatgatctctgtgccctcggcaggcggcgggaaacgaagcgccggccgcacgaggcacagcggccgacgcggtcgtccccttccccagcctcagcccgacgaggcgtcccgcagccgcgcaatctggcgcggcaggtaccaggtaggtaccatcagagcatgccatcactgaacgtgtccttctctgatgaggaactggaaggcgtccgcatcgccgcagcggcagagggcaagagcctcaagcagtacctgcatgatctcggagtgcgggagatgcaccgcaagcagttcgtcgccggggccaccgcctgggccgacaggctgcgcgaagagttcgacgacgccttccctgacgaggtccctccctcccagcgcggtgacggaaatgtggctgcctgatggttgtgcacatcgatgtctcgtggctgcttgacgtccaggaagccgccctcgggcacgaggacgtgacagtgacggattattcggcgctggttgccgccgtcgcacggcacaagacgaagatgccgacgttggaggcgtcggatcccgatgccgcctggcgcgcagcagcactcctgcacacgatcacccggcttgagccgctcccccaccgcaacagccttttcgccgcctttgtcgccgctcagtacatggagcagtccggagagggcatcgatccgccctatggggctctttccgatcttgtccggaaggtccgggatgcccgtctcagcgtttatgccgtcgccgaggcgctgcgctcctggaaactgtgacgctgagtgcggcagcaggccagccgactgcggaccatcgggcgcgcggatgacgatggattgattccatgccgagccggtcgagtggggtggtcctggcacgaccgacagcaaggcacgacgtcacctcagccccggacacgctcgccggtccaggctgttcagtggctgcagagccggctcatgaccagcaccccgagacgtgcggcgctgacgggcacctcgtcgcgacagaccggcggtcattccacgtcacggtgccctcctcccactgcgacagcccggcccccgggtggccgaggaggcggccgggcgactgcttggccgaggggcggggggcctggag

SEQ ID NO: 291 - DNA, 1557 bp, Unknown
  Kingdom: Bacteria, Phylum: Actinobacteria, Class: Actinobacteria, Order: Streptomycetales, Family: Streptomycetaceae, Genus: Streptomyces
agcgcgtcgccgagcaggaaggagtccccgcactcgcgcagggcccggtcctccggcgtgttccaccacaccggccgcacgtacggcgcgccggtgcgccgcgccagatgcgccagcgtcacgaagtacggcagcagccgccggcgctcgacgagcgccacgcgcgcgtgcccgagcacctcaggaccgaactcccacggctcccgccgccccgcccgcaggctcgcgtgcgtccggaacagcggcaggtacgcggccagctggaaccagcgcaggaacagctccggcgagggactgccgtcgaagccgcccacgtccggccccgaatagggcaccccgcacagccccaggcccagcaccagcgacagcgaggcccgcagccccgcccagcccgtggcgacgtcccccgaccaggtcccgccgtagcgctgcatcccggcccagcccgagcgggagaacacgaacggccgctcgtcgggcaccagggcgcgcagcccctcgtacccggaccgggccatgcacagcccgtacacgttgtgcgcctcgcgatggtcgccgccgcggccctccagagcgtgccgggccgacctgggcagcgtcgtctcgccgaaggccgcgaaggaggtcggctcgttcatgtcgtgccagaaaccggagaacccctgcgccagccgctcctggtacagaccgccccaccacgtgcgcacacgcgcgtgcgtgaagtccgggaagaccgtctcgccgggccacacgacaccccgcacgacatccccggacgcgtcccgtacgaaggcgtcctcgctcatccctgagtcgtggacggcgttgccctgtgcggcgcgcaccgccgggtcgacgatcgacaccagccggatcccgtcccggcgcagttcctccgcgagcaccggcagtttcgggaagcggtcctggtcgacggtgaacacctggtgcgcgtcgtagtggtcgatgtccagatggacggcgtccagcggaaggtcgtgctcctgatagcccgcgacgatccggcgcacctcctgctcgctgccgaagccccaccgcgcgtgatggtggccgagcgcccatgcgggtggcagcgccgccgccccggtgagcgaggcccaggtgtgcgccacgcgcgcgggagtgccgacgaccacccagcagcgcagcgggccgccgtccatccgcagctcgctcgcccccggccggtcatgacccgagccggccccctcctccccctcccgcagcacgaccgtgccgtcccaggagttgtcgtggaacaccagatgggtccccgcgtccgcgacgaccagctgcaccggcatggtgatgtagagcggatcgtcgcccggcccgaacgcgtgccctggatcggtgttccacaagcggtacgtcccctcgcgcagcaccggccccgacgcccgcccgcccaggccgaagaaccgcgcgccggcggccacctccgagcgctgcatccagcgcgccgggcccccgcccaccggctcccaccaccgcggcggcagatcacggcgcagccgcacaccgccgggcgtacac

SEQ ID NO: 292 - DNA, 3590 bp, Unknown
  Kingdom: Bacteria, Phylum: Actinobacteria, Class: Actinobacteria, Order: Streptomycetales, Family: Streptomycetaceae, Genus: Streptomyces
gtgtcgtcgaggccgccgaggctgccgaggtcggtggtggtggtgtggcccttcgcgtcggtggtggtgacgaccccggtgccggggtcgacgacctgcttgctgccgtcggggaaccgggtggtgagctgccggtggtcgaggctggtcgtggacccgtcggggttggtgaccgacgcgccgtgggtgaggtcggtcgtgctgccggctccggtcgggtccacggaggtgagcatcccggtccgcgggtcgaaggaggtccggctgccgtccgggaaggcggtggcgaagtcgccgccgtcgagggtgaggtggcccccggtcggcgtccgaagtcctgcgtacccggtgtcgttgaggttgccgagatcgccgagcgactgcgtcaccacgtggtcgcgcaggttgccggaaccggtcggcgcgccggtgccgtcggtgccaccggtgccgtggagggtgtggtcgcttcgggggttgtcgttgaggccttggagactgccgaggtccgtcgtggtggtgtgacccgtcgggtcggtggtggtcgcgatgctggtgtcggggtcgatgacctgcttggtgccgtccgggaactccgtggtgagctgtccgttctccagcctggtgacggacccgtcggggttggtgacggcggcgccgtgggtgaggtcggtcgtgctgccggctccggtcgggtccacggaggtgaacatcccggtctgccggtcgaaggaggcccggctgccgtccgggaaggcggtggcgaagtctcccccgctgagcgaggtgtggccgccggtcggcgtctggatcccggggggagtgtcgccgagggggagcagggcgtccctgaggccgtcggtggcctgcttctggcgggaggagggcgtgttgccgccgttgaggccgccgagggtgccgagcgaggtggtggtcggcaggaaggtgctgtcggtgccggggccgctgccgccggtgccgcccgggtcaccgagcgccagttcggtgcggggcagcgtggggacgggcccgccgtcgccgccggaacctccgccgccggtgagaccgttgagaccgtcgagggtgccgagcgaggtggtggtgggggctacggtgctgtcggtgccgaggccgccgtcgccgccggagcctccgccgccgttgaggccgttgaggccgttgagatcgttgagaccgtcgagggtgccgagcgaagtggtggtcggggcgccggtgctgtccgcgccgccggcacccgtgccgttcgggtcgccgagcttgtcgagggcgtccttcaggtagtccgtctggttgccgttcgcgtcgccgagcttgtcgagggcgtcctgcaggccgtccatctggtcgccgttcgcgtcgcccagcttgtccaggaggtcctgcaagtccccggactgtttgtcggccgcgtcctgggcgtccttcttgtccttttcgtactcgtccttcagcttctcgttctcctcctggatcctcttgttctcctcgtccgccttcttcttctcgtagtccgcggcggcggtgctggtggtcttcggcttggggatgttgtcggtgaactccctgcccaggtcgaggaacgtgttgttcaggtccgactgcacggtggccgcgggtgtgaccagcatctggtccacggccttgttccagatgcggaccgcttcctcgccgaccttcttccaggccgccttgtccgccaggtccccgtacttggggtggttctgtgtgaagccgtccttggtcttggcgtagtacacggtcgaggtgtaggacgtcgtcgcgtagaggccggtcttcttgacgttgttctcctcgacccagtgcgcgaggtcgtccagcacgtagccgaggacgcggatcggctcgtagtacgccgactgggcccacttctgccaagcttccagcagttgctgcgcggccttctgcaccgcggccttcgcctgggacagtgcccgggagtacacggtgtcgccctcgccggtccggtcgccggagccgttgaaggcgtcgatgtacgactcgtagttctcccgggtcttggtcagcagactgcggaagatgtccgcggactcgcccttccaggcggcgtcgtccttgccgagggcgtcctcccagccctggatgatcgtcgcgtagtccttgaagaacttggccgcgcggtcgaaggactcgcctgtggcgtggaaggtgctgaggtcgacggcggctgcgtccggcacactgagcccgccgaagctggtgctggtggtgcctccgccgtgcaggtcgagcaacgccgtacgaggaccgttcatgtactggaacaggacctcgttgctcatcgtgtccttgttgtagtccgtgaactcggtccccgcgcccgcctggacgtccttggccgtcttgcccgaggtgtcggcccagatgatgtgtccgtcctcgtcctgcgcggtcccctcgaagacgatgcgggcctgcttcagctgggcgctgcccggcccggtgaagaaccagatgtcgtagtcctcgccgctgttcacctcgaagccggacttgatggcctcgtccacgtcgtggtcctggaagtccatgcggaacaacgggccgccgtggtcggaggtgagcttctcgaagagcgtcgagcgcttgggcatgggatagccggtcaggtgggccacgaggttggcccaggtgtcgtcggcgtcgtccttcgaggtgccgtccttgtacttgtcgacattgtccttggaatggtcgtcgacgtacttgtcgacaccgccgtcgacggcgttgtcgtcgtccccaccggccaccgtgagccctcctgatccgctgctggtcattgccgaaggggcaccggacgtgccccgtgcggcctcagctgtcgctgctgctgttctcggtcgtgctgctgccggtgctcgtgccgctgccggtcgtggtgctgccggtcgtggtgctcgtgccggtgccggtcgtggtgcccgtgccgtccgtggtgccgctctggccggaggtgtccgtgtccacgtccgagaagatctgcagcagggtcttcgcgtcgatcgagtccaggttctcctggttggtcttcttcatcttgtcgatggtctgctgcagggcgtccttcaggtccgtgaagaacgtctcctggtcaccgaggagtttgtcgatggcggtcgccgcggtcttgatgtcctgcagcagcgtcgggccggacaccagtgtcttcgtggccatgtcgccgatgcgcagcagctgctggtcctgggcgaggttccccgccgtggtgtgaccgtcgatcaggtggcccagcgggcggaccccgttggcgtcgtcgttgcggtatgcgcgtgcggccgtgcggccggcgtccgcctcgtggtcgtggaagctctgcagttccgtgaggttgaggtgcgtcagatcggacacggaccgtccttgggttgctgggggccgggggcgggaggagagaaggccggacccgccgcacgcgccggtgccggtcgcgagggaccgcaccggcgcgcaggcggtgccgaagccgcgggggaggcggccggcgtgccggccgtcagcctgcgcgg

SEQ ID NO: 293 - DNA, 4147 bp, Unknown
  Kingdom: Bacteria, Phylum: Actinobacteria, Class: Actinobacteria, Order: Streptomycetales, Family: Streptomycetaceae, Genus: Streptomyces
tgccgactgccgactgccgaccgctcactgctcactgctcactgctcgccgagcgtcacgtccaccgtcttttcggcgccgtcgcgcgagtacgtcaccttcgtccgctgtcccggtttgtccgcggccagcgcctccgacagtgaggtgatgtcggtgatgccgctgccgcccacccgcaggatgatgtccccgacccggatgcccgcacgggccgccgcgccgcccgccttcacgtcgacgaccgcgaccccggcgggctggtaggtggaggcgtcgacgacggtccgtccggtgatgccgagcgcggcccgccccgagtcgacgaccctgccgtacctgacgatctggccggcgatcgtcttcaccatggacgaggggatcgcgaagccgatgccgggcgccgcgctgccgccgagctgcgggtccgtggcggcgagcgtcgggatgccgatgacctgcccgttcaggttcaccagcgcgcccccgctgttgcccgggttgatcgcggcggaggtctgcaccatgttggcgatcgtcgccccggtgccgccgctctgcccctcgctgacggtccgcccggtcgccgacacgatcccctgggtgacgctcgacgacagccccagcggcgagcccatcgcgagcacgatctgcccgacggcgaccttgtccgagtcgccgaacgcggccgccttcagtccgtggggcaccttgtccagcttgacgacggcgaggtcctgctgcgggtaggcggagacgagcgtcgccgtgagcgtctgctcgctgccggccgtggtgacgtggaaccgcttctcgttcccgacgacgtgcgcgttggtgacgatgtgccccttgtcgtcgtagacgatccccgagccgaggtcgcggctcgcctggatctgcacgaccgacggcaggacctccttgatcacccgctcgtagtcgctctgcaggtcgctcgcggtcgccggggcggccacctgccgcccgcccgagggcgtccgcgtggcgggatccgccgccgcttcgggcgcggcggaaccgctgcacccggacagcacggcggcacagcacgccagtgcggcgagcggcgcgatcagccgacgcgcacgagcacgggaacgtacacagacacggacaaagacacgagcgcgggcacgagcacaggcacgggaaacgtccatggaccgagtctgtggccgacccggccccccggcccccggagcgcccccgtacgggcggcgtaggggcggcgagcaggtgccccgcggacctacccgcgcaccccgcacagatgcagcagcgccgccaccgcgcggtacgggtcggtccggccggcccgctcctcggtgtccagcagcctcgccgcgtccgccggcggctccgcgccgtccgccgccgtgtccgtgaagacccgtactccgtaccaggcgtgcagcggggcgccgatcccggcgagcgtcgccgtcaggtcggcgagccggtccgcccgtacgtccaggcccagccggttgcggtacaccgtcgtgtcgaacgccgccagcgccgccgcccagtcaccggacagcccaggccgcatcgccagcgcgtcggcgttgcgcaccagcagcgacagcagtccgccgggcgcgagcatccgggccagcccggccagcagcggatcgggctcctcgacgtacatcagcacgccgtggcacagcaccacgtcgaagctgcccggcaggaagtgcacgccggtgtcctggccgtcgccctcgacgatccgcatccgtgcccggatgccctcgggctcggcggccagcgcctgacgggccaccgagatcatcttctcgtcccgctccaggccggtgacctggtgcccggcccgggccagccgcagcgcctgcgtgccctggcccatcccgacgtcgagcacccgcagccgctgcccgaccgggaaccgcccggctatctgctcgtcgagctgccgggccaccagctcctgccgtacgacgtcacgcagcccgcccagcttcgccagccaggcatccgccgcacccccggagaaagcggtcgtactcagggccgctctccacgcttgacctgcggcttcggcaggcggagccggcgcatctgcagggagcgcatcagcccgtaggcgacggcgcccttgcggctctggtccgggaagcgctccgccagccgcttcttcagccgcaggccgctcacgagcgagtcgagcacgatcagcacgatcaccacgagccacagcagcagcgcgatgttctgcagatagccgacccgcaccatgctcagcaccaggatgaccacggccatcggcaggaaccactccgcgatgttgaaccgcgagtcgatgaagtcacgcgcgaacttgcgcaccgggcccttgtcccgggccgggaggtaacgctcgtcgccgctggccagcgcctggcgctgccgctccatctggacgcggcgctcctcgcgctgccgcttggcggcctccttgcggttggtcggcgtggtggcgacgctgcggcgctggctctgggcctcactcctcttcggcgtggggcggcccttgggcgcctgcgggtcacggggctgcttggagatgctcaccggcgtctttgcggcgaccggcgccttctcttccttggcacggctacggaacacaaatcccaagggtacgggctcgacccgcatggaccccagcccggtggggaacgatccggcaacgccggtcgtctcacaggtacaggggaggcggtccgcacgtccggcccaaggcgcatcgggggtcacctactccctacgccggatcggaaacgcgcgcagtcgtccttggggatgaccgcatccgttcccgaacagtgcggtaatggatgcagggcccgtactgtgggttctgtcgcagagctgtgagctggagtccgtcagaagggggcgcgcgaagcccatgagcggtgtcatgaagcgtatggggatgatcttccgcgcgaaggcgaacaaggcccttgaccgggccgaggacccgcgcgagaccctcgattactcgtaccagaagcagctcgagctgctgcagaaggtccgccgcggcgtcgccgacgtggcgaccagccgcaagcggctggaactccagctgaaccagttgcagcagcagtccaccaagctggaggaccagggccgcaaggcgctcgcgctgggccgtgaggacctggcccgcgaggcgctctcccgccgcgccgcgctccagcagcaggtgacggacctggagacccagcactccaccctccagggcgaggaggagaagctcaccctcgcggcccagcggctgcaggccaaggtcgacgccttccgcaccaagaaggagacgatcaaggccacctacaccgccgcccaggcgcagacccggatcggcgaggcgttctccggcatctccgaggagatgggcgacgtcggcctggccatccagcgtgccgaggacaagacgcagcagctccaggcccgcgccggcgccatcgacgaactgctcgcctccggcgccctggacgaccccaccggcacggccaaggacgacatcgccgccgagctggaccggatctccggtggtacggatgtagagctggagctgcagcgcatgaaggccgagctggccgggggctcgtccgccgaccgccaggcgatcgagggcggccagggtcaggcgcagccccagcagcagccgcaggacaccccccgcttcgacaagcagtaagcaccggggcccacgcgccgaggagggcgacacggatcatgggggagggacaggtgaagctggccgacagccacttcaccgaactcaacaagctcgacgacgaactcctggcagaagtggagaagggcgacggcccggctttccgccgcaccctggccgccctcctctccaaggtccgggaactgggcgaaccactcccggacgacaccctggaaccgtccgagctgatcctgcccgccgcggacgccaccctggaggaagtccgggacatgctcagcgacgacggcctgatccccggctgaacgcgacaccacccgggccggccccgaagaacacggggccggccttttggtgcgagcgggtcgggcgccctgtccggcgcctgcggcagaccccgcccccgcgccc

SEQ ID NO: 294 - DNA, 14616 bp, Unknown
  Kingdom: Bacteria, Phylum: Actinobacteria, Class: Actinobacteria, Order: Streptomycetales, Family: Streptomycetaceae, Genus: Streptomyces
gaacagctcggcgaacgccggcttgccgtcgagccggccgatgggccgtacggtcacaccctccgcgtccagcgggaacatcaggtaggtcaatccgcggtgcggccggtccgcgaacgggtcgctgcggaacaggccgaaggcacggtcggcgaacgcggcccgcgacgaccacgtcttctgcccgctgagcagccagccgccctcggtccgcacggccgtggaacgcagcgaggccaggtcggagcccgcctccggctcggaccaggcctgcgcccagatcacctcgccgctcgccatcggcggcaggatccgggcccgctgctcctcgctgccgtgctcgaagagggtgggggcgagcaggttgatgccgttctgggcgacccggccgggagcgccggccgcgtagtactcctcctcgaagatcagccactgaagcagggaactgccccgcccgccgtactccttcggccaggagaccaccgaccagcggtcggcgaacagggtgcgctcccactcccggtgggccgcgaagccgtcggcggtctccagggagggcagcggcgccgaggggacgtgggcggacagccagtcgcgggcctcggcacggaagccggcctcggcatcggtgaattcgaggtccatcaggccgagccctccttcatggcgcggacgtccatgccgccgagcgggtcggccgcggtctccgcgttgtgcgcgtgcgccaggtggtgcagtccgaagaccgagtccatgccggtgtgcagcccctggaggtcctcggcctggttgacggcgcgcttggtgagcgccaggcccatgcgtggcatctcggcgatacggagcgccagctcgccgacccgctccccgagttccgcgcgggggacgacgcggttgaccatgccgacctcgtgggcgcgctgcgcggtcatccgctcgccggtgaacaggaactccttggcgacacgcggcggcatcacccacgggtgggcgaagtactccactccggggatgcccatgcggaccaccgggtcggcgaagaacgcgtcctcggaggccacgatcaggtcgcacacccaggccagcatcagcccgcccgccacgcaggcgccctgcaccgcggcgacgacgggcttgggcagctcgcgccagcgacggcacatgccgaggtagacctccgactcacgggcgaagcggctctccgcgcccgccttgtccgagtggtcccaccacagccccgccttccgctcgaagggcagatgggcgtcgcgctgcggagtgccgatgtcgtggccggccgagaagtgctcgcccgcgcccgcgaggacgaccaccttgacctggtcgtccgcggcggcgcggtagaaggcgcggtccagggcataggtcatcgcggagttctgggcgttgcggtactcgggccggttcatggtgatcgtcgcgaccgggccctgccggtcgtagcgcaccgggtcgtcctgcgcctgcgggcgctcggcctcttcgtgggcagcggacatccgcccctccttccctaacaagtgtttggtaggttaacgtacggccatgaccagcgtcgaggagttccgcaccgaggtccgcggctggctgcgggccaacctcacgggggagttcgccgccctgcgcgggcgcggcggtcccggccgcgagcacgaggcgttcgatgaacggctcgcctgggagcgccacatggccgccgccggctggacctgcgtgggctggccggtggagtacggcgggcgcggggccacgctcgaacagcaggtcgccttccatgaggagtacgccctcgccggtgcccccgcccgggtcaaccacatcggcgagcagctcctcgggcccaccctcatcgccttcggtacccccggacaacgcgcccgcttcctgccgccgatcgtcgcggtgcaggagttgtggtgccaggggtacagcgagcccgacgccggctcggacctggcgaacgtacgcaccagggcggagcgtgacggcgacgcgtgggtggtgaccgggcagaagatctggacctcgctcgcccacgagtcccactggtgcttcgtcgtggcacgcaccgagcccggctccgtacgccaccgcggactgtcgtacctgctggtcccgctggacggccccggcgtggacgtccgccccatcacccagctcaccggaaccagcgagttcaacgaggtcttcttcgaccgggcccgcacccacgcctcgaacatcgtgggcgcgcccggcgagggctggaaggtcgcgatggccacgctcggcttcgagcgcggcgtgtccaccctcggccagcaggtcggcttccgccgcgagctggaggccctgatcgacctggcccgccgcaacggcagcgccgaggaccccctgatccgcgaccggctcgcccgcgcctggatcggcctggagaccatccgcttcaacgcgctgcgcatgctggacggggtggccgccggggccccgggccccgaggcgtccatcggcaagatctactgggccacctggcaccgggaactcggcgaactcgccatggacgtgtgcggagccgacggcatgctggccgccggcgagccctacgacctcgacgactggcagcggctgttcctgttctcccggtccgacaccatctacgccggctcgaacgagatccagcgcaacatcatcgccgagcgcgtgctcggcctgcccaaggaggcacgtccgtgaccaccccgcccgactacgttcccgggcacggcctgctcaagggccgcaccgccgtcgtcaccgccgccgcgggcgccggcatcggcggcgccaccgcccggcggctgctcgaggaaggcgccgacgtgctggtctccgacacccacgcctgcagactggaggagacgcgggccgcgctcgccgacgagttcggcgccgaccgggtcgcggcactggtctgcgacgtcaccgacgagagccaggtcggcgcgctcttcgaccacgccgaggaacggcacggccgcctggacgtcgtcgtcaacaacgccggactcggcggcaccgccgacctggtcgacatgagcgacgcccagtgggacaaggtcctcgacgtcaccctgggcgggaccttccgctgcacccgcgccgcactgcgccggatgaaggcccggggagacggcggcgtcatcgtcaacaactcctcggtgatcggctggcgggcacagaaggggcaggcccactacgccgccgcaaaggccggcgtcatggcgctcacccggtgcgccgccctggaggccgccgagtacggggtgcgggtcaacgccgtggcaccgagcctggccatgcacccgcacctggtgaaggtcaccacgcccgaactgctggccgagctgacctcccgcgaggcgttcggccggtacgccgagccctgggaggtcgccaacacgatcgtcttcctcgccagcggctactcctcgtacctgacgggcgaggtcctgtccgtcagcagtcagcgcgcctgagcgaggatgggcgggtgccgaaagacagcagcagcaagaagaaggcgacgccgccgtcgcccgagcggcgcgaggagatcctcgccaccgccgccgaggtgttcgccgcgcagggctacaacgccaccaccgtacgcaggatcgcggacgaggcgggcatgctcgcgggcagcctctactaccacttcgactccaaggagtcgatgctcgacgagatcctctccgccttcctcggcgaactctgggagcgctacgacaccgtcctcgcttccgggctggggccgcgcgagaccatcgaggccctcgtcaccgagtccttccgggagatcgaccggcaccgcgccgccgtcgccatctaccagaaggagtccaagcacctgcagacccagccgcgcttcggctatctcgccgactcccagctcaagttcgagaaggcctggctcgggaccctggagcgcggagtggccaccggggccttccgcgccgacctggacgtacggctcacctaccgcttcgtgcgcgacaccgtctgggtcgccgcgtcgtggtaccggccgggcggacagcacagtccggaggagatcgcccgccagtacctgtcgatggtgctggagggcatcgccgtccgcgactgacccggcacacgacacgacatgacaggcgcgacatgacatgtcgtctcccgtcacgtcaccgtcaccgtcactgaaggagcagcagtccatggccgaggcatacatcgtcgaagcggtccgtactccggtgggccgccggggcggcggtctgtccgccgtccaccccgccgacctgggcgcccatgtcctcaaggagctgatggcccgctccggcgtggacccggccgccgtggaggacgtcgtcctcggctgcctggacaccgtcggcccgcaggccggcgacatcgcccgcacctgctggctggcggccgggctgccggaggaggtgcccggcgtgaccgtggaccggcagtgcggctcgtcccagcaggcgctgcacttcgccgcccagggcgtcctgtccggtacccaggatctggtggtcgcgggtggcgtgcagaacatgtcgcagatccccattgccttcgccagccggcaggcggccgagcccctggggctcacccagggcccctacgccggctccgagggctggcgggcccggtacggtgaccagccggtcaaccagttccacggcgcggagctgatcgccgagaagtgggggatctcccgccaggacatggaggagttcgcgctgcgctcgcaccagcgggccgtgcgcgcccaggacgagggacgtttcgaccgcgagaccgtcgcctatggtgccgtgagcgccgacgagggcccgcgccgcgacacgacactggagaagatggcgtccctcaagcccgtcgtcgagggcggccggctgaccgccgcggtctcctcccaggtgtccgacggcgcctcggcgatcctcctcgcctcggagcgggcggtacgcgagcacgggctcaccccgcgcgcccgcgtccaccacctctcggtgcgcggcgaggacccgatccgcatgctgtccgccccgataccggccaccgcgtacgcactgaagaaggccggcatgtccctcgacgacatcgacctcgtcgagatcaacgaggcgttcgcctccgtcgtgctgcgcttcgtgaaggacatgggcctgagcctggacaaggtcaacgtcaacggcggcgccatcgcgctgggccacccgctcggcgccaccggcgcgatgatcctcggcaccctcgtcgacgaactggagcgccaggacaagcggtacggcctcgccaccctctgcgtgggcggcggcatgggcatcgccaccatcgtcgagcgcatctgaccccctcccgacggatacgacggatcacctggagcacaccctcatgaccaccgagtccaccaccatccgctgggaacaggacgacaccggtgtcgtcaccctcgtcctcgacgacccggaccagtccgcgaacaccatgaaccaggcgttccggacctcgctcgccgcggtcaccgaccgcctggaggccgagaaggacaccatccgcggcatcatcgtcacctccgccaagaagacgttcttcgccggcggtgatctgcgcgacctgatccgcgtcacccccgagaccgcccaggacctgttcgacggcggcatggcgatcaagcgcgacctgcgccgcatcgagaccctcggcaagcccgtggtcgccgcgctgaacggcgccgccctcggcggcggctacgagatcgccctcgcctgccaccaccgcgtcgccctcgacgcccccggctccaagatcggctgccccgaggtcaccctcggcctgctgcccggcggcggcggagtcgtgcgcaccgtccggatgctcggcatcaccgacgccctgctgaaggtgctcctccagggcacccagtacaacccgcgccgcgcgcaggagaacggcctggtcgacgaggtcgccgacagccgcgaggacatgctcgcccgggcccgcgccttcatcgacgcccaccccgagtccgcccagccctgggaccggcccggctaccgcatccccggcggcacgccgtcgcaccccaagttcgccgccaacctgcccgccttcccggccaacctgcgcaagcagacgaacggcgccccctacccggcgccgcgcaacatcatggccgccgccgtcgagggcgcccaggtcgacttcgagaccgcccaggtcatcgaggcccgctacttcgtcgaactggccgccgggcagacctcgaagaacatgatccaggcgttcttcttcgacctccaggcggtcaactccggcgccaaccgcccccgtggcgtcgagccccgcaaggtgaccagggcggccgtcctcggcgccggcatgatgggcgccggcatcgcctacgcgtgcgcccgcgcgggcatcgacgtcgtcctcaaggacgtctccctggaggccgccgtcaagggcaagggctactccgagaagctgtgcgccaaggccgtctcccgcggccgtaccagccaggagaaggcggacgcgctgctcgcccgcatcacgcccaccgccgacgccgccgacctggccggctgcgacgcggtgatcgaggccgtcttcgaggacccggcgctcaagcacaaggtgttccaggagatcgagcacgtcgtcgccccggacgcgctgctgtgctccaacacctccacgctgcccatcaccgcgctcgccgagggcgtgcagcggcaggccgacttcatcgggctgcacttcttctcgcccgtcgacaagatgcccctggtggagatcatcaagggcgagcgcaccggcgaggaggccctggcccgcgccttcgacctggtccggcagatcaacaagacgccgatcgtcgtcaacgactcgcgcggcttcttcacctcccgggtgatcggccacttcatcaacgagggcgtcgcgatggtcggcgagggcatcgagcccgcctccgtcgagcaggcggcggcccaggccggctacccggccaaggtgctctccctcatggacgagctgaccctcaccctgccccgcaagatccgccgcgagtcgaagcgagccgtcgaggaggcaggcggcacctgggtcacgcaccccgccgaggccgtcatcgaccgcatggtcgacgagttcggccgcaccgggcgcagcggcggcgcgggcttctacgagtacggcgaggacggccggcgcgcagggctctggccgggactgcgcgagcacttcaccaagcccgggcaggagatcccgttccgggacatgcaggagcggatgctcttcgccgaggcgctggacacggtccggctcctggaggaaggcgtcctgacctccgtcgccgacgccaacatcggctcgatcttcggcatcggcttccccggctggaccggcggcgtgctccagtacatcaacggctacgacggcggcgccgcgggagcgagcggtctgcgcggcttcgtggcccgcgcgcgcgaactcgccgagcgctacggcgagcggttcaccccgcccgccctgctggtcgccaaggcggagaagggggagaccttcacggacgagcgctgagccgcggctcagccggagggcgcgtcccccggagcccccggggctccgtcgcgcgccgcgccctccaccgggccgcccgcccggcaggcgccttctccagggtctccggcggagtcctcgggggcggagtcctcgggcgagcccacccactcccgcagctcctccttcagcgaccgctggaaggtggtcagcagcgcctgcaccaccaaggggtgcatatgggcggacagggacttcacgtcccgcgtgtcgcgttcggccacggcgtcgcgcagcagttccgacagctcgcgcgccgccgcgcgcgcgtggtcgatcagcgctgtacgggccgcgagcacggtctcctcggacagcggtacgtcgagcagttccacgccgagccgcagcagcccggagtcgacgcggaaacggtcgccctccggcgtcaggacgctcatcgcggccagccgctccacgtcctcgtcggtgagcggccggccggcccgccgcccgagttccggccgtgagagcatctccatgctctccggtgcccaggaggccaccaccgcgcggtgcacggccaggtcgtgcgggctgagaccgggcgggagcaggctcaggtggcgttcgatcgccgccagcgtcatgccctggtgctgcatctcctcgatcagtgccagccgcgcgaggtggtccctgccgtagtggcccacccggcgcgggccgatcgcgggcggcggcagcaggccccggccggcgtagaaccgcaccgtgcgcaccgtgacgccggcgcgcgcggccagctcgtcgatggtgaggacgggctcgccggtgtcggtcgtcgtcatgtgcagcagtatcgctgtctcaccagtggtgtgaaagccggtgaccgatctgcgtggatagtgtgagaagttcccctttgtgacatacgccatcgcatgagaactgatctctctgggaagctgcttgcctggtctgtaccgcgtccccagtggtgcaagccggaattgtacggacacccgggcgcacccccgctcggcccccagagagtggataccaccgcgtgagcaaggactccgtgcacacggcacaggtcgccgaccatccccgggcgaccgcgacccccgccgacgcgggcgacgccggctacagcaaggacctcaagcaccgccacgtcaacatgatcgccatcggcggtgcgatcggcaccggcctgttcctgggcgccggcggtcggctgcacacggcgggaccggcgctggcgctggcctacctcgtctgcggcgtcttcgcgttcttcgtcgtccgcgccctcggcgagctggtcctgtaccggccctcgtccgggtccttcgtgtcgtacgcgcgcgagttcctcggcgagaagggcgcctacgtcgccggctggatgtacttcctgaactggtcgacgaccggcatcgccgacatcaccgcgatcgcgctgtacacgcactactggagtttcttcacacccatcccgcagtgggtgctggcgctgatcgccctcgccgtcgtcctcaccgtgaacctgatctcggtgaagatcttcggcgagatggagttctggttcgcgatcgtcaaggtggccacgctggtcgccttcatgctgatcggcatcttcctgctggccacccagcacaaggtcgacggcgcgacgccgggcctgagcgtgatcagcgaccacggcggactgctcccgcacggcgcgatgccggtggtcctcgtcatgcagggcgtgatcttcgcgtacgccgccctcgaactggtcggcgtcgccgcgggcgagaccgccgagccggagaaggtcgtcccgcgcgcggtgaactcgatcatgtggcgcgtcgccctgttctacgtcggctcggtcgtcctgctggcgctgctgctgccgggctcgctctactcgggcgacgagagcccgttcgtcaccgtcctgtcgaagatcggcgtacccgccgccggtgacgtcatgaacctcgtggtcctcaccgccgccatgtcctcgctgaactccggcctgtactccaccggccgcatcctgcgctccatggcgatggcgggatcggcgccgaagttcacccgcgtgatgagccgcagccaggtgccctacggcggcatcctgctgacctgcgcggtctgcgtcctcggcgtcggcctgaactacctggtgcccagccaggccttcgagatcgtcctgaacgtcgcctcgctcggcatcgtcagcacctgggtgatcatcatgatctgccacctgatcttcgtccgccgggcgaaggcgggcctggtcgaccggccgcacttccgcctgcccggcagcccggtcaccgagatcgccacgatcgccttcctgatggcctgcctcggcctgatgtggaacgaccccgacgtcggccgcaagaccctcctgctgatcccgctgatcgcggtcctcctggtaggcggctggttcgcggtccgccgccgcgtcacagagcagtccaccgaggaccccgcactcacgaagtagcaggtcacggccactgtcagtggcagcccgtacggtggcgtcatgtcggagatcaactacgtccggggcgacgccaccacgccgcaggccaagggcgccaaggtgatcgcccacgtctgcaacgacgtcggcggctggggcaagggctttgtcctggccctctcccggcgccggcccgagccggaggcggcctaccgcgcctggcaccgggaccgcgtgaggaacgacttcgccctgggcgccgtccaactcgtgcggaccgagcgcttggtgtgggtggccaacatgatcggccagcacggcgtccggcgcggcagccggggcactccggtgcgctacgaggcgatcgacgcggccctcgccggcctcgccgaccgggtcctcgacctggacgcctccgtgcacatgccccgcataggctgcggcctcgccggcggcagctgggagcgggtcgagccgctgatagcggagcggctggtgcgccgcgggatcgccgtcacggtgtacgaccacgaggggtagggcgtacggccgccagcgagggccggaccgcccccccgggccgggagcggtccggcctgcgctcacttggcgtgcactcctgcgtgcacgtcgttcgtcgcctcgatcttcttccacgacctgggctgcaccggggtcgccgccctggccgttgcgaaggacgccgcgcgcgccgccggagcggccggcctgaccggctggaacagccaggtgtcgaagagcgcggccagcggcttgccggagatctgctcggcgtacttctggaagtcggccacggaggcgttgccgtaggcgtgctgctgtggccagcccttcagcagggcgaagaacgccttgtcgccgatcgcgttgcgcagcgcctggatggcgacggcgccccggtcgtagaccgccgcgtcgaactggtggtccgggcccgggtcacccggcttcaccgtccagaaggcgtcgtcggccgggtgcgaggcgtacacgtagtccgccagttcctgtgtggtgccctcgccctcgtgctcggaccacagccactgcgcgtaccgcgcgaagccctcgttgatccagatgtccttccagcccttgagcgacacgctgtccccgtaccactggtgggccagctcgtgcacgacgacggaggtgttggagccgttcgcgaactgcttcgggctgtagtacacgcgggactgcgtctccagcgcgtacccggtcgtcgtgttcggcacgtacccgcccgccgagctgaacggatacggcccgaaatagccgctcagccagtcgaccagctccccggtgcgctccacgctcgcgcgtgccgccccgtcgttgtcgccgaggtccttgctgtaggcgttgatcaccgggacaccgccctcggaggtaccggtggtgatgtcgaacttcccgagggccagcgtggacaggtacgtcgcctgcggcttgttctgccgccagttgtagcgggtccagcccagcttcgaggagaccgactggagggtgccgttggagatcgcctgcgtgccgtccggcaccgccaccgagacgtcgtaggtggccttgtcactggggtggtcgttgctcgggaaccaccaccaggcggcctcgggctcgtccgccgcgaccgcgccgtccggggtgcggtgccaggtgttgaagccgtaggcgctcttcgtggacggcaccccgcggtagcggacgaccacggtgaccggcgtccccttggccagcgggctcttcggcgtgaccaccagctcgtgctggcgcgcggtgctgaacgcggccttcgtcccgttgacccgcacctcgctcacgtccagcaggaagtccaggtcgaagctggacaggtcctgcgtggtccgcgccgagatcgtcgccgtgccctccagaacgtccgtcgcgggctggtacgtcagccgcaggtcgtagtgggagacgtcgtagccgccgttgccgtagtcggggtagtaggggtcgccgatgcccggcgcgccgggggagtggctcgcggccgacgccgggatcgccagcaacagggaggccgccgccagagtgcccggcacgatgattctgcggtgcacgtcagctccaagtcgtagggggacgcagactgttcggagcctattgagtccctggggacgcagtcatgtccatggccacacctgtcacatgatcgccattcggccgtcatgagggaagcactccccgtgtgcgcccgtgcactcccgcgcccctctggccccttcgccccgtttccgccccggcgacacgtcagtttcccccttctgcaaggcagttgccccctgtaccgtcccgctcatgccgaacagcatgcgcatgacgacctggagaacgctcgccctggcggtcatcgccgtcctggcgaccgctctcctcagccccgcggcgcacgccgccccgcaggacgcccgggccccacgcgagagcaaccccgtctactcctacgcgaacgccgtccgcgagtccgtctgggtcgacaccggcctcgacggcgacggcgacgggaagaccgaccgcgtcgccgccgacatcgtccggccccgcgaggccgcccagcagggccgcaaagtgcccgtgatcatggacgccagcccgtactactcctgctgcgggcgcggcaacgagagccagctgaagacgtacgacgcgaacggccagatcgtgcagatgccgctcttctacgacaactacttcgtgccccgcggctacgccgtcgtcggcgtcgacctcgccggcaccaaccgctccgacggctgcgtcgacgtcggcggccgctccgacatccagtccgccaaggccgtcgtcgactggctgaacggccgcgcccgcgcctacaccacccgcaccggctccaccccggtcacggccggctggaccaacgggaagaccggcatgatcggcaagagctgggacggcaccatcgccaacggcgtggccgccaccggcgtcaagggcctgaagaccatcgtgccgatcagcgccatctcctcctggtacgactactacttcgcccagggcgccccgctgtacgactcgggacccgactggctgtccgacgtggtggagagcgacgccgcccacgcccactgcgccgccgtgcagaagaaactcgtcgacggcgccccgcgcaccggcgactggacgcccctgtggaccgagcgcgactacgtgaaggacgcggccgaggtcagggcgagcgtcttcctcgtgcacggcatgcaggacctcaacgtgcgcaccaagaacttcggccagtggtgggacgccctcgccaagaacggcgtgcagcgtaagatctggctctcccagaccggccacgtcgacccgttcgacttccgccgcggcgcctgggtcgacaccctgcaccgctggttcgaccacgaactcctcggctaccgcaacggcatcgaccgcgaacccatggccgacatcgaacgccaccccgaccagtgggtgacctccaccacctggccgccgcgcggcaccgcgacgaccaccctgcgccccgcgcccggcgcccatgcaggcgtcggcacgctcggcctgcgcccggcccgcggcaccgagacgttcaccgacgacccgaagctgagcgagaccgactgggccgcgcggatcgacaccgcgaccccggacaaggccggcttcgtcaccgggccgctcggcagcgacctgcggctgtcgggctcctcgcgggtcaccgtccgtgccacgtccaccaccacgagcgcccatctgtccgccgtcctcgtggacctcggccccgacaccatccgtgactacgccgacggcggcgagggcatcaccacgctcaccgaccgcacctgctggggcgcgagcacgccgggcgacagcgcctgctacaaggcgacggcggccaggacgaccccggtcggcttcacggtcgtcagccgcggctgggccgacctcggccaccacacccgcgacggcaagggcggcccgctggtcccgggcaaggcgtacacgctcaccctggacctcgcggcgaccgaccacgtcgtcccgaagggccaccgcctggcgctgatcgtcgcgggcacggacaaggacctcatcgacccgccgtccaccaccccgacgctcaccctcgacctgtcgcgcacctcggccgcgctcccgctcgtcggcggcgcggcggccttcgcccgcgccaccgcgagcaccccgtccgcaaccaccgccacgccgtccgccaccgcatcgcggcccctggacggcgtacgggccgagcgcaccgcgcacccgctgcccggccggtgacccagcccgcgacctgccccctcacacgggactgaagcggcgcggacgggcagttcaggcggccgggacgaccagcccggccgcctgccgcgcacagccccaggccacggtgaccccggcgccgccgtggccgtagttgtgcaccagcg

SEQ ID NO: 295 - DNA, 2405 bp, Unknown
  Kingdom: Bacteria, Phylum: Actinobacteria, Class: Actinobacteria, Order: Streptomycetales, Family: Streptomycetaceae, Genus: Streptomyces
  misc_feature (310)..(336): n is a, c, g, or t
  misc_feature (1841)..(1842): n is a, c, g, or t
gctgggcggggccgcctggaaggacgccgccacgcgcaggcactcgtcgcgcatggactcggcgctcgggaagcgttcgttggggttcttcttcagcgcgcgggcgaccagcgcgtccaccgcagggggcagcgcgcggttgaccgaggacggcgcgaccggctcctcctgcacgtgcgcgtacgcgatggccagcggcgagtccgcgtcgaacggcagccgcccggtgaccagctggaacagcatgatgccgaccgagtacaggtcggagcgcgcgtccacgccccggccgagcgcctgttcgggcgannnnnnnnnnnnnnnnnnnnnnnnnnnccgaagtccatgaccttgaccacgccgcgcttggtcaccatcacgttgcccggcttgatgtcgcggtggaccaggcccatctcgtggctgatctccagcgcggcgagcacgtccgcggtgaccttcagggccttgtcggcgggcatcgcgccctgctgccgtacgtcctcgtcgagcacggagcccagcggccggccctcgacgtactccatgacgatgtacggcatcggcgcgccctcgcccgcggcggagccgtcggcggacagcgtgtcctcgccggtgtcgaagaccgagacgatgttcgtgtgcgtgagcttcgccactgcctgggcctcgcggcggaaccgctcgcggaacgccggctcccggcccagctcggtgtggagtgtcttgatcgcgacctggcggtcgagcacggagtcgtaggcgaggtgcaccgaggccatgccgccctcgccgagcaagtcgcgcagctggtagcggccgccggccagcgaccgccccgcgaaccggctttgcgcgccgtcctggctcatcttctgcgtcccccatgtgcgcggtgccagtggctgctgtgtccgcgcgatcggctgtccgtcgacggtcccgggaccggaccgacctgaccgcgtgtccggatctcgatgatcgaaagtgttattcccggccaagtctgccccagggcactgacacgtcaagctcggtgcccgatccgtgaccgtacgcgaaagaagcgtcgcggaagcgttacagccgacgtacggccggcacacgggatttgcacgacgacggccgctcgcggtttgatggccggtccgtccccgaccggtgcccgcgacgaaccgggaccggcggcttgccccgagcctgtagcgtggccgacggagaccgtgacaacaccgcgcaccgcgggcagaaacgacggcgaggactgatggcacagacgcagcgcgcccagggcccgtccgaccccgaggcgtctggcggcggcggcatgtcggacgcgccggagttgtggggcaacggcggcctggtcggcgacggccgctaccggctgacgcaccggctcggccgcggcggcatggccgaggtgttcgcggccgaggacgtgcgcctggggcgcaccgtcgcggtcaagctgctgcgcgccgacctcgccgaggacccggtctccaaggcccgcttcacccgtgaggcccagtcggtcgccggcctcaaccaccatgcgatcgtcgccgtgtacgactccggcgaggacttcgtcggcggccagtccgtgccgtacatcgtgatggagctggtcgagggccgcaccatccgcgacctgctgctcaacgccgaggcgccgggccccgagcaggcgctgatcatcgtctccggtgtcctggaggccctcgcctactcgcaccagcacggcatcgtgcaccgcgacatcaagcccgcgaacgtcatcatcaccgacaacggcgcggtgaaggtgatggacttcggcatcgcccgcgccnntcgcccgaacaggcgctcggcaaggccgtcgaccaccggtccgacctgtacgccaccggctgcctgctgtacgaactcctcgcgctgcggcccccgttcaccggcgagaccccgctgtcggtggtctaccagcacgtccaggacacgccggtgccgccgtcgacgacctctcagggcgcctgtccgcccgaactcgacggcctggtcatgcgctcgctcgccaaggagcccgacgaccgtttccagacggccgaagagatgcgcggcatggtccagtacgcgctgcagatgctctacgaccagggcggccacaccggcacctggcacaccggcccggtggccgtgcccgacggccggcagactccggcgtccggtttcgccagtacgacggtgatgccgcaccccggtaacggccacgccggcaccacgcagatcccgcagccgatcctgccctccgggtacggcaacggcgacgacggcggcttcgaggggcacggcaacaagggcggcggccggggcaagctgtggatcctcgccgtgctggccgtgatcgccatcgcggc

SEQ ID NO: 296 - DNA, 4805 bp, Unknown
  Kingdom: Bacteria, Phylum: Actinobacteria, Class: Actinobacteria, Order: Streptomycetales, Family: Streptomycetaceae, Genus: Streptomyces
cgagatgacccggatgtacgagcaccacgacgcggtgctgcactcggtccgggagggcgtgatcatcgtcggcgacgatggccggctgctcctcgccaacgacgaggcgcaccgcctgctcggcctgcccgaggacgcggagggccgccgggtgctcgacctcggtctggacccgggcacggcggcactgctgtcgtccgggcggatcgccaccgacgaggtgcacctggtcggcgaccggctgctggcgatcaaccagcgggccaccgacctggagggcgggccgtcgggcagtgtggccaccctgcgcgactccacggagctgcgggccctgtccggccgcgcggaggaggcccgcgagcgcctcagcctgctctacgacgccggtgtgggcgtgggcaccaccctggacgtgacccggaccgcggaggaactggtacgggtggccgtgccgcgcttcgcggacttcgtcacggtcgacctgtacgacgccgtactgcggggtgaggagccggaacaggatgccgtgctgcgccgtacggcgtccggcggcgtccgcgagggcgccccgctgttcccggtgggcgcgcagatccgtttcgtcccgtcgtccccgcaggcgcacagtctcagcacccgccggccggtcctggagccccgcctcgaggccgccccgggctggctggcgcaggacgtggagcgcgccgggcgggtgatgcggttcggcatccactcgctgatcaccgtcccggtgcgggcgggcaccgtgatcctcggtctggtcgacttctggcgctccgagaaggacgaacccttcgacgccgaggagctggccctggccgaggagctggtcgcgcgggccgcggtctccatcgacaacgcccgccgctacacgcgcgagcacggcatggcggtcaccctgcagcgcagtctgctgccgcgtagcctgcccgagcagggcgcactggacatcgcctaccgttatctgccggcgcaggccggggtcggcggggactggttcgacgtgctgccgctgtcgggggcgcgggtggcgctggtcgtgggggacgtggtcggtcacgggctgcacgcggcggccacgatgggacggctgcgcaccgcggtgcacaacttctcctcactggacctgccgcccgacgaactgctgggcctgctggacgagatggtcgaccggatcgaccaggacgagacggccgccggcaccgacgggagtggcgcgccggtgatcggcgcgacctgcctctacgcgatctacgatccggtgtccctgcgctgcacgatcgcccgggccggccatccgccgcccgccgtgatcgcaccggacggcgaggtgacgttcgccgacgtgcccgccggtcccccgctcgggctgggcggtctgccgttcgagacggccgagctggaactcgccgagggcagccgtctggtcctgtacaccgacggcctggtcgaggaccgcacccacgacatcgacgtgggcctggaggagctgcgcggcgcgctcttctcggccggcgattcgcccgaggagacgtgccgcgccgtactggactcgcggctgccgttccggcccggcgacgacatcgcgctgctcgtcgcgcggacccgggccctggacggcgaccggatcgccgagtgggacgtgcccgcggatccggcggccgtcggcgacgtacgggcctcggtgagccggcggctggcgcggtgggggatcgaggaggcggccttcaccacggagctgatcctcagtgagctggtcaccaacgcgatccggtacggcagcgcgcccatccgggtgcggatgctgcgcgacaccgccctgatctgcgaggtcttcgacagcagcagcacctcgccgcacctgcggtacgcggcctccaccgacgagggcggccggggtctgttcctggtcgcgcagctcgcggaccgctggggcacccgctacacgcccaccggcaaggtcatctgggcggagcagtccctgtcctgaacccggcgtccggtcctctcgttcgtttctacgaatttccgcacggcgggtgcccgtgtgttcgagtctctggtaggaaaccttcctatcagttgacttccgggtcaactcccctccccccactcacctttggagcccgtggtgcaaccgaaccccgacacggccacgccggccgccacctcccgccgtaccgtcctcgccctcctcggcgcatccctgaccgccgtcccgctgctcggcgccgcgccgcaggcgacggccgcccctgcaccggccgcggcgaccggcctggacgacccggcgaagaaggagatcgccatgaagctggtgtcgagcgcggagaactcctcgctcgactggaaggcgcagtacaagtacatcgaggacatcggcgacggccgcggctacaccgccggcatcatcggcttctgctccggcaccggcgacatgctcgacctggtccagctctacaccgaccgcaagcccggcaacgtgctcgccaagtacctgcccgccctgcgcaaggtcaacggcagcgactcgcactccggcctcggttcggcgttcgtctcggcctggcgcaccgcggccgaggacggcgccttccagcaggcccagaacgacgaacgggaccgggtgtacttcgatccggcggtcgcccagggcaagaccgacgggctgcgcgcgctcggccagttcgcctactacgacgccatcgtcatgcacggcgacggcgacgactccaccagtttccgcaacatccgcaagcgggcgctgcgcagcgcgaagccgccggcgcagggcggcgacgaggtggcgtacctgaacgcgttcctggacgcgcgggtgtgggccatgaagcaggaggaggcgcacagcgacaccagcagggtcgacaccgagcagcgggtgttcctgcgcaagggcaacctcgacctgaagccgccgctggactggaaggtgtacggcgactcgtaccacatcggctgatgcgggcggccggccccgggacccgggtgcgggtgccggggtcagccgagggcgcggtccaggttgtaggcggcgctgatcagggacaggtgggtgaaggcctgcgggaagttgccctgctgttcgccggtgcggccgatctcctccgcgtacaggcccaggtggttggcgtaggtgagcatcttctcgaaggcgagccgggcctcgtccaggcgcccggcgcgggtcagtgcctccacgtaccagaaggagcagatcgagaaggtgccctcctcgccgcgcaggccgtcgggactggtgcgcgggtcgtagcggtagacgagggagtcggagaccaggtcctcggtgagcgcgtcgagggtggccagccacttggggtcggtcggcgcgatgaacttggccagcggcatcatcaggacggcggcgtccagcacgtcgccgccctcgtactggacgaacgcctggcgccgctcggaccagccgcggtccatgatgcgccggtagatcgcgtcccgggcgcgctgccagcggaccagttcggcgggcaggccgcggcggctcgccagccggacggcgcgttcgacggccacccagcacatcaggcgcgagtacaggaagtcacggcgtccgccgcgggtctcccagacgccctcgtcgggctggtcccagttctcgcagacccagtccaccagcgcgcacacgtcgtcccactgggcgctggagatcggctcggcccatttgtcgtagaggtagatggagtcgatcagggctccgtagatgtcgagctggagctggtcggcggcggcgttgccgacccggaccggggcggagccctggtggccctccaggtggggcagctcgcgctcggggaggtccgtgcggccgtcgatgccgtacatgatctgcagcgggccggtggccctgccgtcacccgggctgatgtgccgggtcacgaaccgcatgaacgcggcggcctcgccgctgaagccgaggcgcagcagcgcgtagacggcgaacgcggcatcgcgcacccagacgtagcggtagtcccagttgcgttcgccgcctacgcgctcgggcaggctggtggtgggcgcggcgacgatggcgccggtcggggcgtaggtgaggagtttcagggtgagggcggagcggtggaccatctcccgccagcggccgcggtagcgggactgcgcgatccagcgccgccagtaggccacggtggccgcgaactggtcctccgcctcggcccgcgcgcaccggcgcggggccacctggccgccgacctggtcgagggcgaagacggccgactctccctcggtgagcttgaagtcggcccggacgtcgggcccttcggtctccagcggcacggtggccgtgagggcgagggccagtttcgcggactcgaacagcgtcatacggccctcggtgcgcaccgtgtgcgggtcggcgccgtagccgaagcgcggggcgacgcgcgcgcggaaggcgacggtgccccgcacgcacaccacgcgccggatcaggcggtgccggtcggcctcgccggtgtcgccggagaccggcatgaagtcctgcacctcgccgacgccgtcctcggtgaagaaccgggtgatcagcacgttggtgtcggggaagtagaactgtttggtgcgcgcgccctgggtcgcggcgagttcgaagcagccgccccgctcggcgtccagcacggcggcgaagacgctgggcgcgtcgaaggcggggcagcagtaccagtcgatggtgccgtcggtgccgaccagggcgaccgtgcgcaggtcgccga

SEQ ID NO: 297 - DNA, 2672 bp, Unknown
  Kingdom: Bacteria, Phylum: Actinobacteria, Class: Actinobacteria, Order: Streptomycetales, Family: Streptomycetaceae, Genus: Streptomyces
ggggcgctccgcgccgggccgtgccggggggcgccggtgtcagcgcggcccgtctccgcaccggcgccgggcgccgctcgctgcgctcgcgggaccgtttgcacgtggcagttgcctaagagatttaggcatgtgcacaatccgttcaggtaaccgaagggatcactgtgccacgtgctggactcaccgccgaacgcctggtccgggccggggcggagctggccgacgaggtcggcttcgaccaggtgaccgtctcggcgcttgccagacggttcgacgtcaaggtcgcgagcctgtactcgcacctgaagaactcacaggacctgaagaccgggatcgccctgctcgccctggaggaactggccgaccgggcggccgacgccctggccggccgggccggcaaggaggcgctggccgcctacgccgacgtctaccgcgcctacgcccgcgagcaccccggccgctacgccgccgcacggctcccgctcgacgcggagaccgcggcccgaagcgccggagtgcggcacgcccagatgacccgggcgatcctgcgcggctacgacctgacggaaccggacgagacccacgccgtccggctgctcggcagcgtcttccacggctacgtcagcctggagctggctggcggcttcagccacagcgcccccgactccgagaagacctggacctgggtcctcgaccgcctggacgcgctgctgcgcaacctgaccgcgccctgaaacccgccctcaccgccccctcagatccggtgctccggacgcgcccggacaccgggtcccggccgtggccgggcgtccgggcgtgtctcaaggagcggtccccggcaaggatcatgcgtccaagtcgtgacgtcttgggtgggtcgatgctagaaaggccggatggcagaccgttttgcccgtcttcgacggataccggggcggtcgctggtgggaaagagtccgcgaagcgttgccggacaggtgttcgttctccaggtggctctcgtggcgctgctggtgatctgcgccgtcttcgccctcgtcctgcagtcccagcgggacaccagcgccgaggccaagcgccgctccatagccgtcgcccagaccttcgcgcactccccgggcgtcctggccgcgctgcgcgcccccgccccctcggccgtgctccagccgctgacggaggccgggcgcgccgcggcaggcgtcgacttcatcgtcgtcatggacacccacggcatccgctacacccaccccctgcccgaccgcatcggcaagcgcttcgtgggcaccatcgggccgtcactggctggccgggtccacaccgagagcgtgcacggaccgctcgggcaggaggtgcaggccatcgtccccgtcgaggacagcggcggccacgtcgtcgccctggtctccgccgggctgaaggtcaagaacgtcaccggtcaggtgtaccggcagatcccgatcatcctgagtgccggagccgtggcgctgggcgtggccaccgccgtgacggcgctcgtgggcaggcggctgcgccgccagacacacagcctgggccccgacgagatgacccgcatgtacgaccaccacgacgcggtcctgcactccgtgcgcgaaggggtgctcatcgtcggcggggacgggcggctgctgctcgccaacgacgaggcccggcggctcctggacctcccaccggacgccgaaggcagacaggtcacgcagttgcccaaactgcagcccgagaccctcgcgctgctcgcttccggccgggaggccaccgacgaggtccacctggccggagggcggctgctcgccgtcaaccagcggcccaccgaccgcgacggaggacccgccggcaccgtcgtcaccctgcgcgactccaccgaactgcaggccctgtccggccgggccgagaccgcccgggaacggctcaaactcctctacgacgccggcctgggcatcggcaccaccctcgacgtcctgcgcaccgccgacgaactcgcccaggtcaccgtcgaccgcttcgccgacttcgtcaccgtggacctcgacgatgccgtactgcacggagaggaaccgggcagcacggccaccggcatgcgccgcgtcgccgtgcgcggcgtacgggacgaccaccccctctacgagcagggccgactgatcgacttcctgccctccacaccccaggcccgcggctacggcagcggccggcccgaactggtgcccgacctgtcgtcggcggccggctggcaggcgcaggatcccgaacgcgccgggcggatcatggactacggcatcaactcgctcctcacggccccgatccgggcccgaggcgccgtactgggcgtggccaacttctggcgctccaaggaacacggccccttcgaggacgaggaactgtccctggccgaggaactcgtggcccgcgccgccgtcagcatcgacaacgcccgccgctacgcccgcgagcacgccctggcggtcaccctccagcgcagtctgctgccgcgggccctgcccgaccacagcgccgtcgacgccggataccgctaccttcccgcccagtccggcgtcagcggggactggttcgacgtgatcccgctgcccggcggccgggtcgcgctcgtcgtcggcgacgtcgtcggccacgggctgcacgccgccgccaccatg

SEQ ID NO: 298 - DNA, 10457 bp, Unknown
  Kingdom: Bacteria, Phylum: Actinobacteria, Class: Actinobacteria, Order: Streptomycetales, Family: Streptomycetaceae, Genus: Streptomyces
ggtggcggtcaccgcggtgaccgccaccccgtggtcccggcgcagctcgtccaggaacctgctgacccggcgcatgctcggccggaagtcctcccattgcggaagggtgtgtgcctcgtccacggcgatccgggtcacccggcccgccgccgcggccgcgcggacggtctcccggaagcgccgctggcacagacgttccgggctgacgtagaccaggcggataccgtggtcggctcgaccgaggagctggtccgtcacctccgtcttaccggtcctgctgctggactcgcgcagcggggagatgagcgcacggaccgcgccaccgatggaccggttcagttcaagggcctggtcgtgcatgagagcgatgagcgggctgacgaccacggttacgcccggcaggaccagcgcgggcagctggaaggtgaagctcttgccgaagcctgtgggaagcagtccgagtacgttgcgtccctcggccacggcggcgatgacggcctgctgcgccggcttgagggccacaggttcgtcgacgagccgcagcaatcctccgatacgggcgcagcggtccttgagctcctctaccagcaggccctgttcccgcaacttctgagtctcctcggtggtcagtgccaattcgcggatgcgcctcgtgtgcggcaggagggtctgtcgttcaagggcttcgttgatacacagctccgcggccctggcgggatccaggaggtggtgggccgccatgaatccccagatgcgacgccatccttcggccatagtggcgacgttgccacctccgacgtcgccggtttccggggcggggagctgaagtccgtcatcgaggctgccgaggaaggcacgtcggtaggagcggcgcaggctgcttgctcccgcgagtttgcggtcgctgatgacgacgacgccgcggtggcggtcggagcggatgagccgacccaccgcctgacgcagctggagcgcggcgagcggcaggtagtagtgctcggtggcggcaccttccggatcggggtggccggcctgctcggcccgtgcggcgaccgccgcgcgccgggcctccacaatcggagcggcgaacggcgcgaagggcagtttgttgatccacaccaaacgcagccgctcggcgtcggagacgtcgaccccctgccagagtcccttcgtgccgacgagaaaccctccgccgtcacgccggtcggtgaaggcctgataggcccgggcgttgccgagagtgagcgcctcgacgactggtgtgtctagggcgcgggagcgcagttcccgtaggaggtggaagccgatgcccgcggcggtcgagcgggcggtcgtgaggatcacggcgccgccgtcgaagccgttgccgtcggcgcgtacacgcgtcatttctgcggcgaacccagcgacttggtgggcgacagtccgcaaggcgccctcctcctgctccgcccaggaggggaagtcggagaagcacacgacctcggcctggctgcgcagggcgaacggagaaggcagggccagcgtcggcacatcgtcgggcaacccgagtcgggtccgcatgaagttccattccccggctacacgcagagtcgcggagacgtagtggacacggtcgaaggactctaggtatcgccgccactccgggtctgcgggcagatcgacgggactggtggcgacacggaagcggtaggaccgcagctccgccctgggttcgtccacttcctccagatgtatgacgcgggaagggggagcctcgtccagggtgagggcggggtcgagaaaggcgcggatgtcggccgtgatccggtcgagggcattggtgagggagtcggtgtgctccgcgagcgcggtcaggcgctcgcgtatcaggggatcgatttcggcagcgtgctggaccacgtaccgctccagcgtgatgcgacaggacacgagcgccttggcgatgctctccagcactagcgacagccgccgggtgtgcttagtgccggaggttccagcgtaggggctggcgagcgtggtcgaccggctgccgatgcgtacgcccacgcccttggcctgggcgtcgaaggcctgcgccgccagtcgcggaaggcgttcatcgtcgagcagccgctcgaggtcggcaatcgctgtagcggcctgctccttagcggtgcccgggtgcgcgtcccctatccatgcctggtactccggcagcaaggcttccaggtcctggtagtcggcagtcacggtcagcgcggatgtggcggcgttctccagctcatgcgcctcgtcaatcacaaggagcacgtcgggtccgagggcacgcaggtcgtccaggtgggaaaggacgagcgcgtggttggcaaggatgaggcggtggctgtcgatcgactcccggacggtgtcggtgtgcgcggtgagcgggttgcctgcgccggggccgtagtcgccgtcgcgctgcgacagcgactccagccagagcggcaggccgcgcccgacgtagtcggtgaaaaaggcgggcaggtccaccgggtcgaccgatctggccgtccaagactgcgggggcttcttagccgcgagcaggcgcagcgctaggaacacggcgagttcgcggaaccggctccgctgggagatgcgagcccgggcggtgcccgcggagctgcgccgacgcgtggcctcggcgagggccttcgtcagggctgcgagggagagccggttggacttacccttgaccaggtcggcgactccgaggatgcccggcagggcccgctccaggtcctggatgtccttcgccatctggctctgcaactgtttggtgtacgtggcgatgacagcggtacggctatcgccaccggcgagccagtccagcgcggcggcaagtaccgcatagctctttccggtgccggtgggcgcttccagcatgccgccgacgccgcggtcggtccagtcgtgcagcgtcgccgtcatctcctgctgcgcgggccggggttcaacgcggaagccgtgtacgacccgggcgagagcggtcggctcgacccgcccgccggcgccccgaaagacgtccggcacgtccacggcgcccttgcccggtgcccttccgccagaggttcgacgcggcgtgtgctgtccaaactcggcacccaacaggcgggccacgctcgcctgctcccacacccgcggctctcgatcgttggccgcctcgccctcggccagttcccgcagcaaccgccaggcgtcggagtcggggcagacgtcggcaatgagatcgcgcaattcggccgtcctgcatgcgaactccgcggcggcccgctccaggagacgcaccagcagtaccgcgtcgccgtccgcagtatgggcacggaggtccgaacggaagacgtcgagctgaagcgcaaggtcctgaagtcggtgggaagaggctgtcggccaaacggcgtgcgcgaggtacaggccatcgacagggtgcacagcggagagcggatcgcgggtactggcctccttcgccgcttcactgacgacggggaagtccagggtcgtgccgttgtaggcgaccacgacatcggcatccgacaggaagtcgctcagctccgtccacgcctgttgcggagatagcccctggccgagtacggcgtcccggacgctgccgcgcaactcctcagtgtccccatggaacctgaggtaacgccgccagcgtggggccgcagcgacccattcccgatcggcgccgaacctgaccgctgccacctcgtagacgtgccgctccaagtagggaacagtcgccgtcgtacgtacaacgctctcgacgtcgagcgcgacggcccgcagcacggatgtctcgtccaaccgttcagcgatagcggagtcggcgcctggcttgcgtcgttcagacgccacctgcgtcgagggcgccgattcctgcagagcagcaggcaggagaaggtcccccgaagcgatcagcagacctccacggaccgcctcggcgaccagcttgactaaccgctgctccggcagtgtgccgaactgcctcttggcctcgacgaccagttcccgctcagaaattccggacgtaaacgcgcgaaccagctctgcaactttccgcgatgccgcagaaaccgtctgcccttcgggcatgcacaccccccttgcacatagcccggcccatgctcgaccgcgccgctccctcggctctccctcccctggagacccgggacgtgggctacatcatagtttgatccgggcagttacgggccttcagcagaaatattcgggggcaactgacagacatggacaggcgtgacggtgttcagcttccacgagccgaactggcgcacaagacgcacgttgatggaagttttgcgtgctcgcccatcgagtacgcggcctcttccgtagggctgggcccgagagggccggaccgacgcctacggcctcgctcagcgccttggcaccgggtgcactaccacagccggatgatgtcgcttctgctggcagacgtctgccgcagggacagcaccggtcccgagccgatgctgtcagcactggtagtcaatagatccagccgaaagccttccgaccaatttcttcgagctggccgttaccgagttccgccgtcgggaccccgactggacatgagagtgagagcgggatgcagtgtttgaccgttaccgcagcccggtttccccgtgagtcaactgcggggtagcgcgtagagcgctcggctgccctgcacatccgccgtgcagggcagccacccaccgtggacggctccgggttgaaacctgctggctacaccgcatcctctcgttgcaacggcggtagaggggatggacgcgatgaccgcctctcaggcgttctcgtcgtggattcgcgcgcccagatcctccgcccactccagcgcccacgccttgagttcttcgatctgccgggaggtgagcccgtacgcggtgtagtcctcatcctcgtaccagtccgcgccgatcagccggtcccggaggtcttcgaggctgaactcgtcatgggcgcgacggcggcccagggattcgaggtcggcggtggagcggtgacgggaggcagcctggacgtcgatgaggtcgcggacggtgccccggtcggcgagggcacggaccttggtgccgatcacatcgtctagggaaagaacggggccgtagcgggtctgggcaggcggagcccagaacgcctccttgaggacatcgacctcgcactcctcgccggtgtccggatcggtgacgagaaaccggccgctgagcggatcggtctggacgtgcgtggtccgccagccgcgcgcgctgaggcctgctgtgagtgaggcgacgatctcatgcatcggagcggggttctcggtggcgacgtcgaggtcacggctgaagcgttcgaccaggccgtgggcctgcacggcgtatccgccggtgagaaccagagggtagggggagccgaggtcgaggatgtgggcgaggagacgctcgtggagcggagtgagcttcacgcggcggtcgtgtcggccggagcgctgcggagcagctcggggaaggcgtcctcccagacctcgcggatgtagggactgatcaagcgccgcagcacgggccactgctcggtgagcagccggtggtgcaggagggccaccaggtcctcactcagtccttcggcgaggacggtccggtaaagcgtcatgcgggacttcggacggtccaggctgtagctcgtccgcccggaccaggcgatgtggagcggcaagtccacgttgccctcgacggggccggccagctcctgcaagcgctcgggcagtcggctgcggtaacggtcccgcagcacctcggcgcgggggacggtggtcgtcgtgtccatgcatccagtatcactgctgggaggcggcagcatggcggatacggggtgccctgtcgtacgtacgcatcgggcgccgcctgcccttctatcggacctctcacccagtgggcgtttagcgcatcatcgcctacccgcgcaggcccccaggtggcgcggcaaccggcggccctgtagacccaggaccagccctgctcgtgggcacgggtgatcatgacgcagcaggtcacgcggagggccgccgcagtggaatcggctgcggcttcggtctcggttcggaaatgacgacggtgccgaagccgaggcccatggcgccggcgcagtggacgagaaggacacgggggcgggcgaggccgcggtagcggccggagggcgcaggcggcatctatagggcacgccgctccggccccgaacgcagcccggtcgctcaggacccacgccgcggacagctgtcgagccacgcagcgaacctcccaagagggagccaggcgcctgtgtccaggcccccgtcatggcggccaccaggtcagcaagctgggtcgctcccgcgcccggtgctgaccgtttgctgacccgagcggggccatcaagcctctgacctgcaaaaacacccaaacgctagatcttggacttgaacagagtacgcagcactttggactcctggaagacggctccctgcctgctttgtgcaggtcaagggcggtcttcactgtacaccggcactcgtcgcagccgaggagggtgaggaacatgcctcacgtcgggcggggcggtttcctgcccgcggcgcggcggctcagagagtgagcatgaccttgccctggtcccagtaagtgccgtggttggtacggacggcgactctgccgtccttggtgaggacgaacaagtcggccttgccatcgccgccggcgtcgccgaactccaggacacccagcccggtgccgtcgatgaagcggtcccagccggcggaccactgtttgccctggtcccagtaggtgccgtggttggtacggacggcgacgttgccgtccttggtgtggacgatgaggtcggccttgccgtcaccgtcgacgtccgcgaagtacagccggcccagatccgtccaggtcacgaagcggtcccagccggcggaccactgcttgccctggtcccagtaagtgccgtggttggtccggacggcgatgttgccgtccttggtgtggacgatcaagtcggccttgccgtcaccgtcgacgtccgcgaagtacagccgccccagatcacttccgtcgatgaagcggtcccagccggcggaccactgcttgccctggtcccagtaggtgccgtggttggtacggacggcgacgttgccgtccttggtgtggacgatcatgtcggccttgcggtcgccgtcgacgtccgcgaagtacagccggcccagatccttccaggtcacgaagcggtcccagccgccggacatgaccttgcccggggcgaaggtgtcaccttggttgcggtagacgaccacgtcgccgttcgagcgcaggacgaccaggtcggccttgccgtcaccgtcgacgtcggccgagtagctccggtcgcggttgcggacgtccttcacccagtccgccaggccgtcgaccctggcgtccaccgcaccggtccgggtctccgtctcgccgaaacacccgccctgccaggaaagactgtgaacggcggtcagctcgacctcgctgccgttgctgcgcagggccgggccgccggcgtcacccttgcagacggaggctccgtcctgaccggtcagcgccacggtggtgtcggccgtggagtccaccttgaactgaccggtgtgcaactggtccgggacccactcggtgccggtccgcccgaatccggcaccgatcaaggtctcacccgcgtcgggggcgttggcggccagtgccactggcttgacggtggtgacgggctcggcgagccggaccatggccacgtcgcggtcgtcacgcgggaccacctcgacgacatcgagggtctgcttgcccacggtcgctctggtcttcagcgcgggcttgcccggcttgaccacggcacccggggtgggcgcgaagcaactcgtggcggtcaccagccactgctggtgcaccagcgcggcggagcaggcacgcagggagtcgccctcgccgatgtccagccgggcggtgaaggcctggtcgcccgcggtcgcgggcttgcccgagagcgcctgtgcggccggcgctgcactgagcacgcctgcggcaaccgccaggacgacgccggcggtcatggcaccgcgagtccgccgggtgcggattcctgtggtgggcaacgtacttcctcctagggttgatcgtgcgggtgaccgacggtgtgagcagacggtccgtcacagtcgcgcgacggcccgcagcgggggtggggcagacctcgccccccgcccggctcggagagcatccggcctgcgccccgggcgcaggccagatggcccttgaggggccggccctgtcacatcgacctccccacggcgggaggacgcggcctgccgcgcgacgacggctgctgccgggggcggccgcccagtggctgggcatgtccaggacgggccgagaaaggaacgctgcgccggccggcgccgggcaagggccggtgtccgacggtctctgccggtgacgcgccgatcgggaacgccgaggggtccccgcgcccggctcgccggcctgatacctgccgagaatcccgggaccggatcactgtgcggtccgtacgccggaccggagaggacgctcccgggcgcggcggccggcgtcggcggcgcctcgcagggtgccgcagggtgcgtggcgaggcggtgacggcgggcagtcgcaggtgacctggaaagttcctggcgcacggggcaccgagggcgggttacttcgaggtcctgatctccacgagcatgtggtcgcggccctccgggtccgcggactcgcccaccggcgtccagctgttcttggtgatctcgtaggacttctcctcgctgcccacggtcatgtcgaccgtggtggagtagtcgttgcccctgatcgagaagacggcggggatctccagggtcagccagccctcgttgccgacggtgttgaaacagatcttgtcggccttgtcgcgggccaggagctccaactgcccggttcctgtgacgcagtcggcgagcgtgatgtggccgtcgcctcgcttcaggacgatgttccgctccgccaggatcttgtcggcctgggggtagttgaagtcctccacggcatagccgggggcgtcgcccgcgaccagcgcggcggtgtcggcggcctccgcggtgcccgcacccgcgccctgcgcgccgccggccaccgcggtccaggccagcgcgccgccgacggcggcggcgagtacccgtaccgtgagccgcattctccgcgactttccgacgtcggtgccgatttccttcattccatcccccatttcgtagccaccgcccggcctctagccaccgcccggcctcgcacagcaccggtctcgaaaccggtcgccaaacctgtcacgaacaggggaagcctcacacgcggaagaaatcccccttgcgcaccctcggcgcgcctccgcgacgcactctccgaaccccccggtgatcgtcatcggccctgacatcccagcatggcgacgcacccgcgtccagcgccgtgaaatgcccatacccggacattgaaagcaagctcgccgtgacctgtgtcacgccgcgaaaaggctgcagggactgacgtcctgttttcaccgggaaagtagttgtgccgtcaatctgtatgacgttgtgcgaagttgacgcatagacaggcgtaactgcccggtgtttcgaagaggttgatactgtccacgaattacggcgagggccgatccgccgtccgtcacggcgcgaaatccgacacgtcatcgcattactcgtagaagggcacgtcccgcatgcagacagctttctggagcagacgccgcgtcctcggcgcgctcgcggccgcgaccgctgtcgcggccaccccctcggtcctgcggccggccaccgccgcggccgccgagacgggaggggccgacccggtgccgctgccggacaccgagcgcgccaaggcggtccgcgcgtggctgaccggcggcaagggcgtcaaggccgccgccaccacagccctgtgcgggaccgacaccgagatccggaccttcctcgccgagacgctgccgcagcagaccgtgcaggacaaccgggtcgcgatcgtccgcagcctggaccgtgcgggcaagggcctgcgccgtgaggccgtcgccgccctggacaacggcgacgaggcgatagccggcttcctctcgaagggcttcgcccccgccatcctggaggatttccaggtcgccaccagcatcgtcgcgtccaccggtgacaagggcgtggtgcgcgcggccaacgccgccctcgacgccggcaccgagccggccctgctcgccttcctcgccgacaagcagtacgacgcgcggctggaggacacccgggtccaggtcagcgtcatgctgatgaccggcggtccgcatactgcagaagcatccggaccgccggtcatcagcat

SEQ ID NO: 299 - DNA, 3060 bp, Unknown
  Kingdom: Bacteria, Phylum: Actinobacteria, Class: Actinobacteria, Order: Streptomycetales, Family: Streptomycetaceae, Genus: Streptomyces
gtgccgctgatcgccgcgtgcggcgacggcggcaccgccgcgaaggccgaggccaagagcgccaagctgctgccgaccaccaccgtgcgcaacatcggcctcaaggccgacctgcccggcaccgcgacgggcgtaccgaacgcctacctgaagtacccggcccgactggtccgcgcgaccgagggaacgccgctcaagggtgccgagaagatcaccgccgtcaccgagacgttcgcgccgctgccgcccgagcgcggcaagaacgcggcctggcgggagatcgagaaactgctcggcacccaggtcgacttcacggccgtgcccgcggacgactacccggcgaagttctccacgatggtcgccggtgaccaactcccggacatcttcatgtacccggagaccggcggcgtcgacaacatgggctcgttcctcgccgccaagtgcgccgacctgggcccccacctctccggcgacaaggtcaaggactacccgaacctcgcggcgatcccgcagtacgcctggcgcgacgcgatcaagggcggcaagctctacggcatcccgatcgcccgctcgggcagcgccggcaccggcttctaccgggccgacctgttccacaaggccggggtgaccagcctcgaccagatcgacagcatcgaacggctcgtcgagctggccaaggacctcaccgacgcgaagaagaagcagtacttcttcaccggcggcagcaccaacctgctcgccatgtcggccggcgcccagcacttctggcgcttcgaccgcaccaccggcaagtggacctaccaactggaggacgacaagtaccgatacgccgtcgagaccgccgccaagctctacaaggcgggctgcttctacccgggcaccgtgcagatgtccggcgcccagaaagcccagtacacggacctgttcaagaacggcaaggccgcctacgtgtacgacggcatgcccgcgtacctgaccacggccaccggatacgtcgacgccatggcggccatcgacaggtccttcgacgtacggcccatggtcccggtcggcaaggacgcggtgacctggaccgacaacgtctcgctgcagaactgctacatcagcagggcgagcgagcagcgggtcaaggaactgctgcggctcgccgacttcgccgcctcgcccttcggatccctcgaatacacgctcatcaactacggcgtcgagaacgtcgactaccggcgcgacgcgaacggcacacccgtcctcaccaaacagggcagccaggacgtgaccgtgccctggggcaagctcgcctccgcgaccccctcgttcttcagcgccacccacgccgaggccgcccgctacgtgcacgacgcgtacgcggtgctcatccccaagctcatcgaggacccgaccctcagctactcctcgccgacctgggactccaaggggctcggcagcctctacaccatccacctcgacggcctcaaggacctgatcaccggacgcaagccgctgtcggcgtacgacgcgctggtcaagaagtggcgccgcgccggcggcgacacatgccgcgccgagttcgagcaggcctcgcagaaggacaagcaggactcgcagaaggggaagaagtgacctccagcagacgcgcgttcctcacgaaggcggcggtcgcggccgcgctcaccgtaccggtgctgggctcgcccgccgacgccgcgggcttcgacccgcgccccggctccgacggggtcggcgacccgctgttccccaccctcggcaacggcggctaccaagtcacccactacgacctcaccttcgacttcaccccggtgacgtacgacttcacggcggcggtgaaactgagcgcgcgggccacgcaggacctgtcgtcgttcaacctggacaccgacggccacaccgtcgactcggtcaccgtgaacggccggtccgcgtcccacgccctgtcgctgggccagtcgggtcaggaactgacggtcacaccggccgcaccgctgcacaaaggcgcgcccttcgacgtcaccgtcgcctaccgcggcaacggcaaggcgccgcgggccggactgaccggctggcggttcggctcggacggcggcttcgcctcggccgcgcagtcgtcgcgggccgacaccttcctgccgtgcaacgacacaccctccgacaaggccacctggaccttccacatctccgcgcccgaggggtacgtcgccgccgccaacggagtactgaccggcaaggacaagcgcgccgacgggtccaccgtgtggcacttcgcgctgcgcgagcggatgccgacggagctgctcggaatcgccgtcgtcaagggcacgtacctgtacggcacgtcgcacaccgggctgcccctgcggcacatcgtcccgcagggccacgaggacctctacgccccgatcgtggcccgcacccccgaccatctcgcctggctggaggcgaagttcggccgctaccccttctcggtgtacggcgtgcacatctacgacgggtacaccgacgccctggagaacacgacgctcaccctgatgggcaccaactggttcaagaccggcgccgacggcaacccgacgtacgagaacaccatggtgcacgagctgacccaccagtggttcggcgacagcgtgaccccgcacgactggcagcaggcctggctcaacgagggtccggccgtgtactacgcggcgctctacagcgaggagcgcggctggtccgtcatggccgacaagatgaaggcgacgtacgccaagctcgacgcggtccgtgccagcgacgggccgcccggactgcccaaggccctcggcggcaccaacatctacgacggcggcgcgctggtgctctacgcgctgcggctccaggtgggccggcgcaggttcgaccggatcatgggcctgtggccgcgccgcttcagggaccgcacggtcaccagcgaggacttcatcgcccacgccgtcaccgtgaccggcgaccgctcgctcgaccggttcctgcgggactggctgttcggcgcgcagaacccgccgatgccgggccacccggactgga

SEQ ID NO: 300 - DNA, 4515 bp, Unknown
  Kingdom: Bacteria, Phylum: Actinobacteria, Class: Actinobacteria, Order: Streptomycetales, Family: Streptomycetaceae, Genus: Streptomyces
gggtcgcgggcccgtagtcggtcccagtcttccgcacccccgtggcggggccgccaccggccaccgccccggccggtccggtgcgggcgggcctcccgcgcccgctcgggcgaagcgggccggacgcacctacgatgggcgcaagtgggctcgaagacgggggcaccgggccgcccgtcgcgaccgcacggggtgggagacacatggcacaggccgcggaagccgcgcggaccgtcatcatgaccgtggacgacgatccgggagtctcccgtgccgtcgcccgcgatcttcggcgacgctacggcgagtcgtaccggatcgtgcgcgcggagtccggcgagtccgcgctggacgcgctgcgcgagctgaagctgcgcggcgacctcgtcgcggtgatcctggccgactaccgcatgccgcacatgaacggcatcgagttcctggaacaggccctggacgtgtacccgggcgcgcgccgggtgctgctgaccgcgtacgcggacaccaccgcggcgatcgacgccatcaacgtggtcgacctggaccactacctgctcaagccgtgggacccgcccgaggagaagctgtacccggtcctggacgacctgctccaggcgtggcggcacagcgaccaccggccggtgccgagcaccaaggtcgtggggcaccgctggtcggcgcggtcctcggaggtccgcgagttcctggcccgcaaccaggtgccctaccgctggtactcctcggacgagccggaggggcagcggctgctgcgggcggccgggcaggacgggcagcgcctgccgctggtcgtcacgccggacggcaccccgctggtcgagccggaggctccggaactcgcgggacgtgtggggctcgcgaccacgccggcggccgacttctacgacctcgtcgtgatcggcggcggtccggccggactgggcgcggccgtgtacggcgcttccgaggggctgcgcacggtcctggtggagcggtcggcgaccggcggtcaggccgggcagagttcgcggatcgagaactacctcggcttcccggacggcgtctccggcgcccagttgacggaccgggcgcgccggcaggccgcgaagttcggcgcggagatcctcaccgcgcgtgaggtgaccggtctggaggtcaacggcgcggcgcgcaccgtgcggttctccgacggttccgcggtcgccgcgcacagcgtgatcctggcgaccggtgtctcctaccggcagctcgcggcggccggggcggaggagctgaccggctgcggcgtgttctacggttcggcgctgaccgaggcgcccgcctgccacgggcaggacgtgtacatcgtcggcggcgccaactcggccgggcaggcggcgatgtacctgtcgcggggtgcgaagtcggtgacgctgctggtgcgcggcccgtcgctgtcggcgtcgatgtcgcactacctcatccagcagctggaggagtcgcccaacatctcggtgcgcacgggcacggtcgtccaggccgcgcacggcagcggccacctggagcagctcaccctgcgcgatgtggagagcggcgtcgaggaacgcgtggacgcgcagtgggtgttcgtgttcatcggcgccgcgccgctgaccgactggctggacgggacggtgctgcgggacgagcgcgggttcatcctggccgggccggatctgaccgcggacggacggccgccggcgagctgggagctggaccggccgccgtaccacctggagaccaacgtgcccggcgtgttcgtggcgggcgacgcccgcgccgagtccgccaagcgggtcgcgtccgccgtcggagagggagccatggccgtgatgctggtccaccgctacctggagcagtcatgagcgggctgtcatgagcgggcgtgtgatgccgtgcagcccccaggagatcggctcgctgttcctgttcgagaagctgtcggacgagcagttgggccggctgtgcagcgccgggcgggtcgagcggttcgagccggggccggtgtacacggagggtgatccggccacctgcttcttcgtgatgatcgagggtacggtcgtgctctcgcgccgggtcggccacgacgacgtggaggtcgcccgcacctcgcagcgcggggtgtactcgggcgcgatgcaggcgtacatcggcgaccgggtgcggcaggtgtacaccaactcgatgcgcgtcacggagccgacgcggttcttcgtgctgcccgcggacacgttcgcgagcatcatgcgggagtggttcccgatggcggtgcacctgctggaagggctgttcttcggctcgaagaacacccaggcggccatcggacagcgcgaacggctgctggcgctgggctcgttgtccgccggtctcacgcacgagctgaacaacccggccgcggcggccgtgcgggccaccgagacgctgcgcgagcgggtggcgaagatgcggcacaagctcgcggtgatcgccgagggccctttcacccgggagcagttggcgcacctcgtcgacatccaggaacgcacggccgagcgggtcggcaaggccccggtgctcagtccgctggaggccgccgaccgcgaggacacgctcaccgactggctggacgaccacggcgtcggcaacggctggcagctcgcgcccacgttcgtgcaggccgggctggacgtcgactggctggagcaggtggcggcggccgtcggcgaggacatcctgccgggggcggtggggtggctcaactacacggtggagaccgagctgctgatggacgagatagcggactccaccacccgtgtctcccggctcgtcgaggccgccaagcagtactcgcagctggaccgggcgccctaccaggtcgccgacgtgcacgaactgctcgacagcacgctgctgatgctgtcgggcaagacgggcccgcggatcaaggtcgtcaaggagtacgaccggacgctgccgcggatccccgcctatccggccgagctgaaccaggtgtggaccaacctgatcgacaacgccgtctccgccatggccggcgcgggcggcgagggcacgctgaccgtgcggacggcgctccacgacgaccggctgctggtcgagttccgcgacaccgggcccggggtgccgccggagatccgcggccgcatcttcgacccgttcttcaccaccaagccggtcggccagggcaccggcctgggcctggacatctcctggcggatcgtggtcgacaagcaccacggcagcctcacggtggagtcggtgccgggcgacacgcgcttccaggtcctgctgccgctgaccgccacggccggcgacggcacggcaccgggtgacggcacggcaccgggtgacggcacggcaccgggtgacggcacggcaccgagtcccacttccgaggaggcggtatgagcgagggcggttccgatgacaccttcgtcgacccggccgcggcgccgagcggtccgggctgcgtcgagtgcgaggcggccggcggctggtggttccacctgcggcgctgcgcgctgtgcgggcacatcggctgctgcgacgactcccccggcaagcacgccggcgcccactaccgggccaccgggcacccggtgatccgcagttacgagccgggcgaggagtggttctggaacttcgcgaccggggagctgtacgactccggtccgtccctcgcgcctccggcggcccatccggacgaccagccggtgccgggcccggcgggccgggtcccgcacgactgggcgcgtatcctgcgctgagctgaccccggcggggccctgcgaggccccgccggggacgaggatgccccgccgggggcggggcatccaggtcaccggtgcggcggtccgtcagggacgggccgccggggtgttggcggcggtgacgttgaccgccgcccaggacgtgtccaccgtccggtactcggtgctgttcgcgccgtagaggtccttggccgcctgcagcgtcgcgacgcgcgcgtcgtggaagtcggtcgtggagaccatgtagcgggtcagcgcccggtagaagatcgccgtcgccttggtgcggccgatgccctgcaccgacagcccgccgtaggtcggcgagtcgtaggcgacgccgccgatcgtcctgcggccgctgccctcggcgagcaggtagtacgcgtgcgaggagacaccggaaccggcgtgcacctcggtgtagtacacctggggcgaccagtagtcgatcgcgccctccagcttgtcgagggaggggtggtcgaggcggcgcaggaacttctgcgcgaggcccagcttctcaccgaggaggtagttcggcgggttcttcgggttgttggcgaagaactcgacgttggagccgaagatgtcggcgagcgactcgttcagcgaccccggttcgccgtactggttgccggcggcgtccacgcgggtgggctccagccgggccgtggagtccacgactccgtgggtcagttcgtggccggtgacgtcgagggcgacgagcggc

SEQ ID NO: 301 - DNA, 5135 bp, Unknown
  Kingdom: Bacteria, Phylum: Actinobacteria, Class: Actinobacteria, Order: Streptomycetales, Family: Streptomycetaceae, Genus: Streptomyces
cctccagggtggtcgcggccgagccggcggggcgtgcggccacgggagcggtgtccgcgccgtacgcgggcccggcgagtccgctcacggcggcgacggcgagcgcggccccggtcacggccccggccggcagacgtgcggtacgtcgcatcggtgctccttagagctgctcagcggtcgggacacggcccgcggcaccggcatgtgccgccgtcgtcgcgtccctgcccttccgaggtaagtggcacatgcgcccgcccgcttcctgagggcccgtcagaaatacgatgaacgggtgccgccgcgatcggcgcacgagccgcgaccgcgggcgtttgcgcaggtcagcggcgcgctcctgacgaggcgtcggcaatttcccgaagggggcgacaggcgggggtgaacgggtgaccggggggcgcgggacccgggcttgacctcaagcgcggttgagctaccaggctgtcccgcatgaacaccaccgcggcgcccggcgcgcccctgaacgtcaccctcgtcgtcggcagcaaccgccacggccgcttcggccccgtgatcgccgactggctcctcacgcacctgcgggagcggcccgacttcgccgtccaggtcgtcgacgtggccgagacggccgccctcccgacgaccatgaagccggacgcggaggcgacggcggtcctggcggaggtcaccccgaagctcgcctccgcggacgcgttcgtcgtgctcaccccggagtacaaccactccttccccgccgccctcaagaacctcatcgactggcacttcaccgagtggcaggccaagcccgtcgcgctcgcctcctacggcggcgtcgccggcggcctgcgcgctgtcgaacacctgcggcaggtcttcgccgaactccacgcggtcacactccgcgacacggtctccttctacaacgcgggcggcgccttcgacgagcacggcaccctgaaggaccccgcggccccggacgcggcggcgaagctgatgctggaccgcctggtgtggtggggccacgctctgcgggaggccagggagcagcggccttacgggagttgacgacggctgcggtcaacccgcggtggtacggctaccgccggggttgaccggcgggttcccacgccgggttgacgcggtggggtccgcacaccccgtacgttcggcagcgacacggttcctggagcgcgggccccggcagggcggatgtcccggtcagagggtcccggcgccgctatcgctgcggtcgacgcagcagaggaggagcacacccatgtccccgcgcacaaccctggcggccgtcgccatgtcagccgcgttggccggtggcggcctggtcctcgccgcccccgccgaagcggccccgctgtgcgatccctggggcgcgaccggcaccgccggagacatcggcggggcgtacgcgcacgggaacatgtgcatcttcaacgtcgacaaccgcccgagcgtcgaggtgcacctgagggacacggccaaggacggcaaggcggcgtgcgtccagctccacgccacctatgccgacggtggcacccgtgacgagtgggtctacaacggccgcggagcaggagcggacaaggaggtggaggcgaactacaccttcgcctccagcctgcgtggcatctgggtgcgggaaggcctgggcaagggccgggtctgtacggtcatggcccgcggggtgcacaccatctaccggtactgagcccactggtacgcggaagaacggccgcctccgccgtgcgggcgggggcggccgtcgtgttcgggcggagaggtcagttcacgctgaccgcgctccacgccgccgccaccgcgttgtactccgtggagccggcgccgtagaggtccttcgcggcgctgagggtggccgtcctggcggccgcgtagttcgtcgaggacgtcatgtagaccgtcagggcccggtaccagatcttgccgagcttgtcgtggccgatgcccgtcaccgtggagttgttgcaggtgggggagtcgtacgcgacgccgttcacggtcttcgcgccgctgccctcggcgagcaggtaggcgaagtggttggcgacgcccgaggagtagtggacgtcgaggttgcccaccgaagtgctccagcagtcggccgagttgccgtccttggaaggcttgtccatgtagcgcagggcggtgccgccgaagccggagcggacgatcttctcgccgatcaggtagtcaccgggatcggcggggttgttcgcgtaccactccaccatcgtgccgaggatgtcggacgtggcctcgttcaggccgccggactcgcccgagtacgtcagtgccgccgtcttggacgtcacgccgtgcgacatctcgtgtccggcgacgtcgagggcgacgagcggcccgaaggtcgtgccgtcaccgtcgccgtacgtcatgcagaagcagctgtcgtcccagaaggcgttgttgtagttggtgccgtagtggacgcggttgtacgagcccttgccgtcgcccgctatgccgttgcggccgtggacgttcttgtagtagtcccaggtctcgttcgtgccgtactgcgcgtccaccgccgccgaggcgcggtccgccgtggtgcccgtgccccagtggttgtcggtgtccgtcaacagggtggcgggcgcccgctggaagcagatgccgaagatgcacaggtcggtcttgttctccgcgtcaccggtgtacgtgttgccgcgcgtggggtccttgagctggtacgccgacccggactgcgtcgtctccagcgcgaccgtgccgctgtagagcgacttgccgtcgcccgtcgccgtctcgatgctgtcccaggcgtcgatctgcgctccggtgcgcgcgtcggtcaggacggtgcgggcgaccgggttgccgagggagtccagtccggccgcgacggtgcgccaggccaggcgcggggtgccgtgcagggcgtcgacgaccaggcccggtttggccttgacctgctgcagacgggcaccggggttcgcggcgcgcagcgcgtgctcggcgaggtcggcggcccgcggtgcggcgaggcgcggtgtggtggtcgggagtgcgatggtggtgtgcgtggcgcggttcgcgccccggtaggccccgtccggggccaggtggaccacgaagtcaccgcccagcacgggcagtcggtcgtacgtacggtcgtaacggacgtgctgggtgccgtccttgtcgacgatcacgtcacggacggtggtgtgctcgtcggaggtgagacccagggcgccggtgtggcccgcgagcgcggcggcggcgttgtggacggcggtggcgcggctgggtctgctctccgcgtgggcggcgggggagagtacggcggccagcagggtggcggcggtggcggccacgccggctgcggcaaggcgggaacctcgggtgtgccgtgtccgactcatcggtctccttgagcgcgggcgccctcgggcgcgcgggggtggcgctgacggtgaccgagatttaagtgcccatgacatgtcatgtccatagcgcctgcaggaatgagtgtccgcgggcgcgacgggggagtgcggggtgggggcggtggggcgaaccgtgctacggggctcagggctccctgcggccgtccccggaaccgtccgcgacctccacccgtaccgcgcacaccttgaactccggcatccgggagaccgggtcgagcgccgggttcgtcaacgtgttcgcgcgacccgcgccgggccagtggaagggcatgaacaccgtgtccgggcggatggcgtccgtgatgcgcgcgggcgccaccgcgcgcccccgccgggacacgacggccagcgggacgccctcgaccgcgcccagccgcgccgccaggcgggggtgcagctcgacgaagggaccgggcgcggcggcgttcagctcgtccacgcgccgggtctgcgcgccggactggtactgcgcgacgacccgccccgtggtcagcagcaccggatacgcgtcgtccggctcctccgcgctcggccggtgcgacacgggagcgaaccgggcccggccgtctgcggtggcgaagcggtcgaggaagagccggggggtgccggggtgttgcgaagggcgcgcgggctgcggggtctgcgcggggtgcgcgggccgaggggcccgaggaggctgcgcggggtgcgcgggctgtgccggcggtgcggagagggtgtgctccggatcagcggcgtccgccgggcagggccagaacaccccgttctcgcgtgccagcctggcgtaggtgatcccggagtagtcggcggggccgcccgcgctcgctcggcgcagttcctcgaagacctgctccgggtcggtcgggaagcctttccccacgcccagccggtcggccagcccgtgcagtacctccaggtcgccgcgcaccccctcgggcggggccaccgcgcggcgccgcagcagcaccctgccctccaggttcgtcgtcgtgcccgtctcctccgcccactgcgtcaccggcaggacgacgtccgcgagcgccgccgtctccgacagcaccacgtcgcacaccgcgaggaagtccagcgagcgcagccgttcctcgacgtgcgcggcgcgcggcgcggacaccaccgggttggagcccatcagcagcagcgtgcggatgtccgtgccgagggcgtccaggagttcgtacgcgctgcgcccgggccccggcagactgtccgggtccacgccccacaccccggccacgtgccgccgcgccgccggatcggtcagcttgcggtaaccgggcaactggtcggccttctggccgtgttcgcgtccgccctgcccgttgccctgcccggtcaggcagccgtacccggacagcgggcggcccgcccggccggtcgccaggcacaggttgatccacgcgcccaccgtgtcggtgcccttggcctgctgctcgggcccgcgcgcggtgagcaccatcgccgcctccggctcgcagaacagccttacggcctcccgcagtcgggggacgggaacgccggtgacccgttccacgtactccggccagtgcgccatggccgccgcccgcgccccggcccagccgctcgtgcgctcccggacgtactcctcgtcgacccggcccccggcga

SEQ ID NO: 302 - DNA, 5416 bp, Unknown
  Kingdom: Bacteria, Phylum: Actinobacteria, Class: Actinobacteria, Order: Streptomycetales, Family: Streptomycetaceae, Genus: Streptomyces
  misc_feature (245)..(292): n is a, c, g, or t
ccgacgacctgctgcccaccggggtccggcgggcgtcgggtccgggcggcggacgcacccgcgcggagcggcgcaagctgcagcgcaaggtcaagcgcaagcgcaggcgttcagccgtacgggagattccgctcctggtcggggtggcggtcctcatagcgctggtgctgaagaccttcctcgtgcaggccttcgtgatcccgtcgggctccatggagcagacgatccgcatcggcgaccgggtnnnnnnnnnnnnnnnnnnnnnnnnnnnnnnnnnnnnnnnnnnnnnnnngagaaggacctgatcaagcgggtcatcggggtcggcggtgaccacgtcaagtgctgcgacaagcagggacgggtcaccgtcaacggcgttcccctgaacgagggcgactacctctacccggacaacgcgccctccgacaccccgttcgacatcacggtccccgagggccggctgtgggtgatgggcgaccaccggggcaactccgccgactcgcgggcccaccgggacaccccctacggtggcacggtctccgagaagtccgtggtgggccgggccctggtgatcggctggccgttcagccactggaccacgctgcgggagcccgcgaccttcgccgcggtgcccgactcggcggccgggtcggacgccgccggacccctgtcgcatagggttgccccctacgatcggaacagatcggtccgactcccgagccctgcggaactcccgctcgttatgggagtggtgggcctgcgccgtggacggggcaggcggtggcgcggagtgaggagttggcgtgggggatgtggcggttggcgcacggtccggcagcgacggcgaggagcaccgcggacacccggtggacgcggcggcccccgcagcggacaacgccgcgacctccgggaacgaaagcacgacagccgaggacggcacggtgacggagcacaaccagagcgatgagcaggcccccggcaggaccgagccggaggagaggaagccgcggtccttctggaaggaactgccgatcctggtcgtcatcgccctggtgctggcgctcctgatcaagacgttcctcgtccaggcgttctccatcccgtccgactcgatgcagaacaccctgcagcgcggcgaccgggtcctggtcgacaagctgaccccgtggttcggctccgagcccgaccggggcgaggtcgtcgtcttccacgacccggacgactggctggccggcgagccgacggccaagcccaacgcgctgcagaccgtgctcagctggatcggcctgatgccgtccgccgaggagaaggacctgatcaagcgggtcgtcggagtcggcggcgacaccgtcgagtgcaagggcaccggcccgctgagggtcaacggcaaggcactgaacgagccgtacgtctaccccggcaacaccccgtgcagccaggacgaccagggcggccagttcaaggtcaaggtgcccgagggcttcatctgggtcatgggtgaccaccggcagaactcccgggactcgcgctacaaccaggccgacaagaaccacggcatggtcccggtcaaggaggtcgtgggccgcgccatcgtgcgggcctggccggtcaaccgctggggcaccctgcccgtcccggacaccttcgaccagcagggcatcggacagcagtcctcggcggccggcgcgctgacggtggcccccggcggagtggccctcaccgccgcggtgccgctggtgatctggcggcgcaggcggaccctgaaggcggagaccggcaccggcacgcccaccacggcggccgggagccgctgaccgccgacaccggccgcagggcgccgtcctgatcgactcggggccgtcgtgatccgtacggtggcgtcctgatccgcaccggtggcgccctgatcttcgcgaaggcgcctgtgaagcccccgtggagctgtggttccggccccgggagggggctgcccgggccctgtaccgccgggtagggtgcggatccatgggtggcgagagcacgacgcgtacggccccgcgcagcggcggcacagacagggcaccggcgggcggcaggacaggacagcggctgtccgggctcgccgtggcgctcgggctggtgctgttcctcggcggattcggctgggcggcggtcgtgtaccggccctacaccgtgcccaccagctccatgaccccgacgatcggcatcggcgaccgcgtactggcccagcgtgtcgacggcggcgaggtgcgccgcggtgacgtcgtcgtcttccacgacaagacctggatggcgaacgcgcccgtggtcaagcgcgtggtggccgtcggcggtgacacggtcgcgtgctgcaccgacggcaagctcaccgtcaacggcaagcagatcgacgagccgtacctgaagggcggccccgccgagatcacgaacttcccgacggtcaaggtgcccgaggggcgcctgttcctgctcggcgacgaacgccagggctcgctggactccaccgcccacctcaccgacgccgcccggggcaccgtctcgcgcgccgacgtgacggcccgggtcgactccgtgatctggcccatgaagggcatgctcgaacgccccaccggattccaggcgctgggcgccctgtcccagccgggaccgctgcgcacgatcgtcgtactgatcatcgcgggcgcggccctggtcctcgccggcggtgcgtacgggccgctcgccaagctgctgggcgcatcccgtgcccgtcggcggacggagccggcccgtgcccgctgagaccgccgacgcgggccgcgacgcggacgggtgcggcgccgggccgcgcaaggtggcgcgggtggtgctgctcgacccggcggaccgcattctgctgctgcacggccacgagccgggcgatccggccgacgactggtggttcacgcccggtggcggcctggagggcgacgagacccgtgaggaggccgccctgcgggaactcgcggaggagaccggcatcaccgacgtggacctcggcccggtgctctggcgccgccgctgctccttcccgttcgcgggccgccgctgggaccaggacgagtggtacttcctggcgcggacgacccagacggagacggcggccacggcgctgaccgaactggagcggcgcagcgtcgccggagcgcgctggtggacgtgtcgggaactggcccgggcgcatgagaccgtgtacccgaccagactcgccgagctgctgcgcacactgctcgacgaaggtcccccggccgcgcccgtgaccctggacaccgaaatcgtctaggggctcgcgagactggcgcacaatggggagaccgtacggctgaaggggaacatgccatgagcgccgaggacctcgagaagtacgagaccgagatggagctgaagctctaccgggagtaccgcgatgtcgtcggtctgttcaaatacgtgatcgagaccgagcggcgcttctacctcacgaacgactacgagatgcaggtgcactccgttcagggcgaggttttcttcgaggtgtcgatggccgacgcctgggtgtgggacatgtaccggccggcccggttcgtgaagcaggtgcgcgtgttgacgttcaaggacgtgaacatcgaggagctgaacaagagcgacctggaactgcccggcggctgagccgggagggctcgggggcgcggccgggaagaacagcggccggggatcactcgtgtgggtgacggagttgtccacaaccggtgagtaactcaccaagatccactcgatgggcccggatgcgtgacggttggcgccggaggtggtgccgacatgaccacgcatcaagcacgcagcgcactcggcaggtacggagagggcctggccgcgcgccggctggcccaggcaggcatgacggtcctggagcgcaactggcgctgcggcaggaccggcgagatcgacatcgtggcccgcgacggtgacgtcctggtcgtctgcgaggtgaagagccgcagggacggcgccttccagcacccgatggccgcggtcacgcccgagaaggccgagcggctgcgcggcctcgccgaacgctggatccagacccacggcggagcaccgcccggaggcgtccgcatcgacctggtcggcgtcctgctgccccggcgcggcgcacccgtcgtcgagcacgtgcggggggtggcctgatgggcttcgcgcgtacgtgctccgtggccctcgtcggtgtcgagggcgtcgtcgtagaggtccaggcggacctcgaaccgggcgtcgccgccttcaccctggtgggactgccggacaagagcctgaccgagagccgcgaccgggtgcgggcggcggtggtcaactccggcgccgagtggccgcagaagaaactcaccgtggggctcagccccgcctcggtgcccaagggaggcagcggcttcgacctcgcagtggcctgcgcggtgctcggcgccgccgagcggatcgacccccgagtgctcgccgacatcgtgatgatcggcgagctgggcctggacggccgggtacggccggtgcggggcatcctgccggcggtcctggccgccgccgacgcgggatacgaacaagtggtcgtaccggagtgcgccgccgccgaggcctccctggtgcccggcgtctcggtgctcggcatccgcagtctgcggcagctgatcgccgtcctgacggacgaacccgtgccggaggaggaccaggacgagcagggccgccccgacccgctcctggccgggctgcgcgtgccgggcaccggggccgccaccggcatgcacaccatgggagccggcccgcacgaccagggacacgacctcgccgacgtcgtcggccagcgctccgcgcgcaccgcgctggaggtcgccgccgccggcggacaccacctcttcctcgaaggaccacccggcgcgggcaagaccatgctcgccgagcggctccccgcggtcctgcccccgctcgcccgccaggagtccctggaggtcaccgcggtccactcggtggccggactcctccccccgggcaaaccactgatcgacctcgccccctactgcgccccgcaccactcggcgacgatgcaggcactcgtcggcggcggccagggcgtcgcccgtccgggagccgtctccctcgctcatcgaggagtgctcttcctcgacgagaccccggaattcagcagccacgccctcgacgccctgcgccagcccctggaggcggggcacgtggtgatcgcccgcagcgccggagtcgtgcggttcccggcgaagttcctcatggtcctcgccgccaacccgtgcccctgcgggcgcttctcgcagcgcgacaccctgtgcgaatgcccgccgtcggcgatccgccgctaccagtcccggctctccgggccgctgctcgaccgggt

SEQ ID NO: 303 - DNA, 6813 bp, Unknown
  Kingdom: Bacteria, Phylum: Actinobacteria, Class: Actinobacteria, Order: Streptomycetales, Family: Streptomycetaceae, Genus: Streptomyces
gcggacgggagggacgccgcggaacgccgacgggcgcggcgcgcggcccggcgcggggagggcggtcggccggttcacagaccgtggcgcagcagcgggtacaggaagtcgggtgcttccaggacgcccaggggcgctgccaggatcccatggccaagtctgcagcggccatggtcatgcggaaccgcggtcagcggtagcgcatgacagggcgcatgctgttccctcggatgcgtcggcgtacgtagagcgcccgtccgcctgacggggtgccgctgacgccctcacgcagcagcagcggtgcgccgatcgacatggcgagatgctcggcgtcggcgagatcagcggcgatggcgctgaaggcgcgccagtcgtacggcaactgcgcgccgatcgcctcatgaagggtcaacacgaggttgcctggggcgctggccgtgtgcgggccgggaaagtcggctgggagcagagcggttgggagccagtaggtgctgaccgctacgtgtgcgcggtcggcgcccagcagagtctcgatgcgcagcagttcctccgtcgtccggccgaggtgcacggcggcttcccggtcgtggaagccgtccccggcggccttcgacgaaaggatgctgtccccgccgagcgaggagccgtcgatctgggtgcacgctgccggcgtccaggcgctggctgcgcgggtcgacgtcgatggagacgcggacggcgggcccgcggacgaacgtgccggccccgcggcggatctccactacggcggcgcgttcgagtccgacgacggactgacggtccgtcaggccgcccgggccgtgcagtgatgcattggccagctgtcacactcgcccgatgagtatgaagagtcagcacggtcgttccgtcgacccggaggagttgctgctgcggacagactggagttcggtggagcattgctgtccgagcgttgctccagcgacgcctgtgatcttgcgacaacttctcgacaacgacgcgggcaagcagggcgctgctctccgcgacctgcaacaggccatcacgcatcagaacaccttctacagtgccacggcccctgcagcgtcgttcgtcgcggcgatccttgggcacccgcggactcttgccatggtcaccgatcagaggccaggggaagcctctcgctccgctgagcagcctcgattcttccttcgcgtcggtcttctggactggcttggcagcaccgccgaagacgccaaccaagagtcacctgacggatatgacgcggacatcgaagcggtccgcgcccttcggccaaccctctttgacgcgatccatcccttccttgcggaccgtgagccggagatccgcaaggccgccctcgccgctgtactcccgttgctcacctcaccagaactagcccaccacgtcgaagttctacacaaggaggtccgcgctcttgccgccgacagctccccgtaccggcggcgcgcgatcgacacactcaccagctggggggaagacgtcactctcttccagcaggacgcggacatgcccgccggcattcacgtgcatgccgagggctatgcggacgacccgcctttctgaaaccaccttcaagccccgagttggaaaccgcacccgggcacgggaagcccaggcgccggctgcccgcccgggtctgggcaacttcgcgaacttgtcgttgaacgcgaagtagtcgatggactcggccatggccgagtcccggcccatgaggaaggctcggaccgcgtcgacggcggcggtgtaggcgccctgagcgatcgcgggggcggcggagttgttcgggaggccggggcaccatgcagccacatggcgttgaccttcaggtcggtgtcacgcgtgatcatgcgcagcgcgtcgaggtcgagaaggccggggacgaacaggccacaggcgccgaattcccggtaggcgttcccgcgggcgatgacatcggccggccgtcctcgttgcccacgcccaggaggaacacgtcggtgcgggcggtgatgaacagatcgacaccgcgtcgtcggccgtcgcacccgcgaccgcgatgcgcttgccgcgaccgtggtggcgtatagcggtccgtcagtggtaccggagtcttccgggttgattccgacgggcaggaagccgtcgtgcagcctccggaactgctcggcgcgctggtgctgggtgtggatgtcgggcatctgacgctctccttttgagccgagccccggcctcgcaactggtggacgcgtctcggccggcgaacgtgaggtgctgagcgtgagatccgatgcgccgggtctcggccgtggcccaggccggaccacgatgtgcctctccgcggcgggtctgcgcccgagggcggccagcggaacgaccggaggggccgcggtgcgcagcgccccctccggctcactgatggatgccgccgcgcatgctcacgcggcccagatgatgccgagctgctgaagggccctcactcccgccgtcaataccgacctcttcgacgatgagaccgttctggaccttgagcaccgtggttccggtgaagcggagcgtcttgccggacgccgcgggcgcggagccgatggggaggtcgtcgaagacgatcggccccgtgtgcgtgccgccgccctcccactgcccgacgacgtagtcgccctcggcgatgaggtccgcggtcccccagaaggtgaggtccggtaacgccgtgcggaagttggtcgcgaattcacgcacgtcgtcgcgaccgcgcatgggcttgtgcagcgagtactcgaaccggatgcccagggcggcgagttcgtcgattatctccgggttgaaggacttgctggcatacggtgcgcacggacatctggtgtccgcggaccttcacagtgcgcagaggaacagggccccctgtgcccacgcgcggaactggtcgacgatccactcctgttgttccagggggggcggccagtccgggacgtagtgggcgccccggggcgatctatgccgctccgcggtccgggagttgcggcgtgaacagcgcggtcatggcgtgccctctgtgggggcggggtgctggagggcgtcgtcgtcgacgagccaggtggtgccgtgggcggtcgcgccggtcagaccgttcaggttgatcaggccgacgagtgcgagggtgcgctggtcgccgatcgcggcggtcgccagggtgcgttcggggcgccagggggtcgaccacagcagtcgccgggtcatctgggcccagccggtcgccggtccggtcatcacccacagatccggatcgccatcggtgaaccatgacgcgtggcgcagccaggacgcgccggtctcgggccaggtgatcgcagcgagggtggtgcctcccgcgcggtcccaggccgcttcgaccagccgcgaggtctccagggcgtgcggggtgcggccggagccgatggcaatggtctgggcgcggcggccgtgcgccaggcggacgatggccgcgacctcggcgtccgtggcggtcaggtccgcgtcgtagtgcgccggccctttcagcagggggctgttcagggggtccatggtcggctcttctctcgggctgtcttccactgcaggtagcggtcctcgcagcagtcgccgcaggggcggaaccccgctgcgatcgcggtggcctcgtcggcgaagaagacgcggtgcttcacgtagccgccgcgcgcgatggcgcgtcgggcggcggagcagtcgagccgtccgtagatcttcgagccgcggtggccgccccactcccccttgaccggcgaccggtggaaccggccgtcggccccgaggagggtgtacgtcttcctgccgtcgctcatgtcgttcacgctgcgtcgtggaagacgagggcgagtgtggtgcgttcgccggagcggacggcggacacgccatggcggaccggcgcggccgaccagcctcgtgccgacctgacagggcggtcgcgcgtggtgaacaggtatccgtgcccgtgcggcagcagggtggccgtgccccgcgactgggcgcgcgggcgctgttccagcagcaggaactccccgcccgtgtggtccaccccgggctcgttgaggttgatcacgacctgcagcgggaacacgaggtcgccgtacaggtcgcgatgcagcgcgttccagtccttctcgccgtagtggagcaggatcgccgtggacttcgtctgcccggcctcgtgacacatgtgaagccactcgtcgagggagtcgggccacggtgcaggccggccgagcttgccccaccagtcacgggcgatgggcagcagccgcgggtacagcgcctgcttgagtcgctcgaccggctccgggtagggcgtgtcgaggtagcggtactggccctcgccgaagcggtgccgtcccatgtcgaccgtgctgcggaacaggccgtcctgctcgtacagctctctgatctccacggtctcctgcggggtcagcagttgcggcaggagtgcgccgccgtactcgttgacctccgcggtgatcgcttcccagtcgccggactcgacacgcttgtgccacgggtccgtcttcttcctggtcgctgtcgtggtgttcatgccgcggcctccaggtccagcagcgtggtcttggcctccagtccgccgatgtagccgccgagggtgccgtcggtgcgcagcacgcggtggcaggggacgacgatcggcagcgggttggtcgcacaggcggtgcccaccgcccggacggccttggggttgccgacgagttcggccatgtcccggtagctgcgggtctgtccgtactcgatctcgggcaggtggatctgcacgaggcgccggaagccgtgggacagcgacaggtcgagcgtcaggtcgaagatccggcggcgccggtggaagtactcgtcgatctcgcgagccgcctcgtccagccgcttcggcgcgcgcaggatccgcgggctgagcttctcgccgagggtctccaggacccggttgtggtcctcgccggcgtacgccacgcggaccaggcccttcggggtggcggcgagcagcagcttgccgacgggcgagtcgatggtcgtgtaagcgacatcgatcaggccggcttgctctgcggcctgctcaagacggcggtggaggcggttgagagtgtcggcgtccacgggtgtcgacagcaggacggccatgtcgtcgttgtgcgtgtcgctcacggcgatgctcctttcgtgatcgcgcccggatactgtttcctgagattcttcagtccgtccgcggcggctcttcgggccgcctcgacggtgccgccgaggatctcggcgatctcggcgtatgccaggcccgccacatagcggtaggcgacggcctggcgctgtttgctggggagttccttcactgtgtcccacaagccgatggcttcggcgtccgggaccgccggcccagccggcctttccggtacctcgtcgaccggtagagggttccgcttcgcggctcgcagcacgtcgatcgccttgcggtgcgcgatcgtcacgagccacgcctccacgttcgccgtctgcggcagatcgggataggcccgcatggcggccaggaaagtctccgaccacgcgtcgtccgcgtcgtgcgggccgaggacgacccggcagacgcgcagcacggtggcgccgtgctgcgcgaccacactctcgaacggttgcttcatgttcatcccattgaagacgtacgtgctctggcaaacgtgagatgcccggtcagaacaatcgtccggcgtcgtccgcgggcggttcctccagcgccagcagcgcctgcttgcacttcagtccgccggcgtatcccgtgagcgatccgtctgcaccgacgacgcggtggcacgggacgaagatgcacagcgggttcgaacccaccgcctggccgacccgttgcgccagagcgcggtctccgacctgctgggcgatacggccgtaggtggtcgtgtccccgcactgaatgctcttcacgatgtcccagacagcgtgctggaacgcgtcgccctcggcagcaagcggaagatcgaactgtctgcgccgtcccgccaggtagtcgcccaactggcggaccgcttcgtccaacgacgagtccgtcgaggcactgacctcaggaccgaacgtctcctgcggaggccggcggacatgatgccggaagtacagaccggcgatcgcctcgcccttcgcgacgatcgtgaccggtccaagctgtgtctcgatcacgacgtgtcgggtactcatctgcctctcccttctcctgaccggtagacgtccgccacccgcagaccgtgagatccccctctggtgcggtcacagacccacggtgtcggagcatgtgacgctggcattccaggcggctcatgtgtgtgcacgggactacgtccgcgatcgccgctgcgtacgcgcgtcaggcggcgagcgcaggagagggcgcgaagagaagcaggaaccgacgggtcgtcgatcttggctcatcctgctggcgtgctcgccgactccagccacgcgaccccatgcgatgcgctggttggtcacggtgctcgcctggaggttgtcccgtacggggcgtgagttatccggtgagggctgaggtgcctctgacctcggcgtgcggtgcgggatgagcaggccggtgccctggtatccgcacgcgatgccctggatccggcgcggacggtgacccggcggacacccttcccctggatccggtgcacgacggccggcgcgctgctcatgaactcgagagcgggccgccgggcccgcgcggcaccccgaaaatcggctgccggcgccgcggcccggctggggtcg

SEQ ID NO: 304 - DNA, 9365 bp, Unknown
  Kingdom: Bacteria, Phylum: Actinobacteria, Class: Actinobacteria, Order: Streptomycetales, Family: Streptomycetaceae, Genus: Streptomyces
gcgtcgggggtgctcacgggcggtcctgaggctgattcaagggcgggcccgggcgctcggggcgagaccggggattcgtcatcaagcgttcatcaaggtgtactgacgcgtccacgataatggaccacgtcaggcgtgtgaacctcttacgcaacttacgcccccaccgcgggcactgtcatttccgaaggaaccgggcactgtcattccgaaggaacacggccacggaacagctccagcacctccatgtccgtcgcccgagcgtgcaggaagtagtcggcccaggcggcgatgtcctcgtaaccgcactccgcttccagccgggccctcgacgcctcgatgtcgaacggcgtcacccgcagatcggcgcccgggccgagcagacaccagtgggcgccagctcggccgtagggcatgccgacgctgccgggattgacgaccagccgcccgtgcgcgaggcggacgtacggcatgtgggtgtggccgcagaccaccgtgcggatctcgtcggccaggccggtgaagaccttcgcccaccgctcggggcccgagtcgaccaggacgatctcctcgtcgtcgcgcggcgtggcatggcagaacagcacccggcccagtccccgcacggtgagcgtcagcgtcggcggcagtccggccaggaagtcgacctggtccgcgcggagcgccccggccgcgtacggtccgatcgggtcggggatctccgtccgctgcccccgccggaactcgaccagttcccggtcggcgttgccccccacccacagcacccgttcgccctgcgaacgcagcaggtccagcacctcggcgggctgcgggcccgccgtgatgtcgccggtgagcacgatgcggtcggcggcggccacctccggctcggcgaggaccgcctccagggcggggaggacgccgtggatgtcggagaggacggctacacggttcagctgcatgggctcatcctctccctgtcccttccaggatctccgcactcttccagcccctccgccagcacctccgccaggtgccgcccccgtgcccccgccagttgctccagctgtgtgcggcaggagaagccgtccgccaggaccaccgtgccctccggggcgttgcgcaccgccggcaggagctgctcctcggcgcaggccgtggagacctccccatggcccttctcgaagccgaagttgccggccaggccgcagcagccgcccgcgaggtcgccggtcaggcccgctgccgtgcgcagccgccggtcggcgtcgtcgccgagtacggcgtgctggtggcagtgcgtctggcccgtgaccggacggttcaggcggggtggccgccagtgcggggcgtggcgctccagtgtctcggcgaaggtgaggacgcggtcggccaggcggcgggcgcgcgggtcgtcggggagcaggtcgggcaggtcggtacggagggcggcggcgcagctcggttccaggacgacgaccggcgcggccgtgtccaggacgggctccatcaggtcgagggtgcggcgcatgacggcgcgggcctggtccagccggcccgtcgagatgtacgtcaggccgcagcagacccaggcgcggccccgtaggagggacacggggttcagcgtcaccgaccttccgtcgccgaccggaggtctgcgcagccgcagggtcggcggcagcgccacgcgcagcccggccgtctccagcacccgcacggcggctcggcccacggacggggtgaggtgttcggtgaaggtgtccggccacaggacgaccaggtcaccgccgccgctcctccgggccggctgccgctgtccgcgccaccagtgggtgaacggctccgccgccaggcgcgggatctgccgttcgggcgcgattccggcgagccgtttcgccagggcggcgagcgggcggacggcggcgagggcgttgaggacgggtgccgtgcgggtggccgccgcccagcgcagccagcgcgggagcgagcccatggagtagtgggcggcggggcggcggcgcccggcgtagtggtggtgcaggaactccgccttgtaggtggccatgtcgacgccgaccgggcagtcggtgcggcagcccttgcaggacaggcacaggtcgagcgcgtcccgtacctcggcggaccgccagccgtcggtgaccagctcgcccgcgagcatctcgtgcagcagccgggcgcgcccgcgggtggagtgctcctccgcgccggtcgcccggaaggaggggcacatcacggcggcgccgggcgcctgggtcgtccggcacttggcgacgccgacgcaccggcgcaccgccgccgcgaagtcgccgccgtcggccgggtagccgaaagccacgtccacgggctcgcgcggcaggacggcgaaccggaggttcgcgtcgagcggggccgggcggaccaggatcccagggttgagcaggtcgtccgtgtcccagacggccttggcccgctcgaacagggcgaccgtctccgcgccgtacatcctcggcagcagttcggcgcgggcctgtccgtcgccgtgctccccggacagggagccgccgtgtgccaccaccaggtcggccagttcctccgagaagtgccggaagcggccgattcccgccgcgctcagcaggtcgaagtcgatccggacgtggatgcagccgtccccgaagtgcccgtagggagtaccgcgcagcccgtggtccgtcagaaggaggcggaagtcccgcaggtacgcgccgagccgggccggcggcaccgcgcagtcctcccatcccggccaggcctcggtgccgtccggcatgcgcgtcgccgtgccggccgcgtcctcccggatgcgccacagcgcgcgctgggcggcaggatcggtgacggtcagcgtggccacggcgtcggccgcgcccgcgatcgtctccgcacgcgcgcgtgcctgtgcctccgtgtccccgccggtctccacgaacagccacgcgtcgccccggggaagaccggtggtggccgtggcgggcaccaggtcgcgggccatgccctccaccgtgagcggccggtggggcagcagtgcggcggctgcctcggcggcggcgctctcgtcggcgtacccgagcacggcgagcgcccgcgcacggggcgcctcgaccagtcgtacgaccgcttcggtcaggacgcccaaggtcccctccgagccgcagaaggaccgggccacgtccgcgccccgctccggcagcagggcgtccagcgcgtacccggagatgcggcgcggcaggtcggggaatccggtgcgcaggcgggccagttcggcctcggccagctcccgcagtccttccggtgccccggcccactgtctcccgagccgcaggcgccgcccgcgcgcggtgagcacggacagctcccgtacgttgtccgcggtcgtgccccaggccaccgagtgcgagccgcacgcgttgttgccgatcattccgccgagcgtgcaccggctgtgggtggaggggtccggcccgaagcgcagcccgtgcggggcggcggcctcctggagccggtcgaggaccaggcctggctggacgacggcggtccgcgccccggcatcgagggacagcagccggttcatgtgccgggtgaagtccaggaccacgcccgtcccggtcgcctggcccgcgatggacgtgccgccgccgcgcggcaccaccggcacgcggtgctcccggcacacctggagcaccgccgccacgtcgtcggcgtcccgcggggccaccacgcccagcgggaccctgcggtagttggaggcgtccatggtgaccagcgcccgggaggtgacgtcgaagccgacctcgccccggacggcagcccgcagttccgcctcgagggccgtgggatccgtcatgggtccagaatgcatccggccacggatcgtcacgccgagttgtccacagcagcgctgatctcatcgtacgaactcaccgtcacatcactccttgatctcgtctcatcggacggacacggttacgtccggtttcgcccagcgactacgctccgactcgtggccgacatccagatccccgctgacatcaagcccgccgacggacgtttcggcgcgggcccctccaaggtgcgcaccgaggcgctggacgccctcgccgccaccggtacgtccctcatgggcacctcccaccgccaggctcccgtcaagaacctggtcggcaaggtgcgcgagggcatcagcgagctgttccagctccccgagggctacgaggtggtcctcggcaacggcggctccaccgcgttctgggacatcgcgacgcacggtctgatcgagagcaagtcgcagcacctcaccttcggtgagttcagctccaagttcgccaaggccgccaagctcgcgccgtggctggccgagcccacgctcgtctccgccgacccgggcacgcaccccgaggcgcgtgccgaggccggcgtcgacgtctacgccttcacgcacaacgagacgtccaccggtgtcgccatgccgatcaagcgggtggcgggcgccgacgagggcgcgctcgtgctggtcgacgccacgtccggcgccggcggcctcccggtcgacgtctccgagaccgacgtctactacttcgccccgcagaagtccttcgcctccgacggcggcctgtggatcggcgtgttctccccggcggcgatcgagcgagcggagcgcgtccacgcctccggccgtcacatcccggagttcttctcgctccccacggcgatcgacaactcccgcaagaaccagacgtacaacaccccggcgctggccaccctcttcctcctcaacgagcagctggagtggatcaacggccagggcggcctcgcctggtccacggcccgcacgaaggactcctcgacgcgcctgtacacctgggcggaggagtccaagtacgccaccccgttcgtcaccgacccggccaagcgctcgcaggtcatcggcacgatcgacttcgccgacgagatcgacgccgccgccgtcgccaaggccctgcgcgccaacggcatcgtggacaccgagccgtaccgcaagctcggccgcaaccagctgcgcatcgcgatgttcccggcgattgacccggcggacgtcgaggcgctgacgaagtgcgtcgactacgtgatcgagaagctgtagccgatcggcccacgcaggcgaagggcgccccgcggagtacgtcaccgtctccgcggggcgcccttcgcgcgtgtgctgccgccgcttgtcgctcgccgcttgtcgctcgccgctcagaactgctggaggaacgcctgccagctgtcgcgggagacggtgagcagggggccgtcctgctgcttgctgtcgcggacggcgcggccccggtcgattgtgggggccacctctacgcagtcgccctgctgagcggagtacgacgactttcgaaaggtacccacaacctcggtcacgtcactcttctttcaggttcctcagtacgtcccggatgagccgcgcgctcgcgtccggcgccagtgccgccgatcgtagtaggtcgtacgcattgccgtaagccgccagatcctcgggcgcttcgagaaccgacgtcccacggaggttctcgatcgtcacagcctcgacagccggttcggagtcgaagctgaaggaggagaaggcagggatcgaggccaccagaacaccagcactgaagggcagcacctgcacggtgacgttcttcctcttcgcgaccgtgaggatcgcggacagctgctccctgtgagtgtcgacgcccaccagagggtgcacaatcgctgtttcccagaagatggcggtgtacgaagcgccgccttcaccgatcttggcttgacgcgcctcgcgcaccttcaccagctgttcgaggacttccggtgcaacgtagtcgggccccgctgagatgaccgcttcggcgtaggcgggtgtctgcaacagaccgggcaccaaggccggttgccactgccggatatacgtggcgtcgtcctccagcgcgatgtgatccaggtagtccggccgcaagtgcgccgcatgctccacccaccagccacggttcttggagtgcttggccaagtcctccagcttgtcgcgcacttccgggtccgtgacgccgtacgcgtccaacagcagacgtacctcgatgacgcgcggtgtggcgtgcccgctctcaacgcgactgatcctcgcctggcttgatgcgatgacctcggccgcctgcggctggtcaagcttggctgccagccggtactgcctgagcgcggtacccaatcgcctactgcgaaccgtcggccgtccacctgcgggcatgggtgccctcccctctctttcggcaaccatgccacaccggggcacaactcctactccacatcacacgatcgagtgacaccgctgcatgtatttcgcagtttcgattgtccgggttctggattccgccctagcttcgccccatgcctcaaaccaccaccttccgcatccacaagcaccgaaggcacgtgtccgcggcacggcaacgcaccggcaaagccctcgccgactggggcgtcaccgacggactggccgactcagtagccctgttggtcagcgaactcgtcaccaacgcggtaatccactgccgcgtctctcacgcccagatcaaggtcacgctgattttggacgaaccggcactgctcctggaggtctccgaccccgaccgggacaggctcccccggctccacgacgccgccccggacgaggagggcgggcgcgggctggccctcgtagcggcgttggccgatgcgtggggatgccggcaggagccgtacgcgaagtgcgtgtgggcccggttcacgctggcggagccggcggagagggagagtgcccgtgccgttccggctggtgcgtgacgcgttccgccgcctgttcgcaccgccgtgctcgcgcggtcgcgaggcggacgaccgggacctcggccgggaggtccgcgcaccggacccgtacgtgtggcgtttgccgagcccgtacgaagcccggtggcgtcgctggtccaagcggtgccgggcagccgggcgtcacctgccggtgccgcgcgaagaggcgtgctgggcgggggacccggagtcatcgcagccggtcacctggccgtgcgaggacgacgtggtgcggccgtacgtcctcagagtctgatgctccggcgaacgcaggcgatcagatgctgcgcgtcggggccgtagacggccgactccgcgagcgcgtcccaggcccggcggtagagggtgatcgtttcggcatcatcgagccagagttcggcgtgccagtcctcgaccgtgaccagtcggtcgtccagtacccagaacccgttgccggccggcacgcgcagtggagcgtccaggggaacgatccccaggtggacggtgtccatacccacgacaccgaggagccggtccagttgagcggccaggacttccggcacacagacccgggaccgaagagccgcttcccacatgaccaggttcaaccgcttacccggctggtacagccactcctgacgcttcatacgggctcgcaccgcgttctccgtgtcctgcggagaacggctgagccctgcatgcgatgtgaagaggcttctggcgtagtcggcggtctggaggagaccgttcactacatggtcgtcccacacatacagcgttcgcgactcgtcgacgagggcgttccacgtctcctgcactggagcatgccctgctgcgagcaggcgccgccaggaccggatgtggctctcgaagcccttcagccgagcccgcagctcatcgaagacggccggctgccccaccgcctcggcccacgcccgaaggtcgccgaccgtgggcgtctgccgaccgctctccagcttgctgaccttggactggggccaccccagccgttgggccagttccgtgccggtgagccggccatcagggctgtcggcgcgcaactccctcagcctgtggcccagttcctcacgcgccctctgatagtccgtgctcaccggtacccgctcttgcctctacgtgtcgctgcgcatctccgccatgaactgcttccacggtacggcgtggtgccaagcagcgtcacggatcatgcagcagcgcaccacctccgcgggctccgtgatcagatccacgtgtgtgagctggtcgtcgtcatcgaagcgcaggagtgcgacgaggcggctgtcgaacagccagaagtcctcggcgggcagccggagtcgatcggcgtcggctcgccacatgttccggatgtcctcgccggactcgatgttccatcgagcgtgccccaacaggtatcgctggccggtggtgggcacctcatccaccagccgtacccgttcaatgcgcttcccctctgggcttggatcgtcttgcggaaggcactgaccggcgtttcctcggtccagtcctccgagacgtgccccgcctccatgaactgtttccaggcgtcgccggcctcgtcgctcgcgtaccgccgccgtgtctccaagcgccacgcggtgtgctcgaacttgccgaacaggccaccgaactcgtccagatcgatcgtccgcacctgtcgcgtccgctccttcggtgtccagtccaccagcaggtcgcgcggtaccactacggcgacttccccctcggaaaggtgctggagctgtgcgacgtcgtcctggccgagcggaggtccgtgcacgatcacctcgccactgtccaagtcctcgtgcacggacgggcatccgccaccgttgcttcccgtcccgttgaaccgcagcctgcgcgccatccggacccaccccttggggctcgacgatgttggtgcgctcagcatgtcggtgcctcactgtgaatgtccatgcatccagagtcaccgcgcgagaataatggagaatatttgccgccagttctcaccctttccgcataccttcatcacgcagagcgatccgctcgccacctggtgatacggaaaggacacagctatgccccacggagacgacctctacgccctcgacctcaccggcgcctccttcgtgaaggcctgcggaggcccctgcaccgagggctgcgtcaccctcgcccggatcggcgaggacgcctgggccctcggtgacagcaagcggccggatgcgcagccgctgcggttcagcacggaggagctgagcgtggccgggatcgacccgacccggttcgggctggccctctgaccttccgtacgacgcccgtcccggccggccgggacgggcactcccccgaccgtccccccgcagaacaggaccccggtgcaccaccacgcctacctgtggaccggtccgaaggcccggttcgaccaggacgcgctgcggcgccccccgccccccgcgccgccccccccccgc

SEQ ID NO: 305 - DNA, 7210 bp, Unknown
  Kingdom: Bacteria, Phylum: Actinobacteria, Class: Actinobacteria, Order: Streptomycetales, Family: Streptomycetaceae, Genus: Streptomyces
cgtcgacggcggcacgatgagcgcggccgagatgctcaccggcgcgctccaggaccgcggccgggccgtcgtcgtcggctcccgcaccttcggcaagggctcggtgcagatgccgacgcggctgcccgacggctccgtcgccgagctgaccgtcggccactaccgcactcccggcggacgcggggtggacggccacggcatcaccccggacctggaggggggcggcgacccgatgggccgggcccgtacggtcctgaccggcctcggcgacccctcctgacgcgtgagcggggaaatgaacttcccgcacaccccctgtgtggtgccaaaatgggcggcactatggctaaggaaaaagggcgcaagctgatcgcgcagaacaagaaggcgcggcacgactaccacatcctcgacacctacgaggccggtctggtcctcaccggtaccgaggtgaagtcgctgcgccaggggcgggcgtcgctggtcgacggcttcgtgcagctggacgaccacgaggcgtggctgcacaacgtgcacgtgccggagtacagccagggcacctggaccaaccacagcgcgcggcgcaagcggaagctgctgctgcatcgcgaggagatcgagaagctggagtcgaagtcccaggagacgggtcacacgatcgtgcccctcgccctgtacttcaaggacggccgcgccaagatcgagatcgcgctggcgaagggcaagaaggagtacgacaagcggcagacgctgcgcgagaagcaggaccgccgtgaggcggagcgggcgatgtcggcggtgcgccgcaagcagcgggcgtgagcacgccctgacctgggcgtcgtgaccgcgggaataagctggcaaggacccgcgttggtcacgtacgatggcaacgcaccgcacagccggtgcagctcccttcttcggaagggcccctctccggaggggtgggtttgaaaaatcaacatggggatgatcggtttcgacagcggatgtcgaagcaggggaagcgtgtcgaggaagcggccacgatctcgtaaaccacaggccgaaaaaaataatcgccaacaccaagcgcgattcctcccagcaggccttcgccctcgctgcctgatctcaggtagcgaccgcgagcctcctataaagggagtgtcagcccggggctgttcccgacccggatcctggcatcagctaggggactaaaccttgatcccggtcacggggtgaagagggaaaccaaacagtgactgggcccgtcggagacttgttcgcgtgatctccggggccgagaaaatcgaagcggactgcacacggagaagccctgattccgcaccgttggacgcgggttcgattcccgccatctccactcacccgcatccgcgggcaccccatgtgagacaaggccctgccgcttccgagcgacggggcctttgttgtgggcgcgggacctgcgccggggaggcggtaccgtgaacgcatggcgccttgcatccttcgcacccctccggaggaccgatgacgactgcggcctcacatcgcaacccgggcgtgcctcccatgccggacaggaacccgaaagccctacgggccgccgtagcgcagcacgctccacagctgctgcccggattcgacgcccactggaagcggtacgttgcggacgcctacgacgtcaccaccgttcccgccttcatggctcgctggtggggcgagtacgcgatcgcccgcgacccgcagctcgacgcctacgtcacagctctcgaacaccgggccgcgtacgagtgcgacgacgccgccgaggccggagcgctcctggaggaggcctccaacatccggcatctggcggcccggacggagccggggcagtgacggatgaggggttcatggggccgccttggcagatggactggacgctcaaggcgcaggccgcgcgtgacgcgctccccgagcgtgtccgaaaggccctcgacgcggcacgtgcggagctggtcaccgcggtggatccgtactttcgcggcgtggagaccgacgcgggcctgcccgcgagcatgagtgtcgagcctgcgaggtcgagtgatccgaaagggcctcgtgttctgtatttcgacaacgggcacgggtggctgagatacgtcttcgtccaacggaccgaggacccccagatcgtggtggaagaggtcttctggcagtagagcagtagagcggagcacgtgggctcacagggcctcggcctcagttcccgcgtccagctcgaaccagaccgtcttgccgatcccgccgggccggggtaccgctccccagtcgtccgccagttcggccaccagggccaggccccggccgcactcgtcgtccgcgcggcctcgcgcggcaccggcagagcgtcgtccgcgtcggtgaccgtcacgcgcagccggcccgtgtcgtccagcacgcagcgggcccagatctcgcgccccggcgccgtcctcgcatgccggtacgcgttcgtcatcagctcgctcagcagcagtacggccgtctccgccacctcgtccgggaccttccacgccgctgtctgctcccgcaggtacatccggggccgccccacgctgcgggcatggcgcggcatacgccactcgatgtcacggggcagcgcgccgggcgagcggcgggacgtcgtgctggtgctgggagaaggcgtcgtcggcatgggcgtgggttcctcgcgtggggggggcgtctgggctccgtcgttcggcggcggcaccaggctcccggggcgccgccccgccccgggagtgccccgcgcggtacgcggcgccgctgtacacggacggcgcgtacacggcggcccgcgatgagatcatgaaggctcagcaactacaccgctgtagaggaacgcacgcacatgttcgaacagctcaagaacctgaagaacctcaaggacaaggtcgaggacctcgccgagacccacggcgacaagatctccgccggcctggagaaggccggcgacttcatcgacggcaagaccggcggcaagcaccacgacaagatcgactccgccgtcgacaaggcccaggactacatcgagaagctgggcgagaaggacgggaagggctcggaggacaagggctgagccgtcggctgcgcgcccttgcgtgtgcaactcggccgaaccgtggatacgcctcgtgttcggtgactagcctcagcgtggcgagtcgggtacacagcgtgtgcgtacgcgctgtgtcagcgggaggcgggtgagggcgcgtggccacgggggagtcccagcaggcccagcagaactggcggtactgcggcggccgatcaagctgtggcgcgaggaggcccaggtcagccgccaggccctggcggaggaggccgggtacgactacgagtacgtcaagtcgatggagtgcgggcgccgtcgaccgacgttgcggttgctgcagatcgcggaccagttgtgcggggcgcgggggaagttgagcgcggcgcacgagtacctgaagccggagccgtttccgcagcgcacgcagcagtacgtgctggtggaggccgacgccatcacgatccagtggtacgagcccttgctcattcctggcctgttgcaaaccaaggagtacgcaggggagctgatcggcaacgactgtcctccgttggatgaggagacggtggaggagcgggtggcggcccgtttggagcgccaggacaagctgacccgtaagccgttggcacactgcacctttgtgatgcacgaggctgcgttgagggcgatggtcggcgatcagtctgtgatgcggaggcagcttgagcatttgctggaagtcggtgatctgcggaatgtgacgctgcaggtcctgccgttcgcacttgctccgacggtggcgctcagcggagcgctcatcctcgtggagactgctgagcacgacgtctacgcccacgtcgaggcccaagagacaggggcgctctacggcgacggcggcaagatcagcgcgcttgcgcaacgctatggcatgatccgctcgcaggcgcttagcgttgacgagtctgcccggttcatcaggaagttggcggaggagctatgagcgtcgagctgtcatggttcaagtccagttacagcgactcttcaggcggcgcatgcctggaactcgcctacgcctggcgtaagtccagctacagcggctcccaaggcggcgcatgcctggaagtcgccaccaccccccgcgccccccaaaccatccacatccgcgactcgaagctcggggctcgaagcccccgtttctccgtcgccgccggcgcctggtcggccttcctcacgcacgccgcccgcgacgaagcctgagccctctgcacctcggtaacccttgtccgcccagcaggagatggggtggaccacgctcatgcggtggcacactggtcggcgtgtccaactcctacgcgcagcccatcctgaggacggcggacctcccggaggggctgcgcatcgttgagaggctgctggggatcgccgatctgagggatctggaagtcgatttcgatgcgcggatctcctcggctccctctctgtcggaggtgctggccctgctgccggacgccgattggtgggctgaaggggagagggacggctcctcggacagggaggacgatccgtcggcctacctgcccatccggctacgaggctgggctggggcacccgagaccgtggagccgttcctcaaggcggtgggcgacagtccggcgacggtgcggtgggacttcagcggctggcccgaggctccggaggcaggtctgggggtgggaggctcccgcggcgcgttcgtcaccctgtgcgcgtacgcccgcgatctcgaccttgaggagcctgcgacagaccacacggtgttcgtccacgtcaagcaattcgaggccgaacgcgcaccgtggcttgcggcccaggtcgggctgcgggtgatcggcgacttggtgatggcaccgtactgagcgctacggaaggcggctccgtcgtccacgacacatgctctgccagtcgttgcggaccattacgggttcttgagacgacaagcagcccgtggcaggctcatgccgcatgatcgaggagttcgcgaaagacaaactgcacgggagactgcggcgggaccgcaatgcgctgctctggaaactcgacggcttgtccgaatacgacgcccgccggccgttgacggcgaccgggaccaacctcctcggcctggtcatacacgtggccagcgtcgaggccaggtacttcggcgaggtcttcgaccgcccttccccggaaccgctgccccggtggcaggactccaacggcagcgatctgtgggcgaccgaggatgagacccgcgatcagatcatcgggttctaccggcgtacgtgggaacactcggacgcggtgatcaacgagctttccctcgacgcccccggccacgtggcgtggtggccggagccctatgccgacacgaacctgttcgccgtcatcgtccatgtcctcggcgagaccattcggcatgcagggcacgccgatatcctgcgcgagggcctcgacggccggaccgggctgcgcgccgaacacgagaagcagatcgacgcggaagcccgtgcagcctactgcgcgaagatcgagcaggccgccaggtcggccaccaatcaagggtccgatgcctagagcatcccgctcgccgtcgccgtgtccggcccgaacatacacggcagcctcgccctcaagccgctcatccgcggcatacccgccgtcccgtcctgcccggggaccacggtggcgccgacccgtcagactccgcgcgggcaaaacgtacttctctgccgcacatctggcctggctgcgcgagcgcgggctcgtcgcatgcatcgcgcggcccggcatcgagtccggccaacgcctcggtcggcaccgctggaagatcgagcgatcgatcgcctggctcttcggccaccgccgcctcaccgtccgataggaacgaaaggtctcgcacttcctcgccttcctcggcctggccgccgtcctgaccggctacaaaaaactcgcgtgacggaaccgtcgtcttgaccggtgacaccgtccgggcgggcgattcccttcgacctctatacgcattgcgggatctacgaggcccgtgtcggctcgacatacttcgaggcaagaaccccgctctccgacggttcagggaattcgcctggagggtggggcaaccccacccagcgcggcacgatgaccttgaagtccgagtgggaagccgtcttcaccgacgacatcggacatgaggtctacttccgggcccggccgggtgcgagcaccttcaagcgcctctgttcgtagtgatccagctgtcgcgcccgtcgtgccgggccggtcgcacgatgcggggctttggctgccgccgccgttctcacatgcgggcgggcatgtgaagcccccgcttctccgtgggcgccggcgcttggggggcggccttcctcgggctcgctgcctgcgacgaagcctgagcttcgggcttcgggctgcgagacccgagccgcttcttgacggaatgggcgggtaggcctcaacccaccctcccgccctccccgttccagccgtgctgacttttagtgagcgagttgcgacgcaccgtcgccaccctctagcgttcgcagcaacgaaacgaccccggtcgggtgttaccagcacccgccggggtctcacctcaagatcgaatgcgagtcgatccgtggctgacggaaaccttagcgctgctctgcccgcacgcgcagcgcaccccatggccaagcctggttacggcaagcggtccgcgccggaccaggcgccgccccgcgcgggcgacttcgaccggctgcacgcccgtgcggcgtacctcgcgagcctgatcgaccagctcgacgagaacgcggcgatggacgcgaagacgctggccaaggcacaaccgctctacggccagcaggcggtccgctcggcgctcaacgaactcagcgcggcagggcacttgcgccgcgtacggcgccgggtcgtaccggacgacggcgctgcgaacggcacgcgctgggtcttcctgacgtactggtcccgtaccgcacgggatgacgagtggtgggcgcgactcctggagggtgacgtgccgggcgcgtacgcctccgccggcgcacccgagggcgaagcccgtaccccggctgagccgacgccccccgcacccaccac

SEQ ID NO: 306 - DNA, 4174 bp, Unknown
  Kingdom: Bacteria, Phylum: Actinobacteria, Class: Actinobacteria, Order: Streptomycetales, Family: Streptomycetaceae, Genus: Streptomyces
  misc_feature (3677)..(3703): n is a, c, g, or t
  misc_feature (3837)..(3838): n is a, c, g, or t
gggctctcccggccgccgggcactccggaccaccggggcccggcccgccggagttcccggcccatcgggccttccgtcccaccgcggccacggcccaccggggcccggtccaccgggttacccggctgccggggcagggggctcccagccccggcaggccaggcgagaccagctgaggccaagtcaggccagccccagccgttccgccgccgtggccgcgtcgaccgggacggtgaccggctgcggtgcgccggcgacggcccagtcggggtccttgaggccgttgcccgtgaccgtgcacacgatccgctgccccggatccaccttgccctgctcggcggccttcagcagaccggcgacggacgcggccgacgccggttcgacgaagacgccctcctgcgcggccaacagccggtaggcgcgcaggatctcacggtccgtcacctcgtcgatggcaccgccggactcgtcccgcgcggccagcgcgtacgtccaggaggcggggttgccgatgcggatcgcggtggcgatggtcgacgggtccttgacgacctcgccgcgcacgatcggggcgctgccggaggcctggaagccccacatgcgcggggtcttcgtggagaccttgtcggcggcgtactccttgtagcccttccagtaggccgtgatgttgcccgcgttgccgaccgggaggacgtggatgtcgggtgcgtcgccgagcatgtcgacgatctcgaaggcggcggtcttctgcccttcgatacgtaccgggttgaccgaattgaccagcgcgacggggtagttgtcgctgagcgcgcgggccagggtcaggcagtcgtcgaagttgccgtcgacctggaggatcttcgcgccgtgcacgagggcctggcccatcttgccgagcgcgatcttgccctgcggcacgagcacggcggagaccatgccggcccgcacggcgtacgcggcggcggaggccgaggtgttgccggtggaggcgcagatgaccgccttggcgccttcctccttggccttgctgatcgccatggtcatgccgcggtccttgaaggacccggtcgggttcgcgccctcgaccttgaggtggacctcgcagccggtgcgctcggagagcacctgcgcgggcacgaggggcgtaccgccctcgcggagcgtcactaccggcgtgctgtcggacaccggcagccggtcccggtactcctcgatgattccgcgccactggtgggtcattgctggttactctccttcaacccgcatgatgctggcgacgccccgcacggtgtcgaggctgcgcagcgcctcgacggtgccggtgagggcggcgtcggacgctcggtgggtgacgacgacgagggaggcctcgccgtccttgccctgctgtcgcaccgtgtcgatggacacgccgtgctcggcgaacacggtggcgacctgggccaggacgcccggtttgtcggcgacgtccaggctgatgtggtagcgcgtgacgacctcgcccatgggcgagacgggcagcgcggcgtacgcggagtcgccgggtccggtggcgccgctgagccggttgcggcagacggcgacgaggtcgccgaggacggcggaggcggtgggcgaaccgccggcgccgggcccgtagaacatcagctggcccgcggcctccgactccacgaagacagcgttgtacgcgccgcgcaccgaggcgagcgggtggctgagcgggatcatcgcggggtgcacgcgcgcggtgacggaggcgccgtcggcggcccgctcgcagatggcgagcagcttgatggtgcagcccatctccttcgcggaggcgaagtcggcggcggtgacctcggtcatgccctcgcggtagacgtcgtcgaggcgtacgcgcgtgtggaaggcgatcccggcgaggatggcggccttggcggcggcgtcgaagccctcgacgtcggcggtcggatcggcctcggcgtacccgagcgcggtggcctcgtcgagcgcctcctggtatccggcgccggtcgagtccatcttgtcgaggatgaagttggtcgtgccgttgacgatgccgagcacccggttgaccttgtccccggcgagggactcgcgcagcggccggatcagcgggatggcaccggcgacggcggcctcgtagtagaggtcgcggccgtgctcctcggcggcggcgtgcagggcggcgccgtcctgggcgaggagcgccttgttcgcggagacgacggaggcgccgtgctcgaacgcggtggtgatgagggtcctggccggctcgatgccgccgatgacctcgatgacgacgtcgatgtcgccgcgtttgacgagagcggtggcgtcggtggtgatgagcgcggggtcgatgccctcgcgcaccttggaggggcgccggacggcgaccccggccagttccaccggggcgccgatgcgggccgtgaggtcgtcggcgtgcgtcgtcatgatgcgcgccacctctgagccgacaaccccacagcccagcagcgccaccttcagcggacgcgtacgcatcatccgacctcgcttcctcataccgtctacggttggaccagtctcactcaccggaccggagtttctgtcatttgtccggatcgtgagacgtttatttcattttcgccgggccggaagacaggagatcttccggcgcgacggtgccctgcgtcaggcgccccgcatcgggagcctgcgtcagggtgtctgtgtcacccgacgtcgagacgcaagaggtcgtcctccgtctcccggcggacgatcacccgggcctcgccgtcggcgacggcgacgaccggcgggcgcagggcgtggttgtagttgctggccatggaccggcagtacgcacccgtggcgggcacggcgatgaggtcgccgggcgccaggtcggccggcaggaacgcgtccttgaccacgatgtcgccgctctcgcagtgcttgccgacgacacggacgagcatcggctcggcgtcggaggtacgcgagacgagggccacgctgtactcggcgtcgtagagcgcggtacggatgttgtcggacatgccgccgtcgacggacacgtacgtccgcagtccttcgagcggcttgacggtgccgacctcgtagagcgtgaaggcggtgggtccgacgacggcgcgccccggctcgaccgagatccgcggcgtacgcagccgggcggcctcgcactcacgggtgacgatctcgctgagcgccttggcgatctcgtgcggctcacgcgggtcgtcgtcgctggtgtaggcgatgccgaggccgccgccgaggtcgatctcgggcagctcgacgccgtgctcgtcacggatgtccttgagcagcccgaccacacggtgcgcggccacctcgaacccggacatgtcgaagatctgcgacccgatgtgactgtggatgccgatcaactcgagaccgtcgagctgcagcgcgcggcgcacggcctccgcggcctgccccccggcgagcgggatgccgaacttctggtcctcgtgcgcggtggcgatgaactcgtgcgtgtgcgcctcgacgccgacggtgatgcggatctggacgcgctgccgcttgccgagggactgcgcgatgtgcgcgacccgcacgatctcctggaacgagtccagcacgatccgcccgaccccggcgctcaccgcccnnnnnnnnnnnnnnnnnnnnnnnnnnnatcccggcggacagggcggtggccagttcggtcccggagcagacgtcgaggttgagcccctcctcgttcagccaccgtacgacggcacgcgacaggaaggccttcccggcgtagaagacgtcggcgccgtgccnncgggcacgcgaacggaagtcggcctcgtccatgacgtaggcgggcgtgccgaactcctcggcgagccgcgtgacggggattccgccgacggtgacgaccccgtccgcgtcccgtgcgacggtctgcgcccagaccttggggtcgagggtgttgaggtcggtcggcggggcggcgtagtggccctcgggcaggacatcggcgtgacggggccctgcgggatgtgcggaacggctcatgtcggtgtgtctctctgcgctctcagaggtggtcgggtgcgtcgatgccgagcagggacaggccgccggccagcaccgtcccggcggcttcggcgagcgc

SEQ ID NO: 307 - DNA, 13031 bp, Unknown
  Kingdom: Bacteria, Phylum: Actinobacteria, Class: Actinobacteria, Order: Streptomycetales, Family: Streptomycetaceae, Genus: Streptomyces
ggcgcgcgacccggccgccgccggcccggtgacgccggcgccgcgcggcccccccggacgggatcagttcttgcgggccacgatgatgtcccggttgatcgcctggtccacccggtggacgaagccccggtacgcctccgagtcgcggacggtgaacccgtgggcggcgaggatctcggccagctgctcccgcccggccaccagcgtgttccaggagatgccgatggcgccaccaggccgcagcaggggttcccagaccggaacggcggcggccagcaggtcgacggggctgcgggagagccggcccgcgttcccgccgccgtgcgggcggctgccgtgctgcacgccgtacggggcatcggtgacgatcaggtcgaactcgccgcggcggaagaagtcgccgctcttgagcgtgtccgcgttgaccaccgtgacgtcgatggtgctgccctcgcggtacagctccttggtcgccccgaggctgacctggagccggcgcccgagggtcgccttgttgcggcggacggtcccggtctccgcgtggtgcttgagcctgctgttcttcagccacgtgcggaagaacgccgagtacgcctcgaagtccttggagtcgatgtcgagcccgctggcgtccatgccgtacatgaccgcctggttgagcgtggtaccgcggccgcacatcgggtcgaagagccgcatcgcgccggtcagcagcccgtcgggcgagtccgtcgccagcgcggtcacgttcaccagcagccgggtgaagtcctcgttggtcttgcccgcgtacttctggatggtgagcaggtcgctgctgaacaggtcgaggggcttcctgacgaccgggcgcagcacgtccggctgctcgacgacgaagagggcgtacagcgacgacaggttcgacagcaggcggatcgcggtgtcggacagcggatccgcggtgaaggtgacgtagggcacgccgcccatctcggtgagggcgacgtcgtggaccccgccctcgatcacggtctcaccgaacgcctggagttccgcgatggccaggtcgggcgcggagcgggcgtacacgcggttgtgcgagggcgagacgagaaacccgtacctgctcatgtgtttttcggatcctgctttcgagtggcttccggcgacggccgcggtggtactgacgcccgggtgcggccctgctcggagccggtcagtgacacaccgaccttacccgaggcgcccgggccggcgcggaggcaccggcccgggcggatccggtcagcgacggcggccgatcgatgcctcgaagcggtggaaggcgacctcctggcgccattccaggcgggccttcaggctggagtccagcagcccgcggcacgctcccgccggctggtcgacgcccggacgcgtgccgcggcaggcggccttggccacgtagccggagcgggtcgggttgccctcccacaggctggtgcccggcgcgaacgcgtactccagtgacgcgcgggccagcttcttcagctcggtgtagctcagcgcgtaggtgcgggcggcgtacgcgtactcatgggtgatgtcgatacggctgacgccggggtcgtcggtggcgagcacgaccggcacgccgtagcggcggtaggtgttgaacgggtgctcggcgcccttgacgccgaggatctgggcgttgctggagaagggcacctcgacggcgatctcacgggcggccatggtgcgggcggtgcgctgccagtcgtcctcgtggaccaggtcgacaccgtggccgacgcgttcggcaccggcgacgtccaccgcttccttgatgtggaacttcaggtcctccggcttgaccaggcccggccacagttctccggcgtggagggtgaggtgggcgtgcgggtagacgccgcgcaggtacttgagcatgcgcatctgcaggctgtagttgctcagggagctgtcccagtcctcgggctggaccaggttgacggcgacgtagcggtggtcgcgctcggccaggcgcatgccgagggccatctgcgtgaagacgcgcaccggtgaactgccgcgcgagacctgggagatccagcgcacggtgagcgcgcagccgggccgggccgcggccgtgccgcagtgctcggtggtgcggaactcggcgtcggagtcgtcggtctccttgcgcgcctcggtcaccagccggtcgagtccgccgccggccgcgagtttgcggtgcagcgcggccaggtcgtcgtcccagccgacctggtcggccagcttcttcgcgctgtccgaggccggggtgatcatggtttccaggtagaactggttctgtgcggccgcgtggtcggcgacgtcggcgaggagcttgccgcggtgccgccaggtcacctcgccgaacttgccgaaggtgtcgaagaagtggtcgtggccgttgccgccgggcgggaagtcctgcatggaccaggcgcggacgatcgcgtcgcggaaggccttgtcggtgcgggcgtcggcggcggggcgggtgcccgggccgcagggcggagcctgagcggtcatggtcgcggcgtcgacgcacagcccgtcctcggcggccagctcgatgaggtactccgtggtgaccgcgccggagaggtggttgtgcaggtcgccacccttgggcatgcgttcgaagaagcgccgcagggcccgggggtcgcgccggatcgagcgcaggtaggcgtcggtggctgcctccgccggggtcgtggacggccgtacggctccggtacggccgccggcctggacgggcgtaccggcagcggcggcctcggcggccggggatgcggtcagggtggacagtgcggcgaggcacacgagacctgaggtgaccaggctcctgcgccggcgcccgggccgggtgggttcggtaatcacgcctgcatcatcacgagccgcggcagcccgggtccggcgagcgcgcggagatccactcgacagggtgacagggcggcgggcctgcgcccgcaccgggccgggccgtgttccgcggccgggccgtgttccgcggccggccccggttccgcgggccgggcgttgtcagtggtgctccgtagagtgaaaccatcatccgaacggaccggattccctgccgggttgcgcgagcccggcatgcgacgtccaccggcggaagagggcgttccgtgcgtgcgtggcgagtgctcgtcaccgtttccgggccgacgcccgacgacttgaacaggccgagacaccaacgggcatgcctccccgaggaagccgcctctgcgcagggcgccgacgcggtccgggggaggagaccaacggaaggggaccgacgcgatgagcgcaacggtgaaggaccgcctcaagaagcacttcgtgaaccacgtcgctctcgtcatcgacaagtccggctcgatgaggggccattcggagcagctcatccgggtggtggacgagttcgtgaaggggctggcggaggagtccgaccggctcggccacgagacccggatcagtctttacgccttcgaccacctggtcgagaacctggtgtgggacatggacgtgaagcacctgccgtccatgcggggcctgtacaccgtcgagaacggcgcgaccgcgctgatccaggcgtcggtgaaggcgctcgacgacctcggccacatatgggaggagtacggcgagcacagcttcctccaggtcgtcgtcaccgacggcgaggagaacgcctcgggcgcggacacgacgggctcgcgccacgatcaccttcccgacggccgcgccgtcctcgactcctggcgggacaggatcgcggacaggatgaacagcctgcccgatcactggacctcggccatcatggtgccgaactccctggccaagcgcaccgcccagcagtacggcttccccacgggcaacatctcgatctgggacgccgactcggcccagggcgtcgaagaggcgatcggcaccgtcaagacggccgccacgcggttcctgcgcgaacgcgagcagggggtgcgcggcaccaggaacctcttcgcgatggggcaggacctgagcacggccgacgtgaagtccagcctccagtccctcgacgccggcaagtacgtgctgatcccggtggaccagcagacgtcgatccgtgatttcgtcacccgcgccggacacccgtacaggaccggctgcgccttctacgagctgtccaagcgcgagaagatccaggccaacaagaagatcgccgtggcggagaaggacgccgtcaccggccggatgaccggaaaggtgttcaccggccccgcggcccggcagctcctcggcctgccggagacggaggtcacggtgacgcccgggagcaacgcggagtacaccgtgttcgtccagtccacctcggtcaaccgcaaactggtcccggggaccaggctgttggtactcctgtagacgggtacgggtcgggcacgcgggccggacggtgccgtccggcccgcggagatccccgtcggggcaggctgcggggccgtccccgcccccgtgccccgcggcggtccgtccccgctcagccctcgcccaccaggtcgaggtcgtcgcgggacgccgccaccggcgtgatctccgcgacgggccacgtgcggtccagtggtcgcgacacgtcccgccaccaggggcgcgtggggaggtccccggccggctcgaacggctcgccggggcaggggaacgcgaccgcctgtccggccgcctccgccgcctccttggtccactcccccggttccgcccacgggtgcggggccaggttgaacgtgccccagtggatcggcagcagcacaccgcgcgggccgcctccctggaggtccaggtgtgcgcggaccgcttccgcgggtgtcatgtggatgtcgggccagaactcggcgtaggcgccgagctggatcatcgtgacgtcgaacgggccgtggtcggcgccgatgtccttgaacccgtcgaagtagccggtgtcaccactgtggtagacgcggtgctcctcgcccgccacgacccaggaggcccacagggtgtgctgggtgttgcgcaggccgcggccgcagaagtgccgggccggggtcgcggtcagggtgagtccgccgaccttggccgtctcgtgccagtccagttcgcgcaggcggtcggccgcgacgccccagtgctcgagatgcgcgccgacaccgagcggcacggcgaagagggtgtccgtgcccgccagcgccttgatcgtgggcatgtccaggtggtcgtagtggtcgtgggagatgacgaccacgtcgaccgggccgagcgcggccagcggcaggggcaccgggtgcagccggcgcgggcccgcgaaggggaacggtgagcagcgctcgccccacacggggtcgaacagcacccggtgcccgtcgatctccacgaggacgctggagtgccccagccacgtcacccgcagaccgccggccgcgggtcgggccaggtccgcgtaggtggtggcgtgtacggggatgttgcccaccggggagcggcggacgcgctgctccttgtcgaagtagagcttggcgaagtcccacggcgagcccgacggccgggtccgtgcctcgcctccggggttctggaagacgccgtccttgaagtggggggagcggcggatccgcgccatgcgcgcaccgccggggtccacaccgaaggcctcgggccgcagggcacggagcccggaactcgggggacggaagccggccacgttacctccaggtggggtcggtcaggttttccattatggagggcccgcaaggcggctcacctgccgcccggcgggcccggcgggcggccacgggcgcagtcgacccacgcccccgtcgggcgccgcgccaccacggcgtcaccacgccgccgcccccgtcaggccaccgaagcgatccgcgtcctgatgtcgtccggggacagcgtgcccttggccgtcacgtcgtcgcccgaggactggccgcgcaggcggcggccgatccacgggaccaggtactcccgcgcccagtgcacgtcgtcgcggcggatgtccagcgtgccgcgcggcggcagcggcggccagggctgctccgggtcggccgggacgtcgacgccgaggacctggccggcccgcagcgcgacgcgggtgtgtccctcgggagacaggtgcagccggtcgtggtcccaggcccggcggtcctgcacggtcttcagggaccacaggtcgagcaccgggcagccgtagcggtcggcgatggcccgcacatgcccgttgtacgtggcgatcttgccgcgcagatgcttgaggacgggcacgccgcgggtgtcgaagccggtggtgaccatcacggtgccggccgcggaggcgaggcgggcgaccgccttctcgaaacgctcggccacgtcgtccgggtcggtgccgggacggatgatgtcgttgccgcccgcacagaaggagaccaggtcgggggccagttcggcggcccgcggcacctggtccgccacgatctggtcgagcagcttcccgcgcacggcgaggttcgtgtaccggaagtcgccctcgggtcgccggtcggcgagcaggaccgcgaaccggtcggcccagccgacgaacgccccgtcggggccggggtctccgacgccttcggtgaagctgtcccccaccgccacgtacgacccgatcactgatctgctgtcactcttcgaatcgtctgccacgtcggcctatgattcaccttccaatgtgacctacgcgaccgtaggcaggggttgacggctggtgagaaaagccacttcaacatcatctccggctcgggaatacacccggcgcgggaggagagagagggggtcttcatgactcgcgtcaccccgcccccgccgacgacgttgcctcaggcagccatgtcgtatcgtcgggaccgcgcccgccgacgagccgtgatgcggggccgagagggaggagtccccgtgacgcagcaggtcccgtcgacgcaggtcccggcgaacgagccggaactgaccggagtacgcaacttccgtgacgtgggcggactgccgaccgtggacggacggcgggtgcggcacggcgtgctgttccgcagcggccacctggcgcacgcgaccgccgaggacgccgtcttcctcgcctccctcggcctgcacaccgtcttcgacttccgcaacgaggccgacaagaagctggacggacccgacgtcgagctgcccggcgtgcgcaacgtcagcctgccgctgagcgaccccgccgacggcgccgagttctggaagatggtccgcgacggcgacctcgaccagctgcgggcgatcctggacgacggcaagggcgcggcccggatgatcgcctcctaccgcacgatcgtcaaggaacgcaccgccgagcactcccaggtgctgcacgcgctcgccgaggacagcgtcccggccctgatgcactgcgccgccggcaaggaccgggccggcctgtcgatcgccgtgacgctgctcgccctgggcgtggagcgggaggcgatcaccgcggactacctggagtccaacgcccggcaccgccgctacaaggtgcgccgcagcagctcgtccgcctcggcctactcacccgagatcatggagctgctcagcccgctgttcgacgcgcgcgccgagtacctcacggcggcactggacaccgtcgaggagacctggggcggggtcgacgcctacctggagcagggactgcggctcacgccgcagacccgggagcggctgcgcgagcgcctcctggactgagcccggtggcgcccggccggtcaggtcgctcggcgctggctcactcggcgccccgtcacttggcgccgacctcgaacagcagccagacgaaggcggcgaagaggtgtccgacggcgatgtagatgatcagccggacccacagcgcgcgcgggaacttctcctccatgtcggtcatggcatgtctccgatgtgagggcccaggcacagcgcggccgtgggactctgcagcagggtgtggacgaagagcagctccagcccgtccgggtcctccgcggtgatgcggtgcggggtcagcgagtcgaagtgcgcgctgtcccccggggcgagcaggtgcgtgctgtcgcccagccgcagccgcagccgtcccttgaggacgtacagccattcctcgccggggtggacccgtacgatgtcgccctgcgagccgtggggcacacgcacccgcagggtctgcatgccacgcccggaggaaccggcctggtagtaggtccagccgccggcccgggtgggttccatgtcggcgccgcgcacgatcgcgtcccgttcggcgaccgtctcgccgagcagttcggagaccgtcgtaccgtagatgcgggcgagtgccagcagcatcggcagcgagggctggcgctgtcccgtctccagacgggagaggtgggcgggcgacagtccggccgcgccggccgcggcctccagggtgagggaggcgcggcggcggagcgcgcggagctggggcgcgacggcgggcaggttctcggcctgcctcgcctccggcccggactcgggagtgctcatgcctccattcagccgcaggcttgccgctggggcaaatttcttgcctcagaggcaaatcggctcccggctccttcccggcctgcccggccggtggctccccgggccggctaccggttggccaccgcctgcttgaccagcgtcttgccgaagtcccacatcagtccaccgccgtgcgcgtcgtccatcaccgcggtgaaggcgtccacgaaccggtcgacgtcctgctctccgatgaccaggggcgggatcagcttgatcacctccaggtggtcgccggagacctgggtgaggatccggtggcgctggagcagcgggacgaccaccatctgcgcgaacagacccttgcgggccgcttgcagcatggtccaacggccgcgcagcttcagcgacttgggcctgccgaactcgatgccgatcatcagcccccggccgcgcacgtcggcgaggagttcgtacttctcggtcagcgccgccaggcgggacctgagcagctcgccggtggcccgcgcacgggccacgatctgctcgttctccatgacggagaggacggcgaggcccgccgccatggcctgcgcgttcgagccgaagctcgccgagtgcaccagcacccggtcgatcgaggagtagaccttcttgaagatccagtccttgccgagggtcgcgctcaccgggacgtagccgcccgacagcgccttggccacgcacaccaggtccggctcgacgccggcctcgtgctggtaggcgtagaagtcgccggtgcggccgaggccggtctgcacctcgtcggcgatgagcagggccttgtgcttgtgcagcagctcctgcgcggcccgcaggtagccgggcggtgtctcgtggacgcccttgccctggatgggttcgacgatcagggcggccacgtcgcccttcttcagctcacgggcgagcgcgtcgaggtcgccgagcgggacggcggtgtcgggcagcagcggggcgaagccgtcgcggaagccctcctcgccgttcacggacagcgagccggtggtcaggccgtggaaggcgtgctcgcagtgcaggatgcgcggcttcccggtggcgcggcgggcgaacttgagcgcggtctccaccgcctcggtgccgctgttgccgaagaagacccggtccaggtgcgggctgtgcgtgagcagccgctccgccagcaggccgggcagcggctggcagtcgaagcgggtgaggtcggcgagctgggcgtccagcacgtcgtgcagggccttgcggacgacggggtggtgccggcccaggcccatcaccccgaacccggcgagcatgtccaggtagtcgttgccgtcggcgtcccagaagtgcgcgccctcggcccgctcgtagaccttgtcgaaaccgatggtgtgcagcatgcgcggcagctggtggttcaggtgcttgctgtgcagctcgtagcgctcggcgccgcgctcggccaggagggcgccgaggtcgaactccgtggtcattcagttttctccttgactgccatgacggccccggccgcgtcaccggcctcaccggccacggcgggttgctgcgccggtacggtcccggtcggcgcgggtacggtcccggtcgtggccggtacggtcccggcctgctcctgggcggccaggctcgcgctgatccggccggcgacctcgaccggggtcagcccgatgtcggccagcacctccccgcgtttggcgtgcgggaggaactgctccgggatgccgaaccgccgcagcggtacgtccacgtcggcgtcgcccagggccagcgccaccgcggaaccgacaccggcggcgcggctgttgtcctcgaccacggcgaccagccggtgcccggcggccaggtgcggcagcgccggatcgacgggcttgacccagcgcgggtcgacgacggtgcagccgatgccgcgcgcctcaagcagctcggcggcctgcaggcacaccggcgccatcacgccgacggccaccagcagcacctcgggccgctccgcccggtgcagcacgtccatgccgcccacccggtcgaccgccgggatctccgggcccaccgactccttcgggaagcgcaccagcgtcggcgcgtcgtccacggcgaccgcctcgcgcaactgggcgcgcagctggtcggcgtcgcgcggcgcggcgatcctcagccctggcacgacctggagcacggacatgtcccacatgccgttgtgggaggcgccgtcgacgccggtgacaccggctcggtccaggacgaaggtgacaccgcagcggtgcagcgccacgtccatgagcagctggtcgaaggcgcggttgaggaaggtggcgtagacggcgacgaccgggtggaggccgccggtggcgaggccggccgcggagacggccgcgtgctgctcggcgatgccgacgtcccacacccggtccgggaaacgctcggcgaacttgcccagtcccaccgggtgcagcatggcggccgtgatcgccacgacgtcgtcgcgctcctcaccgatcttgacgatctcctcgccgaacaccgaggtccaggacggtccgccggacgggacgaggggcgcgcaggtcagcgggtccatcgcgccgacggtgtggaagtggtcctcctcgttcgcgagggccggctcgtagccgcggcccttctcggtgaggcagtgcacgaggaccggcccgtggaagcgtttggcgcggcgcagcgccgactccagggcgcgcaggtcgtggccgtcgatcgggccgacgtacttcagcccgaggtcctcgaacatgccctgcggcgcgaacgcgtccttgaaacccttcttcgcgccgtgcagcgactcgtagagcgtgccgccgacgacgggcgtgcgctggagcacgtccttgccccaggccaggaccttctcgtagccgtcggtggtgcgcagggtggccaggtggttggcgaggccgccgatggtgggcgcgtaggagcgctcgttgtcgttgacgacgatgatcagcggccggtcgcgggcggcggcgatgttgttgagcgcctcccaggccatgccgccggtgagcgcgccgtcgccgatgacggcgacgacatgccccttctccccttgcacctgccgcgccttggcgagcccgtcggcccagcccagcgcggtcgaggcgtggctgttctcgatgacgtcgtgctcggactcctcgcgggagggatagccggacaggccgcccttgccgcgcagcttggagaagtcctgacggccggtcagcatcttgtggacgtaactctggtggccggtgtcccacaggatgcggtccaccggtgactcgaagacccggtgcagggcgacggtgagttccaccacccccaggttgggcccgagatgaccgccggtcctggccaccgcctgcaccaggaagtcacgtatctcctcggacagttggccgagttccgcctcggacagcgccttcaggtcgcgtggtccccggatgctctccagaatgctcacgctgggccccctctcggtccgtgccgtacttcaactcaccgtcaccgtcggtgttttggtggcggttgtggcgtctgccgcgacgtcgtcggcctccatctgcccggcgagcttcatcgcctcctcgatcagggtctccacgatcttcgactcgggcaccgtcttgatgacctcgcccttgacgaagatctgccccttgccattgcccgaggccacacccaggtcggcctcacgcgcctcaccgggaccgttgaccacacagcccatcacggcgacccgcagcggcacctccatgccggtcagacccgccgtgacctcctcggccagcttgtacacgtccacctgggcgcgcccgcacgacggacacgagacgatctccagaccccgccggcgcagccccagcgactggaggatctgaaggccgaccttgacctcctccaccggcggcgccgacagcgacacccggatcgtgtccccgatcccctgcgacagcagcgcaccgaaggccaccgccgacttgatcgtgccctggaacgccggtcccgcctccgtcacacccaggtgcagcgggtactcgcactgctccgccagctgccggtacgcctcgatcatcacgaccgggtcgttgtgcttcaccgagatcttgatgtcccggaaaccgtgctcctcgaacagcgacgcctcccacagcgccgactccaccagcgcctcaggcgtcgccttgccgtacttctgcagcagcctgcggtccagcgaccccgcgttcacaccgatccggatcggcgtgccgtggtccttggccgccttcgcgatctcccggacctggtcgtcgaacttcttgatgttccccgggttcacccgcaccgccgcacagcccgcctcgatcgcggcgaacacatacttcggctggaagtggatgtccgcgatcaccgggatctgcgacttcctcgcgatcgtcgccagcgcgtccgcgtcgtcctgc

SEQ ID NO: 308 - DNA, 57570 bp, Unknown
  Kingdom: Bacteria, Phylum: Actinobacteria, Class: Actinobacteria, Order: Streptomycetales, Family: Streptomycetaceae, Genus: Streptomyces
ggtagcggcgttcggcggcttggcggctggcgacgccaagggggtgggcgaggtcggcccagctggctcctgcgtggcgggctgtttcgatcaggccggtttcccagccggcgagctgctcgcggacccgccgcagcagcaggagggaggccagggcctgctccgggccggggccgtgggcggcgtgggcgccgggggcctcgtgctgggcggcgcgcagggcgtcgctgatggtttccagggccgccgcggcggcgatgaacgaagccgggctctcggcgtcgatgctggaaggcggctgttcctctgctgccacggacacctccttcagatctgtcgtccactcgacgacatcatgtttgtcatccattggatgacatgttacaacggtttcagtgaggcgcattggcaggactgcctgaaccttctggaggtgtttcacgatgttgatgcgcaccgaccccttccgcgagttcgaccggctggctcagcacctgatgggcccgggcacctggtcgcggccgtccgcgatggcgatggatgcctaccgcgagggcgacgagtacgtggtggccttcgatcttccgggggtcaccgcggacgcgatcgacatcgacgtcgagcggaacatgctcaccgtcaaggccgagcgccggccggtggcgaaggccgacgacgtgcagatggagctgtccgagcggccgctgggcgtcttctcccgccagatcgcgctcgccgacaccctcgacaccgagcacatcaaggccgactacgacgcgggtgtgctcaccctgcgcatcccgatcgccgagcgcgccaagccccgcaagatctccatcggtgtcgggtccgggcacaaggagatctccggctgaccgaatgacccgggccgttcagcagtggagggcgggggcacctgacctccccctcaccccgccctccgcacccactggagcgaagctgaagaagggtggcggccgacgtgaccctgcgatgggaagcattcctcgaccacgtgaaggaacgcggcgggtacgacagcccgcaggaagccgaacgcgcggcccgggtggtgctcgctctgctcggcgcgcacctggtgggagatgtccgcgctcagctggccgcgcgcctgccggaggacttcgccgtgatcctgctcaatccgctgcagagcgccgagccgctgcccccggagcggttcctgcgggcggcggcggcctggatagacggggccaccgaacagaccgcggcctgggacgtcagcgccgtgctcagcaccgtcgccgacgcggccggcgatgacctgctggggcagatcctgcttcagctccccgcgggctacgacctgctcttcggccgtccccagcccacgtgaccacctgtgccccggtgtccgcacgcccctgcgggcaccgccaccacaatctcgtccacagaaaggcgaataccgcagtgatgtccgaccagcgtgcaccgctccagcacatgcccgcgatgacgttcgagcagatgctggagaaggtccgctatgaaggcgcgtaccccacccgggagcgagccgaggaagcagtgcgcctggtgctcgcgggcctggggcggcagttgaccggcgacgaacgcgtcgagctcgcagcccgccttcccttcgaggccgcctccgtcctcgctgagcagatccctgacactcagcccctcaccggctgggccttcgtcaaagacctcgccggccgcaccggtgcgaccccggccacaactcgctgggacaccggatccgtcctgaccaccgtcgccgccctggccggccccgacctgctcacccgcatcctgcgccagctcccctccggctacgcgctcctgttcggccgcgccgagctcacccgagccgcctgaccgctcgcctgctcgcgcacccgaggtccggccccagccagcccggcagacggcatggaatgcccggccccctcgggcagcagagccgatgtccgaccgagagccgttgaaacccgacccacatcagcaccaccgagttggtgaagcggctcctcgccgactgctgcgagacatgcggatcaacgagccggattgaggtcatcacaggggccgtcggaaaaggaatggtaagccacgggaaacaccgggcagccgcggcggccgggcacgagaacggcccccgaccgaacaccaaggtcagaggccgttctcactgctcatcgtgcggtgcgtgtcgatgcgaacccacggtgacatcgctaccacgacggttttcaagatcccgaccctgtgtgactcggcccatgccgtcctcgtgctccccggcaggcagaggcgatcagtcgagccagatgagcagggcgtcatccgctgccgcggcagcctcgaagaaccgcgtcaggccgtcgtacgagtgacgcccccactcaagcgctccaggcctctcccatccgaggggatacgccccagccaggggatacacatcagccttggtcaggtcggccggattcacgccgctgacgagctggtcgtacgtggtggcacacagtccccgcgccgcaagacgcacgcgctccgagcgaaggtacctcggcggcccgtaaccccagtcctcatcctcggcgaacgactcctcaccatggatgacgtccaccgggaagtcggcacgcgtcaagaagaagcccagcatgtcccaggtcttggacgtgctgaaatgacgcgcttcggccggcgcgggctctgactcctcctcggcggcctggacctcttcggcgaaatccagcgcccagccagggtcctggaccgcccggtcgagctcagcagccgtcacgcgcagatactcacctatcatgctcatggccggagactagacgagccccctgacagcggtgggcgagcagaccgtctcggtctccgtctcatccagcccgttcaagagcgtgttcatctgagccgcggttccggttccgacctggtcgcaagccgcccacgaaccccggcgaacgccgctgaaagcgcgcgccctgaatcagcaggcgcgagtaccggcaggccacgtccttcaggaccgctgggcccaatcgcggagcgtgccggcagtcatgagggcggccacagagccgggctcgtcggccacgacgagctccaggccgggttcctctcgcgtgttccggcccggctgcagggccccctcttcgcgtcggcgacgctccagacgtagcgccgtcagtcggtgagcgaggcggctcttgacccggcgactacgggggcagcccgcgtcatgggctcggggcggacaccccgggcagagagttcggaggcgtcgaacgggaccggagcgcatcatgcacccccggcgacgacggtggccagatccggacgcagcgccagggccggtccccgctgttcctcgcggacctggctcgcgacaccccttgtacggccggatcggcgtacgggagtccgggattgaccagagtgaggtgctcggcgaagccgcgcaggcctgtggcgccgtcccctgcactcagctcatggtcgcgcggccattcctgtgaagagggcatcgagaatccggtcgacgtgtgagtgggtgagtggttcatgtgtgatcagcaggcggaaatacagcggacccgagaggagcgacatcgccaggtccaggtcgaagtcgggtgagagctggcccttgtcctgtgctgtcttcaggcgcgcgacggtcttgtccgcctgagggctgatgaatcgttcgttgagcgctgtggctaggcccgggtcgtgctgggcctcgccgaccagggcctggaagagcggtcggaagggtggtccggccaggaggtcggtggcttcgtagatctgctggcgcaggtctgccatgacatcgcccgtgtcggggtagtccagggacgactcgctgagcgacagcagcgagtcgagcagaagggcgcctttggatggccaccggcggtagatggtgtgtttgccgacgccggcacggacggcgatcgcttcgatgctgagcttcgcgtagccgagttcctgtcccagttccagcgtggttcgcatgatggctctggtcagagcagggccattacgtcgggcggcggtcatgtccccatgctataggcacggcacgtgccgttcttgacaagtttccctcacccaggcacgcttccggcgaacggcacggcacgtgccgtattgtcgaggggagcgagcgcgtggacgctgacgtgatcatcgtgggtgcgggtcctacgggcctgatgctggccaacgagctgcgggccgccgacgcacatcccctgattctggagcggcaaaagcaactgcgtgagacaccgcgagcgaacggcctgggcgggcagatcctggaactgctgcgctaccgaggcatgctgggcgagctgcaagctgtctgcaccgtccggcctgttggacacataccacggcgagcgttccgccgcggcggcacggacgttgctgcacacccgcgcgcaggcggcattgcggcgcggacacgaccccgccgcggaggcactccgccaggtgttccaggaactgctcagcgacgaggcgcccctgcgacgcgtcggagccatggtcgccgggtccgacatccgctccccacagcccgacggcaccgagcacgtcctgaccggagccttcgcacccgacctcgcgttggacaccggccggggcagaaccagtatcgcggaactcatgcgcccggcccgcccgctctttctcgatctcgcgggccgtgacgacctgcgcgagaccgccgatgcatgggaccaccgcatcgacatccacagggcagacaccgcaggccggccggccgacgccatcctgatccgcccggacgcccacatcgcatgggccgcgcctgtcggcgaaccctccggcgctctcctccccgccctccgccgggctcttcgcacgtggttcggacacccgtcctcccacgcgctaccgcatgaccagccggtcaccgatcgcacatcgaccactcgcacacgatgaggatgcctgccatgcccgtacccgccgaccccaccgtgctccacccgatgcccggccagccgagggtcgtgcagctcaagccgctggtgacctcgccgctgatcgaggtgggggagtactcgtactacgacgacccggacgacgccaccgcgttcgagacccgcaacgtcctctaccactacggcccggagaagctggtcatcggcaagttctgcgcgctcggcacgggcgtgcgcttcctgatgaacggcgccaaccaccgtatggacggcccctccaccttcccgttcccgaccatgggcggctcctgggccgatcacttcgacctgctcgcggacctgccgaaccggggcgacaccgtcgtcggcaacgacgtctggttcggtcacggggcgaccgtgctgcccggcgtgcgcatcgggcacggcgcgatcatcggcagcggcgccgtggtcaccaaggacgtgccggactacggcatcgtcggcggcaacccggcccgcctcctgcgtacccgctacgaggacaaggacatcgcccgcctcctcgcggtggcctggtgggactggcccgcggaacacatcaccgcccacatccgcaccctcatgtccgggacggtcgacgacctcgaagccgccgccccctccccgccgcgcgcctgatccgccggccgccgcctgcggaagagaaccgacaacgtgccaccgccacagaggcgtcgtactgatggcccacaacgcgcacatccagaagacgcccgtcacctttgacggccaccttgccgggctccccatgggccggcacctgcaccacgccctcggggactcgtacctcgctctcggcctgaccagtgtcaccggcaacaccgcggaaatgccccgcggcgagcaagcccgcttcgggttcaccgtccacaacacaccgctggtcccacccgagccgggaagtatcgaagcggccttcgccgacgcagccatgggactcgccgtcgttgatcttcgtcaggtccgggcgatggacctcggcggccccgaccggatccgcatgcagaacgtctaccagcccgcaccgggcgtcaacgcgttcgacggcatcctttgcacgcccgtatcgaccaccacccatctggagaaaccatgaccagcaggttcaccgaactcgtcgtcgactgccgcgatccacagcggctcgcggacttctggtgcgcagtcctggacttcaccgtgctcgaccgaagtgaggacaaggtcgagatcggctcctgggagccgaccgccgaagctgtacgggccaggcagatgccgccgactgtgctcttcgtccgggtgcccgaggcgaagaccacgaagaaccggctccacctcgacgtgagccctgtcgacgccagtaccgatgacgaggtcgccaggctgctgaaactcggtgccaccagagtggacgtgggccaggtgcccgcacggagctgggtggtcatggccgaccccgagggcaacgagttcgatgtcctacgcacccttgcaccctaggcgtattgacccgcagcgttgttgacgcggctgacgggcgggtgtccgcccagcgcggtggggcagcggtggtggtggtaggcgtggaggaagtctgccagggcctgggtccgctcgtcgttcgtccggtagggccgctggtgggccccctcgtccagcagggcgcggtcgaagcgttcgactttgccgttggtcgcgcgtaccagcggccacgcctcgcgtgagatacagcggcgggcacgggccacctcatgatcgttgagcttcggcaccccaatgatcacgaagcccgtgcctgcgctgctatgcaccccgccggccgcagcccggcggccaaccgccgacaggcgtgagtgacctgcactggacgcctgggacgcacgggacgccgggacggtcaggaccgcgcggaggcccgtgcctcatcgatgtcaccaggccctgaacggcggcaacccaagatccgtcggaacaccgaacgggtggacactgtcatcggtcagcatccggaaaatgaattcggacaccggcatctcgaaacgatgccaatcgtcggtcgaatcgacacgtgccacgatcggccatcggcccgaatccaccccgtcctgcgcaagccagtagaactcggcttcctccgccgtggactgagcccacgaaagcagcccttccttgccgggttcaaagaccgcgtaggggcgatagacactggtcgcgtccggatgacgactcagcgtctgcctgagcatggacaaattgccggaaacgctgaattctcctgatgtgtccccgagagggtaaaggtactcgccgaacacccccatgccgaaagtgtccaccagttgcttgaagtccgccgggagcgtggcaccgatctcctgctcgacggttccccaatcgctgtccaggtcaagcggctcatgcccggcaagttgagcgatcctgtttacccattccattgaatacgcctttccgaaacagaaggggagaggttgaagtggcccgtctccgggggcccgagacccccggagacaggccactgcttcagggccgaagtccacccgtcaacctcatgggacgttgggaaccgggaagcctccagtttcgccggtcgagcttgcccagtatatagagacactcaccgggatggggtcgtccccctcgtagtgggcgcgcgccgaataccagatcgtctcgccgaccgcgaggcgtcccgcgatctcgtcctcgaatttgctcatcaccggactgttcgcgttccggtacagggtgaccaaattccttcggtccgttccgctgcctccgagcgatttggccaggaggtgtccccggttgaccgccgcctttccggtccttcgggcttcctcagcgctgtagtacccggccactcgatcgtccggcgcgtaggaaggcggccaggaagtgctggttccccagatctccgactggaccccggggaacttctccacaccgtccgcgtccttgcccttgaagtagttgaaacctccagggctcagacaggcatccacgccctgagcacgccccaggccgtcaagaggcatgtagtacaccatgctctgccccttgccgcagtcctgctgggtgaaggggtacatgtcggtgccgggctgccactcgttcttcgtcttcggagtgagcagcaggcccttgtcgtagtcgggcctggcacccggcgccgacgagtagccgccgggcgcggtggccgtgggctgggacgcccacgcgaagacggataccgcgatgccccagggagacagccggctgagcaggctgcccccgctcgacgcggcttcggcgatacccgaggccgccgagtcggcagcgcccgacagagcaccttccagagatgcggccccgtcttccagaacgcttccgaggctgctgacagcgtccccgatgggcccgaagaggtggccgtcgaactcgaccgcgctgatcgggttgccgctgccgaaggcgtaccggttgccggtgtacgggtcggtgccaaggcccatgtcggcgagcgctccgttgtacgagtcccgggtggtgaagcggttgaggcccgggtcgtagttgcggaagcccatgtcgtaggtgccggacttggcgtcccaccgcttggagttgaagcggtaggggttgtactcctccttcgtcgggtcggtggcctcgggcttgtcgatgccggtgaactcggacttgtcgtcggagccgtaggcggtgtagccgtaggtggccttggtgtcaccgctgtcgtcggtcagggtctcgacgtcggtgtgggagttgtagccgtagtagccgtcctccgtggtgccgtcgtcgttgtgcttgacctgggaaaggcgtgaaccccacgggctgtactggtaggacttcgtcagctcgccggcgacatcctccccgagcacctcgctggagaggcccaggtagttgtagtccgtggtcttgccgtcggcggtctccgacgcggtgcggtcgagcgggtcgtacgtgtacgtcgtcgccttcaacgatccgccggcgtccatgttctcggacttggcgacatggtcgaagccgtcgtaggtggtgcgtccgatgaccttcccgtccgaggtggtggactgctggcggccgaaggggtcgtagttgtagttcgccgtcgagccaccggtggccgccgtgaggagccggttgcggtcgtaggtgtaggtggtggtgacgtccttgaccgtctggctgatgacgttggcgttgtcgtcgtggacgtacttctcggtcgtggcgccgttgcctgtcttgacggactgggagagccggtcggccgggtcgtaggtgtagtcggtcgtcgaggacaggtacgccgagtggttgtcggcgttcatcttcttcgcgacgtcctgcgccttgttgccgttggcgtcgtaggcgtaggtgtgcgaggagacgagaacgccgttcggcttgttctccgtcgtcgacttgacggggccgtcggcgaagtagctgtagtcgacggtgttgccgttgtccttggtctccttcagcctctgcccgaggtcggtgtaggtgtactgggtgaccttcgggtcgccgccctggtcggtgaccgtgatcttgtcgacctgattgcgcaggtcgtactcgtagagcgaggtctggtcggggtgggtgacggtcagcggctggccgttggcgtcgtaggtgtacgacgtcgtctccttttcctcacccgcgagcgcttcggtgaccttctggacctggttgagtccggtgtaggtgaccgtgtaggcgtcgaccttcgtgttcgacgaggtgtcgtcgatgtcggtgaggttgccgttgacgtcgtaggtgtaggtgaagttcttcttctccttgtcactgccggcgtcgacggagttgtcgcggaccagcttcaccccgtcggcgaccacggtgccggtgctcgagacaccgagcttcagcgacgcgtcctccccctgcttcagggtgtaggaaccgagcgccacccacgtgcccgcgccctgggtctggttcttggtgaccgcgggctcggtggtggtgccatgggtgagcgtgtaactcgcggacgtggccgcgccggtcaccgccgggtacttcacgtacgccttgtagctgccgtcggcgggaacgttcagcgtccaggtgaaggcgtccgtcccggtgcccgcggcgtgctcggcgtggtcgtagccctgctggctctcggtgtccttcttcgtccaggtgcctgtggccttggtgttctgagtgtccgagttgtcgaccaggaccgtgttccagccggccggcacaccgtcgtccgccttggaccgcagcttgccgtccgggtagtagccccacgtcatcgtgcggttggaggacgtgttgtccggcgagggcacctctccaccgggtgtcagcgtcctggtcgtctgctggccgaggtcgttgtagtcgtaggtcgtcgtgatgtcccacgggtccttcgacgacttcacccagccgttgtcgaagtactcgttcgtcgtcttgttacggaccgtctggccttccgacggcggcagcgacgtcgacttcacgcgcccgatctcgtcgtagtcggtctgcgtgtagacgttcgggtcgttgtagcgagcgtcggccgggtcgtagggctggtacttcttgaccggccggttcagcgcgtcgtactgggtgcgctgggtgaacgcctcggtgctcccggcggccacggccctcggggtgatcaccttggtggtgttgccgacctggtcgtactcgaatcgggtcgtccggtaggtgaccgagtcgccgctgccgtcgtgcggagtcctgacctcggtctgcttgccacgctcgtcgtacgtgatgtacgtggtgttgccggccgggtcggtggaggcgacgacgttggagtccttgtcgtactcctgcttcgacgtcttccccgccgcgtccgtggtgctggtgacacggtggtcgaggtcgtaggcggacttggtggtgaagtcgtccggatcggcggaggcggacttcttcgggtccatcaccatcacgacgttgccgtcgtcgtcgtagcggtaactgatcgcgtctccggccgaattggcgaccgaggtgacctggtagatctcgtcgtagtggttggtggtgacgaagtcgcccgcgtcgggggtgaggttgcccttcggctcggtcgtggtcagcaggttaccgaccctgtcgtaggtgtaggaggtacgccgctcgcccgaggtcgaggtgtccttcggcgcggtccccgagacgatctggtcggcgtcgtcgtacaccgcctcggagacggctccgttgggggcggtcgacttgacgacgttgtcgttcttgtcgtactccggggccggcgtggtgatcaggtcacccttcgcctggtccttgggcaccgtctggaccagcgggcggccgaaggtgtcgtacgtctgcgtggtcgtgtgctgcagcgcgtccgtgacctggaggacctggccgcgctcgtcgtagacgaacttcgtctccttctgcagcgcgtcccgcatcacgttcgggaagccggtcggcccgaactcgtcgttggtggaggtgtttccgttggcgtcggtcgtcttggtctgctcgccgtaggagttgtactcatacgacgtggtgtagtcaccggcggtcgcggttgcgacgcccttggggtcggtgaccgtcttgaggttgccgaaggtgtcgtagccgaactgccaggcccgcccttccggggaggtcttgcggaacaggtcggcggcgtagccgtccgcgcgggtctggtactcgtacgtcgccgcgtcggccggccacttggacgggtccgtgacgcaggcggtcgtctggtccgggacgcctgccttgttgttctccgcgtcgcgctgccagagcgggtagcccgtcttggggtcgtagcagtacgcggtcttcgcgccgttgttctcctccagggaggtgacgttgttgtcggcgtcccaggtcatcttggtggtctgggacttggcgttggtggtctgcaccgggcggtcgaagtcgtcggtgacgtacttcgtggcgtgcgactcggcgtcggtgaccgtggtgtcggtgtacttggtgttcgccgtgtcagccgcgtacgcgaagccggtggtgccgttcagccggtcggtgatggtcttggtccaccagtggtacttggggtcgtcgccgtccttgggcgcgtagtagtcgagcttggtgtcgtggccgcgcgggtcggtgacggtgaccagcttgacgttcttgttgccctgggtggcgtcgtaggtgaggccgaagaccttcggctgggcggagccggcgccgtcggtgagtttggtcagcaggcccttgtcggagtactcgaaggcgagcgtgcggccggagatgtcggtcatcgacttgacgtggtcgatgatctgcggcgtcttggtgtcggccttggtgtagtagtcgacgctcagcgaccggcggccggccgggtcggtgatgtaggcgaggaacttcgtcggcttgttgttggacttgcgttcctcataggtgtacgtctgcgtgttgccgttcttgtcgaccgtcgacgtcaggtagccgtcgcagccgaagaagaaccgcgtcccgtccggccgcagcagcgtccaggcgtcggggatggggtccttgttgggtgtgcagtccaggccgggtttctcggtgacctggtagtggacgcccgcgggggccttccaggtgccgtcgtccctcttggtgaagacgtgggtggtgccgtcaccgtcgggaaggcggatctcggtggggtgggggttggggtggaagtccaggggtgcgccgaggcgtatgggtccggcggtctgtccggaccagccggcgccgaggacggtgtcggaggtgtcgagggagttgtaggagaagcgggcgaacgtggtcaggccgcgtccggggttggtgaaggcgttgtaggaccagacgctgttgccggaggcgagattgttcatcaccgtcgagccggcgccggtgttcttgccggtgtaggagtagaacttctccagcccgagggtgttggaggtcgggtcctccacggccacgttctgcttcaggccgggaatgccgcccgagccggccgacagccaggtcccggctgtcttgttgtagacgtcccaggtcaggacgtagtcggtgcgcttgttgccgctggccgagttgatgggggtcttgacctgtgcgtgcagggtgacggtgtcaccgggcacgatgtccttgggcagcgcggtctgggcctggttgccgccgttggtgacgtcggtgccgtcgggcagcttccaggtgtaggacagcacctggtcggcggccttccagacggtgctggtggtgttggtcagggtgacgtcgacggtgtagtccgagttcggcgtcatccgcgccggagtgccgggcgcgtagtaggtcgagtcggtggtggagtcgatgtaggtgacgaccatccgcgggtgcagccgcttctcgggcgcctccgtcgacaggaagacggtgcgttcctgcggcgtcgactcgtcccgggtcttgatcagcacgccctggtcggagccgggggcggtgacccagttctggaccagggaggtggcgttccagtcgtgccgtgcggggtcgttggtcacgcccgcgacggtgtccgcggcggttgcgccgatgtcaccgccgggtgtggtccagctggtggcggaggtcgccttcgtccaggtggccgtctcgtcgaagtcccgggtcaggggccgcagttcgtagaccgtgccgctggtgtcggtggtggtctgcgtcgcccacagacgcaaggtcgcgtccaggacccggccggttgccggaatgcccagggcggggaacttcagggccgcgcgggtcgtgccgtaggtggccgagttgttgccgacggtcaaccagttctggggtgtcccgtcggtgatcgtgtcgtgggccgtgtccggctccgccgaggacagcgtggtgtcctgtgaggcttcgacgaccttgacggtgcggcccgccttcggcagccgcaccagctgcgtcggcgcggggatcaccgtgccgtccttggtcctgacggcgaccatgtagtaatacgcccgcccgaacgggtccgcgctgtccgccggtgtcggggtcgccgaagtgtccgtgtaggcggtcgtgcccgacgctaccggcgcgaccagggtggcggccgacggggtgaacgtctggaacaccgagcggtgcacctggtactcgacgatgtcgtcaccgctggcggtggacgggtcggtgtaggtggaccagttcagctccgcaccggtgtcgtggatcgtcgtcggcgcgtccagctccacacccggccggccgtaggtcagcaccaggcgcgggtagttcgccgtctcgtccccgtagccgaactcgctgccctcgtagcgcggaccgcccttgggaccgctcgcggattcatcccccgccttgaccacgaaaccgtagttcgggtcggtgccgtcgatccacgactggaccgtcttcgtcaccgggaacgagtgccagacgttgacctggttcggctgcttggtgaccacaccgcccttggtgaaacgcaccgcgtccgcgatcaccgacgtgctcgccgacgccggttggtcaccgagcacgaccttgccggccgtacccgccttgaacggcagcgttcccagcgtcttccactgcccgccagagccggcgtgctggtcgacggtgtaggtcttgctgccgccgctgtaggtgacggtgtagggcgcgtcggtggcccggtcctcggccggcacgtaatgcgtctcgacctggtagtcaccgtcctccgacagactcggctgccaggtgtaggtgtcccccgccaccgcgtccttgttgtacacgtagtcctgattcaccgcgtactgcgtgtagtcggtattgccggacgcgggccaggaacccttggccgccgtcgtgcccgcgtcgccgtcatccaccaggaccgaagtgcccgacagctcaccggtcagatccctggcgctgttccacgtcgccgacgactcactccacgcggcagtggcccggtgcgcctccagctgcacctcggtgtcaccggcggtgtgggtctggtcgtagtagagcttcagatcggccgagtccagcttcgtccccgccggaacacccggcagcgggaacctcagcagggcccgggaggaacccgtactcgtgttgccgacggacagccgccagttgtcgtcatagttcgtgtccggcccgtccgaggagatcatcacgtcctgggcctgactcggtgtcggcgcgatcgcgatcgtcgggtccacggtgaccggatactgccgttccttcgccgcaagccacttcgcgtccggagtgacggtcagcttccatcccctgccgtcccgggacagtttctgcccgacagccgtgctgtaggcagccccgtacggcgaccgcgcgtccttcctcgcgtccgtcatgaacggcgccgggatcaccagcaccggctccggctcctcaccgtagaagccgaccgaaccgtccttgcccgccctcggcgtcagcccgtccgtgtcgagggtgaaggtgaacttcaccggacccgagggtcgttcggccagggtgatgttctccttcacccggccaggacccacctcgtacgacaggtccgcacccgcgaccgcgtcccgataggtgacggtattgccctcggccaccggcttgagcgtcttgcccgcacccgccaggcccacggtcaccgcatgaccgtcggcggactccacccgcaccagttcgcgcgcgctgtcaccgaaccagctgcgcgtggaattggtggtgttggcgaattcgaagcccttgcgcgcggacttcccgacgttcgggtcgatgcccttccacgacttcccggcacggtacgaggtcggcaccgccgacacctcggcctgcacccggccgtccgacagtttccagaaccgcgcgttcgccgtacgccggcccgccagctccccgacacgcttcgccttcggcgcgatccggcccttcggcagcttctgccgctccgccacccccgcctcattgtgcgacggcggcttgtcccattcctttccgtcctccccgaaccaacccttgaccgtgtcgacaaaccccttgccgtcaccgtccggaaccgacgcggcagcataagcggcctgcggcagcagcgaactcgtcaccgccgctaccacgaggcacgccagcgccctgcccaatctgggtctcacgccaaaccttccctcagagaatggccagaatccgccgccttttccgcgcgagacgaactcggtgcagaacatgcgcggcggcggcctgagggtttagccattcaaccatgacgatgtcaagtgagcggatatttcgctcacctgacgtggaatcaggcccaacagaacaaaagaggatgcccgcaatgcccgctatttccaatcactggatcaggcgggatgtgctggtgtataaccagtcggctttcgacgcaatgacaggtataccgatttccgaggagtggaattaatggacgccagtacccgggattcggccgcggctgaccgggcggggaaaaggggcggtttcgccggccggcctgaccgcgcgggagtgctcgcaggcgccgcggtgctcgccgcgtgtaccggactcgttctctacggcgttctcagccccgagcccggcgcgccgaggcacgaagtggtcaccgctccggtgacctacgaggtgaccggcaccggtaccgccgacatcacctaccaggcccgcaacggttccggaaaggccaccgtcgtcaaggccgcgacgctgccctggcgcaagaccgtcgacgtccccctcggacaggatccgatcgtcagcatcgtcctcggcgagcagggcggacaggcccgctgcaccctcgccgtccgcggccggcacgtgcagagcgccaccgcgagcggcggcttcggccgcgcggcctgcaccggatcgctgccccgcccggccgccaccacggaccaggccaccaccgccgaccacaccacggccgccgagcgggccacgggctgacccgtacgggctccgcaccaccgtcccgtgccatggaggatcctgccgaggtgatgccgctctcagtcagctggacgtccgaccaggcttcggtgttcgtcccccgcgctgccgggccgcactcacgactgaccgcagcccgcacccaccgcatcatccggatctgcgagcgtcagggcgtcccgatcctcaccggccgcgcctacacgcgcgccggcccctgggccggtcaccaccggacccaagcggccaccgggccagtgccggggccggactgcgccatgcctctatggggccgcttccggtcccccgctccgggtgaggcgggcgacgaacacggtgcggccatcggttgcctcctgtgtctggatgcacaggctgacctcgatcagcctgccgtcgcggtggagggccggcatcgataccgggctgccgaggatgcgcggttgtccggtgagcagcagggaggtgaaggcggcgacgtggcgttcgcgcaggtgctccgggatgatcgtggtgatccgctgcccgatgaggtcgaccgggcgccagcccaggagttgtgccaccgctgtgttcgcggcgatgatcctgttgccgtcgtcggcggcgatggtcggggtgctgctcgcctggaggcggctgggatcccaaggcgccagttcggggggtgtggtgctggcctcgcggggctgcgcggtccaggcggtggggtcctgcccggcgagctggccggtgatctgctcgaggagccagtgggtggcggcatggatctgcggcagggccggccgggtcagcagccgcccctgacgcgctgtctcatcggccgcctcgagcacctgccccagggtgagtacggcgtctcgggcatcggcgggaagggacgcacgtaccgtgtgcaggtcgccgcgggtgcggtcctcggaagcggaggccagcgccgcgttgatgacgtggttggtgtcgtgcgcggtcagcaggtcgtccagccgggtcgctgagggcaggtcgccggcagacgccgccagcagggattcacgcagcaatgcctcccggtgctgctgggcggcctcatgcagcgctcccggcgcatcgaccagctccacgctcactctggcggcgaagggcgcatccgggatggtccagcctgatgtcggcggcttcggggtctcgggccacaactcgaaccagaccgtcttgcggtcctcgccgacaaggacaccgtggctggaggccagttcctcgaccatggccaggccccgcccagtgccggcgtacgccgtgccgcctttgtgcggcaccaggacgcggttcagttcgtgatcgctgacgtggacgtgcacccgtccgtccacggcccaggcccggacctccacctcggtgtgcgcgtgcaccaccgcattggtcaccaattcgctgaccagcagctgcgcggtgtcgaccacgtccggggccgccccgtccaggacctcccggacgaaccgccgggccgccgcggcgctctgcggccgcggcggcaaccggcgcaccggcgtacgtgctgggccaggcgtagccatgccaccagtctgcccgccgtcacggctcctgtcgtccccggccgtcgtcgccaccggccagtcgggggcggagcaggaggagggcgatgtcgtcgttgcggggacgggtccgggcgtggcggatgagtgtgtcggcgagggtgtccagggggccgggccgggcgtgcgcgaggcggtcggcgagttctgtggtggacgcgtcgaggtcggtctcgggggtctcgaccaggccgtcggtgtagagagcgaggacggcgtcggggggaagggcgatctcggtggtctggtagtcggcggccggatcgatgccgaggaggagtccgggcggcaggtcgatgatctcggtgtgtccgtcggggtggcgcagcagtggtggggggtggccggcggtggccaggtgagtgcggtggtggatgaggtcgaggtgggcgtagacgcagctcgtgaacagtccggtgtccaggtcggtgaggaggcggttggtacggctgaggacttcgctcgggggcgctccggcggtggcgtggacggcggtgcggacctgtcccatgagggcggccgcgttcacgttgtggccctggacgtcgccgatggtggcggcgacggtggcgtcatccagtcggatgaggtcgtagaagtcgccgccgatgtccatgccgtgggcggcgggcaggtagcgggcggccacctccagtgcgcgtatgcgcggaagggcggcggggagcagggcggtttggaggctctgggcgaggcggagtttggcgtcgtagagacgggcgcggtcgagagcctgggcgatcagtccggcgagcgagatgaggatggcgcgttcgtcggggctgaaggggtgcggtcggtcgtaggagagcacgcagcagccgaccgggcggccggagacgagcagaggcaggatggcccaggcggccttgcgggtcagctgcggtatgcccggatcggagcgctccatgtcgcgaggggaggggaagaagagaggggttctggtggccagtgcccgcgcggtggggactgtcgcgtccatgaagcaagagccgttgaagtggtcgatgacgtggggacggtagccgcggtggccgacggcacgcagccggtcaccctcgaccacggtcaggacgaagccctgcgcgccgagggcggccatgatgtggcgggcagcccgctcggccacgtcttccgcgctcagggcgtcggtgagcgccacggccagacgcatcaggtcgtacagcgcgcctgcccgtgtcggcagcgcactgtccggttccggccccggcccggcgcggtcaggcgggctgctcgcgggggtgggcgtgatgcggacgctgattccggaggcgtccggatggagctggaagtccagccacaggtccggtggccgtagggcggtgaaggaggtggcctggcggctgatcaccgccgcccggtagtggtcttcgaagaccggatggtccagccagggcaagacctcccacggcagcgcgccgatcaggtccggcacactgctgccgagcaggtccgcggcggcggtgccgacgaaagtgatccggcccgccgggtcgagcgcacaccagcctcccacagctccggcgtcgaagtcggccgcaggcagcccggccgcgtcggtgagcggcggagccgccgtgtgcggctcgccggccggcatgaccggcggccggccatcgtcggcgccctgcagtagcgagcccatctgggcgcacgccgcttcgatcacctcccgctcggctgcgctgagctgcgcggggcgcgagcccggccagagcaggaccagcccgccccagaccgtggcaccggccatcacgggggcggcggccagcgccacgtggtagggcagcaagtgcgcggccctggggtagtggcgtgccagctccgtctggtcggcgagccacaccagacgccgctcgcgtaccgcgtcagcaacggggcccgaatcggtcagcgccagacgttcccagagggcggcgaccttggaggggacatgggccgtcaccgccagacgcagcatccgctcgccgctggccagcacatagaccaggcccgcggacgcccccgactgccgcaccgcatcgagcagtaccggatccagccggcccggacaggaatcggcggccggtctcggctccggcgcaccacaccagcggcaccgcatatcacccattcagcaacgatattctcctatcgcgtcatcgggctcgtcagcgccggtgcgggcggagcggccggtgagccggacggccggggcccctcggtcgccgggctgccggcgagcggtctcgcggtggtcatcggcgagcggagcctgatcgccgggagtgtgccgggcggcggcgcttcggccgcgactgcgacctgccccggggccgcgcgtgtctctgtcccgcccaccacccctgaggggtttcaccgctatgccggaacgtttccggtgtagtcgtgcgggccgcctcgccgccgggacgcggctcaagggcagggccccacttgccgcctctccggaggggccagcgagatgtccagcgagatgtatggcacctttcgcaccagtatcatccacttcatccggccagggcgcgaaaggcggacgagagcatgcgagccgaggcgtcgtccgtgctgggaccacgacgccggatgccccagccttcccccgggcgctacaggcccacggaccgggggcatccggacaccacctaccggacggatcccgggggcgaggcgggggagtgcaccctctcgatgtgcgtggacgacctccccgccatcgccggcgggcacgaggacggcgccttcccgcagaggcccggccgaccgcggctctcgtcaaggcccgggcgtcccctgcgcgggtggagctttccggccgcagcaccggcggtcccgccgatccctgaggccctcaccgcggcccgcatccctcaccgcactgccctgggccgcgcccacgtcgtccacgaccacctggcctgacccgtgcaccgcgcagaaaagagctcccgtatggacgagaacggcggcatcgccggaatccgtgacgtcaccgtggtgggaggaggtgtcatcggcgcctcctgggcggccctgttcctggcccgcggcctgtccgtcgccgtcagcgacccgcagcccggagtcgatgacgccgtacgcacacacatcgcgcaggccgcccccgcgctgaaggcgctcgggctggacacctcggacctcaccgcccggctcaccttcgagcccgacctggccgccgccgtccgcacggcggacctggtgcaggagaacggcccggagcggctggaggtcaagcacgagatgtggcgcaccatcgaggagaacgcccccgccggcgccctcttcgccacctccacctccggtatccccgccaccgagatcgccaccgccctcaaggacccgggacggctcgtcgtcggccaccccttcaacccgccgcacctggtgccgctcgtggaggtcgtaccgggcgagcggacctcgcgggagacggtcgaacgcgcccgcgccttctaccgcgccctcggaaagcgtccgcaggtgctgcgcaaggaggtgcccggattcgtcgccaaccggctgcagtcggcgatcttccgcgagtgcgtgcatctcgtgagcgacggcgtggtcaccatgcaggagctcgacgacatcgtcacctcctccatcggccagcgctgggccgtcgccggtcccttccgctccttccacctcggcggcggcgagggcgggctgccccacttcatgagccacctcggcatcggcatggaacgctcctgggcctccatggcccaggagcaggtcgcattcgacgagcccaccaagcagctgctgaccgaacaggtcaaggacttcgacggcaccatcgacgaactcgccgccgaacgcgaccgcaagcagatcgccctcatgcgcgccctcggcgacagtttcgacggacccggccgctgatcgaacccctggttcggcctcggaccctgacgtcggtccggcccctcccgtaccgccaccgcaaacccggcacaccgcaaaggccccctctcatgagcgctgaagaactcaccgtccggatccagaaggccctcgccgacccggtcgcccacgacgacgacttcgacatccaccaggccctgcgcgaagtcctcgcctcggtcggcctccgccccgaggacagcgggggagagatcaccttcatcggcagcgacccgatcgtcccgagcatcatgcggctgggcgccgtccccgccctgggcatgaccgccaagtgcgtcgccctggcagcactgtggcggcagcgcggcggcgagggccaggacatcacgatggacctgcgcaaggccccgcaccggctgtgccccttctacgacaggaagtgggagctgctcaacggctaccccggcggcaccccctcggacccggtcaacccgctcggcttcgacttctaccagacacgcgacggccgctgggtcatgccgctcaacccctaccccaagatcaagaactcggtctacaagctgctgcgcacgtggcccgagaagcaggccgtcgccgacgccatcgccaagtggaacgccgccgacctggagcgggccggcgatgagaccggcgtggtcatgccgatgctgcgaaccaccgaggagttcctccgggaaccggcgtacgagtacatcgcccaggagccgctcatcaagatcgcgaagatcggcgacagcgcgcccgaaccgctgcccgccgcggcggctcagccgctctcgggcgtacgcgccctgggaatgggccacatcatcgccggcgccggagtcggccgcgacctcgcctaccacggcgctgacgtgctgaacatctggcgacccgacgagctggaacacgacgccacgtacaacaccgccaacgccggcgtccgctccgtcaccatcgacccctacggatccgaaggacaggcgaagatccgcgaactgctgcgcgacgccgacctcttctacgccaaccgccgtcccggctacctggagaagatcggcctgagcgccgagcaagccgcgaccatccgccccggcatcatccacctcagcttctcactcgccggcgaggccggcccgtgggcccaccgcgtcggcttcgaccagaccgccggtgccctcagcggcatcatgctgatggagggcggggacggtgtagcggcagggccgaccagcacgccggccctgccgtacatcagcgtcgtcaacgactacgtcctctcctggctggccaccaccggcgcgctcgccgcgctgatgcgccgcgcaaccgacggcggcagctaccgcatcaccctcaacctcacccgcatcgccgcctggatcctcagcctcggcgtgttcgaccgcgactacgcccacgaggtcgcgctcaaccccgaccccgcctccccgcacgcctacctcgacccggagaccttcactgccgagaccccctgcggccactaccagggcgtcaccgaccagatcgtcatgtccaggacccccggccgcttccgcgacgtcctgctcccgcgcggcagcagcgccccggtctggctcccccgccccagctgagcgcgaccggctcctgcgggcgggcaaggggatggccacaacatcctgcggccgtgatgaagaagaccagttggatcccccgaacaggcggcgtgcacggtccgctcgctcggcggaagccgtcagcgtccccgttccatgccgccatgatgccgtcacgtctgccgccgcgaactggtcgccctgtgggggacggcggtcgcggcgagttgagagactcccggtatgggatcttggggaactctggggccggcattgttgtctctcgccggtgtcgcactcggcgccggcgggtcgatcttcggccagtacctcgtgtcgcgagcgagtacccggcagctcgaagtacaggaatcagccgcgcaccgcgcagagttgaagaacgcggtcctgaagttcctcggcattgcgtcacaggtggagaaggcagcgctcacgcgcccggtcagtgacggcacgccagacgatgcggtgctcgaccggctcgtcgacgacctgtggctcgcacaggcggagatcgacctggcggccaggagcgagcccctgcgaggctctgcctatcgttatgcgtcttccctggtgcaggcagcccggggcgagatagccggctcctctgcgctgcgtgggccgcaggcgcagttcatggacgccgcgtatgacgacatgtggcccggccggcggcgggcaaccggggatgcggtcgcacctcggtgaggcgagcgtggtcgacatcaccgagatctacgtccactggtacgcgggccgctcgaagagcgcgccggccgcgtgctgggagtggaccgcaagacggtcaggaagtacctgccccaggcggaggcgtccggggccgccccgggcgggcctgcgatgagcgaggccgactgggccgggctgatcgaggggtggttccccggcctcgtcgacaggagactgcggcaggtcacctggtccgacaccgacgacagacgtccgctgctgcagaacacgagacacaccgaggggccccgccgccggaaggctgacgtgggcccttcggtatggcccggcgtgccagagcagccgtcactcacggggctcgcatggtggcggaggtgttacgggcagttgccgatgactcctgcggatgcctcgccggcggtgtcactgctcagcaccagcgcagcaagagtcgcaccggccagcgctacaacacgtcacatcacgtctctcctcatctacgtcaggggcagttgccgacgtttcctgcgaacgcctcgccggcggcgatcaacggaagcaccaccgcggcggcaacagcgatgagacgacggaacatcagctctcctccaagatcacgggcagttgacgacgcttcctgcgaacgcctcgccggcggcgatcaacggaagcaccaccgcggtgacgatggtgacgatgcgacggatcatcagggctccccccttatgtttcttacgtgggccggacggccgtactgcacgagggagcctaggcgggcgcgtaccaggcctgtgtgctgcgcgtgcagtctttccgaacgacgcgtgcatcgttcggcagagcggtacgggcggggcgaaccggccgtcatgtctgctttggcgcgtccatgccccctctgcgacactgcccgcaaccgggcggagcaaggggcccggctgagtgagtcagaagggcgggggccgatggcgtggcaggggatgacggcggcagacataccggccgccgacagattcgactggttcgcccaggtggtgtcggaggtgatgcttccgacggccttcgagacgcaggacaccgccgggttctgcgcgcagggcggcgtgctgcacctcggtgacgcacaggtgtcgaggttctcctactccccgctgcgttcgcgacgcactccggagctgatccgcaagggcgaccccgagcagtaccaactcgccctggtgacccggggctccgcgtggttcacacagttcggtgccgaggcccggctcggccctggtgacctcgtggtgtgggacacctcccacccctacacttcgggctcaggcctggacggcgaagacgtcgagacggtggtcctgcagatccccaaggcccgcatgcccttgccgtctcagaaggtcgaccggctcctggcacggcgcatcgccggcggcgcggggatgaccgccctcctctcccagttcctgacggcactggccgacgagggacccgactgccccggagagcaactggccgggctggggagcatggccgtggaactggccgcctccgtgctggccgggcaactcggcaacgccctggaacaatctccggagcttcgggcccatggcctgcttcgccaggtcaaggcctacatagagcacaacctggccgaccccgacctgacaccgcgtgccatcgccgcccacctccatttctcactgcgcagcctgcacgccctcttccacaacgaacccgaaggcgtcgcagctacgatccgccgacgtcgcctcgaacgctgccgtgaagacctgacccgcccgggccggcaccaggaacacatccagaccatcgccgcccgctggggcttcaccagtgccacagcgttcagccgcacctttcgagccgcctacggcaccacaccccgcgactaccgcgccgatgccctgcggctcaccggccgaacgtggactcgcccagcagctgcagaatgacctggtgcggcggcgcgtaggcgacgtggacctggccgtcggcgacatcgcggagctccttccctgcgaagcgggacggcggaagagcgatcagctcgaccggtcgatctccacagggccctgcaccgcctcgttgcacgtggacacggcacaccatgccgtggtcatcgactgcgtcggccccgtcccgggaaccggagcgccgctgacgcggtaggagccggtccggaccggagagcgagggcctgccaacccaaggcaggtcctcggccggcaagggcgcggtggccgccgggcagcctctgtgtgccgacaccgggggagtgcccggtgtgcgggccgggcgacggcggccccgccgggcccctttcctgtgacaccacccataggagccggatcacctcctacccggggtcgtaggacctgaccggcctcggcgccgggcggacccggtaccggcgcgtctcggactccgtagcggggtagtacgtcacacctttgcaccccggccgatccgccgctaaccatggctgtcgttgctccgagccacgacacgggcccagcggatcatgccgcggcccaacggctgggaaccacagcgcggggcaccgccgccccgacgccggcctcggacccccgacggccggcgccacgacgacgatccccaccggagagttccccttcatgatcgccacccgcacccgccgtaccgcccgactgcgcaccctcgccttcaccggcctcgccaccacgggcgccgcggccgccgccatcaccctgatgcccaccaccgcgcaggccgccgagttcacccaggccaaggccgccaccgtggcttcggcctctcacgacggccacgtcgccaccggcaagcacggctacgccgacaacctcgacggctggatcaagcagtccctggccatcatgaaggacaagggcatccccggcagctacgagggcctgcaccgcaacatcatgcgtgagtcctccggcaacccgaacgcccagaacaactgggatgtcaacgctcagaagggcatcccctccaagggcctgctccaggtgatccagcccaccttcaacgcgtaccacgtctcgggcacctcccagaacatcaccgacccggtcgccaacatcaccgccgcggccaactacgccgcccaccgctacggctccatcgacaacgtcaactccgcctactgacaagtcagcgccagcggtccccgcagcggtcggtcgcccgtgctcgctgccgggctcacctcggctgaccgcgccacttccaccgcgtcgaccgcgacactccgcccggtatgagcaccgggcggccggggcctgatgcgtcacggcaggcacaccccggggcagccccggggtggactcggcgccgacggcgatgccgccgaagaagacggccagccgaggtcgtgcccggcaagcgtgtagcgcagggtggcccgctgcgctgttccagctgggccgcgaccggacaggaagctccggcacccggtgccgcccgaccggcacacggatcgcgatgcacgcggaccccgtgcgcgagtacttcggcatccatgcggacccccgtgcgcgagtacttcggcatccacgcggaccggctcgtcgtcctcgcggtctcctgcggctgcgccgacacctcacacccgggtcgaccagttccgcaccactcgcgcggaggtagtggacgcggtgggcggggcgtccgctgaccgggtacgggcaactccttcgcggcccctctcaccctgtgcgtccccgacgggggtgcgcctcgtcaggaggcggcttcttccttccagagtccgcgttcttccaggctctcgatcaggtggtcggcgctttcgaggatgtgctgttccatgagggaccgggccatgcgcgagctgcgccggcggagcgcctcgaggatgagcgggtgctcctcgcgggttgcggccgcccggccttcgatggagatgtagaagcggttgggcagatgcttgacgacggagcggagcagcagggcgaggcggtgggagtcggcggcgaggttgatctggcggtggaaggcgtggccgtactcgaccatgccctcctcgtcgttggccttgatggcctcttcctgctgcttgacgatggcctcgagtccgtcgagctgttcggccgtgatcttcttggccgcgcgggcggccagttcgccgccgagctgggcctggacccagaacaggtcgcggacgtcctgctgggtgaagggggtcaccacgaagccgcggcgcgggacgagttcgatgaagccctcgctgctgagggagagaagtccttcgcgcacgggcgtgttactgacgccgacggcctcggcgatgggttccatgcgcaggaagtcgccgggccggacctcgccagagatgatcagctcacggacgtagctcgccacctcttcggagagctgctgccgtctggagtcgcggtcgcgcgccatgagcacctcgttcgccatcattgagtcggcctgctgaacgcatacatcatatagcgtgagcccgcgggctactccgaacggcaggaacggcggcactcgtcgcggtccgggacgacgccggctgcggcacgcgaggcgcgccgcagccggtgagggtggtcgtggcgggttgctcaggccgtgtcgcgcagggccgcgagcgtgtccttggtcagctgccggggtgtgtggtcggcgtcgacgaggacgacggtgcactcggcgtcgtgggtgagcgcggtggtgagactgccgtcggcgaattgggcgagcgggccgcgcggcgagcggccgaccgcgatggtgcgggcgcccacctgagcggcgtgctgggccagggcgtggccggcggccgcgtggtccccgacgctggtgaggatctggccggtggcggcgatgccctgggcggcgagccggtcgaggtgggcggtcacggccgccctggcctggtcggcggtctcgatgtcgacggcctgctcctcgaccacggccgtctgctggacgtgcacgacctccagcgggctgccggtgtcgcgggcgagacgggccgcggcgtcgacgatggtggtggcccggtcgtgggcgccgacggcgacgatgaccgggggcgcgtcggtcgcggccggagcgccgacggcggtgagcgtcggcgccaccggttcgctgtcgccgctgtgcgcctcggcctgccggagcagacggtggccgctggcgaggacggggatggcgatgaagaaggtggcggcgccgaggtagaaggggacgctgaggtcggtggcgtcggcgagcttgcccgccacgaagggcgccaggccgccgccgatgaagcgcaggaagccgtaggcggaggaggccacgggacgctcgacgggggagaccatcatgacggcctgcgtggtcagggtgttgttgatgccgatgaacgcgccgctgacgatgaccgccacgatgaccacggtgggcgtggcgacgccggcggcgatgacggccatgacgatgctcaagccgagcaggttggcgtagaggaccttcgcggtgccgaagcgggcctgcaggcgcggggcgacgaagacgctgaaggcggccaccagcaggccccagccggtgaagacgagcccgagttcatgcgcgctcagcttcatgggatagggggcgtagccgagcatcgtgaagaagccccagttgtacagcagggccatgatgcccatggtcagcagaccgcggtggcgcagggccttgagcggggcgaccggtgaggtgcggcgttccggcttgggcaggttggggacgaaggcgagggtggcgagcagggcgacggccatgaggacggcgacgccgaagaaggggccgcgccagctgacggcacccagttcaccgcccagcagcggtcccacggcgatgccgaggccgagcgcggtctcgtagaggatgatcgcgccgccgaagccgccgctggcggaggcgacgatcacggccagcgaggtggcgatgaacagggcgttgcccagcccccagccggcgcggaagccgacgatgccgttgatggagccggtgcagccggccagcgcggcgaagacgacgatgacggccaggcctatgacgagggtgcgcttggcgccgaagcggctggagaaccagccgacgaacagcatcgccaccgcggtgacgatgaggtagctgctgaacagcagggagacctggctcggcgtggcgtgcaggctctgggccagggcgggcaggatcgggtcgaccagaccgatgcccatgaacgagatcacgcaggcgaacgccacggcccagacggccttcggctgcctgaacggactggcggtctttccgctcggtgcacttggtgcactcattactgcttctctccagtcgtgtcgcaacggggacgtgggtgcgggggcgggctcaggaacgggcccggcggttctcgatcacccgggccagggccggcagggcgatcccgaccgcttggcgttcggtctcggtcagctcctccaggagttcctgcagggccagggcgcgctcggtccgccgctcccggaacagctccaggccggtgtcggtggcttccaccagcaccccccggccgtcggtgtgatcggcggtgcgccggaccagaccggcccgctccatgcgggtgaccagctgggtcatgttgggctgggagacgttctccgccctggccagttcggtcagccgctgcggcccttcgcggccgagccgcccgagtgccgaggaggccgcggtgctcagaccgccggccgtggcgctgtggcgcacgtaccggaccatctgctccacggcgatgatcagctcctcgccgggcgtgaccggagggaccgaatccataacccgcttatgcataagctcattatgcatctacgtgcacgctgaagcaaagccggtctcgcagagccctcacggcgacctcggaggtggagagggtccggcgggttcacgggggcgaggggcgccggtcgccccacaggccacgcacttcgagggcgtcgatcaggcggtcggcgccggcgaggatgtgccgttccatgagggacctcgccgcgcgcctccggtgggtgcgcagggcgtcgagcagctgggggtgctcggtgcgggtctcgacgacctgcccctcgatggcggcgtagaagcggttgggcaggtgcctgacgaccgacccgagcaggagggcgagccggtgggagtccgccgccagattgatctcgcggtggaaggcgtgcccgagtccggcgatgcgctccctgtcatgggccgccacggccccctggtgctcgtcgaggatcgcctcgatcccggcgatctaccgtggggtgatcctctccgcggcccgcgcggccagctcgcccgacagctgcgcctgggcccagaacagatcgcgcacgtcccgccgggtgaagggggagaccacgaagccccggcgggggaccagctgcacgaagccctcggtgcgcaccaggagcagcccttcgcgtgccggcgtggtgctgacgccgaccgcctcggcgatgcgctcggtgcgcaggaactcgcccggccgcaccgcaccggagatgatcagctcgcgtacgtagccggccacctcctcggggagcgcctgccgcctgccgccccggtcgcgcatctcgacgacgttgctggtggccatcggtcctgcgaccctccccgaggaactcgggatccactgaactgaacccttgtccaacgcatgatatattttgtatgttctcttcgcttgtactgagagcgaaaggatcccctcatggccggtctctacttcgaggagttcgaacccggtgccgtcatcgagcaccccactcgacgcacggtcaccgagaccgacaacgtgctcttcagcaccctcacgctgaacctggcgccgctgcacctggacgcggagtacagcaagaacagcattcacggccagcgcctggtgaacagcctcttcatcctcgggctggtctcgggcatcacggtgcccgagacgacccagggcaccacgctgggcaatctcggcttcgacgaggtgaagttccccaagccggtcttccacggcgacacgatccacgtccgcaccgagatcgtcgacaagcgcgagtccaggagccgtgacgactccgggatcgtcttcttccgccacctaggcatcaaccagcgcgacgagatcgtctgcgacgcccgccgcgcgggtctgatgctcaagcgatccgccgccgagaaggcgaccgcgggctcctgaggacgcgactcgactcgcggagaggagtcgtaccgtatgcacaacaccagcctgttcgccaagccgctcaaccccgtgtgggtgcccggcgaggccgagcgcaagcgcagccgcctgctgacggccatgcggcgatggggctacgccaccatcgaggacctgcaccgggcgtccgtcgaggacccggagtggttctggcgggccgtagtggacgacctcggcatctccttcagccggccgttcgagaaggtcctcgacgacagcgagggcaagcccttcccgcgctggttcgtggggggaggcctgaacgcggcggcggtctgtgcccaccgccacgcgaccgggccgctcgcccagaagcccgcggtggtctacgaaggtgacggcggtcagcgccgttcgctcacctacgcccgactggacaccgaggtgcggcggttcgcggccaacctcaccaggctgggcgtcggccggggcgaccgggtcgtcctcttcctcccggtcgttcccgaggccacagtggccttcctggcgtgcgcgatgatcggcgccgtatcggtgcccgccttcaccggctacggcgcggaggccctggccacccgcctgcgcgactcggaagccgtcgcactcgtcaccgccgacggcaccacccgccgcggcaagcgggtgccgctgaagcagaccgccgacgaggccctcgcctccgcgccgtcggtgcacagcgtcgtcgtggtccgccacctcgcggacggcgtcgacatgctggacggacgcgacgtctactgggacggcctcgacccccacccggacccggtcgacacggccgacaccgaccccaacgacccgctgaccatcgtctacacctcgggcaccaccggcacacccaagggaatcgtgcactcccacggcggcctggcggcgaaggcggccctggacttcggctacgggttcgacgtgcacgccgaggacgtcatcgcctggatcagcgacatggggtggctggtcggcccgctgctcatcatgggcggactgcagctcggtgcgacggtggtgttcaccgagggcgtgcccaaccaccccacacccgcgcgcctgtgggagatcgtcgcccgcaacggtgtcaccctgcagggtgtcgccccgaccgccatgcgcgcggtgatggcaggcagcgacggcaccttcggcgacctcggcagcctgcgcgcgttcgtctccaccggcgaggcctgggacgagccgacctggcgctggctgttcgagaccgtgggcgacgccaagcgcccgatcatcaactacagcggcggcaccgaggtcggcggcggcctcctcaacagctatccgttcctgcccatggagcccgcctccttcaacgggccgctgcccggcatcgacgtggcggtcctcgaccaggacgggcagccggtcgtgggcgaggtcggcgagctgaccgtgctcaacaccttccccggcatgacccacgccttctggcaggaccggaagcgctacctggagacgtactggagccagtgggacggcgtctggctgcacggcgacctcgcgagcgtcgacgagcacggtacctggcggatccacggccgctccgacgacaccatcaaggtctccggccgccgggtcggccccgccgaactggaggcggcgctgctcaaggaccgcaggatcgtcgaggcagccgtcatcggcgtacccgacgagcggcacgggcagcgggtgatcgccttcaccgtgccggccgacgcggacgtggaccacgaggacctgctcaccaccgcggtgcgcaacgtcggccgttccttcgccccgaccctgcacgtcgtggcgacgctgccgaagaccaagaacggcaagatcatgcgccgcgccatccgcgcccgctacctgggcgcgtcgccgggcgatctgtcgtcactcgaccccctgacccccctggacgacatccccgtactcgaaggagaccactgatggccacgacggagctcggcgacctggagctgatccgcaagacggtccgcgaactggcgcgcaagttcgactacgggtactggcgggagaaggacaagaagggcgagtacccctgggagttcgtcaaggccttcgccgacggcggctggctcggcgcgatgatccccgaggagtacggcggcctcggcctcggcctgaccgagtccgcggtcatgatgacggagatcgcgcagtccggcgccggcatgagcggcggttcggcgatccacttctacgtcttcccgccggccccgatcctgcggtacggctcggaggcgatgaagcgcgagttcctgcccaggatcgccaagggggagctgctgatggcgttcgccatcaccgagcccgacgcgggtgtggacacctcccgcatccggacgcgggccgagaagaccgagggcggctggcggatcaacggccagaagatcttcatcaccaacgcgcagaacgcccacaagatcctgatcgtggcccgcacctcaccgcgtgacgagaacaagccgctcgacggcatgaccctgttcttcaccgacctcgaccgctcgaagatcaccgtccgcgagatcgagaagctgggccgcgcggccatcgacaccaacgagctgttcatcgacaacctggaggtcagcgacgacgaggtggtcggcgaggtcgggcagggcttccgctacctgatcgacgggctcaaccccgagcgcatcgtcgtcggcatggagggcgtcggcctcggccgcgccgcgctcgaactggccggcaagtacgccaacgagcgggtcgtgttcaaccggcccatcggcaagaaccaggccgtcgcgcacccgctggccgactcctggatccggctcgaggcggccgaactcgtggccatgaacgccgccaggctcttcgacgaccggaagaactgcggcaaggaggccgccgccgcgaagtacctcggcgccgaggcgggcttcgaggcgtgcgaccgcgcgatgcagacccacggcggctacgcgtacgccaaggagtaccacgtcgagcggctgtggcgggaggcgcggctgctccccaacgcgccgttctcacaggagatggtgcgcaactacatcgccaccaaggcgctgggcctgccccgctcgtactgacggaagggccggcccgccgcccgagggcggcccggtggtctcccgacggcgaaggatctgcaccgtgcccggcgggcacggagacgacaggagaaagcgtgaggacgacatgcgtgacgcgatgatccgccggcccggcggcggatcggcgggcggcgaccggggcggcaggcccaccaggggtgcggcatgagcgggccgctgaccggagtgcgcgtgctcgtgctggcgggcatgggccccgttccgttcgcgggcatgctcctggccgacatgggagcgcacgtcgtacgggtcagccggccggcgggccggtccgcccgggcgctgagccagaccgacggcctgcgcgcggagcacgacctggccaaccgggcagtcgactccgtcgccgtcgacctgaaggaccccgacggcgtggagacggtactgcgtctcgcccgcgccgcggacgtcttcatggagggctaccgcccgggcgtcgccgaacgcctgggactcggaccggacgcggtggcgggccgcaacccggccgtcgtctacgcccgcctcaccggctacggccagaacgggcccctgtcccggacggccggccacgacatcaactacgtcgcccagtcgggcgccctgcatgccatggcccgggccggcgaggccccccggccgcccgtcaacctgctcggcgactacgcgggcggcgggaccatggccgccttcgggatcgtgtgcgccctgctggaggcgcggacgtcggggcgcgggcaggtcgtcgacgccgcgatggtcgacggggtggcgctgctgaccgccagactccagggcctgcgggcggccggtctctacgccgacgagcccggcaccaactacctcgactccggcgcgccgttctacgacacctaccggtgcgccgacgggcggtacctcgcggtgggggcgctggagccggacttctaccgcgcgttcacctcgcgcctcggcgtggacgtcaccggctggcctgagcagaacgaccggtccggctggccgaaactgcgtgagctcatcgccgccgcgatcgcctcgcggacccgcggggaatgggccgagatctacgccggcacggacgcctgcgtcacgccggtcctgtcgttcgacgaggcggccgacgacgtccacaacgcggcgcgccaggtataccggcgcatcgacggcgtgctgcatccgtcacccgcgccgcgcctgagccggacgcccgggcgggcgccgcggacaccgagcgccgggccggtggacgcgggccggctgatcgagtcctggagcgcggggcccgcctgacaacccggtcaccccgagcggtggtgtacggaagcttgcgtgcaccaccccttcctcgtttcccgcgccaggcgcgtgggattcccccgccacatgccgatgcgacggggccgaatcggtacttcgcgctttttcaatcggcgcggacttcagacggggctgctggcggggatagtctcccggaacgggacgggagtaagagaaatgaaacatgcaatatcgggtccgctcacgggcgtcaggattgtggagctgggcggcgtcggaccggttccgttctgctgcatgctcctttccgatctgggcgcggacatcatccgtatcgaccggcccccgggttacgacggcggcgcaccggtcgatccgcgtttcaacctgctgaatcgcggacggcgcagcgcggcgctcgatctgaagaacaaggcggccgtcgaggcggtcctggaactggtgcgccgcgccgatgtcctggtcgagggtttccgccccggcgtcgcggagaaactgggcctgggccccgacgactgcctcgcggtgaatccggcactggtgtacgggcggatgacgggctggggccagacggggccgctggcccacgcgcccgggcacgacgtcaactacatcgcgctcaccggcgtgctgcactccgtgggtaccgccggcgggccgcccgtgatcccgctcaacctcgtcggcgacctcggcggcgggtcgctgtacctggcgctgggcgtgctctccgcgctgctggagcgccggagttcggggcggggccaggtgatcgacgccgccatggtggacggctcggcgtccttgatgaccctcttctacggcctgcacgccgccgggtactggaacgacgagcgcggcacgaaccgcctcgactcgggtgctccctggtacgacgtctacgggacgaaggacggccgctggctgagcctcggctccaacgaggcgcggttctggcgcgccaccctgcgcctgctcgacctgcgcgaggaggacatgccggaccagcacgaccggtcgcagtggcccaaggtgcgcgagaggttcgccgcggtcttccgcacccgcacccgcgacgagtggtgtgcgctggccgagggccaggaggtctgcgtcgcgccggtcatgtcgctgacggaggcgccgcaccatccgcacctgcgggagcgggcgacgttcgtcgaggtggagggcgtggtgcagccggcgcctgcgccgcgcttcagccgcacgcccggagccgtccaggggccgcctgccgagccggggcagcacaccgaggaagtcctcgccgactggggcttcaccgccgacgacctgacggccctgcgtgacgcgggggcgatcgcctgacattcgaccgctccgaaccgggggttcggaacttgtcacttggatcggctgtaacccggccttaatctctgggtaaccgcaagagccggaacccgtcacagcgatttggagagatggcgaaatggcttccaacttcctcagtgaatcccagtccgactggctcaagaccgtgaatgatttcatggacaacgagatcaccgtcgaatacgtgcgtaagtgcgaccaagggcgtgaatacccgtacgaggcgtacgagaagatagcgcgtcaggggtggctgggcatcctgatccccgaggaggagggcggctcgggcggtgacatcttcgactactcgctgatggcggagggcctgggcaagttcggcttcgacttcgcctgctcggtgctggtgccgacgttcacggcgatgaacatcatcaagtacggcacgcccgagcagagggcgaagtacgtcaagcccttcatcgacggcgagatccggttctcggtctcgatctccgagccggatgccggctccgacgcggcgaacaccaagacgcgggcgcggcgcgactccaacggcgactggatcgtgagcggtcagaagctgtggtgcagcggagcggcggccaaggacacggtcatcgcgatgcaggtgcgtaccgaccccgatgacaagcacggtggcatctccgtactgctgatcccgaacgacacccccggtctggacatccgccggctgccgacgctgtcgcgccacgcgaccggcaccacggagatcttcctggacgaggtccgcgtcccaggcgatgccctcctcggcgaggccggccaaggctggcaggtcatcaccgagcacctggagctggagcgctgcgcggtcgccgcggcgtacaccggcaacgcgcaggaggccgtcaacgtcgccaaccgctacgcgcagcagcgcatccagttcggcaggccgatctacgacttccaggtgctcaagcacatgctcgccgagaaccagacgcgcgtggacgcggcccgcctgctgtgctaccgcgccgctcagatgaaggccgagggcctgcccgccgcccgcgagacgtcgatggccaagctctacggctccgagacgctcaagcagtgcgcgctggacggcatgcagatcctcggcggctacgccaacctccccgaggcggacatggagcgctacctgcgcgagggcatccagtgcaccatcggcggcggtacgtcgcagatccagcgcaccatcatcgccaagtccatgcgcctgcccgccggcgcctgagaaccggggaagagggacacacatcatgaccgtgatcgacaaccgtatcgacatgccgctcgacgagatcgaggtcggccgtgtcttccgctcgggcggccggacgatcaccgagaccgacgtcgtcaactactgcgcgctgaccggcaactggatcgagatccactccaacacccactacgcggcgcggacccgcttcggtgagcgcctcgtccagggctcactgacatactcgatcatgacgggcctgatcaccttcggcccgtcgatccaggccaactacggcatcgacgggctgcgttacctcacgcccgtgcacatcggcgacacgatctacgtgacctgcgaggtcgtcggcaagaaggagaaggacgacaagtacggcgtcgtcaccttcctgatgaaggcgctcaaccaggacggcgacgtgtgccagaagtccgagtggagcctgctcatgctccgcaaacgcgaggacctggaagcgctggtgtccgcgtccgtccccaccgagaagccgcgccgcaagaaggcctgaggtccgccgatgtccaacgcacccgtcgccgccgtcatcggcatgggcgacgcctatgcgtcgctggagaaccgcaaggacccgctccggctcgccgaggaggcgaccctcggggcactcgccgacgccgggatccgcaaggaccaggtcgacgcggtgttcaccgggcgctcgccgtgggccgacaagcgctcgcagtggagcaacatcttcatctcgcacctgcagatgccggtgacgctgaccagtgaactcaccatgcacggcgccggcctgaccgcgacgatcgccgtcgcgtcccagatgatcgccgccggcaccgccgagtacgtgctgtgtctgcagagcgacgcgacacagctgttcgtcgacgcggtggcgatgggtgccgaagccgacgccgacccccagtacgaggtgccgtacggccccacgatccctgcgctgtacgcgcaggccgcgcgccgctacttccacgagttcggcctcaccgaggcggacctcgcggacgtcgccgtcgccaaccagcgctggggcgcccgccatccccacgccgcgaaggcgaagcacggtgagatcgaccgcgccgaggtcctcgcctcgccctacgtcgccacgccgctgcggcggtggatgtgctccacctggggcggcggcaccggtggcgcgctgatcgtgacgtcgccggagagggcgcgggaggcccgcgatccggtgtacgtcctcggctacgggtcggccaccacccacgagtacctgggcgaccgcatgaacatgcgacagtgccgttacccggccctgggcgagttcccgaacctcacgcacaccgcgaccgcggaagccgcccggcaggcgtacgcgatgtccgggctgggccccgccgacatcgacatgacgcagatctcggtcaacttcgcgcacatgggccccatcgtcatggaggacctcgggttcgcgaagaagggcagcgggatcgacgtctaccgggagggccgtaccggcatcgacggggatctcccgaccgacacgaacggcggctggctgtcgttcggccagcccgggatctcctgcaacatggacagtttggtcgaggccgtccgccagctgcgcggacaggccctggggctggcgccggagcgccggccgaagacggtgctggtgcagggggcgggcggcatgctggccgccggcagcgtgatgctgctttcctcctcgacctgaggcgcgaacgggagcacggcatgactgaagcgaaagcatcgaacgactggccccagccctatcgcctgatggcggcggagccctactgggaagcgctgtcggacgagcagctgaccttccagcgctgcgcggactgcgcacaagcggtgtggcctgcgcactcgtactgcacgcactgcggttccgcggggctgtcgtgggagcggtccgacggccgcggcacggtctactcgtacagcacgatcctgcgcggcccgaccccggtctgggcctcgatggcgccgtacaccgtcggcttcgtgcagatggacgagggctacttcctgttcacccagatcgagggcgagccggacgacatcgagatcggcagggaagtgacggtccgctatgtgcagcgcggcgagcagaagcttccggtgttcgccctgaccgggaacgaataggagccgggcatgcctggacctcttgacggcgtgcggatcctggatctgacgtcgaacttcatgggcccgtacgcgtcgctgctgctggcggacatgggtgccgatgtctccaaggtcgagtcgccggcgggcgacacgacccgaggcatcggaccgtgcaggaaccccgggatgggtccgatcttcctgcacctcaaccgcaacaagcgcagcctcgtcctcgatctcaagagcgccgacggcaacgcggcgctgaagaagatgatcccctccgccgacgtactgctgtacagcctgcgccccaaggcgatgactcggctggggctgtcgtacgaggacgcccgggccctcaatcccgggatcgtctactgcggcatgttcggattcgggcagaacggcccctacgcggaccgtcccgcgtacgacgacctgatccaggcggcggtggggatgccggtgctgcagagccgcaaggtggggccgcccgactacgtggccaccgccatagcggaccgtgtggtcgggatggccgcggccacggccgtgtccatggcgctgttccggcgcgagcggaccgggcagggccaggaggtccaggtgccgatgttcgagacgttcgcccacttcgtcatgggcgaccacctgtacgggcacaccttcgttcccgcgatcggcgactggggataccagcgcatgatgaatccggaccgtcgcccgtaccgcacgctcgacggttacctgggcgtgaacgtctacatcgacaagcactggcagcggttcttcgaggtgtccgggcacccggagatggcacaggacccgcgtttcgccgacatctccggccggaccgagaacatagggctgctgtacgagttcctgcgcagggtcttcgggacgaggacgaccgccgagtggatgacgcttctgaccgaggcggacatacctgtcatcgagatgaacacgcccgagtcactgctcgacgatccgcacatgaaggaggccggattcttcgtcgaacaggagcacccgtccgagggcaggctgcgggtgctcggcattccgcagcactggagcgaaagcagcccagagctgcgctgtcccgcaccgcggctcggtgagcattcggtgcaattgctgaccgaatacggattcagcggggccgagatcgacgatttgctgagctctggcgccgtgcatgcgagtgactcgcacaacgcggaccgaggcgactaggaaagcaggggaacgatgctacgagatctgccgctgtcggggatcgtggtggtggagctgagcgacagcgcatcggcaccgttcaccgggaagatcctcgccgaactcggtgccgaggtgtggaaggtggagcgtccctcgggcgactccgcgcgcggctggggaccgagcacgtggaagggcagcggcgcggccttccacgccctcaaccgcgggaagcggtgcatcagcgtcgacatcaaggaccgggagcagctcgcgacgctgcaccagctgatcgccgaacgcgccgacgtcttcatccacaacctccggcccggctccagcgcgaagtacgggctggacccggacagcctccgggtgaccaagccggagctgatctgctgcgagataggcgctttcgggcacgaggggccgctcaacacgctgcccggctacgacccgctgatgcaggccttctccggcatcatgagcatcaccggcgagcagggacagcgcccggcccgcgccggcgtgtccatcgtcgacttcgggacagggatgtgggccgtgatcggcatcctggcggcgctccaccgacgcggtgccaagcactgcggcgcgaccgtgaacgcctcgctgctggagaccgccatcgcctggatgaccgtcggcatcgcgaactacaacaccgacggcgaacccggcgggcgtcacggctccggtgtcgccttcatcgtgccgcaccgcgcctacccgacctccgacggcgacctggtcgtcagctgcgcgaacgacgcgctgttcgcccggctgtgccaggtactcgaccggccggaatgggccacggacgaccggttcgccacgaacggggcgcgcctggggaaccgggacgagatcgaccgcctgatcggcgaacggctcgcgaaggagtcccgcgcgtactggcaggaacggctgcgggcagcgggcatccccgtggcaccgatccagaccaccgcggagatcgtcgcccatgagcagacgcgcgcgctcggcatcatcggcaggccgtccgacgacgagatcggtgtggtgggcctgcccctgtcgttcgacggcaggcgtccgccgcccctgtacgcggcgcgtgacatcggcgcggacaatgaccagatcgaggaagtgctcgaaggccgcctccgctgacgcggagccgtgcgcggacatgaaggtggcgacatggggacattcaaccggcttcacctgattcgccaggtcgacctgttcacgctgcggctcttcctctccgcgatcgaggagcagcagatcggccgggcggcgatccgcgagaacatcgccgcgtcgacggcgaccaagcgcatccaggtcctggaggacatcgccggcatccagctcctcgaacgcgggccgaagggggtcgtaccgagcccggccggggcggtcctggagcgctacgtccggcaggtcttcgacagcctggaagacatgcgctccgagatcgcctccttcaccgaaggggtgcggggggacctgaccatcgcgtcggcgcgcaccctcttcgtccccttcctcgcgcgcgaactgggtgactacagtcgcgagtatcccctcgtcgacctggcggtgcacgatgtggagaacgccgagatcgtgcggcaggtcgcgcacggcgaggcggacgtcggcgtgttcgccgcggcctacgagctcgatctcgacggcgtcgacgtcacgccctaccggcgggaccggctggtggccctcgtgccgcaggaccactggctgagcgagcgggccggcgtgacgttccgggacctgctggcggagaacctgatcgcggtcccctccctgctgggcgcattccgcgccgcggcgcgccggcttgaacagcaattcgagcccagctacagcgtgcggagtgcgggcgtcgcgatcagcctcgtacgggcgggactgggcgtcaccgtgcagcccgagtgtctggtcacctcggacgtgctggccggcgcggccgtgctgcaactcgacgagccgtgggcggtgcgaaagatccatatcgccaccgcgcacgggcgcacaccgagcccggccgcccgcgcgctcgtccagcagctgctcgaccgcccgagcgacgacagcgagccgatgacctacatctgaccgtcccggggccgagagccccggatcccggccgctgtgcaccatctggtcgagcacgaaccccaagtccccaacgggagcttggggttggctgcgttgaacgccgggtggcggcaagcgccctcggaccgctgtcgagcgggcggggcctgtcgggcacgatcagggatcgtgcccgacaggccccgcccgtcagcgcttgggcgctccgtcacgtcactacggcatcgctccttcggccggctacgccgtcactcgttcgatcagcgcgaccttgacgtggtccgggcgctccagcgtcccgtcggggacgagctcgacgaccgtcttgacgttgagcgcggagcggatccgctgctcgagtacggtgcgcagctcctgccgtcgctccggtcccatccccgccgcgtgctccacgaccagggggagcgggcgctgggtggagtgcccctcgaagtccgcccggatccgcatctcgccggtggtggccggcgtcatctccagcaccagctgcttgatcgccgaggggaagacattgatgccgcgcacgatcagcatgtcgtccgtgcggccgatgcaccgcaccttgtagcccgtccgcccgcaggagcagtcggtcccggtgacgacgacgtggtccctggtgcggaagcgcagcaggggggaggcctggcggcgcagcgcggtgtagacgagctcgccctgcgcgccttcgaccggcgcgacctgctcgcccgtctcgggatcgatcagctcggcgatcatgaggtcgggggagaggaagtgcatcccttcaccggcctcgcactcgccccagtaggtgcaggcgatgtcggtcccgccgagcatctcccgtgcggtcgcgccccacagcgattcgaggttctcgcgcaccgcgggcagaccgccgccgggttcaccgccgacgctgatcgcgcggacaccgagttcgcgggccgggcggccgacgatcttcggtgcctgctcggcgagatgggtgaggaagtagggggtgccgatcagcgcgttgggccgctggtccgcctgtacccgaagcagccgttcggcgccggcctccgcgccgatggggatgtcgacgatgcccatgtactgcagaatctgcacgaccggcagtccgccgacgaatcccttgctcatgccgaaggcgtgcagcagccggtcgccgggccggaatccgttcgcgtacagcgccctggcgccgagttcgcaccaggtgacgatgtcgctcgcggtgagcgccacgtacgacggacttcccgtcgtaccggacgatgcctggatctgcacgatgtcgcggtcgtccacggcgacatgagcgccgagaggcggatgtccggccaggctgtcgcgcagttcctgcttctcggtgaagggaaggccggctagatcctcgaccgtcctgaccttcgccacatcgacatggtgctgggagaacttctcacggtagaaggcgctgtccgctgccagatgagcgatgtgttcccgcagacgctcgttctggaccgcccgggcctcctggggagaaatggtttcgatcgagctccagtacttttctgaaaaaggagcaactgccatgacgcctccttctcgccccggcttctcgatgaccgacccgacgtcgaactcatcgcgatgcccgccaggcgtgtaggtatccctcgcacgtgggtgtagcagtctcactgaggagtctttgagaaatcatatatcgtatgttgatgatgaaccaggggtgattctggctgcggcagtgagatggaatacaagcgagaacgaactggtcgagtctgttctggtctgcggcggccggaggtgcggccgggtgtgagtccgaagggcgtggccccgtggtccgtcggcggcccgcagtaccctttcacggaagtatatatataatatatcatcgcttgggcgaaaggatgaccatgacccttgacgaacagcccccgcgggaggggctcctgtccggcctcaggattgtcgagatctcgagctacgtggccaccccgctgtgcggcctcaccctcgcgcagctgggcgccgacgtcgtccgggtcgaacccctcggcggggcggccgaccgcaccaggtggccgttggccgactccggtacgagcctgtactggtcgggcctgaacaagggcaagcgcgctgtcgccgtggacatgggatccgaggcggaccgccggcgggtggtggacctgatcgtgcggggcggcccgtgcgtggtggtgagcaacagcgaaaggtacccggagttcgggcccgaggcactcagcgcgctgcgccccgacgtgatccatgtgctcctgcaggggcgtgccgacggcggcgccggggtggactacacggtgcaggccgccaccgggttcccgctgatcaccggagcgcccggcaccgggtcgccggtgaaccacgtgctgccggcctgggacatcgcggccggcctgtacctcgcggtcggactgctcgccgcggagcgggagcggctcctcaccggtcgcggccgggcgatacgggtcgccctggaggacgtggccctggccacggcgggcaacctcggctatctggccgaggcgcaggtcaccgatcacgaacgcaccaagtcgggcaacgacgtcttcggcacctacggccgtgacttcgtgaccgcggacggcgtacgggtgatggtcgtgatcctgacgaagcgtcactggacgaagctgctgaaggcgaccggtctgacggccgcgttcgaaggtctggccgagtcgctgggcatcgacttctcgagcgagtcgcagcggtacgaacaccgcgggctgatctccaccctcctggcacggtggttcgacagcacatcgttcgccgaagcggccgagatcctcgacaggcaccgtatcctctgggagcgctaccggagcttcggggaactcgggcgcgatggcggtgccgcactgcgcaagggcgacctgttcgacgtggtggaccagcccggcgtgggcccgcacctcgctccgaagtcccccatcatcgtggacggcggccgtctggatcccctccccgcgcccgcggtcggccagcacaacacggacctcctgcccacgacggcacagaccgcggccgtcggcggtgacgcagacccgcggacggcgtgacgcaggcgcaaccggcccggagcagcttcaagctgctccgggccggttaccgcaggcgcacgcgccgtcagacgctccggaagatggtctgggccgagaccgccgggcccggccggtgaagcggctgaagcgccccggaaggtgcccgggcgcttcagcattcggtgtcgggaaggctctgtgcgccgcgagcacggatcagtgcaccgtcagaccaccagtggggctgacggtcgcgccggtcagatagtgggcgtcgtcggacgccaggaatgccacgacgttgccgatgtcctgcggagcggcgaccccgaagggactgcggtcgcggatcttctcgtactgcttcctgtggtgctcggaaacgccgccctcacgctcgaaggcagcattccaggaaggggagtcgcgcaccaccgtcacacatacgcagttcacccggatccagtcgcgggccaattccttggacagtaccttgctcgccatgatcagcccacccgagaacgtggcaatggccgtctggcccggcgtcggcgtcctgccgccttccgaggtgacgaagaccacgctgccgccgtcccgttcccgcaagtagggcacggctgcctgcaccaccagcagcttcgcggccaccgcctgcccgacaaaggccgtcgcgcgggcgaggtcgatgtcggcgaagaggccgcggacctcgggcgagcgggcctcgtcgtcatggccgccggcgttcggcacgacgatgtcgacgcccccgtaacgacgggcggcttccgccgccacctcctccatgtcgctcttcgagcgcacgtcaccggcggcgaaacagccggtcccgcccagccggcggatctccgcgagaaccttctcggccttctgcccgtctctgccgttgaccacgacggccgctccctcggcggcgagccgcagcgtcacgcccctgccgatgccgcccgtgccgccggtgacaatggcaaccttgccttcgagtttgttcattgcaaaacgcctcatgtagggaaaagcgacttctgccgtcgcgtattcgacccggccctgcgtccacgccggggcgcggagaaggcacgatgagacagacgtcagcgtgcagcgggacgaagtctaaatttcgttttgcgggcgcttcaagtgaagaaatccgaatcgcctgtttccgtcgcggacggaattgcgggcgtgacccggtctgtgagaaagcactcgggcggctaccggtacgggtacgagccgcccagagcctcggcgtcgagagggcgctcccgcttgtcccaggcgccgagcgcgtcggcctcgaaggccgcgttcgcgaggcgctggagggcgtggtgcacgtcgctggagtggcggggattctcgccggcgagccaggagtccatgatgcgggcctcggcctgggagagcagatcgagctcccgctcacgggcccggcggcgctcgcgtcgcagaatcctgcgccagtgcagcgcgccgccgactcgcctgctcggtcggtccggatgcgtgtgcgccacaccacccactgatgcctcctggcgtctggcaccgcatcctgcgcggtgggaacctgcgtctggtcgacccgagggtgacgaagccgaccaggagccgtaagcgtcagataaataatagcgttatatagaccggctgagtacgtgacgccgcccacgcaccagccctgggtgccaccgcgtcagccgccggcggcggcgaggatccgccgggcgcgttcgagcaccggcttgtcgaccatctgcccgtcgaccaccgtgaccgactcgccggcgtcgagcaccgtgcgggcccactgcagctcgccctcggtgggggcgaaatgcgccgtcaccgcggtgatctgggcggggtggatgcacagcttcccggtgaaaccgaggcggcgggcgtgcgtgaggtccgcggtgagggcatcggcgtccttcacgccggtggtgaccccgtcgaccggagcgcacagacccgcggccgccgatgccgacacgagccgggagcgggcgtacctcagggccatgtggtcgtcgtggtcgatgccgagctgtccggagaggtccacgttgccgaaggccgcccggaccgcgccggcggtggcgcacacctccgtggcccgctccacgccggcggcggtctcgatgagcggcagcagggcgcacgctccgcccgtacggcacgccagttccgccaggaccgccgggtcctccgacttgggcaccatgacgggggcgccgtagcgggccgccacctccagatcggcgtcgcaccacggcgttcccggcggattgatcctgaccacggcactgtggcccgcccccagccagtcggccacgtggtcccgcgaccggtccttgtcctcggccgcgacggcgtcctcgagatcgatgatgatcgcgtccgcacccgaggcggcggccttggcgaaccggtcgggccggtgcccgggcacgaacagcaggccgcgggcggtctccagacggcttctcgacagcgtcatgcgaaggtcacctccgccgtggcgtggcgctgctcgcgatgggtggcgatgcgcagggcggaggacatgccgccgggtgtgccggacgccagcagccgctcacccgcgaacgcggggcgccgcagccggtaggacaccgaccgcaccggacggtccggggcgttgcggcgggccagttcgagcatcgcgagcaccagcagcgggccatggacgacgagaccgggatacccctcctcgccctgggcgtacggcgcgtcgtagtggatgcggtgggcgttcgccgtcagggcgctgaaccggaagagcagcgccgggtcgggctgaagggcgagccgccagggctcgtcggagccgggtgcggtggaggtgtcgagagccgtgggatgctgcccggcgctgcgccccgaccggtagacgatgtcctgctcctccaccacacacgtgcggccgcgctgcaggtactcgctgcgcaccgtgacgaagagcagctcgccggtcgagccctgcttggtcgtcaccgtgccgaggctgctgacgcgctgggccggctcaccgaccaggaggggctcggcgacctcgcagcgccctccggcgaacatgcgctgccgctcggggacgggcggcaggaagtgaccgtgccgcgggtgcccgtcgtcgcccaggtcctgctgtgcgggccactgcaggaagtgcagccagtgccacagcggcggcagcggatcgccggttccggcggccggttccggcaggtccagcaccgccgacagcgcggcgacggggccgggggacagtacgtcgtcctcggtcaccgttcctgggctccaggactccacgtacgggccgagcccgctccgggcgatctgcatgggggcttctccttcgctggccgagctcactcgcggctgacggtgacgacaccgtcgacgactggctcatcatcatgcgtgctgatgggtgaccttgcgtaatagaaaagcgtgatgtccgcatgccccgccgtcatggacacctgccgatcaccgggtttcccgtccgggcaggtccgcgaaggcgtccggagacgccaggtgacgccaggcgctgccgggtgtcgtcacgtctctttcagcgccccctgtcgttcagctcggccgaaggccaccggcccttggccaccgccgcgtggatctggcgggtcagctccctggccacgacctcgacggcgggcgtgatcctgcccgaccgggacgtgccgagcacgatcgagcgccacatctcgggctcgcacagcggcgccgcgctgagtgtgccgttcgcgacgtcctcggcgatgccgacaccgggcagtaccgtccagccgtgaccggccagcacgagttgcttctgcacgtgcatggagttggtctggaccacgaggttcatctccaccctggcctgcgcggcggccgcgtcgatcaccttgcgcaggccgtgcccggccgcgggcaccaccagcggatgcgacgcggcctccgcgagggggacggggtgctcggcccgaagcccggcggtcggcggagcgacggcccacagtctctcccgtaccaacggttcggcgttgagcgacggcgtgctggacaggttgtacagcagggtcaggtccaggtcgccgtcgtcgagccactgctgcagatgcccggagtacgcggtgaggaggcgcagatcgatgccggggtggtcgcgcaggacggcggacgcgagcggctcggccagcagatgactgggactgtctagcaggcccaccgtcacgatccccgtgaccgcgcccggcgccggccggatctccgcgcgagcccgctccagctcgttcagcgcgcgccgggcccgctccaccatcgtcaggccggcgggcgtgggctgcatgccctgccgggtccgctcgaacagggcgacccccagctcgtgctccagcgtgcggatctgccgggtgaccgccggctgcaccaggtgcagcagctcagccgcccgcgtcacgctgcccgtctcggccaccgtgaccagcgcccgcagttgcttgatgtccacagctccgcccttcacccacgtccatctgcgcccggcatgggcccatcagcaatcggtatttcacttccgaacccatgaacatcgatgatgacaccgctgccggaacgagggaggttcccggatcgcacccccagcttcagggggtgcggcgggcggctcgagggtgaccgcatacgccctcgacaccggcggatctcccgcgagccccttacgcgggagatccgccggcgacgatccttcgaccagcatgttcccgcaacgcccgtggaggtcagagcatgaccgaactcccgctctccggcatcaccgtcgtcagtgtcgagcaggccgtggcggcgccgtacgccacccgccagctcgccgatctcggtgcccgggtgatcaaggtggagcgccccggcggcggcgacttcgcccgccgctacgacaccaccgtgcacggccagtccagctacttcgtctggctcaaccggtccaaggagtccgtgaccctggacctgaagaccgagtccggccgcaaggtcctggaggaactgctcgccagggccgacgtgttcgtgcagaacctggccccgggcgccgcggcccgcctgggcctggacgccgcgtccctcgcccggcggcacacggccctgatcccgtgcaccatctccggctacggcaccagcggcccctgggcggaccgcaaggcatacgacctgctcgtgcagtgccagaccggcctggtctcgctgaccggcaccccggaggagaccgcccgggtcggggtgtcggtcgccgacatcgccgcgggcatgtacgcctactccggcatcctgacggcgctgtacacccgggcgaccaccggcgtcgcgcgagcggtggaggtctcgctgttcgaagcgctcgcggagtggatgagccagcccgcgtactacacccgccacggcggcacacagcccccgcggatcggcacccagcacgcgacgatcgccccgtacggcgcctacacggcggccgacggcaaacaggtgctgttctcgatccagaacgagcgcgagtggtcggcgctgtgcgaacgcttcctcggccgaccggagctggccgacgatccgcgcttcgccaccggatccgaccgggtcgcccaccgcgacgagctcgacgcgatcgtcgccgagcggttcgggcggtccagcggccacgaggtgatgaagctcctggacgaggcggggatcgcgaacgccggggtcaacgacgtccgggagttcatcgcacacccggtgctcgccgggcggaaccgctggcaggaggtggccgtccccggcgccgtggtgcccgccctgcgaccgcccgcggatcttgcggggatcaccccgcgcatggacccggtgcccgccgtcggcgaacacaccgagcgggtcctgaccgagctgggactgtccgccgagcggatcgaggaactgcgcgccgacggcgtcgtctgacagcacgctcggcgaccgatgacaacacgctcgccgaccgatgacagcacacctcgggaaccggccacagcacgttccggcaaccgaaagacgaggagcacacacgtgagcaccctggacgccctctgtgacgacgagcagttcgtcgtgaagaccgtgcgcgatttcgtggacaaggaggtgaagcccgtcgtccaggaactggagcactccaacacctaccccgaggccctgatcgagcagatgaagaagctcggtatctacgggctcgccatccccgaggagtacggcggtaaccccgtctccacgccgtgcttcgtcctggtcaccgaggaactctcccgcggctggatgagcctggccggtgccatgggcagccacaccgtggtggccaagctgctggtgcacttcggcaccgaggagcagaagcgccgctacctgccgaagatggccaccggagcgatgcgcgccaccatggccctgaccgagcccggcggcggctccgacctccaggccatgcgcaccgccgcccgcaaggacggcgacagctatatcgtcaacggctccaagacctggatcaccaactcccggcgcgccggactgatcgcgctgatgtgcaagaccgacccggaggccgacccagcgcacaaggggatctcgatcctcctggccgagcacggccccgggctctccgtctcccgcgacctgcccaagctgggctacaagggcgtggagagctgcgagctggctttcgacgactaccgcgtaccggccgacgccgtgctcggcggggtcgagggcaagggcttcgcgcagatgatgaagggcctggagaccggccggctccaggtcgccgcccgcgccctcggcgtcggccgcgccgccctggaggactccctcgcctacgcccaggagcgcgagtccttcggcaagcccatctggcagcaccagtcgatcggcaactacctggccgacatggcgacatcgctcaccgccgcccgccagctcaccctgtacgccgcccgggaggcggacgcgggccggcgcgtggacatggaggcgggcatggccaagctcttcgcctccgagacgggtatgcagatcgccctcaacgccgtccgcatccatggcggttacggctactcgaccgagttcgacgtcgagcggtacttccgggacgcaccgctgatgatcgtcggcgaaggcaccaacgagatccagcggaacgtgatcgcgagccagctggtcaagcgaggaggactcgaagcatgaggatcgttgtcactgtgaagtacgtgcccgacgccacgggcgaccggcacttcgccgatgacctgaccgtcgaccgggacgacgtggacggtctgctctccgagctggacgagtacgcggtggagcaggcgctgcagatcgccgaggacgcggacgacgccgaggtgaccgtgctgacggtgggtccggaggacgcgaaggacgcgctgcgcaaggcgctgtccatgggcgcggacaaggccatccacgtcgaggacgacgacctgcacggcacggacgcgatcgggacctcgctggtgctggccaaggcggtcgcgaaggcgggctacgacctggtgatctccggtatggcgtccaccgacggcacgatgggcgtcgtcccggccctgctggccgagcgtctcggggtgccgcaggtgacgctgctgtcggaggtctccgtcgaggacggggtcgtgaagggccgccgcgacggtgacaccgcctcggagcagcttcaggcgtcgctgccggcggtggtgtcggtgaccgaccagtcgggcgaggcgcgttacccgtccttcaaggggatcatggcggcgaagaagaagccggtggagtcctgggacctgtccgacctggacatcgaggcggacgaggtcggtccggagggcgcgtacacggtggtggagtcggcggcggagcgtccggcgcgcacggcgggcacgatcgtcaaggacgagggcgagggcggcaggcagctcgccgagttcctcgcgggccagaagttcatctgagtccgcatccgctgttccgcccctcacacttcgcaagcaggagagaagaagtcccatggctgaagttctcgtctacgtcgaccacgtggacggttccgtccgcaagcccaccctggagctgctgaccctggcccgccgtatcggcgagccggtcgccgtcgctcttggcaacggtgccgccgataccgcctcggccctggccgagcacggtgcggtgaaggtcctcacgcacgacgcctccgagtacggcgagtacctggtggtgccgaaggtggacgcgctgcaggccgcggtcgcccaggtgtccccggccgccgtgctggtcccgtcctccgcggagggcaag

SEQ ID NO: 309 - DNA, 21755 bp, Unknown
  Kingdom: Bacteria, Phylum: Actinobacteria, Class: Actinobacteria, Order: Streptomycetales, Family: Streptomycetaceae, Genus: Streptomyces
ccgcaccgctgctcgaagcgacgtccacactcgtcgtcggcaccagcatccagagcatctggcagcacgacgccgaggcgagcgccgccggttacgccgagctggaggcggcccaccccggccgcttcgtgctgggcatcggggtgagccacgccaagctggccgagcagtaccgccgcccgtactcggcgctggtcgcctatctggacgagctggacaccgcgaaggtgcccgtccccgcggcgcgccgggtgctggccgcgctcggccccaggacgctcgaactgtcccgggaccgggcggcgggcgcgatcccgtacctggtcacggtggagcacaccgcgcaggcccgcgagatcctgggcgagggcccgctgctggccccggagctgaaggtcgtcctggacgaggaccccgaccgcgcccgcgcgaccgcccgcgactacctcgcgatgtacctccagctccccaactacaccaacaacttcctccgcctgggcttcaccgaggacgacgtccgcgacggcggcagcgaccgcctgatcgacgcggtctacgcctggggcgacgacaaccgcatccgcgcccgcgtggaggagttccggtcagccggcgcagaccacctggcgctccaactggtcaccggcacgaaggaccccgacgacctccccagggagggctggcgccgcctggcctcacttctcagctgaggccagctccacaggggcgcggggcgctgtcgatatgcggctccgccgcgtgggcgcgcgaaaccacgacggcgccgcacccaaaacgcaccgccagtccccggaaccgctctttccccgcccccagcggagcgctcacgcgtccttgagctgctgccgctgccgccccaacccctcgacctccagctcgaccacgtcaccggagcgcaggtacggcttcggctcgggctgccccatggccacgcccgccggggtaccggtgttgatgacgtcaccggggtagagggtcatgaagtggctgacgtagcgcaccacttcggcgacggggaagatctgctcggcggtcgtcccgttctgcttcagctcgccgttgacccacagcttcagggagaggttctgcgggtcgggtacctcgtcggcggtgacgagccaggggccgagcgggttgaacgtctcgcagttcttccccttgtcccaggtgccgccccgctcgatctggaactcccgctcggacacgtcgtgcgccacggcgtatccggcgacgtgcgcgagggcctcctcgtccgtctccaggtagcgggccgtacggccgatgacgaccgccagctccacctcccagtcggtcttgacggagccgcgcggcaccagcacggtgtcgttcggcccgaccacggtgtccgcagccttgaagaagacgacgggctcggaggggggttcggcgcccgtctcgcgggcgtggtcgtggtagttcaggccgatgcagacgaccttgccgatccggccgagcggcggcccgatgcgcagcccgtccgcgtccagcacgggcagtacgccggcgtcggcggcgctccggatgcgtccgagcgcggcggcgtcggccagcagcgggccgtcgatgtccggaacgatgcctgacaggtcgcgcaaggtgccctcggcgtccagcagcgcgggcctctcggcaccggccgtaccgactcgcagcagcttcatgttccccaactccctcgatcgcgggcagcccggccgagcgacgcgacctgagtgcggcgggcgcagccgtcggaggactgttcgatcctccaaggtcgtggtgcactccgcaataccccgttcacgtactggaccgtaggcccgttctgcggtgagggccgtaggcccgttccgcgacctggatcacaggcccgctcagcgatagagcacggcccgctccacagcgctccacgcggtgctggtcaccacgtacagcgcggcggccagcggtacgacggccacggtgaccagcgtggcgaaggacatgaacggcatgaccttgcccacggcagcgagcccgggaacctgcccctccccacccgagacgcccgcaccgcccccgataccggcaccgcccccgagggcatcggcaccggccgccgcccgccgggcccgcaggaagttgaaggtggcgacgacggccacgaccgcgaacagcccgacgtagacgagtccggccgcgccgaagacgccgtcgccggccagggcgtcactccaccgcccgcccagcggcgcggccagcagccggtgcgtgagcagtccgttggcgccgccgccgatcgtcgtgctggagaacaggtggtagagcaggaagaaggcgggcatctggagcagaccgggcaggcagcccgacagcggcgacaccttctcctcggcatgcagcgcgagtaccgccttctggagccgctccggatccttccggtacttcttgcgcagctcggcgacgcgcggctggagtgcggtccgcgccttctgcccgcgcgccgcggcccgggagagcggatggacgaggagccgtacgagcgcggtgaccaggacgatcgcggcggcagcggcggaggcgtggaacagcggctggagcaggtcggcgaggcgttcgaccagatcagcgaaaacggagaagacggacatgggtgaggagccctccgggggtctcgtcgtgccgaagaagaagagaggacggcatgacgacccgcggcggcgcagggcacgaagcgaaaacgggtgaacgcgaagcctggacctggacctggacctgctggatctggacctggaggtcaagcagacgggtggcgtgccctcagacgggtggcgtgccctacgcggcggcggtcgccggaaggccgcgtccgggtgccctgggccgtcgccggcccgcggcatcggggtcgcgctgtggcaggaaggccgtacgccggtcccgttcgcggatcgccgtacgcacccgcgtgggcgccacggcgggcgcgcagcgcgagccgagcagcgcacacgcgacgagcgcggcaccggcggcgacggtcacggagagaccgcccgtgtcgagcagcgagagctggaggaccaggagggccagcacgagcaggggccccagaacgggggcgagcggcacaccgagccggtgacgaacacgacggatcacgaccggccctccccgcttgctcgtcccacacccgcgtatcactggttcctacggttatacaggaccgccccggaagagccgcaagggatccatgcgcgccgaggcactccggcagcggtcacgcaggccgcggaacgcggaggccggcagggcacggaacgtacgtcctccccggggaccgggcggccttcccgcgggcacctcatcttcgtcaccgcccggcagtaccgtgtcttccatgcgccccgacacgcccgccgaaaacgcagaaaacgccgagagcgtcgaccacaccgccgaagcggcccgcctggagcggaccgcgggcctgtacccggaggacgccgaagccctcctgctgcgggccgccgcccacctggaactcgccggcgaccgccccgcggcgacagcgctctacgaccgcctgctgaccaccgcggacgccctggagaacgccacgctggtgcgcgccctgaaggcggcgaacctgtgggagtacgaccacgaggccgaggcccgcgcgatcatcgacggcgtccgcgccatcgcaccgcgcgacccggccccctggctgatcgtcgcggagtcgctggagtcgcacgacgaactggaggcggcccacaagacgttcacggaggccgtcacactcctcctgaccgacgtcccggagcccccgtacgccacccacccgctcctcttcggccgccaccgggtgcgccgcatgctgggcgcctcccacgacgagtgggacgcgctcgccgacaccctgcactcgctgccggtctccctggacgaactgcacgaccccaagcgggtctggtccctcggctcggagaacccggccgaactccaggcggaactggtccgcctgcgcgcggaactcggcgcctaccgcgaggccctctcccgtcccttcccggtggcggtcctgcactggccggcgcacgaactggaggaactggtggcggcctacgccgacctcgccacggagtacccctcccacgagacccacctcgcgacgatagagcgctccctgcgcgaactgtccgcctccggcacccccaacctcggcatcgtcacaggcacggtcccctcctacgaggccttcgccgcctcagagggctcctccccctccgacccgaccctgctcccccagtacgcgacgaccctggcggcccggggacgagcggtggcgtggccaccacagcgggcagcggcctgctggtgcgggtcgggacgggcgtacggggagtgtcacggggttacggaagcctgagaccgcgacaacattggacaacgtgagaccgtcctcccccggcgtctcggcacgcatgtcccgtcagggcagcaaggacaccagcgctgagctggccgtgcgacgcctgctgcacgcggccggcctgcgctaccgcgtggagtaccccgtgccgggcatgaagcggcggcgcatcgacgtggccttcacccgagccaaggtcgccgtcctgatcgacggctgcttctggcacggatgcccggaacacgctacgcagccgaaagccaacgccgagtggtggcgcgcgaagctggaccggaacatggctcgcgatcgggagacttcggaacatctgacctcggccggatggacggtgttgcgcttctgggagcacgagcatccggaagaggtggccgctcggatcagagcggctgtggagcgatgcctggcggaacaggcgggaaggcgtgacccgtggggggactgactttcgtggacgtgtgctcgggggcgggtggactcgccctcggtctggagcaagccggattcgagccgcgtctgctcctggacgacgacgatgacgccgtcacgaccttgcgggccaatcggccgcactggaacgtgctcagcaccgacctgctcgacttcgaccccgccgagcaccccgagagccacgacgtggatctcctcgcggcaggcctgccacgggtgaagtcgagtgcgacggctgggcgggcggaatcggggtcggaggagcggctgttggaagccacggtctacctggcacacgccatcaggccgcgagcggtgatcatcgagaacgtccccgacctcgcccactcggacaggtaccagcgcttccgtgacttcgcccgcgccgaactggctcatctgggctacgagttccgctggttcgtcgtcaacgccgtcgacttcggagtgccgcagaaccggaagcagggccttctcgtggctgtcgagcggcaccgggccgaggcgttccgaccgccgacccccaccgtgccgcagccgatgacggtcggttccgtcctgggaccgtccatggccgcgcgcggttggcgggatgccgcccgctgggccgcacaggccgaccagccggccccgacactggtcggaggctcgaagaaccggggtggtgccgacctcgggccgaccggggccaaacggaagtgggcgaccatgggcgtcaacgcccacacggtgggtgacgaggtccccgggcccgacttcgtgtgggatcccctgctcggcagggacaatatggtgaaaatcacagtcgaacaggcggcgctgctccagggtttccctgcgtcgtgggcggtcaccggccgcaagacggcccgatatcgccaggtcgggcacgcgacgccgccgcccgtcggtcgggcgctgggccgggccgtcgcccaagcgctgcacgcggagccggtggccccggctgccggctagacttccgccacatgaccagcacgccgccccaccagtccatcctcgacaagccctttgtcctggacctcttcgcagggcccggcgggctggacgtggccggacaccggctgggcatcccgagtctcggcctcgaatgggaccggagcgcgtgtctgacgcgttacgcggccggtctggacaccctccacgccgacgtgagcgcgatccgcagggagtccttcgaatcgctccccccggagatcaacgtgctcgccggcggcccaccgtgccagacgtactcggtggccggaaagggcgcgggtcgtaaagctcttgaagaggtcaagaagttcatcgaacgactcatggcgggtgatcccgacgaggagatcgacaaggagctgaagaacctcagcgacccgcgcaccgcgttggtgctcgaacccctccgctacgcgatccaggccaccaggagcccgaaccgggggcaccgaccgtacgacgtcatcgtcctggagcaggtccccgccgtcgaggcgctctggatccgctacgccgaggtgctgcagaacatcggcctccccgacggcaccaagtacaaggtcgtcgtcgacgtcctggccaccgagacctacggagtgccgcagacccggtcccgcgccgtactgatcgcccgccgggagggactcggcgagccctcactgcccaagccgacccaccgcgcctacgaggcgaaggcgtggaaccgcaggcacggtgacagcgcggtcccggcggctcagccgaccctctgcgaggcgaccgtccccgaaccccggcagcgtcccgtggaggacgacgatctggagcactggacgtcgatgggcgacgccctcgccgagccggtcggcacgcactcggggcgcaagacgcccttcttggtccggtcgaactacggcagctccgggatcccgggacgacgcggggtgcggaccgaccgacagccggccaccaccgtcacggggcgcatctcccggttcgtggtcttcgaacccgtcggcgaccaccaccccgacgtcgtccgggaagggccgaggttcagcatgaacgaggcggggatgctgcagagcttcccgccggactacccctggtcgggtactgcgaaggcccagcaggtgggcaacgccgtcccgcccctgttcggagcgcacctcctgagtgccgcgctcggtcttcccgcgccggccccggaggtgatgagagagccgtgggtcccggccacggaggagcagcgggcgaagctgcgcagccaaggctgcgggtcagcggacgactgcaccgcccgctgcccccatcccgaggagcagacgccgccccgatcgacctcgcgtgcgccgaagaacgcctcgaagcagtgatcaagggccgcccgatcagtcctcgctcttcctgcccctgaccggcgcggtctcgaacagctcggtgaagtagtcggtgagcgcagccagggactcctccgggacgggatcctcgtccggcccctgggggaggacgtggcgtgagaccggcggggccgtctccgcctccgcgatccagtcccgcagacgggcgggttccctgggctcgtcccgtgcgaggacgtcgtagatcaaggttgctccggccgcgttgacggcgacgctcagaccgttgacgtcccggccggtggtgatcttgccgtgcttcagaaggcggaccagagcctgggccgtggggcggtggtcgatcaagtcgttccggagaacggtgtggatgaggtcctggttaccacaagcgatctcgaccggttcgtagtccggcccgttccggaagagttcggccgcccaccacaggcgggagaagcactgtcggtcggcggggccccgaaagcgctccgcggcgacgcgttgtgtcgactccgacaggtgacgccacacgacatagtcaggagctacggccagcgccaagtggttccaccgtcgcttgtccgccgcctcccgccgtgtcagacgcagcgtggcgtggagtcgtggcgcgagccaggcgtcggcccgggtccggtccttgccgaactcgaacatggcgtcctccaccagactgcggatcggctcgacccaccacctggcgtcctcctcggggagcggctcgacgactttggcgaggtcgatgccgctgtggacctgttcgcccctgagcagtccctcggtgaggaaggtgtccacggccgagccggaaagcagtgccagacgctccggtaggtggtgaggctgggtgatcacgactcgctctccctgttcgtccgttccagagcgcggatggcatagcccaccgccttggcggcctcggcacgcctgaccgccgcgtaatggatgcgggtctggagttcgccccaacccgactcgccgacgcgtcggcggtgaacctgccgcagggcctcttcgacatgcacgccggggacgacgtccgggagcatctcccgcagcacctcgccctgccagtcggtcggaaagaccgggccgccgcccggttccacttccaggtcaccgatggcggcgtggaacaccgccgtccagacgtccgtggccatctggccgacgaggacgtcacgcaccttgctctccacaccagagccgttgctgtccaacagtccgacgatcccgtcgatatcggtgttgacgtacacggtggggaccctcgccgtggtatccaccagccagggtgcatcggcgtaggcgcgcagccattccctggaactcttgctgaacgacgccttctggacatccaatcgcagccctctgaccggttcgtccgagacggtgtcgacggcccaaccccggtcggtctcggcgatcgaccgcccttcaactccgtcgaccacaccgacggcgtatgcggcaagggtcgctcgaccgaggtggtcgtcgcgcagcacctccagggtgcccgaccagtcgtgactgtcctccgtgtcacgggtgagagccgtcgaggtacggacgttggtctcaccgtcggtcaacaccgcgaggacacgtagttcggaccaggccgcgtccggggcgtcggcgccgggcggcagcgtggccgacagaccgatcgtggcgctcacccagtccgcgtggcccgcgacgccgagggcgacgacctgctcctgcgtcgagtaggcgctggtgtccgtcggcacacgggtgccgtcggagagcttgagggagaccgacgtcaccctgagcgtgatcgggcggttgagccgcttgtacgggtagatcttcacgcgtcacgcccccttgccggcgcgcagttcgacgacgaggcgggtgagtgtggtcctcaccggatggctggagacatcggtggctccccggaatttcgctcgacgtgtgccggacgggaagcgcagggtgccgtcctccacctcgcagccctcgacggccacgagttccgcccagtcgagtttcggacggccgccggagcgaacgtccaactgggcgaccggcaccatcgggacgatctcgtcaccgcgcgggatgctcacctccgccgtgatcagccactccccctggtcaccgatcgtcgcctcgagcccatcgagcaccgggaccaccgggccggagggaaccttggccttgggtcggctcttgacggtcagcgccttgcgcagcgcctcgccgccttcgcctctgccacgcttcgggcgggcgacgagttccctgaccgcgctgttgacctcggcggtcaggttgttgatccgcctgtaagcggaaggggaccagcgcagggtcagttcctccgtctgcccccagcgatcgtgctcgggcggttccgccgcccgcaggaactcctcggcctccttcgcgaagggagcggactccccggcggcctcgcccaccaggacgacggcctggaaggggctggtgccgatcggcaggttcgggaccttggccttcttgaccgtcatacggttgccacgcagcgcgtgcacatggttcgcggggatgtccttgtcgccggcggcctcggtgaccagcagaaccgcctggtgagtacccagggtcccctgggcacctccggtcagcggcagcttcagcggaacgtttctggatgccacctgaccggactcggtgagccgatccaccgtggcgccctcgtagtgggcccgcagggcgcgggttctggagggctgctcgacggacgggtccaccttcgtctcggccaccacctcctcgccgttgcgcagagcgcggacggaggcttccagcaacgggagtcggccacccccgccgaccatggccgcccagaagtcgcggcccaacgcctcgaccaggcggccgtgcatcctctcgatgtcgcgcgtgtcctcgggcccctcctcgtcccgacgcttgtcgtcgtcgacctggccttcgaggccggccacgtcgtgcgcgcccacgatgaggaaagaagtaccgggctcgtcactgtcccgactcagatgcaggcgggccacggtctcctcgtccgcccaccaggaacgggcgacctcggcaccctgtttatcggggtcggggcgcccgaaccaggcggggcccgcgcaaatgcggccgtcgacctcccgccagggcagttcgaggcggccgatcacccttcgctcggtacgcccctcgtgcggcacggacagagtggagttgatgagcacgaggccgagggcgctggtggcccacagcgtggccttgcccaggccgtacgaacccccggcgccggaaccggacttcaggctttcgagctggcgccggacgacggcggcgaacttgccgtcctcgtagtcgtcgccgatgagcccggaggcgttgtagtcgtcgactcgcagaaggatcaagcggcccttctcgtacatgtcgcgcacaccggcgtcgacgactcggcccaccttctggttaccggcgagttccgagacggcggagtagtgcgggaagagctcgttccagaggatcgcctcgcggaaggcttccaggtgttcgccggtcagctcgtgcagggtgtagcggacccggaccgggcggccgttctccgtcaggcgctcgtcgaggctgttctggcacgtctcgcgtgcgagaacctggacgtcggcgtcgaaggcgaaagccgcggcattgcccaggtcacggccgccgtcgagatagccggggcggtggtaccaggtgacgggaaggccggcttgggtgtcggtggtgcgggtgtgcaccgtgccgatgtccgtgccgagagccctggcgatgtccgtcatgactgtcgggcggggggtcgaccgtccggctatccacgctgagacggccgctcgggtcagctggagttccttggccagttcggcctgcgtcttccccgcgagcttgagctgccgagccagccagggcccgaactcctcacctgtctccatgcgttacctgtctctctcgggtcgtaggagcaggctaatttgacgatcgcgatcatgtcaaccaatagttgaccgaacgggagtgaccgactgactaacccgcctgtccgaatcaccctgtttgcatgcttcgcacccatttggggttcggttgcaaaaccgggatctcgaactccacttgtgtataggtgagttgggttgccaacaacgcggaagaccgctaccttcgccatgttggaaaagccaactcgcccggaaaccggaaatccggaggctgggcgactgggggaggagtgcgtccgcatgcgaccaacaccgttgtggcgaaacgtttttggaaaggggctggcgggccgacggatctcccgctagcgttttgcaaccggggggcgtagcccgacccctgtgcatgaataagaactgacacgacaggggtggggtgtcatgaacgcgggtgactgttttcctttgctgctctctgaccgggagtgcagcgcgatagacctggccgttcggtcggcgacgagcaaggccgaagcggcaagcattctgcaccgccacgaactgtccgatcaggagttcgtcgcgggattccccgatctggacaaggcggttcaggagctgccggacgagagcctccccggctcctgacacacgctgccaccagcacggaccgcgtcctcggccaaccggcgagacgctgggacgaccaacacctcatgaaccacgggccggctcccgacagccggcgagccggcccgtcatccagacttttcaccctcctttgacaccaggagcagcagccttgccgtcctcgtcctcagcggtgatcgaaaccgttctcgaacagtccgcccgcgttctgcagacctatgccgtggaccccggcctcgtcgccgagcacgccaatggcgagcgccggatcacgcagggaggatacggcgaccgtcagcttttcgaactcgtccagaacgcggccgacgaaatcgccggcgaacccggtggacgcgtccacgtggtactcaccgacacccacctttactgcgccaacgaaggaaatccggtcaccccggagggggccgagaccattcttcgaatgagtatgtcgaagaagcgcggtgggcagatcgggcggttcggggtcggtgtgaagtcggttctcgtggtgaccgacgcgccggaattcttcagccgcaccgggagcttcgggttcgaccgcgcctggtcctacgcgcagatcaaggccgtgcccggggtgaccgagcgctacggaccggagttcgacgcccccgtcctgcgaatggcccgcccgctcgacatgcaggccgaacgtgcctccgaccccgtactggacaagctgttggcctgggcgaccacggtcgtccggctcccgctgctcccgaaggccgacgaccggctggggaaggacatgcacggcagtcgtggcaaggaccacggtgagccgcgcgaggagttcccggtcgggttccagctcttctcaccgcacgtcaccacggtcgtgctggaggaccaccgccccaggcccttggcgcgtcgaacgctgaccgtccagcagtccggtgacctgcacaccgtcaccgaagagcgtacggggaaggctctgtccacggagcggtggcgcgtgttcaccaccacgcacgagccgggccccgccgcccgagaagatgccggggagttgcacgatcggctctccctcgacctgtcctggggcgttcccgcgctggagaaggacccggagagcggcctgtacgtcaggtcggcccgctcgcgcggtcgcggaaagttctggtccttcttccccaccaagtacgagatgtccctgagcggcatcctcaacggggcgtggaagacaaacgaggaccggcagaacctgctcgactcctccccgttcaaccaggagatgatcagggtgtcggcgaagctcgtcgtcgactccctcccggcgctggccccggccgaggatccggccgcgtatctccccctgctgcccggtcgtgtcaaggagtcgatcagttgggcggacgagttcctgacccgggagatctgggcccgcaccgccacgtccccctcactgcccgatcaggacggcgtcctgcgcgttcccgggcaactgcacatccatccgcggctggacagggatctgaagcagctgacgcggtggcttcggatgtggcacgaatgccccgggcgcccctctgactggctgcacccgagcgtcgaggccgacgccctgcgctcgggcaaggtcgagcacatcctcggcgccgccggacacgagcgggccggggcccgcgactggctggaggctctggtcgcgagcggaaccgccgaggcgtcgggggtggccgtccgcatcctggccgacatgatcgagaagggctccccgtccgccgacgaggcccgcaaggctcgcatcgtgctcaccgaggagcacgggctggtcgcccccgtccacggcaaggtgttccgccgggccgagcaccaggacggcctgcgcgagtccacggtgtacgtcgtcgacgaacttgcccagaacccggccctggcgcacgcgctcaatgtcctcggcatccgcgaggccgacgccgaggggcgattcgccagcgtcctcgaccagggcttcgaccactacggggagtcggactgggagcgcttctgggaactgttccgccaggcaggcgttcgccggctggcgcacaaggtcctggagcgcgtgcccgatccgcgcacgacgctccgggtacggacagccgacaagcatttccggccggtcggggactgcatgcttcccggtgtcgtggtcgacgccgagcgcgatccgagcgtcgccgtcgacatgacgttccactccgacgacgcgtccttcttctccctgatcggcctgcgggagcggccggccggcggcgtacagcctcaggccgaagaggcttggttcgaggagtatcgcgcggccgtccacgcttcctacctgcgctccttggacagccgcgctccgcgccccgctctgaaccggatgaaggtcgagggtgccgcgatcggtggtcctctccatctcttccgcgagctgtcccaggagtcccgcgccgccttcctgaaggcgctgcccgatgacgcggtggtggacaactggacgcgtcagttcggcgcccagaccagcactcggcaggcggtgatgtcaccgatccgatggatgctgcgcaagcacggcaaggtcgccacctcccaggggatcaagccgctgacggaggccgtcggcccccagctcgccgcctaccgcgacgtgctgccggtcgccgacatctcccccgagaaggcccgcaagctgcggctgccgatcaccgtcgaagaggttcccgccgaccgctgggacacgctcctcgacgaggtgtcccgcagcgaggacgacgccttcgtcggcgccacctacgtgatgctgacccggttcggggcggacttccccgaggactccctcacccgctgccggatcggtgacgcctggggcacccgccccgacgacgagatcaccctcgccgtcggcgcggccgagtaccgggccctgcgtgccgagcaactcccggccctgctcgtgccgaccaccgaggacgccgagctgatggtcgagaagtggggcatgctccgctactccgacgtgatcagtcgggagacccgcgaggtgcccgagggcgaccccgttcccctcgtcgagttgttccccgccctgcggcagcgcctgaacagcggcaaccggaacagcacggtgcagcggtgcaccgagctggaggaggtcacgcgcacgcccaacggcacgcacgcctcccccctggacgccgtgcgccaggacggcacggtcaagatccgcgtgcctgtggagccggaacccatgctgcggctgatcgaccgcgaactcggcctcggcctcggcgcggcaggctgccgcgcggtgctggaacaccaggaccgcatggccaaggacagcgcgctgaaggcggcgcagaaggccgtgcgcgatgccgaggacgtcgtggccaaactcgagctgctgatcggagcggacgcgctcagggccggcctgcccgaaggtctgatggacgccgagctgcaggcgaccggcggcgccgagccgtccggacgtcgcatcgcgcagatggcgttcaacgcgcacggcgacggggtgctccagcagcacgccagggacattcaggcacgcttccccaacgccccggtgtcgtacgggggttcgtcggcggccatcgcgttcgtctccgacctgcgcctgcctgtcacgttcgcaggttccaggactccctcgccgccctccttcgagaccgtcgaaggcccccgggacttccccagcctccacgagtaccaggaagacctggtccggaacatctccaccctgctcgaccggctcgccccgcagcgcggcatgctgtccctgcccaccggcgccggcaagacgcgggtcaccgccgaggccgtgatccgctgggtgaagcgggtcggcgacctcaaggggcccttgctgtggatcgcgcagaccgaggagctgtgcgaacaggccgtgcagagctggaagttcgtctggggcaaggtcggtgccgaccgtccgctcaccatcagtcggctgtggagcagcaacgaggtcggcaacgtcgtcgaccacccccacctggtggtcgccacggacgcgaaactggagcggtgcctgggcaccgaccagtacgcgtggttgcgcgagcccgcgctcgtgatcgtggacgaggcgcacaccgccatatccaagcggtacacggagatcctcggcctgttgggcctgacccagtacgagacgagtcggcacctgctcggtctgaccgccaccccgttccgcaacaccaacgaggacgagacccgccggctgatcggtcgcttcggcaaccgcaggctcgacgagggcgtgttcccctccggcgacccgtaccgcgatctccaggagtggggcatgctcgcccaggtcgagcaccgcaccctggagggtggccggatcgagctgaaccaggacgagaagacccacgccgaacgcatggcgatgctctcccgtgccgccgagcaacgactcgccgacgaccacgcgcgaagcctgcgcatcgtcgactcggtggccgctcttccggcggactggccgacgctgctcttcgccacctccgtcgaccacgccaagtacctggcggccatgctcaacgaccgtggtgtccggtccgcggccgtggactcgacgaccagcgcgcaggaccgtaggacacggatcgagaacttcaggaacggccgcatccgtgtgctcaccaactacggtgttctgacccaagggttcgacgcgcccgccacgcgggccgtggtcgtggcacgaccagtctacagcaccaacgtgtaccagcagatgatcgggcgcggcctgcgcggccccaagaacggtggcaaggacacctgcctgatcctcaacgtcgacgacaacatcgccaacttcgacaccaagctggccttcacccagttcgagcacctctggagccgtgcgtgaccgacgtctacctcgacagccccccgctcaccgccgagcagcgggccgtcgtcgagcagccctgggacgcgcgggtcctggtcaccgcgggggccggtgcgggaaagacgcacacgctcgtgcgtcgactcgacgcgctgtgcggtcacgaggacccggaggaggcactggaggccaccgacatccttgtactcacgttctcccgggcggccgcgcgcgagttgcgtgagcgcatcacccggcacggggacagggcccgccgggtgcgcgcccagaccttcgacgcctgggcgtacggggtactcgtccaggcgtacccggaccgggactggtccacgacctccttcgacgagcggatcaaggccgcgacggaggccgtcgaggagggcgtgctggaggccggcgactcggtcccgccggcccatgtggtgatcgacgaggtacaggatctgctgggcgatcgccgggaactggtggagtccctgctcgaccgctaccaggacagctgcggcttcacggtggtcggtgacgccgcccagtccgtgtacggcttccagatcgaggaccccgccgaacgcaacgacgagaccggccgcttcttcgagtggttgcgccgctcgtaccccgacgacctggtggaactgcacctcaccgagaacttccgtgccgtcaccccggaggcacgggtcgcgctgtcgcacgggccccggctccagcaggtccgggacgcggaggaggccgccgcgctctacgaggaactgcgcgacctgctcctggacccggcgaactcgctcggcgacctcaccggcgagtacacgttgcagggtctgcgggacctcgacgacacctgcgccatcctcacccgcgacaaccggcaggccctggtggtctcccggctgctccacgagaacggcatcgggcaccggctgcgccgtcccctcgaagagcggccgatcccctactgggtggccgagctgctgcgtcgtaccgaggcgaccggcctgcccgaggaccggttccgctccctgctggaacagatcccactgccccacgaaccgaagacgggcgccctgtggacggtactgcgacgcgccacccgctcccccgggcgcaccgcgctcgatctggaccggctgcgccgcctggtcgccgacggacggttccctgacgaggcggccgacccggagagcgcgcggatcatcgtctccaccgtgcaccgggccaaggggctggaattcgatcgggtgatcgtcctcactcctccgagcatcgccgaactccgcaagcagtacgggaccgagacggacctccccgcggaggcccgcgccctgtacgtggcgatgacccgtgctcggcaggacctctaccacgtccgctctcccgagttgccgatcgtcaagagggcggggaaccgcaagtccggtcggcggtacgtcggcggatggcggtcgtgggagaggttcggcgtggtggccgaggccggcgacgtgtgccgggacaacccgcccggtcacgcgaccgacgccgtggcgacccagacgtacctcctgcgagaggtcggcgccggtcaggaggtactgctgcgcaagcgtcacgatctgccgtcgggcgaggctcagagcccgccgtacgccctgctgcaccgaggacgggagataggcgaggcgtcggagcggttccgacaggagctgttccgggtgcagaaggtgaaccggacgtgggaaccgtggtggcccgacgagatccatggtctgcggatcgacaccttggagacggtgacgggcagcgtcgccgccggcgccaacgccggcctcggcgaccggggtgtgtggatcgcgccgcggatcaccggtatcggcatgtttcgacgggctgacgacgtagaggagcaggacgcatgacgcacgtggcaggtcggcactccgagcactatcgagtgcgcgacgaggagcttctccttgggctgcgcagggaactcttcggcccgacagaggattccgagccgcaggaccgggccgaggtgctccctcaggacgccccgatcgaccggtacctgaccggtgtgctgtatccccgcgcctcgcgcgagcggaggatcgagaacgccgccgaacaggacggcccggacgccgcgcccgtactcgcacgggaggacgccgaggagtccggcgccgcgcaggaaaccggtgtctcgggcgacaagcgcccgtcctccatgggcctgaccttcgcgatcgacccggccataagcgacgcgatcgtggtctcggcgcgtgcggcggtctacgagcccaccgacgcggacggcaacccggtctcggcccgccgtgccgaggcccggaccgtcgcggagcagcgggagcggtggcggcgcagggaactggggctccccgaccagcgcatcgacgtgacccgtccctcctcgggcgagctgatcgaactcgttcctgagaaggtcgccctgcacgtcatcgtccgcagcgcttccccgatcaccggagcggtcaccgtcacggtgacgctgatcaacagggagaaggtcggcgagcgggacctccaggatgctttcgccctgttccagtgcggcctgacggtccgagccgcgaacggctccagcgcgttcgtcgagcgccccgccccggccgccgctcacgacccggagatcgccaccagtcgactgctgcaccgccacgccccgaccttcgccatcgggcacggctgcgccgccgcctgggactggatcccgtcgccgatcggcgtgaccgacagcgtcccggctgccgtccccgaggtgcgcagcgagttcgtgcccagcgtggaggtgctgctgaccgactccaacccggagatcgacagctcgtcgctgtcgatgctgggactggccgagaagtccgacgccgagatcctggccgccctggaggcgctcgccacggggtacgaggactggatcgaccggaagtcggccgaggcggacgctctggcgggcggtcctcacgagcagcccgcgcgagaccaggtggacgcctgccgggaggcgctcggccggatccgcgagggcatccggctgctgcgcggcaagcccgacctgatgcgggcgttccggctcgccaaccgtgccatggccgaccagcgcgcccgcagcgcctgggtgaagggcgggcgcgtgggcgaccccgacccgtccgccgggcgttggcggcccttccagatcgccttcgtgctgctctgcgtcgccggcatcgacgaccccgagcacgacgaccggaagatctccgacctcctgtggttccccaccggtggtggcaagacggaggcctacctcgggctgatcgccctgacgtccttcctgcgccgcatccgcaagggcccgaacggcggcggggtcaccgtcctcatgcgctacacgctccggctgctcaccctgcagcagttcgaacgtgcggcgatcctgctctgtgccatggagaacatgcggcgccacacgcccgagctgggcgacgagccgttctccgtcggcatgtgggtggggcgctcggccacccccaacacgctgcccgaggccgccggcaggctggacgagctgcgcgcgaacccggacaagcgactcgccaccgagaaccccgtccagttgcacgcatgtccctggtgcgcgacccggctcgacgcccgggactacgaggtcgacgaggacgccaagcggatgtacatccgctgtcccggtacggactgtgacttcgccgacggtctccccgtccacctgatcgacgaggcggtgtacgacgcgcgcccgacgctggtgatcgccactgtcgacaagttcgcctccatgccgtggcgcccggcgacctccgcgctcttcaacctgaacgaccccgccgacgacactcccgcaccggagctgatcgtccaggacgaactccacctgatctcgggcccgctgggtaccctcaccggtctctacgagaccgccgtggacgcactggccgaccggcccaaggtgatcgcctccaccgcgaccatccgtcgtgccgccgaccagggccgtcacctcttcgcccgcgaggtgcgacagttcccgcctgcgggcctggacgcacgcgactcgtggttcgccgtggagaccccacgcgcggagaaggcgagccgccgctacgtgggcctcctggctcccggcaccagccagtccacgctgttgatccgcacgtacgccacgttgctgcaccgggccatgcacgcggacaccgacgacaaggtgcgtgacgcctactggagcctcgtcggctacttcaacagcctgcggttgctctccgccgccgaactccaggtccacgacgacgtagtggcgtacctggaactgctcgccgaacgcgagggcgtggccgcgcgctcggtggccaattactcggagctgaccagccggatcgacgcgagcgagatccccacacgcctcaagggaatcgagaagaggcttcccgacgaggacaccgtggacgtcctgctcgccaccaacatgatcgcggtgggcgtggacgtggaccggctcgggttgatggccgtgatgggccagccccagacgacggccgagtacatccaggccacgagccgcgtcggccgcgcccaccccggcctggtcgcggtcatgctcaacgccgctcgcgcccgcgatcgttcgcactacgagaacttccagcactatcactcggctctttaccgtgaggtcgagtccacctccgtgaccccgttctccgctcgcgcgcgcgaccggggcctgcacgcggtgatcgtcgctctcgcccgcatcctgatcccagccgcacgcccgaacgagggcgccggcgatgtcgagtcctacgaggatgtcttgcggggccgcatcaggaccctgctccttgaccgcgtcc

SEQ ID NO: 310 - DNA, 10175 bp, Unknown
  Kingdom: Bacteria, Phylum: Actinobacteria, Class: Actinobacteria, Order: Streptomycetales, Family: Streptomycetaceae, Genus: Streptomyces
ggcggtgccgggggtggcgaggtcggacggggccgtcatcgagttgtccttctgctggtgggacgcgcggggaccgtggctgctcaacagcccggacagcgctcgcccacggcgcgggccaggtcacgccgtcgcggcgcggacggggaggtgacgaccgggccggggagcgccgtcccgcggcgttcccgcccgaggagaaggagttcccgaggcatacggtcaggctgacgataggtggcgggtgcagtcaagtgggtcctggcacatgggacatgcctcacggtcgcgcacggccccctcacaccgcctccccgagagccgcgatgacgtcggccgtgcgcggctgcccggtggcgcgccgcacgacgcgtccgtccgcgtcgaggaccagcacggtcggagtcctgcggacgtccagttcgcggacgagttccaggcggtcctcggcgtcgatctcgacgtgggcgacgcccgggaccatccgggccacctcgccgagaaccctgcgggtcgcccggcagggcgcgcagaaggcggtggagaactgcaccagcgtggctcgttcgcccagcccctgccccaactcggcggcgcccagccgcctgtccgcgtcgcgtccgcgcacccgtgccctcccgttccgccgcgccggccgttccggcgcgtcactgcttcggccgccgccgccgccgtagcgccgaccgacgcaccaccgcctcgtgcccagccgtcgtaccgccgtctcgtacccgccggtgtaccgccgtctcgttcgcggccgtcgtacggcctcgctccgcttcagcgcgcgcgggcccgtggagattcccggtcgccctcgggggcggcccggacggccgatcgacgtgacgaggatctcgccggggacgggcacgtgggctggctccccggccgttcttggggcacgatctgcgacatgccgtaaaacctacggctgcgtaacttccgccgggagtcccccttccctggcagacagaagggtccgccccgcccatggccgagcttgtctaccgtcccgtcatcggtttcgcccgcaccatgttcaaggtgtgggacctcaagatcgactgccggggttcggagaacgtaccgcgccagggcggcgccgtgctggtgagcaatcacatcagctatctggacttcatcttcaacggcctggcggccctgccgcagaagcgcctggtgcgtttcatggcgaaggagtccgtgttccggcaccggatctcgggcccgctgatgcgcggcatgaagcacatcccggtggaccgcgcccagggcgaggcggcctacgcgcacgcgctggacgcgctgcgctccggagaggtgatcggggtcttcccggaggccaccatctcggagtcgttcaccctcaagagcttcaagtcgggtgccgcccggctggcccaggaggcgggggtgccgctgatcccgatggccgtgtggggcacgcagcggctgtggaccaagggccacccgcgcaacttcaagcgcagccacacgccggtcacggtccgcgtgggcgaggcggtcgaggcacctcgcgaccagtacgcgggcgcgatcacccgccggctgcgcgagcgcgtccaggagctgctggaggcggcccagcgcgcctacccggtgcgtccgaggggtccggaggacacctggtggatgcccgcccacctgggcggcacggcgcccactcccgagcagttgcggatggccgccgcgcactgacgtgtgatcactggcccactccgtgccccgtcaactaatctgacggtccgccggtcaccggcggcatccggtgcgcggccgccgtcccgacggcgcgcgtgaggggaggggggttctcgatggcgtcactcgttgtcatgttcgggctgttcggcggcgtcgccgcatggctggtcatggtgctcctgcgccgccggagcggcgccacgcagaacgccgaagggctcctcatcgagcaggccagccgcgtccaggcgcagcgggaccgctcttcctacagcgccttgtcgatgcacaacaccacgccgaccatgagcgaccagtaccgccgcccctgaacgaccagtaccgccgcgaggctcagcgcgcgggctgcgggtcgcgcacggtgatccgggcgcccgggctgaacttctgaaggagctcggcgagttcgtccgccgcccggatgacgtcggcgaccggcatcggggccatgctctccagcaggaagacgccggaggtggtgtcttcggtgagtcgggtgcgcgggccctggcgccagttccagcggcggcaggtgacgccggcctcgtcgcaccacaccacttcaccggcgtcggggtgttcgacgacctcctcgccgcccgccacggtcacgaactcctcctcgccgccggcccgcaccagcctcatgccgccctggatccggtcgaggtcctcgcctcctacggggatcaggtgggcgacgctgagggcgttgtagaggtcgacgaggacgttgatgcggggcaggccggtctcggacagggcgcgcttggccagtgcctcggcggagttccgggtgcgggacggcttggagccgaacgccgtgtaggtctcgcgccaggcggccatgtgcgggtcctcgtgcggggcgcgcccgtccaggcgcacggccaggcgccgggccgcgtcgtccagcagcgccgaactggcctccgtgctggggccgttgaccaggtcgtacgcctccacggccacgtgggtgaagccgggcgcgagcgcgcgcacctcgtcggacacggtgagtgtgagcgtcatcgtctctccgtctgacacgtcagagttcggtggggagcgccttggacagcgccgtccggtcggcggcggccttcagcgcgcccaggacggccggatgcggttcagcgtacagtaccgggtagtccatctcattcgactggaggtccggtacgaaggccagccgctcgcccgtgagggagaactgcgcgtcgacaccgggtttgttgccgcgcgggtcctgccggtgccaggcaccgttgaaccgcacggcgaccagcccgtgcagggcgtagccgtcaccgccgtcgtcccaggcgagcctctggtagcagagcgcggtggggatgtcttcggcgcgcagcagggcggcgagggcgtgggccttggcatgacagataccggtgcggccgcgcaggacgtcggaggcccgccaggtgacgcgcggatcgccggagtcctgcgaatggggaatggtgtcgcgtacgaactcgtaggcggaccgcgcataggcatacgagtcggcgaccccctcggtgaggcgggcggcggtttcgcggaccaccgggtgctcgtggtcgatcgcctcgtcggcggccagataggcggacaggtcaggggtgtactggatcagctccatggccgcagagcataggaatgcgatcacccggtcgtcaatgattttccaggtgatcgcataactatgcattcgatggcgccgggaccgcctggccccgggcccttactgccgcgccatctcctccttcagcgccgccacgaacgcgtccacgtcgtcctccgtggtgtcgtacgagcacatccagcgcacgacccccgcgctctcgtcccagaagtagaagcggaaccgctgctgcaggcgctcgctcaccccgtgcggcagcttggcgaagacaccgttggcctggaccgggtagcagatctccacgccgtggacggcccgcacgccctcggccagccgctgggccatctcgttggcgtgccgggcgttgcgcagccacaggtccttggcgagcagcgcctccagctggaccgagacgaagcgcatcttggaggcgagctgcatgctcatcttgcgtatgtgcttcatccggcgcacggcgtcctggttgaggacgacgacggcctcgccgaacatggcgccgttcttcgtcccgcccagggagaggatgtcgacgccgaccgcgttggtgaaggtccgcatggggacgtccagcgaggcggcggcgttggccatccgggagccgtccaggtgcaccctcatgccgtgggcgtgggcgtgctcgcagatcgcgcggatctcctcgggcgtgtagagcgtgcccagctccgtgctctgggtgatcgagacgacctgcggcatcgcacggtgctcgtcctcgaagccgaacgcctgccggtcgatcagctcgggggtgagcttgccgtccggggtgggcaccgtgtgcagcttcaggccgcccatgcgctcgggggcgccgccctcgtcgacgttgatgtgcgcgctctcggcgcagatcaccgcgccccagcggtcggtgacggcctgcagcgcgacgacgttggcgccggtgccgttgaacaccgggaacgcctcggcgctcgcgccgaagtggctgcgcacgatccgctggaggtggtcggtgtactcgtcctcgccgtaggagacctggtgcccgccgttggccagggccagggcggcgagcacctcagggtggacaccggcgtagttgtcgctggcgaagccgcggacctgagggtcgtgatggcggcgcgcgtcggtcttggcagggttcacggctgctcggtcagccacagacgttttccgttcacttccgcggcgggcttgctccagacgccctcgatggcctcggcgaggtccttgacgtccgtgaatcccgcgaacttcgcgttggggcgctcggcgcgcatcgcgtcgtgcaccaacgccttcaccaccaggatcgcagccgccgacgtcgggccctcggcgccctcggccttcccggccttgcggaagtagtccgccatggccagcgtccatgcctcggcggcggccttggccgcggagtaggcggcgttcccggcggtgggcttgctggcgcccgaggcgctgatcagcaggtaccggccgcggtcgctgcgctgcagcgcctcgtggaaggccagggaggtgtgctgcacggtcttgaccagcagcagctccaggaagtcccagtcgtccaggctggtcttggtgaacgtctcgctgccgcgccagccgcccacgaggtggaccaggccgtcgacgcggccgaagtccttctcgacgtgcgcggcccagtcccgggtggacttgaggtcgagcaggtcgacggtgtccccggtgacgctggcgccacccgaggcgtagcgggccgcgtcgacggcctcggagagccgctgcggatcgttgtccgcgccgacgacggtcgcgcccgcctcggcgagcctgagcagtgtcgcccggccggcgggtccgcccgcgccggccaccgcgatcaccgcaccgctgagtgccccgttccccgccatgttcttcgcctccgtagcagcagtgttctggacgcggtcgctcacgcggcgacctgctcggcgctgtcggccgtgatgccccgggtcgaggcgatcacgttcttcagcttcttggacagtgcctcgtagaacatgctgagcggaaactcgtccggaagcacgtcatcgacgagcttgcgcggcggctgggtcaggtccagggcgtcggggcccttggcccaccgggagcccgggtgcggggcgaggtaggtggcgaccagctcgtacccggcgaaccagtgcaccagtttcgggcggtcgatgccgtcgcggtacagcttctcgatctcggcgcagagctggttggtgacctgcggggcgcgctcccagtcgatggagagcttgttgtcggtccagcgcaccacgtcgtgcttgtgcaggtaggcgaagagcagctggccgccgaggccgtcgtagttgcgtacgcgctcgccggtgaccgggaagcggaacatgcggtcgaagaggaccgcgtactgcacgtcgcgggcctgcgggacgccgtccgcctccagcttcacggcctccttgaaggcggtgaggtcgcagcgcagctcctccaggccgtacatccagaacggctggcgctgcttgatcatgaaggggtcgaacggcaggtcgccgtggctgtgggtgcggtcgtggaccatgtcccacaggacgaaggcctcctcgcagcgcttctggtcgtcgaccatggcggcgatgtcgtcgggcagcttcaggcccagcaggccgacggcggcggcggtcacccggcggaagcgggcggcctcgcggtcgcagaagatgccgccccaggagaaccgttccggcgcctcgcggacggcgatggtctcggggaagagcacggcggagttggtgtcgtagccggccgtgaagtcctcgaaggtgatgccgcagaagagcgggttgtcgtagcgggtgcgctccagctcggccagccagtccggccagaccatgcgcagcacgaccgcctccaggttgcggtccgggttgccgttctgcgtgtacatcgggaagacgaccaggtgctggaggccgtccgcacggtgcgcggcgggctggaaggcgagcagcgagtcgaggaagtccggcacctggaagccgtcgtcggcccagcggcgcaggtccgccacgagcgcctggtggtacgcggcgtcgtgcggcagcagcggggacagctcctgcacggcgccggtcacgcggcgcacggcggcgtcggcgtcctcacgggcgggcgcgccctcggccgcgaagtcgatcgagccgtccttcgactgccatggccggatctgctccacggcatccttgagcacgggccacgccgggtgctcgaccaccctgctcgccggaggaacctgcccctccgcacccacctgcacaagaatttccgtcatgacccatcctccacgggagaagctcgcgtaagaagaccgtatacatatgagctttcttccagcaagggcgccctcgggaaattatcctgtcgtcgctcaccttcaccggtcattttcctgtccatcacccgtacggggctacttcccctagaccattcgagtgagggcaatcccttgatccccggggcgatttctggcctcggcggcgcggtcggcacggcgtccggccgcttccgtcaacgcccagcggactcgcccacgcgggagtgaccgcccgggccggtgcggccccgccgtcgcccggccgtcaccccactgccccgtgtacggacgggtccatcgcgactgcggaacgttaggctgcggccgtgccgcgtggacgacgaggtccctgaggtccgcgggcgagcctagccgccgtcgacggaagcgagttgaaccttgaacttccttaccatcggtcaccgcggagtcatgggtgtcgagcccgagaacaccctccgttcgttcgtcgccgcccagcaggccggcctcgacgccatcgaactcgatctgcacctgagcaaggacggcgcgctcgtcgtcatgcacgacgccgcggtggaccgcacgaccgacggcagcggccccatcgcggacaagaccctcgcggaactgcgcgcgctcgacgcgggcctcggtgagcggatcccggtcttcgaggaggtgctcgacgccgtacggacgccgctgcaggccgagatcaaggacatggcggcggccaaggcactcgccgaggtgatgcgccgccgtgacctcgtcgcacgtgtcgaggtgctgtccttccacgacgaggcgatcgccgagatcgcccgcctggtccccggggtgcgcaccgcgctggtcgccgagcgctacggcacggaggtcgtcgagcgcgccaccgcggccggcgccggcaccctcgtgctcgacatccgcaggctcaccctggagatcgtcgagcacgcgcgcgcggcggagctgcggatcatcggctgggtggtgaacaccctggaccacctgcgtctggtccgcgcgctggagctggacggcgccaccaccgactacccggagatcaaacgcaccggccgcttcaccgcgtagcaggcgtgcgcgtcgcgcgcacccctgggcgagcggcttgaccagcagctaggcgagcggcttgaccagcagctcgaactccaggtcgtcgcgctgcgggatgccgaagcgctcgtcgccgtacgggaaggggctcgtcctacccgtacggcggtagccgcgccgctcgtaccaggcgatcaggtcctcgcgcacggagatcacggtcatctgcatctccgtgacgccccagctcgtgcgggcctgccgctccgcctcggcgatgatcaccttgccgagaccggcgccctgcagggcgggattgaccgcgaacatgccgaagtaggcgtggtcgccgcggtgctcgagctggcagcaggcgaccacgcggccctcccgctcgaccatcagcagcctgctgtcgggagacttgatcacggccagcacgccctcggggtcggtgcgccgcccgtgcaggatgtccgcctcggtggtccacccggcccggctggcgtcgccgcggtacgccgactcgatcagctccaccaggacgtcgacgtcggcatcggtggcatcgcggaagaccggtgcggtggcggcggtgtccatggagtaagcctctctcgggtgtctcgggcgcggcgggcagcaacgagagtaacccccgccgggcaggccctaagctgccccgcatggtgcacgtactcagcagccggacgctgatccggcccacggaccccgagcgctcccgtgacttctacggccggcggctgcggctgcccgtccaccgcgagttcggcacgggccccgagcgcggcaccgtctacttcctcggcggcggcttcctggagctgtcgggccgctccgatacgccgcactccgccgaggtccggctgtggctccaggtcgaggacctggccgcggcgcacgccgagctgcgggccgcgggcgtcgagatcgtacgcccgccggtacgggaaccctgggggctgatcgagatgtggatcgccgatccggacggcgtcccgatcgtgctcgtcgaggtccccgcggagcacccgctgcgctaccgcccgggcatctgaaccgctcccgggcgtacgaaccccgctggccaccgtcggtgaccggggatagcgttcaagcggtgggggcgagccttcccggaggagtgccatggagttcgacaagccggtgatcggcggcccctgctgggcggagctggggaccagcgatctggaggcggccaaacggttctacggggaggtgttcggctggcactgcgacgagccggactcccggccggagctgcgcggctacaccgtcgtgcggcttggcgacgcggcggtcgccgggctcggcccgctgtaccggcccacccagccggtcgcctggaacgtctcgttcgccgtcgccaacgccgacacggccacgaaccgggtggtggaggccggcgggacggtgatccgcggtcccatggacatcttcgacgaaggccgccggacggtggcgctcgatccgtccggggcggcgttccagatctggcaggccaaggagttcgccggcgccggcgtgttcaaccggcccggatcactgggctgggtggagctggcgacccgggacgtcaagcgggcccgggacttctacaccaccgtgttcggctggagcgtcaacgcctccgagtggtacacgcagtggggcatgcacggcatggacttcggcggcgtcaccgcgctgcacgagcgtttcccggccgatgtgccgccgcactggctgccgtacttcgcggtcgaggacgtcgacgggaccgccgaggtggcggcccaggccggggccagaacgctccaggagcccgtctccgtcgcgcacgggccccgcatcgcggtactgcgcgacccccagggcgcggccttcggcgtctaccagcccggcccggaggactgacgggcgggggcgcgggacacgggcagggaggacttcggccggggcgcgggaaggccgggcggcagcggcgccggtcagatccggggggcgccggggcggccctccaggcgggtgagcagctcgcccagcagcgcggccagctcgccgcgcccgtccctgtccagaccggccagtacggccctctcgtaggcgagctggtccggcagcaggccgtcgacgaggtcccggcccgcagccgtcaggcgcagatgggcgacgcggcggtcacgggtgtcgccgcgccgctccaccaggccgcgttcggtgagctgtttgagccgcttggtgacggcc

SEQ ID NO: 311 - DNA, 4987 bp, Unknown
  Kingdom: Bacteria, Phylum: Actinobacteria, Class: Actinobacteria, Order: Streptomycetales, Family: Streptomycetaceae, Genus: Streptomyces
  misc_feature (311)..(312): n is a, c, g, or t
tcacgacctcgagaccctcaagctcgaggttgaccctgatcagctgccggatgaccttgttgtcgtccacaacaagcacccggccggaagcccctggcacaactcgagagtaggtcggccccggccaccgcgtccgggttttccccacttccgccccgtccgggggacgcaccggttccacatggacacgcggaggggccgcacccccacggaaaacgttcatgaccacccgctgggagctggtagtgttctacccgtcgccgcgcacagagcgcgacgaacccgcccccgtagctcaggggatagagcanncgaatcctgccgggggcacccaccatgaggtgcccaaagaccccgtcaccagcggaaacgctgaggccggggtcttcgcgtatgtgcagccgtatgcggcccggagcgggcgtatgccggggtctgtggactattcgtggacaggaactgagcgcgtctgcccaggtcacagtggctaatttgaagcagacgcaggccggcgtgccggtcccgctccagatccgcggcgccgaatacgctgcggctgactgccacaccggggcgactcttcacgtcgatccggagggcacagccgccgcatgcaggaaggggtgtggcatgaggtctccaggcgtacacctacgcgagatcaccgacgacaaccgggatgccgttcgtgccctccgtgtccgacgcgaccagaagcggttcgtcgcctccgtgtccaagtcgctcaagcaggcagcacagcacccggaggccaacccctggtaccgcggcgtgtacatcggcgacgagccagtcggcttcgtgatgctgtcgtggaagccgccggctggtccctacagaggacggcacttcatctggcgcctcctcatcgacaagcggcaccagaggcgagggatcggccgagagaccctcacgcaaattgccgctctcgttcgcgcggacggcgccaccgagctactgaccagctacgatcccggcgacggcgaaccgtggcccttctaccagaagttcggattcgagcccaccggtgagatcgacgacggcgagatcgttctgaggctcaccttccccgttcagtaagctcgcatgggaaaccgaagacagttcccggtagtcacctgactaagaatttgcggccgacgcccttcggccgggagacgacgaagcccccggcccacactcggaccaggggctaatggctatgtgcctcgtcactcgtattcgcgcagcaactcttcgatcttgcggttggcgatttcctgccgtccatcaatgcacttggcgtagcggctcagcagcacctcaacactgttgcccgcacgttcagccacttcggtcgggtccaccccggagttgagccacgtcgacagcgccgagtgtcggaggtcgtacggccgcgcagcgagcggcgaggcgacggcagccggctggagcccgagcgcccgagcctcctgccacacgcggtagtacgtggacgagccgaccactcccccgcgttcgttggtgaacagccgcccgtcctcggcagtcccgaacgcatcgatgtgctgccggaggatagagacgagctggggcgggatcggtacgagccggacctcctccgccggccggttcttcaggccacggtcatcgtgggtctcgccggagtcggtccactgcttgccgacactgggacgcgtccggttcagcagtgccgtcccccagccggcctcaggcagcttcaggtccgcattcgtaaggccgacggcctcagccggacgcagggcgccgtagtacatgcaggcgaacaggccaacgagtcgacggccacgcgcccgggcatacccaccgacgtacgagaccgcagtcagcagggaccgagcctgctcgggattggcgaccacccgaggatcaacttccccagcaaccttcggcttcttccatcgaatgcccgtgatcgggttctctttgaactccccgaggtctactgcatagtgcagcgcgttgacgagtgttcgccgcttgcgccgaacggtctccgcggctgccgcagtcccgtcgagcttcagcttgagggagtccaggactgcccggccgatcgcagcatcaccgaggtccgatagcgggcgcgaggccttagccacccagtggagagtgttcgcgatctcgccgggcagttcgcgatcgtttgggccggggaggacgaaggcccagttacgaagcgccttcctgatcagttcctccggcggctggcccgggcgatcatcgagaagagccatcgtcactgcagtcagcgcctcatcgatcccgttacgcgtgttgggagccgcatgcggccacttcatagcgagatacttcagagcaaaggcataccagctcagggaggctgtcttttcggccatcgagtctggcagccctgtggccgtgtcgaactcttcgcccccatgagcggcacggagaagcttcgaacggtagtggtccgcgaggcccttggtacggaactgttcggaaaacacgcttccggccacagtccatcggacatcgaaggacgatttcttagtgttcctcttccgaacgccccagaccttgacgtcaagagacttcacgctgcctcctccagctgccggagccacgaggcgaagtcactacgccatacccgaagctcgccgttggggagcttgaacgcggccggcccctgtcccagctcgcgccagcggtaaaacgtccgtcgagaaacgccgcccagctcggccaggacttggcgaacagtcatcaattcgtcgcggcgggcgtccatgtcggttctccttccgttccgggggcggcttcgagggatgcggcaagccaggcttcggtgtctgacaggccggttccggcgaagacccagtgggcgaggacgtacgtcgtgtcaatctccgggccgtttgctgctgccgcctgtgctcggcgccattcggcgcgggcgtcgcggagggcaccgagggtggtggagtagcggcgggatttggtggagaagtggccgcggaagccgagcatgtgggcccaggcgcgtaggcggaggtgttcgaggtccttgcgtgcgccgagggcccaggcggtgcggatgaggcggcgggcgtggtcgctgatgtcgagctgggcgagttcggcgacgaacttcagcgggcggtcgagggcgcccgtcgcggtttcggcccccttggtggcgtacttggcgatgtacgccgctacagcgcgctcggtcagcgcctggccgtcgttgaagtcggcggagcggatcgtgcggacgtcgagttggcggccgaaggtgaaggtgtggggtcggccgtcgatcaccggaccgtcgacgcgaaccttggtagcagcggccttgatggcgtcggtgagtagttcggcggtggcccaggcagggggcggtgtctctccgccgctgtggccgtcgatgcgaatcacggcatggaagtggaccgcgccgcgcttctggtactcggcgaccttggcgaaggagacgcgggcgtgttcgcggaaccggcgctgggacaggccggcgcgcttggcgacctcccggcgcaggtaggtggaaaagcgccgccagagcggtccggcgtgggcgttccagaggactgccgcgtcgtagtcgtaggtgtccgagtcgagcggggtgccgagtgtgtcgtcgtcctggtcgtggcgggtgccgcagcggcagggccggacggtgccggccggaccggtgggccggttgtggaccgggccgaagctgggggcggtgaaggtggcgaagacgcgcgggtgcgcggcgacgtgttcgggggtgcccttgccgccgcgcagtccggcggtgatgaggtggaaggtgtcgcggcggtagacctctgcgcaggccgggcagcgggtggtgcggcggttgttgcagcggacgaggagttggccggccgggaggttcgccgagtcgatgtggtggacgacggggccgatctcgccggtggtggtgtcgatgtcgtactcggtgcggtagccgtcgaggcggatcgggtgggtgcagccgccgaggccggagagttggcggaggataccgggcagggtgccgtccgaggccaggttcgcgagttcccgaagcggtggcggggtggtgcgggtgaagatggcggttcccttctgactgggctcggtcaggagtgatggaccccggggcggcggatgcttggccgtgtcgcgccgccccggcggtcgggtgatgtcagcgccggtgctgttcgcggaagagggagcgcaggaccacggcggcgatggccacggagatggccgagacggcgacggcggccaggagcgcggtaaggaccacgccgccggtgatgacggctgctatcgctccggtgctgatggagaccggcgggagtgtgcgctggaccggagccggatcggccgggacgtgggtgtgcgcgggcggcggggtggggttgtccgggtactagggcaggaacacggtcagagtctcctcatctactcgtctaggcatgtgagccgtttatgacggtcatgccggtgcgcgtgccggattcgatggcgggggcgaagaaggtgtgggagagccagaagccgaagagggcgatcaggatgacgatccaggggcggacgccgaggaatttgatcgctccccagacgaagaagccgaggacgacgacgagcggcaggctgacggtcacggtgtccggggtcctttcatttcacggggcagcggtgggtgcgggcggcgagttcggcggcggcgcggctgtcgtagtcggcggagaagccgcagcgcggggcggtgcaggcggcggtgtgcttctcgcggccgcggttgtcgtaggcggtgccgatctggacgggtccgatgcgggtgacgtcgcggaagcggcggttggcggtcacgcggtgtcctttcagaggtgggcggcgatggcttcggccatgggggcggggacgccgaggcgggtgcggaggg

SEQ ID NO: 312 - DNA, 11232 bp, Unknown
  Kingdom: Bacteria, Phylum: Actinobacteria, Class: Actinobacteria, Order: Streptomycetales, Family: Streptomycetaceae, Genus: Streptomyces
gccctgcccgagttcgacgccctcgccgacgcgtacgcccgcatcgccggacccaccggcgagcaggcccgagcctgccgcgcccaggcagcccggtgccgcgcggaactcggccaggtcaccgacgcgctcgccgcgctccagagcgtgctgaacgtcgtgcgggccgtcgacagcgacgtgagcgaggaagccgtggaactgcggcacaacatcgggatgctgctgctcgcccagggccgggccggcgaggcccggcaggtcctcgaaccgctccaccaggacatgtgcatggtgttcggacccgacgacgagatgaccgccgagatcgccgaggcactcgccgtgatccgcctcggcctcgacggttcggcttcctgacccgccttctccagaagcggcaccggccagaaccatgctgctcgcgacgggttcgaagccgcaccggaccagtaacacaactcctggcgcacctcattcgccatgatgagcggtgcgcaccacttcaccgaaaggaccagccgtgtcggatgtcgcacgagacgacaaccaggatgacgacctcgcggaggacgaatgggactgggaggaagaagacgaggaaggggacgaggacgcgcaacgcgtccgggacgcggcgaaactggctgacagggatcctgcccgcggaatccccgcgcttctggccttgatcgccgacaccgacctcggcaccgtggacaacctcgaataccgcgcagaagcacttgaccatctgctcagcagaggcggaagcgcagcgaccgcggcatggtgggtgatcaatacctcgaacccctggcgtgagatgcagcgggtttacgtggagtcgaaccagtgcacagctcctgcacagcggaagccgaccgaggacgaacgtcggcaggaacacgtcgccgctctacggcaccttgtcgcgtcctcagacctgcaggacgacctccgctggccggccatcggtgagctgatcaacgaggaggggcgagaagggtacgaggccgtcaagagcctcgctcctgacatcgacatcgcgaacctcgccaccggaaccgacgaggcggacgatgaacacgcctacggcatcgcccgctgggtcgcagccgaccaggatcagccggccgaggtgcgtgtggaagcggcagcgtggctcctcgatgaggacgcatggtccgctgacgacgcggttgcggacgcgctacgagacgtgcccgtcggcacgtacggacgcaggaagttgctcgccaggctgctggagatggagaacgcacacctggaagtgaccgacccatccgctttcgagtggcagcaggagaaggagcgcgccgacaaggttcctggtgtcgtccggcttgccgtgcaggaagcgggacgcaatcaccatgtcgggccgctggacggcctgcttcagtcctgggtcgatgtcgcgcttcgcgatcagtgggaaggtggttggccgtacgcccgccgggtagcggacgatgctgtcggacaactggtgggcatcgcgttccgccaccaggagcttcgccagcgcctggccgcagacctctccgcggcaggccccgacgcagactggcatccgctgctgatccgcggagtcggtccccggccgaagcaggagagtctcttccgctccacggcagaggatggatacttcgccttcaagacaacgcctgagtgccagttcgccctgtgcaggacggctgcggacactactgaccccattgactgggagctgacggtttttcagggaaatgcggcgtcagccacgagcttctccgggcgcttgctcatccaaggcaagcagacgttcatacacttccccgacgacctgaacacgcacccccattggtccgccgagctcatcgccggcttgtccgccatctcccgagccgggcttccaggataggcgtgcagcccacacggcacgtgagccccgcaggctgccgtccctgactgtctacagatcccactcgtcggccagcagccccaggagccgccgctgccgcttctgcagcagttccggcgaccacttctggtgctgtagcacctggctggtcaggggggaacgtggagacgccgtgcctgccggtgaagtacttggtcttcttctctgcgaagtcgtttccttctcctgctcgaccgggtcgttgtgcgagaccgtgccgcgctgcccgaaccgtacccagtcgctgaagccgttgaccgcctcgaccttgttggccgcagccgtcacccggccgcgcagcggcgcgtccgagagaaactgaagcagctgcaccgtgcggatcacgcgcccgactcgcggaaggcggtgtaggtggcgttcttcttggagccggagcggagccgcttgagcagcagggtggaggagatggggtctgaggaacatccgtgtcagatcttgcgctaagcgttcatcggctctgttgggcggccggcggagtgtcggtcactgccgggtctgaagttgttccacggataacgccctattatctgcagcatcactgagcgcgacctgcgcggacgtcttccgtgcgctgcatgaagcggccctgttatctgcggcaagggggagagggtgcccgcggtcttgctgctgccgaccgggaaggcgctgacggtccgggcgtcggccgacgccttcctcgactcgctcgccaacccgaacaccgtccggaactacgggatcgcggtcgggaagaccgcgcgagcggatcggcgagggccggccgctcgccacggtggcgggcgacgaaatcggcgaggcgctggagctgctgtggggcagctctgcggtgaacacctggaacgcccgccgcggcgcggtgctctcctggaccagttggtgcgccgagcgcggctacgacgggccgacggtgccggcctgggcgaaacggatggcgccgccggcgaggatgcggtagacggtggcgactgaggggcgctggccctggttcttgcctgaggtgatgaccagcttctgggcgatctggggtacaggtacgccgttggtccgcaggctgcgggcgtagtcggccatgtcgtcgtcgacgaccttggggcgcccgcagtgacggccgtgctcgcgggcggacgcctggccctccagggacttctcccggatgtactcgcgctcggactctgccatgccggcgaagaacgcgaacagggcggcgccgtgcccggaggggtcgtagaccccttggagggggccggtgagaagttcgagctggatgtcgtggtggcgcaggtcctcggcgatggccaggagttcggcggcgccgcgccccagacgcttcatctcgtgcaccgcgaagatcacccgttgatgggggacggccttcttgatggtgcgggcgaagtccatcgccttgacgaactcgggccggaccttgacgcgggtgctgatcttctcggagaagaccgggtcgcacccggctcggtgctcgcaacgggcgtaccccactcttgtgggcttcggggacggcggcgtcgatggccgcgccgatcttccaggcgtggccggggccgcggtccgcgggggtgcggacttcgagctcggcgcggagctggaggacgagcatggagcgcggggtgtggtacttcggggcgaccttgccgccgcggatgcggcaggtgcttccggcgggcacctcacaggtggggcggtcgaaactgttcgacgacggcggccggttcggcgagctggggcatgtcgcagaacctatcgcgaggggctttgtgcgaaagctgttctgcgagaggttgtgagaacgaagatcagggataaaccggacatggtccggtgggggtccgcgatctctcagaactactcatttctgcgaatgcaaagcatggccgactccgctgagagtgatggagctgacacggggccgatccgatgttcgatggctccttccgcctggcgttcgggtcgccagaagtgtcagcgggaggtgtccaggccgaccctcgccgtgctgatgacgtcactcaggacgtcgcgggagcggaacaggccgccgatcacccggtcgatacgatcccgttccgcggtgagctcgtcgaccagctctgcggtggcgatctcgctcgggccgccatcggtgtcgcgtatgcagggcagcagttgcgcgatcttcttgctgttcaaccctgctgcgtgctcgtcaccttcgtcaagggcaccaacatgggtccgtacgaggccgcccggcacatccccggcgtgagcgggcacgagctgtcgtacgtcgccaacaaacacttctcgatcgtgctgctgaacgaggcgatcgccgacctggtgaacgcgcacgcacgcctggacatctcgcaggcgtggggcgacgggaccgctatcgcggcggacggcactcacatggacacctatcttgacaacctgctctccgagacgagcgtgcggtacggcaagcctggcgggatcgcataccatcacgtctcggacacctacatcgcgctgttcacccacttcatcccgtgcggggtgtgggaggctgtctacatcatcgagggcctgctgaagaacaccagcgaggtgcagccgaccaccgtgcacgcggatacgcagggccagagcttcccggtctttgcgctcgcccacctgctgggcgtcgacttgatgcccaggatcaggaactggaaggaactgaccttctaccgccccagcaagaccaccgagtacgtgcacatcgacgcgctgttcggcgagccgggcaagagcgtcatcgacttcgacctgatcgagtcccatttccgccacctgatgcgggtggccgtctccgtacgcgagggcaccatctcctcctccacgctgctcaagcggctgcggtcggggtcgcggaagaacgccacctacgccgcctttcgcgaggtcggccgcgtaatccgcaccgtccagctgctgcgctacctctcggacgcgccgctgcgccgacgggtgaccacggcgaccaacaaggtcgagtcgttcaaccggttctcccagtggatcggcttcggcaaccgcggcgtcatcgccgacaacgaccccatcgagcaggagaaggcgatgaagttcaacgcgctgcttacgaacgcggtgagctttcacaacgccctggacatcgcggagatcgtgcggcagctgctggaggagggatgggagatcgacccggaggacctggcccacatctcgccgtacctgaccgagcacatcaaccggttcggcgagtacagcacgcacgaactcggcatccagcccgacgcgtatgacccgaaactcgatgtcgacttcgctccgctgcgtgagcaggacctgactgccgtcggcctcggtcaggccgcttgactgaccgcgagtcttcttgtgtgggcgccgcttctcggggtgcggtgtcaggtgtggggcgatggagcgctgggcggcgaccatgaggccgaaggccagggcgcggccgacgaggtgcgagccgccgcggacagtcttggcggtgacgccagtgaagtctcaaacatcaacccgtaggacgccttccgcctggcaacggcaagcggctagatcaggggcttcctgtcagcttgcctcgacagcggcaggttgaagcggcctcagtgtcccggcgcccctgagggcgcggcggtgatgatggtgtcgaggatcgcgcgcgacgcctgtagatcttcgatggcgtgggtgattcgctcgccttccctgcgcagttgggcgagcaggtctgggcaggtgggcacgaggtgctcgtcgtccgcccggatgcacggcagtacctgggcgatcagagcggtcggaagcccggccgccagcagacagcgaatgcgccgcactgtctcgacgtccgactcgccgtagatgcggtagccgctgggcagcctgtcgggcgccaggagtccttgctgttcgtagtagcgcagcagccgctcatggaccccggtacgccgcaccatctccttcatgcgcatgccgctcgcctcattcctgttccccttgccaacgcgacttgactctgacactgatgtcggagtttagcgtcggtgccatgaccactgatcacgtgcttcccacttctcatctcgacgttctcgtgcaggggcgcggccccgcacttctgctcgcgcacggcgccggcggcggcatcgaggggaacttcggcctcgtcctcgacgacctcgcccaggatcacaccctcgtcggcccgcactacccaggggccggtggctctgccgtggccgtcgaacccctggacctggacgacctcgccgaccgcctggtcgcagccgccgtcgcggccggccaggagtcattcgccgtcctcggggagtctctcggtagcgccgtggccgtccggattgccacacggcaccccgaccgtgtccgggccctcgttctcaccgctggcttcgctgccgctgaccccgtcctggcgctcgcagcccagctgatcaagtccttggctgctgctggtcagtgggaggacgtggcacggctcgcccttctgtcctgcatgtccccggcggacctggcggacctcgaaccggccgccctcgacgaaccagtcgcccggaccctgaccgcgatgccgccgggcatgctggaccacttcgacctggtgtcgcgcgtggacgtccgggccgacctggctaaggtgtccgcccccaccctggtggtggcgccgaccggcgaccgactggtgctgcccgagagctcgtaccgtctggcggccggcatcccgggcgcccggctggtcgaactgcccggggccgcccacgtcctgaacccggcagaccgggcgacctggctccgccacgtacgcgaattcctcgccgcactccccaccacatcggcgtgagcgcaccattcctcacggaccaggccggtccgcccacgacgtcaccggcccggcgccgggccggcctgctggttctcgccaccacgaccttcgtcgttgtcaccacagagctgctgccggtcgggctgctgacgtcgatcagcgacgatctgggagtcgcgcgatcaggggtggggctgttggtcaccgtgtacgccttcaccgtcgggctgacggcagctccgctcacccactggaccagcggctggccgcgcaagcgcctctacatgaccgtgagtgcggtcttcttcctcggcactgtgctctccgcggctgcggagagctacccgatactggcgatcggctggttcctgtgcggaatggcgcacggggtcttctggtggatcgtcgccggatatgcagccgcgctcgccacgcccggccgctcgggccgcacaacagctgtcgtcttcgccggaaactcaacggcccttgttctgggcgttcccctgggcacagtcctcggcggcgtcgtcggatggcagggggccttctgcgccgcggcggccctcggtctgggggcactcgccgccgcccagcgactcttgctcgacataccgggccgctccatcccagcgcagtcgacaggactcggcggcgcgctgcgcctgcccggtctacgacggatggtgacagtaaccgcgttgctcatcctcggacacttcgccgtatacaccttcgtgacccccctcctgcacgacgccgctgccttcagcgaggccgccaccagcatgctcctggccttgtatggactggtcggctttctggggacatggctcggcggtgtcctggtggaccgtcgcccgcacaccgtcctgctcggcaccatcgccctgatggccggctcactggtgctgctcggcgcgagcatccgactgcagccactcgccgtggtagccgtggccctatggggcgtggccttcgccgctctgccggtggcgctgcaatcgagcgttctccgtctgggagccaccgcacccgacgccgcgtcctcctggtacgtctccgcgttcaacctgggcatcggaggaggagccctgaccggcggactgctgagcagctccccggtggcgatgctccagtggatggcactgatccccgtggtaccggccttcgtctttgcctggaccacacgggcagccctctcgcatccacagtcgcggtaaatgccggatttactgcggcagagtccctaccgtgatcatcgcgacctgcggcgaggcattccggccgccggagcgaggtgtacgcatttactgcggcagcaccggaaaggcggagcgggcgtgacgatcgaaccggtgaccgaactcggaggcgggggcgcgttgcgcttgccgcgcgcccgcgtcgtgcccatgtcagcccctcccacgtcgtacaccgcggcggtcgagcggtacctcaccggcgcgggcatcgcgaagtcctccgcgcggatctaccggatctcgttgacgacgtgggggtggatgctcgcgaagccacccgtcttccccgtcgtcgcaatcgacgacccggcgccgccggagttgctggccgagctggcggcggcgcgggctgacgagatggacttcgacaccgtcaaccgggagctgtccatcgcgcgcaaggcgatcggctggtggcagcgccagggctggatcgaaggggacccgacgatcggcatccagcggcggccggcaccgccggaccgcaccaaggccctctccgagaaccggatcgccgcgctgtgtcgcctggacgtctccctgcgggagaagacgtgctggaagatgctctacgagtccgccgcgcgggccgacgaggtgctgtgcctgaacgtggaagacctgcacccgcaggacaagcgcgggaagatcaccgccaagggcgggtcgaccgagtggatccactggcagtccggcaccgcccagctcctgccccgactcatcgcccgccgcacccgcggcccgctgttcctcaccgaccgcaaggccccggccggaacgccgacactcgacgtgtgcccggagaccggccgggcccggctctcctaccgcagggctgaggagattttcgaggagaacacgcggctgctggccaacccgctcgcctcgcccgaggacatcgaggacctggacggctggacccttcaccggctacgtcacagtgccttgacgcacgacgcggaggacggcacctctaccccgatgctgctggcccgctcccgccacgcatccgtccgctccctggagcggtacgcctgtcccggcgtcgactcggtcgcccggcacgtcgccgaacgcgcccccgctgcacgccgccgcacgtaaatccgagcagatcagggctccaagatcatcccattgcccctttggtgtgtatctcggtcacacccgccctggtcttctacgacaagatcccccgagatcactccaggccttgccgagatcgtcggtgccccaggggattcgacaggtgaggagcagggccagaagccggctctcgccagtgtcgtcggcagcagtggctcagaggtcctggacggcgcgcagggcctgatccacgcgggccataaccgcaccgtcgatgggaccgcggagcttggcgccgtcgaagcggctggtccgtagctgaacgatgttgaccgcgacggcggtgcaggggatgggggtgtcgatcaccaccgacatggccgtgtccgggaaccggccgctttcgtgcagcacgatgaccaggaccgcaccgtaggactcctccaggcccgtcagactgatgatcaggacgtgccggccgtcgggcagcgtccagacctcaccccgcttcacagggtgtcgccctcgcccgccaggtcgccgcccaggccgagcgcagcaagatgctgcgcggcatccagggtggcagcccggcgcgcggcacgcaccacatacgcgttcacgctgaggccggcctccgatgcggctgccttgatcgatggcgcaaggtcatcagggatacgcagggtcattgtggtgacagacatggtggcaacaatagccaccacgagtcggtaccgaaagatggtatgcaccactgggggccggagcggacagcggtggggtggcagtgggcctggccggcactggagccgggtgatccgccacccagccctccaacagccggcttgcatgcggccaggcgcgccgtggcgctgccggtctcccagccgggaccgtctcgcgttcggtgcagcgcgcatcgccacgtcctgccgggccagccccggggctcaccaccagccctcgcgccggaggcgttgcctgtattccctctccctctgttccaagaactccttgaccatcgcctcgcgctccggggtgtgcaagagaccacgcccggcccgcttgtcctgtgtctcccggtgccggtccttgccgggccgcgccgcttcagcggctgcccgcgcggctttggcggccgcctgcgccgcctcggctgccgcctgcgccgcgtgcacgggaacgtgcaccgcacgccacttgtcggccggccaccacaggcgggccaggtgagccgacactgtcacatccagtcccgcagccgcccagcgtttacggtgtctgcgggccttgcgtgttcgctgctcgtcggccagccggtcgaggactctccggtcggacggctccatccatacgttccaacgccgccactgcatccagccgaggcccacgacccggccgcaccgcgccaagtgccccagcctgtccagcactcgctgcgcgagacgtgccgtctcccgcagcgacaggggtgctccgaagcgctcggcggccagccggccgacaatccggccgggcaggaacgggcccccgcgcatcgcttccaaggcagccagaacatcgtccgcgctcggccacgcatccgcttcttcccactcacgtccggccatcggcccatgcacccccgagcgtcactgcgccccctccgtcatggcaccacacaactcgacccaggccaagaccacttgcctgctggccgttcagccgtcgacggccaggcccagaaggccagcacaggaacagtgccggctcacctggcccgcctgtcgtggccggccgacaagtggcgtacggtgcacgtccccgtgcaagcagcacaagcggccgccgaagccgcgcgggcagccgccgaagccgcgcgggcagccgctgaagcggcgcgggccgacaaggaccggcgccgggtgacacaggacaagcggaccgagcatgatctcttgcacaccccggagcgcgaggcgatggtcaacaagttccagtcatcctggacctggcgcatgccgccc

SEQ ID NO: 313 - DNA, 2919 bp, Unknown
  Kingdom: Bacteria, Phylum: Actinobacteria, Class: Actinobacteria, Order: Streptomycetales, Family: Streptomycetaceae, Genus: Streptomyces
gacccggggccgctggccgcgttcggacccggcgcagccgacgccgtccgccgcaccgactccttcccgcacaccgcggacatcatggtcaactccgcctacgacccggccgacggcgaggtcctcgccttcgaggagcagatcggctcgcacggcggactcggcggcgcgcagggccgccccttcctgatgtcgccgctggcctgctcgccgcccaccgaggacggctcggacctcgtcggcgcggagcagatccaccgggtgctgcgccgctggctgcgcgaggccgccggcggtccgcaggtaccgcgcccggcacagccggaggaggagcgggccgcctgatggcgccccttgcggccgcgctggcgcacagcgcaccgcggcgcacgtccttcaccgtgtaagtgccgcgcggatgtgatcggatgggggcgatggaacccgggaaccgggcacctaggcgaaaggtatggaacacaccgtggcaaccacgcgcaccgctcacaccgtctgggaaggcaacctgctcgagggcaagggcgtcgtcaccttcgactcctccggcatcggcgagcagccggtgtcgtggccgtcgcgcgccgaacaggcgaacgggaagaccagccccgaggaactgatcgccgccgcccactccagctgcttctccatggcgctctcgcacggcctggccggtgccggtacgccgcccaccggcatccggaccaaggccgacgtcaccttccagccgggcacgggcatcactggcatccacctgaccgtcgagggcaccgtccccggcatcgacaacgacgcgttcgtcgccgccgccgaggacgccaagaagaactgcccggtcagccaggccctggccggcacgacgatcaccctggacgccaagctcgcctgacccggcacgcacggcccacggcgccgcgccccttctcgcacaaagggcgcggcgccgtcgtgttccgccgcccgtctgggtacccgtagggcagaggcggaaaggggacgacgatggcacgtgcggtcgggatcgatctcgggacgacgaactcggtggtggccgtcctggaaggcggcgagcccaccgtcgtcgccaacgcggagggcgcgcggaccacgccgtcggtcgtggcgttcgccaagagcggtgaggtgctcgtcggcgaggtcgccaaacgccaggcggtgacgaacgtggaccgcaccgcccgctccgtcaaacgccacatgggcgacgcgcactggcgcttccccgagcagggctccgtcgacggcacccgttaccgggcgcaggagctgtccgcgcgggtgctgcagaagctgaagcgcgacgccgaggcctatctcggggaggacgtcacggacgcggtgatcaccgtgcccgcgtacttcgacgacgcccagcggcaggcgacgaaggaggccggggacgtcgcggggctgaaggtcctcaggatcatcaacgagcccacggccgccgccctcgcctacggcctggaccggggccaggagcagaccgtgctcgtcttcgacctcggcggcggcaccttcgacgtgtccctgctggagatcggcgacggcgtcatcgaggtcaaggccaccaacggcgacacgcacctcggcggcgacgactgggaccagcgggtcgtcgagtacctggtcaaacggttcaagggtcagcagggcgtggacctgtccaaggacaagatggccgtccagcggctgcgcgaggccgcggagaaggccaagatcgaactgtcctcgtccaccgagacctcgatcaacctgccgtacatcaccgcatccgccgagggtccgctgcacctggaggagaagctcacccgcgcccagttccaggaactcaccgccgacctgctggagcgctgcaagaagccgttccaccaggccgtgaacgacgcgggcatcaagctctccgccatcgaccacgtgatcctcgtcggcggctccacccgcatgcccgccgtcaccgacctggtccgcgaactcaccggcaaggacccgcacaagggcgtcaaccccgacgaggtggtcgcggtcggcgccgccctgcaggccggtgtgatccgcggcgacgtgaaggacgtgctgctcctcgacgtcaccccgctgtccctgggcatcgagaccaagggcggcatcatgaccaagctgatcgagcgcaacacgaccatcccgacccggcgttcggagatcttcaccaccgccaccgacaaccagccctcggtcggcatccaggtctaccagggcgaacgcgagatcgccgcctacaacaagaagctcggcgtcttcgacctcaccggactgccgcccgccccgcgcggcgtgccgcagatcgaggtcgccttcgacatcgacgccaacggcatcatgcacgtctccgccaaggacctggccaccggccgcgagcagaagatgaccgtgaccggcggctccgccctgcccaaggacgacatcgaccgcatgatgcgcgaggccgagcagtacgccgaggaggaccgcaaccggcgcgaggccgccgagacccgcaaccaggccgaacaactcgtctaccagaccgagaagttcctccgcgacaacggcgaccgcgtgccggccgagacgaagaacgaggtcgagtcggccgccgccgaggtgaagggcctgctggagcggaacgccgacaccaccgccctgcgcaccggcgtcgacaagctcgcctcggtcagccagaagatgggccaggccatgtacgcccaggccgcacaggaccggccggacgcggcggagggcggcgaaggcaccggacagcgcaccgggacgcaggaggacgagggcgtggtggacgcggagatcgtcgacgaggaccgcgacgagcgggacacgaaaggcggagccgcctgacccgcc

SEQ ID NO: 314 - DNA, 11799 bp, Unknown
  Kingdom: Bacteria, Phylum: Actinobacteria, Class: Actinobacteria, Order: Streptomycetales, Family: Streptomycetaceae, Genus: Streptomyces
  misc_feature (436)..(506): n is a, c, g, or t
atgcgcgcgtgggtgaggcccgcgccgagcagggcgtgtccgtcctggtactgccagccgcggatctcgctgatccggccgaggccgaccagcgcggcgggcctgagctgcccggagttgacggcggccatgaggtcggtgccgcccgccacggggacggcggcgggcatggcggtgagcgccgccactgcctcgtccagcgtcgtgggcagcgtgacggcctgcgccgcctgtggtgcgtgcgtggtcaaaccggctgccccttcccgctgtcccactggtcccacccgtgctgccgtacggtacggcctgacagggcggacgtggcaactctggcacatcttcgcaggactcgcggacacgggtccgccgggaggcattcgcccacctcatcgtggacatggtcccttttgacacgggatcaccggtgcgagcnnnnnnnnnnnnnnnnnnnnnnnnnnnnnnnnnnnnnnnnnnnnnnnnnnnnnnnnnnnnnnnnnnnnnnnggccggttcgcaggagggccgatccgaggcggcgggcggccggttcgcaggagggccggtacgagacagcgggcggccggtacggaaccggccgcccgcgtcccccacgcgacccgtgccagtgagcgccccgtccggctacttcaccggcggcgccccctcgatcggacgtcccaggacaccgggcctgcgctgccaggggtgcggtccggcgggcgggcggtagccgacacccagggcgtccaggcgcaggtagtggccgctcatccgccgttcgaagtcggcgaagtcccgctcgtccggcgcgggcagggcgctccaggcgacctcggcgaaggcggccagccgggggaaggtctggtagtccacgcgcgcggggttctccatcacctcggtccacacgttggcctgggtgcccagcacatggccggtgtgctcggcctccaggcctgacggaaccggctcgaaccggtagacgtcctccagggtgcgcacgaagccgatcggcacgggttcgtccgcgcccgcgtcctgccggtggtccaagtacacctgctgctcggggcacatgacgacgtcgtgtcccgcgcgcgcggcggcgatcccgcccgcgtagccgcgccaggacgcgacggcggcgccctcggcgaggccgccctccaggatctcgtcccagccgatgagccgacgcccgcgcgcggtgagccacttgtcgaagtggccgatgaaccaggactgcaactcgtcctcgtcggccagtcccagttccttgatgcgggcctgcgcggtcgccgaggcccgccactgctccttggggcactcgtcgccgccgatgtggaagaagtccgagaacggcgcgtcggtcaccgggaagaggccgagcagttcctcgaagacgccctcgtagaagcggagggtggcctcggtgggggcgaggacgttcttgctgacgccccagtcgtcccagacggtgagggcggtggtgtcgacgacgtccgtgttgccgagttccgggtaggcggcgatggcggcctgcgagtggccgggtacgtccacctccgggatgacggtgatgtggcgctcggcggcgtaggcgacgatctcccggatgtcgtcctgggtgtagtggccgccgtgcggtttgtcctcccacagcggcgaggcgcggtggccgaacttcgtgcgtgaacgccaggatccggtctcggtcagcttcgggtagcgcttgatctcgacgcgccagccctggtcgtccgtcaggtggaagtgcaggacgttgagtttgtgggcggccatcaggtcgaggtagcgcaggacgccgtccttgggcatgaagtgccgggccacgtccagcatcaggccgcgccagcggaagcggggggcgtcctctatctcggtgagcggcagccgccagcgtccgccgggcagcggggcgcgccggaaggcggccgggccgaggagctgccgcagggtctgggcgccccagaagagccctgcgggaccgccgccggcgaggtcggcgccctcaggtgtgaccgtcaggcggcagccctcggggccgagttcgcgtgcgacggcgtcgtccaggcgcaggcgcagggcgccgtcgccggccggggcgggggcgagcgggagtccggtggccgcgccgagggtggcgcgcagccagcgttcggtgcggccggtgccttcactcgccgtcatggtggtgtgggggcccagctcgaagaaccgttcctcgtcggtcgtggtgcgaccgggccgggggatcacgtccgtcttgtccatcgctgtcagtccttcaccgctccgccgaggccggagacgagtcgtcgttgcacgagtaagaagaagaccagtaccggaatcgtcatcaccgtggacgcggccatcacgccgccccagtcgggatcgtccggtttgtagaagaccagcagcgccatgggcagcgtcgactgggaggtgtcgctgatgatgaacgacttggcgaacaggaagtcgttccaggtcgagatgaaggagaagacgctggtggccacgaggcccgggaagaccagcgggaagaggatctgccacaggaagcgcgtccggctcgcgccgtcgatgaaggcggcctcctccagggcttccggtacggctttgacgaagccgcgcagcatccagatcgcgaacggcagcgagaaggcgatgtgcggcaggatcagcgagcccagcgtgttgagctggccgaagtcgcgcatgaggaagaacagcgggatggtgagcgcctccacgggcaccatctgggccaccaggaacaggatcagcagggtggtgcggaaccggaagcggaaccgggtgacggcggtcgcggccaggaacgcgatcagcgcggaggcgatcacgacggacaccgcgacgacgaggctgttgaggaagtagcggccgaactcctgctgctcgaagacccgccggaaggcgtccagcgagggggacgtcgtccagggacgcggcttcgtcgactcgatctccccggccggtttgaaggcgctgagcaccatccagtacagcgggaaggcgaccacgaccgcgacgatcagcgccgtcgcctcggccgctagccgtcccgggcggcgcacccgtgcgcgcacgaggttcacagctcctccccctggcggcgcagcagccgcaggtagaccagggtcacggcgagcaggatcagcagcatcacgacgccgatcgcggagccgaggctgtactgcgaggaggcgaacgccttctggtaggcgtagacgttcaggacgaggttctgccctgcgatgccgccgccgcccgtcacgacgtagatctgggtgaagaccttgaagtcccagatgacggactggatggtgacgacgaccaggatcgggcggagcatcggcgccagcacggagcgccagatccgccactgggaggcgccgtccagcgcggcggcctccagcacctcggcggggacggcgcggataccggcgtagacggtgaccatgacgaacgggaaggagcaccagaccacttcgagcaggacgaggaggaaggcgctgtagcggccgtacgtccaggagtggtcgcccaggccgaggatcttgttgacggggccgaagtcggcgtcgaacagcagcagccagaccgtggagccggtgaccgccggggtcgcccaggcgccgagggcggcgagcatcagcgcgaggcgcggcacggcacgcacccgggtgaggagcacggcgagcgcgcagccgacggcgagggtgcacagcacgcaggccgccgcgaacaccacggtggcgagcaggacccgccagaactggtcgtccccgaacagctcggcgtagttgcccaggccctggaaggtggccggcttgccgccgctgacctgggcctgggtgtactccaggaaggagatcaggccgagctggtagacggggtagacgagcagtccgccgaggacgacgagagcgggggcgaggtacagccagggggtggcggcgccgcgcctggcggggcgcgggccgcggcgcaccggcgcccgcgaccgccccaccgcgacccccgggctcgtggtcgaacccgtcatccggcggcaccgaacgcgtcgttcatcttcttcgcggcgtccccggcggcggccttgacgtccttcttgccgctgacgacctcctggaacatggtcggcagcaccagcgaggagtcgatctgggcccaggcgggcgtggccgggacgaactcggtgcccgcggccagggtgtcgacgaagggcttcacgaacgggttcttggcggcgacctggccgcgtacgtccttgaaggtcggcaggaagcccatcgcgtcgaacatctcgccctgggtcttcttcgacgtgagccgcttcatcaggtccacggcgagggtgcggtgcgaagtgctcttgagcacgccgatgttgttgccgcccgcgaaggccggtgcgacggatcccggcttgacgccgggcagcggtacgacggcgtacttgcccttggcgcgccccgcttccacggcctggtggctgaagtcgccgccgatggccatcgcggccttgccggcggcgaaggcggtgatggtgtcgttgccggtcatgccggcgcacttggccgcagggcagttgccgtcaccgaacagggacgtgtactcctcgattcccttgcgggcggcggggctgtcgatggcggaggtgtaggagccggacctgccggtcgcgatctggccgccgttggcccagatgaagggcatggcgccgtaggtgtaggcgccgccgacggcgaggccgtacaggtcgggccgggcggcgcggatcgtgtgggcggtggtggccagttcgtccagggtcttcggcggcttgaggtgcagttccctgaagacgtcggtgcggtagtacagggcgcggacgccgacgaagtagggggcgccgtagatcttgccgtccacggtgaccgaggtgcgggcggtggggtcggtgtccttggcctcgtcccaggcgtcgaactccgcggtgacgtcggcgagtccgccgtccttgacgtaaccggcggtgtcggtgttgccgtactcgatgacgtcgggggcgctcttcgggtcgttgaaggcggccttgatccgctgggcgcgggtctcgacggggatgtactcgacggtgaccttcgtgtcctggtgggccttgcggaagtcggcgagtacctgctggaccacctgttccttcggcctgtcggcgacctcctggaacagccagaggcgcagggtgccggtcttctcgtccttgcccgaggaggagttgtcggacgtctgcggggcgcaggcggtggcggtgagagcggcggcggccagcagtacggccagccgtccggagagtcttgcggagagcttcatggagcgattcctccggtcagggtgttgcagcatgcgcaatgacggttttgctctgcacaacaccacggaggctaggtactcgatgaacgccgccacaagaggtctcaaccactctgtgaccgccggacgcaccctgtgcaacgccgggcagcacaaaggccccccaagcgcgcagaacgcactcgggaggcccggtgacggaggcggtaccgcctcttctcgacgcccctcttcccgacgtccctgcgacagggacgtctggccgcctctgcgaccgggacgctgacgctacttcttgtcgccgcccttgccctggtcgccgccgccgctcatggactcgtagatctccttgcacagcgggcacacggggtacttcttcgggtcgcggcccggcacccagaccttgccgcacagcgcgacgacgggcgtcccgtccagggcgctcgccatgatcttgtccttctggacatagtgggcgaagcgctcgtggtcgccgtctccgtgggacacctgcggcgtcggctctacgagggtccccgtaccagtgccgcgctcgggctcgagagtgctcatacggcaagggtactgaagcgcgcgggcatcagttgagcgacgggtcgtccgggtaggtggcgaccatggccagttcgctgcgctggcggcgcagcacctcgcgccacagccgctccggcgacggcgaggagacgtccccgggctccgactcgacgacgtaccaggccccctcccgcagctcgtcctccagctggccggggccccatcccgcgtacccggcgaagatccgcagcgagccgagggcggaggcgagcagctcgggcggggcctccaggtcgacgagcccgatcgcgccgtgcacccggcgccagcccagcggggcgcgcccgcccgcaccgccgcccgggatgacggcgacgccgagtgcggagtccagcgagaccgggccgccctggaagacgacgccgggctcccccgcgagggcggcccagccctccaggacgtcgcccacgtccacgggggtggggcggttgaggacgacaccgagggagccctcctcgtcgtggtcgagaaggagcaccaccgcgcggtcgaagttcgggtccgccagggcgggcgttgccacgagcagctgccctgtgagcgaggacacctcggtcatgccagacatgatcccgcatcttcccccggcgtggggagccaatccggctaccggggtgagggcgtgcacggggtacggaggcgcggcgggcgcacggccccggccgtgaccgcacgtgcccgtcggtcgacggttcgtgttgtgacacagccatgacgtaccgggcggcgcacgggcttacttccggggggcgcccggcgattacgctgtccctccggcccccggcccgaagtgaccggccgctcccctgcccacctcatcggaacgcgagatacatgaccgtcaacggcactgatgacgtactgcttgtccacggcggaaccccgctggagggcgagatccgtgtccggggtgcgaagaacctcgtaccgaaggcgatggtcgccgctctgctgggcagcgaaccgagccggctgcgcaatgtgccggacatccgggacgtgcgcgtcgtacgcggcctgctgcagctgcacggcgtgacggtccggccgggtgaggaaccgggcgagctggtgctcgacccgacccgggtggagagcgccaacgtggctgacatcgatgcccacgcgggctccagccgcatcccgatcctcttctgcggcccgctgctgcaccggctcggccacgccttcatcccgggcctgggcggctgcgacatcggcggccggcccatcgacttccacttcgacgtgctgcggcagttcggcgcgacgatcgagaagcgggcggacggccagtacctggaggcgccgcagcggctgcgcggcacgaagatccggctgccctacccgtccgtcggcgcgaccgagcaggtgctgctgacggcggtgctcgccgagggcgtcaccgagctgtccaacgcggccgtcgagccggagatcgaggacctcatctgcgtgctgcagaagatgggtgcgatcatcgcgatggacaccgaccgcacgatccgcatcaccggtgtggacaagctcggcggctacacccaccgcgctctgtccgaccggctcgaggcggcgtcctgggcgtcggcggcgctggccaccgagggcaacatctacgtccacggcgcccagcagcgctcgatgatgacgttcctgaacacctaccggaaggtgggcggggcgttcgagatcgacgacgagggcatccgcttctggcaccccggcgggcagttgaagtccatcgccctggagacggacgtgcaccccgggttccagaccgactggcagcagccgctggtggtcgcgctcacccaggcgaccgggctgtcgatcatccacgagacggtctacgagtcccggctcggcttcacctccgcgctgaaccagatgggcgcgcacatccagctctaccgcgagtgcctgggcggctccgactgccgcttcggccagcgcaacttcctgcactccgcggtggtctccggcccgacccggctgcagggcgccgacctggtcatcccggacctgcgcggcggcttctcctacctgatcgccgccctcgcggcccagggcacgtcccgggtccacggcatcgacctgatcaaccgcggctacgagaacttcatggagaagctggtggaactgggcgcgaaggtcgagctgccgggccaggcgctcggctgaacaagcccggctgcccggtcccggccgcctgcccgcctcccggccgggggtccgggggtcgcccccgggcagacacagcatggagaagctggtggaactgggcgcgaaggtcgagctgccgggccaggcgctcggctgagcggtcccctgcgtcggccggtgccacttggctgagcggtccctgcgtcggccggggcgcttggctgagcggccgttcgaggagcgtgtacggcgatggggcggccccccgtggagggggccgccccattggcgttgtcggccctgccgggctccgcacgccgtcccgtggcgtacggcggcaaggtcacttgcccttggcggcttccttgagcttgctgcccgcggagaccttcacgctgtagccggccgggatctggatcggctcgccggtctgcgggttgcgcgcggtgcgagcggcacggtgggtgcgctcgaagttcaggaaaccagggatggtgaccttctcgtcccccttggagacgatgtcgccgacgacgtcggcgaacgcggccagcacggcgtcggcgtccttgcgggtcacctcggcgcggtcggccagcgcggccaccagctcactgcggttcatgttgttactcccgtgttcttcttgccgttgaggcgtgccacgcggcgaagccgcatgttgggccagccaagccgatgctgccagggtcctcgggggtccccggacccgggtccctcgtcagaccctcgcgcccagggaggcatcctgcccccacctgcggcgggaaagccaatccggcacccgtaggagtcgtgagaacacccttgggagtcacacgaaaagagggtctgcgccgcgcggtcgcgtctggatcgagccgcagacgacagaccctggccagccacgatagggcgcggcactgacaacgtccgccgtgacgcgccggtccacggcacgtcgtggcgatcgtcacgcccggggaggccgtggaatgccgccccgggcgctcttttcggccggttcgtccgcttctcagatgccgcttgtgctgctggtcaccgcgctcgcgccggcggccttggcggcttcacggacggcaccggcgacggcaccggcgaccttgtcgttgaagacggacgggatgatgtagttcgggttcagctcgccctcggtcaccacgtcggccagggcctgcgcggcggccagcatcatctcggtgttgacggtgcgcgactgcgcgtccagcaggccgcggaagacacccgggaagaccagcacgttgttgatctggttggggaagtcggagcggccggtggccacgaccgccgccgtctgacgggcgatcgccgggtcgacctcggggtcggggttcgcgagtgcgaacacgatcgcgccgtccgccatggcggccacgtcgtcgccgtcgagcacgttcggggcggagacgccgatgaagacgtccgcgccgcgcacggcctccttcagggtgccggtgaggttctccgggttggtgttgtccgcgatccagcgcagtgccgactcgggggccgcgtcgaccaggtcctcgcggccggcgtgcacgacgccgtggatgtcggcgaccaccgcgttcttcacgccggcggcgatcagcagcttgaggatggcggtgccggccgcgccggcgccggacatcacgacccggacgttctcgatgggcttgtccaccacgcgcagggcgttggtgagggcggcgagcacgacgatggcggtgccgtgctggtcgtcgtggaagaccgggatgtccagggcctcgcgcagccgggcctcgatctcgaagcagcgcggcgcggagatgtcctccaggttgatgccggcgaagccgggggcgatcgccttgacgatctcgacgatggcgtcgctgtcctgggtgtccaggcagatcggccaggcgtcgatgccggcgaaccgcttgaagagggccgccttgccctccatgaccggcagcgcggccttggggccgatgttgccgaggccgagcaccgcggagccgtccgtcacgaccgcaacggagttgcgcttgatggtcaggcggcgggcgtcctcggggttctcggcgatcgccatgcagacgcgggccacacccggcgtgtagaccatggagaggtcgtcacggttgcggatggggtgcttcgacgccatctcgatcttgccgccgaggtgcatcaggaacgtacggtcggagaccttgccgagcgtgacgccctcgatgccgcgcagtttctcgacgatctcgtcggcgtgcgcggtcgaggtcgccgcgatggtgacgtcgatccggagcttctcgtggccggacgcggtgacgtcgaggccggtcaccgagcctccggaggactccacagcggtggtgagctgcgagacggcggttccgctcgcgggcacctccagccggatggtcatcgagtaggagacgctgggcgccgttgccatggccgacttcctctgctttcaccgtgtcgcgaagttgtgccgtccgatcgtcgcacctacccctgagtacgtggtagtcgccccgggttgcggactttgtgttcaccggagcggccaccagaaggtgcgttcaggaggtaccaggaggcgccgttttcggaaagtgacttccaccatacgagagatcacggcgtcgcggaaggtgcccacgcaacaaaagaggcccacgtcacattcctcgtgacgtgggcctctcggaggcttgtgacaccgacccgccatgctcgcctcgcggcaagtggtcgctcgtagcgacgaaggttgggcccgggggcttggatcgggccggtgccacaccaaggctaacaaacggatccggtaaggccattcccccggtgaggttccttttccgccagcccctgagcgggccccgcgctcagtcccgcagcaggtccggcaccccggccgcgtccggctcgtcgcgctcgccggagaccaccgtgagctgctgggtggcgcgggtcagggcgacgtagagcacccgcaggccggccggggactcgtcggcgatctccgcgggcgagacgacgagcgtcgcgtcgtactccaggcccttcgcctccagactgcccagcgccaccacgcggtcgccgagcccggccagccagcgccgcgcctcctcgcgccggttcatggcgacgaccacgccgaccgtgccgtccacccgctccagcagccgctgggcctccgcccggacggtggcgcccagcgagtcccgtacgaccgcgaagcgcggctcgacgccggtggagcggaccgcggagggcgagcgggagccgggcatggccagggccagcaccttcgcggccagctcggcgatctcggccgggttgcggtagttcacggtcagctcgaaacggcggcgcgggcgggtgcccagcgcctcgtcgcgggcctcggccgcctcgtccgggtcggaccaggaggactgggccgggtcgccgaccaccgtccacgtggcgtgccggccgcggcggcccaccatgcgccactgcagcggcgtgaggtcctgcgcctcgtcgacgatgacgtgggcgtactcggtgcgctcctcggccagccgctcggcacgctcgcgctgcg

SEQ ID NO: 315 - DNA, 8604 bp, Unknown
  Kingdom: Bacteria, Phylum: Actinobacteria, Class: Actinobacteria, Order: Streptomycetales, Family: Streptomycetaceae, Genus: Streptomyces
acccagccccgaccaccccaccatcacccgtacgacatctgcgcacactcacgcacggatgagcaaagaagggtaaagccccaggttagcccagcctttccttgctggcggcggcgaaatttcaggcgtagtttcggtgttgtcgaaaagtagaaccaatccaaaagcaagccttgcctaagctctctgggggactctcatggccatcctcgacaccgaagcgacactgcacgaggcgcaccgcgacaaccacacgcaccgcgacgtgaacggcggctggctgcgcccggcggtcttcggcgcgatggacggcctcgtctccaacctcgccctgatgaccggtgtcgcgggcggcgccgtgagccagcagaccatcgtcctcaccggcctcgccggcctggccgccggcgccttctccatggcggccggcgagtacacctccgtggcctcccagcgcgagctggtcgaggccgagctggacgtcgagcggcgcgagctgcgcaagcacccgcaggacgaggaggacgagctggccgccctgtacgtggcgcggggcgtcgagcccgagctggcccgggaggtggcccgccagctctcccaggacccggagcaggccctggagatccacgcccgtgaggaactgggcatcgaccccggcgacctgccctcaccgctggtcgcggcggtctcgtcgttcggctccttcgcgctgggcgccctgctgccgctgctgccctacctgctcggcgccagcgtgctgtggcccgccgtgctgctcgccctgatcgggctgttcgcctgcggtgccgtggtggccaaggtgaccgcgcgcacctggtggtacagcggtttgcgccagcttgtcctgggtggtgccgccgccggtgtgacgtacgccctgggcaccctgttcggaaccgccgtaggatgacggcactggaacttatgcatgtcttcgcataagtagccgctacccgctggtttcgaccgcatgaccgcggggcatgagccgtaagcgctgtgggcaacgaagccccgacgtacccctgagcaccctcaggggcgtgtggcgccgccacccgccccgcccttccgggcccgccgaggccaggaatccgaacgattccggccaccgccgggcccccacggcacacctccaccgcgggcgcggaaaccccgccgccgaccctgcggtgtccgcatgctggaacggagtatccggttcccgagatccgccccatcatgtaatctgcaccgaatttcgcactccacgcagagggccaacgtcgtccctcggcacttgcacatgccagatgacgacgacgggagagccgatgcgtacgccgcgccagccgtcccagcactccacgaacgaccgccccacctggtccttcatggatgctcgccctgccgcgcagggtatgtacgacccccgcgacgagcacgacgcctgcggcgtcggcttcgtggccaccctcaccggcgaggcgagccatgcgctggtcgagcaggcgctcacggttctgcgcaacctggagcaccgcggtgccaccggctccgaacccgactccggtgacggcgccggcatcctctcccaggtgcccgacgcgttcctgcgcgaggtggccggattcgacctgcccgccgccggctcctacgccgtcggcatcgccttcctgcccgaggacggcaccgccgacgccgtctcacgcatcgaggcgatcgccgccgaagagggcctgaccgtcctcggctggcgcgaggtccccgtcgcccccgcactcctcggcgccaccgcccgctccaccatgcccgccttccgccagctcttcgtcggcgacggcgcgagcgagggcatcgccctggaccgcaaggcgttcgtgctgcgcaagcgcgccgaacacgagaccggcgtctacttcccctcgctgtccgcgcgcaccatcgtctacaagggcatgctgaccaccggccagctcgagcccttcttcccggacctgtccgaccgccgcttcgcctccgcgatcgcgctcgtgcactcccggttctccaccaacaccttcccgagctggccgctggcccacccctaccggttcgtcgcccacaacggcgagatcaacaccgtcaagggcaaccgcaactggatgcgcgcccgcgagtcccagctcgcctcgcggctcttcggcggcgacggcaacctggagcggatcttcccgatctgcaccccggacgcctccgactccgcctccttcgacgaggtcctggaactgctccacctcggcggacgctcgctgccgcactccgtgctcatgatgatcccggaggcgtgggagaaccacgagtccatgaacatcaaggacacggcccgccgcgccttctacgagtaccactccacgatgatggagccctgggacggcccggcctgcgtcaccttcaccgacggcacccaggtcggcgccgtcctcgaccgcaacggcctgcgccccggccgctactgggtcaccgacgacggcctcgtcgtcctcggctccgaggtcggcgtcctcgacatcgaccccgcccgggtcgtccgcaagggccgcctgcagcccggccgcatgttcctcgtcgacaccgcccagcaccgcatcatcgaggacgacgagatcaaggcgtccctcgccgccgagaacccgtacgccgaatggctccaggccggcgagatcgagctgggcgacctgcccgagcgcgagcacatcgtccacacccacgcctcggtcacccgccgccagcagaccttcggctacaccgaggaagagctgcgcgtcatcctcgccccgatggccaagtccgccgccgagcccatcggctccatgggcaccgacagccccatcgcggccctctccgagcgcccgcgcctgctgttcgactacttcacccagctgttcgcgcaggtcaccaacccgccgctggacgccatccgcgaggaactggtcacctcgctgcgctcctcgctcggcccgcagggcaacctcctggagcccaccgcggcctcctgccgcagcgtcgtcctgcccttcccggtgatcgacaacgacgagctggccaagctcatccacatcaacgccgacggcgacatgcccggcttcaaggccgccaccctctccggcctgtaccgggtctccggcggcggcgagacgctggccgcccggatcgacgagatctgcgccgaggccgacgccgccatcgacaacggcgcccgcctgatcgtcctctccgaccggcactccgacgccgagcacgcgccgatcccctcgctgctgctcaccgcggccgtccaccaccacctcatccgcaccaagcagcgcacccacgtgggcctgctggtcgaggccggcgacgtccgcgaggtccaccacgtcgccctgctcatcggctacggcgccgccgccgtcaacccgtacctggccatggagtccgtcgaggacctggtccgcgcgggcaccttcctgccgggcatcgagcccgagcaggccatccgcaacctgatctacgccctcggcaagggcgtcctgaaggtcatgtccaagatgggcatctccaccgtcgcctcctaccgcggcgcccaggtcttcgaggccgtcggcctcgacgacaccttcgtggagaagtacttcaacggcaccaccaccaagatcggcggcgtcggcatcgacgtcatcgcccaggaggtcgccgcccgccacgccaaggcctacccggccagcggcatcgccccggcgcaccgcgccctcgagatcggcggcgagtaccagtggcgccgcgagggcgaaccgcacctgttcgacccggagaccgtcttccgcctccagcactccacccgctcgggccgctacgacatcttcaagaagtacaccgaccgcgtgaacgagcagtccgagcgcctgatgacgctgcgcggcctgttcggcttcacctccgaccgcgccccgatcccggtcgacgaggtcgagccggtctccgagatcgtcaagcgcttctccaccggcgccatgtcgtacggctccatctccaaggaggcgcacgagaccctcgccatcgccatgaaccagctgggcggcaagtccaacaccggtgagggcggcgaggacgccgaccgcctgtacgacccggcgcgccgctccgcgatcaagcaggtcgcctccggccgcttcggcgtgaccagcgagtacctcgtcaacgccgacgacatccagatcaagatggcccagggcgccaagcccggcgagggcggccagctgcccggccacaaggtctacccgtgggtcgccaagacccggcacagcacccccggcgtgggcctcatctccccgccgccgcaccacgacatctactccatcgaggacctcgcccagctgatccacgacctgaagaacgcgaacccgcaggcgcggatccacgtgaagctggtctccgaggtcggcgtcggcacggtcgcggcgggtgtgtccaaggcgcacgcggacgtggtgctgatctccggccacgacggcggcacgggagcctcgcccctgacgagcctcaagcacgcgggcggcccctgggaactcggcctggccgagacccagcagaccctgctgctcaacggcctgcgcgaccggatcgtcgtccagaccgacggccagctcaagaccggccgcgacgtcgtcatcgccgccctgctcggcgccgaggagttcgggttcgccaccgccccgctcgtcgtctccggctgcgtcatgatgcgcgtctgccacctggacacctgcccggtcggcatcgccacccagaacccggtgctgcgcgaccgcttcgccggcaaggccgagtacgtggtgaacttcttcacgttcatcgccgaggaagtccgcgaactcctcgccgaactcggcttccggtccatcgaggaggccgtcggccacgccgagatcctcgacgtcacccgcgccgtcgaccactggaaggcccagggcctcgacctggagccgctgttccacgtccccgaactgcccgagggcgcggtccgccaccaggtgatcgcccaggaccacggcctgcagaaggcactcgacaacgagctgatcaagctcgccgccgacgccctcgccgcacccggcgccaccgacgcccagcccgtgcgcgcccaggtcgccatccgcaacatcaaccgcacggtcggcaccatgctcggccacgaggtgaccaagaagttcggcggcgcaggactgcccgacgacaccatcgacatcaccttcaccggctccgcaggccagtccttcggcgccttcctgccgcgcggcatcaccctgcgcctggagggcgacgccaacgactacgtcggcaagggcctctcgggcggccggatcgtcgtccgccccgaccgcgccgccgaccacctcgccgagtacagcgtcatcgccggcaacaccctcgcctacggcgccaccggcggcgagttgttcctgcgcggcaagaccggcgaacggttctgcgtccgcaactccggcgcactcgtcgtctccgagggcgtgggcgaccacggctgcgagtacatgaccggcggccgggcggtcgtcctcggcgagaccggccgcaacttcgcggccggcatgtccggcggcatcgcctacgtcatcgacctcgactgcgaccacgtcaacgccggcaacctcgacgcggtcgagcccctggacgagaccgacaagcagtggctgcacgacgtggtgcgccgccacgccgaggagaccggctccaccgtcgccgagaagctgctcgccgactggaccgccgccgccgggcgcttcagcaagatcatcccccgtacgtacaaggcagtgctcgccgccaaggacgccgccgagcgagccggtctcaccgagaccgagatcaccgagaagatgatggaggcggcgatcaatggctgacccgaagggcttcctgaaccacggccgcgaggtcgccacctcccgcccggtcgaggagcgcaccaaggactggaacgaggtctacgtccccggctccctgctgccgatcatctccaagcaggccagccggtgcatggactgcggcatcccgttctgccacaacggctgcccgctcggaaacctcatccccgagtggaacgactacgcctaccgcgaggactgggccgccgcccaggaacgcctgcacgcgaccaacaacttccccgagttcaccggccgcctgtgcccggccccgtgcgagtcggcgtgcgtgctcggcatcaaccagcagccggtcaccatcaagaacgtcgaggtctccatcatcgacaaggcgtgggagaccggggacgtcgccccgcagatccccgaacgcctgtccggcaagaccgtcgccgtcatcggctcgggcccggccggcctcgccgccgcccagcagctcacccgggccggccacaccgtcgccgtctacgagcgcgcggaccgcatcggaggcctcctccgctacggcatccccgagttcaagatggagaagcggcacatcaaccgccgtatcgagcagatgcgcgcggagggcacccgcttccgcaccggcgtcgaggtcggccgcgacatcctcgccaccgacctcaagaagcgctacgacgccgtcgtcatcgccgccggcgccaccaccgcccgcgacctgcccgtccccggccgcgaactgggcggcatccaccaggccatggagtacctgccgctgtccaacaaggtccaggaaggcgactacgtcaccgcgccgatctcggccgagggcaagcacgtcgtcgtcatcggcggcggcgacaccggcgccgactgcgtgggcaccgcccaccgccagggcgccgcctccgtcacccagctggagatcatgccccgcccgaacgacgagcggcaccccaccagccagccctggccgaccttccccatcctctacaaggtcacctcggcccacgaggagggcggcgagcggatctactccgcctccaccacccacttcgagggcgacgaggacggcaacgtacagtggctgcacctggccgaggtcgagttcgccgacggcaagctgaaccagaagccgggcaccgaacggaagatccccgcccagctggtcaccctcgccatgggcttcaccggcaccgaccgcgccaacggcctggtcgaccagttcggcctggacctcgacgaacgcggtaacatcgcccgcgacgccgacttccagaccaacgtgcccggagtgttcgtcgccggtgacgcgggccgcggccagtcgctcatcgtgtgggcgatcgccgagggccgctcggccgcccgcggtgccgaccggtacctgaccggagccagcgacctgccggccccgatccgcccgacggaccgcgcgctgacggtctgacccgcggccacaagaagacgtcccgtacaacggcgtacgggcgggtcgcctgggagggattcccctcccagaccccccgtgccggcgcctgcccgcccgtccccgaccggacaacagggcaggcgccgtcgcatatccagaacccgcgccggcccagaagccactgctgacctgaagccgccgccccgaaaccgtccggcccgccccggcgtcctgctccttgaccgacaggggaggagccgccacatggccgcgatcagtctgagcaagatggaggagaccgcgcccgcgctggtcagcctctacaagagcgccggaacctcgatcgtcgaacacgggctcgacgaacagcgggccgccgtgtacctcgtcctcgaccactccggctccatgagcccgtactacaagaacggcagcgtccaggcgctcgccgaccgggtgctgtcgctctccgcacacctggacgacgacggacgcgtccccgtgatcttcttctccaccgacgtcgacgccgtcaccgagatctccctcgacgaccacgacggcagcatccggcgcatcgcggcaggcctcggccacatgggccgcaccaactacgaagccgccatggacgccgtgatcgaccactacctcgactgcggcgccaccgacccggccctggtgatcttccagaccgacggcggcccctccagcaagaccgccgccgaacgccacctgtgcaaagccgccgaactccccctcttctggcagttcgtgggcttcggcaacgcccgcggccaccagttcgacttcctgcgcagactcgacgaactcgccgtacccggcaagcggatcgtcgacaacgccggcttcttccccgccggccgcgacccccgccgcctgaccgacgcccggctctacgacaacctcctcgccgaattcccccactggctgacggcggcccgcgcccagggcatcgtcacctgagcatccctcggggagaccctaggtgtcgcactccaggaccgtccggcacaacccgcaccgcgcccgcacccggccccgcaccggcaccctgatccgctgatgacaggtcggacacggaaacgacacccgcagcggatcagcaccacccgccgtgaacgagtacggcacacccgccgccgccggcaccggcccatgctcctgagcatgccgccggtcccgggcgtagcggcgccggcccgc

SEQ ID NO: 316 - DNA, 3262 bp, Unknown
  Kingdom: Bacteria, Phylum: Actinobacteria, Class: Actinobacteria, Order: Streptomycetales, Family: Streptomycetaceae, Genus: Streptomyces
cgtcgaggaggtcgaggacgcccagtgcgtgcgggtcggcgagcgggtcgtgggcgtgggcggcggcgccttcgcgcagtacgatcccggcccagaccagggcgccgtgctcggtgtcgggccagtcggcgacgaggcagtcggccacgcgcgggtcgtcgccgaggacctgctcgatgcggctcggcgagacgatctcgttgtcgtacttgaagacgtcggcgaggcggtcgaccagacgcaggttgccttcgtcgtcgacgtagccgacgtcgccggtggcgaaccagccgtccgcgtcgatccgctcgcagggcccttcctcgccgaggtatccgctcatcagctgcggtccgcgcacctggacctctccggtggaccacacgtcgacgggctgccgtgtggtggggtcgacgaggcggcactcggtgcccggaacgggggtgccgaccgtacccggacggtagtgctgcggtcgctgacagtgggtgagcggggctagttcggccatgccgtagccctggatgacggggacgccgaggtgcccctccagcacgcgggccgcctgcgggcgcagcgccgagccgccggagaggaccgcggtgagccgcaggccgcccgggacggcgccgggcaggcgttcgtcggcggccagggcgtgcaggcgtgcgggcaggccgtagtagtgcgtggcccgcgtctcggcggcgacggcgagtgaggcgatcgggtcgggtgcctggcagagcacctggcaggcgcccgcgagcagcgcggagttgaggtgcatgacgtggtacagcggcaggtggttcacggtcacggaatcggcccgcagaccgtgtgccgtggcgacctgccacgcgttggcgacgatgttgcggtggctgaggagcacgcccttggggacgccggtcgtgccggtggtgaactgcacgcaggcgaccgcctccggatcggcgtcctgtgccgccggctcgtagggcggtgccgcgtcgagcaccacgtgcaggggctcggtgtcggcgggcacgacgccgtcgggggcgtcggtgaccacgacggtgcgcagggcgggcagttcgtgccggatcttggtgaggggttcggcggtggcggtggtcacgagggcgatctgtacgccgccggcggccagcacgtgccgcagaccgtcctgcgcgagcagcgggttgacgaggacggccgtggccccggaccggatgacgccgtggtaggcggcggcgaactccggggcgagggcgtgggcgaccccgacccgggtgccgggcccggcacctgccgagaccagccagccggcgatccggtcggcgtaggcgtcgagttcggcgaaggtcagcacacgcgtcgcggtgcgcacggcgatgccgtccgggtcgcgccgtgccgcgcgccgcagcaggccgtccaccggaaggtcgctgtacgggatgtcacgcacgaggtgtctcctcccgtttcggtcgtggggtcgggcaccgggggcgtcgatgtccccggatggttctcaccgtccgccggggcgcttgaggaatcttcgaagaacactcgatcggcgccgcggaaagtgaggggaaccgctggaggaccaccgcacgaagagggagccacgatgacggtcgaagccttgcacacgagcgctgaacacccgctggccggcgcggagttcggtgtggtgtacgccgaggtccagcagttctacgcgcaccagatgcagctcttcgaccggcacgagggcgagcgctgggcggccacgttcaccgaggacgccgtcttcgccgtgccgacgctggacgccccggtgcgcggccgtgccgcactggccgcgaacgtcgcgcgcaaccgggcgcgtcaggaacgcgacggtgtgcagctgcggcactggatcggcatgctggacgtggacacgcgccccgacggcaccgcgcgcacccgcgcctacgccctggtctacgcgacggtgcgcggcggcgacccggcgctgtcgcgggtgtgtgtgatggaggacgaactggtgcgctgccgggggaagctgcgggtgcgccaccgggtggtgacccgggacgacctgtagcgcacgcgcgaaggagcgatgctcaggacctgtggatcggttccgggcgggacgcggagggcgtaccttcccgaatgatcctgtgatggtcaccgagtgggcccgcgtcgcggcgcgggtcggggaggcacgcccgtgccgagcgaagtgaacgccggcggcggtatcgagtccggctccctgatcgacgagatcgtccgcgagggcgcccgccgaatgccggcagccgcgcttgaggccgaagtcagccagtgggcgggggcggcgttggtgtcagtggccgcccgttgcgtgggcgaagggtccgtacagggctgcccattgcaggagcaggatggtcttgccgtcggtgatgcgtccgtcgcgggtcatggcgagggcttccgcgtagggcagttcgaggacctcgatgtcttcgccgtcttcctcgagtccgccgccggtcccggtccggtctgcgggggtgtagggggcggcgaagaagtggaggcgctcggtgactgagccggggctcatgtaggcgtcgaggacatgggtgagcggaccgagggtgacgccgagttcctcggcgctctcgcgccggacggcgtccacggggtcgtccgcgtcgagcaggcccgcggccgcttcgacgagcatgccgtcggggtggtcgttgacgtaggccgggtagcggaactgacgggtgagcaggacgcatccgcgttcggcgtcgtagggcaggacgacggcgccgttgccgcggtcgtaggtctcgcgctgctgggtttcccaacgtccgtcacggcgacggtagtcgaaggtggtgcggcgcaggacgtgccagccctgggaggtgagttcgacgtcgcggatcacgacgtcggggttgcggtccaggcctcgtccggcctggtcgagggcggtgcggccgcggtggtcgggtgtgtcgatgccggggcggcttgtcacgcgctctcccgcggggtgcggcagggaatctcggccgcgtcgtggtgaacgggcaggccgcggcggcgcgcagtggcgacgtcctggtcggctccggtggagtcgccgggcaggcgcagcacggcgtcgcagggggtcggtggggccggcgccggctgaacgcaggacgggcagggcgatccattccccgatgacggggaggtggccggccgcgaagac

SEQ ID NO: 317 - DNA, 2993 bp, Unknown
  Kingdom: Bacteria, Phylum: Actinobacteria, Class: Actinobacteria, Order: Streptomycetales, Family: Streptomycetaceae, Genus: Streptomyces
ggcggccggggaggccgcggcggccctgccggctcccggccgcgaggtctccgggcggctggtcctgccgctgggcggcggccgggaggcggtgctggccgacatgggcgccgcgcacagcacgcacgacctggcggtgctggtgccggtgccgagtgagcggccggtggtcttctgcggggacctggtcgaggagtccggcgagccgcaggccggcccggacgccgtaccgcagcggtggcccgccgccctggaccggctcctcgaactgggcggcgaggacgcgctgtacgtccccgggcacggcgcggtggtcgacgcgggcttcgtccgggcgcagcgggacgcgctggcggcgcgcttcggcgtgtcgcgctgatcaccgccggggatctccatatcgtcactcgaatgcgccagtactccgccgatctgaccccgccctggaagaagaagtccgcgccggtgccggaggtcgcggccgagccgggcctggtcgtggaggaaccggtgaccggtttctgcggcgcggtgatccgctgcgaggcgggcacggtgaccctggaggaccgcttcggcaagcaccgcgtcttcccgctccagccccgggggttcctgctggaggggaggccggtgacgcttgtgcggcccgccgccggtccggtacgtcccacccgtacggcttccggttcggtcgccgtgcccggcgcacgcgcgcgcgtggcccgcgccgggcgcatctacgtggagggccggcacgacgccgagctggtcgagaaggtgtggggcgacgacctgcgcatcgagggtgtcgtcgtggagtacctggagggcgtcgacgacctgccctcgatcgtcgccgagttcgcgcccggcccggacgcccgcctcggcgtcctcgtcgaccatctggtccccggcaccaaggagtggcggatcgccgagtcggtgaccagcgagcacgccctcgtcgtcggccatccgtacatcgacgtctgggaggccgtgaagccgtccgcgctgggcatcgaggcatggccccggatcccgcgcggccaggactggaagaagggcgtctgccgcgccctggggtggccggagaacacgggcgcggcctggcagcggatcctcgggcgggtgcggtcgtacaaggacctggagccggagctgctgggccgggtcgagcagctgatcgatttcgtgacggagcccgcttagggcctgccgggccgggggcctgcccggcccggggtcagtccaccaggtcgcgcaccacggcgtccgcaaggaggcgcccgcgcagggtgaggacggcgcgtccggcgtcgtacggcgcacgctccaggagcccgtcggacagcgcgcgccgggaggcggccaggccctccgggtgcagcaggtccagcgggacgccctcccgcagccgcagttccagcaggatgcgctccacccggcggtcctcgtccgtgaggagttcgcgtccggcgcccggggagcggccctcggcgagggcgccggcgtacgcgccggggtgcttgacgttccaccagcgcacgccgccgacgtggctgtgcgcgccggggcccgcgccccaccagtcggcgccgcgccagtacagctcgttgtgcaggcagcggccggcctcggaggtggcccagttggacacctcgtaccactcgaagcccgccgcggacagcgtctcgtcggcgatcaggtagcggtcggcgtgcacgtcgtcgtcggtcatcgggacctcgccgcggcggatccggcgggccagctgggtgccctcctcgacgatgagcgcgtacgccgagacgtgatcgggcccggcgccgagggccgcctccagggaggcgcgccagtcgtcgtcggactcgccgggggtgccgtagatcaggtccaggttgacgtgctcgaaaccggccgcgcgggcctcggcgacacaggcctcggggcggccgggggtgtgggtgcggtcgaggaacttcagcacgtgctgccgggcgctctgcatgccgaaggagatccggttgaagccgccctcgcgcagggccgccagatacgccgggtcgacggactcggggttggcctcggtggtgacctccgcgtcgggcgccaggccgaactcgtcgcggatcgccgccagcatcctcacgaggtcgtcggcggcgagcagcgtgggcgtaccgccgccgacgaagaccgtacggacctggcgcgggtcgtcgccgaggaccttgcgggcgaggcgtacctcgtcgacgagggtggccgcgtagttgtcgcgggaggcgagcacaccgccggtgccgcgcagctcggtggcggtgtaggtgttgaagtcgcagtagccgcagcgggtggcgcagtagggcacgtgcaggtagaacccgaggggccggccggcggcgccggcgagcgcggaggcgggcagcgcgccgtcggcggggacgggctcgccgtcggggagtgcggagggcatgccttccattgtcccgtacggccggccttgtccagtacggccgccctcaccgggtcccgtaccgccgccctcactgcgcctggagcaccagcagggcgaggtcgtcctcgggcgggccttcgccgaagtcgtgcacgaggtgccggatgcgttcggcgatcaggtcggcgtcgaggcccgcgcagtcggcgagggcggcggcgaggccgtcgccgtcgtcgaactggcgcgggcccgagcgccgctcggtcaccccgtcggtgacgcagagcagggtgtcgccgggcgccagctcgaagctctcgcacacgtacgtctcgtcctcgatgacgccgaggagtgtctgcggccgggcgaccgtgcggacgtcgccggcccgggcgaggaccagcggcagcgggtgaccggcgcaggcgagcgtgcaccggacgccgccctcgaagggcgccagctcgccgtagaggagggacaggaagcgggtctgcggggcgtcgcccggtacgacggg

SEQ ID NO: 318 - DNA, 10159 bp, Unknown
  Kingdom: Bacteria, Phylum: Actinobacteria, Class: Actinobacteria, Order: Streptomycetales, Family: Streptomycetaceae, Genus: Streptomyces
acgcgctcgccggccatcttcagccagcggtgcaggtgctcgttctccgggaagagctccatgatggccttgtcggtggcctcgatgtccttcgggtcaccggagagggcggcccagcggaaggggccgaggccctcctcgaacagcggccggatgtgggccggcacgaagccggggaagtcgaacgcccgctggtagccggccttgcgggcctcgtcgcggatcgagttgccgtagtcgaagacctcggcgccggcgtcgaggaagccgaccatcgcctcgacatgacgggccatggacgtgcgggagcgctcggtgaagccggcggggtccttgcgggcctgctcgtgccactcctccacgctcactccgacgggaaggtaggacagcgggtcgtgggcgctcgtctggtcggtgacgatgtcgatgggcgcgctccgccggagcagctcggggaagacctcggcggcgttgccgaccaggccgatggagagcggcttgcgggcgtcgcgggcctcgacggcgagacgcagggcgtggtccaggtcgtcggcggccacgtcgaggtagcggtgggcgatccggcgctcgatgcgggacgggtcgacgtcgacgcagatcgccacgccgtcgttcatggtgacggccagcggctgggcgccgcccattccgccgaggccggcggtgagggtgatggtgccggccaggctgccgccgaacttcttgcgggccacggccccgaaggtctcgtacgtgccctgcaggatgccctggctgccgatgtagatccacgaaccggccgtcatctgcccgtacatggtgagtccccgggcctccagcgaccggaactcctcccagttcgcccagtcgccgaccaggttggagttggccagcagcacacgcggcgcccactcgctggtgcgcatcacgccgacgggcttgccggactgcaccagcagcgtctcgtcgtccttgagcgtcttcagcgtacggacgatggcgtcgtacgcctcccggttgcgggccgcctttccggtgcctccgtagacgacgaggtcctcggggtgctcggcgacctcggggtcgagattgttcatgagcatccgcagggcgccttcctgctgccagccgaggcagttcagttcggtgccgcgcggggcgcggacggagcccggtgcttcggcggaaacgctggtcatgtgcactcctcacaggggatcgagcggttgccctgccatgacacgggagcgggacggccgcagccagcgactccgttcgtgtttctcggatccgagactcttcacgtccgtgacatcgcccgctcgtaacggggagcactcatcgaggagctctcctttaggatgcgagtcggggacggggcggcagcggggcggaggaagagaacggtgggcggcttgagcgtggatccggcggagctcggccggttgtacgagcagcgcacggccgctcccgcacccgcgtaccagcgcgtcaaggacctcgtcacccagcagatcgcgggcggccactggcgtgaggacgacgccctgccgtcggagagccagttcgtcgaggcgctcggtctgtcccggatgacggtcaatcgcgccctgcgcgagctggccgccgagggcgtcatccggcgggtcatgggcgtgggcagcttcgtcgcccagacgaaggccagctcggcgctgctcgcggtgcacaacatcgccgacgaggtgcacggccgcggccaccgttacgaggcccgtgtcctgtccgtccgcgaggagcgggccgacgacaagaccggcgcgcacctcggtctcggtgcggggcagccggtcttccactcgcgggtggtccactacgaggacggggtggcgctccagctggaggaccgctacgtcaatccggccttcgctcccggttacctggaacaggacttcacccggcagacgccgttcacgttcctctccaaggtcgcgccgctgggcaggggcgagcacatcgtggaagcggtgctggcctcgccggaggagtgcgagatcctcggtgtcgccccgaccgagccgtgcctgctcatccaccgccgcacctggtcacgggacgcgctcgtcagcatcgcgcggctgctgcaccccggttcccgttaccgtctcgagggcgcgttcgccacacactgacgctcacgcggcggccctcgcccgcgccccggcggcgggcgctctgcccgagacggccgcggtgagccgtgcggcgccctgccgcaggacgtcccgcacctggtccacgtcgtgcctgcagtgatggcggcgccaggtgctgctgatcgccgcgacgggccgcccgttgtggtcgaacgccgccacacccatcgaacggaacccgggggtgaccagttcgacctcctcggagcagccgcgctcacgttcctgggccagctcgccgaccagtcccggcagcgtccgcggccccctgcccgtgcgggtggtcaggtcgcccggccgggggaagagcgcccgaagctgcgtctcggaggtgtgggcgaggatggcacgcccgttggccgtgaggtgggccggcagacggacgccgatgtcggtgacgagggcgatgtcgacttcaccggccgggcccgcgggcggccgttccttgagcaggtagaccgtctccgcgccgtgcatgatccccaggtgcaccgtctggccgaggcggctcgccagggtgcgcaggatgggctgggcgagccgttccaggggctcgtgccgcagataggcggagcccacttcgaacgaggtcacgcccagtccgtacgcctgctccgccggtacgtaggtgacgaaaccgcggtcggccagcaccgcgaggatgtggtacgccgaggaccgcggaatgcccaggtcacgggcgagcgtcgcggcctgcacaaggccggggcgcccggcgaggtacaccagcatgtccagggcccggccgacggccggtgacgcgctcgacgccgcgctcggtgacgacggcctgcccggcgtcgtctcgtgttcactcaccggatcacctcttgacgctcctgtatagacaggaatatacagactgcgatccgctgctgggcgctcggacgacaccggcgcggtcgggacagacaacgctccgccgttccttcgcggcgcacaccccgaacagggagacactcgtttgcgtaccgacaccgccggcctgagccgagggctccggtcccggcacatccgcttcatcgccctcggctccgcgatcggaacggggctcttctacggctcctccgagtccatcaggaccggcgggcccgccgtcctgctggcctatctgatcggcggagcggccgtcttcctcgtgctgcgttccctaggtgagatggccgtggcctccccgagcgccggctccttcggcgagtacgcgacgaagcatctcggccccctcgccgggttcaccaccggctggacgtacgccttcgagatggtcatcgtctgcgtggcggacatcaccgcggtcggcgtctacatgggcttctggttccccggcgtgccacggtggatctgggtgctggccgccgtcctgctcatcggcgccctcaacctcgtcagcgtgaaggtcttcggtgagctggagttctggctctcgctggtgaaggtcgtcgcgatcgtggcgatggtcctcgtcggcatcgccgtgatcgccttcggcctcggcagcggcggcgcccacgtgggcgtgtcgaacctctggaacaacggcggcttcttcgcgggcggcgcgaaagggttcgtcatctccttcgccgtggtgatgttcgccttcggcggcacggagatcatcggcgtcaccgccggcgaggcggagcgcccggagaagaccatcccgagcgcggtcaactccatcccgctgcggatcatcctcttctacgtcctgacgctcgccgtcatcatgtcgatcaccccgtggcaggacatcgacgcctcgggcagccccttcgtcgagatcttcgccggcgtcgggctcaagtccgccgccgccgtgctgaacctcgtcgtcctcaccgccgccctgtcatcgatcaacagcgacatcttcgccgcgggccgcaccatgttcggcctggcggagcggcgccagggccccgccgtcatgcggcggctgacccgcaacggcgtgccgtgggtgaccaccgtcatcatgatcgcggcgctgctggtcggcgtactgatgaacgccctcatacccggcgagatcttcctcgtcatctcctcgatcgcgaccttcgccaccgtctgggtgtggctgatgatcctgctcacccatgtgaaggcgcgcaggacgatgtccgccgaggaagcggcgtccctgaagttcccggtccctttctggccctacggtcagatcgccgccatcgtcttcatggccgcgatcatggtgttgctcggcttcgacgacagcacgcgggtcgccctcgtcgtcggcgtcgtgtggctggcactcctcgcgggcgtccacgccctctgggtccggccacggcgtcccgccggcccgcagatcgcggacggccggcgggacgccgtcgaccgacgcccggcagaagcccggagcgtgtccaccgcggatcatccctgagagccggcctccccggccgcgaccggcacggcggtgtcctcacggcgggccaccgccacgccgactgcaccgacgatcagcagcgcggcgaccgtgccgagggtgaacgtctcgaacgagacgcgggagacaccccagacgccgtggaagtcgtagccgatcccgaagaggtgttccagcaccccggggaagagcgccgaccacgacccgatcaggatccaggcgtagacgagcaccgcgcagatcaggaagccgcgggtgccgaagggaacgcggtagggccgcgggacgtccggccggcgcagccgcagcaggaccagcgcggggatgacgaccaggtaggacagcagcagggtggtgaccgcgaccgtgagcaccaccgcgaacacatcggccgcgtcgccgttcgcgagccgcatggcggcgagcatgaacaccgtggcgacgacaccggagagcagattggtgcgcaccggagtgccgagccgcgggtggaaggtgccgagtgcgcgcgtgaagaagcctccgtcggcggcggccatggcctgcatgcggtcgctgacgatcatccaggcactgccctgggtgagcagagcgaggacgaacatgacggcggtgatcttcagcagcggtccggcggcggggccgtagacgccgaagaccaggcgcgcgccttccatgaaaccgccgatgccggtgacctggcgggcgggtacgacggccagcagggcgaggaccggcagcaggtagcagcaggccgcgacggtcgcggagcggccgagcgccgccggcacgtcggactgcgggtcgtgcatctcctcacccgcggcgttgggcgcctcgaaaccgacgtaggcgaacagcaggatcggcaccagggcgaggaaaccggcggtcgtcggcgtgaagctggtctccgacaggccgtggaagccgtgccgcatcccgtagagcacggcggtcagggtgaacagggcgagggcgaggaccttcatcgccgcgcccgccgtcgtgatccacttgccgcggcgcagggagaccaccgccgtcaggatggccacccagacgaagagcagcttgaagacgtagtcggccaccgtgcccgagcccaggtggaagacgaagccgtcccaggtctgcgcggcgaggaagaccagcgaaccgcccagccagatcgggttggtgacccagtacatgagggtcgtcagcgcggccgccggacggccgagcgcgagcttgacccatacgtacgggccgccttcctgcgggaacgcggcgccggtctcggcgaacagcagggcgtaggggatgaggaagaacaacgcgatgaccgccgtccaggtggcggcctcgccgccgccggtggcgatctgcccgacggtgtcgaaggagatgaccgcggcgatggccatcgcggtgatgtcgaagcgcttgaggctgcgctgcagcgcgccgccggtctcgggctgtgaggagcgtgcttcggtcgtcgagaggtgggaggacacgggcagttcctaggaggggagaggagtaactgcgaggaggcgcgtgcagggggcgccgctacggtgtggggtccgtgtcgggtggtgctgggcgggggcccggtcgcggaccgggccccccttcgaaggtgtcaggcggccgaaggcgtcaggcggcgcggatctcaccctgggggtcggtgcgctccaggacgccgcgcagcgcaccggccacttccttggcctccgcctccgtcatgatcagcggcggggacagcacgaggctgtgcgcggagtcgcggacgatcacgccggtctcacggcggatgacgtcgtgcggcatccggtccgggttcaggggcaggggctcgcgggtggtgcggtccttgacgagttcgacggcgagcatcatgccgaccgagcggatctcgccgacgatcggcaactcgccgagctgcgcctgcagttcaccgtggaggaaggcgcccaggctggtcgcgcgggcgagcaggccctccttctcgatgatgtccaggttggcggtggcgacggcggtggcgacggggtggccgttgtaggtgtagcccatcgggaagccgtgctcgcgcagcagcgcctcggcgacgtggtcgcccaccaggagcgcgccgagcgggacgtacccggaggtgatgcccttggcggtgacgatgatgtccggggtgacgccgaagtactgcgcggcgaaccactcgccgacgcggccgtaggcggtgacgacctcgtcgaagatcagcaggatgccgtgccggtccaggacctcgcgcacccggggccagtagtcggccggcgggacgagcatgccgccgacacccatgatgggctcgccgatcatcgcggcgatgttctgcggaccgatctcgtcgatccgctcctccagctcgcggatcaggaagtcgctcacctgcgcggggctcagcggctggtcgccgtacagctcgctgcggtacggccacggcggggtgaggtgggagacgtgcggcatcatcggggcgaagccctcgtggtagaccgggaagccggtggccgaaccgccgccgtagccgatgccgtggtacgccttgctgcgcgccaggatccaggtgcggctgctctcgccgcgccggtggtggtagtagcgggccatcttgatggcggcctcgttgccctcggagccgcccgaggtgaagtagacgtggtccatgccctcgggggcgatggaggccaggcgcgcggcgagttcgatggcgcgctcgttggagaactcccagaagctggtgaagtactccagcttcttcatctgctcgtgggcgacgtcggcgagttcggtgcggccgtggccgacctgcgcgagccacaggccgccggtggcgtcgaggtagccgcggccctcggtgtcggtgaggcggcagccggagccggaggtcatgacgacgcgctcggtggcgctgcccggcaggtaggggtggatgatgtgcgcccggtccaggcggacgaggtctgcggcgtcgagggtcatgagggttgcgtcctttgtccgtgacagtgattcggtggtgtggccggcgcggtcaggagtgggcgatccaggtcgtcttcaggccggtgtacttgtcgaaggagtgcagggagaggtcgcggccgtggccggactgcttgaagccgccgaacggggtgaacgggctgagcgcgtcgacggtgttgacggacacggtgcccgcccgcagcgcgtcggcgacgcggtgcgcccggcccaggtcgcgcgtccaaagggaggcggcgagcccgtaggcggagtcgttggcgaggcggaccgcctcggcctcgtcgcggaagggcagcacggtcagcacgggaccgaacagttcctcccggacgagcggggcgtcgggcgcgaggccggtgacgacggtggggtcgaggtaggcgccgtcgcggtcggggcgcgtaccgccgcacaccagcgtgccgcccgaggagtgcacggctgagtgcacggcttcgaggatgcggtccacctgggcctcgtccacgagcggtccgaggcgggtggcggggtcgagcgggtcgcccggcagccaggtgcgggcgtgctcggcgaccgcggccgtgaactcctccgcgacggacgcctcgaccagcaggcgggtgttggcggagcacacctgcccggagttgtagatgaagccccaggcggcgcgctcggcggcggcctccagatcggcgtcggcgaagaccacgttggggctcttgccgccggcctccggccacacctgcttcatgttcgactcggccgcgtaggcgaggaaccgcttggcgacggcggtggacccggtgaacaccagggtgtccacgtccgggtgcagaccgagcgcccgcccggtggtctctcccgggcccggtacgacgttcagcacaccgtcggggagcccggccgccgaggcgagttcggccagcagcagcgccgacagcggggactgctcggccggcttcagtacgacgctgttgcccgcggccagggcgggcgccagcttccagctcgcgatgtccagcgggaagttccacggcaccaccgcgcccacgacacccagcggggcgcggcgcaccagggcgagattgccgggcggggccggggcgacctcgtcgtagagcttgtcgacggcctccgcgtaccaggcgaagacgccggccgcgccgggcacgtcggtgccgtgggactccgcgatgggcttgcccatgtcgagggtgtcgcacagggcgagttcctcgctgtgctcctcgatgaggcgggcgagcgcgagcaggacccgcttgcgctcggcgggcgcggtgcgcgaccagcggccgtcctcgaaggaggtacgggccgcggccaccgcccggtccacgtcggcggccgagccggccgccacctcggcggtggtcttgccggtcgcggggttcacggtcgggaaccactggtcgccgtcggggtcggcccacgcgccgtcgatgaacaggcgcgtgcggggcgtgaggtcggcggcgcgctgccgccagtgggcgtacgtctgcatgctgtggccttcgaagcgtcgtgtgcgtggtggacgtcgtgtcgttcgtgctcgtcgtgctcgtcgtgctcgtcgtgctcgtcgtgctcgtcgttcgtcgtgggacgtgggcgaaccggtgcccgttcggatccggtgcggccggggtcgcctcggaggtgccgccgcgaatcggcgggcgaggcagggacgaggggctcggcagcgagtgcgctgcgccggtttctttgagtcgagattcaaacaataggtgaaccgaccgtcaatgccccggcggaaacttcttgcgaagactgatgtctgtgacagagaatcactcgtcatggggaaagcgggcagaccacgcaaccagacggcacgcaggcaggccctcgtcaccgccgcgggacaggccatcgcggagcgcgggctggaggggctgcgtatcaaagacatcgcggacgcggcaggcgtctcccagggctcggtcctgtactactacccggagctggacgacctcgtcctggaggtgcaccggggcgcggtcgagagctacctgggcgcacgccggcgggcgtacgacgaggcacccgccgcagggcccgcggcgcggctgtcggccctgctgcacagcggcctgccgagcatgaccgacgatccggtccacggactgctctacgaactgcaccggcgcgccggccgcagccctggccacgccgagctgatgacctccctgttcgcccgcgaggtcgcgctctacacgaccgccctggaggtcggcgccgcgaccggcgcgttcgcgctcgccgcgcccgcgcacgacctggcgcacggactggtggccctggaggacggctacggcctgcacatcgtcagccgcaacgcggctctgcgccccgagcgcgcccaggagctgatcctggcccacgcgagggcggtgacgggctgcgccgagctgtagagcccggtccgccgggacatggacgaccc

SEQ ID NO: 319 - DNA, 3907 bp, Unknown
  Kingdom: Bacteria, Phylum: Actinobacteria, Class: Actinobacteria, Order: Streptomycetales, Family: Streptomycetaceae, Genus: Streptomyces
cgcccgcgcgaagacggagggcaccttcccgtacgcggccgacctgtgggccgagggcctgctgtgggcggccgtgctgcgctcaccgcacccgcacgcgcgcatcgtgtccgtcgacaccacccacgcgcgcgagatgcccggcgtccgcgccgtcgtcacccacgaggacgtgcccggcagcccgttgtacggcaggggcgtggccgaccggccggtgttcgcctccgacgtcgtacgccaccacggcgagcccatcgccgccgtcgccgccgaccacccggacaccgcgcggatggccgccgccgccgtcatcgtcgagtacgaagtactcgacccggtgaccgacccggagcaggccttcgaggccgaacccctgcaccccgacggcaacctgatccggcacatcccgctgcgccacggcgacccggaggcggccggcgaggtcgtcgtcgagggcctgtaccgcatcggccgccaggacccggcgcccatcggcgcggaggccggtctcgcggtgccccgccccgacggcggcgtcgaactgtacgtggcctccaccgacccgcacgccgaccgagacacgctggccgcctgctacggcctggcccccgagcgcgtgaagatcgtcgtcaccggcgtgcccggcgcgacggccgaccgcgaggaccagggcttccagctgccgctcggcctgctggcgctgcgcaccggctgcccggtgaagctgacggcgacccgcgaggagtcgttcctgggccacgtccaccgccaccccaccctcctgcgctaccgccaccacgccgacgccgagggccggctggtgaaggtcgaggcgcagatcctgctggacgcgggcgcctacgccgacacctccgccgaggccctggccgccgccgtgtccttcgcctgcggcccctacgtcgtcccgcacgcgttcatcgagggctgggcggtgcgcaccaacaacccgccctcgggccatgtgcgcggcgagggcgccctccaggtgtgcgccgcctacgaggcgcagatggacaaactggccaggaaactcggcgtcgacccggccgaactgcgcctgcgcaacgtgctggcgaccggcgacgtcctgcccaccgggcagacggtgacctgcccggcgccggtcgcggaactgctccagaccgtacgggaccacccgctgccgccgctgcccaaggacacccccgaggacgagtggctgctgcccggcggccccgagggcgcgggcgaaccgggcgcggtgcgccggggcgtgggctacggcctgggcatggtgcacatgctcggcgcggagggcgccgacgaggtctccacggccaccgtgaaggtcagcgacggggtcgcgaccgtgctctgcgcggccgtcgagaccggccagggcttcaccacgctcgcccggcagatcgtccaggagacgctgggcgtcgacgaggtgcacgtggcgcccgtcgacaccgaccagcccccggccggcgcgggctgccgcggccggcacacatgggtctcgggcggtgcggtggagcgggcggcgaagatggtccgcacccagctcctgcagcccctcgcgcacaagttcggcatgtccaccgagctgctccagatcaccgacggcaagatcacctcctacgacggcgtcctgtcgaccacggtcaccgaggccatggagggcaaggaactgtgggccacggcgcagtgccgcccgcaccccaccgagccgctggacgaggccggtcagggcgacgccttcgtcggcctcgcgttctgcgcgatccgcgcggtggtggacgtggacatcgagctgggcgcggtccgggtcgtggaacttgcggtggcgcaggacgtcggccgcgtcctcaaccccgcccagctggccgcgcgcatcgaggcgggcgtcacgcagggcgtgggcatcgccctcacggagaacctgcgcaccccgcgcggcctggtccgccaccccgacctcaccggctacgccctgccgacggccctggacgcgcccgacatccggatcgtgaaactggtcgaggaacgcgacgtcgtcgcccccttcggcgccaaggccgtcagcgcggtccccgtggtcacctcgcccgcggccgtcgcctccgcggtgcgcgccgccaccggccgcccggtcaaccggctgccgatccgcccgcaggccgcggtcgtcaccggccggtgactcgccgttcccctggcgttcgcgcaggtcgggggcgttgtcagtggtgcggcgtaatgtgctgggcagtggggacgacggcgcccgcccgtagcgggtgagtccggccgcgccccgcccggaccgggccccgcccgcgcccgggagccgttcagcacgggggacacggggacagatgagcacgaccggcaccgccactgcggtgatcacccggcccgaggccggcctcggacggtacgtcacacacgcgccgacgcaccgcagaccgaccgtccccgggctcccggccgccagcatgctgccggggttcggggcgccgcgacgcgacggcctgctcacactcgccgactccaccggtggctccgcccgcctgtccgccgaactgcgcggccagttcgcctcctaccccggccggtacggccgggagacggtcgccgaggcgtcccgccggctcctcgcggtttccgaggcgggtagggacggcgaggagccgccgttccggaaggccgccgccctgatccgccgcccggccctgaccacgggtccccgcacgcgctcgggcctcaccctcgacctgcccgcccgcctccttgagcaggagttcgggcccggccgcgtcgcccgcttcgaggacgtcgacttccccgccacgctcgcccacgagccgacccgccgcttcctgcgcgagacgggcctgcccgaggacggcctcctcttccgcctggacaccgacatcccgctgcccaccctcgccgagtactacgccgaagaggactccgcggactttccgcccaccggactcccgctcgacgccgaccggttgatacgcctgggccgtctcgtcgacgacaacagcctggtggtggacggcggcacgggcgcggtgtggaactggagcgagtccgaggcgacgctccacccgctcgacgtggacgtctccgccctggccttcgccctctggctgctgcaccgcgagaggcggacctgtctccaggacgaagcgggcggagcgctctgaagcaccccgcccgcgctctccccctcaaccggaggccgtggcgggaatcgaacccgcgtaactcgctttgcaggcgagtccctcaaccactcgggcacacggccgtgttcgggacgctgagtgctcgtcccggactcggttcaccgaccgtaggacgggcgcgggcggtggctcaaggagacggcgggtgccgcaacgcgactgccacacgccgttcacaaaggcagggggccagggggcgttcatgaaggccggggaaaggaggatcggatgcgttcggtcgtacgaccaaggtcccggaccgggaccgactcccgacaggggtcaaagccgcttgcggaccttacgctggcgaccatgaccgtcctcgaaccacgcgacaccgacgtcgcaggcccacctgacccgcgccggacgcccttgccgcgggaggcggcggccgaggccaccgactcggtgctgggccgcgcctaccgggcgctcagcgtcgggatcgtctccgtcgtgctgctgatcgccttcgaggcgaccgccgtcggcaccgcgatgccggtcgcggcgcgcgaactgcacggggtgccgctgtacgcgttcgcgttctcggggtacttcacgaccagcctgttcgggatggtgctcgccggtccgcccactgcccggcgagcaccatcccgaac

SEQ ID NO: 320 - DNA, 1645 bp, Unknown
  Kingdom: Bacteria, Phylum: Actinobacteria, Class: Actinobacteria, Order: Streptomycetales, Family: Streptomycetaceae, Genus: Streptomyces
aaagggcgcgcctgccctccggacatcccccgcacggagggcaggcgcgccctttccccgccgttcccctgctccgtcccgggaggacccttggacgcgttcaccggcctgttcgacggtcccagggcgcgcggcgccctgctgcgtcccgaggtcctcaccccgccgtgggcgctgcgcggggaggacggggcgctcctcgccctggtcacggtgctggacggcgccgcctggatccggcccgcccacggcgcggccgtacccctgagtgccggggacgtggccgtggtccgcggtcccgacccgtacgtcgtctcccacgccccggacaccgacccggcggacacctcagacaccgtgggggcgtcgggcagcgggagccgcacggtgctcctcacggccacctaccgggcacccagcgagataggccgccgtctcctgctcgccctgcccgacgtgctggtgcgtccggcgggagccggccacgagcccctggtcaccctgctggtgcaggaatcggcgaaggacgaacccggccaggaactggtcgtggaccggctcctggacctgctgtcggcccacgtcctgcgcggctggttcaccagccgcgagtccggggcacccgcctggtaccgggccggcgacgacccggtggtcggccccgcgctgcggatgctgcacgagaggcccgcgcaccgctggaccgtcggggagatcgcccaggagacgggcgtctcccgcgcccagctggcccgccgcttcaccgaggtcgtcggcgagccccccatggcctacctcgcgtcctggcgcctgaccctcgccgccgacctgatgcgcgccccgggcggtatccgcctcgccgaggtcgcccggcaggtcggctacggcagcgccttctcgctcagcacggccttcaagcgggtacgggggatgacgccgaaggagtaccgggggctgacgacggccggcggtcaccggcgcggaccggcccgaccgcgtcgcgcccacggctgagggccgccgtccccggacgggggacggcggccctcacggtgtgcccggcgacatgaactaccggttctcccgcgccagttcgccgaccgcgctcaccaccgcctgcggcgcctcgaggggcagcatgtgcccggcgtccgggagctcctcgaagcgggcccgggggagggcctcggccacgacacggcccaggcgcggcgggatcaccttgtcgcgggcgcccgcgagaaccaccgcgggcacggtcaccgacaccagggcctggcgcaggtccatgccccgcgaggaacggaacgcctcggcccgcaccgcggggtcggtcgcggcgaacatctgccggttgacctcgcgcagctgccgcccggcgcccggacccagcatgttctggccgagcagcttgcgcccgagggccggccgcgagacggcccgctggaacagcgcgctgcccatcatgcggacctcgctgtcgggggtgtcctggtcgtgggccgccgtgcccaggagcaccagtccgcccagccgctccgcgagcggggccgtggacgaggcgtacgacagggcggcgaacccaccgcccgagtgcccgacgacgaccgcgccgggcgcctgcgcctggtcgagcaccgccgcc

SEQ ID NO: 321 - DNA, 1254 bp, Unknown
  Kingdom: Bacteria, Phylum: Actinobacteria, Class: Actinobacteria, Order: Streptomycetales, Family: Streptomycetaceae, Genus: Streptomyces
gcccggatcgcggcgacctgcgcgggccggtgcgcgcgctcctccgtcccggtctcgttgccgtcgccgtccatggcgcgtacgcggaccgcgacgccctcggtgaccggcggcccggcgtcgtactcggggtaggcggggaacggagcggtgacgaccacgtcgagggacggcttgagttcaccgccgagcgccgaccagatctcggccagcgaacgggactcggtctgggtgccggccaccgacaccgggacgctcatgcccagcgcgcccagcgcaccgggcaggtcggcggccgggatcacctcgcgtgggatgagcgtggccagcaccgcggacagcagccggtgctcgtcctgcggctgccgggtccacgccgtcaccaggtacgacagccggaaccagcgcggcggctggcgccgcttgacgatcacgtcccgctcgtcggtcacggggatgtggccgcgctggcggcggttgacgtcctcacggatgtcgtacaggtaggcgttgatggtgggcgcgttgcggcgggcggcccagtcgcgggtgggtgcgtcgaggaccacctcgataccggaaccggccagcgcgccaccgccgagcaggctcttgaggacctcgtccacttcgtggatcaccgtcgtgctcctgccctgccgtgctctgtgttccgtgtgcgtcgtcgtgccgtgtgcgtcgtcttgcgtgtgcgtcgccgcgcccggcgccctgccgccgtccggtcctcgatcatgccccgcccccggcccgtccccgcaggagcgccggggaccgggacgaggcagaccgggctgccccgggggccggtaccggatgcccgttcggtcagatgtagccttcccggagggcatgggcgacggcatgcgcccggttgcgcaggtgcagccgggtggtcagcccgtgaatgacgttcttgacggtccgttcggagtaggacaacttgccggcgatctccccggtgtcgaacccttcggcgaccagccgcagcacgtcgacctcacgcggtgtcaggccggagccgggcgcgccgggccggccggccgcgttgcggtgcagcgtgccgacctggtcgatgagccggccgagcaggtcggcgggtacgagccggtgcgcgccggcctcgtggcgccacacgatggcgcccaccccgcactcgatcacgtcgagcagttcggcctcgcgcagcgagctgacgacgagcacggcccgcgcgccctcgctgcgcaccac

SEQ ID NO: 322 - DNA, 11332 bp, Unknown
  Kingdom: Bacteria, Phylum: Actinobacteria, Class: Actinobacteria, Order: Streptomycetales, Family: Streptomycetaceae, Genus: Streptomyces
gccctgagcccgctggaagccgtcgcggagacgtgacgcacggcctccgccccgccgcgccacacctcgccggaaccgagcgtcaccgccaggcgcagaggacgggtgctaccgacagcgcaggtggccgcgtcgagggccacctcgccttctccgtcggcgccccggagccgatccggggcactcgaggccgtccgctcgctgcgcggagacctgcgcccctaccgggccgcggagtgcggtgcgccgccgaactcgacgagcgcgcccgcctcttcctggcccaccgcgactcgaactcctcacaggccccctcaccggcatctacgaccccaacggcaggggcgccatgttcttcgccgtcctcgccgtcgccgggcagatcgaacacgactacatcagggagaagaccctggagggccaggccagcgccgcgaaggggcgggatttgtgggctttggcgcccaggagatgccgtggccgtcgccgacgtagcgagtgaggccgtcacggctgacgagcaggggtggcgggtggccggcgttggtccgggacagtttccagtggccgtagtggcgcggcagttgggtcagcaagtggttctgcacggtctcggcgaccttgcgctgacgctggtaggggcgcgcattgccaccggctcctgccgcgggcctgcttcctgcgcttgctggtcccgcccggtcacagccgggtcagaggcgggccaggtcggatccgcgcacgctggtgcagttgcccaccggcaggttgattccgatgatgtgctcgttgttggccgtgtccgtgcagatcggaatccgcagactgacattgctcagatcggcgtcctccaggattgtctgttcgcctgcgttgtagtcacggacgcgggtctgggcggtgcgggttgcgggagccgttgcacggctcggagagggcggctggggcggggtgaccgtcaggcacttgccctgcgggctctgcccgacgggcactgcctgcgcggtcacggttgccttcagcggtccggtgttcttcacgcacagcgtcacgcgcatgttggccgcttcctgctgcgtgccgcggtacagctcgacgctgcggacctgtggggcccggatctgctcggtggccgaggcggggccggcgaccgaagcggccagggccagcgccgcgagagcggcacccgtcacgcgagaggtcgcacagaacatgggggcacttcctttccggcgggaacgatcgccgtggaaatgcccgttccgggggcggcccactgcgaagcagcactgcgcgaacccgaacgagggacagtatgggacaccggaccacgccagtgagtgaaccgcccgctgtgccgtcgcggggaggtccggcagcgcgcggacaagacgccataggatcgggcagcacacatcgccgccatcaacctacttcccgatcggtgagggcgggcagagccccgccctcacgccagcttcggcccaccagggctccggagccgtgtacttcacaggctcggtttccgcgccggagcactcagctcctggtcagggtgcggccgagaaggggcagcagacggttccagtgatgctgcagtgcggcggggttgaaggcagcggtgtcagacatggtgaacccgtggacggtgccgggatggatctcggaggtgcagccgacacccgccgcgtccagggccttgttgagctcgccgagagcctcgggcgtcaagccgctcacggcacgaccgaagtggacctcggtggtgagcttggaaagggtgtcgggtcgtcggctcccatgtgcggcacaacctgtgcgaagccgccctgagcgaggtcaaggcactcagtacctgctgggccaccgtgctggacgcgcccatctacgacggacccgcgcacagaccaccctcaccctcgaacgctggcaccaggcccacggtctgctcggccagggcgggggcctgctcgaatgcgcgcgccgcccgcacctggccctgaacaccgtcaaacgctatgcccgcgccgaccggcccgagcgcatgctccgcgtccccaagcaccgtgccggtctcgtcgatcccttctgcacaagtacatcaaccagggccgcgccgacgccgaccgcagccatatctccccgcgccggctcgcgcggatgctgctgaccaggcccggcaacctcaggccgagcaacaggagctccttgccaagctcaccgccgcctgtcccgaaatgacccaactgacctcgggcatcaggaacttctccctgctccttgcacctcacgccgacaacgccgaggcgctcacgaactgggtctcccaggtctgcggcgccgacctgcctcacttgcgtgtctccgcccgaggtctggaacgaaaccgcgaggccgtgaacgccgctcctcggatagcagcactctccggcaccaccgaaagtgagtcagggccgcccgttcgaacagaccccggggagcgggcgcagggccttcccacggtctttgacgggctcttccgaagcggacggcctcacgtctcttaccgcggccggtgcacatgccacccgttcggcccccttggtcgtcctccctcggggggagccttgctgtgcgccagttgccgggagcccagaggggaagcgcggaaggatcaggatgagcgagtcggacgacggacgagcaaagggtgcgacgatcggagtcgtgatcgcccgctcggggcggctggcgaacctgggtaaccccctggacttcgccacgaccctgctgcggcccgcaccggtctcgaacccggccgtccggcccggtatccggctggcgagcaggggcagccgctcgtgcgccgaaggctgcccgcgagcagtggcggtcggttgcctggggaacggcgggctgcagggcgcctggtccagacacccgcaccggggcttcgcccctgcggctcgcgcccgggggcaccggctgttccagccgcggccctatcgtgagccggccgcctgtctggacgcccatggtcaggcgttccgcgacgcggaggtggacatcgtcaccagcgcggccaccggccaggacctggcgctgttgcccgctcaggccgccgagagcggctggagcccccgtctgatcacctgctcacgcttgctggcctacccgccgtcggtcgctcgcggcggcagacagccgccccagccgaactcggccacacgcctactggcccccggcccacccctacgcctcgtcgctcgacggcatgacagcggccgagctggccgaggcctacgaacaggccacggggcgccagtgaccgcagccgcccgggccggcgtatgcactgttcgaggtggccgcgcacgcgctgcgctctgccggcgaccccaccggccgccgcgccgtggccgcggccctgggccgtacacggctgcgaacgatggcgggtctaccggactggaccaggggaccggtacccaacatcgccaccgtcccactggccggcgcgcagtggcagcaaggcacgcgccacgactacgaactcgccgtggtcaccgccggacaggccgacggggctcacggccggcggagaccgcgtcacgacgtgaccgcgtctcggacggcgggcggaggacgcatggacgtgttggtggaagaagtcgtcgacgggccgtcccctgtgccctggcaggccggggacgcctggctggcgggcggcaccgcgctgttcgccgagccgcagcccggtgtgcggaggctgcgcgatctcaccgggttcggatggcccgtgctggcggtggccgcggacgggatcgacctggccgccacctgcaccgtcgccgaactcctgtccttcgctgaggcgccggacgggccgtggccgacgggccgcgcgctcatcgcccactgctgccgggcgttctcgtcctccttcaaggtgtggaacaccgcgacggtgggcgggaacctgtgcgcggcgctgccggccggccccatgatttccctggctgtggcgctgcgggcgacgctgcggctgaaggacctcgacgggcgggaacgcgaggtggacgcgcaggagttcgtcaccgcgccgggcaggacgctgctgcggcccggtgaactgctgcgttccgtccaactgcccgccgcagcgctgatggagcggcacacgctccgcagggtgagcacgcatccgtggggccggtccgtcgccctggtgaccggggcctgcgacccggcgaccggacggctcaccatcgccgtcaccgccggcaccacgaagccgatctccctctccttcagccgtgtcccggccgccccccggctacggcacgcgctcatggaggccctgactcccgacgtcctgttcgaggacgtgcacggacggacggactggcgtcggcacctgactctgctcctcgccgacgaggtccgcgaggaactggcggaacggagatagcccatggccttccgcgtaagagtcgacgaccgcgagagccgcgagccgccgcgaccggggcaatgcttgcgcacctacttgcgcgagcacggccaccacgcggtgaagaagggctgcgacacgggcgactgcggcgcgtgcacggtgcacgtggacggactggcggtgcacagctgcctgtatccggcacaccgcgccgacggacgcaccgtcaccaccgcggaaggcctgggcagcgcagaccgcacgcatcctgtccaggaggcgttcgcgagggcgcaggctttccaatgcgggtactgcacgcccgggttcgtcatgaccgccgcggtcctgacgccgtgccaggccgacgatctgccccagtcgctgaaaggcaacctgtgccggtgcaccggttaccggccgatcggcgaggcggtacgcgcggcccacgcccctcacgcggaagcgatccggcccgtcgccggcacaccggatccggtcacccggggcgtcgtcaccggcacccaacccttcaccttggaccttcccgaaccggagggactgctgcacctcgccctggtgcggtccccgcaccgccacgccagggtcctggacatcgacgccgccgacgcactggccctgccgggcgtccatgccgtactcacccaccgggacgcaccccacacccgcttctccacagccctgcacgagaacaccgacgacgaccccgcagaccagcgtgtcctggacgacgtcgtacgccacgtgggacagcgcgtcgccgcgatcgtcgccgacacgcccgccaccgccgtccgagcatcccgactggtccgcgtcacctaccgggttctgcccgcagtggccgagcccgaacaggccctgctggcggacgcggtgcgcgtgcacgaggacggcaacatcgccggggagttccatcagtccctcggggacaccgggcgaggcctggccgaagcggaggtcgtccacgaaggcgtcttccacactcaacgggtgcggcacaccgccttggaatgccacgccagccgcgcctggaccgacccggacggccggctccgtctgcatgccgcgacccaggccccgcacctggtccgccggcgcctgtgcgacgcgttcggactgccccccgaccgcctgcgcgtcaccaccggacggctgggcggatccttcggccggggacaggacctgcagaccgaggacatcaccctgctcgccgcgctgcacaccggccgtcccgtccaactggagcacacccgcaccgacgaactcaccatcaccaccacccggcaccccttccacgtcaaggtgaccatcggcgcacgccgggacggcaccctcaccgcccttgaactgagggtcgtcaccgacaccggcgcctacggcaaccagggaccctcggttctcgaagtcgcctgcaccgaagccctcgccctgtaccgctgcgcgaacctcaccgtcgacggctactgcgtgcgcacacacaacgtgcccgccggagccttccgcggctatggagcgggccagctcgccttcgccgtcgagtccgccctcgacgacctcgcccgccgtcttcacctcgacccgctgaccatgcgcgagcgcgcctacctgcgaccgggggagaaggccttgtccccaggttccggcggacggcacccggtgatggactcaggcctcgcccgctgcctggacgtcctcggccgtgtcaggacccggcattcccgcaaccgcccggctccggccggcgaacggcatgtgaccggggaaggcatggccgtggccacccggcacaccgtcccagctgacggacacatctccgaggcggccgtcaccctgcgcccggacggccactacgacctggccaccggcgtcccggacttcggcagcggcgccggcaccgtcctccgccgcatcgcggcccgagcgctcggcacctcacccgaccgcgtccacctgtccaccgccgacaccgacctcctcgaccaccacagcggcgccttcggctccaccggcgccaccctcaccggccgcgccgtcgaccgcgcatgccgcaccctcgccgatcgcctgaaagatctggcggctacctgcaccgctgccgcccccgacacttgccggctggctaccgacgccgtccagtgcgacggttccacgatcccgctcgccgccctgcacacctacgcccgcaccaccggaacgccggtctgtgccgacgcggccgccttcgcggacgacaccgtgccggccatggcgttcagcgctcagtggttccgcgtggaggtcgactgcgagatcggtctggtccgcgtcctcgacagcgtgcacgtcgccgacgccggcaccgtgctcgaccccggccagtgccgcgcgcagatcgaaggcgccgtcgtccaaggcatcggtaccacactccgggaagacctccgcaccgacgtgtcgggccacgtcaccaccaccgacctgcgcacctacctcatcccccacttcggcgaagtgccaccgaccgaagtccacctcgtcccgcccgaccgggcccagagcgccccgaagccgatgagcgagcttcccttcaactccgtcgccccggccctcgccaacgccgtacgcgacgccaccggcgtccgcttcaccaccctccccctccgccccgacaccgtgtgggccgccctgaacagcccccacccgccatgtggtgacccaggtgagcgagcaagtgaatgccgcgacacctgacgtggtgtgggcggcggccggccggtctgtaggggtgtgctgcttgacgtgacggccaagctcacgaggaggcacgggtgctggggcactggctggagaagaaacacccggccggcactcctgaccaggcccgtaccaagacggagccccgggagtccatcccgcggcgttcagaacgcgatccgcgacgcccgcacccgagccaccaccgccaccgccaacgaggcgacgaccgcaacctcggccgcctccgccgccgccgatcaccgcgacctcaagggcgaggcggcgtccgctgctcacgctgtcgaccacccaggccgggacgccgcgcacccggcgcagaaggccggcgccgtacaggcccaccagcaggccgcgatgcccaaggagtgcctaaaggaagggtggtgtggccgctgcttcaaccgccggccgcgcaggggctgcccggtggtctgatggcggcgtccgcacgacagcctcttcatgagcacgaacacgaacacgccatcgatggtctagagctccatggtgttccgcaaggtcattgccgaatccatgtccactgtcaagaggtcggacctattggatcagaccacttcacgcgctacgttcactgcagccgggggaagcgcagggagtttccggggccggacgcaacggcgcgccgccccgggccgcgctcgacgccccagccccgcgccggccccaccgtccccgactcgactcgccccagggaagaaacgtcaccatggaccgcagaaccttcatcggtatgctcggcgccgcgggcgtcaccgtcgccctgaccgcccctcagttcgctttcgcccccgccgccggcgcggcggacggggacccggccgccggacgcggagcgcaccagccgtacatgcacggctacgacgccgccgcgatcaagaactggaacccgcagagcgaccgcttcgcccggtacttccgctcgcgggtgcccctcgcccgccgcatcgcgcccttccgggcgacccaggcgaacccggcgctggcgaccggggcgcaggtgatgaacctgacgtacgactacgacaactcgttcttcacggcgtacaagtatgacaacgttttcccacgccgcctgctgcgcttctggcagtactccgacctgtacggctcctggcacggcatgcccgtcgacggttccccgaccgacaatccggtgcacggcgtggtcaacctgccgaaccccgcctggacggacgccgcgcaccgcaacggcgtgcgcagcctcggctgctggttctggccgcgtcccggtcacttcgccgactacctggagcagcgcccggacggctccttcccggtggcggacaaactcatcgagatggccgcctacttcggcttcgacggctacttcatcaaccaagaggccgccatctcacccgcagacgccgggaaactgatggagatgatcgtgtactggcgggcgcacgccccgaagggcttccatctgcagtggtacgacacgatcatggtcgacggccggctggactaccagaaccagctcaacgacaagaacgcgccctggctcctggacgacggcaagcccgccgtcaacagcatcttcgccaactactggctccccgacgccgcgcaggtcgagacctcgcgcaccacggcccagaagctgggcctggacccgtaccaggcggtcttccacggcacggagaacgagaagtacggctacaacccgccttacgacacccggctgatcttccccgagggcgaacccgcccgcaccagctggggcctgttcggctcgcacttcgtctgggaccgctacgccggacgcgacgacccggacgcccaggacggtgtcttcacccgggaacgccagtactggtcggggccggaccaggaccccacacgcaccggccgcaccgagtacgtgccgtggcccgaccaggacgacggcaaaccgagggacgcggacaacccgaagaagtgggacggcgtggcccactacatcaccgagcggtccgtcatcggctccttcccgttcgtcacccgcttcaacaccgggcacggacgcgcgttcttcctcgccggccgccgggcgagcgggagcgagtggaacaacgcgagcatccaggacatcctgccgacctggcagttctggacccgcagcgagggctcccgcgcccccctggacgtcgacttcgactacacgcgcgcttacgacggcggcagttcgctgcgggtgagcggtgacctcggcccggacaacaccacgacactgcggctattcaagaccgagctgagtgtacggacgggacgggagcgggtccgcctcacccacacccccacgcgcccgggcaccaccctggaggtgggcctgctcttcaccgacgcccccgaacggttcacctggctgcccctcggccacggcaccggcgaccgagccgcgcaccaggaaggcacggacgacacctggcagaccgtcacccaccgcctggacgcccaccgggggcggacgatcgccgcggtggccctgcgcttctccgggtcgcggcaggcgccgtacgacctcaacataggcgagctggcgctgctcgacggggaggcgtcgccgtccccgcggcgcccgcggtccttccgcgtcgacgccgcctacccgtccggcacgacggcggaggtcttcctgtcctggcagctcgcggactcgggcgtctggtactacgacatcacccgggagctgccggacggcagccgtgaggcggtcggccggatctacgacgacgtctactacgtgaaggcgctgtcccgtgccggcggggaggccgccacggtgctccgcctggaagcggtcggtccggacggcacgcgcagcgaggcggccacggcgcgcctgcgctgggagtgagcggcgcggtccgcgcgtctgactgggcaggtcagcgcctgcccagtcatccggttgtctggagcacgcccaagccggtcggcgaccgcccggcaccacccctgcccgcaatcgacgacagcttcgaggacaagctggaactcatcgccgccgggcactgcgtcgcgatcttccccgccagtgatcgacgcgccgctgtgcgcgaggacgtcgccctggtgcccgtcatcgacatcgatccctgcgaggtcgtgctcgtcacgcgcgctgacgaccccaacccgctgctcgaatcactggcagacgtcgcacgcacattgctcggcacagcctcccgacagcagaacaacgaactgccggccgactgacccctctgcctctgcgaggcgttccataggctgtcgccgcgcggccctcgtcggcttggaccagctggacgattaacggccccgtgatcaccgggactttgaaacgcccctgtcccgcaggctgctgtgctcaggactggtcataccaggagaacgccgcgatccgccagccctccggggtgcggacgaactggaaggtcttggtcccgccgcccttgaacggcttgccgtccaggacgccggccttgcggtactcgccgaagcgcgacgcgatgtcgcccgcgatctcggtccgctcggaggtttcccactccgagaactcgaccaaccggccgtcggagagcaggcgttcgcgaggctcgatgaactcgtccatggtgtagaccgtgtacttcggcccggtcagcacgatcacgccgcccggaatgaccagacggcggatccgggccacgtccgcggccttgccgccgcgggtgtcgaaggctccgaagaactcggcggttatggcgtcaatctcgatcttggacatcgtgcgacagtaacacctatagggggcaacggacatggcgccgaggcagcttcggtccagcacacccacgagatcacacgactttgcaacagccttggagaggagggaggtgatttctcggaaatcccgaaagttttttggcttccttacgttcttacatggcgaatcctacggatgttagggtgctcgccctcttcgaaaagagggcgagcgtaggagccggaaaggtgcaactcgactgggccaaagcggatctgacgatacggcaagagcgggtgtgtcggaaagtgacgcccccttcctgtagccggcccgagggattcgcggagcgaatcccgttc

SEQ ID NO: 323 - DNA, 7941 bp, Unknown
  Kingdom: Bacteria, Phylum: Actinobacteria, Class: Actinobacteria, Order: Streptomycetales, Family: Streptomycetaceae, Genus: Streptomyces
ccggcggccgtccacgcgggcgcgcggtacccgccggccacagccacgtcgagctgtgacacgcacgcgaccgccagacccgggaaccgagaaccgaggaggacccatgtccagaacggaaccgggcggacggaccggtggccggcaccggttcaccggacgcgccgtgcgggccgtctgcgccctgctcctgtcgtgcctgcccctcgccgccccctccgccgcacacgccggcgacggcacaccggccgtgcagcggatcaccgtggacggtgccggcaccgggcgggtgttcgacggcgtcggcgccatcagcgggggcggcggcacgtcacggctgctcgtcgactatccggaaccgcagcgcagccggctcctcgactacctcttcaagcccggctacggagcctcgctgcagatcctgaaagtggagatcggctcggacaccaactccagcaacggtgccgaacccagccacatgcgcacccccgcccacgtcgactgcaaccgcggctacgagtggtggctcatggaacaggcccgcgagcgcaatccgcggatccggttctacggcctggaatggggcgcgcccggctggttcgacggcggcttctgggccgacgacaacatcgactacctcatgcggtgggtgggctgcgccgggcagcacgggctgcacgtcgactacctcggcggctggaacgagaagggctgggacgcggcctggtacgggaagctgaaggccgcgctggtgcgccacggccacggtgacaccaaggtggtcgccgcggacaacgcgggctggcaggtggccaccgacatgaagaacgaccccgccttcgacgcggccacggacgtggtcggcatccactacccgtgctccgccgtccactgttccagctcggcggacgccctcgccctggacaagccgctgttcgccagcgagtcgggctggaacaactacctcaccggggcctcccggctggccgccgagatgaaccacgagtacgtcgactcccgcatcaccgccttcatcaactggcccgcggcgtacgcctggtacccgaccgtccagatgcagggcagcggcctgctgcgggccgacgagccgtggagcgggcactacgaactcggaccgacgctgtggacggtcgcccagaccgcgcagttcacccgtcccggctggcgctacgtggactcggccagcggctacctcgacggcggcggcacctacgtcacgctgcgctcgcccggcccccggcccgcctacacgacggtgttcgagacgaccggtgcgacggccccgcagaacgtcagtgtcactcccaccggtcaccttccacgcggcgccctgcaccgctggtcgaccaccctggagtccaccgaccccgccgactggttcgtccgcggcgccgacgtacggcccgacgcggccggcggacacggcatcaccctccagccgggtaccgtcacgaccctcaccaccatgccgggcggcagcaagggcggggccgccgcgacggcgccggccggccggaccatggccctgccctaccacgacggcttcgacggctaccggacggcggccaccgcacgctacgtatccgacatggagggggcgttcgaggtcgcgccgtgcgcccgggccccgcaggccgccgccgggagcggcggcaccggcaagtgtctgcggcaggtcatcaccacgcagcccgagaagtggtcccgggtgcccgcgccgctcaccctggccggtgacagcaggtggacggactacaccgtgtccgccaaggccctgatcgaccacgccggtacggcgtcgctgctcggccgggtggtgacccagctcaactcgttcggacccggccgcgtcaacgtgtgggagggctactacctcgacctgtccgcgtccggcgcctggacgctgaaggtcatcgcaccggaccggacgacccgggtcctggccgagggcagcctcagcacggccggagcggacacctggcaccggctctcgctcggcttctcgggcgagacgatcacggccggcatcgacgggagcgtcgtggccaaggtcaccgacgccacctacgaccacggccagaccggcctggcgctcgactcgtacaccacctcgcagttcgacgacctgagcgtcgagccggtgcgcggcgacggctgacgcgtcgtcacccatgccgtgcgagggaccgggtgggccgggcacacgccccggcccacccaggccgccgcccggcccgccccggaaccggcctcttctcccgcacccgtccccactcttgacgagtacacgcacaggacgaagaatgagcgccgcttctgacaacgttgtccagttgttcgcggagaggggctgtcgcccatgagatggatccagcgcatacgcggcgcgggaacggccgtgaccgccgccgcgctcctcggcgccgccctggccgcgcccacggcccaggccgccaccgcccggaacaccccgctcaccgacctcgtcaacccgttcatcggcaccgagaacgagggcaacacctaccccggcgcggccgtgcccttcgggatggtgcagttctcgccggacaccgggcacaacaccggctacgaccactcgcagaaccacatccggggcttctccctcgtccacctctcgggcgtgggctgcggtctcggcggcgatctgccggtgctccccaccaccggcgacgtcagagagaccgactacgccaagtaccaggccgagttcagccacgacaccgagaaggcgagccccggctactacaaggtcggcctggacagcggcatcgacgccgagctgaccgcgaccgcccgcaccggcgtgcagcgctacaccttcccggccaccgacaaggccaacgtcctgctggacgcgggccagtcgctgcaccggacggtctccaccaaggtcgaggtgctcgacaaccggaccgtgcgcaccgccatcaccggcagcggcttctgccaggacaccaagccgtacacggtgtacacgatcacccgcttcgaccgtcccttcaccgcgtacggcacctggaacggctccaccgtcaccgccgggtcccgcaccgggcaggacggcgcctacgtccgcttcgacacgaccaaggaccgtaccgtcgaggcgacgacggccctgtcctacgtcgacgcgcgcggagccgccctcaacctccgtgcggagggcggccgttccttcgacaaggtgcgtcagtccgcacaacgcgcctgggagggccggctcgacgacgtccgggtacagggcggcagcgacacgctccgccgtaccttctactcgtcgctgtaccggtccttcctcgcgccgaacgtgggcagcgacgtcgacggccgctacacgggctgggaccagcgcgtccaccgcgcacggggtttcacctactaccagaactggtcgctgtgggacacctaccgcacccagtcccagctcctgtcgctgctcgcgccgcgtgaggcgcgtgacatggcgatctccgtcatccacatcgacgaggagagcggctggctgcccaagtggggctacggcacggtcgagacgaacatcatgaccggcgacccggtcacccccttcctgaccaacgcctaccagcagggcctgctcaagggctacgaggaccgcgcctaccacgccctgaagaagaacgccgacggcgtcccgcccgccggctccccggcggtgggccgcgaggccaacaaggagtacctcgccgagggcttcgcgccgtacatcaagggccgcccgcacgccaagccgggcgactcggactacgaccacggcccgtccgcgacgctggagtacgccctgtcggacgccatgctcgccgagatggcccgcggcctcggccatgacgcggacgcggcacgctatgccgcccgggcgcagaactaccggaagatcttcgacgcctcgaccggcttcttccgcgcccgcgacgcctccggcgccttcaccggaccggccgacccggcccggagcgaagggttccacgagggcacggcgtggcagtaccagtggctggtgccgcaggacctgcccggcatgatcggcctgatcggcggcaagcaggcggccaacgaccggctggactccttcttcgcctacgaccagttggtgaaggacccggcgaagaccgcccgcgaggtatgggtgaacgggccgtacgactactacaacgcggacaagtacaacccgcagaacgagcccgacctgatcgccccgtacacgtacctgtcgaccggtcagccgtggaagacgaccgacgtggtgcacgccgcactgaccctgttcacggacacgccgaccgggatgaccggcaacgacgacctgggcaccatgtccgcctggaacgtgctctcgtcgatcggtgtcttcccggtacagcccggctacgacacctggggcctgtccacgccggtcttcgaacgggtcgacctgaccctcgaccggcgctactacccgcacggttcgctgacgatcacggcgcccggcacctcggacgcccggcactacatccagtcggcgcgggtcgacggctccgcctacggccgcacgtatctccggacggacgacctgcggcacatgcggtcactggcgttcaccgtgggcggcacgccctcggcgtggggcacgggcgcccaggccggtccgccggcgctgaactgaccgttcctgcggtcccgttcccggcggggccgcccgggtccggatgacgcacccgccggtcccgccggcgcactcgtgtgccgccggcaccggcggaaaaaggacgggcggcggccgggccactgtggcagtgtggcgggccggccgtcccgcccggtgggcggccggccgcccacctcaggagtcttccgtggtcccgccccgactcgtccccctgctcgcacagttcgacttcgcgtgcgagcgcctgagcgcccgtatggcgggccccgtcatggacagcggtgacggaaccggcaccgcggtcacgcccatgaccgacgaggagtacttctgggagccggtgccgcggtgctggtcggtacgcaggcggtccgacgggcccggaccacgggcgacgctgctggccggcgccggcgactggggacgtgacgccgcgtcgtacccgcacccgtggccgccgccgttcaccaccatcgcctggcggctgagccatctcggcgagatgctgacgctgcgcgccgatcacacggcgggcgcgcacgcgctgaaccgggacgttcatccggtccccgggagcgcgacggaggcgatcgccgccttcgccgccggtgccgcggcctggcggcgggccctgctgagcgtggacgacaccgcgctcgacaccgtggggtactgcacctacccgcacggcagcgatgcggaggagccgttcgccgacatcgtgtggtgggtcaaccaggaagtcctgcaccacggagccgagatcgccctgatccgcgacctccaccgcgcccagcagcgctgacccggcgggcggcccgggggggtgacccgcgccccgggccggccccgggctcactgctcacttgctcacttgctcacttgctcacggcgaagcgcatcagcgcgtgctcgtcgccctgcttgatcttgcccgtcgtgttgatcacctcgagcttccacgagccgcccacacgcaccgccttggccacggcgcagccgttgtcctggctgagcaggctgggccagatgtcggcgacctgctgggaactgccgccggtcgcgtcgtacaccttgaagctgatgttgcgcgccttctggaaggaactgcccttcttgaaggcggcggccacgaacacgatcgaggtgatctgctgcgggatccgggcgaactcgacggtcaccgtctcgtcgtcgccgtcgccccggccggtctggttgtcgccgctgtgcaccagtgagccgttgcccatggggtcgagggagtccagtcccgccaggcgcaccgggtcgccgccctgcatcgcgacggcgatcaggtccaggtccgtgccggccttgcggcggagcatgcccatcacgccgccgctggcacccgccgtggggtcccacgacactccgatggacaggtgcgtgacaccgtccaggtccgccgggccgtcttccttcgtcagcgtaatcatccgttgctcatcctctggtcatgggactgcgacacccaaagtgtgcctggaacgcccgccgtgctccatgccgggtccgccctgctcccgttcgcccggaaatatccccggggacgggcgccggccccgaccggccgccgggaaaagcggatgcgtcgggtctggtgcccgtgtcaggctccggcggtgaaccgtgcccagatctcgctgctcgcccacgccggccatccgatcgcggccccgctcgacgacgactccgtacgcctgctgctggaccgcgccctgccccgcgaggacgcccgggtgctcgacctgggctgcggcagggccgagtggctgctgcgcgcgctgaccgcgcaccccctgctgcgtgccgaaggggtggacgtctccggcgacgccctggcccgcgcccgtgacagcgcgcacggcctcggcgtccaggaccgcctggagctccaccaagaggacgcgtccggtttcaccgccgcgcactccttcgacgtggtcctcagcgtcggggccacgcacgccttcggcgggctgcgcgccactctggaagcggcgcgccgccacctggcgccgggcgggcgcgtcctgatcggtgacggattctgggagcaagcgccctctcccgaggccgtggagatgctcggggacctcggtgacctcccggccgtcatggacgccgtcgccgccgacggctggacgcccgtcggcgggcacatcagctcgcgccgtgaactggacgcctacgagtgggcgtggaccgggtcgctggccgcatgggccctggaccacccggccgacccggacagcgcccaggccctcgcggcgtccgacgcccaccgcgacgaatggctgcgcgtctaccgggactgcttcggcttcgtgtgcctggtccttcgcccgacggccggctgaaccggcagccggtgcctcagccgatccgtcggcagcgcaggaagagctgctcctcgggcggcgcgtccctgccgtcggtggtgtcgggggcgtacgagcgggaggactcctccacgacttcgaaaccggcccgctccaccaccgcgcgcagctcgccccgcggataaccggagacacggatcgtgcggccgaggaacgggatgggcatgtcgtccacgtcggcctcgaccatcgagagcgcgaacaggcccttcggtgcgagcagttcacggaccgaggacagcacgcccgggatctcggcccggcccagcatgagcagcgagaagaaggccgcgaccgcgtcgaacctgcccaggtcgagggggccgtggggaccgaggtccgcgatgtcggcctggtggaaccgcgccgcgggcacctgagcacgggccgactcgaccatcttggccgacaggtcgacgcccacgacgtcgaggcccgcctccgtcagccgccgggcggtcggcacacccgtgccgcaccccaggtccaggacccgggctccggccggcagggacgcgacgagccagtcggtcgcctcgatctggccctccttgtgcgggaacgccgcgtcgtagcggtcaccgatggagtcgaaggcctcggcctggccggtgcggtcacgcggcccggtcccgtggccgctctccccgttgacactgctcatgcgatgtctccccttcacgcctcgtcgtccgacatgccgtgccgcgccgcgcgttgagccgcgtcgcgcccgtacggtgcgacagtaccggccggagcacgccgcgcggaccgtggccggggccacggtccgcgcgg

SEQ ID NO: 324 - DNA, 10977 bp, Unknown
  Kingdom: Bacteria, Phylum: Actinobacteria, Class: Actinobacteria, Order: Streptomycetales, Family: Streptomycetaceae, Genus: Streptomyces
gcctcggcgacggcgaccgcggccgcatgcgcgaagcggttggacgcgccgatgacgaacgtgtcgaagaggtacttcgggttcagccgcgcggtcgccgtcgccgaggcaccggccaaggcctacaacccgctgttcatctacggcgagtcgggcctgggcaagacgcacctgctgcacgcgatcgggcactacgcgcgcagcctctacccgggcacccgcgtgcgctacgtcagctcggaggagttcaccaacgagttcatcaactccatccgcgacggcaagggcgacagcttccgcaagcgctaccgcgagatggacatcctgctcgtcgacgatatccagttcctcgcggacaaggagtcgacgcaggaggagttcttccacaccttcaacaccctccacaacgccaacaagcagatcgtgctgtcctccgaccggccgcccaggcagctggtcacgctggaggaccggctgcgcaaccgcttcgagtggggcctgaccaccgacgtccagccgcccgaactggagacgcgcatcgcgatcctgcgcaagaaggcggtgcaggaacagctgaacgccccgccggaggtactggagttcatcgcctcccggatctcccgcaacatccgcgagctggagggcgcgctgatccgggtcacggcgttcgcctcgctcaaccggcagccggtggacctgggtctgacggagatcgtcctcaaggacctcatccccggcggcgaggacagcgcgccggagatcacggcgacggccatcatggcggccaccgccgactacttcgggctcacggtcgaggacctgtgcggcacctcccgcggccgcgcgctcgtcacggcacgccagatcgcgatgtacctgtgccgcgagctgaccgacctgtcgctgccgaagatcggcgcgcagttcggcggccgtgatcacacgaccgtcatgcacgccgaccgcaagatccgcgcgctgatggccgagcggcgctccatctacaaccaggtcaccgagctgaccaaccgcatcaagaacggctgagcaggcccgcacggcagcagtggggcgccctccggaaccacggctccgggcggcgccccactgctgtacccgcactgccgcaccgctgtgcacggggccttcgccaggaccggagcggggtcttcaccacgcgcccggagcaggggcctcgtcacgaccgcacgggcgtcaccacgaccgccaaggtccccggacgccatcggcagacaccccgaacgccaccgacggcagcccccggcaggcgccccgctcctgtgcaccgaggtgccccgccctgtcccgttgttcgattacctgcctggttacggcctctctccacagattcggtgactttcttccgtccacatcctggggactgggaagttgtcccgaacggcgtccacaggcactccgcccaaaaaccgtctccccagctcaggaggctgtggaatcgtggacgaagactgtccacaggctgtggagggagcggtgatccacaggctgtgcgtaaagttttccacgggcaacccacaggctgcggtccgttgtccccaatgatcggcgacttctccacatggttgtccactgttcggcaacccgacgtccccggtcaccgcgtcgagtgaaagccgtcacaccaaggtgccggattggggtgtgggaaactcgggtaaacctggggacgcagctggggagaactgcccgcgtcctgtgggcgaggtgtgcagaactttctgttctccacagacccctcgagttgtccacgggtgtcacccacagggtcggtggacaaaatctccgcgctgagctgggcaaacgtggttatccaccgtatccacagcccctactactactcccaaccagtaagagtgcggaatccgtttcgaagcggggcctgtgcacaactcgccgcatcgagcccgaccgtccctctgagcgacttgaccccgacaggcacctactgtcagtggcgtgcgtcagactggtccccggtgctcttcccgtcgcagcgggcggtgacaccgggtcggaggactcagcagcaacacaggaggcggcttacggtgaagatccgggtggaacgcgacgtactcgcggaggcagtggcgtgggcggcacgcagcctcccggcccgtccgccggcgcctgttctcgccggcctgctgctgaaggcggaggacggccagctgagcctgtccagcttcgactacgaggtctccgcccgcgtgtcggtggacgccgaggtcgaggaggagggcaccgtcctggtctccggccggctgctcgccgacatctcccgtgcgctgcccaaccggccggtggagatctccacagacggtgtacgggcgacggtggtctgcggttcctcgcgcttcaccctccacaccctgcctgtggaggagtacccggcgctcccgcagatgccgaacgccacgggcacggtccccggcgaggtcttcgcctccgccgtgcagcaggtggccatcgccgccggccgcgacgacacgctgcccgtgctcaccggtgtgcgcatcgagatcgagggcgacacggtgacgctggcctccaccgaccgctaccgcttcgcggtccgcgagttcctgtggaagccggagaacccggacgtctccgcggtcgccctggtccccgccaagacgctccaggacaccgcaaaggccctgaccagcggcgacagcgtcatcctggcgctctcgggctccggcgccggcgagggcctgatcggcttcgagggcgcgggccgccgcaccaccacccgcctgctcgaaggcgacctgccgaagtaccgcacgctgttccccaccgagttcaacagcgtcgccgtcatcgagaccgccccgttcgtcgaggccgtcaagcgcgtggccctggtcgccgagcgcaacaccccggtgcgcctcagcttcgagcagggcgtgctcatcctggaggccggctccagcgacgacgcacaggctgtggaaagggtggacgcgcagctggagggcgacgacatctccatcgccttcaacccgaccttcctgctggacggcctgagcgccatcgactccccggtggcccagctgtcgttcaccacgtccaccaagcccgcgctgctcagcggcaagccggcggtggacgccgaggcggacgaggcctacaagtacctgatcatgccggtccgcctgagcggctgaccgggccggaaccgacccgggggccgcccccggccgacagcggtcgttacgtatgagcgggtatgcccacggatgtgcgtgagcgtccgggtctaggctcggacgcgggcacggaagtgcccccacatcacgtcggacacctaaggacacaactgatggagctcggtctcgtcggcctcggcaagatgggcggcaacatgcgcgagcggatacgccgcgcaggccacaccgtcatcggatacgaccgcaaccccgacctcgcggacgtccacagcctctctgagcttgtggacaagttgcagggcccccgcgtggtctgggtgatggtcccggccggtgccgcgacccagtcgaccatcgacgagctggccgagctgctgcagcccggcgacgtggtcgtggacggcggcaactcccgctggacggacgacgagaagcacgcgcgggagctggccgccaagggcatcggcttcgtcgactgcggtgtctccggcggcgtgtggggccttgagaacggctacgcgctgatgtacggcggcgacgcggagaacgtcgccaaggtgcagccggtcttcgacgcgctcaagccggagggcgacttcggctcggtgcacgcgggcaaggtcggtgcgggccacttcgcgaagatggtccacaacggcatcgagtacgcgatgatgcaggcgtacgccgagggctgggagctgctcgagaaggtcgactccgtggacaacgtccgcgaggtcttccgctcctggcaggagggcaccgtgatccgctcctggctgctcgacctcgcggtcaacgccctggacgacgacgagcacctggagcagctgcgcggcttcgcccaggactccggcgagggccggtggaccgtcgaggcggccatcgacaacgccgtgccgctgcccgcgatcacggcctcgctgttcgcgcggttcgcctcccgccaggaggactcgccgcagatgaagatgatcgccgcgctgcgcaaccagttcggcggccacgccgtggagaagaagtagtccacaggacaccgccgtccgcaggacgccggtccacaggacggtggaccacagatggtccgcaggtggtccgcaggacacggacaccggacggtccgcacgacatgggaccgcccggcggtccacccgctggaggaggccggcgaacgaccatgcacgtcacgcatctgtcgctggccgacttccgctcgtacgcccgggccgaggtgccgctcgacccgggcgtcaccgcgttcgtcggccccaacggccagggcaagaccaacctcgtcgaggcggtcggctacctcgccaccctgggcagccaccgggtcgcctccgacgctcccctggtccgcatgggcgccgagcgtgcggtgatccgtgcgcaggtgcggcagggcgagcggcagcagctggtcgagctggagctgaatccgggccgcgccaaccgggcccgtatcaaccgttcctcgcaggtcagaccgcgtgacgtgctcggcatcgtccgcacggtgctgttcgcgcccgaggacctcgctctgatcaagggagaccccggcgagcgccgccggttcctcgacgagctgatcaccgcgcgttcgccgcggatggccggtgtccgctccgactacgagcgggtcctcaagcagcgcaacacgctcctcaagtccgcggcgctcgcgcggcgccacggcgggcgctccatggacctgtccacgctggacgtgtgggaccagcacctcgcgcgcgcgggtgccgagctgctggcgcagcgtctggacctgatcgccacgctgcagccgctcgcggacaaggcgtacgagcaactggcgcccggcggcggaccggtcgccctggagtacaagccgtcggcgcccggcgaggcgcacacgcgtgaggacctgtacgcccagatcaccgctgcgctcgccgacgcacgcaagcaggagatcgagcggggcgtcactctggtgggtcctcaccgggacgatctggtcctcaagctcggtcggttgccggccaaggggtacgcctcgcacggcgagtcctggtcctacgccctggcgctgcgtctggcgtcgtacgacctgctgcgtgcggagggcaacgagccggtgctggtgctggacgacgtcttcgcggagctggacgcgcgtcgccgtgagcggctggcggagctggtggcccccggtgagcaggtcctggtgaccgcggcggtcgacgacgacgtaccgcatgtgctggcgggcacgcggttcgccgtgtcggacggggcggtggagcgcgtatgagcaccgagagggaccgcgggtccgggaaagcacccaaggcggcggaggcgccgacggcgtccgggcggagtcccgagccctccggtgtcgacctcgcgcgtgtggcgctgcgcgcggccaaggaggcggcacgcgcgcgtggggatgcgacgcagcagaagaagcaggcgcggcggggtgggctgcgctccggtgcccgtggtgacggccgtgatccgatggcgctcggtgctgcgatcaaccggctgatcaccgagcgcggctgggagactcccgcggcggtcggcggggtgatggggcgctggccgcagatcgtcggggcggacgtggccaagcactgtgtgccggagaggtacgacgaggacgagcgggtcctggccgtgcgctgcgactcgacggcctgggcgacgaacctgcggctgctggccccgacgctggtggcccgtctcaacgaggacctgggccatggcgcggtccggctgatcaaggtgcacggtcctggcggcggcgcccgccgttacggtccgctgcgtgctcctgggagtacgggtcccggcgacacctacgggtgacggaaaccgccttgcccgcgggtgcgggaggccgccttgcccggcgttcccgccttccctgcggcaggcgggaacccctcttcctgataggtgacagagatcacatcgggtggtcacggaggggtgcgtggggacccgggaagcggccctgtcacgcaaccgcacgcgcttgcgaatcccgacctgaccgtggagtagcgaagggttgacgcccggaagcgctgagtgccgctgtgagcctcttggagcccccttccgtatatcgggacccggccaagaccggttcagggcgccacatgcggactcaggtacccgcaaacccccatcactgtcggcgctaccggtagactggaagccgatcccgccccgaacgtggggaccgtccgggaaaaagctgagcaacgctgatcagggcttaccaacgcaacatgccgcagccgctccggcgaccctccccccggagggggaaaccccaggagcccggctcgtgctgtgccagaaagggcgcttcgtggccgattccggcaaccccaacgagaacatcccgtccaccgaagccggcgccgaggcgccggtcgcctctccgaacggtcaggccccggcctcgtacgacgccagcgccatcactgtcctcgagggtctggacgcggtccgcaagcgacccggtatgtacatcggctccaccggtgagcgcggtctgcaccacctcgtgtacgaggtcgtcgacaactccgtcgacgaggcgctggccgggcacgcggacaccatcgacgtgacgatcctggccgacggcggcgtccgcgtcgtcgacaacggccgtggcatcccggtgggcatcgtcgcctccgagggcaagccggccgtcgaggtcgtgctcaccgtgctgcacgcgggcggcaagttcggcggcggcggctacgcggtctccggcggtctgcacggcgtcggcgtgtccgtggtgaacgccctgtcgtccaaggtctccgtcgagatcaggaccgacggccaccgctggacgcaggactacaagatgggcgtcccgacggcgccgctggcccagcacgaggcgaccgaggagacgggcacgtcggtcaccttctgggccgacccggagatcttcgagaccaccgagtactccttcgagacgctgtcgcggcgcttccaggagatggcgttcctcaacaagggcctgacgatccggctgaccgacgagcgtgagtcggcgaaggccaccagcggtgcggacgaggcgggcgccgaccagaaggacgaggtcaagtccgtcacgtaccactacgagggcggcatcgtcgacttcgtgaagtacctcaactcccgcaagggagacgtggtgcaccccacgatcatcgacctggaggccgaggacaaggacaagagcctgtccctcgaggtcgccatgcagtggaacggcggctacagcgagggtgtgtactccttcgcgaacatcatccacacgcatgagggcggtacgcacgaggagggcttccgcgcggccctgaccagcctgatcaacaagtacgcgcgcgacaagaagctgctgcgcgacaaggacgacaacctcacgggtgacgacatccgcgagggtctgaccgcgatcatctcggtgaagctgagcgagccgcagttcgagggccagaccaagaccaagctgggcaacacggaggcgaagaccttcgtccagcgggccgtctacgaacacctgaacgactggctggaccgcaacccggtcgaggcggcggacatcatccgcaagggcatccaggcggccaccgcgcgcgtggcggcccgcaaggcccgcgacctcacccgccgcaaggggctgctggagtccgcctccctgccgggcaagctctccgactgccagtcgaacgaccccaccaagtgcgagatcttcatcgtcgagggtgactccgccggcggctcggccaagtccggccggaaccccgagtaccaggcgatcctcccgatccgcggcaagatcctgaacgtcgagaaggcgcggatcgacaagatcctgcagaaccaggagatccaggcgctgatctccgccttcggcacgggtgtgcacgaggacttcgacatcgagaagctccgctatcacaagatcatcctgatggcggacgccgacgtcgacggccagcacatcagcaccctgctgctgaccttcctgttccgcttcatgcggccgctggtcgaggccgggcacgtgtacctgtcccgtcccccgctctacaagctcaagtggggccgggacgacatcgagtacgcgtactccgaccgcgagcgcgacgcgctgatcgagatgggccggcagcgcggcaagcgggtgcgcgaggactcgatccagcgcttcaagggtctcggcgagatgaacgccgaggagctgcgcgtgaccacgatggaccaggagcaccgggtcctcggccaggtcaccctcgacgacgccgcccaggccgacgacctgttctcggtcctgatgggcgaggacgtcgaggcccgccgccagttcatccagcgcaacgccaaggacgtccgcttcctcgacatctgagtcggtctcagctgaccgcaccaggaaggatccccaccagcaatggccgacgagaacacccccgtcacccctgaagagggcggcgaactcgcgatgcgtgtcgagcccgtcgggctcgagacggagatgcagcgttcctacctcgactacgcgatgtccgtcatcgtctcgcgtgcactgcccgacgtccgggacggcctcaagcccgtccaccgccgcgtcctgtacgccatgtacgacggcggctaccgccccgagcgcggcttctacaagtgcgcccgcgtcgtcggcgacgtcatgggcaactaccacccgcacggtgactcctccatctacgacgccctggtgcgcctcgcccagccgtggtcgatgcggatgccgctggtggactccaacggcaacttcggctcgccgggcaacgatccggccgcggccatgcggtacaccgagtgcaagatggcgccgctgtcgatggagatggtccgcgacatcgacgaggagaccgtcgacttcacggacaactacgacggccgctcccaggagccgaccgtcctgcccgcccggttcccgaacctgctgatcaacggctcggccggcatcgcggtcggcatggcgaccaacatcccgccgcacaacctgcgcgaggtcgccgccggcgcccagtggtacctggagaacccggaggcctcgcacgaggacctcctggaggcgctcatcgagcgcatcaagggccccgacttcccgaccggcgcgctggtcgtcggccgcaagggcatcgaggaggcgtaccgcaccggccgcggctccatcaccatgcgcgcggtcgtcgaggtcgaggagatccagaaccgccagtgcctggtggtcaccgagctgccgtaccaggtcaacccggacaacctcgcgcagaagatcgccgacctggtcaaggacggcaagatcggcggcatcgccgacgtccgcgacgagacgtcctcgcgcacgggccagcgcctggtcatcgtcctcaagcgggacgcggtcgccaaggtcgtcctgaacaacctgtacaagcacaccgacctgcagaccaacttcggcgccaacatgctggccctggtcgacggcgtgccgcgcaccctctcgctggacgcgttcatccgccactgggtgacgcaccagatcgaggtcatcgtccgccggacccgcttccggctgcgcaaggccgaggagcgcgcccacatcctgcggggcctgctgaaggccctggacgccatcgacgaggtcatcgcgctgatccggcgcagtgagaccgtcgagatcgcccgcggcggcctgatgggcctgctggagatcgacgagatccaggccaacgccatcctggagatgcagctgcgccggctggccgccctggagcgccagaagatcgtccaggagcacgacgagctgcaggcgaagatcaacgagtacaacgagatcctcgcctccccggtccgccagcgcgggatcgtcagcgaggagctggccgcgatcgtcgagaagtacggcgacgaccgcaagaccaagctgatcccctacgagggcgacatgtccatcgaggacctgatcgccgaggaggacatcgtcgtcacggtcacccgcggcggctacatcaagcggacgaagaccgacgactaccgcgcccagaagcgcggcggcaagggcgtgcgcggcgcgaagctgaaggaagacgacatcgtcgaccacttcttcgtctccaccacgcaccactggctgctgttcttcaccaacaagggccgcgtctaccgcgccaaggcctacgagctgccggacgccggccgggacgcgcgcggccagcacgtggcgaacctgctggccttccagccggacgaggcgatcgccgagatcctcgcgatccgcgactacgaggccgccccgtacctggtgctcgccaccaagggcggactggtcaagaaaacgcctctgaaggattacgattcgccccgctccggcggtgtcatcgccatcaacctgcgtgagcgggaggacggcagcgacgacgaactgatcggcgcggaactcgtctcggccgacgacgatctcctgctgatcagcaagaaggcgcaatcgatcaggttcaccgcctcggacgacaccctgcgccccatgggccgcgccacctcgggtgtgaagggcatgagcttccgcgagagcgacgaactgctgtcgatgaatgtggtgcgacccggtacgttcgtgttcactgccaccgacggcgggtacgccaagcggacccgggtcgacgagtaccgcgtccagggccgcggc

SEQ ID NO: 325 - DNA, 11181 bp, Unknown
  Kingdom: Bacteria, Phylum: Actinobacteria, Class: Actinobacteria, Order: Streptomycetales, Family: Streptomycetaceae, Genus: Streptomyces
  misc_feature (9328)..(9347): n is a, c, g, or t
agcacgatgtcggcgagcttgcccgcctcgatcgagccgacctcgtgcgaaagcccgtgcgcgatggcggggttgacggtcagcttggcgatgtagcgcagcacgcgggcgttgtcgtcgtcggggccgtccccgtccaccgggcccagctcggccttcatcttcccggccatcgcgaacgtgcggcgtacggtctcgcccgcgcggcccatgccctgcgcgtcggaggaggtgatgccgatcgcgcccaggtcgtgcagtacgtcctcggcgcccatggtgccggcgcggatgcggtcgcgggccatggcggcgtcgccgggcaggtcggtcttcaggtcgtggacggagacgatcatgccgtagtgctcggcgaccgcgtcccggccgaagggcagggtggggttggtggaggagccgatgacgttggggacgccggccatcttcaggacgttggggacgtgtccgccgccgcagccctcgatgtggaaggcgtggatggtgcggccctccaggacgcggagggtgtcctccaccgacaggcactcgttgaggccgtcgctgtgcagggcgacctggacgtcgtgctcctcggcgacgcgcagggcggtgtccagggcgcgggtgtgggcgcccatgtcctcgtgcaccttgaagccgcaggcgccgccctcggccagcgcctcgatcagcggggcgtcgtgcgaggacgaaccgcggcccaggaagccgatgttgacgggccaggcgtcgaaggcgttgaacgcgtgcttcagcgcccacggcgagttgacgccgacgccccacaccgggccgaactcctggccgatgatcgtggtcacaccggaggccagcgaggcctccatgatgcgcggcgacagcaggtggacatgggtgtccacggcaccggcggtggcgatcaggccctcgccggacacgatggtcgtaccggtgccgacgacgacgtccacgccgtcgagggtgtcggggttcccggcccggccgaccgcgctgatgcggccctcgcggatgccgatggacaccttgcggatgccctgcgccgcgtcgatcacgacgacgttgctgatgacgacgtcgcaggtctcgcggacggcggcggccttgaggtgcaggccgtcgcgggcggtcttgccgaaaccggcgaggaactcgtcgccgtacttctgcgcgtccgactcgacgcggacgacgagaccggagtcgccgaggcggatccggtcgccggcgcgcgggccgtgggtggcggcgtaggcgtgcgggtcgacgtggatcgcccggctcacctcgcgtcccttggagcggctcatcggacgtctccttccggcgtgtccacagcggtgacccccaggtagccgcaggcggcggccctgcgcagcgcctcttccctggcgcccggggcgtccagcggcccgtcgacgagcccggcgaagccgatagcgatccgttcgccgccgatcggcacgagaccgacctcggcgctctcgccgggcccgaaccgcaccgacgagccggcgggcacggccaggtgcgtgccgtaggcggcggcccggtcgaagtcgaggcgcgggttggcctcgaagaagtggaagtgggaggtgacggagaccgggacggccgccgtgttggtgaccgtcagccgcagggcgggctcggggtcggcgtgctgcggtccgggcagcagcgcgcccggtgccgcctcgccctggctgccgccggagatcggctcggtgacgatcgcgagccgtgagccgtcgtcgaagacggcctccacgtggacctcggtgaccacgtcggcgacgcccggaagcacgtcgtccggcccgagcaccgtacgggcgcgctcgagcgcctcggcgagccgggcgccgtcgcgggcggcctcgcacaccgtgtcggcgatcagcgcggtggcctccggcacgttgagcctgagtccgcgggcccggcgggcgcgggccagctcggcggcgctgaagagcagcagccggtcacgttcggtgggggtcagtctcacgcctcggtacctccttgcctctcgcactttagaacaacactctaaacgcggaattcacagaaacgaaaggttgactgcaccacaaacagacggtcacattgaacgtcgttctaacctgctccccccgcaggcgccagtcgaaggagacccggccatgccgatcgaacagcgcggtgtcgacaccatcccggaccaggaacgcaccagcggcccgcgcgacctggtgtcgatcctgctcggatccaacctgtgcctcggcgtgatcatcttcggctggctgccgccctccttcgggctcggctggtgggcgtcggtcagcgcggtggccgccgggaccgcggtgggcacgctgttcaccgccccgctggcgctggtctcgctgcgcaccgccaccaacctgtccacctcctccggcgcccagttcggcgtgcgcggacgactggtcggctcggtcgtcggactgctgctcgccctcggctacaccgcgctgaccgtgtggatcggcggggacgtgatggtgagcgtcctgcaccggctgttcggcctcacggccggctcggcgtcgtacgccgtcgtctacaccctgctcgccgcggccaccgtcgcgggcgccgtctacggctaccgggtgctgctcaccatgtcccgcgtgctgtcggtcggcatgacggcactgctgatcctcggcgtgttcgcctacgccccgcacttcaccaccgccgcgctgcccgaggccggcggctatctgctgggcgggttctggccgacctggttcctcgccgccgtggccgccggactgtccggcccgatcgccttcatcaccctgctcggcgactacacccgctacatctccccgcgccgccactccccccgccgcgtcctgcacgccacctggctcggcctcatcctcggcctgctggtcccgcagctgttcggcaccttcaccgcgtacggtgcccgggccgccctggactacgccggaccgctggtggacgcctcacccgcctggtacctggtcccgctgctgctcgccgcctccgccggatcggtcggcaacgcggggctgatgctgtactcgatgggcctggacctggacgcgatcctgccgcgcgcctcccgcgcccgcgccaccttcacggtcgccgtggtcgccacggtgtgcgtcttcatcggccactacgcctggaacgcgcagtcggcgatgacctccttcgtgctgctgctcaccgcgatcggcaccccgtgggcggtcatcaccctgatcggcttcgtccgctgccgcggcgtctacgacgccgacgccctccaggtcttcaaccgccgctcgcacggcggcgtctactggtaccgggccggctggaacgtcagggccaccgcgtcctgggccgtcggcgccggggtcggcctgctcgcggtctccctgccctcctaccagggcccgctgctgcacctgaccggcggcgtggactgcagcttcctgctgtcgggcgcggtgggcggcgtggtgtacctgctgctgacggcgcgcgaccgggcacacaccggggccgccgcggacggggagtccacggcggccctggtcacgagcggggagcgctagacgagttcctgcgcgcccggggtcagccgaggcggtgcatccagccgtgcttgtcctcggcgatgccccgctggatgtccaggagggcctggcgcagccgcatggtgacctcgccgggctcgccgcccgactgctgccactgggcgttcgcacgcttgaccgtgccgaccggggtgatcacggcggccgtaccgcaggcgaagacctcggtcagcgtgccgttctcggagtcgcgctgccactggtcgacggagacccgggcctcctcggcctcgtaaccgaggtcacgggcgacggcgaggagagagtcgcgggtgacgccctccaggatggagccgctgagggtgggcgtgacgatcttgtcgccgtacacgaagtacaggttcatcccgcccagctcctcgacccacttgtgctccacggcgtcgaggtagcagacctggtcgcagccctcggcggcggcctcggcctgggcgagcagggaggcggcgtagttgccgccggtcttggcgtcgcccatgccgccggggacggcacggacccggtcctcggacgcccagatggagacgggcttcacaccgccggggaagtacgcgccggccggggaggcgatcacgatgaacaggtactcgttggcgggcttgacgcccaggccgacctcggtggcgatcatgaacgggcgcaggtacagcgactcctcgccgccgtgcgccggcacccagtccttgtcctgctggaccaggacgtcgcaggcctcgatgaaggtctcgacgggcagctcgggcatcgcgagccggtgcgcggaggcctggaagcgccgggcgttcttctcggggcggaaggtggcgacggaaccgtcgggctggcggtaggccttgaggccctcgaagatctcctgcgcgtagtgcaggaccgtcgtggccgggtcgagcgggatcggcgcgtacgggacgagctgaccgtcgtgccagccccggccctcggtccacctgatcgtcaccatgtggtcggtgaagtggcggccgaaccccgggttggccatgagcgcctcgcgctcggcggcggagagcgggttggccgagggcttgagctcgatcgtgggcgtcgtcatgagtgagtgtccttcaccgagttgttgtgacgggccgcgctcacgcccgcacggtcagtggccggtgctaggacgtccgagcattccctcatgtcgcggctccgcgttcgattatcgcgcgcgggcggtggcaggaggaaacggggtgagcggggcccagggtccgatggtggcacccggcggcggacagggggaagccgccgggcgcggtgtgcgacccgacggcttcgaagtggttcgagtggcgcggcaggtcagccggctactcgtacggcgagcgcgtcgccgatctcggcggtggtgcgctcgggcagcgcgccgcgctccgcgaggtcggcggagacggcgtcctcgatccgggtcgcctcgacgtcgtagccgaggtggcgcaggagcagggcgacggagagcaccgtggcggtggggtctgccttgccctggcccgcgatgtccggggccgagccgtggaccggctcgaacatggacgggaactcgcggctcgggttgatgttgcccgaggccgcgacgccgatgccgccggagacggccgcggcgaggtcggtgatgatgtcgccgaagaggttgtcggtgacgatgacgtcgaaccgttcgggctgggtgaccaggtagatggtcgccgcgtcgacgtggatgtactcggtggtgacctcggggtactcctcggccacctggttgaagatgttcgtccacaggtgaccggcgaaggtcagcacgttgttcttgtggacgagcgtgagcttcttgcgcgggcgggcctgggcgcgggcgaaggcgtcacggacgacacgctcgacaccgtaggccgtgttcacggagacctcggtggcgacctcgtgcgcggtgcccttgcggatcgtgccgccgttgccggtgtacgggccttcggtgccctcgcggacgacgacgaagtcgatctgcggctcgccggcgagcggggtggccacacccggcaggagcttgctcgggcgcaggttgacgtggtggtcgaaggcgaagcggagcttgagcaggaagccgcgctccaggacgccggagggcaccgacgggtcgccgatcgcgccgagcaggatcgcgtcgtgacccttgagggcgtcgaggtcggcgtcggtgagggtctcaccggtggcgtggtagcgccgggcgccgaagtcgtactccttggtctccagcttcacatcctgcgggagcgcggcggcgaggaccttcagcccttcggccaccacttcctggccgatgccgtcaccggggatcactgcgagatcgatgctgcgagacatgtcggcaccctacccttcgtcccgagaggtgacatggagcgtccggaatatggacacgaacgggtggtggaacgcggagggaccggggggagggacctgcacgggcgaagccgctcagtgccccgtctggccgccgttgtcccggcggtcgagggcgcgctggagggcggcggccgcgttcttgcggtcggcgtcgctcgtacgggagacgtggcggacgcggcggcggacggtcgtctcggccatgagggatcgactccttcgagaagacaggcggtgcctgagcggagggattgcgacgagacgccggaaggggcggggagcgagggccgcaggggtgacctgctcggggcccggctcactaccgccgttcgcttgatcgagcgagacgttcggctcctacaaaagtaggtcaggaccgcgccgctgtctgcacaattactcggacttcctactatctgagacggcgacctcggccgtacggctgacgcgcgccagccttacggccgtgacctgcggaaatacccggtgaccgctcgggggcgcctcaggtgatgtcgccgtcccgccagtcgaagagcagctcggtgccggggtcgtcggccgcggcggcggcgtggggccacacgtagatggacccctcctcgccgggcagccggaccacgccgtccgggccgagcgcgctgaccggtcccggccagacccgccagccgcgggccgcgtagagcccggcaccggcctcgctcgccgagagggcgccgaggtcgtaggcgcgggtgaggacgtcctccagggcgtccatgacgagcgtgccgaggccggtacgccggacgtcctcgcggacggcgacggcctccacgtacccggtgcgcagccagcgcccgcgcagccgcacccgccgcatgacgaccgatccgtgcgcggcgagcccgtgctcgtcgtgcaccagggcgtgcacgccgcccagggagtggtcccagtcgtggtcgctgaagtcgccctcgaaggcgtcgtccagcagagcgcgcgcggaccgcagttcgtccggggcgagggcgcaggtgtgggcggtgcgcagccgcacccggtcctcacctgtctgctgaactgcctggtgcgactcggtcgtccgcgtggaggtcatggcgtcagtctgcccggcggacacgcggacgggccggtccttctcgcggaccggcccgtcgggtgcgtcagggtgtcagcccatgtgcgggtaggtgtagtcggtcggggcgaccagggcctccttgatggcgcgggtcagcgtccagcgcatcaggttctgcggggcgccggccttgtcgttggtgccggaggcgcggccgccgccgaagggctgctggccgaccacggcgccggtcgacttgtcgttgatgtagaagttgccggccgcgtagcgcagcttctccatggtgtacgccgccgccgcgcggtcgttggcgacgaccgagccggtgagggcgtagtcggagaccgactccatctgggtcagcatctcgtcgtacttgtcgtcctcgtagacgtggacggcgaggatcgggccgaagtactcggtggtgaacacctcgttctccgggtcgctgcactcgatgaccgtcgggcggacgaagtagccgaccgagtcgtcgtaggtgccgcccgcgacgatcgtgcaggacgggtcctcctcggcccggtcgatggcggccttgttcttggcgaaggaccgctcgtcgatgaccgcgccgatgaagttcgacaggtcggtgacgtcacccatggtgaggtggtcgacctcggcggcgaactcctccttgaaaccggcgttccagatggaggccgggatgtaggcgcgggaggtggcgctgcacttctggccctggtactcgaaggcgccgcgggtcagggcggtcttcaggaccgcgcggtcggcgctcgggtgggcgacgacgaagtccttgccgccggtctcgccgaccagacgcgggtaggagcggtacttctcgatgttgttgccgaccgtcttccacaggtgctggaaggtcttggtcgagccggtgaagtggatgccggccaggtcgcggtggttcagggcgacctcggagacctcaaggccgtcgccggtgaggaggttgatgacgcccttgggcaggcccgcctcctccagcagccgcatgagcagcacggcggcgtgcgtctgggtcggggacggcttccagatcaccacgttgcccatgagggcgggcgcggtgggcaggttggcggcgatcgccgagaagttgaacggcgtgatcgcgtagacgaagccctccagcgggcggtggtccaggcggttccacacgcccggcgagttggccgggggctgctcggccaggatctggcgggcgtagtggacgttgaagcgccagaagtcgaccagctcgcaggggctgtcgatctcggcctgctgcgcggtcttggactggccgagcatggtggaggcggcgatggtctcgcgccaggggccggccagcagctcggcggcgcgcaggatgatggccgcgcggtcgtcgaaggacatggcacgccaggcgggggcggcggccagggcggcgtcgatcgcgtcctgggcgtcctgccgcgtggcgttgcggtacgtaccgaggacggccttgtggttgtgcggctgcacgacctcgaaggactcaccgccacccagccgcttctcgccgccgatggtgcagggcaggtcgaccgggttctcggccagctccttgagcttggcctccagccgggcccgctcgggcgaaccgggggcgtagccgtgcaccggctcgttgacgggggtggggacctgggtcacagcgtccatggtttccgtaactccttgacttgagcggtgtttcgagcttgtggagggggctcgctcagcccttgctgaccatcgagcggacgaagaagcgcaggtcggccggcttctccgccagacggcgcatgctgtgccttcccggggggcgacccccggacccccggcagggggtgcggcacagccggtgccgtcagcctcggctgagcatgctccgcgcgaagaagcgcaggttggccggcttctcggcgagacggcgcatgctgtgccatcccggggggcgaacccccggacccccggcagggggtgcggcacagccggtgccatcagcctcggctgagcatgctccgcgcgaagaagcgcaggttggccggcttctcggcgagacggcgcatgctgtgccatcccggggggcgaacccccggacccccggcagggnnnnnnnnnnnnnnnnnnnntccgcgcgaagaagcgcaggttggccggcttctcggcgagacggcgcatgaagtagccgtaccagtcggtgccgtaggccgtgtagacgcgcatgcggtggccctcggcggccaggcgcaggtgctcgtcgctgcggatgccgtacagcatctggaactcgtactcgtcgagcttgcggccggccgtgcgggccagctcctgcgcgatggagatcaggcgcgggtcgtgggacccgatcatcgggtacccctcgccctccatcagggtgcgcaggatccgcacgtacgccttgtcgatctcgtgcttgtcctggtaggcgacctcggcgggctccttgtaggcgcccttcaccaaccgtacgcgagagccgctcgcggcgaggcggcgcgcgtcggcctcggtgcggaagaggtacgcctggatgacgcagccggtccgcgggaagtccttccgcagctcctcgtggacggcgaacatcgagtcgagggtggtgtggtcctcggcgtccagggtgaccgtggtcccgatggcgtcggcggcctcgacgaccgggcggacgttggcgagggccagctcgtggccgccgggcagcgcctggccgaacatcgacagcttgaccgacatctcgaccttcgggcccagctccaggtccttgatgtggtcgacgagcgcgaggtaggcgtcgcgggccgcggtggcctgctcgggggtggtgatgtcctcgccgaccacgtccatggtcagctccaggcccttggcggtcaggtccgcgatgatggggacgatgtcgtccacggtctcgccggggatgaagcggtccacgacctgcttggtcaccggggccgccgagatcaggcgtcgcatccggtcgctgcgcgacgcggcaagaatcacgggacccagcacggggcacctccacaacagtgagcacaaggccgtcacccgaccgatcgggaacggcacggagaaccactgtgaaagttaaggatctgtgcgatcgtctgccatcgacagctgtcacgcatccgtggacccgatctcagacagatgtatgaaggccgcgcggaaatgcgggagaatgcccgggtgacggcggattacaagggcgactaccaggagctggtcgacgagatctcggaactgctgggtgctccggccacgctggagaaccggaacttcgagctgatcgccttcggcgcctacgacagcgagggcgacctggacccgtcggccctggacccggtgcgcacccgttcgatcctcacccgccgctccacggccgcggtccgccgctggttcgagggcttcggcatcacgcgggccaccgggccggtacgcatcccgcccacccccgaggccggcgtctaccggggccggatctgcctgccggtacgccaccggggcgtggtcctcggctacgtctggctgcttgtcgacgagcccggtccggccgaacagcagctcgcggcggccatgcgggtggcggcgcggatcggcgcgctcctcgcggacgaggcgcagcacggtgccgacctcacccgtgagctgcgggcggtgctgaccgccgagcggggctggccgcgggacatggcggtggccgagctgcgcacggcgctcggtgcgcgggcggaggggccgcacacgatggtgtgcgtggcgccgtggccgtcggccgacccggacgacgcgccgtcggtgcgcacgctgccgggcgcgacggccctgtgcacggtgccgtgggggacgacggaccagtgcctggcgctgctggtgcggctgcgctcggcggacaccctgaccccggcggtgtcggcggcgacccggctgctggag

SEQ ID NO: 326 - DNA, 2488 bp, Unknown
  Kingdom: Bacteria, Phylum: Actinobacteria, Class: Actinobacteria, Order: Streptomycetales, Family: Streptomycetaceae, Genus: Streptomyces
gaggccggcgagcgggccggcggcagcgtcgacctgggcggagggaacctctcggacgacttcagccagtactacctgggggcctactcgcgcacaccggcgccgggggccaccggcttcgccggttccggcaagctggccggcgtctccggcgcgctcggccgcgcacccggcgaaccgctcgaccgggccggtgcctacggggtgacgtcggaggaacttccggtggcgggccacccgcggttcgcgagcgcgggcgcgggacggttcaccggcaccgtcgacccctacagcccctacacgggcgcgttcatggccgccgccgtgcacaccgacgacgcctacaagcgcctgacccgtaccgtcgacctcaccaacgtcgccgcggcggacaagcccactctgagcacccgtctgctgtgggacaccgagcgcggctacgaccacgcgctgctggaggtgcacacctcgggcgccgacgactggacgacgctcccggatgcgggcggcaggagcgccgcggccgtgcccgccgagtgcggggccgggttcctgatcgccgaccacccctggctcaggcactacctgacgccgggtgccggcggctgcgccgcgcacggcaccagcggggcgtggaacagcttcaccggctcctccggcggctggcagcgggcgagcttcgacctgagcgcgtacgccgggcggacggtcgaggtctccctcgcctacgtcaccgaccccggcaccggcggtcacggcgtcctggccgacgacgcctccctcgtcgtcggcggcaccgcgcgggacaccgagggcttcgagacgtcgctgggcccctggagggtgtcaggaccgcctccgggcagtccggccgtccgcaaggactgggcccgcaccggcaccctcttccggacctacgcggcggtcaccacggaccggtccgtgctgctcgggttcgggctcggagacctccgctcggcggccgaccgggcggccctcgtgggacgggcgatgacggcactcgacaagtgagccggggcctgcacgaaagagtgatgaatacggtcaacgcgcacggacactctgtacccaaatggagtgaaccgggcgcatggctacggcggcccgcacccctactggcgcgtacggctcgccatgccgtccagggggtctgcgaatgtcacttcggaggcctcagggaggtagggtcgggggtggtcggggacatcccaaatacagctcgccggcgtcgaaaccggcgtaccaacgaggagatcggttcgtgacgatccgcgtaggcatcaacggctttggccgcatcggtcgtaactacttccgcgcgctgctggagcagggtgcagacatcgagatcgtggctgtcaacgacctgggtgacaccgcgaccaccgctcacctgctgaagtacgacaccatcctcggccgcctcaagcaggaggtcacgcacaccgaggacaccatcaccgtcgccggcaagaccatcaaggtcctctccgagcgcaacccggccgacatcccctggggtgagctgggtgtggacatcgtcatcgagtccaccggcatcttcaccaagaaggaagacgccgagaagcacatcgccggcggcgccaagaaggtcatcatctccgccccggcgaagaacgaagacgtcaccatcgtgatgggcgtcaaccaggacaagtacgacgccgccacggacaacgtcatctccaacgcctcctgcaccaccaactgtgtggcgccgatggcgaagatcctggacgagaacttcggcatcgtccgcggtctgatgacgacggtgcacgcgtacacgaacgaccagcggatcctggacttcccgcacaaggacctgcgccgcgcccgcgccgccgccgagaacatcatcccgaccaccaccggcgccgccaaggccaccgccctggtgctgccgcagctcaagggcaagctggacggcatcgcgatgcgcgtcccggtcccgaccggctcggtcaccgacctcgtcgtcgagctctcccgcgaggtcaccaaggaagaggtcaacgccgccttccagaaggccgccgagggcgagctgaagggcatcctcgagtacaccgaggacccgatcgtctcctccgacatcgtcaacgccccggcgtcctgcaccttcgactcgtccctgaccatggttcaggacggcaagaacgtgaaggtcatcggctggtacgacaacgagtggggctactccaaccgcctcgtcgacctcacggtcttcatcggcaaccagctctgatcggcagagcaggcacctcgatgtgagaacagggctcgggcagcgcaccacagcgcggtccgggccctgacgcacgtacggcgagccgctccccgcggcccgcccgcgtgcggatcgaccggccctcgtacgatcaagagcccctcctcaggagtcccattcccatgaagacgatcgacgaacttctcagcgaaggcg

SEQ ID NO: 327 - DNA, 1170 bp, Unknown
  Kingdom: Bacteria, Phylum: Actinobacteria, Class: Actinobacteria, Order: Streptomycetales, Family: Streptomycetaceae, Genus: Streptomyces
ggacagcaccgcgccgggcggccctccgcccgggccgccggggccgcctgcagcggagcggttcatcgaggcggtccgccgggcggcggggcgggacggctgagcatcgagaaggtgactcgaagttgcggtaccgaaccccttgcgtcacgctggtctcacgtcactctgggtttaccggcgataacgctgcgaaccagcccgccggccacgacagcaggcggcagtgtcacgcaggcgccctgctgcatccgaaacgtcgtgttcttccggacctcaacgtcggggagtcgcagccgtgatcagtcacccaagcaggcactgcacggtggagctccaagccctgccgtcgcggatcggccaggtccgcagaatcgtatcggcgcacttgcgctactggcacctggatcctctgatagaccgggccgcgctcggtgtgacggagttgttgaccaacgtccaccagcacgcccggcccgacaaactgtgcaccgtcgagctggagttgctgctcgaccgactcaccgtctccgtacgtgatcatgatccgcgtcttcccgtggtggaggacatgggcgagatcgcgccgctggccaccgagggccgcgggctcgcgatggtggccgcgatgagcgagagctggggtgcgcgcccggacggcgaggagggcaaggtggtctggttcaccctgcccacggccgccggtccggtcggggtgcccgcacgggtgccgcggctgatgggcggggagcagccagttccccggttcaccgaggtcgagcccgccctcgacggcccacgccccgcgcacgctcccgcccggtcggccgttgtcggctgaccgggcggtgaggtggtgagagcgcggcggccggccaccacggtggccgaccgcggcggccggtgatggccgcggtagcgggcggccggccggtgatcggtggccgctcgccgggaagccggcggtcacaccgtccagggcacgtacggcggtgtgtcgccgacgggggtcacagggcaccgcccttgcccgtgcggccgaactgctcctccagcaccgacagccggcgccagtactcgtcctcgtcgatctcgccggaggcgaagcgccggccgaggacggccagcggcgagtcggccgcaggacagccgtccggcccgctccaggga

SEQ ID NO: 328 - DNA, 3130 bp, Unknown
  Kingdom: Bacteria, Phylum: Actinobacteria, Class: Actinobacteria, Order: Streptomycetales, Family: Streptomycetaceae, Genus: Streptomyces
ggtcaccccccgaggggccgcggctcctgcgcgtcaccgtccgatgaactgcggcccctcggggggtgaccccgccggggcgcagcaaacctggtgatcattacctgcgcttgaccatgggcaccacaacttctcggacggaaccggccgcgcggcatgaccgaatgagatcacttgaggacgttttgtgatcacttccggacagggcacgatgccggaaccggggcggtggcacaggtgcgccagtcggctgcgccaggcccggctgccggtccgtgcgccgagcccgccctaccggtccgccttcgacttgtagccccggccccactggagcccccacccgtagagccggtccagttccgactggaagccatagacgaacttgacctctcggcggacggtgagttcgcccttcacgttctcgatcaggacgaccgcgcaggagcgggcctgcgggtggcgctcgtcgaggccgatctcgatgcgcgggccgttgctcgggtagagcgtgacgacggcgtgggtgcggtcgaaggccggggtctggtcgtagatgtagacgaagaccagcagccgcttgatgtcgtcgcggtggtcgaggttgacgtagatcgtctcaccggacgcggagccgaaccggtcgtcgccgctgagcttgacgtacggcggcgcgttgacgtcgccgaggaggccgcccaggggctggacgacgcccttggtgccgtccgccagttcgtacaggcagccgaggtcgaggtcgacgttgaccatggactggctgtggccgagcacctccgggggcttcagcgccttgaacgggtggcgcagcaggctctgccgggcggcgccgccgatgtcggaggtgcgcatccgccagttcaggttgatgcgcaggttgccggtggcggcgccctgtttggtcagcgacacctggctgtgccgtttggtcagttcgatcgcgttggacgcggcgctgcccgagtcgaactcggccggccgtccgccccgcagaccgtcgaagaagcccatcttccgcccccaccttcaccgcgtctcgcccacccccgcacgtatcgagcggggcggccggaagggatgtcacccggcgaggctcgccgtgtggtcccgccggccgccccgctcagagcgttcccgtgccgggtggggcgtcacaccccggactcgacctcagtccgctcgcccgagccggccgcttttccctcggcggcctccagcgccttgttgcggcgcacggaggaccagaaggaccaggcgatcaggacgacaccgaccagaccggtgatgacctcgttgatctcgtactggatggtgaccatgaggatcacggccagcgcgccgatcgcgtagtgggcaccgtgctccaggtagacgtagtcgtcgagggtgccctggcggaccaggtagacggtgagcgaccggacgtacatggcgccgatgccgaggccgagggccatcaggacgatgtcgttggtgatggcgaaggcaccgatcacgccgtcgaaggagaacgacgcgtccaggacctccaggtagaggaacatgaagaacgcggcctggccggccagcttgaccgccgagcgctgcttgccggtgcgggcggcctcctcttcctcctcgtgctcgcgctcctcctcttcctccagccggtcctcgaagaacccggaaagaccaccgacgatcaggtacgtgatcagaccggcgacaccggagatcagcaccgtctgcgccttgtcggcgtgcacgccgccgtgctggtgggcgtgggtggcgaaggtgaaggaggtgatcagcaggacgatcagcgagatgcagaccgacagcatgtcgaccttgccgagcttggccagcggccgctcgatccagcgcagccactggatgtcccgctcctcgaagatgaagtcgaggaagatcatcagcaggaacatgccgccgaaggcggcgatcgccgggtgggcgtcggtcaccagctgctggtagcggtccttgtcggagaacgccaggttgaccgcgtcccacggattgagcttggcggtgatggcgacgatgacgacggggaacaccagccgcatgccgaagacggcgatcagcacgcccaccgtgaggaagatcttctgccagaaggcattcatcttcttcaggaccccggcgttcaccacggcgttgtcgaaggagagcgagatctccaggaccgcgaggatcgccaccaccccgaaggcggtccagcccccgtagaacaccgccgcgatcaagccgagcacggtgatcgcgaacgaccagccgaaggttttcagaagcactggctacccaatccgttgtgtacgggtatcccccgtcgccgtacccggctttacgaaacgttgactccgaagtctagagcgataccgcgcagtccggacgcgtacccctggcctacggcccggaacttccattcgccctggtagcggtagagctcgccgaagatcatcgccgtttcggtggaggcgtcctcgctcaggtcgtagcgcgcgagctcctggccgtcggcctggttgaccacgcggatgaaggcgttgctcacctgtccgaacgtctggccgcgctcgtcggccatgtggatcgagaccgggaagacgatcttctcgcactggaccgggaccctggtgaggtcgaccaggatcgactcgtcgtcgccctcgccctcacccgtgaggttgtcaccggtgtgctcgacggagccgtcggggctggtgagctggttgtagaagacgaaccactcgtcgcccagcacccggttgccggcgccgcacagcagcgcgctcgcgtcgagatcgaaaggggctccggtggtggagcgcgcgtcccagccgagcccgaccatgacgttggtcaggttgggtgcggccttggacagggagacattgcctcccttggcgagcgtgacgcccatgatgctggtcctccccggggatggtgcgtgtgttgtggtcctgcgcgtccggcgccgcgcggtgaggcgcggcgccggacggtcgggctctctcgccgctcagacgttgacgccgaagtcctgggcgatgccccgcaggcccgaggcgtagccctggccgatggcgcggaacttccactccgc

SEQ ID NO: 329 - DNA, 5183 bp, Unknown
  Kingdom: Bacteria, Phylum: Actinobacteria, Class: Actinobacteria, Order: Streptomycetales, Family: Streptomycetaceae, Genus: Streptomyces
cctgccagccgtcctcggcgacgagcagccgcagcacggacggcacgacctggaggacggtgacggcgtgcgcgccgaccgcgcggaccagggcggccgcgtcgcgctcgacgcccgcgggggcgaggacgacggtgccgcccgagacgagcggggcgaacacctcccagacgtgcgcgtcgaagaccaggggggtcttctggagcacccggtcggcggcgtccatcccgtgctgccgcacggtccaggcgacgcggttggcgatgcccgcgtggctgaccacgacgcccttgggcgtgccggtcgagccggaggtgtgcagcacgtaggcggcgtgcgcgccgtcgaggccggtgacgggggcggtggcgggccgcacggcgaggtcggcggcggcctcggcggggacgaccgcacgggcaccggcctcggtgactgcggtggcgccctcggggtcggtgaggacgagggaggtgccggacgcggcgatcagctgcgcggtccgggcccgcggcgcctcggggtcgagcggcaggtaggcggccccggcgcgccagatcgcgagcaggccgaccaccaggtcgaggccgcgggcgagccggaccccgaccgggaggtcgggtccggctccgcgggccagcagcaggtgggccagccggttgctccgggcgtcgagttccgcgtacgtcatccgccgccgaccgtgttccacggcgatcgcttccggagtcagcgacgcctgacggccgacgagcacggggatgagccggttcgcatcggccgatgcgtccgtccgtgactcgggaaacatggaggtgggctcctcgtgtggggtgagtggtcgacagctgggcggcgggcggtgcccggcgggtgcggtgcggcgggttacgcggcggccatgcggcggcgcaggctggccgggcgcaggtcggtccacacctgctcgatgtgggccaggcactcctcgcggctgccctcggtgccctcggcgtgccagccggcgggcaggtcgcggtcggcccaccagatcgagtactgctcctcgtcgttgagcacgacgcggtacgtggtggcggattcgtgctgctcggacacgctggtctccctgagttgatgcgggtgttcgggtgtgcgctctatgtgcgagtcgtgatgtgttggccagttttcgatccggtcccatatccggcctatacgccgccgcctgcacacgggcggggcccggccggtgggtgttcgccaccggccgggccccgccgtcaggacctcgtcgcaggggaatcagtcggacatcgcgaccaggatccggcgtgggccggtgaacgggcggcggccgtggccgacgagcaggttgtcgatgagcagcaggtcgccctcgtaccagtcgcagtcgaccgcgtgctccaggccgcggtcgcggacctggaggacgtacgcgtcggggatcgggctgccgtccgcgaaggtcacggactgcggcagctcgtcggccggcatgatctgcgcgagcgccttcgcggtgtcgtcgcccagggacgccgggtgccactggtcggactggttgaaccagacctccgtgccggtgaccgggtggacggtggtggcgggccgcagctggctgatcttcaggctgtcgcccgggccccagctccagtccgcctccgtctccttgaggaagacgtcgacctcgtcgcggtccgtggtctcgaaggtgtcctgccagctcttgccgagccccttgccgccgtgcaggttctgcgtgtagcgcacgccgccctggaaggcgtcgcggacctcggggtccagggactggagccacagcgcggcgtcgacgacgggggtggccccgccggtcgtcggcgcgacggcgcagtagaaggcgagccgggtgggccacgcgtgggcgtacgacatctcgttgtgcatcgagatggtgtactcctgcgggtactccgtcgacgtgtacacgttcgaccccaccttggtgcggggcgagttgccgtgcacgtaggcgaggcgccggggcagcagccggtccaggaccgggtcgaggccctcgtgcggcaccttgaaaccacggaagacgacggccttctcgcggaccagcagcccgtccaggtccatcgcgtcgagctgttcgaccagcgcctccgcgctggccgcggcccccaggtcgcccggggtcacctcgaacggcgcccagccgttgcggtcggtcatgtggttgcgttcctctcgtgcgggatggtgtgcgctccggtgctgcggagctgccgggcgggctacggaaggaatccctccacctccacgccgagccccttctcgcgcgccgtggtgagcacctggtcggcgagcgcgatgtccaggaccccgagaccgaacggggcgtagaccacggtccggcccggctcggcggtgaacgcgtcgccgtcgagcaggagttcgccgatggtcgggtcgatgaaaccggtgtgccccgcgaggccgcgggcgaggtcgagcgaggtgcgctcgcgcagcgcgtggtcgacgtcgtccacgatgttgtggacgtcgagcagcgactcgggcagcaggtcgcgcagcgagatgtgcagcacgaccgtgcccggtacggcggctcgcacgtccaggtgcggttcgatcgcggaggtcgcgacggagaccaggccgtgggcggcgagggccgcctcggcggtgccggcggtgacgaccctgaccccgggggccgcctcggcgacctgggcggcgaaccgcgcggcccgttcgcccgcgctgtcgtacagcgtcaccgtgtccagccccggcaccgcggcccgcacatggcgcaggatctccaggttgatgacgccgcagccgatcagcgcgaggccgtcggggcggcggtcgcgggtgaggagctcggcggcgagcgccgcgctggccgcggtgcgcttggcggagatcagcgagccctcgacgagcgcctcggggcggccggtggcgagggagttgaggatgatggccgcgttggcgcgctggatgccgcggtcgatgttggccgggaaggacgagatccatttcatgcccgcgaccggcttcgcaccgccccggtaggcgggcaggccgatgatgcggttgcgcggctgtccgggaaagcgcaggaaaatggagtgcggcacggcggtgtcgccctgcgcatggatacggtaggcgtccgcgacggcctcgatgttctcgagttctcggccttcgagtatctgcccgacctcggagtgccggatgatgagcatgacggttttcagtccttccagagatgcgcgacttcaccgaaattgcggtgcacccacgcgtcggaatagatcgtgtcgaggtagcggtcgccgccgtcgggaaagacgagcgccacggtggaaccggccgggatgtcgtcctggagccgggtgagagcggccacggtcgcgcccgaggagccgccggccagcaccgcctcgcggtgcacgagcctgcggcagcccacgacgcagtcgaggtcggtgacgtgcacgacccggtccgcggcggccgggtccatcagcgcgggcaccacggacgccccgtggccggggatgaggcggcgggcgggctccaggccgaagatggcgctgccctcggcgtcgaccgcgacgacggtggtgtccaggccctgcccgcggatgtggtccgcgcagccgcgcagggtgccgaacgtgctgaccgagcagaacaggtagtccacccggccgtcgagggcgtgcacgatctcgctcatggtccgctcgtgcgcgcgcgggttgagcaggttggcgtactggttgggccagtaggcgttcggcacctgctcggcgagttcacggacgcggcgcagccgcatcggcaggaactcgccggtcagctcgtcccgctcggtcaccctctcgacctcggcgccgtaggcccgcaggatcgcgaggttctgctccgtggtcttgccgtcgaccacgcagatgaagcggaatccgaagtaacggcacatctgggcgagcccgacggccaggttccccgaactggactcgacgaccaccgagcggccgggcaccaactggccgctctcgatcgcgctgctcagcatggagagcgcggaccggtccttgatactgccgcccggattgaatctctcgattttggcgaaaacccgggacttgaatcccggaagcagcctctccaattccacgagcggggtgttccccacggtcgacagaattcctgatgacggcggctccgacacgactgacacctcccgaacactgatcgctgcgaatgctcgacgaactccttccgaggagtactcgaaggagtgcttcgaatcttgaaagcgcgacctatcggtcagctatattgcaagcgtttccgagccatttctgtgcggtttcccgagcttttcctgcggtctcccgcggcgaagaggccgatcacgcgggcccgcggaactccagggtgccgtcgccgcgccaccgtgccaggtctcccgtgcggtacatccgggcgcctggccgggtcccgtacgggtcggcgaggaaccgttcggcggtgagcgagggccggccggcgtacccctcggcgaggtcgtcgcccgccaggtacagctcgcccgtggttcccggcggcaccggccgcagccacggatcgaggacgtagcagcgcccgttgggggcgggccgcccgatcggcacccgggtgtcctgcccccgcccgtcctcggggccgaccgggtgaaaggtgaccgccatggccgactcggccggcccgtactggttcaccagccaccagccgctcccgatcgcggcggccaggcgcacatgggccgcggtcagctcctccccgctgaccagccccgtccgcagccacggtgacggcccgcccccggcttcggcggcgacccgcgcggcgccggcgagcgcgctcagcgtcgtcggcgccagcgcgggcaacacggtcacccggtgccgcacgagcagcgcgaacagcgcggccgggtccgcggcctgtcccggcacgacgagccgggcgccggcggtgagcggcccgaagaggtcccgcacggacgggccgagggacacggacgccaggttgagcacggtgtcgtcgcggccgagcccggtcaggtcgtgcagatgggacaggtacccggcgacggcgtcgtg

SEQ ID NO: 330 - DNA, 8970 bp, Unknown
  Kingdom: Bacteria, Phylum: Actinobacteria, Class: Actinobacteria, Order: Streptomycetales, Family: Streptomycetaceae, Genus: Streptomyces
gccccgggcggggcccccgcccggggcgggtagggctccgcccggggcggggagggctccgccggacgaccgcctcggctcacggcacctcgggcgcccgttcagggtccagcaggggagccagcaggtcgccgaagtcctgtacccgcggtgcgatgtcgtccgcgcggaagtcgagccgcttcggtgtgcggcactcggtgacctcctcccacgtcaccggtgccgacaccgtcggctccgcacgcgcccgcagggtgtagggcgtcgccgtcgtcttgcgcgccgcgttctggctccagtcgacgaacaccttccccggccgcagactccgcgtcatccggtgcaccaccagccgcggcatcgccttctcggcctccacggcgagccccttcgcgtacgccgaggtccgctcgccggacgccccgcgcaccgcggccagcaggtgcagccccttggacccggaggtcttcgcgtacgcctcgatcccgtccgccgccagccgctcccgcagccacagcgccacccggcagcagtccaccacggtcgccggcggccccgggtcgaggtcgaagacgatccggtcggcctcctccggcgcctcgatcaaccactgcggcgtatggaactcggtcaccaggttcgcggcccacatcaggctcggcaggtcctgcacgagcaccatccgggccggcccctccgagcgcggcacctcggccgtcgtcacccactcgggcgtaccgggcggcacgttcttggcgaagaacacctggccgtccggcccgtccgggtaccgcaggaaggacagcggccggtcccgcagatgggggaggaggacgtcggcgacggtcgcgtagtagtgcagcacctcgcccttggtgaacccggccgcgggatacagcaccttgtccaggttgctgagcgggagccgtcgcccctccaccactgtgatcggcgccatacgataagaaaagcacgtacatcacgtacatcacatgaaacatggacaaaagcagtcgaaaagccccgccgatccgacccggaaggtgctgcacgtgcgatccatctggaacggcgccatctcgttcggcctggtcagcatcccgatcaagctggtgaacgccaccgagaaccacaccatctccttccgccagatccacacggaggacggcggtcgcatccgctaccgcaaggtgtgcgaactggaggaccgcgaggtgacccagggcgagatcggcaaggggtacgaggacgcggacgggtccatcatcccgatcaccgacgaggacctggcccacctgccgctgcccaccgcgcggacgatcgacatcgtggcgttcgtaccggccgaccggatcgacccgctccagatggagcacgcctactacctggccgcgagcggcgccccggccgccaagccgtacacgctgctgcgcgaggcgctcaagcgcagcaagcgcgtggcgatcgcgaagttcgccctgcgcgggcgcgagcgcctgggcatgctccgcgtggtcgacgacgtcatcgccatgcacgggctgctctggccggacgagatccgcgcgccccagggcgtcgcaccggaggccgacgtcaccgtccgcgacaaggagctggacctcgccgacgccctgatggacaccctgggcgaggtcgacctcgaggacctgcacgacgagtaccgcgaggcgctggaggaggtcatcgcggcgaaggccgccggggaggaacccccggagagccccgaaccggcccccggcggcaaggtcctcgacctgatggcggccctggagaacagtgtgcgggcggccaggcgctcccggggcgaggaggaggaaggcggcggggcggagtccgccggggagggcggccaggaggcggagggcgaggccgaggtcagacaccttccgcgccgcaaggccgcccgcgccgcaccggagaagtccgcgtccgggaagacggccgccaagaagacggccgcctccgcgaagaagaccgcctcctccgccaagaagccggcgtccaagtcggggcagtcgcggtcgcagtcgaaggcgcagtcgaagaagaccgcgtcgtccgccaagtcggccacgaagaaggccccggcgaagaagacgacggccaagaaagccacggcgaaaaaggccacggtgaagaagtctgctgccgagaaggccactgccaaggccacgcggacggtgaccgacgagaagacggcggccaagaaggcgaccgcgaagaaggcagccccgaagaaggcggcaccggcgaaaaaggcagccacgccgcaggcctcccccgccgccccggtctccgtcgccgtccccttccccgaccgtgagcggctgctcgccggaacgcatcacgacccgcactccgtgctcggcgcgcaccccgtgcccggcggcgtcgccgtgcgggcgttccggccgtacgccctgggtgtcgccgtcctcgccggggacctccaggtggagctggtccacgacggcgagggcttcttctcaggactgctgccactgcgcgacgtaccggagtaccggctggaggtggcgtacgagggcgcggtgcgggtcaccgaggacgcgtaccgtttcctgcccacgctcggcgagctggacctgcacctgatcggtgagggacggcacgaggagctgtggcgggcgctcggcgcgcatccgacgacgcacgagggggtcgccgggacccgtttctcggtgtgggcgcccgacgcgcggggcgtgcgggtggccggcggtttcaatttctgggacggcgccgcgtacccgatgcgctcgctgggcggcacgggtgtgtgggagctgttcgtgcccgggatcggcgagggcgagctgtacaagttcgagatcacccggccggacggttcgaagactctgcgcgccgacccgctggcccgccgcaccgaggtcccgccggccacgtcgtccatcgtgcacgcctcgcactacgagtggggcgacgaggagtggctggcccggcgcgcggagcggcccgcgcacgaggcgccgttctcggtgtacgaggtccacctgccgtcctggcggccgggatcgacctaccgtcagctcgccgaccagctccccgcgtacgtgcgggacctgggtttcacgcacgtggagctgatgccggtcgccgagcaccccttcggcggctcctggggctaccaggtcaccggcttctacgcgcccacggcccgcctgggcacaccggacgacttcaagtacctggtggacgcgctgcaccgggccggcatcggcgtgatcatggactgggtgccggcgcacttcccgcgcgacgaatgggcgctggccgagttcgacgggcgcccgctgtacgagcactccgacccgctgcgcgccgcgcatcccgactggggcaccctggagttcgacttcggccgccgcgaggtgcgcaacttcctcgtcgccaacgccgtctactggtgcgaggagttccacatcgacgggctgcgcgtggacgccgtggcctccatgctctacctggactactcgcgcgagcccggccagtggacgccgaacgagcacggcggccgggagaacctggacgcggtcgccttcctccaggagatgaacgcgaccctgtaccggcgggtgccgggcgtggtgaccgtcgcggaggagtcgacggcctgggacggcgtcacccgggccacgcaccaccgcggcccgagcggcttcggcggcctgggcttcgggctgaagtggaacatgggctggatgcacgactcgctgcagtacatgagccacgaacccgtgcaccgcgcctaccaccacggcgagatgacgttctccatggtgtacgcgtacagcgagaactacgtgctgccgatctcgcacgacgaggtggtgcacggcaagggctcgctggtgtcgaagatgcccggcgactggtggcagcagcgcgcgaacctgcgcgcctacctggccttcatgtggtcccaccccggcaagcaactcctgttcatgggacaggagttcgcgcagggctcggagtggtcggagacgcgcggcccggactggtggctgctcgacccgtcctacggcgccgcagccgaccaccggggcgtcctggacctggtccgcgacctcaactccgtctaccgtacgaccccggccctgtgggcgcgggacgtccaccccgacggcttcgagtggatcgtcggggacgcggccgacgacaacgtgttcgcgttcctgcgccgcgacgcggacggcgccccgctgctcgcggtgtgccacttcgccccggtcgtccgtcacgactaccgcctgggcgtccccgacgacgtgcccgcctggcgggaggcggtcaacacggacgcggcccgctacggcggcagtgacgtcgtccgccccgacccgctcaaaccggagccccagggctggcacggccgcccggcgagcatccgcctgaccctgccacccctggcgacggtgtggctgcgcccggcctgaggacccggcgcgcagcgactcccgtcgcgactcccgctagttcgcgaacgcctccgccagcgccggcgggaacgcgcccgtgtgcagcacgcccagccgctgcgtggcccgggtcagcgccacgtacaggtcgctggtgccgtagcggccgggctcgaccacgaggacggagtcgaactccaggcccttggcctggcgcgggtcgagcaggacgaccgtgtgcgtcaggtcgggctccgcgccggcggtgaccccgtccagccgggcggcgagacggcggtgcaggtcgcgcggggcgatgacggcgaggcggccctcctcgggggtgagttcggcgacggccttctcgaccgcgccgggcaggtcgtcggtggcgcggacccagggccgtacgcccgtggagcgcaccgagctgggcggctcgaagccgggctgctcggcgcggaccacggccgccgcgacgtccatgatctcggcgggcgtgcggtagttgacgccgagccgggtgtgctcccagcggtcctcgacgtacggctggaggatgccctcccaggagccgacaccggccgcctccgccgtctgcgcggggtcgcccaccagggtcatggagcgggtcgggctgcgccgcatcagcagccgccacgccatcggcgacagctcctgcgcctcgtcgacgatgatgtgcccgaacgcccaggtgcggtcggccgccgcgcgctcggcggcgctgcggtggtcgtcctcctcatggcgttcggcgaaccgctcggcgtcgatgatgtcgtgcgcggacaggatctcggagtcctcctcgtccttgtcctcgaactcgtaggtccgcgaggcgtaggagacgtccagcacgccctgcgcgtacgccacctgcgtctcgcgctcgcgttcggcgcgggcgcgggccacccggtcgtcctcgccgagcagttcggcggcctcgtcgagcagcggcacgtcggcgacggtccaggcccgcgtgaccggacggcggatcgctgcggcgtcctcgtcgccgacgtacccctccggggcggccaggaagtccgcgaccagccgctgcggggtcagccgcggccacaaccggtcgacggcggaccagacctcggggttctcggcgagttcgtcgcggatctgggtgatgtcggacgggtcgaggaggttggagccgtcgtacgggtcggtgccgatgcgctcggcgaccatgtcggtgagggtgttgaggatgtgcccctcgaagtgctcgcgggccgcgttgtgcggcagcttcgcggcgcgggtgcgctcgcgggccacgctcaccagtccgtcgtcgagcatcaggacctcgcggtcgtgctcgatggcgatgaccgggtcgggcagcgcctgccggtcgcgtacgacggcggcgagcacgtcggccatgtccgcgcgccccttgacggcggcggcctgcggggtgtcggcggcggtcgccttcacgccggggaacagctcgcccacggtcgccagcagcacgcccgtctcaccgagcgagggcagcacctcgccgatgtagccgaggaacgccgggttggggccgacgatgaggacggcccggcgggcgagcagctcgcggtgctcgtagagcaggtaggcggcccggtgcagggcgaccgcggtcttgccggtgccggggccgccctccaccaccagcacgccgcggtgcggggcgcggatgatgcggtcctggtcggcctggatggtgcgcacgatgtcgcccatccggccggtgcgcgcggagttcagcgcggccagcagcaccgcgtcgccggccgggtcctcgtggccggtgcgggtggcgtcgcccaggtcgaggatctcgtcgtgcagggcggtgacgcggcggccctcgctggagatgtgccggcggcggcgcaggcccatcggggtgtgcccggtggccaggtagaacgggcgggcgacggcggcccgccagtcgatcaggacgggcgtgcgctccgcgtcgtcggcacgcagcccgatgcggccgatgtggtggctgacgccgtcggtcagatcgatccgcccgaagcagagcgaaccgtccacggagttcagcgcggcgagcagccccgagcgctcggcgacgaggatgtcccgctccagccgggcctgcatgggcgtgttgccctgggcgagggcgtccgtgacggcggcctcggtgtcaccgcgcagcgcgtcgacgtgcgcgtacagcccgtcgatgaattcctgttcctgctgcaattcaccgtcggagaaatcggtgtttgacaattccgctcccggccgcatatactgtgctcagtagacttctccgcgaccacattcttcgtgaagtcgcgaaccaccgaatatacgcaaagaaatcccccgggcgcaattgcccgggggatttctcgtgtcggcggcgggccggtcagcgcgcgtcggacagcacgtcggacagctcttcgagcagccgccgcttgggcctcgcgccgaccatggaccgcaccggctcgccgtcccggaagaccatgagcgtgggcgtgcccagcacgccgtacctgatcgtcgtcgccgggttgcggtccacgtccagctggacgatcttcagccgctccccctcctcggccgcgacggccgcgaggaccggcgcgagctgccggcacggcccgcaccactcggccgtgaactgcaccagcaccggcactccggcgctcagcacctccgccgcgaagtcgtcgtcggtcacttccccgacaccttccacctgcttgatcaccgctcgtgccctcccagctcgcacaccggttccggaccccccggaaccagcgactcggcggccagctcctcccgcgcccgctcggcccgcgccagctgggcggcgacctgcgcgcgcaccgcccccagctccccgatcaacgcgtccagctcgtcgagcttgcgccggtagaccacgagcgaggccggacaggagtcgccctccgggtgcccggcgcgcagacactccacgaagggccgcgtctcctccaggtcgaacccgaagtcctgcagcgtcctgatctgccgcagcagtctgaggtcccgctcgtcgtacgtgcggtacccctgggcgtcgcgccgtgcgggcagcagcccccgcgactcgtagtaccgcagcgcccgcgtcgtggtcccggcccgctcggccagctcgccgattcgcatgtccccgacggtacgggttgacgtcggcgtcaaggcaacggcggcccggagcatccgaacccgctcagaccatcacccccgccgacacctccacctcgaggagcgacgcgctgcggcgttcctcctcgaaggccttgcggccgccgcgcagcccgaagaggcgtttggcgacggcgatgtagaggacggcgaggatgttgagggccagcgtggcgatcttcaccgcgctgatgtgctcggtgagttcgtagatctccagcgggaggaaggcggcggtggcgaccaccgtcaggtactccgcccagcgcttggcgtaccagaggccgaccgcctcgatgatctcgatcagcgcgtaggccagcagcagcccggccacgaccagcagcgtggagtgcttgtagccgaaggtcttctggatggtgccgacgaccggtgaatggtcgaggtcgtagtggaagtgcctgaagacggggcggaagacgtccaggtactcgttgaagaggcggcgtaccgcgtcctggctgttgctgaatctccagacggcgaccgccaccaggacgatgaacaccccgcgcaccacccgctccagggcgaggaagcgcaggatgaacaggtcccgcagcaccttgccgcgcggtaccaggggcgcgtcggctgccggacccgagccgtgcgggtcgccgagcacgaagtcgccgcagcgcaggcagcgccagacctcgccgagggcggtgtcggcgtgcagccggatgcgcagccgggggtcgtccggtgcgtaggtcacgtggcccttgcgcgcgcaggtgcgccggtcccagtcgatcgccatcccccgttgcctccatctgcgtctgttctgcgtctgctgcgtctgcgtacgtacgcggccgtgccgcgccggtcgatcacggcacggcacggcacgctagtgcatcgcggtaagagacgccgaccaggggcgtttcagttcacgcggcccaccaggtccttcgtctcctgcgccggttccgtcgcacggccggtgccgcgcggcagcagcagggccacggcgagggtgccggcgcccaggatcacggcgccgatcaggctggtgtgggagacggcgtcggcgaaggaggagccgacggcgtccttcatctgccgggcgccctggaggagctgcccggcctgggccttcagctgggcggcctggtgcgggtcggtcgtctgcgcggcctgcgcggcgagccggcgcgcctgctcgccgatgccctgggag

SEQ ID NO: 331 - DNA, 8586 bp, Unknown
  Kingdom: Bacteria, Phylum: Actinobacteria, Class: Actinobacteria, Order: Streptomycetales, Family: Streptomycetaceae, Genus: Streptomyces
cggcggtgctggcggcggtgcgcgtggccgcgcccgccccggcgatgtcgctcaccgcgggccgccgcgatcccgccgacatcgccgagcggatccgccacctcggggaactgcaccaggcggggctcgtcacggacgaggagttctcggtgaagaaggcggaactgctggcggagctgtgagcagccgcttccggttccgccgcggacccggcgttcagcgggcccggtggccggcctccgcgtagaacctgatcttgcggtccagtacggagacggtgtcctggagttcggcgatccgggccaggacgtcccggcgggtcgcctccagcagctcgaaccgctccccgtacgtgctctcgcccacgcgcaccagctccgcgtacctgaccatgtcggccaccggcatgccggtcagccgcagcttgccgaccaggtcgagccagtccaggtcgcggttggtgtagcggcgctgcccggtgtgcgagcggtcgacgtgcgccatcaggccgatccgttcgtaccagcgcagggtgtgggcggtcagcccggtgaaggcgacgacctcgctgatcgtgtagctgtcctgcccgtcggggcgcggatgccgcgggggcgggccggagcagcggtcggcgctggtgggggcgctgctcgaggcgcgggtgggggcgctcgcgggcacgctctcgggctcctgcgtctcccggatgtccacggccgtggtctgcgtcaccgtcatgacctccacgctatggccttcgagtgcactcaaggcaaggcgcccccgtcaactccccgggaaaagcgcaggacacgccccggccgtcctggctagcgtgctcagtcatgagtctcgtacgacgtgccggacccgcggacgccgccgaagtgctgcggctgcgccaggtgatgatcgactcgctgttccaggccgaccggtcgaccgagtggcacatggagtcactgcccacgctgcgctcgcgcctcggtgacgcggacggcgacttcgcggccttcgtcgtcgaccacccggagcgtggccgggcgcgctcgcggcactggtggccgggacgatcgagtaccggatcggccgggccggcgaccccaccggcacggtcggcttcgtcttcagcgtcgccaccgaccccgacgcccgcaggcgcgggtacgcacgggcgggcatgcagacgctcctggagtggttccgcgagcgcggtgcgcggcggatccagctcaccgcgtccgcggaggccgcaccgctgtacgcctcgctcggcttcctgccgaagccggacccgctgctggagctgcggctctgagacgcgcgcggcccgcggcgagccctgccgcgtcccgcccgtcagggtcacgtccctgggcaccggcccgcacctcgtcccgttcacgcaccgggtgggcccgtcctcggcgcgccggtgcgccgcgtaggctcgggccatgtcgttgaacagcctggcgtcgatcgagaactggccggtgcccaccgccgcggcgggcgtggtccgcgcggacggcacggtcgccggcacccacggcccgaccggccaccgcttcccgctggcctcggtgaccaagccgctggcggcctacgcggtcctggtcgcgtacgaggagggcgccgtcgagctggacgaacccgcgggcccgcccggggccacggtccgccacctcctcgcccacacctccggcctggccttcgacgagcaccgggtgacggccccgcccggtgagcgccggctgtactccaacgccggcttcgaacagctcggcgaccacgtggcgaaggcgacggacatccccttcgcggagtacctgcgccaggcggtgctggagccgctgggcatgacgcggaccaccctggagggctccccggcgaaggacggcgtctccaccgtcgacgacctcctccgcttcgccgccgaactccagtccccgcgcctgctcgacccgcgcacggtcgccgaggcgatgaccgtccagtacccgggcacgaagggcgtcctgccgggctacggccaccagaacccgaacgactggggtctcggcttcgagatccgcgactccaagtccccgcactggaccggcacttcctcctccccccgcaccttcggccacttcggccagtccggcacgttcctgtggaccgacccggacgcgggcgcggcctccgtcgccctgaccgaccgggccttcgggccgtgggcgatcgaggcgtggccggtgttcacggacgcggtgctcggggagctgcgctgacgctgccgggtgcgcgctcggtccgagcacgctcggaccggacggccggcgcaggcactccgcccccggcaggggccggtcaggacggatctccggtccggcccccgtccttctcctgcatctcccagaccagcagttccgcctcgctcaccgcccgcgcctccgtctgtcccgcgtccgtgagccgggccgcgtcccccggccccaaccgctcccccgccaggccgacttcgccgcggacgacgtggacgtacacgaaggcggccgacgggaccgtcgtcgtcccgcccggtgccaggcggcggacgtggagggtcgccgcggcccgcgggacggcgtacggcgtggtgtccgccaggacgcgtacgacttcgtagtgcggctcgccgccgggatccaggggggccagccacatctggacgaaggtcaggggggccgccgcgtcgttgcgttccgtgtggcggacgccggtcgccgcggacaggtgctggaggtcgccggggcggatcaccgtcgcccggcccgtggagtcacggtgggtcagttcgccctcgacgacccacgtgacgatctcggtgtggctgtgcgggtgctcggcgaagcccgcgccgggggccagacgctcctcgttgcaggcgatcagggcgccgaagcggaggttgccggggtcgtagtgggggccgaaggagaaggcgtgccgggtggtgatcccggcgctctcctcaccgcccgggtagcggtccgccgcgcgtcgtacgtcgatcgtcacgggtcccaccgtaggccgtcgcgggcccgccggaggccgtcacgggccccgccgtaggccctgccggcccggggtacgggcgccgattccgacccgcggcacgcacgcacgtccggataaggcagtcttgtcccgtgcccgaacccgaatcgcatagccccgaagccgcgccccgtcccgcccatccgcactccgcgaccctgaaacggctggagcggtcctccgggtcgctcgccgcgcaggcgatcgcacggatggacgagacgctgccgtggtaccgggccatgcctccggagaaccggtcctggatcgggctggtggcccaggcgggcatcgccgcgttcaccgagtggttccggcaccccgacgccccgcaggcgatctccaccgacgtgttcgggacggcgccgcgcgagctgacgcgggcgatcacgctgcggcagaccgtggagatggtgcggaccaccatcgaggtcatggagtccgccatcgacgaggtggccgcccccggtgacgagtccgtgctgcgcgaggcactgctcgtgtacgcccgggagatcgccttcgccaccgcgcaggtctacgcccaggccgccgaggcacgcggtgcctgggacgcgcgcctggaatcgctcgtggtgaacgcggtgctgagcggggaggccgacgagggcgccgtgtcgcgggccgccgcgctcggctggaactcgcccgagcacgtctgcgtggtgctgggcaccgcgcccgacggggactcggagctgaccgtggaggcgatccggcgggccgcccggcacgccaagctccaggtgctcaccggggtcctcggggaccggctggtggtgatcgcgggcggcaacgacaacccgctggccgtcgccaagtcgctgatcgggccctacgcggcggggccggtggtggccgggccgatcgtgcccgacctgctggccgccacccgctccgcgcaggccgccgcggccgggctgaaagcctgtttcgcctggcaggacgcaccgcgcccggtcctcgcggacgatctcctgccggagcgcgccatcgccggtgatccgggcgcgcgggagcagttggtagaggagatctacagaccgctggaggaggccggctccgccctcctggagacgctgagtgtctatctggagcaggcgagcagcctcgaaggcgccgcccggatgctcttcgttcacccgaacaccgtccgctaccggctccgacgtgtgacagacgtcaccgggtggtcaccctccgatgtacgatccgcgttcacactgaggatcgcgctgatcctggggcgtctggccgacggagatccccaggcctagccttttgtcgggggtccacaaaacccctccgtgttcttcgtccctgtccccacgggcggccatgcccgtccccaagagagagtgtgagagtgctcgtactcgtcgctcccggccagggcgcccagacgcccggcttcctgaccccctggctcgaactgcccggtgccgccgatcgtgtggccgcctggtcggacgccatcggcctggacctcgtccactacgggacgcaggccgacgcggacgccatccgtgacaccgcggtcgcgcagccgctgctcgtcgccgccgggatcctgtcggccgcggcgctcggtgacgtggcacccgatgccgtcgccgggcacagcgtcggcgagatcaccgccgccgccttcgcgggcgtgctggccgacaccgccgcgctgtccctggtccgccgccgcggtctggcgatggccgaggccgccgccgtcaccgagacgggcatgtcggcgctgctcggcggcgaccccgaggtgtccgtcgcgcacctggagaagctgggcctgaccccggcgaacgtcaacggcgcgggccagatcgtggccgccggcaccatggagcagctcgccgcgctggccgaggacaagccggagggcgtgcgcaaggtcgtgccgctgaaggtggccggcgccttccacacccgtcacatggcccccgcggtcgacaagctcgccgaggccgccaaggcgctcgagccgtccgacccgaaggtcacgtacgtctccaacaaggacggccgggccgtgacgagcggcaccgaggtcgtggagcggctggtcggccaggtggccaacccggtccgctgggacctgtgcatggagacgttcaaggagctgggcgccacggcgctgatcgaggtgtgcccgggcggcacgctgaccggtctggccaagcgggcgcttcccggcgtcaggacgctcgcgctgaagaccccagacgacctcgacgcggcccgcgagctcatcaccgagcacgcgagcgcctgacgaccgaaggagccgacgaacatgccgaagatcaggcccagccagggcgccccgtacgcgcgcatcctcggcgtgggcggctaccggcccacccgtgtggtgcccaacgaggtgatcctggagaagatcgactcgtccgacgagtggatccggtcgcgctccggcatcgagacccggcactgggcgtcgccggaggagaccgtcgcggccatgtcggtcgaggcctccggcaaggcgatcgcggacgccgggatcgacgcctcgcagatcggcgccgtcgtcgtctcgaccgtctcgcacttcagccagaccccggccgtcgccaccgagatcgccgacaagctgggcaccggcaaggccgccgcgttcgacatctcggcgggctgcgcgggcttcggctacggcctgacgctggccaagggcatggtggtggaaggttccgccgagtacgtgctcgtcatcggcgtggagcggctgagcgacctgaccgacctggaggaccgggccacggccttcctgttcggcgacggcgccggcgcggtcgtggtcggcccctcccaggagcccgcgatcggcccgaccgtgtggggctccgagggcgacaaggcccagacgatcaagcagaccgtcccgtgggaccgcttccgggtcggcgacctgtccgagcttcctgtcgacagcgacggcaacgtcaagttccccgcgatcacgcaggagggccaggcggtgttccgctgggccgtgttcgagatggcgaaggtcgcgcagcaggcgctggacgcggccgggatcagcccggacgacctggacgtcttcatcccgcaccaggccaacgtgcggatcatcgactcgatggtgaagacgctgaaactgccggagcacgtcacggtcgcccgtgacatccgcaccaccggcaacacctcggccgcctcgatcccgctcgcgatggagcggctcctggcgaccggcgaggcgaagagcggcgacaccgcgctcgtcatcggcttcggggcgggtctcgtctacgcagcgacggtcgttaccctcccctaggcactccgtgccggatcatgctccggtacggctccgccacacctgccgctgccgcggcgggcgccacaccctctggaacaccaacgaaggagcgccgacatggccgccactcagaaggagatcgtcgacggtctcgccgagatcgtgaacgagatcgccggtatccccaccgaggacgtccagctggacaagtccttcaccgacgacctggacgtcgactcgctgtccatggtcgaggtcgtcgtcgccgccgaagagcgtttcgacgtcaagatcccggacgaggacgtcaagaacctcaagacggtcggggacgccaccgactacatcctcaagcaccaggcctgatctaccgatcagtgctgtgggctgattgccccgccacccggcggtggcgccgtttttgatcctcgttccgttggagaaagaattcccgtgagcccgaccaatcgcaccgtggtcgtcaccggtatcggcgcaaccacaccgctgggtggcgacgcagcctctacctgggagggcctggtcgccggcaagtccggcgtcaagccgctgacccaggactgggcggccgagcaggccgtccgtatcgcggccccgatcgccgtggaaccgaccgagaccatcccgcggccgcaggcccgccgcctggaccgttcggcgcagttcgcgctgatcgccgcccaggaggcctggaaggacgccggtttctccggcaaggccggtgaggacggcagcgacggcgccgtcgacccggaccggctcggcgcggtcatcgcctccggcatcggcggcgtgacgaccctgctggaccagtacgacgtactgaaggagaagggcgtacgccgcgtctccccgcacaccgtccccatgctgatgccgaacggcccctcggccaacgtcggcctgctcgtgggcgcccgcgcgggcgtgcacaccccggtctccgcctgcgcgtcgggcgccgaggccatcggttacgccatcgagatgatccgtaccggccgcgccgacgtggtcgtcgccggcggcacggaggcggcgatccacccgctgccgatcgccgcgttcggcaacatgatggcgatgtccaagaacaacgagaaccccgagaccgcctcgcgtccctacgacgtcgaccgggacggcttcgtcctcggcgagggcgcgggtgtgctcgtcctggagtccgccgagcacgccgccgcgcgcggcgcccgcgtctacgcggaggcggtcggccagggcatctccgccgacagccacgacatcgtgcagccggagcccgagggccgcggcatctcgcacgcgctgcagaacctgctggaccgcaacgacctggacccggccgagatcgtgcacgtcaacgcgcacgccacctcgacgcctgccggtgacatcgccgagctgaaggcgctgcggaaggtgttcggcgacgacgcggaccacatggcggtctccgcgaccaagtcgatgaccggtcacctgctcggtggcgcgggcggcgtggagtcggtggcgaccgtgctggcgctgtatcaccgggtggcgccgccgaccatcaacctggacaacatcgaccccgaggccgaggcgaacgcggacgtggtccgtggcgaggcgcgcaagctgcccgtcgagggccggatcgctgccctcaacgactcgttcgggttcggcgggcacaacgtggtactggcgttccgtacggtctgagtctccgcgaacggcgtcggcccgagcccccgctgggggttcgggccgacgccgttcgttttcggttcgttcgccggctgaccgccggggggctgccgcgcagttccccgcgcgccttccgggcgcctcagaccacctggtggagccagcggaccggggctccttcacccgcgtagcggaagggttccagttcgtcgtcccagggcttgccgaggagcttggcgatctcggcctccaggtcggtctcgccgcgctgggagcgggtgagcgccgcgcgcagccggtcctcggggatgaggatgtcgccgtggatgccggtgacggcgtggaagatgccgaggtccggtgtgcagctgtagcgttcgccctcggcggtggcgcacggctcggcggtgacctcgaagcgcagcagctgccagccg

SEQ ID NO: 332 - DNA, 2101 bp, Unknown
  Kingdom: Bacteria, Phylum: Actinobacteria, Class: Actinobacteria, Order: Streptomycetales, Family: Streptomycetaceae, Genus: Streptomyces
acagcgccggggcccccggcgctgtaccggtgtgccgtggctacggcctgagcgcgggctcgcgttccacgtcccgcacgtccagcctggcgtccgggcgggccagcggccgggccgccgacgggttctcccgcaccgcggccggggcgactccggcccagtcgaggatccgggcggtggcgagcgccttctggtcgggcacgaggcccgcgacgttcgcgccgtggttcatgcccggtgccgtgaagacgtacgagtcccgtgcgccgtgtccgaggcggaaccgctccgagccccacgggtcgttctgcccgtagacgaacatcatctggtccgcgtggtggcgcacccaggtgtcgacgtcgcgcatcgcccacggctggaagcgcatcgggatggagcggggcacgaagttgcgcggcggctggtagccgtagcggatcagcttcttctcgatgtgcgggaagtggatggtgggcgcgccgagttgggtgcccgcctggtagtagtacggcgtgtacgtctccaggccctggtcggtgtaggcggagaagccggagatcgtgtcgacggagtcccagatctgctggtcggtggcggtacgggcgtcggcggggatcgtgtcgcagtccttcagcaggctgtactgccaaaagccccacacgtagtcgaggacgaccgcctcgtaagcccggtccaggctgccgatggtggtgaaggtgtagtggttgccgtcggcgtactgggcgtacttcttctccagcggctcgcggcgcaccagtgcctcgcgctgcacggcgccgagccggtcgcggcactccttggtgccgacggtctcgaagaagcggtcgtaggcggagtcctcgtcgttgacgacgtcgttgggcgcgacgtaggcgacgacgccgtccatgtcctgcgggtagaaccgctcgtagtaggtggccgtcatgccgcccttggagccgccggtggcgatccagttgtgcgagtagacctgcttgagggcggtgaagaggcggtgctggtcgctggccgcctgccagatgtcgagcttggaccagtcggccggggccggccgggacggggtgaagaagcggtactccagggagacctggttgccgtccacgatctgggtcggctcgcggcggctcggggtggtggagacgttgtagccgccggtgtagaacaccgtggggcggtcgactcccttgtgcagcacggtgatccgctgctggaaggtgccctcggacgggtgccggtggtcgaccggctgggtgtagttcaggacgaagaagcggtagccggtgtagggcttctcctcgatcaggctcatgcccggtatggacagcagccggtccttgatgtcggtgctggtggcccggtcctgggcggcggtggccgccccggccgtactgacggtgccgacgagcaccaccagcgccagcagccatctgagcgccttgcgcatgcacactcccctgtgagacagatgtgcgccggaagctatcggagcaactcgggtgcacaccaggggagtcggcgaattcgtcctcggcgggggcgtcgccgggtcagggtgtcagcacaggatccagccgctggcggccgagcgggagccgaccgagccgctgacgcgcacgcagcggtggccggcgtgcacggtgaccgggccggcgcggtaggagtagcggccccggtcggtgaccgggcggttgccgcgggcctgcacggtcaccgacatcgtctgcttgcggcccgggcggccggggaccgtgaccgcgcagacgtagccgtcgcgcttgtagacgtgcacggaaccggtcgcgaacgacagcgtcttgacctcgcggcccgcgcaggaggacgaggccgcctgggcggcgccgggcagcgcgagcgtgagcagcccggatccggtcagcacggccagccccagcgccagccggcggcgcagcgcacccctgtccacggtcactcctccccttgcaccaggcgtatcaacgtacacgcgtacggacgccgtacgtaccgcggatggttgccccgccgcgccacctgctacccgtcgcccgccacgcgtcacccgtcacccgtcacc

SEQ ID NO: 333 - DNA, 2469 bp, Unknown
  Kingdom: Bacteria, Phylum: Actinobacteria, Class: Actinobacteria, Order: Streptomycetales, Family: Streptomycetaceae, Genus: Streptomyces
accactgccctcaacaccggccccgcgcaaccgcgtcacgaggtcgcgcagcgcgttgccggtgttgagggcagtggtgttcagcgcctggcccacccggtcgctgatgcccgccccgacgaaggtggaccagctggtggacccgttgatcaggaactcaccgagcgcctcggcgccgccggaggcgaggaagtcaccgaactccttgatgaggtggtgccccgtcgccgcggccgtgccgggcggcggggcgggggtgaggtgcccgccgcccggcaggcccgaccccccgccgcggacgtcgggaccgggcccgggcgtgccgggtccgtccttggcggtggccgggccgtgggggaacggatccggcttgttcgtcggcacgttcggaccgggcttgggggcgcccttgaagtcgaggtccggggagttcttgtagaacgtcttgtcgtacccgttgaggacgccgcgggcgatgtcgcggaacacactgtcgaagaaccccaccgtgaggccgaacaggccgtcctggaggatctgcttccagtcgaagccgcccgggcgccgtccgttcggggcgcccaccatcatggcgagccgcaccgcgaaggtggtgaacgcctcttccagcgcctccgtcagggacggcagcaggtgcgtgcgctgcagcaggtggctgagcgtggtgaggacgagcagtcggctgcgtgccttggccagcgcgatctgtgtgagcgaggcgccgccggtgaagaacgacatcgccagatagaaggcgatctcgatgagcaggcggacgacctccgcgatcacctgccacttggcctccatgatgtccatggaggtcttgacccggccgtccgagatcgcgtcgagctggctgccgaagtcgcgcaggaggttcttgccgccgtcgtcgatgagcaggttcatcgcacggacgtattcgcgggccacgtcgtccggcatggactgggcgatgtcccgtaccgatgcctcgacgagctgcgagagttcgcgtacccgcttgcccagccgcgcgtacggctgccggctgtcgtaggccaggtcctcgtcggcctggagcagccgctccccggtgaggatgaacaacagcgcgttcacctcgggagacgccttgatgctcacccctgcccggcccttcccccgggccgggacgcgagcgccgggcgcgggtcagtgacggccatggttcccggcgttctccacctggttcgtctgctgcccgatggcatccagcgcctggtcgcggacgcgggtcatcgagtccaggttctgcagcgtgccctcggtgatgccgacgatggcgtcccggatcgcggtgcaggtgtccttggcggcctgccgctccttctgctccttgggccgcgcctgcttcgcgaagtcgtcactggtacccggccagtccacggtcgcactgatctcgtccaggaagtccgcggtgatgctgcgggccaggtccgcgatctgcttcagctgttcggtacccgcctggatccggcgcgggtcgccgtagtaacgctccgacacggctagtcctcaccgtcctcgccgagcgcgtcccgccagggcgcgcccgtgccccgcttcttccctcccggccggtccgggtcctccagcacctcgggtccgaagagcttcgcccagtcgacctccagaccgctcagttccggcacgtccgcgttcccctcggcgaagggcgccatggcccgcatgacgttccggcccatctcgacacgtgcctgctgtgccgcctccagcacgctggccgccagctcctgcggcgacatccggcggtacttgccgtccaggaactccagttggctcagttctccctgcgggcccacggtgacgcgcaccgcccggtcggacgacagcgcaccgtaggaggcgttgcgcagttcctgctcggtgcgggcgaccgcttcctgcgtggccttgagttcggccatcgcccgctcgatgcgcttgtccagcggttccgtcactgccgcgtcccctcctgtccgtctcccgccgccacgccggcgtcctcctgcgcgccgcaagtccgccgccggtcacggccgttcggccgtgctcgcatcgtaaccgctgccgatgacctgccggttccccgtacggctgtgacctgccactcctgcggtgcctccgcctgcggtcagcgaccgatgacggctggtgcgccgccctcgtcggtgccccagacgtctgtgtcgtcgtccgcctggagcgaggaacccccggtcgtgcggacctgggccgcgccctgcggtgtctcctcgccggggcggccgctcgtggtggccggccgcgaggcgggtgccaggaacgtgtcgtcctcgtcctcaccgccccagcgaccgtgccgagcggttctggtgcggcgtttgctctcctccagcgagtcggtgagcacggcgcgcacccgttccgcgtgcgtgccct

SEQ ID NO: 334 - DNA, 5553 bp, Unknown
  Kingdom: Bacteria, Phylum: Actinobacteria, Class: Actinobacteria, Order: Streptomycetales, Family: Streptomycetaceae, Genus: Streptomyces
ccccccagccgcagcgcgccgaacgcgaccgcgagtggctgggacgcggcgcgctgcggctggggggcgaggatctcggcgacgccgagccaggacgtctcggcgccctgcgcgcacccctcgtcgcccgcggcctcctgcgtctcctgcgcttcctcggcggacatgcgcgcccacacggtcttggccccggcccggtaggtgatgccccactcctcggcgagcgcggcgaccagccgcaggccgcggccgtactccgccggttcgtacgccggctccccgtcctggccgtggtcgcgcggggcgcgcgaggggtgctggtcggtgacctcgacgacgcacgcgccggtctccgcctccagccggcaggtcagctcggcgtgcgtgcccgcgtgcacgacgacgttggtgaccagctcgctgacgacgaccaggaccacgtcggcgagccgctccgcaacgtccaggccgaggtcgcgccacttctcgaaccccgtgcgcaccagcgcacgggcggagcccggcgccagcgggctgccgggcagcgtcgcgcgcacctcgccaccggcccccgcgccctgccgcgcgcccggctcaccggcgcgggaacccgtctcccgctgcgtcggaatggcccccatctacagctccccgagcaatcggacgataggtcggtcttcgccgacagggtgacagaccgatcgcgtccatgagcacggagttaccgaactgggccgccgggggcgggaactgtgctacgcatgaactactacgccctcacgcctcccgctccctctcgcacgtcgccgcgtacacgcctcacgcctcccgcgtccccgcgtacatgtcgtcgatcaggtgcttgtactcccgctccaccacgggccgcttcagcttcagggacggggtgatctcaccgtgttcgacgtcgaggtcgcgcggcaggaggcggaacttcttgatggtctgccagcgctgcaggccctcgttgagctgctggacgtagccgtcgatcagttcgacggtctgcggggcggcgacgacctcggcataggccttgccgtccaggccgttctccttggcccactccaggatcgcgggctcgtcgagcgagatgagggcggtgcagaagttgcggtcggcgccgtgcaccaggatgttcgagacgtacgggcacacggccttgaactggccctcgacctcggcgggcgcgatgtacttgccgccggaggtcttgatgaggtccttcttgcggtcggtgatgcgcaggtagccgtccggggacagttcgccgatgtcgccggtgtggaaccagccgtcggactccagcacctcgtcggtcttctcgggcagcttgtggtagccctgcatgatgcccgggccgcgcagcaggatctcgccgtcctccgcgatgcggacctcggtgccgggcagcggcttgccgacggtgccggtgcggtaggcctcgccggggttgacgaaggaggcggcggaggactcggtgaggccgtagccctccaggatgtggatgccggcgccggcgaagaagtagccgatctccggggcgagcgcggcgctgcccgagacgcaggcgcgcagccggccgccgaaggcctcgcggatcttggcgaagacgagggtgtcggcgaccttgtgcttggcggcgagggcgaagggcgcggagtggacgccggtgcgcttgaagttgtcctgcgtgaccttcgcgtactcgcggccgacctcggcggcccactggaagatcttgtacttggcgttgccgccggcgcgggccttggcggcgacgccgttgtagaccttctcgaagatgcgcgggaccgcggccatgtaggtgggctggacgaccggcaggttctcgatgatcttgtcgacgcggccgtcgacggcggtgacgtgccccagttcgatctgcccggaggtgagcaccttgccgaagacgtgcgcgagcggcagccacaggtactgcacgtcgtcggggccgagcaggccggtggaggcgatcgccttggccatgtacgaccagttgtcgtgcgggaggcggacacccttgggccggccggtggtgccggaggtgtagatgagggtggcgagctggtccttggtgatcgcgccgacccgctccttgatcagctccgggtgctcgtccaggtaggcggcgccgcgccgctccagctcggccagcgtgagcacccagccgtccccgccgctctccacgcccgccgggtcgatcacgacgacgtggtgcagctcgggcagttcggcgcggcgttcgacggccttggcgagctgcgcggcgttctccgcgatgagcactctgctctcggagtcggacaggatgaacgcggactcgtcggcgttggtctgcgggtagaccgtggtggtggccgcgcccgcgcacatgatgccgaggtcggccagcacccactccacgcgggtggaggaggcgagcgcgacccgctcctcgggccgcacgcccagttcgatgagcccggcggcgatggcgtacacccgctcggcggcctgcccccagctcagcgaacgccactcgtcggggccctcgccggaggacggcggtacggggtagcggtaggcctcggcgtccggtgtggccgccacgcgctccaggaagagggccgccacggacggcggacggttctcgatcagggtctgtgcgtcgctcacgacatcctccggggcccgcgacagtgcggcggctggctcaggtgcggctgggttgactcacgggtggttcggcctgttgtttaactcacgagtaactagcgagcaggcatcagggtaaagggcgaccggccaccgcgtaagaggctgtggcctgagacttcccgccgagcgccaccacgcgcacacgcaggggcccgccgcactttcgtacgacgggccccgtttcgcccggttcaccggcgcggcggccgctcgacccgggctaccgccggttacttcttgcccttggccgatcccgcgctgtcatcgctggagagcaccgcgatgaaggcctcctgcggaacctccacggaacccaccatcttcatgcgcttcttgccttccttctgcttctccagcagcttccgcttacgggagatgtcaccgccgtagcacttggcgaggacgtccttgcggatggcgcggatggtctcgcgggcgatcacgcgcgaaccgatggccgcctgcacgggcacctcgaagttctgccgcgggatcagctccctcagcttggcgacgagccggacgccgtacgcgtacgcctggtccttgtgggtgatcgccgagaaggcgtccaccttgtcgccgtgcagcaggatgtcgaccttcaccagggagctgctctgctcgcccgtgggctcgtagtccagggaggcgtacccgcgggtcttggacttcagctggtcgaagaagtcgaagacgatctccgcgagcgggagggtgtagcggatctcgacgcggtcctcggagaggtagtccatgccgagcagggtgccgcgccgggtctggcacagctccatgatcgcgccgatgaactccgtgggcgcgaggatggtggcccgcacgaccggctcgtacacctccgcgatcttcccctccgggaactcgctcgggttggtgacggtgatctcggcgccgtcctccatgatcacgcggtagaccacgttgggcgcggtggcgatcaggtcgaggccgaactcgcgctccagccgctcgcggatcacgtccaggtggagcaggccgaggaagccgacgcggaaaccgaagccgagggccgcggaggtctccggctcgtagacgagcgcggcgtcgttgagctggagcttgtccagcgcctcgcgcagctccgggtagtccgagccgtccagcggatacagaccggagaagaccatgggcttggggtccttgtacccgcccagggcctcggtggcgcccttgctctggctggtgacggtgtcaccgaccttggactggcggacgtccttcacaccggtgatcaggtagcccacctcgccgacacccaggccgtcggcggggagcatctccggggagttggtgccgatctccagcagctcgtgcgtggcgccggtggacatcatccggatccgctcgcgcttgttgagctggccgtcgatgacacggacgtacgtcaccacgccgcggtaggagtcgtagaccgagtcgaagatcatcgcgcgggcgggggcgtccttgacgccgaccggagccgggatctggtcgacggccttgtcgagcagcgcctcgacgccgaggccggtcttcgcggagaccttcagcacgtcgtcggggtcacagccgaccaggttggccagctcctcggcgaacttctccggctgcgcggccggcaggtcgatcttgttgaggaccgggatgatcgtgaggtcgttctccatcgccaggtagaggttggcgagggtctgcgcctcgatgccctgcgccgcgtccaccaggaggatcgtcccctcgcaggcggcgagcgaacgggacacctcgtacgtgaagtcgacgtgccccggcgtgtcgatcatgttgaggatgtgcgtgttgccggggtcgtgggtcggggcccacggcagccgcaccgcctgggacttgatcgtgatgccgcgctcgcgctcgatgtccatgcggtcgaggtactgggcacgcatctgccgctgctcgaccacaccggtcagctgcagcatccggtcggcgagagtggacttgccgtggtcgatgtgcgcgatgatgcagaaattgcggatcagcgccgggtcggtacggctcggctcgggcacatggctgggggtcgcgggcacgcagggtcctgattcttgaggcgtccgcatacgtgtgcttgtccgtctgcggtctcgggtcggatcgatacgtagtctttccatggtcccatgtccggccgggaccggtgagccgcgaccggtttgggccacgcaacgggccgctggtaacgtggggggctgtgtctcatgccctctcagcacgaggcacatcggaaaattttcgaaagagaaggctcattcgtggcgaacatcaagtcccagatcaagcggatcaagaccaacgagaaggctcggctgcgcaacaaggccgtcaagtcctccctgaagaccgcgatccgcaaggcccgcgaggccgctgctgcgggtgacgccgagaaggccaccgagtaccagcgcgctgccgcgcgtcagctcgacaaggccgtctccaagggcgtcatccacaagaaccaggccgccaacaagaagtcggcgcttgcttcgaaggtcgcttcgctcaagggctgagtttcctgacttgacgccggacggacccgagcgggccctctctcatccgctcccgcccggcacccagagcctgtgcgcggcctgcgttcgccacgcgggcatgggctcacgagcatgatccgaaggccccggccgcctctcccttccccagggagggcggcgggggccttcggccttttcggtcttttccgcgggggagggctggtgctgttctcttctgcgg

SEQ ID NO: 335 - DNA, 2232 bp, Unknown
  Kingdom: Bacteria, Phylum: Actinobacteria, Class: Actinobacteria, Order: Streptomycetales, Family: Streptomycetaceae, Genus: Streptomyces
cggcagcgggtcggccgccgcggcggacgccgagctggcggcggccgacccgctgccgcacaacggatacaaggtgaccctcatgcgcaacctggtggtggccgtgctgaccgaactcgccgaggagaccgcccgatgaccaccgccaccggaacacccacgtccgtcaagggctccgtcggcaccgcgcacacccgcgtggagggccgcgacaaggtcaccggagccgcgcgctacgccggggagatccccttcgccgacctggcccacggctggctggtgctgtccaccgtggcccggggccggatccgctccgtggagaccgggcccgtcctcggcatgcccggcgtcctcaccgttctgcaccacgagaacgcgccacgcctggagaccgacttcatcggcctgctgggttcaccgccggaccccacctgcactctcttccagaacgaccgggtggcgcacctgggctggccggtggcgctggtcgtcgccgagacctccgagcaggcccgcgaagccgccgaagccctcgtcgtgcactacgaacaggagccgcacgacaccgagttctccgccgaccgcaccgacgcgtacgcgttggagggccatatgccggcggtggtcgagaagggcgacctggaggccgagctcgccgcctccgccatcgtcctggaccaggagtacaccactcccgaagaacaccacagcatgatggagccgcacgcggccaccgccctgtgggacggcgggcggctggaggtcgtcgactccaaccagggagccacctgggtcgtcggtgaactggccaagatgttctcgctcgacccgtccgccgtgcgggtgcgctccgaacacgtcggcggcggcttcggcagcaagggagtgcgcgtccaccaggtgggcgccgtgatggccacgaccgtcctgcaccgcccggtccgggtcgtcctgacccgccgccagatgttctcgctgaccggctaccgcagccccaccgcccagcggatcaggctcggcgcggacgccgacggacggctgcgcgcgctggagcacctctcgctcaaccagacctcggccgtccacgagttcgtcgagtcgtgcgccgccccctcacgggtgatgtacgacgccgacgcccaccacaccgcgcaccgcatcgtccggctggacgtgccgaccccgaccttcatgcgtgcaccgggcgaggccccgggctccttcgcgctggagtcggcgctcgacgaactcgccgagaaatgcggcctggacccgatcgaactgcgccggcgcaacgaaccggagcggggccccgtctccggactgcccttcagcggccgcaatctagaagcctgcttcagcgaaggcgcccgcagattcggctgggcagaccgcgacccgcgtcccggcgtgcgccgggagggccgctggctgctcggcaccggcatggcagccgcgtccttcccctccggagccggaccgtccaccgcggtcgtcacggccgaggcggacggcaccttcaccgtgcggatcgccgccgcggacatcggtaccggcgcccgcaccgcgctggtcctgatcgccgccgacgccctggcgaccacaccggacaaggtcagggtgcggatcggggacagcgacttcggaccggcgatgatcgccggcggttccatgggcacccgctcctggggctgggcgatcaagatcgcggccagggagctgcgggagcggctggcgctgggcaccgacatcccgccggagggcatcaccgtacggtccgacaccacggaggccctgggcgccctcgcccgcaaggaacgccactccttcggcgcccagttcgccgaggtcgccgtggacgtcaccaccggcgaggtgcgggtgcgccgcatgctcggcatcttcgcggccggcaagatcgtcaacccgctcaccgcacgcagccagctcgtcggcggcatgatctggggcatctccatggcgctgcacgaggaggcggtccgcgaccgggccagcggcggcctctacggcgccgacctcgccggctaccacgtcgcgacgcacgccgacgtaccgccgctcatcgaggccgactgggtcgacgacccggacccggacgacccggtcgggatcaagggcatcggcgaggtcggcatcgtcggcgcggcggcggccgtcgccaacgcggtctggcacgccaccggcgtccgccaccgccacctgcccatccgc

SEQ ID NO: 336 - DNA, 3253 bp, Unknown
  Kingdom: Bacteria, Phylum: Actinobacteria, Class: Actinobacteria, Order: Streptomycetales, Family: Streptomycetaceae, Genus: Streptomyces
gggcgggagcggggtgacttctttcgcgcatggcgtgctcctggtggggggagtggagcccaactcgtcctcgcaaaagacgcgttggcgctgactgcgaaccggtcgcaacgtacgcgcgctggtcgaacacgtcaatgtttgttgcttcgaagtgggatgagcgtcggcgtatgtccgaatctgttgcttaccggtccgtcggtccggcccgtcagctcacgcctcgcgcggaggctggggcggcaccggcccctcgcccgcgtaggtgtccccccgcgcgggcatcggcacgtcgtcctcggcgagcgtcagagtgggccaaggcccggccagggcggcgtcgtcgaggacgatgccgaggtggtcgaggaggagggccaccaagggtgccattccggcatcctcgccctcgtgcgcggcgagtgccgcctccacccggtcccaccaggacgcgctctgcccgggccgggtgtgctccatgcccggctcgaagttctcgacgcactcgccgtcgcgccagtactggaagacgtcgatgccctcggtggtcgccacgctgtacgtctcggtgccccgggagagcgcggcgagcggctcgccccaggagccgatgagaccgtcctcctcgacgcagaaggcccattcgccgagctgcccggcccgcagcagcgagacagtcccgtcaccggcgtcgcccgcgggcaggtcggaggccgcgtccccgtcgagcaggcgcgcccgcgccgggtcggccccgtaccggcggaacacgtcctcgggaatcaggccgcgcgtgaaggtgacgcacatccaggccgtcgcccagcgcaacgaccgcacgtccgcgcctgcttccatgtcctgcctccgtcgttcacgtccggcacgctcgccggtcccggcacctccgggcacccggccgtgcgcgcggcacggccgggaacccggatcatgatgcccgattcaggcggtgaactcgatgcggaaggggtcgtcgtccacgagacgctggtacttgcgcagcgagccgaggaccccgcccgccgagctgttggcgcgctgggtgatgtgcagccgcaggcaggtctccgcgcccgtggccgggcgggtgggccaggtcgccggggcggaccacacgccgttcacgacctgcggggtcagctcggcacacaggttgccgtcctggccgccctccttcgtgctggcgggcgggaactcgtcgcagctgtccgcgccgcgctgcgtcgggtagaggttggtgaagggtgtgcaggtggcggtgcggttggtgttcgccgtggtctggttgaccgcgtgcaggatgtcggtgccgcggcgcctcatgatctcctcgtagatcggcacgacgatgccgtacttctcgtgcgagcgcgaatagctcagcaccgggaggtcgtcggtcggtatgacacagccgcgcagccggggctgctccttgtcgcagcggatctcggcgccggcggggctcgaccaggaggcgttcgggtcgagcgggacggcgccgggcatcagcacgtacatcttgtagctcgtccggaacgaggaccgggtggcgttcgccgcgaagtcgccgccgttgtacttggtcacgcccgtcttctcctggccgggcgtcaggttcggcgtgccgaaccacggctgcttcgtcttcgtcgtgcagccggcgccgcagctgacctccatcttcaccccgaggctcttcacctcgccggtcacccggaccagcctggcggtgatcgtctcgttgaggtccagcgacttgtaggacgtggcgagcgtggagttgacctggatgaggccggtgccgacgggcttggcgtactcgtcgtagagcgtgtacgtgacctcggcgccgttcaggcacagtccgccggtgcggctccagctccactggcccgggttggtcagcatgcaggagggggcgggcggctcggggtcctcggtgtccggctcgtactccgggtcggtgccggggtcgtccgggtcgtcggcgctcacgtcgtcggcggccgtggcgtcggcgcggggggccagcggggcggcggcctgcggacgggccgcgcccgcccggccgggaccgccgtcgacgctcacacaggcggtgaccgcggtgcgcacctcggcgcgtgccccggcgggcagcggagagcacgagtggccggcggtgaacgaggtgcgctgcagggtcgcggccgcagcggcggggtccaccgggccggggcctgtggcggcggcctggccggtggtcccggcgagggtcggacgagccggtgcgaccgggccgtcggcggcgacggcggtgccggtcgcggtcagggccgcggtgagggcgagggcggcgaggacgggcagggccgcccgtctggcacgtggtgaggacatgtcttctctcgggtggaaggggaagagaggggcgcgaagtgggccggtcaccgggacgcgcgggccccggtgaccggatggacggccatgaccggatggacgaccgtgtccatgcctagaagaagctcttgacgagcgaggagaccccgtcccccaccttcgagatcccgctggccacgggtgcggccaccttgggcacgacgcgcgagacgcccgcgccgatggccgcgatgctgaggaccgtcttgccggccgacatggcgaacttcccgctggtgaagccgtactcgatcccgttgcacagggtgctgagggccgaggtggccaccgagacgccgacgagcacgccggcgatcgacccgaggacgggtgcggcgggcgggaagaacgccgaggcgacgaggaggcctccggcgacgagaccggtggccatgctggtcacctcgaaggcgtccgcccaccagcccgcgtccgagtaccacgggtcgtcgccgccgtcgccggtgccgtgcgggttgaccttgtcgttgtgctcgttgtcggccgggttgcggttcttgtcgcggttctcctgcgccttcttggccgcgtcgtcggccgccttcgcgatctccgcctgccgcttgtccgaggcgatcttgcgggcctcgctcgcggcgtcggcggccgtctgcgcgtccttgcccgcctccagcgaggactggcgcgccgaggccgcggaggcgcgggcctggtaggaggactgcagggcgctgcgggcggagtccaccgccttgttggcggagtagttggccgagcgcgaggcactgcgcgcggtcgccgcggcggccgcgcgcagtgcctcgcg

SEQ ID NO: 337 - DNA, 10306 bp, Unknown
  Kingdom: Bacteria, Phylum: Actinobacteria, Class: Actinobacteria, Order: Streptomycetales, Family: Streptomycetaceae, Genus: Streptomyces
ccgggggagtcatggatccgttgacggcggtgagcgcggggcgggccgcggcggggcgccggttcgccttctacctctctgcgcagctgacctccgttctggcgcccggcctggtcgccgtgacctgcctgaccgcgctcctgctgcacgccggccatccgcagcaccccggccccgccgtcgagagcgccgtacgcgccctgcacggaccggccatgatcctcgtcgacgtgtcctggctggccgccgcgtacgtgatcggatacgtcggccgggaactggccttccgcctgctcggcgccgccgagcgcctcagccaccggcaccgggccgccctgggcgcgctccgcacagaactcgaagccgtctacggaacaccggctctgcgccgttgcctgggcacccaccccttactggaccacctgctgcgagcggccgaccggaccgccacgccctcccagaacatgcggcggcctggcggcgcgctgcgcgcgggcaacgtctacgaggcgttcaactacgccaagtcctggctccgcacgcacagccccgccctcgcgcccgatgccacccgggttcggaggctggcgagcagcccccgctcccgggtgtggcgggccgaactgtcgggcacgcccgtggtgatcagacacctcgtcgaaggaccggaggcagccgggcgatacgggcgcgaggtgaccgcgctacgcctcgcatccagagccggccctcccgtcgcgctgaggctgctgggcgcggacccggacgagcggaccctggtcatcgagcacgtggacggcggccggccccgcgaggactggccggtcgactacgccaccgcctggccaggctccatgcggtcaccgcggcggagccgagggcgctcttccggcctggtccggacccgcggaggccgacgtcgggtccttcctgaccttggcgcgtacgctcggggcggagatccctccgggcacgcgagcggaactggatgccctcgtcggccgcctggcccggctgccgggcggctccctgctgcacggcgacccgtgtcccttggagtggccgcgtggttcacgctggctgtcaggcgcatcgccaccttctcgccagggtaggccgcgaccggctcagttcagcagcatcagaccgatcagccagatcgcggtgacggccagggaggccgggccaggtgggcggcgtgcaggccgggtgagagctgggtgcccatcacgacgacggccaggacgcccacgacgtgtacctggcgaagggggcactgctgcggtggattacgcgaggggcgggtgcgcagtgttgcggcggaccacctggcgggcaccgggcgtcgcagcgccgcatcatctgacggctgcgacgccctggccttggggccgcctgacggcggttcgccggtcagcctgccgggcgggagcgcccggtgtgtgcctggtgtgcgggatcgccgggctgccggctcgtgccagcggtggggccggttggtgacaaggctgtgtggtgtgtggacggcgcggtgtctgggggcgcgtggtgtgcgcgatcgcgccgcccagccaccggccccgtcctcggtgccgggtgtcgtaggttcaggccgatgcgaagaaggcgcggctgcccggggtgccgagctgggagcgggctgccgattccatgccggagcgggcgatggcggacaggcgcaggagacggccctcctcccagcgggccagttgcgcggtgggcagttcctggtccggtgtccagccgcgcagtgccgccgcgaggccggcggcgtcgccgaacgccttggaggtgccggacgccgtgtggggacgtaccgtcccggcggcgtcgccgatcagcgcggcgtggtcggcgaccatccggtacggggacaggtcgaagacaggctgcatgaagatgtcggagaccgccgtgaggcgggcgaactgcggcggcagcgacttctcggcggtggccaggaactccgcgcggatctcgtcgaggatctcaccgggcggcaggaacgtcgtgtacgtccgccccgaccggctggccagcacccgcggcagatctcgctcgggcacgttcgtgtaccagacccagttcacccgccgggagctctcggtcaactggccgtcggcgccgggcaccaggtagcacagcatctgctgcccgtccgagccgaagaacgtgaaccgccccgacagcagttccagcagatcggcgggcaccgcggactccggctgcagtccgcgccaggccacatatccggagtatgtggggcgcgtggcggggtcgagcagccggcgcgtcgccgagccgatgccgtccgcgcctaccaggaagttgccccgagtcgtgtacccgtcggtgaactcggcggtgacgtccgcgccctccacctccacccggttcagcgtgctgtcgaggcggtagcagaccccgtcggcgtccagcgggtcccgcagggtccggtagagggtgtcccaggcggtcatgagctgcggcatctcgtagcgggccacctgcccgtgcaggtgcagttgctgccgctcccgcagctcgacggacacctcccgcgccgtccgtcccagccggtgcagcaggtcctccacctccggctgcatgacgaccccggcgccgcgcgcctccatctgcctcgccgaacgctcgtacacggcggcctgggcgcccaccgctctcagctcgtgcgccgccgcgagtcctccgacggaaccaccgacgatcgtgaacctggccgccttgctcggctgcatctcgtgccttcccgtcctcggccaccgtggtgcaccccggcgccgctgtcgagggtcctctcatcctcccggtttggtgccggacccgcacggacagcacaccggctcggcactccaggccgccggatcacgtcgagcccgggtcaggacggggactggattcccaggaaccggcggccgttcgcttcgagcgtcgcggcgtcgaggccgttgtccagaagaaagcggactgggtcgggctgtgccatgtcgaaggggtagtcgctcccgcacaggatccggtcctgcgaagctttggctgtcaggagcctgagtacttcggggtcgtgggtgatcgtgtcgaagtagagcttggtgaatgcctgcgagggcgggcgtgtgctgccctggcggacatccgcccgtgaacgccatccgtgttcccagcgtccgagcagcgagggggcgcagcctccgccgtggacgaagcagatgcgcaggttcggcagttcttccatgacgccgctcaggagcagcgatgccacggcggtcgtggtctccaccgggttgccgatcaggttggtcaggtagtgatctttccattcgggccgtggccattgcatggggtggacgaggacggcgagtccatgggcggctgcggcggccagtaccttgcgcatgacgccttccccgtaggactgcccctggaccaggggtgggacggcgacgcctgcgatgccatccatagctgtcaggcgggtcatctcgcggcgggcggcgtccacatcgtccacgcgggtcagtccgagtccgaccagggtgccgtcgcaggaggagacagcttcggcaagccggtcgttgtaggccgagatgtagtcgtccgcctcggcgggcgcgtggacggggaaggcgaagggaggggccgagactgcgcgggcactgagacccgctttgagcgtgtcggccatgacagcttcgatgtcggtcatggccgaggtggggaagaacagcgggttgtcgccgaggaacagttctccgtcacggtcgttcatgcccccgagcggagagcccggcgggagggagagcagttcacggggcagccagtgcgcgtggacgtcgatgattccggggcggacacttccggtggcggccatgtctactcctcaaccgccgctcggcggcggggttgtcgcccggcggggtcaggtcgaggcttgccggtgttccttcgcggcgcgcatgatggctcggtggatcggctcgtagccggtgcaccggcacacgttggacccgacgatgcggtccacgcgctcggggtggtcgccgagagtggggtcgtcctccatggccccggcggccaccatgaggaatccgggggtgcagaagccgcactggagtgcgtgctcggcggagaatgcgcgctgcagcgcgctgggttcaccgttcgggccggagagtccttccactgtccggacagaggcgccgtcgcactgtacggcgagcatcaggcaggagcggacggcctcaccgtccaccaagaccgtgcaggcgccgcagaccccctgctcgcatcccagatgcgtgcccgtcaggcggcactcctcgcggaggacgtcggccaggatgcgccggggctccacgtccagcgggaacgcctcgccgttgacggtgacggtgatcttcatcaggtggctccctcggggccgccgatgcgcgaccggtggtcattcgcggcctggctcagtgtcctggcggtcacgacggcgatggcgtgccgccggtagtcgaggtccgcgtacggttcggcgatcggggctgcgtcctgctctgccgcgatccggccggcgcgggcgaacggatggtcctcgggcagctggtacccatccgtcggtgggccgatctcagcgtcggtcagggcctgttcggcagcatgtgccctcagcggccggtcggcacagttggccagtccgatgcgtgctccgctgatcacgccgtcgtgtacggtgaggacggctgcgacggccgtctgcgcgaagcagaagtgcgtgcgtcggtgctcgatgaagccgacgccggtgtgttcggcaagcatgggccaccgcacggaggtgatcagctctccgggtcggcgagcggtcttgagggggccgtgaaagtagtcgcgggccgcgacggtacgagcgcctcggggcccttgcagctggatgtcggcatccagggccatggcgatggcgcaccactcggacgcggggtggccccagccgaagctgcccaccatggtgccgcgggcgcggatgggtgggtgggcgatgttgaccacggcgagggagagcaaggaacccagggggccgggcacggcgtgcgccgattcgaagacttggtgcctgatgagggcgccgacctgcagtgtggtgtcggttacccgtatgtcgtcgagttccgggatgcggttgatgtcgaccaccaggtcggggcggatgcgatccaggtgcatctccaggagcaggctctggccgccggcgaggacttgggccttgcggctcccgtctcccagggcgtcgacggcctcggataccgtgcgcggcgccacatagtcgaaagctgcgggtttcaccgtgtgccctccagcttgggggcgcgggctgcacgccagatcacgtccggggtgagcggcatctgcagcaggtcggggcgggccggctggagtgcgtcgaccacggcgttgacaatcgcggccggcaagccgatgcagcccgactctcctgcgcccttcgcgccgaggggcgagtcggggcccggtgtgcaggtgtccttgacgtcgatgggcgcaacctcggtgaacgtgggcagcagatagttcaggaggccgtcggccagcagcggagtgccggcgtcgtcgtaggggatcccctcgtacaacgcctggccgatgccttgaagcgcggatccgaaggcttgtgcacggacgatttcagggtcgagctgcaccccgcagtcgtcgactgtgacgatcttcagcaggttgacggttccgagttccgcgtcgacctcggcaacagccacgtgggtgccgaagggaaacgccattgcggtctcgaagcggtcgtccacccggaggggaccggtggccttcacgagttcggccaggtccatggtcgatccgttccaggaggcttgaacggcgccgtcggaccattccacgtcgtcgaccggaagttcccacagcccggcggccctgttgcgggcctcttcgatgaccagcagggatgcgtgctggagcagggcgccggccacctgggcggtgcggctggcgaaggagcccaggccctcgggctgctcgtcggtgtccccctcgatcagccggacgcggtgctcgtcgacaccgaggaccttggcgaccagcgcggggaagaccgtctcgtggctctgcccgctggaggccgcgcccaaccggacggtgacggtgccgtcctcgacgacctcgatactgccgaactcgtgcagtccccccggttcaccgccggagcgttccacgtagctggagataccgatgcccaagggcttggcggccgggtccgtacggcgccgggcctgctcggccctccacgtgtcgtacccgacggtctccagcgccagatcgagcgcgcgggcgtattcgccgctgtcgtagatcctgccggtgggtgtctcgtacgggaagctttcaggagggatgaagttgcgccgccgaagttccgccgggtcgatgcccagccgccgcgccatcgtgtccatggaccgctccagggccatcaccgcctcggggcggccggcgcctcggtaggggtaggtcggcatggtgttggtcagcaccgagcggagggacgcatggacctggggcgtggtgtacggacccgttgccatccaggcggtctgcatcggcaggcccactcccaggtgcgggtacgcgcccacgtcggcgtcgatgtgcaactcgtaggccaggaggcggccttcggcatccgccgcgagccgggcgtactggtcctgccctcggccgcgtgttgccaccatcatcgattccagccggtcctcgatccaccgcaccgggcgctgcagcttcactgccaggaacgcgaccacgacgaactccgggaacaatgcactcttggacccgaacgcgccgccggtgtccggcaccactacacgcacctggtcttgggaccagtccagcagagcagccagttcccgcctcagccggtgaggcatctgatgccccgaccacaccgtcaagcgatctccttcggggacggcgaggatcgtcctgcactccatcggtgtgggcatgagcaggctctggcggaagcggccctcgaccacggctgcggcctgctgccacaccctgtcgtcgaccggctgcccggcctccccgcggaaagcgacgttgctcaggccctcgaaaaggcggaccgagtcctccgccgctgcagcgggcgtcaccatcgcgggcagcggatcgacctggaaggtgacctctgctgctccgtcctcggcgcggtagcggtcctcacccacaacgaccgcgaccgcctcaccggcgtagcggacccggtccttcaccagggccggccagtcacggcctgccacagcctcgtccgaggacagcttggcgagcacggtgtgcggcacgggcggcaggtcctgcagggcggcagccgagtgcgcgcagaacggcatgtccgtaagatctgctgctgcccaggctcccgctacgccgggaacctcccgtgctccgctgcagtccacggcacgcaacgctccgtgtccgatcttgcttctcacgaacacggcatcgaggcatcccggcacttcgatgtcggcgacataccggccgctccccgtgagcagccctccgtcctcacgccgtgtccattgatccacaactgcaccttgcgtttgaggtcccgcgacgccaactgggccgtatcgacaggagaaccccctacatctacatcgttacagaaggatgaaaagcgcacaaattggttgatggggcgaccagccgggtgagaacgtcttccccggggcaaggcagcctgtcccttcagagagcgtttatgcaggtcaggcctcataggtgactctcgcccggccctgctgtgagggcttacatcccataggcttcgaatggccttccccggggtggaggcttggtcacctatctcgttcacttctggaagccgttgtctttccggcagtgacgggttcatttccgctggtcaggtgtaggtgtggtgtttcggcgggaggggcggggtgacgtgtcgtctcttcggcggaggtgccggaacaccgtcggtgatggggctgctggaggaacgtgaacgtgccgctcggcagcaggtcgaggctctccatgccgagctgcgggaggccggggcggtgtgggagcggttcctgatcgcccgtgagacagtgggcgaggttctcacggagccccgcggaggcgaggacgtggcaggccggcgtgccaggacagggagaggtcctcggggagcagccactggacgtgtccgacgtcggcggggtgggcggtggcggtcgcgagcaggagccgttcctcctcgaccgcctccgtgtggtcggccgccagggcgggcggcggcgccgaggtgcggggcaggacgccggcgcgcggggggaagcggctcgcgatgtcgtccacgaccgaggcgagcacgtcggcctcggtgagcaccgtgtggacggggtgcggcagagaggcgtcctggacggtctggacgagacgctcggcggctgcctgcaggcggcggcgggcgtgttcggcttcgaccatccggacgtaggcccggtgagtggcggggccaggggcagacctgatgagggtgtgcaggtacgaggcggtcagcccgcgcgcgcctgctcgcggcccgtggcgagcacgcggtccagccactcggtgttcttggcatgctcggcggggtcgggcggcggcagggtggtgatcgcggggtacagggcggcgtgctcggcggtggagccggcggcgatgccgctcacgtcgctcagacggtgtggatcaaggaggaggtggctccagtcgatcccacagcccgagcaggcgctttgcggcgtgtcggcgaggccgagtgaggtcaggtagcggaggcagtcggcacgcgaccagcccagatccatcagcggatgccggttgcgcatggagcggacgtcggcgtccttggcacggtggaactcgtccgtggagatgccgacccactgctcgacgaagacgtccttcgggatgcgcggcgggtaggggtagccgaggagttcccggacctgtcgttttctcggtttgatcttgtattccccggagcttctctgcacgtcactcgatcgggtgcgtggacgggcggctggctggcttatgtaatgcgggtgggcagcgcctccccgcatggcacgatggcgacgtggctctgatccgaaaggacgatgccgcgtaggtcgcccggcgcgttgcgcgcccagaagcggttgagccggggcggttcccggcggttcagtcagatctcgggacttggtcgtagtgctcaggttgctgtccggcggctggaggccgaccggttctatccagggtacttgcgcgatggcctcgaccagtccgagcagtttcttcgaagcccaggccgtttgctctacgtgccgctggcggactgtccgtgccacgatccggtctatggccgagacaccgtcgaggcgatgctgggcgcctcgcctttgcgtgcgcggcgtgagctgagagagatcgtcgcgcggttggatgacgaattcgagcggcggacgctgcccgatccgaccgcgccggtgaagctcggggccgggtggtggcaccggcgcctgacgggacggtagtcccggagggcggggccaacgcgctggaccggcgaaggccatgcgtgatcgggtagctgcatgagcctggctgtggacgtcttcgttgttggtgatgacggtgagacgtacatgcaggacgttcctgccgactgctctgacctggctggccccgagagccggcggaccacggtgtgggggccggatgtggcccgctcgatgggcgcccagttcttcctgatactcgccggcggggatcgcactgtcaccctgaccaggtgtcggacttcctccgcgagtgcgcgctcatccgcagcaacctggaagccgtcgcgccccgacgagacccggtgatggtcgacgagcggtatgttcggcaggtctccgagcggctggccaacatcgagaacgtcggcgcccgtctcgggcgagtttgcgtcaggtgccatcgttcgtgacggatggttggtctctgggccgactgcactcacgtgcccagccgcagggaagggagttcaaccatggcgcatgagccgatcctggtgctcgccgcgacgggcgggcagggcggtgccgtgaccgaggcgctgctcgcccgcggggcccggaccagggcactggtccgcgaccccggccgcagcgccgcgcggaat

SEQ ID NO: 338 - DNA, 2228 bp, Unknown
  Kingdom: Bacteria, Phylum: Actinobacteria, Class: Actinobacteria, Order: Streptomycetales, Family: Streptomycetaceae, Genus: Streptomyces
aggactgacgcttggagctgcgcagtgtcgaagagctgatggacctgctgtacgccggtcggggtaccggcagacagggtgccgccggacgggacaccgctgtacccgagcggcccgggcgccgccccgtcacccggacccagcagtccgccgaccccgaggaccagccccgcgacctgcagctccttgtccgccgggcggcgccggcgcagcagcgcggcggtgcgcagggcatggtcgtgcggatcggggcggcgcccgggccgctcgggtacagcggtgtcccgtccggcggcaccctgtctgccggtaccccgaccggcgtacagcaggtccatcagctcttcgacactgcgcagctccatgcgtcagtcctcccgcgggacggccgttgcggtacgtcagcagatcacggccaccttgcggcgcggccaacgggaactgaactgcgtgacgtagaccgaacgggtgaatctcggaccgcttcgcaaagtgacaaatcaccttgtatgcggctcaatgaacacgcctgacttcagatagttacctgctctttgcagccccatcgagcaggggggcgctcatttggttaatctggagtaggcggacagcaccaacgggttcccaccacacccacggtccgtcccggggtgagccggcacaacagcctgctcggacctcagttgccggcgccaccgcgtccgacctgtttcgacccagacccgagcgggcgtcaggggccgcagcgcagactgccggtgaccgccccgagggtgaccgacacataaggagtgcgcggtgacaccggagaagacgaagcgagaccaacacccccaggaacgcgcggagcgctcggggcggcggcccggagacctcggcagcctcgacgtgtgggcgcggtccgccccgatccgcctggccggctacgaggacgacctcgccgagccgcacatcctgcccagcgtggactagaacggggctccccagcctggaccgggggctccccggcgtggaccgggacgaggtaaggtcccccgcgagatctcgcacggcaagatcaccgaggggggcctgtcccatgggcggcactgacagcaccggcagcagcgcgtacgagggtttcacggccgaggaacgggccgcgatgaaggaccacgccaaggagctgaaggcggcggcgcggcgcaggtcacaggcggacaaggcggccgaggcggagcgggatgtgctcgcgaagatcgccgagatgcaggatgcggaccgtgtcatggccgagcgcgtccacgcggtcgtcacggccgcagccccggtgctcgcgccgaggctctggtacgggatgcccgcctacgcgcgtgacggcaaggtcgtctgcttcttccagagcgcggagaagttcaaggcgcgttacgccaccctcggattcagcgaccaggccaacctggacgagggcacgatgtgggccgcgggtttcgccctgaccgaggtgacccccgaggcggaggcccggatcgccgcgctggtgaagcaggcggtgagctgagccgcccggacctcgtcgctcgcgctcatccgcagcaggggcgtgccagactcgcgcccatgctgatcagggaagccacccccgaggactggccgcggatctggcccttctggcaccgcatcgtcgccgccgccgaaacctacgcctgggacccggacacctccgaggaggacgcccgcgcgctgtggacgggtcccgccaagcgggtcttcgtcgccgaggacgacaccggcgcggtcgtcggctccgcctacgtcactcccaactacggcggtcccgccgcccgcatcgccaacgccgggttcatggtcgaccccgagcaggccgggcgcggggccggccgcgccctcgccgaacacgtcctcgcggcggcccgcgccgacggctaccgcggcatggtcttcaacgccgtcgtcgagacgaacccggccgtgggcctgtggacgtccctcggtttcaccgtcctcggcaccgtgccgcgtgccttcgagcatccgcggcacggcctggtggggctgcacatcatgtaccgggacctctgaacatgtgccgggacctctgaggcccggccgccgggcgcggaggctcatgcgagcggggccgtgcgcggccacgggcgcagccgttcgatccgctccgccacgtccagcagagcggcctccgtgccggggcggcccaccagttgcac

SEQ ID NO: 339 - DNA, 1457 bp, Unknown
  Kingdom: Bacteria, Phylum: Actinobacteria, Class: Actinobacteria, Order: Streptomycetales, Family: Streptomycetaceae, Genus: Streptomyces
gccccagcctgcccaccggcggcgccggcctccccgtccgctacgacgcgggacaccccgccctgcagtgcatcgaacgggccggttccgtccgggccaccgccggtaccgcaccggccgagcaggcacgcgaatgggccctcgcccggcagtggccgccggacaccgtgcacgccctgtgcgcggtactgcgcagccgcggccgcaccctgggcgtcgtcacgttcctgcgctccctgggccgagcccccttcgaacgcaccgacgcggcccacgccgaggacgtcgccgtacgtatcgcgaccgcactggacctggcggaactgctggagccgggaccccggcgtccgtgacggcccgacccgtgggaccgccgcggaaaaaagcggttgatcgagggccgagcggttcttagtgtgtggggtacacgagaagggaggtggttcggcagatgtatggaaaccggacgcgtgaggtggctgcgggctagcggcccggcaccacatccagtgcggtgccggaccagcacgtgagacacgcgtgcagccggccccatcccaagcagtcacccgacccgcgagctgccggtacgtccggccggcttctccgccgtcaggcggaggacccagctcgcgggtcgtctgcgtgccatgggggaaccgtgcacgcaggacacggcacgccgcctccgcttcggcccggcgttcgcgctcagcgctccggttgtcagtggtatgcgtcagaattgagttcagggccagcgcacgcgccgcggagtcgcagggcttccggcagaggtaatcgaggggcacgtatgtccggactgatcgacaccacggagatgtatctccgcaccatcctcgagctggaggaggaaggcgtcgtccccatgcgcgcccggatcgcggagcgcctggaccagagtgggccgacggtgagccagacggtcgcgcggatggagcgcgacggactggtctcggtggccgcggaccggcatctggagctgacggacgagggccgccggctggccacgcgcgtgatgcgcaagcaccggctcgcggagtgcctgctggtcgacgtgatcggcctggagtgggagcaggtgcacgccgaggcgtgccgctgggagcacgtgatgagcgaggcggtggagcgccgcgtgctggagctgctgcggcacccgaccgagtcgccgtacggcaatccgatcccgggcctggaggagctgggcgagaaggacggcgcggacccgttcctggacgcggggctggtgtcgctggcggatctggacccgggcgccgacgggaagacggtcgtcgtgcgccggatcggtgagccgatccagacggacgcgcagctgatgtacacgctgcgccgggcgggcgtgcagccaggctcggtggtgagcgtgacggagtcggcgggcggcgtgctggtgggcagcggcggtgaggcgg

SEQ ID NO: 340 - DNA, 9944 bp, Unknown
  Kingdom: Bacteria, Phylum: Actinobacteria, Class: Actinobacteria, Order: Streptomycetales, Family: Streptomycetaceae, Genus: Streptomyces
gtcggcggcggccaggaacgcgtcggtggcctggcgcgcggcgtgtgccgcgacgagttcgagggcgggggtggaggtggcgttccaacggccgaccgggtcgcgcggggggccctggcgcagcgcggcgcgggcccgtgcctgccaggtccgttccacgtccgcgagcaggccgcgcaggaagccgaggtcggtgagcgactgctcgggggcgacgggttccggtcccggttcgggggcgtcgtaagagaagatcatttccgcggcggccttgagccagatgacgaggttgtcgccctccgccgtgatcgtgccctcgaggttcgcctggtagtcggcgatggcgttgacctggaacagggccgcggcgccgcaccgttcacggcactgtgtggtgatgtcgcgggcctgccaggtgatccagcccttcgctatcgcggccaggcgctcggtctcggcccggtcgtcgggggtgtgctggacccagcggtcgagcaccgcgcggtgcaggaagatcatggcgtactcggtggccagggcgtgcagcagccgggcgtggtggctgcggtgcgcggccagcgggatgcgttcgccggatctgggaccgctgatgtgccggtggtgggcgtgccgcacggcaatgctgagcgcggcccgggacaccccgatggccgctgcgctcatgcacagtttcccggtggtcacccggcctatggagtgcaggaagcgtttgcgccggctgccgacggtgctggcgagcgtgccgtcggcacccatgcgcccgtgctcgccctggagcagtgcctgggacggcagccgcacctggtcgaaggcggtcaggcagtggtcgaccgggctgcccagacgctcgggcagccgggtcacccggacgccgggcagcatgcccgactcgtcgctcaggggggtcaggaagaggaacacgccctgatcctcaccgtcgttgatcagccgcgcggcgacgacggcgctcttgggcccgcccgtggggctggtgttgggcatgaacttctgggcgccgggcgtgggggtgtgcagcacgaactcgccggtgccggggtcccgggtggcggtggtctgcagcgcggaggcgtcgttgccgtgatccagctcggtgcacagaaacgttcctacacggcgcatcgacgtgtagtcggacaggtcgcgcgggccggcgtcgtcatggtcgaccaggctgccgaggaagaggttgtagtggatggacgagagcgtcaccagtgacccgtccgagacgcccgcccactcgtgcagagcggccagccggtgcgggtcgcacgccagttgctccgcgtcgacggtgctgttgaccaggcgcagccggtcgtaggcgagcgtggtgcgttcgctgcgcgtgagccctggcacatggcggaactcgctgcgggcgagcagggcccgccagtgcccgtgcaccctctcccgcgcgtcccggtcgaacaggagccgggtcagctcctcggcgggcggccgcccgctgccggcggggccgtgggacgggcgtgcggtgtgcagggggaccgggctctgggccgactcttcccccgtgctgtgcgtcgcgtgcttctggaacgtcagcagggtcatggacctctccgcatggacgtcgagcgatgactggaagcagtgcagaggtgcgcagggccataaagatacggacgcaccggttttttgcaagcagaatgccgaccaggttttgaagacgcaggccaggtctcccggcaccggcgctgtcccgacgcggccgcgtaaagggaatgccccgctccaggcaacggaaggcggttcggggacctgtccggcgcgtggctccgccgggacggccgggcccgacagtgggctcttgaaaaaccggctagctggtttagtatgacgctggcgcgggccgccccacaggcccggcccgtccggacgccactgagcacgcgccggacggttcgcggatcacaggaggtgtgtggtggcacgacaggaacgcgccctgcgaacgcggcgggcagtcctggtggccgcggccgaggtgttcgacgagaccggctacgaggcggcgaccatctcccagatcctcgagcgctccggagtgaccaagggcgccctgtacttccacttcgcctccaaggaggaactcgcccgcggcgtgctcgccgagcagcgcgacgccctgcccgaagtgccgacccgggcgctgaagctgcagcagctcacggacggggggctcctgctggcccacatgctcaagagcgacccgctgctgcgcggcagcatccggctcaccctggaccacggcagcccgcagatcggtgaggccaggcaggtgccgatgcgggcctgggaggagttcacccgcgccgtcctcggggcggccgacgaggccggggagctgctgcccgcggtcgagctggactccctggcccgcgtgttcgtcggcgccttcacgggagtccaggtgcactcggacatcatgacgggccgggccgacctgcccgagcgggtggccgagctctaccggctcctgctgaccgccgtcgccgtgcccggcgtgctggtgcgggtggacttcgatcccgcgcgggccgccgcggtctacgaagaggccgtcgccgcccgtgaggaggcccgagaggagccggacccggccgccaccggcaccggctgaaccacgccttccccgcgccacggctcactgcaccaggcttcactgcaccacggcttccccgtaccacggctcactgcaccaggcttcaccgcaccacggctcactgaaccacggcttcactgaaccatcgccccgcccacccggcccggcgctcacagcgccgcgggcggggcgtgcaccacggaatgcgtcatgtacgacctatccgaacggagtgcaccgatggaacaggcagtggcgcacgaggcgctgatgacggcccccgccggcggcggatgcccctaccgcctcgacgtctcggggcgggacctcgccggcgaggcggaccggctgcgcgaacaggcccccgcggtacaggtcgaactgcctggaggagtggtcacctgggccgtcaccgggcagagcgccgtacggcagctgctgatggatccccgggtctccaaggacgcgcggcagcactggcccgccttccagcaggggaagataggcgaggactggccgctctaccactgggtgtccgcgcagaacatgctcttctcctacggtgagcggcacgcccggctgcgcaggctggtgtcgaaggcgttcaccccgcggcgtaccgaacggctgcgcccggacatcgagaggctgacccgggagctgctcgactcgctcggctcggccccgcgcgacgaaccggtcgatctgcgcaccgggttcgccaagctgctgccgatgcgcgtggtctccgagctgttcggtctcggggaggaggacggacggcagctgtgcgcggccatcgacgcgaccctgctgacgacccccgacggcgacgagatctaccgggcccagctcgtcgtcgtgcagctcctggccgaactggtcgagcgcaagcgggcgcagcccggtgacgacctgacctcggcgctgatcgccgcccgcgaccacaccggcgaggggctcacccaggaggaactggtcgcgaccctgaacctgctgatcggcgcgggccaggagacgacgagcaacctgatcagcaacgccgccgggctgctcctgtccgaccccgcccagctggcgcacgtgcgcgagggccgggcgggctgggacgatgtcgtcaacgagacgctccgggtgcacaatccgaccgcctacgtgccgctgcggtacgccgtggaggacatccggctggacggtccggacggcccgttgatcaggaagggcgacaccattctgatctcgttcggcgccgccgtcacggacccggagctctaccgggaggacgaggacatccacgcgttcgacgtgctgcgtgagggccgccgcgacagtctggccttcgggcacggcgtgcactactgcctgggcgccccgctcgcccgcctcgaagccatgatcgccctgccggccctcttcgagcggttccccggcatgacactgcagcgccccctcgcggagctgcgccccatggagtccttcatcatcagcggccacagctgcctgccggtgcacctgtacggggcggcctgacggcacacgtcagctccccgcacccggtccgcacccagtgctccgcgccccgaacgggacgcggagcactgcggtttccgcccttgcggcctgccttgcggcctgtcgctcggcgtgcgtgcggcgtgcgtgcggcgttcccggctgtgtccctcgggggcgtccgtctccaccccggctggagcgtttctcgagcggaccggcggagcgtgagcaggaaccgtggaagaggagcgacgaaggggcaccggatgggcactccagcacctaccgacaccgtggtccgggtggagcgcggcaacgccggcgaggaggaactggccgcggtcgtcgcgctgttgtcgcttctcgcccggcgggagggagaagacgcgaagggctccgcccgcccgccggctccggggtggcagccgcgtccggaggacccctaccgtgccccgcacagctggcgctgaccgccggccgaggccgcccgtaccgggcccacgacgatgaccaggcacttctgcatctgacctctacaaaccgcatgcgtggtttgttagactgcgcggatggtcggggcgcaccgcatccgcggcgagaagagaaaggggccgtcatgacggcagatccctcttcggccggtgtggagccggccgacgcgcgtggacgcgtggccgagctgcacgcgatccgtgaactggcgctggccgggccgagcgagaaggcgaccgaggcccagcacgccaagggcaagctgaccgcgcgggagcggatcgagctgctcctggacgcggggtcgttcaacgaggtcgagcagctgcgcaggcaccgggcgcagggcttcggcctggaggcgaagaagccgtacacggacggtgtcgtcaccgggtggggcacggtcgagggccgtacggtcttcgtctacgcgcacgacttccggatcttcggcggcgcgctgggtgaggcgcacgcgacgaagatccacaagatcatggacatggccatcgcggccggcgcgccgctcgtgtccctgaacgacggtgcgggcgcccggatccaggagggcgtctcggcgctcgccgggtacggcgggatcttccagcgcaacgcgaaggcgtcgggtgtcatcccgcagatcagtgtgatgctgggtccgtgtgcgggcggcgcggcctactcgccggcgctgacggacttcgtgttcatggtccgcgacacgtcgcagatgttcatcaccggcccggacgtggtcaaggcggtcacgggcgaggagatcacgcagaacgggctgggcggcgcggacgtccacgcggagacgagcggtgtctgccacttcgcgtacgacgacgaggagacctgcatcgccgaggtgcgatacctcctgtcgatgctcccgcagaacaaccgcgaggcgcctcccgcggcggccaccggcgatccggccgaccggcgcaccgaggcgctgctggacctggtgccggtggacggcaaccgcccttacgacatgaccgaggtcatcggggaactcgtcgacgacggcgagttcctggaggtgcacgagcgttgggcgcgcaatgtcatctgcgccctggcgcgcctggacggccaggtcgtgggcatcgtcgcgaaccagccccgggtgctcgccggggtgctggacatcgaggccagcgacaaggcggcacgtttcgtgcagatgtgcgacgccttcaacatccccctggtgacgctgctggacgttccgggattcctcccgggggtcggccaggagcacggcgggatcatccggcacggcgcaaagcttctgtatgcgtactgcaacgccaccgtgcccagggtctccgtcgtgctcaggaaggcctacggtggcgcctacatcgtgatggagtcgcagtccatcggcgcggacctcacctacgcctggcccacgaacgagatcgcggtgatgggcgcggagggcgcggccaaggtgatcttccgccggcagatcgccgaggcggacgaccccgaggccatgtgggcccgcatggtgaaggagtacaggtccgagctgatgcacccgtactacgccgtcgagcgggggctcgtcgacgacgtgatcgacccggcacagacccgcgccgtgctggcccgttcgctggccatgctgcgcaccaagcatgccggtctgccctcgcgcaagcacggcaacccgccccagtgatccacgtccacggtgtccgccgagtgccggccaccgtggtgagcccctcaggagtgacgtacatggccaagcaggagcgcgcacagcgcacgcggaggtcgctgatccacgcggcggccgaagtgttcgcccaggacgggtacgagcctgcgagactggccaccatcagcgagagggcgggcgtcagcaacggcgcgctgcacttccacttcgccaacaagcaggcactcgccgaggcggtcgaggaagaggccgtcgcctcgctggtccgcatcacccgggccgcgcgcgacacccgcgacaccggggacggcagtcgtgcgctggaggcgctggtcgaggcgacctgcgaactgatgagccggctcgccgacgacatcgtcgtgcgggccggtttcgggctcggacccggagcgcggcacctgtggcagcggtgggtcggggaggtgctgtgccaggcggagcgggacggctgcctggcggagggcgtctccggccggcatgcggcggacaccgtcgtcgccgcgaccgtggggctcgaggtgctcggggcgaaggatccggagtggttctcgcgccgccgcgtcgccgggatctgggaggtcctgctgcccagtctggcatccgcgtccgcctccgtatccggagccatccggaacgaaccggccggatcgcgatctcgctgagacatcacatgcaagagaccgtacggaccgttttttctccccctgagcggaacccgttgagccccctggatgccctgaccgtcggtcattcagggggctctcgcgtcggcgtcgtacgggtgagatcgctgtgcggggttccggggcttttggaaacagcacacatggtttggtattgacaaaccgtctgccctgtttttaactttggtgagtgccgggaggtgactcctgacgaggtcccggatctcggactgccgccgacccggctgatgactcatgcgtgcagaggggaaacgtcatggacatcgaagtactgggcacgttggctgtcacggaaggcggagtctccgtcacgccgacggcgcccaaagcacgccaggttctggcgctcctggcgctgcgcgcggatcacgtcgtctccgtggcctcgctgatcgaggagctgtggggcgagaagccgccgcgcagcgcccgcaccacgctgcagacgtacgtactccaggtgcgcgacctcatcacagcggcactcgagcgcgacgcgcaggacgccccggcgcgcacggccaaggacatcctggtcacggctcccggcggatacgtgctgcacacgtcgggcggcaccgtcgacgtccgcgagttcgagcggttcgccggccgcggctaccgggcgatggacgccgaggacttcccgcgcgcggcccgtgagctgcgggacgcgctgcagctgtggaccggttccgccctggccgacgtgcacgcgggaccccagctggacatggagatccagcgtctggaggaggcccggctgtgcgcgctcgaccagcgcatcgaggccgatctgcgcctgggccggcaccgggagctgctgagcgagctgacggttctggtccgccgctaccgcacccacgagaacctccacgcacagttcatgctcgccctgcaccgctccggccggcgcagtgaggcgctcgacgtctaccagcggctgcggacctcgctcgtgcgtgagctgggactcgagccgtccgcagggttgcgtcgactgcagcgctcgatcctgatggccgggccggagaaggccgtggccgacaccggcgagcggctcacccgcgtgggctgagcgcggagcggagcaggacggcaccgcggacgggcagacccagggagggtcggatgcaggagaggtcacagcggaccaggcgcaggctcctcgacgaggcggcgaagctgatcacacgcagcgggtacgcgaatgccgccctcgggcagatcgcggccgccgcgggcgtcaccaagggcgcgctctacttccacttcacgtcgaaggaagggatcgccgacgccgtgcgcgagcaagggcgggccctgctgcgggacttcctggcccagcggcgggccacgcgcgacgagcccgtccagatcctcatcgacctcacgcactggctcgcccgcgcccggcgcgagaacgccgtcgtcagggccgcgttccggctcgccgacgacgatctgggcgcgcagccggggagcaacggactgcgccgcgtgtggctcaccgaggcccagcgcctgctcgacgaggccgacacggacggcaggctggctgaatccgcccgcggcgccggagccaaggcgctgctcacggcgctcctgtacggcgtcgcaccccccggccaggagcagcgctccccggccgaactgcggcacagcaccacgcagttgtggcggctgatcctgccggtgctggtgccccccggggaggcgggccgctaccgcacggcgccgccgggcggccgcagcgaacccgcgcaggccgcgtgacatgccgacgacccccgcctccggcccggcccaccgggcgccttcctggagacacaccatgttccacgacgtccctcaggcgccctccgcgacgcccgctgcccccgccgacgtcctggccgcgctgctgcgcatgctggccgacgtcacccggcgcaaggccgacaccctcgatcccgggcagccgttcccgatgatcggtctcgactcactgctgggtgtcgagttcgtcgccacggtcaacgcccacttcgggaccggcatcgaggccgcggccgtcctggaccaccccacggcccgggacttcgcccggcacctggcgcggcagctgcgcgacgcccccgccacgccgccgcccgccgtcccggccgcgccgccggcgccccgcgcgctgccggtcgccgacgtgctgcgcgaggaactggcccgggtgctgctctgcgagccgtgggacctggacccccacacgcccttcagcgtgctgggggtcgactcgctggtggcggcggagttcacggcggtcgtcaaccgcctctacggcctgcgcgagcgtgccgtcgtgctctacgaccatccggacctcacggcgctgagcgcccacatcaccgcactcgtgtcaccgcaggcgccgcccaccgcccgaccctgctcaccgcccgcaccgcccgcaccgcccgcaccgtccacgccgtccgcaccgccggcaccgccggcaccgtccacgccgtccgcactttccgtgacgtccgggccgtccgtgacgccgatgtcgctggacgagcttctcgacgcggtgcgcgacgaccgggtcggcctcgacgacgcggtggccctgctgtcccggctcggctgaggcgcggatgacgatggacgagcgcgagatcctcgcccggttcaagtccggacagctcgaccgggggcgcgccgtgcgcctgctcacgggtgtcgtaccccaggcgtcccacccgcccgacgcaccgccgccgcccggcacggcaccacagccgggcacggcaccacagtccggcacggcaccacagccgggcac

SEQ ID NO: 341 - DNA, 1682 bp, Unknown
  Kingdom: Bacteria, Phylum: Actinobacteria, Class: Actinobacteria, Order: Streptomycetales, Family: Streptomycetaceae, Genus: Streptomyces
gaggccggtccgctgccgggggccgccgggcggacggcgatggacacggcgctcacgcggtaccgcagcgcgaacggtcccggccgggtcctctacctcctggacagctccggctcgatgcacacgcggtggcccggacccagcggcgggcccggcatcctgaagcagtccctgggcgggctcggcacgcaggacgagtacggagtgtggggcgtctacgacagttccggcggccagaaccacgacgaggtgctgggcttcggccatcaccggcgcgccgacgccgagcaccgcatcggcgcggcggcgcgggtgcgggacgcagagtccgatccgcacgcggcgctgctggcggcgctcgacttcatggcgcaccgcggcgccgacgacaagtggccgcagctgatcgtgtacatcaccgacgacgaggacgacaaccggctgaccgggaagaacctctccgaggtgctggaccgggcagcgcagcagaaggtgcccgtggacatggtgtccctggccgggggctcctgcgaccagggccgcccggccgcggcgatcgccgcggcgagccacggccgctgcctggacgtcggcgacgacctcggtgccgtcctgcacgacgaggtcgcgcgcgtggggacgggggaggactgatgcggctacggagcgaccggtaccgggccaggggcacggccgcccggcgtgcgcgccccgctccgcccggagcacaggccgggccggtcgtgctcgccgtgctggccctgctgttcgccgccaccgcctgcaccggcggaggtcccgacgcggtgcggtcgcccgccgccgacgtgcccggcgacatcgtggtggccagcggccgggacgtgaccggcaagaacggcatccgggagcagctcatcgacgcctggaaccggcagcaggagaaggagaacaccggttaccacgcccgtctcgtcgagctgcccggctccgccgacgagcagcgcagccagctgctgggcgccctgcagtcgggcagcgccgactacgacgtggtcaacctggacgtgacctgggtgccggagttcgccgaggccgggctgatcacaccgctgccggacagcaccctcgacggcgacgtcatccggtcggtcgccgacacggcgtactggaaggaccgggtctacgcggtgccgttcaacacggacgtggggctgctgtactaccggcgcgactacctgcgtgcggcgggcgtgcagcagaccacgctcggggccggcacgacctgggcggacctgcgcgacctcgccgacaccctggacgcgcaccggcccaagggcttcgagagggcctggacgacccagctcgccgcctacgaaggacgtacggtcaacgccatcgaggcgttcgcgtccgccacgaaggacttcgccctcaccgacgcctccggtcactacacggcgagccgccaggagctggccgacgggatcgcggaactgcgccggcgcacggagaagccgtacaccctcgaccacgccttcgcctccgacgaggccgcctcgctcagcgacttcgccagcggccgcaccgccttcctgcggcagtggccgtacgcctacaccacgctccaccagaccttctccgccgaccaggtgggcgtggcaccactgcccggccgggcggtggtgccacgcccacctggt

SEQ ID NO: 342 - DNA, 4190 bp, Unknown
  Kingdom: Bacteria, Phylum: Actinobacteria, Class: Actinobacteria, Order: Streptomycetales, Family: Streptomycetaceae, Genus: Streptomyces
caccggcacaccggcgcccggaccaccgtccagcggaggatgcggctctaccggctgggcgagctgaccgtgccccggccgctcccgccgggccgggcgcggccggccgggacgaccgaccgggaactcctcgcccggtggtacacggagttctgcgccgctgtcggcgaggcagccgtacgggacccgggggagtgggcggacgagcacgccgagtccggcgccgtgacgttctgggagagcccggacgggacgcccgtcgccatggccgggacctcacccgtggtcgccggacaggtgcgggtcaccaccgtctacacacccgctcacctgcggggccggggatacgcgggtgccgtcacggcggaggtcagccgggtcgccgtggcgtcgggcgcggcggaggtgctgctcttcaccgacctcgccaatcccaccagcaacggcctgtaccagcgcatcggttaccgtccggtgtccgatttcgcggtgcacgccttcgaggcacccgacgccacagggtgacgtaggtgcgtgtggagggcgggggcggcgtcacggccagagcagctcccgcacccactcctgcgcctcctggcccggccccggctccccggcgtggcggtagcgcagccgtacgtggcggcgccgggcgtcgccctggaagaactcgacctcggtggggcgcaggcggtagagcgtccaggaggggacgtccgtgtccggctcgccttcggcgacggtccaggccgactccgacgcccggctcagttcgtcgagggagtccaggacgcggctctgcgcaccggtgagggccgcggccagggcaccggtcgagcgggcgtgcaggtccgagcgggcctgctcgtgcggtgcggtcgtgaccgggccccgcacccggacctggcgccccagtacgggccagtagaagaccagggccgcgtagggacggcgggacaggtggcggcccttgcggctgtccgcgtgcgtggcgaaggcccagccgtccgcgtcggcgccgtgcagcatcacgatgcgggtgtccgggtcgcccgcctcgtcggccgtcgccagggacatggtgtgcggctcgcgctctccggccgcgaccgcctgcgcgaaccagcgggtgaacagcggcagcggatcggcgggcgcctgacgcgggtcgaacgcgggcagctcggtgacctccgggtcccacacgcgcagtgacctcagcagggcgtcgagttccgtgttcatgctccgagtatcacccggccctctgagtcacgcgcaccccgcaccagccacccacgaagtgccgcacaacgcaacaggcggcggcccactcgggtgaaccgccgcctgtctgacaggacttgtggcctggtggcctgggggtgtcgtaagagagcccgggtcggagccggggccggggggccggctacctcgtcggcttcctcccggtgacgcccaggtacaccaacagcgcgaggttcggcttgagttcggcctgcttcacgccccaggaggtgaaacccttctggtgcgaggcgaccgcggcgagcatcgcgaccagcgaaccggcgatcgccgccgggttcacgtccttgtcgaccttgcctttggactggagttcggcaaccgaatccgcgagggagccgttcaccgcgttcaggatcttcatacggagcttgtagaagcgcttgtcgccctcggcggcaccgaggtcgaccacgcgcaggatcgcgtcgttgcggcgccagaagtcgaggaacccgtcgacgagttcctgcgccgtctgccagccggccttgccgacccaggaacggccttcgagcaagccggtcaagtcggcgctctcggaggccatttgctcggcgatctccaggacggcaccttcgacgtccgggaagtactgatagaaggtcgcgggcgaagtgcccgccttccgggcgacatcgatgaccttgacatcccggtagggggaggagctgagcatctcgctgaggcagtcgagcagcttctgccgggtcgcctgccctcgccggccggccacgcggccgtcgacggtacgcacttgtcctgtcatgtcgtcagcttaccgaggggtgatgggagcgcgattcggccgactgcaaatggggtgcacgggcgccgagaggctggtgtgcctggtctgcggggtgcgggagtcccggctactttgaccgcatggccgaaaacagggcatccgcgtacacggagggcgtcccctgctgggtggacgcgcagctctccgacaccgccgcgggcaggcggttctacggtgagcttttcgggtggaccttcgaggagaaggaggcgtacggcggctccgtcctggccctgctggaggggaagcccgtcgccgcgctcacgccgaagtcggacggccggatgcccaccgtgtggacggtgtacttcgcggccccggacctcggggcactggccgcgcggatccgggcgggcggcggccaggtcgtcggagatgcccggcaggtcggccgctacggcacggccgcgctggccgccgaccccgagggcgccgtcttcgggctgtggcagccgggccggcacgcgggcttcggcgtgcgtcaccggccgggcagcttcggctgggcccagctctacacccgtgacaccgacacggccaacgccttctacggcggcctcttccacgaggcactcttcggcccgggcgcccgccccgacttcggccgggcgcccgtgacggacgtcttcccggcacagatgccgccgcacttcctcgtccacttccgggtcgcggaggtccaggccgccctcgacgcggtcaccgggctcggcggccgggtccaggtgccgtccttcgggacgtcgtacggaacggtcgcggtcgtcgccgacaatcagggggcgtccttcgccgtcctgcagcgttgaagccgtcatgcggcgttgaagcgtcatgcggcgtggaagccgtcatgcggcgtcgaaaagcggtgaaaggggcaccgggaggtgcaccggaggtgcactgaagggccacgagggatgcaccggaagatgcacccgaaggtgcggtgaaagtcgtgaaggcacggtgaaaacgcgccccggatgacgtttcggcggcgggaaaccgccgttttgcgtcggaaacgtaccaggacatcccggttcgtcgccgggttcgccaccggtgccgcggccaggaagaatcggagtgcgtgccgccatggcggtgcggtggtgagacgctgcacgggggccgcgtacacacgcaggtgacgcggctcgtacggggaggtggcaggcaagtggtggagcagctgacgcagcacgatccgcggcggatcggtccgttcgaggtgctgggacggctgggcgccggcggcatggggctggtctatctcgcgcgctcggcgtccgggcggcgggtggcgatcaagacggtccgcaccgagctggccgaggaccagctcttccgggtccgcttcacgcgcgaggtcgaggcggcgcgggcggtctccggcttctacacggccgccgtcgtcgacgccgacccgcgtgccgcggtgccctggctggccaccgcctacgtccccgcgccctccctggaagagatagtgaccgagtgcgggccgctgccggtgcaggcggtgcgctggctggcggcgggcgtcgcggaggcgctgcagtccatccacggcgccggtctggtccaccgcgacctcaaaccgtccaacgtgctcgtcgtcgaggacgggccgcgcgtgatcgacttcggtatcgcgtccggtgtttcgaacacgcgtctgaccatgacgaacgtcgccgtcggcacccccgcctacatgtcacccgagcaggccaaggactcgcgcagcgtcacgggcgcgagcgacgtgttctcgctcggctcgatgctcgtcttcgccgccaccgggcacccgcccttccacggcgccaacccggtcgagacggtcttcatgctgctgcgcgagggccccgacctggaaggtctgccggacgagctgcgtccgctgatcgagtcctgtatgcagatggagatcgcgggccgccccacccccgccgacctccagtcccagctcgctccgcacctcttcggctcgggttccgacgacagcggcaccgcctccgcctggctgcccgagcaggcggtgggcctcatcgagtcc

SEQ ID NO: 343 - DNA, 1029 bp, Unknown
  Kingdom: Bacteria, Phylum: Actinobacteria, Class: Actinobacteria, Order: Streptomycetales, Family: Streptomycetaceae, Genus: Streptomyces
tcggtggccgaggcccgcagcgagacggtggccgcgccgcgcggcacgctcagcgtgcccttccaggaggcgtgcccgccgctgagcggcacgtcctgccaggacttgccctcgtcgtacgacacttcgagccggccgccggagatggtgccggtgccgggcgcgcccgccacgtacgcggcgtgcaggcccaccgggatccggccgccgccccgcagttcgcccgcgaggctggtgtcgaggtcgaagccgaggttgatcagcggcagcgcggtccaccggtcggcgggggtggcggcggagcggaacgtccactcggcgtggccctggccggcgagcttccagcgggccgggtcgagcgcggtgtcggtgacgagcttgtaggtgtgctcgtcggccggcgcgtcccacacgtaggcggccgaactgctgccccggtccacctccttgccgtccacgtaggccaccgtggtctgggtcatgccgctgtccgcgctccacacgtcgccgaagccggtgtggtcgggcccggagtcgccccagccgggcgcgttgaaccggatggtgttcccggagcgctgctgcccccagccgaggccggtgcccagccacgggtgccagacgggcttgaaccagtccagctcctggtgcgagccgccggtgtagcggaccaggccgctgcgctcctccagggtgccctcgccgaccgtcacggactcgtgccagcgctggccgggaccggtggagacgtagtcggtccgctcggccgggtaggcgatgctctccgggaagccgatgccgatcgggaaggtgtcggtgacggagtaccggaactcgccgccgctcacggcctgaccggcgtggaacttcacgtccagcgcggccagttcgcggtggccgggccggtaggtgaggtcccggtcggggatggcgcccgggtggccttccgagaggtcgtagacgtacggggtgtggcgggtgccggtcatgtcgacgcggtgggcggcgcgcagccgggccgcgtcggcg

SEQ ID NO: 344 - DNA, 1625 bp, Unknown
  Kingdom: Bacteria, Phylum: Actinobacteria, Class: Actinobacteria, Order: Streptomycetales, Family: Streptomycetaceae, Genus: Streptomyces
gtcgtgggggagggggagccgcgggtggcggtgggagcgctaccactattggactgcaccaattggcgggtcaagaggcgtgcgggacgggggagtcggagacctcggccccggcggccgaagtcaccccgatgggcctgctcacggtccgatttttgagagacgctttgcgcagcaccggggaacccttccccacgccttcaccgtctgacaggggagtgagcccggcagggcgtgagcccgtcgggatcggagagtcgagagagcgaggcaggtcatgggacggcgcaggggcggcatagggatcgcactcgtcacgggcgcggtgctggtgggcgcgagtgcctgtggccacggcggcggcgaccgggcgaccgggaccgacgcgaagggctcgaacaagccgagcgccagttcctccccgtcaccgacgaagcccgcgggcccgccgatgctgctggagacgatcatgccgcagtcgggcaccacggtcggggtggccatgccgatctcggtggtcttcagcaacccggtggcggcgaaggcccgggccacggtcgagaagcacatgaaggtgagcgcctcgcagccggtggccggcgcctggcactggttcggcgacaagcgcgccgactggcggccgaagacgtactggccctccggtacgacggtgaagatcgacgccgacctgacgggcgtcgccaacggcaacggacgctacggcgtgcacggctacacgcacaccttcaagatcggcgacgatgtgcgcgcggacgtctcggtgcgcggccacaccatgaaggtgacccgcgacggcagggcggtccgcaccctgtccatcaacgcgggcagcgcccagtacccgacgtggaacggcacgatggccgtcatcgacaagcagaagaaggtccacatgacctcctgcagcgtcggcataagctgctccaagggcagccccaactactacgacctgacgctgccctgggacgtccacctcacccagtccggcacctacgtgcactactcgaccggcgacccgaacccgggcagcggcagcgcccgcggctcgcacggctgcgtccacctctccctgtcggacgccaagtggttctacggccaggtcaagcagggcgaccccgtcaccatcaccggctcgccccgcgccaaggcaccggccgacaacggttacgccgacttcaacctcggatgggacgagtggctcgccggcagcgcgtcgggagagggcacgaccgccacgctgtgaggcgcaccccttacgcggtgcccaaactgccgtgcccggacagccgtgcccggactgcgggggcctcacgcctggagcgcgtccggaccggcgtggccggccgtccagctctcgacgcgggtccactgggtgagcagccactcgctgcgggcgtcgtcgcccggcggcacgcggctggcgggtatgcgccaccagtgcgcccgcacgctgtcacgcagcggcaggcggctccaggcggtgcgcaccgagtggacggcgtcgagcccggtgtgggccacgaagaccacgtcggccgagggcgcggcggcgatcgcggcgagcgcaccggcgtcgcgcggcggcagcacgtgatgcatccgct

SEQ ID NO: 345 - DNA, 3758 bp, Unknown
  Kingdom: Bacteria, Phylum: Actinobacteria, Class: Actinobacteria, Order: Streptomycetales, Family: Streptomycetaceae, Genus: Streptomyces
ccgagccggtcgcgtgcccgggacggtcgcgtgccctggccggtggccgagccggtcgcgtgcccggatcagctgccggatcggtggcccggaccggtcgtgctgccgcgcctgttggtgcgccagaggtggtacaggtgtcgcgcgcccggccgtacgaagcgcgcgagcatcgtcaggaagggcaacgggtcgtcaccggcgagccaggccagctcggtcccgctcgcgcgggcgggcgcgtgcggtgtcgtgtagccgccgcggcggtaggcgaggagggcgggcaggtcgatgttctccacgacgaaccggtggccggtccgctgctctccctccggtacgcggcgcccggtcaggtcgaggtgcatggcgcgcaccacgtccacccccgactcgctctcgaagagccggaactgggcgcccatgcgcgggttgaagtcgagcagtttgtaatgtccgtcgcgccggtcgaaacgcaggtcgaggtcgatgatgccggtgaagtcgatctgtttgacgaaacgtgcggcgagatccgcgagttccggattgtcgacgacgtaggcgctggccgtcatgccggcgtgcggcggccaggagcggaccttgacgccggtgaacagggcgagggcggtggagtcctggtcgaagtaggcgtgcacgatccagtcctcggcctcctcccgcggcaggtactcctggaggatcaccccgggccgctcgccccagtcccgggcgagcgagagcaggccctcgcgggtggtgatcctcgtggtgccgttcacggcggggcggctgcggcgtacgaacgcctcgcggttcttggccaccaccgggaaacgggccttctcggcgaacgccacgatgtcgtcgtaggactgcggaaaggcggcctccgggctcgggatgccgtgctccacgcacagttcgtgcaggccctgcttgctggccaggcggcgcggcaggtccggggccacgcgcgggaagagaaaggggccgtggagcacgtcctggtgctcggcgatcaggacggcggcctcctcgtcggtgggcacgaggacggcgggccggccgatgcggcgggcgatgcggagcagtccctccaccaggtggtccgcctcctccgtgcccctggtcggccagacgaacgcgcgtttgaggtaacgggaggaggccgcgggcgtgtagcggtcctccgtgatcgcgtacacggggacacccaggcggcccaggctgcggatcgcccccaccccgccgtggtgcagtggatagtcaccgaacttcacgatcaggcccggcacgtcgcggtcggccccgaaaggcacgctgacggctctcctggccacgggtccccccacgtgtccccctacggagcgggcccaccccgtccgcgtcccccaaaggacgctaagccggaattgaccgctcccacaagctcaattcggacattgcaaactctttagacactgcccaagacggcaccgcccccgtaacgtgtggcgcgaccacatgcacgtgtggcgaccacatgcatgtgtggcgcgaccactagagcgtgtggcctggtggcccaggtgccgcccccatggaacgcaccgcacacgaaagagaggcagaacccgatgccccccttcgaggtccccgagggcgaccccttcggtccgcacaaccttccctacggtgtcttctcccgcgccgggtcgcaggagcggaccgtcggcgtccggctcggcgaccacgtcctcgacgcgggcgcggcggcactggcgctcggctccccctacgccgccctgctggcacggccgaccctgaacccgctgctcgccgcgggacgcaccgcctggtcggacgtccggcgcgcgctgacggcgtgggtgaccgtgcccgcccaccaggagaccgtggcaccgttcctgcacccgctgtcctcggtcaccctccacctgccgttcgaggtcgcggactacgtcgacttctactcgtccgagaaccacgcccgcaacgtcggccagatcttccgccccgacgccgaggactccctgacccccaactggaagcacctgccgatcggttaccacggccgctccggcacggtggtggtctcgggcaccgacgtcgtacgcccctcgggacagcggaaggcccccaccgaccccacccccgtgttcgggccctccgtccggctggacatcgaggccgaggtgggcttcgtggtgggcgtgccctcgcgcctcgggcagccggtgtccctggcggacttccgcgagcacgtcttcgggctgtgcctgctcaacgactggtcggcgcgggacatccaggcctgggagtacgtccccctcggcccgttcctcggcaagtcgttcgccacgtcggtgtcggcgtggatcacgccgctggacgcgctggaggacgctcggctggccccgccgcaccgtacgcacccgctgctgccctacctggacgacaccggggaggagcccggcggttacgacctgcggatctccgtcgcgatcaacggacacgtcgtgtccgaaccgccgttctccacgatgtactggacggccgcccagcaactggcccagatgaccgtcaacggcgcctcgctgcgcaccggcgacctgtacgggtcgggcacggtgagcggagcggggcccgcccagcggggctcactcctggaactcacctggaacggccgcgagccgctcgaactcccggacggcaagcgcgcgttcctggaggacggggacgtggtgacgctgtcggcgtgggctccgggtgcggacggggtccgggtgggcctgggagaggtgacggggcggatcgtgtcggggtgacggagtaatcgccgtagcggatgtcgcgcgggccggttgccgccggaccatgactcgtggggcccgtccccgtcatactggcggcagaccgcgcgacgcgcgcaccacgcccgcgcggtccgcacggcaccaccgcgaaccgcgcgcccgtacgaccgctgcccggcccgcggcacagcacgacctgcaccaccgcaccgcgcgcagcaccgcgcgactgctccaccgcaccgcgcgcaccacagcacaaccttctgcaccgcgccgcaccacagcacagcccgctccaccgcacgacccgacacccgcccacctccgatcaggatccggagaccgtggcatgaccgtctgtctgctcctgctgagcgccgtcgcgctgacggccgccgtgccggttccccgcgcgctgacccgggctcagtggcccgagcgggaacccgtggtcgccctgtgggtgtggcagtgcctggtggccaccgtcctgctgtgctgcctgaccgccctggtcctgggcgcggcggccgtcttccacaccgtgcgcgaccgggtcttcgcccccgcgccgcccgcggtgaccgccgcgtacgacctgtcggtcgcgccggcctgggctgccgccctcaccctgctgctggcgtgcggcgccgcctggaccaccgccatgctgggccgcgaactcgccgaggcccgccgccgccgtggcctggcccgcgcgcacctgcgggaacgtgctcccgacctgcccgcgggcctgcccgtggcgcgcgggccgatgctggtgctggaggacgagtaccccgacgcctggtggatgcccggtcatccgccccagctcatcgtcaccaccggggcgctgcagcggctgacgggccaccagctcgacgccgtactcgcccacgagcgcgggcatgcccgcgccca

SEQ ID NO: 346 - DNA, 6464 bp, Unknown
  Kingdom: Bacteria, Phylum: Actinobacteria, Class: Actinobacteria, Order: Streptomycetales, Family: Streptomycetaceae, Genus: Streptomyces
cgtctcggcccgccggcgggcgttgacgccggtggcctccatggcggacctggcggcctcgaagtccccggtctccaggtagccgacgaggaggccgtcctcgcgcaggaagagcgagtagttgtgccggccggtggccgagagcgcctcgcgcatctcgggccacacggccgcgtggcgtgcgcggtacccggcggtcccgtcctcgcggaccttgaggaggaaacagacgcgcatattgaagtaccgcccgtggctcagaagttgtactggtcgatgttcttggcgtcgaagacggtcggcttgccgaggttgatcacgccgtccttgccgatggtgtacgagcccatgccgccggcgtggaaggtctcgcccttcttgccggtgatctgcccggaggccagggcgacggcggtgcgcgcggccagctcgcccagcttggccgggtcccacagctcgaaggcgtccacggtgccgttcttgacgtacttgcgcatgtcgttcggcgtgccgaggccggtcagcttgaccttgcccttgtacttggagccggacaggtactgggcggcggccttgaggccgacggtggtcggcgagatgatccccttcaggtcggggtactcctggagcaggccctgggtctgctggaaggaggcctgggcgtcgtcgttgccgtaggcgaccttgaccagcttgatgtccttgtacttggggtccttcagctcctgcttcatgatgtcgatccaggcgttctggttcgtcgcggtctgcgcggcggacaggaccgcgatctggcccttgtagccgatctgcccggccagcagctggacttcggtgcggccgaggtcgtcggcggacgcctgggagatgaaggcgttgcggcactccggcttggtgtcggagtcgtaggtgacgaccttgatcttgttgctcatggcctgcttgagcgcggtgcacagggcgccggggtcctgggcggacacggccatcgcgtcggcctgctgctgcgtgagggtgttgacgtaggagacctggccggaggtgtcggtggcgctggaggggccgacctccttgtacttctcgccaagagcctccagggccttcttgccgccgccgtcggcggtggtgaagtacgggttgttgacctgcttgggcaggaagccgacggtcagacccttcttggtcgcggcgttcgggtcggccttgccggccgaggagaccgccgagccgctgtccttgctcacgtcgttcttggtggtgccgccgcaggcggtcagggcgagggcgagcgaggtgacggcggccagggcggcgccggtacggcggatcgaagctctgcgcatgagggttccttacggggtgcgggagggagcgggtcctacgaggtcgtggcggggccggtcacgaggccgcggtgggcgcctgcggtacgggtgccttgggcacgggcgccgctgccgcgcggcggccggcccgggcgagggcgatctggcgggcgacccgggggccgagcacggagacgacgagcaggactccggtgacgacggtctgggactgcgcggagacgttgagcaggctcatcacgttctgcagcgcgccgagcaggaagacaccggcgatcgcgccgccgagggtgcccttgccgccgtcgaagtcgatgccgccgagcaggacggccgcgacgacggagagttcgaggccggtggcgttgtcgtagcgggcgctggcgtagtgcagggcccagaagactccggtcagggcggacatgaggccggtggcggtgaacaggatcagcttgtgccgcttgaccctgatgccggcgaaccgggcggcctcctcgctggcgccgaccgcgaacagcgaccggccgaacggggtggcgtgcagggtgacgacggcgatggcgagcaggacgaggaagggcaggaaggcctgcgggaggaaggtgtcaccgacgcgtccggccgcgaagtccaggtactgggcggggaagtcggtgaccgcgtcggagccgagcacgatctgcgcgatgccccggtaggcggccagcgtgccgatggtcacggcgagggacggcagtccgagccgggtcaccagcaggccgttgaccaggccgcacaccgcgccgagcagcaggcacagcggaatgatcgtctcgatggacatgccctggttccacaggacgcccatcaccgcgccggacagaccggcggtggaggccaccgacaggtcgatctcgccggagacgaccagcagggtcatgggcagcgcgatcagcgcgatcggcagcgtgttgccgatgaggaaggacaggttgagcgcgttgccgaagccgtcgacgaagccgaaggagaacagcaggacgacgatcagcagggcgctgacgacggtgtcccagcggacggcacgcgtcagcgaggacgcggagaagtcagccatggcgggcgttcctcttcttcagggccgaggccacgcgcagcgcgacgatccggtcgacggcgatggcgagcaggagcaggacgccgttgatcgcgagcacccagacggagctgacgccgagggcgggcagaacgctgttgatcgaggtcagcagcaaggcgccgagggccgcgccgtagacgctgccggagccgccggtgaagacgacgccgccgaccacgaccgcgctgacgacggtgagttcgtagccgttgccggtgccggagtcgacgttgccgaaccgggccaggtacatggcgcccgcgaggccggcgaggccgccgcagaaggtgtaggcggccaggatcctcttgcgcaccgggatgccggccagccgtgccgcctcggggttggagccgagcgcgtacagctcgcggccgctgccgtagtgcttgaggtagtaggcggtggcgacgaggacggccagggcgatcagcgcgaggtacgggaccgcccagacgccgccggagccgaagtcgacgaagccgccgggcaggtcggccgcggtgatctggcgtgagcccacccagatggagtcggcgccgcggatgatgtacagcgtgccgagggtgacgacgagggcgggcacctggccgaggctgacgagcaggccgttgagcagaccgcagcccacgccgagcaggaccgcgaggacgacggccaccagcgggtcgccgccgccgtgcagataggtgccggcggcgaacgcggtgatgccgagcgtggaaccgaccgacaggtcgacgttgcgggtgatgacgaccagcgactggccggtggcgaccagcaccaggatcgtcgcgttcagcagcaggtccttgatgccctgctgggagaggaactcgctgttgccggcctgggtgacggcgatcatcaccaggaagacggccaggatggcgagttcgcgcatcttgaggacgcggtcggccaggcgggcgccgccgggcttggccgcctcggtggtgggggcggggtcgggagcggtcaccgtcacgcggccctccccgttgctgcggccatcacggtttcctcggtggcgtcggagcgggggatctcggcggtgaggcggccctcgtgcatcacgagcacgcggtcggccatgccgaggatctcgggcaggtcggaggagatcatcagcacggcgacgccgtcggccgccagccggctcagcagccggtgcacctcggccttggtgccgacgtcgatgccccgggtgggttcgtcgacgatgagcaccttggggccggtggcgagccacttggccagcacgaccttctgctggttgccgccggagagggtggagacggcgtcggcgatccgggcgtacttgacctggagcctgaccgcccagtccagggagcggctgcgttcggcgccgcggtccatcagtccggccttgacggtggtgcgcagcccggtcaggccgatgttgcgttcgatggacatccccatcaccaggccctgggcgcgccggtcctcggggacgagggcgagtccggcggccatcgcggtggacggtgcgccgttggtgagggcgcggccgtcgacctcgacctcgccggcgtcccagcggtcgacgccgaacacggcgcgggcgacctcggtgcggccggcgccgaccagtccggcgagtccgacgatctcgccgcgccgcacctcgaaggagacgtcggtgaagacgccctcgcgggtgagccggcgcacgctgagggcgacctcgcccggtgtcacgtcctgcttggggtacagctcgtcgaggtcgcggccgaccatgcggcgcaccaggtcgtcctcgctcatgcccgccagcgcttcgccggcgatccaggcaccgtcccgcagcgtggtgacccgttcgcagatctcgaagatctcctccaggcggtgcgagatgaacaggacggcggcgccctgctcgcgcagggtgcgcacgacgccgaagaggcgggcgacctcgctgccggtgagcgcggcggtcggctcgtccatgatcagcacccgggcgtcgaaggagagcgccttggcgatctcgacgatctgctggtcggcgatggacaggccgcgtgcggggcggtcggggtcgaggtcgacgcccaggcggcgcatcagggcggcggtcgcctcgcgggtggccttgtggtcgatgcggcccagggcgcgccggggccggcggctcatgaagatgttctcggcgatcgacaggtcgggaaagagggtcggttcctggtagatgacggcgataccggcgtcacgggcgtcaccggggccctggaaggtgacgggcgcgccgtcgagcagcacctggccggcgtccggccggtgcaccccggcgagggtcttgatgagggtcgacttgccggcgccgttctccccggcgagggcgtgcacctccccggggaacagttgcaaggacacgttcctgagggcacgcaccgcgccgaaggacttcgagatgtccttcagtgccagcaccggggccggacccgtgtcggacgggtgggtcattgggggctcctcgacggcgcgggccgaagagccgcatcacgccgtgaaaggtttcaactgggttgccgggacgttaggcatgtagcccacgtcacgtcaatgggtacgggtcggaaaatgttccgccgcctgaaagtcacagcagcatcacggccgacgggccgaacaggggggttgacactctcgtcggaggcccctagcttcccgtcctgaatcgtttcatgcggaagctcgtacaggagacttccgaaccgacgtcacaggagccctgaagtgaccgagctcgccgcggtgaaggccgcgctgaagacccaggccgtcgagacgccgtcgtgggcgtacgggaactcggggacgcgcttcaaggtgttcgcccaagccggcgtgccccgcgacccgttcgagaagctggacgacgcggccaaggtgcacgagttcaccggcatcgccccgaccgtcgccctgcacatcccctgggaccgggtcgacgactacgcggcgctcgccgcgcacgccgagaagcggggcgtcaagctgggcgcggtcaactccaacaccttccaggacgacgactacaagctgggcagcatctgccacccggacgcggcggtgcgccgcaaggccgtcgaccacctgctggagtgcgtcggcatcatggacgcgaccgggtcccgcgacctcaagctgtggttcgccgacggcaccaactacccgggccaggacgacatccgcggccggcaggaccggctcgccgagggactcgccgaggtctacgaacggctcggcgccgaccagcggatgctgctggagtacaagctcttcgagcccgccttctacaccaccgacgtcccggactggggcacggcctacgcccactgcctcaagctcgggcccaaggcgcgggtcgtcgtcgacaccgggcaccacgcgccgggcaccaacatcgagttcatcgtggcgacgctgctgcgcgagggcaagctcggcgggttcgacttcaactcgcgcttctacgccgacgacgacctgatggcgggtgccgccgaccccttccagctcttccggatcatgtacgaggccgtacgcggcggcgggctgacgcccgaggtcgcgttcatgctcgaccagtgccacaacatcgaggcgaagatcccggcgatcatccggtccgtcatgaacgtgcaggaggccacggccaaggcgctcctggtcgaccgcgcggcactggccgccgcacaggcctcgggagacgtgctggaggccaacgccgtcctgatggacgcgtacgacacggacgtgcgtccgctgctgcgtgaggtgcgggaggagatggggctggacccggagccgctggccgcctaccggcggtccgggtgggcggagaaggtcgtcgccgagcgggtgggggggcagcaggcggggtggggtgcgtaggcactgccgtgcgggccggggtgcggtgcggtggggcgggtgccggc

SEQ ID NO: 347 - DNA, 16993 bp, Unknown
  Kingdom: Bacteria, Phylum: Actinobacteria, Class: Actinobacteria, Order: Streptomycetales, Family: Streptomycetaceae, Genus: Streptomyces
gcgcccccgattctggcgccgtcggcggcgcggatccgaacaggtcccccagtccgtcgtcgtagtccaggaccggggcgaggccggaccaccgggcggtatcgggtgccacccgcggtgagggaagccaggcatcggccgtgggcggggccgcgtcgccggtcccggccggagggagcagcacatagtcgtccagctcgtgcagcacctcgtcgagcagatcctcactcgacgacccgggcccgtccaccagccgtgcgggcagcaacagcaggcaactgcgcccccgctccaagtcgtgcgccagacgggcgagccggagccggacaccgggcagcgccgtccgcccgaccgccgtggggtacgtcacgcctggcgctccaccgtctgcagcgcccggaaggtgaccaggtcaagggcgtaaccctcctcctcgtcgtccaggacgccgtggtccaccagcctgcggatgaactcggaggtctcctcgagggtgagaccggtgaccgcggcgatgtccatgagggtggacgcatcaccaggttccaggtactgaacccaagtgcccagcagagcgagggtccgcacgtcgagttccacccgttccaggtggccgcgggcagcctcctcccggtcgtacacgatcttgctcgtctccacagccgtctccaaggtcgccccgccccgggtcgcgagatcgacggtgcgctccaccagatgcggccagccacccgtcgcatccaccaggaggctcctcttgtccggggtgtcgaacgggcactccggccacgccctgagactgtccacgttccaccgcgcaggccgtatcacctcggtgaggggctcatcgtcgagtaccgaccgcgcccgcggatccaccaaggcgatcaccgcacggttcttgtccccccgcgagatcgccgtgtactggtaaaaccgttccagggcctcggtgagactgtccatgcccaggtaacggaggtcggcgacgactacgcccggcagccggtctcgggtggccttggtcaggacgtcgacgagtgtgtccggcgccgcgttgtagacggcgagctcgcgcgcctcggcgtaggaccggacggcgtccatggccagcttcggcccgtgcgccttggtgaggcacaccaggcggagtccggggctggtggcgaggaacaactcctgctcggttagcgggctataacgatgcaccccctcgcggtcctgcccgaccagacgccgcgagaaccgcgggttgtagtcgtacggcaggctgaactcggtctgctccagctccagttccaggtcctcccttgtgcctagcatgtgcaccacgttggggctacgcaccgcgtaacgccggtggtcgccgacctgctgggccagcaaccccaggccgaccatctcgtccaggtagatcttcacgtcgttggcggtcagactgcggaagccgtcctcccagtgccccttcgccgcgtgcaggagttcgtcggcgtcgtagccccgctggaagtcgtcggcctggctgcgcagcgcgatcaccagggtgagcacccggtagcggtcctccaggttgatggtgagcctcatccgctcagcgatagaccggtgcacctccgccgaccgcgtcacggcccggatgtcctcctcggtgacggtgatcggccactgcgccgagccgaccggcttctcacgcagcgcggtgaccagccgctcgcagaagatctgcaccaggcacgcctggtagttggtagcggcgagtactcgccacaccagttccgcccgctcgaaccggtacccgaacgccgccatcggcccgacgaccagccgctgcgcttcggccggcttcagcgggccgatcagcagttcacggccatgggctagcggaacgttcgaaagcttgctgaaccgctgcacctggtgcagaccggcgaagatgaccttgaaacgacggtcagtgctgtccatcagccccttcagccgcgcgacgttggcgaacgtgccctcgccgcctgcgccgcgcaccgtcttggagtcggccgtcagaaacgcgtccgcctcgtccgccagcaccagtactcgccggtccggattctcctcgagccagcggcggacctgctccacgagccggtctggcggcatcgtgatggacgccttcggccccaggatgcccacccgcttcagctctgcggcgagcaccggccagatccgctcggccggttcggcctcccccaccccgcgtgccttcagatccaggtagacagccttgcgctccgggctcgacggatagtccgcctcgaccttgcggagcagcgccgactttccgagctgccgacctccgtagaggaagagggcgcccagcgggttcacgacctcggccatctcctcactccggccgtagaagacctccggcggcaccagacccgccacgaacggcgtgtatggcttgaaccctgtccacggcagggtcacccgctgcagcgcgcggaaggagcgcggtgaccgggccacgacccagccgaagacggccgggtccacgaccagcgcctgctgcgacgacgtccgggcgtgcatgaccagcttgcggcggcccgtcatgcccagcgggtagaggtagaggatgatgcacgcgccggtgtcgttgcggtcgagcagttccagcgggctgcggccgcgcagttcgtcggtcaccaccaggaccgtgtaggtggaggccgcggagccgagatccgcgacatagccgggcgcgctctcgtcggcgcgcagcttggcgctgagccggaggatgccgcgcacttggcgctggtcgtcgcgggagggcggacggccttcaagccccagcagacgcagcacggtcggcacgtgcttctgccactccgcgccgcgggtcgttggcctgccgagtgcgtcccaggattccagtccggccagcgcggtgtcggtcagcgattccccgtccgcgtaggcatccgcccacggacgtgccgaaacgccctgctgacccgacttgacgggtgtgacggtctccagcccagcgacgaaacgttccaggtcctctcccggcgcctcgccgctccactccggcaggctgtcgcccttgcgcagcagcgccaggcactcctccgcggtgacggtgtcgcccgcctccagcagaccatggatacggtcacggtccttctcggacaggttcatcgactccagttggccgcgcagcctgcgcacatgcgcctgtacctggtcctcgagctcggcttccagacggcggatccgctcgaccgtggtgcggaaggctccctcggggacggcccgctccaactgctccagccgtcccgtcaggtcgcgttcgtcgagcacgtccaggttctgctgggtgcgcagctccgcgagcagccctgacgccacacggtgccgctccgcccggatcgccgaccagcgcgcccactgcgtatcgcgccgcgcccgccagtcggccggcagcatcccgttgtccgtcccgacggaggggacgagcccttggccgagggcctcgaccagagcgtccgcgaggtgcaggtcgccgcgctcggcgtaggcgaggagcacggacggcacgtccaccggcccgagcaacgcgcccatcgcctcgacgaagccgggagccgccggatccggcttcccctcaggggtgcgcggcaggtcgggggaggcgagcagcgcctcggcggcggggcgcagctcccgggagaagacggatgccggcccgtgcccgtacccctccggaccgtattcctttccgtcctccatctcgtccgagcccttgaggagggattcccgggggccggtggcgcacggcgcgtcctgcccctcgagccagcatcgcaggcgcagcagcgccgcaccttccacgccggggggcggctcctcctccctgacctgtgccagggcgtggcccaggtccgtcaccgtgtcgctgcgctcctcgacctccgacgcggccagggcgcgcgcctggatcagcagggtgaccacctggtcgatgcggctgagcagggagcgccgggccttcgcctcgatcggtaccttggcctgcttcggggtgcggatcgccgcgtcggcctcttcgatcgtccgctccgccgcgtcacgcttgttgaacacccgccaggcgtcgtccagcacggaccgctcggcgacgccggaggcccacttttcgatcgcccgcagggcgaagccgagcggttggtcgtggcgcatcagcaggttctgcacctgggtggcgcgcgcgtagccgatcttgagctttggcacctcctcccggagccgggcagcctcctgggctattccagtgcgggtaagcgaggggttcgtgtcggcggagaactgcagggcggcggggtccagcggctggaagcgcttcaggatgtcgagcgcgcactccagcaggcggcgccagggaccgtggagagaggcgcacgggtcgcactgcagcagcacgtcgttcgggtggcctgcaacgagtcctgcccggacggaggcgaccgcggccaccatcagtgcggggcggtcgctctggaggcgctccaggtcggggccgaaacgggagatcaccgcggtgccggcctccggcaggacagtggcgaaggcggcgtcggcgaaggcgaggcagtcggcacggtaggagggttcgccggagccgacggtcatccagtacgcctcctggaaacgtcctgcctgcaccagacgctccaccggggagacggaagggtcctccggggacagcgggtacctctgccagacgaggggtctcttcgcgtccgcctcctccggtgccgggtcggcgggcgtgtgaggggagttcgtcacggcggcggccgtctcggacctggtcccgccggttccctcggtgtcggccgtcggcggttcgggcatcgtccgccgggaggacggctccgccgccgcggggctgtccggcaggagacacgcctcccccgaggcgccctcggacgtcaaggccggttccgcggcgggggacgccgtggccgacgtgaccggggcggctgggtcgggcgtcactggcagctcgggcgactcagccaggtcaagcgacccggggtcggtcgccgaggccgcctcctctcccccatcgtccggctgcgcacctccgcgcgatggcgtctgccctgcggcttcgtcccctgctcggggcgacggcacccggaccgcgtccgcgtcgaccggggggacggttccgaccgcctcgcctcccagctccgcgatctgctcgtccagagcccgcagcgcttgccgcatggggtctacgtgagaccctccgccggtctgctcgatcatcagcagggttgcgagtagccccttccgctgttcctgcagcgtggcgatacggctcgcccgctcccccgccctctgctcctcggcgcgcagatcgtcgacaaccccctgaagctgcgaccacccgctgtcctccggccattcccggccgactttctgcgccgcttgcgcggcagtcacccgctcgttgttccattcggccacgcgcgccagcacgctgtccggaacagcatgtccgtcggccacgtcctcagcagcggaccgcaacaggccggtgagctcctccgccttcgggcgaagccttcccagtgtcttctccaggaccgatgccgtaaccggatcgggaaggaccgtcatcttctggtcccgctcgccgatctcgctgcctactccggccacggactttcccccgctgcccttctcccgcagagacatttcctgatccgcctgtgcaacatgaccgtcaaccgatttcgccgccgcttcggcgaacctcgtccagtgctcctccaccgtcgcctgccgaggagttccctcctcagaagcgagcgcgtggagcgtcaacgtggccagcaccggcggaagtgcggcgaacagcgcctcgaaagcatcagggtccgcccccgcgaagcccactgcgggcagatcctcacgggcggccagcacatcaccggcgaacttcgccgcggcctccgccacgaacttgacgtcgcgcaccttggcacggcccaaccaggcgcgcacggtgagaagttcacgcttgccgtaccgaaccggcctgccgggaagagggaccttcgccaaatatggcaagggccccggaatacagagaagttcacgcagcccgacatcgtccagcccgcacagccaggccttcaggtccccacccgctctcgccatgacgggatgatgccagagcatgacgattgagccaatccgcaggcacaaatcattgcaggtggaaggggagctcaagcggaattgaaatctccgctcgcggccgttggcgcgcccgaggccctcacgccgggcgttgcgagcccgaagctcacccgcaccatcgtcgccaactccttctccggcggcaccgaggtcacaaagactcgcggagcatcggtccgagtcgccagagagccgcctcgggctcctccggggcacgtggcgagtcagggcatgtggaagctcggcacgggcccttcaccttgagcgcggacacctcacagcccgattccgtcggtggcgttgtcttcccagcgctcaccctcgtcggcgtactcccagaacaccgggctgttcttggaccagccgccctgggcgcgcagcttctcgacgcgtttgcccttcttgcggcccgtgacgacgacaccgcgccgtgcggagtggccggtgatccggcgcccgatgagcccggcgtactgcgcagcgcgggacatcgcccgcccgcagccgtccggggacagccgtgtggcgccgaggttgccccactggtctacgggcaggaaggcggggccgccgggggcggcgccggcagcgagcttggcggtatgccaggcaagccagcagcgcaccggacaggtgtcggggtccgcgccgtaggcgacgccgacgtcgcgggccggccggcccttgacggaggggacgtgcacctccaggccctcgtcgacgagccggatgctgatgtcgtcgagttcgctcatctcctcgttgcgcccggccaccgcgaagcggagcgtgttcagcgcgcggtcgcgcagccgggccagctcgggcaccacgtacgtgcgccgccgccgggtggcctcctgcggggcccgctcgcgcggggcggtgttcatcctccgcagatcctccggggtggctgcggccgctttgccgcggccccgggcctgccggtccctggcgttcttcaggggcttcagcgcctcgcgggccgccctggaggcctccttccttgcccgtcccccccccggccgccaggatcatctctgcaacgaaactcacccggatgttgctgtgctgggaaacctcagccctctccctggcggtttcgagtgcgctgttcctccgttcgggtgatggattacaccatgcgggtgaacgccgcgcggccggcccgttcaggcccgctttcatggctccatgatcatctcagcggctgcagagcaaccgacggatacggcaagcgagttcggggaagcagcgcctgttcatcgggccttcgcggctgcctcgctgcggcaaccgggcgcgaccgcccttgtggaggagcccggtcggcgttggtcttaccacgaactgtcctgctgggccaccgcaatcgcggcccagctacgtgaggcgcggctgggcccgggaagtacggttgcgttgcggctgcctcgttcggcgcggctggtggcctccctgctggcggtcttcgagacgggtgcggccgccgtggtgctcgacccatgtacccccgccgaccggctggcggttatcgaggccgatgctggttgcgcggcggtagtcgtcccagctggcgagcctgccgcggaggatcgccttcatggcccggcgcccgtcgcggtggcggctctgcccgaagagggcggcgcgcccttgcctgccgccggtccggagggcgaaggtgaccgggttgcctgtgtgttctacacctcgggctcgaccgggcggccgaagggtgtccagctcacccatcgcaacctcggacgcttcgccgcggacccgtgctgggacgggcccggccaccgcgtcacggcactgctttcggcactgggtttcgacgccctcagctacgacctgtgggtgccgctgactcggggcgggaccgtggtcgtccctgccgagaaccggatggacgcgcaccagctggccgcgctggtcgacacccacggcgtcactggcgttctcctcaccaccgcatggttcggtcagatcgccgtggatgccccgggcacgctgcgtggcctgcacacggtagtcaccggcggcgaagcggccgacgcgcgggccttcgccatggtccgcgcctcctgcccgcagctggcgctcgtcaatgcctacggaccgaccgagtgcaccacgatcacgacccgtcacctgctggcgcccggtgagccgctgccggccggccgggtgccgatcggtactggtgtgcccggggccaaggtgcggctgctcggcccggacctgaccgaggtggccgacggccagcccggcgaggtgtacgtctcgggcgagcaggtcgcgctcgggtatctgaaccagcccgcgaagaccgccgaacgcttcgtcgccgacccctacgggccggccggtgcccgtatgtaccgcaccggcgacctcgcggtcagggggccgggcgggacgctggagtacctgcggcgcgacgacgaccaggtcaaggtccggggacaccggatcgaaccgggcgaggtgcgcgccgcgctcgccgcgctgcccgcagtggcacaggctgcggtggtggtccgcgacgggcggctgatcgggtacgcggtcctcgaagccggccgcaccgccggtgcggaggaactgcgcgcggagctgacgcgggtgctgcccgagtacatggtgccctcggtcgtggtactgctcgatgcactcccactgacggtgaacggcaaggtggacaaggcagcgctgcccgcccccgcggccgtgactgccggtgcgggcgtgccgagaacggccgccgaaaaggccctgtgcgcggcgttcgcggagctgctgggcctggcggtggtcggcaccgaggatgacttcttcgtcctgggcggggacagcattgtcgcgatgcggctggtcagccgggtgcgtcgggagaacgtgtcgatcagctcgcaggacgtgttccggctgcgcacccccggcgccttggccgctgccgctcaggcagcggccgccccgtcagcggatctgctgcaccaggcggccaccgggccgctggagctgccgccgatcgcgttgtggctgcgggaccagggcaagggaacggatcagttcgtccagtcggtgctggtggagacaccacccgggctggagcggcagcagctggtcgccggcctgcagacggtgctcgaccggcacgacgctctgcgtacccggctgccggacccgtctgcggaggcggtgtggcagcccgaggtgctggcgccgggtgaggtggatgcggcgcggctgctggacacgctggagatgcgggagctgcctgatgctccgtcggcggccgaggtgcaaggggaagtcctgcgcgccatgcggtcgttggatctgccctccggggagctgctgcgcgccatctggtgggaccgcgggcctggacggcccgggcggctgctgctggcagtgcatcacctggtggtcgacggtgtctcgtggcaggtgctcctgccggacctggcccaggcggttgaggatccgcaggcgctcggtgcctggggcgcgggcaccgcttaccggcagtgggtggaacagcacaacgcgcggtccgcgagtccgcaggtgctggcgactttgccgcgctggcgggccgcgacccttcccgcgccggtgccctggcccgccgacacgccgctggaccccgcgctggacacgatcgccacctcgcggaccctggaatcggtgctgtcgcccgaggtcggacaggtgctgctgacccgcgccccggcgtacttcggcgccaccacccaggagctgctcctcaccgcgctggtcgtggcctcggcccggcgtggcggctcacgcactctggtcctggacaccgaggggcacggccgcgacgccgtcgaagcagccggcgacatctccgccacggtcggctggttcacctgcatgttcccggcccggctggagtgccccgagcgggcggcgcgccccacggccgaccccggcgaggaggaagcggtgctggccgaggcagtgcgcgcgatccgccggcagtggcaggaactgcccgcggaccgttcctcctacggcttgctgcgccacctgcacccgcaggccgccgggctgcttgcctcggccccggcccggccgctgctcttcaactacctgggccgctacggtgcgccgggacacagccggtggccgtacgcagcagaggcgcccgtgctcggcatccaccgggccccgctgcaggcgctgtcgcacccgctggaagtcaacgcggtcatcgacgaacgctccggtgaaccgctgctcaccgccgtctggcgctggtcggcgcgactggtcgacgccgaggacgtggcaggtctggcccatgagtgggcgaatgtgctggctgcgctcgtccgcgcctcggccgccgccccggtcgggccggccgcgcggccggccctgcccgcacagcacccagaggagcagtggccgtgctcaccgctgcaggaggggctgctctaccacgcccatcgctcggacggcgcacccgacccgtaccacgttcagaccactatggacctggaaggaccggtgaacacggcggcgctgcgcgcggcgctgtccgcgctcaccgttcagcatccggcgctgcgggccggcttccgctggaactgccgcgggcaggcagtgcagagcgtgcccgccgtggccgaagtccccctgcgagaggccgacctgtctcgtctcccccgtcaggaacgtgagcgggccgccgaggaggaagcgcgccgggaccgggacgagccgttcgacctggcctcgcccccgctgctgcgggcggtgctgctgcgcctgggcccggcacactcccggctgctgctgagctaccaccacatcctcatggacggctggtccatgcaggtcgccctggccgacctcgccgagctctacggcacggccgcgaccggcgccgccccgcaccccgccccgcggccctccgcgctcgcctatcagcgccacgtcgccgcacaggacaccggcccagcccgcacgaagtggcaggagttgctggccggtgtcaccgagccgacgctgctgactagcccgggcaccgcagagcccggccgtccccgcacggtgctgatggagctgccggccgagcgcaccgccgccctgcgggcccaggcccgccaacgggcactgtcgctgaacaccctcatcctcggagcctggtccctggtgctggcacagctgaccggccgcaccgacgtggtcttcggcaccgtggtggccgaccgcccgccccaccttcccggggtcgagtccatggtcggcctgatgaacaacgcggtgccggtacgggtggacaccgccgcctgcggcgaccgcagcggcctgctggcggccctgcaggagcagcggacggcgatgatgccgcaccagcacctcggcctggccgagatcacccgcaccacggggctgcgcgagctgttcgacaccgtcgccgtgctggagaactacaccgacgctttcaccacccggtggggccctacggtgcgggtcacctccacccgggtggacaacggcacccactacccgctgtgcctcctgctctcacctggcgagcgaatcaccgtgcgtgtgcagtaccaccccgggcgcctgaccgagaacggcgcccgtgagatcggcacccgcctgctggaagcgctggacgccctggccggggacctgaccgtgtccgccaccctgcccgtcggcacggtccggactgcggccgggaccccgaccccggccgccgcggcgtcgcgggagccggccgccacgcccgtgctggagcggttcgcggcacaggtacggtctgccccggagcggccggccgtcatggacaccgccggcgtcctcgactaccggggcctcgacctggcctcagaacatctggccggggaactcatcgaccagggcgtgggacccgaggacgtggtggccctgtgcctgcgtcgcggacgggaagcggtcgcggccatgctcgccgtcctgaaggccggcgccgcctacctgtggctcgacccccgccatccggcccggcgggtggcgcaactggccgccgaaggccgtcccgcgctgctgctctggcaggccgagttcgccgacgcgctggccttcgtaccggatgcggcgccccgcatgatgctggagccgcaccacctgaccgcgacgcccccggccgggcccgtccgggccaggccgcagcgctttcccggacaccccgcgtatgtggtgcacacctccgggacccagggaacgcccaaggcggtggtcatgccgggcgccgctctggaccggctggtggactggcacgagcagcgcctgcctgcggaaccgggctctgtcacggcccagttcacctcgatggcgttcgacgtcgccacccaggaagtcttcaccgccctgtgcagcgggcgcaccctggccgttcctgacgcggacacccgcgcggacgccgccgcgtggaccgcatggctgcgcacccacaaggtgaccgaactgttcgcccccacccccgtcctggaggccctgtgcgaattcgccgacggtgaccgggaactgctgcccgacctgcgccacctcgtgcaggccggcgaggcgctcgtggtcggcccgcagctgcgcgtgctgtgcgccaagggcggcaagcgcctgcacaaccactacggcccggccgagacccacgtggtgaccgcgggcgagatccccggcgagcccgccgactggcccgcccggcccggcatcggccacccggtgcccggcacccgggtgatgctgctcgacgtgggactgcaaccggtccccgacggactgaccggggagctctacctggcaggagaccagctggcccgcggctacctgggccggcccgggctgacctccgcccggttcgtcgccgacccctacggcccgccgggctcacggatgtaccgcaccggcgacctggcccgccggctcccggacggcaccctcgagttcatcggccgcaacgacgaccaggtcaagatccgcggtcaccggatcgagccggacgaggtacgcgcagccctggccgtcctgcccgcagtgggccaggccgccgtggtggcccgtccggacggacgcggtggcaaggaactgaccggctacgcggtgcccaccgccaccgccgcagcacctttggacggcgctgcgctgcgccaggcactcgcccgtgtcctgccggacttcatgctgccctcgcagatcgtggtgctcgaccgcttgccgctgaccgtcaacggcaagctcgaccgccgcgccctgcccgcaccggtacgccggcaagccgaagtacgcgagccgcgcacacccgccgaacgcgtggtcaccgacgcgttcgccgaggtactgggcctggaccgagtcggcgcagacgacgacttcttcgccctcggcgggcactccctgctcgccgcccgcctgctccagcggctgcgcgagcaactgaacccgacggccaccctggtccaggtgatgcagcgcgcgacccccgccgccctggccgccaccctcgcatcagcacccggcgaaaccccccacagcgctgtccccgcgcccgcgcccgacaggacctgagcgcgggccccggccgacgcaccggggcccgcgctccttcgcccgtatcaccggcctaccaccggacgttcggaagccgaccgtcccacatgccttccaccatcggaggaaaaccgtgaaccccttcgacgaccccgacggcgtcttcgtcgtcctcgccaacgacgaggaccagcacagcctctggcccgcccacctcaccgtccccaccggctggcacgaggtccatccccgcgccgaccgcgccacctgcctggcctggatcgacaccaactggaccgacctgcggccacgcacgctgcgcacccacgaggccagccgatgaccgccaccaccacgaccgagtcaccagccgaaaccctccccggcacccctcacatgaggatcgccgtcgtggcggcgcttccgcagaccgcgccgcccctcgtcgaagcactccagacactcggacaccaggtgcccgtggtgatcggctaccggcgcccgcccgactggcccggacacgtgctcagcgaacacgacctcccacccggcgtggacctggccatcccctccgcaccgcagcggatcagcgaactgctgcgcgcctacagccccgacgcggcggtgagctacggctacccgcggaaactgcccgccgccgcggtgaccgcgccccggctcgggacggtcaactgccacccctccgacctgcccgcctaccggggcccgaacccggtcggctgggccgtgcgcaacggagaacacgagatcggcgtgatctggcaccggatggacgccgatctggacaccggggccgtactggcccgcacacggatcccgctggagccctcggtgtggtccttcaccggcgtcaactcactcgtcctcaaagcggcgacagcgatgctgccggacgtcctcggccggctcgcccgcggagaggccggcgagccgcagacagcggacaccggcagctgggccggcttcttcggggaggactacgccaccgtcgactggtccgcaccagccgcccacatccacacccaggtacgggcgtggaacatcgccggccaccacccccggtgcgaaggaccgatcgcgatgatcgacggaacacgctggcgcctgcgccgcaccacactggaccgacccccggcaggcaccggccgcaggatcgcctgcggcaccggcgacctatgggtactggccgccgaccccctcgactgacccaggcggccgtcgaaccggcacgcagcccaatctgcgtctctgtcctgatggcacgtcgtgacagtggacgcggcggagggcaccgcccgcacggtcatcgacttcgccgcgcagttcctcaccgaggaccatgaggacgtcgccggacaccctgcgccagttggaggcgggtcggcttgggccaggccctcgatgcgcaccccgcaccgggcgacgtgcttccggtgcgcctgaccgtcgtgtagacgcaccgagacggcggtggtgcggtgcggcgtgcatcgggcccgcgccgccgccgcaccgcaccgcaccgcccaccgtgatgcgctggatcggcatcgccgcaccgcaaccggctcagctctcgaccgaccacagcggggcatgtggccgtcgcgggcagatgatcactagatcgagtgtcatatgcgcgcattggccctccgtcaggatgctctgcctcatgctggagagcccgcaggaaaagatcacgagaggtcggcccatgaccacaacggcacaggacgtcatcaccctcaagttcgagcggaacttcgacgcctgggacgccaaccgcgacggctatctggactggtcggacatccaaaatctcgctgaccgctacatccaggcgtacggcctctccagggacgaccgccgggcaagggcgctgcagaccttctgccagatttactggctggagctgctgcggcacgcgggcgtggatggggaccggctcacgaaggaccagttcgccatggccagccgcctcgcggttatcgacaccagccggctcaacatcgccgatggcggcggccacgcggttttcgacgtcatcgacgtcgacggcgacaacgagatcagcaaggaggagttcgcccgctgcctgagggacgtgtggaaaagcgacgcgccggacgccatggacgcattccagcaactcgacaccgacggggacggcgtgatctcgcgccaggagttcatccgtgcggtgcgtgagtactacctgtccctcgacccggaggcatcgggcagcttgttcttcggacacgtgtgacccactcgctccccggtccttggccgaccgggagcctgccacggccgcccctgggctccggtcccagcgggcggccgttgccgtacatgacgcgagctagcgttgtcagacgatctactgcgcagaccagcggccaccaccagcgtgagcaccccgagaccaggtcatacccgccctttgacctgcgacgtcaagttgacgaaggttcattggagttcactcggtggagctcactgagtggagcccacttgatgtcgtgcatcgccgccggatgctgaacatcgtgggttccactcggtggacgatgcctggcatcggcaccacagccaggcacccgcacgatcggagcctggcgcgtcccaccacgcttcacgggcttcgcgaactacgccgacgcgttcatcgagaagttccacggcatcaaaacctgcgccgacatcccgccggtgaacgtctcctacaccgacacaacaccgaccattcacagcgctgatgccctcacgggccaggttgctgatgagggaaggatccgcctccaggcgctgtggtttccggaaggctggggacatggctcccggggtgtttcgtctgtctcctgcgagtggggagacgacgttgtcgttcctttgccggatcgctggtcggtacgggctggaggagaaatcgctgctgtcattgcgcagatgcggacgtgctgctggatacggcgggccggcgtgcgctgtcacaattgtccggggtcgggcagagacgctggtgcgggcgctgccgtcctggggtgggaggaccccgagctctcagcggtcgaaggcggtgctgcgcgggggctgtggcgggtcgggggcacggtgg

SEQ ID NO: 348 - DNA, 8732 bp, Unknown
  Kingdom: Bacteria, Phylum: Actinobacteria, Class: Actinobacteria, Order: Streptomycetales, Family: Streptomycetaceae, Genus: Streptomyces
gcttcgacaccacgaccgcggccccgggcggcgacttcgccaccgcggtcgtggtgtcgaagcaggcgtccaccacaagcagcgtcgcggtcgcggcggctgccttctctgcactaaggacaggtagtcgggagatcgggcggagcggatttgttacgcgggcctgacgaacggcctggcgtcagcccactcccagaaggcgtggccagcgttgactgctgcctccatgactgcgaagagtttggagggttcggtgtccggcgggacatcgacggcgacgaggcgtgtgccgttccactcactctgaaggtctgccgcgatgatttcggtcttgatctcgtcagtggccttctggagatcggcgggcggcagatcgggaatgaacaagagccgcagcgcgcgatgccaggagttcctgaccacctcgctgacgtagtcgtcgtcgttgagcagcacaacgtcgcccagagcgattccgtaggtggagaagggaatgcaggcgacctcgtagctcccgtcgttgaccgccttgagccagagctgctcgacctgtccgtccaggccaaagggggccaggtcggcgcgcgcgatgtagttggtcgaggcgcgtccgaccggttgctcgtggacaacgaactgcatgacggctcccccattgaccagctccgatgggctgccatgatgccggagcccgtcactgccgccgtcggcggggtgcgggcagcccgagtggaaccggtccggtccgctcgaagcggcgggcctgctcgcgcttgctgcgcaggaaggtaagggtgcgatcgaggccgtcgatctcacctcgccagtcctcggcgacggcgcgttcacggcgggcgaggaggtcctcctccagttcgtccaggcggggcagcatcttcgggttgatgctcagcatcggacagcggatgcaggcgtgttcgtgctggcagggggtcccgtaggggcgtccgcaggagccgagttcgactcggcgcttgtcgaagtgctcgttgaactccgaccactccgtcttggtcggctcgcggtactcgctcgtgggccgttgcgctcgtcgacggtcaaggaactgctggtagtggcggaccacgtcgtcgtcgaagaccgcgacgtagccgcgagtggtctggatattgaggtggccgagtagagcggcgccgatgtgaatgggcaggccgctgttgaccagctcggtagcgaagaggcggcggaagtcgtggggagcgaacttcacctcggcgaaccgcggatcggtgtcgaccagtccctcggcggcccggcggatcatccgccacatcgtcgtggtggacatcgcccgctgtcccccggcgtgcacgttttggaacaggtagggcagcggctcgctccagaccttttcgtgcaggtcgtagcggacgcagatcggaacggtcccgtgcgcgctgatgtggcggcggatgatctgggcgatgacgtggaacagctccgcggacatcgggatcacccgttcccggtcgctcttggatggcgtgatcactaatagggcgaccacttcaccgctcgggcgctggtagttgcgcacgctcaggtgggtcagctcggtcagctcctcggcacgcaggccggccaggcggagcgtctccacgattgcccactgccagaacgcctgattctcggtgtgcgttagctgtaccaattttccggtcacccggttcacggcccggatgggcgcggtcgttgggtcccggcgttcggcgtcaatcttcgcggagacgcgctgccactcggtcccgtcaagggtgaagtgctcgcgtagagctgctgggcctggtggccccgctcgttgaggccggcggtctcccaccgctcctgccaagtgatgccggggaactcctgcaggtgttccagcagccgttgcatctccgtcgtccacttcgcgacaccggagccggtcccgagggccgtcccggccatagcggcgatgtcctcgatggaagcggtcgacaattcgcccagcggtcggggcgggtggacgggctgcggcggaggcgcgggttccaccgcggtcggcttaaagctgaaatcccgctcgtagatctccaacgaatgacggcgcacccgcccggtggtcgggcccttcacccgggcactgttgccggcctgactaccgggcaccgaacaccaccgccacgtcctgcgggtcgtactgctgagaccacgcagccggctggaccgggcggccgtagtgctcggcgagcttgtccaccaggtcgtccaggccgaccacggtgtagagggcggtggtggtgacatgcgcgtgccgaaggatcgtctgcacctccaccagagtcatcgccggatcccgggcaaaccgagtcgccgccgtgtgcctcgcgtcatggagcgtccagttgatgcccaactgctcggctgcccgctgaaggattcgccgggccgcccagtaggtcagcggacgcgtctcaccacggcgagtgcgccagatcggcccgccgccgtcaggcaagccggcatcgtcgaggtaggccgccaagtaggccagggcctctggagagactggcactggctgacggtcccgggtgcctttggagacaacccacatccggcccttctgccagtcgacatcggcgagcccgacgcccagcagctcggtggcccgggcccccgatgagacgtagcaggccagaagcgcctggtcccgggcgcaccgcatttgcgcgaacaactcctcccactgggcatcgggaatcgcccgcggctggcggactgggaccttcggacgcagacggccccggcgatgccggccaggaacttccggcggcgaccggtgcgcaagcgtcgcgcgacgggcccgattctccggcaccgggttgagtaccggcccgcgtccgaagtgcaggtggaaggcgtagaagccgtgaaccaccgacaggttgtgcgcgatcgtcgcaggggcataccccgctgccaggacccgcttgccggtcgtagggttcaccgtcccaggcggatgtccgccctcacgtcgtcgcagccgctgtggattgcggggcgcccgcagccagccgaccagcgcggccgcctccgcctctgtgccctgttcccagccgacgtctacggtccacagcactcggaaccatcgcagcaggtcgtaggcgtaactccggcacgtcagcgggctcacgtcccccagcagacggtcccgcagatagctactgaccggctcgacctcacgccccgcaccatccatcaccagccacggcagcgacagcgacgtaccagcagcaaccgccccgatcctcgacagccgtacacggccgtccatcagatccagatgtacaggagacaactcatgcgacaacgacatgcccagatgttcctgacgcaccaccgccaagtcgagccatggcctgagttagtgcagtcaactgaccagggcgtgccgccggtcgccgcgggcggcgaggaggccagtggcgatcaggcggagcgcctccagcgcgtcgagcccgacccaggcgaccggccagtgcgccgccgtcgcggtggccggcaggccggtggccggcaagtacagccacggcagcagggcgagcccgcaggcgaccaccccccggcccgccgcatgccccgcgccgggcgcggctcctccgcctcttcgtggagcgggatgaccccggcgcggtcaaagctctcggcaccggtcaattcgccatcggacagcaccagttgacgcgtctcccccgttatgttttccgcggtcctgcaaggggaccgctggcctccgggcccggcatgactgttcccccctgtcgaacggatgacctggggggtcgtgtcaccgggcccgagaggcgccgttggagacgctgatgagaggtctgactaccgcctggcctggtgcaatgcccggccgcttgcgggcggcaggtctgcataacgtggatgcgcgcatacggcgccaacgccctggccagcaccgcacgacccccgttcgggaggatgggttgtacgacatcgacgacgtgggcgtcttcctcggcctggacgtcggcaagagcgcccatcacgggcacgggctcacccccgccgggaagaaggtcttcgacaaacagctgcccaacagcgagcccaagctgcgggccgtcttcgacaagctggccgcgaagttcggcaccgtgctggtgatcgtggaccagcctgcctcgatcggagccctccccctgacggtcgcccgggacgccggctgcaaggtcgcctacctgcccggactctcgatgcggcggatcgccgacctctacccgggcgaggcgaagaccgacgcgaaggacgccgcagtgatcgcggacgcagcccggacgatgccacacaccctgcgctcgcttcagctgaccgatgagatcaccgccgagctgaccgtgctcgtgggcttcgaccgagacctcgcggccgaggccacccgcacctccaaccggatacgcggcctgctcacccagttccaccccagcctcgagcgcgtcctcgggccgcgcctggaccatcaggccgtgacctggctgctggaacgctacggctccccggccgccctgcgaaaggccggccgtcgcaggctcgttaaggtgatccggcccaaggccccgcgcatggccgcccggctgatcgacgaggtcttcgacgccctcgacgagcagaccgtggtggtcccgggcaccggcaccctcgacgtcgtgatcccgcccctggcccgctcgctcacggccgtccacgaacagcgacgagccctggaagcgcagatcggacagctgctggaggctcaccctctttccgcggtcctgacctcgattccaggggtcggggtcaggaccgccgccaccttgctggtcaccgtcggcgacggcaccagtttccccaccgccgcccacctcgcctcctacgccggccttgccccgaccacgaagtcgtcgggaacctcgatccacggcgaacacgcgcccagaggcggcaaccggcaactcaaacgcgcgatgttcctgtccgcgttcgccgccctgcaccatcccgcctcccgcacctactacgaccgatgccgggcccgcggaaagacccacacccaggcgcttctccgcctggcccgccaccgcatcagcgtgctcttcgcgatgctccgcgacggcaccttctacgaagccagaaccccacgcctcgcttgacgaaagacatagaggcaccccccggctctccccttcacgtgccccaccctccgccgcacacggaggcgccgccagtcacgcagggtttcgacccggggtggagaaaagtgcacccccgaaccgggcgggagcgtcatggcacggggatggcctgcggctttaccgtttgacacatgcgactcacgacgtggctgcagctggtactgggccggccgttccgcagggcgggacaccggaccgcgctcatcgccgccggcctgccgctccacctcgccgtggtgccactgtggctctggctgctcggcacgatggcggcgttggtgcgcgcgcccggcgcggtggccgtgactccgctgcccgtgctgctcacgctcgcggtgacacccctgctgaccgtcgggcagcggcggcgctaccgggcgctcgtcggcaaggacctcccgcgccccgccgtatccgggccgggacgcaactggaagttggcggtgcgccggctgaccacgcgggccttgtggcggcaggtctgctaccacgccgtggcgggtccgctgttcgccgtcctggacctcgccgtcctcgccgtctgggccgtcgctctcgtggccgcctccatctacgtatggatctgggcgctgcccccgcagtggcgggtcaccgacctcgggtacaccacgcaggccgcgtacatcaccgccggcggtctcgctctgctgttcgcggcgcaccgactggccgggggtttggtgcggttggagttacgggccgccgagatgctgctggggcgcagccgcgcggaggagctgagccgccgggtggaggacctgaccgagagccgggccggtgtgctggacgcggccgacgccgagcggcggcaaatcgagcgcgacctgcacgacggggcgcagcagaggctggtctcgctcgccgtcaacctgggcctggccaggtccaccctcggtgacgacctgcccgaggacgcccggcaggtgatcgacgccctgcaccgggaggcgaaggaggcgatcgccgagctgaacaacctggtgcgcggcctgcacccggccgtcctggaggaccgggggctggacgccgcgctgtcgggcatcgccgcccgcgccgcgatcccggtacgggtctccgtggacctggcacggcggccggggcccaccgtcgaggcggtggcgtacttcgtggtctccgaggcgctgacgaacgtggtgaaacacgccggtgcgagccgggcggaggtgaccgtggagcggatcggggagacactgctggtggtcatcgcggacgagggcatcggcggcgcggtcccgacgggctcggcgggcaccggactcacgggactcgccaagcgggtcgcgtccgtcgatggcgtgttctcctgccacagccccgccgggggcccgaccgtcatcaccgtggagctgccgtgcgtgccgtgatcgccgaggattccgtcctgctgcggatcggggtggtgaaggtactggagatggccgggttcgaggtgtgcgccgaagtcgacgatgcggaagggctgttggcggtggtcgaggagcaccggcccgacatcgcggtggtcgacgtgcggatgccgcccggtttcaccgacgagggggtgcgtgccgcgctggtgatccggcggcagtggccggacacctcggtgctgctgctgtcgcagtacgtggaggagcggtacgcggccgacctgctcgccgccaacacctcgggcgtcggctacctgctcaagcagcgggtggccgacgtcgaggagttcgcggaggcgctgcgccgggtcgcggccggcggcacggccctcgaccctcaggtcgtcgcgcagttgctggtgcgccgccacagcgacccgctggaccggctcacgccgcgcgagcgcgacgtcctcgaactcatggcgggcggccgttccaactccgggatcgcggcggagctggtggtgagcgagagcgccgtcgccaagcacatcaacagcatcttcaccaagctcggcctgcccagggcggacgccgaccaccgccgggtgctggcggtcctgcgcttcctcggggtcgcgtcggcgtagtggcccgggtcttctcggctgtccggtccgtgcgggacatgctcaatcccttgaccgagccctgtacccgagtatggtctagaccaaggttgtaggtctagacctacgtcagcacgtacatcggcatggcctcacaggcgtcggttccgaaacaccgagggaagtgatgtggcatggacacgaaaaggcgtgtggcggtcgcgatcggggcgctggtcgccccggtgctcgccgtcagtctcccggcggccacggccggcgcgcacggctgggtcaccctgcccaccagccgccaggagcaatgtgccgagggcgtcgtcgcctgcgggcagatcaagtacgagccgcagagcgtcgaggggcccaaggggctgcagagctgcagcggcgggcactcggagtacgccgaactggacgacgacagcaaggggtggaaggtcaccccggtcggctccacggcgaccttcacctggcacaacacggcgcgtcacgccaccgccaactggcagtacttcatcggcggtcagaagatcgccgagttcgacggccacaaccagcagccccccgccgacctcagccagcaggtgaacttcggcggcttcaccggccggcagaaggtgctcgccgtctggaacatcgcggacaccgccaacgccttctactcctgcgtcgacgtcaacatcggcggcaccggcggcggtgacggtggcggcaccggcggtggcaacggcggtggggacacctgcaccgcgccggtctgggaccccgcgcgcgtctacaacggcggcgacacggtctcctacggcggccacacctggcgcgccaagtggtgggtgacgggtgacaagcccggcaccaccggtcagtggggcgtctgggaggacctcggggcctgcccggccgcctgatcccaggtcgtccggtggggcagcgcggtcgtgccgccccaccacgggcgggcgaggaagcgggcggccggcctgcccgcttcccgtcgggaccggccgcgtggcgccggacatgccggcaccggcacctacactggcgggcgcacgtgccggacgggagagggcggacgggagagggctgggtgacggggaacgccggtggcttcgacgacccgcccgccgaggtactggcctccgcagccgccgcgtgctgcacctgatgtgggcgctgtcccagggcgagagcgatgtcacgcacctcgccgaccgcgtgggcggcgcgttgcccgccgtcagccagcacccggccaagctgaagctcgccggactcgtacgcgcgcgccgcgagggccggcggcaggtgtactacgtcgacgatcccgacgtcgtcaccgtcgtgcgggtgatggtggggcagctgaccgcgcgcacggccgccggagcgtgctgggagcgcgcggtcagctgccccac

SEQ ID NO: 349 - DNA, 5552 bp, Unknown
  Kingdom: Bacteria, Phylum: Actinobacteria, Class: Actinobacteria, Order: Streptomycetales, Family: Streptomycetaceae, Genus: Streptomyces
ggcccggccgacgccgcgccgcgctggtcgccggacggcactactctggcgttcctgcgggccggccagctgaacctcatccatgtcgacggcggcgaggcccggcaactgaccaccgaacagtcccgcccgcccggcgcgggaccagcagtctggtcgccggacggcacgcggatcgcgttcagtgcgctcgacgccgtcggcgaccggttcgcgccgttggtcgtcgacgaactgcactggaaggtggacggcgccggcatggtcggccgggcgcgtacccagatcttcgtggtcgacgtcgcctccggcctgatcgagcagctgaccgagggtaccgacaattgcgcggcgccagtgtggtcgccggacggcacccggctggctttcaccggtgagagcggtccggggctggagcgcctgagcacgtcggcgccatacgtggtcgacgtccacgcggacgtcgagccctgccggccccccgcaccgcgccggcggtgcggaaccggcatcgcgctgaccggcccgctgtgctggtacccggacggctcggcgctgctggtcaccggccgcgccacggcctccgtggggcacctcaacctgctacgccaaccgctggacggcgcggccccggccgtgctggccgccgacctggatcgcaacgtcatgccgggcgcgcccggctaccccggggcgctcgcccagttctacggcgaggacatcctgttcgcggtccgcgaccgcggctcctccaggctctgtgtcctgtcggccgattccggtcgggcgtgctacctcgacctgccgcagcggctctgcgtcaccggcgcgaaggtgtcgcaagccgcggggaccgtcgcgttcgtatactccgacgagtccacgttcggcgaggtcgccgtggtcgacctggattccggcaagttctcccggctcaccgggcatatggaaacggcgctgcccgacgtccggctgccggtctaccaggaccgcgcgttcaccgtctccgacggcatggtggtgcccggctgggtgatccgcgacccggccgcgccggtcggcggtccgttgctggtggatgtgcatggcggtccgcacaacgcctggagcccgcaggccgacgccgtccacttgtaccaccacgagttggcggcacagggctggacgatcctcgtgctcaatatccgcggcagcgatggctacggcgaggcccactaccgggcggtgaccggcggctggggcgaggccgacgagcgcgacgtgctggagccggtggcgacgctgatccgggacggcctggtggacccggcccggatcgctctgaccggctacagctatgggggcttcatgtcctgctggctgtcggcgcgcagcgaagtcttcgcggccgtggtgcccggcggcgtggtcaccgacctgcgagccctggcgggcacctccgacgagggccaggtgatcacggagctggagatcggtggcgcggagaagctggagcgcctttcgcccctgacctacgtggacgcggtccgcgcgcccacgctcatcctgcacggcgccgacgacgaccgctgcccgcccggccaggccgaggagtggttccaggcgttgaaggtccgcggcgtccaggcccgcatggtcctgtaccccggcggctcgcacctgttcatcctcaacggccgtccctcacaccgcgtcgactactgccgacgggtcgtggactgggtcctcacccacaccgcgtcctgatgccgcttccggtatcggcgatacatcctgattggagtcagcaaatgacccagaccactgatatacccgccgcgcggagcaccccggaccccgcgctgacggcccgctggcaggcccggctggccgagctggtcgcggcgcacggcgtcggcgccggcctggcggtcatgcaccgcggcgaggtgctggtcgaggccgccgccggctgggcccaccagggcgcgggcatccaggccaccaccgacacggtgttccagatcggttcgatctccaaggtctggaccgccacggtggccatggccctggtcgacgagggcctgttggagttggacgcacccgtggtggacgtgctgccggaactacggctgctcgacgacgccgtggccgcccaggtcacactgcggcacctgctgacccacagcagcggcatcgacggcgacttcttcctcgacaccggccgcggcgaggacaacctggagaagtacgtggcacagctcgccgaggtgggggtcacccacccgctcggcgcgacggtgtcctactgcaacgccgggttcactctgctgggccggatcctcgagcgggtcaccgacgtccagtgggacgagctgatgcggcagcggctgttccagccgctgggtctgaagcagaccggcaccctgccggaggaggcgttgctgcaccgcgccgccctcggccacgtcggcacgccgccggccccggctccggtctggggcctgatgcgcagcgcgggaccggccgggctgatccactccacgccgcgcgaggtgctggccttcgccaagctgcacctggacggaggcttcgcggcggacggcatacgagtgctgtcgcagaaatcggtcgaggcgatgcaggagccgcagatcgaggttccggacagctggttgctggctacgcactggggcctgggctggttcctggaccagtgggacggcaccaaggtctacggccacgacggcggcaccatcggccagtcggcgttcctgcggatccttccggagcacgatctcgcgatctgcctgctgaccaacgggggcgacacgttcgcgctctaccgcgcggttttcgacgagatcgccgcggagttcgccggggtgcggatgcggccggcactggagccgtccgccgagccgctggagttcgacccggcggactacgtgggcacgtatgaccgggcctcgacgcggttggacatcaccgagcgcgacggcggtcttgtcatgaccgtcacactcagcgggatcatcgccaccctggccggcggcgacccggtcgagatgccgctgcggaccttccaacccggcgtgttcctcaccaagcgcccggacctcgacgcctggctctccgtggtcttctacgaactccccgacggcacgaggtacatccatcacggcgctcgggccaccccgaaggtggggtgagcgtggtactcgcaggagacaggccggcgcgtccggaccccgggcctgccggtccagatccctggctgcttcgacatgtcgaccggaccggtcgcagagcttgtggaagaaggatgagtgagcgggattactgagagttccgtggtcgcggcggctggcggcgccgtcgtcgcaccgccccggcctcggcacgtgccgggcgccgtagagccagggctgcgggcgcgggccgaggccctcgccgcagcggcggaccgtgcggccggacgttcgccgaactgcacacgatgtccaagatgacccaggccgcctcgctcatggaccgcgtgtggcgtccggacaaaggtgcgaccatgctcccggcgtccttcctcaaggtcctttcgcggcgcggcggctcatcgtcggagggttccgcggcggccggacggccggagtctgtgtcgggctgcttcccgagctcgggctgcactcgcacatcgccgccgttgaggacccgctgcgcggtgcgggcctcggacgggtgatcaagctggaccagcggacctgggcgctgcgccggggcatcggcaccgtcacctggacctatgacccgctgcgtcgccaacagtgtgccggtctggtgcggcggaatgctggagacgggcctgggccgagccgccaacgtggcactggccgcgccgccggggttcaccccgcccggcgacacctcggcctcggaccgttactactgcaccgacatcaccgagccgttcgtgctgaaggacggacacctgcaggtgccgagcgaaccgggactgggacgcacgcccatcccggagctgcttgacgccgtcaccgagacgaaggattggatcgcgctgtgagcgatgtcgaacacgagctgtccgcgctgttcgccggtgcgggagtccgcggattcctttacgcgcaggacgtcgacggccccgcggccgtcggcgtgtccccggacgacccggtctgcctggcctcggtcttcaagatcgcggtgtgcctgggctacgcggtcgaggcagaggccggcaggctctcccgcaccgagcggctcgcggtggagcagcggtttcgcgacggcggcatcgggacctccggattggccgatccggtggagctgagcctgcgcgacctggcgctgatgatgatgtcgatgagcgacaacgccgcgaccgatgtggtgctggcccgggtcgggctggaccgggtcaacgggctcctggccgcgctgggccggacccggacgcacctgatcggcggctgcgtcgagctactcggctcgttgtgccggcaactcgtcggcgtcgaccccgacaccagcaccgaggaggatctgcaagcggcgatggcggcgcgcggagccgccgggacgctgatggagctggacgtctgcacgccgctgcggaccacccgcagtaccgcccgggacaccgccgagctgttggcccagatctggcgggacgaggctggcccggccgaggcctgccaggaggtccgtacgatcatgggtcggcagatctggccgcaccggctcggctctggcttcgacgacagctggcgtgtcggtgcgaagaccggcacgctgccgggctggcggaacgaggccggcgtggtcgagcacgcagacgggggccgctacgcggtggcggtgttcacccgctgcgagcgcccggacttccggaacccttcggcggaccgcgtgatcgggcaggccgcggcccgtgcggtggggcacctgcgatcgctcagtgcgaggtcatgacagtcgggtaacgcgaaaaggggtcgagttggcatcaactcgacccctgtgcgtttccgtgtcgtgctactgcttatgagggcggcgacgggtgtgtggctcactcgccggacagcggtacctgcgccacaccgatgtctgtgcggatgcggtgcgggcgggccgggtgcctgaaccggccggcgctgtcgcgggcgacgtccagggccacctccagcaccatcttcggctccaccaacaccacctcgagcaagcgctgcgttctgctccgcgccgccgatgaggtggcggccgttctggcgcgcaccgcccccgcatgaccggccgggggcacgagacgaagagggtcggtcaccaccaggtggtgaccgaccctctgcctgtcctgcgcccgatcgctaccagcgcatgccgagggcggtccactccgcccgctgctcatccgacagcttgtcggcccgccaccgcgtgttgtccaccacggcacccagcttgatctgagtcccgtccggcagcgcctccaccgccttccgaggcacccgcagatgcccctcccgctcgaagaactgccgcgccgccgccag

SEQ ID NO: 350 - DNA, 10104 bp, Unknown
  Kingdom: Bacteria, Phylum: Actinobacteria, Class: Actinobacteria, Order: Streptomycetales, Family: Streptomycetaceae, Genus: Streptomyces
catctgcgaggggatgtcgatggcgccggagcggacgtcgatgcggaccttgctggcctccgcgatgtgcccgaggtcggcgatgagtccgtcgctgacgtcgcacatcgcggtcgcgcccagcccggcggcggcggggcccgcgtggtacggcggttcgggcctgcggtgggcctcgacgaaggcgcgcggggagcggaaaccccgggagagcacggcgtatccggcggcggaccagcccagccagccggtgacggcgacgcggtcgccgggctgggcgcccgcgcgggtcaccggttcgtggttgcgcagatcaccgagggcggtgatcgacaccatgatcgtgtcgccgcggaccacgtcgccgccgaccacggaggccccggcgacctggcactcgtcgcgcaggccgtccatcatctcggtgggccaggtgaccggcagttcggcggggacgaccaggccgagcagcagcgcggtcggcacggcgcccatggcggcgatgtccgcgaggttctgcgcggcggccttgcggcccacgtcgtacgccgtggaccagtcccggcggaagtgccgcccttccaggagtatgtcggtgctcgccacgaccctgcggtcgggggcggcgaccaccgcggcgtcgtcgccggggccgacccggaccgccggggtggtggtcagacgggaggtgagctccctgatgagcccgaactccccgagctcaccaacagtgcccttcattgcccttacgccccttctgtccctgtgcgttcccggtcgggttcccactcgcgcgtccgcgcgggcctcgttacggtcgtggtgtccgtcaacttcagtcctacctgcaccccggcgcgagggccacgtcggtcgggggtctccccgtggcgtgcggcgacgcgataccgtggcgttccttttccccacatgatcctcgtggtcgccctggaggttccgtggtacaggcttacatcctgatccagacggaggtcggcaaggcgtcgaccgtcgccgagacgatcagcaaactgcccggagtgatccaggccgaggacgtgaccggtccgtacgacgtcatcgtgcgcgcgcaggccgacaccgtcgacgacctgggtcgcatggtggtggccaaggtccagcaagtggacggcatcacccgcaccctgacctgcccggtcgtgcatctgtagcccccgtctacccttgggccggtgagttccttccgtcaccggctgctcggcctgcccgtcgtcctcgccgcgctgatcaccgcagcgggctgctcctcaagcgacgaccgtgccaccgctgcggttcccagcccggacgcggcggtcaggaagctgtgcgagaacctggacaaggcgctgcccgggaaggtggacgggctgagccgcgaggacccgcggcccgactccgcgctcaccgcgggctggggaagcccggtgatcatactgcgctgcggtgtcccccggcccgccgagatgaacgacccggaggccgacggagccgaggtgaacggggtcggctggctgctccagaagctgccggacggatcgttccgtttcaccacgacgctgcgcaaggcgtacgtcgaggtcagcctccccaagagccgcaccggccacggcgtggcccctctggtgagtctcgccccggccgtcaagaaggcgatccccgaagggatcgccgactgaacgctccgccggggacggggcggcgccgctcatcaccggccggctgccgggtgcgggtcgcgtgtggctggtcgcgcagttccccgcgcccccttcggaggcgcttttcagcgcagaccggtcgagcggttcagggccgcctggatgaggcggtcgaccagttcctcgtaggagacgccggtggcctgccacatcttcgggtacatcgagatgggcgtgaagccgggcatggtgttgatctcgttgatcacgaactcgccgtcctcgtcgaggaagaagtccgcgcggaccaggccctcgcaggaggccgcgtcgaacgcctccaccgccagccgccgcacctcggcggtctgctcctcggtgagcggcgccgggacgatgccgggcgtggagtcgatgtacttggcgtcgaagtcgtagtacgcgtgcgtctggggcggcgggatctcggcggggacggaggcgcgcgggccgtcctcgaactccagcaccccgcactcgatctcccggccgcgcaccgcggcctccacgagcaccttcgggtcgtgccgctgggcctcctcgacggcctcgtccaggccggagaggtcctcgaccttggtgatgccgatcgaggaacccgcgcgcgcgggtttcacgaacagcggccagccgtgctctccggcgaagtcgacgatcttcttgcgggccgccgcctggtcccgcgcccactcgcgcggccggatcaccacgtacgggccgaccttcagcccgaaggaggtgaacacccgcttcatgtactccttgtcctggccgacggccgaggcgagcacgcccgagccgacgtagggcacgccggacagctccagcaggccctgcagggtgccgtcctcaccgtaggggccgtgcagcaccgggaagacgacgtcgacctcgccgagcgccttgggcacggagccgggttcggtgtagacgacttcgcggttgcccgggtcgacggggagcaccacgccgccgtcgccggactcggcgacgtcgtcgacgctgggcgtacgccggtcggtgatcgccatgcggtccgggtcgtccgcggtcagggcccaacggccgtcccgggtgatgccgatcggcaggacctcgtacttggtccggtcgatggcgcgcagcaccgcaccggcggtgaccacggagatcccgtgttcggagctgcggccgccgcagacgacggccacgcgcggcttgcgaggcggctgctgggggctctgggggaggttctcggtgctcatatcgcgatgagagtacccgctggcagtgccccggggcagtgtgggaaacgcgggtcgctcagcgtcgttcgggcttcgcgctgcgcgacatcaactccttgagggcgaccttcggcgatttgccttcgtgcacgatgccgacgaccgtctcggtgagcggcatgtcgacgccgtgccggcgggccagatccagcaccgactcacaggacttgacgccctcggcggtctgcttggtgacggcgatggtctcctgcagggtcatgcccttgccgaggttggtgccgaaggtgtggttgcgcgacagcggcgaggagcaggtggccaccaggtcgccgaggccggccaggccggagaaggtcagcgggtcggcgcccagggccatgcccaggcgggtggtctcggcgaggccgcgcgtgatgagcgagcccttggcgttgtcaccgagtcccatgccgtccgcgatgccgacggccaggccgatgacgttcttgacggcgccgcccagttcgcagccgatgacgtcggtgttggtgtacggccggaagtacggggtgtggcaggcggcctggagccgccgggcgaccgcctcgtcggtgcaggccaccacggcggcggccggcatgcgggcggcgatctcgcgggcgaggttggggccggtgaccacggcgacgcggtcgggtccgaccttcgcgacgtcctcgatgacctcgctcatccgcatcgccgagccgagttcgacgcccttcatcagggagacgacgacggtgtccggggcgagcagcggccgccatgcggccaggttggcgcgcagggtctgggacgggatcgcgaggacggtgaagtcggcgtcgcgggctgcttcggcggggtccgtcgtggcccgcacggtgggcgggagttcgacgccgggcaggtagtccggattggtccgggtggagttgaccgcctcggccacctccgggcggcgggcccacagggtgacctcgcagccggcgtcggcgaggaccacggcgaaggcggtgccccacgatccggtgccgaagacggccgccctgaccggctggtccggcttgctcacgtgccctgcccctcttcctgcaccgcttttccctgtaccgcgttttcctgcaccgcgttctcctgcactgccttcggctgcgcctgggccgcctgggccttcgcctgcgcctgggtcctgcggcgctgttcgatccgctcgcggcgcgggtcgtaggggacggcgggtgccttctcgccgcggatgtgctccagctggcgcgtgacggccgccatgatgacctcggtggcctccttcagcacgtccggggtcatctcgcggtcgtagaagcgcgagaggtccacgggcggcccggccagcacgcggtgggtcttgcggggcaggatgttcggcttcttggcgtagggcggcaggagttcgttgacgccccactgggcgaccgggatcaccgggcacttggtctgcagcgcgacccgggcggcgccggtcttgccggtcatcggccagccgtcggggtcgcgggtgagggtgccctcggggtagaaggcgacgcactcgccgcgctcgaccgcgtcgatcgcggcccggaaggcgctcagcgcgtccgtgctctcgcggtacacggggatctgcccggtgccgcgcatcgcggcgcccacgaatcccttcttgaaaagcccgctcttggcgaggaatcgcggcacgcgcccggtgttgtactgaaagtgggcgtaggcgaaaggatcgacgtgggaattgtggttcaccgccgtgataaatccaccctccgccggcatgttctccattccacgccagtcccgcttgatcagaaccatcaacggcggtttgcagatcaccgctgcgaagcggtaccagaagccgattctgcggcggggcacacgaacaccttcctctagggctgatctgcgggccgggggccgcacaagtgtcgccccaggccgccggtctgtcgagggacaccgtacgccccggcccccgcgccacccgatgggccagggagaatgtccgggacgagaggggacgaacgcgcgtgcagtggaccttggtgatccccctgaagcccctggcgcgggccaagagcagactctcggacaccgcccacgacggagtacgcccgcacctcgccctcgccttcgcccaggacaccgtggcggccgcactggactgtcccgcggtcgcgggtgtggcggtcgtcacggacgacccgctggccgcgcgggagctggcggcgctcggcgcgcggatcgtccccgacaccccgggcgccggtctgaacgccgcactcgcgcacggagcggagacggtacgggcgacagggcccgcttctcgcctggcggccctgaacgcggacctgcccgcgctgcggccggcggaactggcgcgggtcctcgacgccgccacggaattcccgcgcgcatttctcgcggacgcggcacagatcggcaccacactcctcgccgtcgccgacgaccaggaattgcggccggctttcggcaccggttcccggatccgtcaccgggaatccggcgcggtggaactgcggctcgacgcggtgctttccgtacgccaggacgtggacaccggcgccgacctgcgtgcggccctggcgctgggcgtcggcccccgcacggcggccgcggcggcacggctgctgtttccggagcggtgagggcggccggcttgtcggccgacgggggcgggcagggcccggagcggggcagtaggctgccgtcatgcaggccaccgcatacacgtacgacgccgaaagccgcagcgggcaggtgctccttgacgacggcacaccggtgcccttcgacgccgtggcgttcgacgcgggaggtctgcggctgctgcgcccggggcagcgggtgcggatcgagaccgagggcgagggcgccgggctgcgcgtcacgctggtgacgttgcagaccttctgactccttctgggcccttctgagtccttctgggtccttctgagtccttctggtttcttgtcagcccttttgagcccttcggaggccgccgggccgccgtgagcggtcgaacggccgccggacacgccgcgggccgggctccctcgggagtccggcccggcgcgtgagtccccggtcgccctacttgctgcgggcggtcttcttggcggcggtcttgcgggcggtcgacttcttggccggggccttcttcgccgtcgccttcttggccggggccttctgggccgccgtcttcttcgtggcgcccgccgccgcggtcttcttggcggccgccgtcgtcttcttcgtcgcggccgtcgtcttcttggccgcggccttcttcccggtcgccgtcgtcttcttggcggcggccttcttcgccgcgccggtcaccttcttggccgcggccttcttgccggccgccttggcgatggtggcggtcgggccggacaggctgcccttgggggccttcttcaccgcgatgtcgttcttcggcagcttcttggagccgctcaccaggtccttgaagccctgaccggcccggaagcggggaacggaggtcttcttgacccgcacccgctcacccgtctgcgggttgcgggcgtagcgggcggggcggtccaccttctcgaaggacccgaagccggtgaccgagacccggtctcccgcgacgaccgcgcggacgatggcgtccagtaccgcgtcgacggcgtcggcggcctgctgccggccacccatcttgtcggcaatcgcttctacgagctgcgccttgttcacgtcttccccttcggagacctggccggaacgaaagtgttcaagctttttcgcacgttaggcagatatataccgcaaatcaaacacgaaacgggctaatcacccttgtgccgcaacggactcggcgatctcgggctgttcagccttccccgccggggattcggccctcgtcgaggtccgcggtgaaccgctccagacgccttgtcgcaccggcgagatcgtgcttggccgcggccgtaatgaccagcagcttccgggtcagcgccatccgtacgccctccgggacttgcagtgcgcgcactcttgcgtgcgcttctttgagttgggccgcgaccgccgtatagagctcgagttggccgtcgttgtccatgcacagattgtgccatctggggcgagttgtcgcctgcgcagggggcaactgccgccgtcggcgggcttcctggcccatccgccgcgcggcggcacggcccccgtgtaccccggcaacgaccctcctcacgtgggaagttggcactccgcacgacggcactccggagggaacgggcccggaaacggctgtacccccgatcgtggcgatcgggggtacagcggtgtctcggggtggccgaaactcgacctgccgggtccaaccgggaggtccgccgggtcagacctggagggtccgcggcttgtacgacgggcgcttcgcctcgtaggcggcgatctcgtcctcgttctgcagggtgatcgagatgtcgtccaggccgttcagcagccgccagcgggagttctcgtccagctcgaaggaggcggtgatcccctcggcgcgcacctcacgcgcctgcaggtccaccgtgatctcggccgtcgggtccttctcggtcagctcccacagcgcgtccacggtcttctgctccaggaccaccgtgagcaggccgttcttcagcgagttgccccggaagatgtcggcgaagcgggaggagatcacggtcttgaagccgtagttctgcagcgcccagacggcgtgctcgcgggaggagccggtgccgaagtcggggccggcgaccaggaccgtggcgccctgccgctcggggcggttgagcacgaactcggggtccttgcgccaggcctcgaacagcccgtcctcgaagccgtccctggtgaccttcttgagccagtgggcggggatgatctggtcggtgtcgacgttgctgcggcgcagcgggacggcccggccggtgtgcgtggtgaatgcttccataactgatcagactccagcgggcgtgcgaacgtcggcgtcggacaggtcggccggtgaggccaggtgaccgaggaccgcggtggcggcggcgacctgcggcgacaccaggtgggtgcggccgcccttgccctgcctgccctcgaagttgcggttggaggtggaagcggagcgctcgcccggggccagctggtccgggttcatgcccaggcacatcgagcagcccgcgtgccgccactcggcgccggcctccttgaagaccacgtccaggccctcggagacggcctgcagacccacccgggcggaacccgggacgaccagcatccgtacgccctcggcgactttgcggccccgcacgatgtcggcggcggcgcgcaggtcctcgatgcggccgttggtgcaggagcctacgaagacggtgtccaccttgatggagcgcagcggctgaccggcgtccaaccccatgtactccagggccttttcggcggcatggcgctccgaagcgtcttcgtacgaagccgggtcggggacctgcgccgaaagcggcgcgccctggccggggttggtgccccaggtgacgaacggggacagctcggccgcgtcgatgacgacctcggcgtcgaactcggcgtcgtcgtccgtgcgcagcgtcttccagtacgcgacggcggcgtcccagtcctcgccctcgggggcgtgcgcgcggccctggaggtaggcgaaggtggtctcgtcgggggcgatcatgcccgcgcgggcgccggcctcgatcgacatgttgcagatggtcatgcgggcctccatcgagagcttctcgatggcggagccgcggtactccaggatgtagccctggccgccgcccgtgccgatccgcgcgatgatcgccaggatcaggtccttggcggtgacgccctcgggcagttcgccgtcgaccgtgatcgccatggtcttcgggcgggccaaaggcagcgtctgggtggccagcacgtgctccacctgggaggtgccgatgccgaacgccagcgcgccgaacgcgccgtgcgtggaggtgtgcgagtcgccgcagacgacggtggtgcccggctgggtcaggcccagctgggggccgaccacgtgtacgacgccctgctcgacgtcgcccagcgggtgcaggcggacgccgaagtcggcgcagttcttgcgcagggtctccagctgggcgcgggagaccgggtccgcgatgggcttgtcgatgtcgagggtgggggtgttgtggtcctcggtggcgatggtcaggtcgagccggcgcacaccgcgcccgctcttgcggaggccgtcgaaggcctgggggctggtcacctcgtgcagcaggtgcagatcgatgaagaggaggtcgggctcgccctcggcgcgccggacgacgtggtcgtcccagaccttctccgcgagtgtcctacccatcgctttccctccggccggacgcacggggcgccggcccaactagagatcttgtggtggtggcgcccgagtccccctgagggcagccgccgccgggcccgccggtccacgggccgttgtgtcttccagggtggcgtgttccatggaaaattgaacttgcgtttcacagagtgagacgcgagtatcgtttcatggacaacagtagcggcgtcggcgtcctggacaaggcagcccttgtcctgagcgccctggagtccggtccggccaccctcgcgggtctggtcgcggcgaccggactggcacgacccacggcccaccggctggccgtggccctggagcaccaccgcatggtcgcgcgcgacatgcagggccgtttcattctcggcccccgcctcgcggagctggccgcggcggccggtgaggaccgtctcctcgccacggccggcccggtgctcacccacctccgtgacgtcacgggcgagagcgcgcagctctaccgccgccagggcgagatgcggatctgcgtggcggccgcggagcggctgtccggcctgcgggacacggtcccggtcggctcgacgctcacgatgaaggcgggttcgtcggcccaggtgctgatggcctgggaggagccggagcggctgcaccgcggcctgcagggcgcggtgcagccgctccggct

SEQ ID NO: 351 - DNA, 7360 bp, Unknown
  Kingdom: Bacteria, Phylum: Actinobacteria, Class: Actinobacteria, Order: Streptomycetales, Family: Streptomycetaceae, Genus: Streptomyces
aggccgagcagctgctgcgcctggcgcagcagctgctcggcctggtaaccgatgtccgcgctgtcgtaggcgggccgggtcatgatggtgcggcgcgcctcgtgcagcttggcgcgcagcacctcgacctggtagccgagatcctcggcgtgctggatcgccttttcccgctcggtcttcagccgctccatctcggcctcgaaccgagagaggtggtcgacgtcagccgccggctctcgctcctggcgttcgtagccccgcactgcgcggtcccatccgtcccctggtcgcaagcctgtccaaacgagctccgtccatccgccgaacggggcccccgggggaatggtgtcagatcaacagcggagcatgggctgctgccccgccgctcgtcccccgaaacccggaccccggcggtcccgccttgacggcaggaccggaacgtcccgttgtcggggacgatcgcccccaaccctaccggcccttatgtacgtcggtcagtgctcggccgactcaaccggcgccgaggtgaccagttctgtgaggacgccatggcagtccttggggtgcaggaaggtgatccgtgaccccatggaaccgcgccgcggctcctcgtacagcacgcgtacgcccttgtcccggatgtccgcggcctccgcgaccacgtccgcggtgccgaaggcgatgtggtggacgccctcgccgttcttcgcgagccacttgccgacggcggagtcctcgcgggtcggttcgagcagctggaggtaggaggcgccgccgtcggacgtctcgttgatcttgagcatggcctcacgcacgccctgctcctcgttgacctcggtgtggaacacctcgaagccgtacgtggcccggtagaactcgacggtcgcgtcgaggtcgtggcaggcgatcccgatgtggtcgattcgcgtcagcatggattcagtgcagcgcggaccgggtggttacgcaacgtgcgcgcgatcacaccgacggcccgatgacggggccgaccggcgctcagtacattcgaagtaaaccctcgttcactcctcggccgtgcaggccggtaaggggatcgcagctcatgtcttctggaaattccggtacgaccggctcggtgatcgtcgcgggcgcgcggacgcccatgggccggctgctcggctcgctcaagtcgttctccggcgctgatctgggcggtttcgcgatcaaggcggccctggaccgcgcgggcatcgggggcgaccaggtgcagtacgtgatcatgggccaggtgctgcaggccggcgccgggcagatcccggcccgccaggcggccgtgaaggcgggcatcccgatgagcgtcccggcgctcacggtcaacaaggtgtgcctctccggcctcgacgcgatcgcgctggccgaccagctcatccgcgccggcgagttcgacatcgtggtggccggcggccaggagtccatgaccaacgccccccacctgctgccgaagtcccgcgagggcttcaagtacggcgcggtggagatgctcgacgcgatggcgtacgacggtctgaccgacgccttcgagaacatcgccatgggcgagtcgacggagaagcacaacacccgcctgggcatcggccgcgccgagcaggacgagatcgccgccctgtcccaccagcgcgccgccgcagcccagaagaacggcgtcttcgaggcggagatcaccccggtggagatcccgcagcgcaagggcgacccggtgctgttcagcaaggacgagggcatccggggcgacaccaccgccgagggcctgggcaagctgcgcccggccttcaccaaggacggcacgatcaccgccgggtcctcctcgcagatctccgacggcgccgccgcggtggtcgtgatgagccgggccaaggccgaggagctgggcctggactggatcgccgagatcggcgcccacggcaacgtggcgggcccggacaactccctgcagtcccagccgtccaacgccatcctgcacgccctgaagaaggacggcctggacgtctccgacctcgacctgatcgagatcaacgaggcgttcgccgccgtggccgtgcagtcgatgaaggacctcggagtgtccccggaaaaggtgaacgtgaacggcggcgcgatcgccctgggtcacccgatcgggatgtccggcgcccgtctcgtgctccacctggcgctggaactgaagcgccggggcggcggggtcggcgcggcggcgctgtgcggcggcggcggccagggcgacgcgctgatcgtccgggtccccaaggcctgaaccgccccgccccggcgtccggccggaccggccgccgagcggggcatccgagcggggtgtccccgaaccgacctcccgccgtacgttcgaaacatcgcgcggaacacgtgaacggagctgagatgcaggacgtctcctcactggtggcccaggccagggacggccggccgcgggccgtggcccggctgatctccctggtggagggggcgtccccgcagctgcgggaggtcatggcggccctcgcaccactgaccggcaacgcctatgtcgtcggcctcaccggctcgccgggagtcggcaagtcgacctccacctccgcgctggtgacggcgtaccgcaagcagggcaggcgggtcggcgtgctcgccgtcgacccctcctcgcccttctccggcggtgcgctgctcggcgaccgggtccgcatgtcggagcacgcctccgaccccggcgtctacatccgctccatggcgacccgcggccacctcggcggcctcgcctgggccgcgccgcaggccatccgggtgctggacgcggcgggctgcgacgtgatcctggtggagacggtcggcgtcggccagtcggaggtggagatcgcctcccaggccgacaccagcgtcgtcctcctcgcccccgggatgggggacggcatccaggcggccaaggccggaatcctggagatcggcgacgtctacgtcgtcaacaaggccgaccgggacggcgccgacgccaccgcccgcgagctgaaccacatgctgggcctcggtgaggcccgcggccccggcgactggcgcccgcccatcgtcaagacggtggcggcccgcgccgagggcgtcgacgaggtcgtcgaggccctggagaagcaccgcgcctggatggaggagcgcggcgtcctcaccgaacgccgccgcgcccgcgcggcccgcgaggtcgagaccatcgccgtcaccgccctgcgcgaacgcatcggcgacctgcacggcgaccgccacctcagcgccctctccgagcgcatcgtcgcaggcgaactcgatccgtaccgcgcggcggacgaactggtggcgggcctgacccagggctgagcgggaccgggccgcggccccggcgcccgccgaaggggcgtggggccgggctctgccccgcgccccttcggcgggaccgctacgggcggccccgctgcccgcgcaggtgctccgcgatgggcttgagcgccttgtccagttccgtcagggcctccgggtccagcaggtcgatgaagtgccggcgcacggacgccacgtggtgcggggcgaccttccgcatcgtctccatgccgtgctccgtgaggacggcgtacagcccgcggcggtcggactcgcagttctcgcggcgcaccaggtccgcgttctccatacgggtgatctggtgcgagaggcggctcttggactggagggtggcggacgcgaggtcgctcatccgcatccgcacgtcctgcgactcggacaggttcaccaggatctcgtagtcgttcatcgtcaggccgaacggctgcaggtccttctcgagctggtacgtcaacagcctgttgacctccaggtgggtgcgccaggcgcactgctccgcatcggtcagccagcgcgtggccgtctcggtctccatgaatgaagtctacctaagaagttgaaaggcgaactagtgaggggtgctgtgacggcgcgcacgcgttcgagccgtcacactccgcagactaccgctcacagcccgaagcgacgctggaggtctccgagctgtccgggaaggcgcggtgccccggcctgctgtccgtggcctgcggaacccgacccgccgggcacccccggctcgtccggaggagccccgacggcctgctccgccatcagcgcctccgacgactggagcagcaccgtcccggcccccacgaactcgaactggtgctcctccccggaggccccgccgagccccgtcatcgcacgtagaccgcccaggacgccggtgaggtacccgtggtcgtagtgatggcacggcgaggggcagtcggcccagccgacgagtgcctgcgggtccacccggatcgggggctccatgaagaccacgggcccgttcgacgcggccacgaacttcccggtgccgatcagcgtcaggaagcccggcacgatcgactgcttcagcgcgagacttggctgaaaagcgagcaagttgcccgagcgaatggtcaggttgccgtcgtccaggtcgtaggagttcacatcgaaggcccggtcggcgaggagcatcttgcccgagccctccgccaccacccagtccgcggcgtgcagaggcgaatggaacgacgtccgcagcagacggtccagccgcccgtgcccgaagccgttgaactcgatcgccccgtagtaggcgatcatcttccccttctgcaggaaccactggctccccttcaactccacgcagaaggtgtagtggttgacgttgtcgtcggccggcagcgtcatcgggtcgtacacctggggcccggcgccgggcgttccgtacgcgctcacagcttctcctccgacgcctggacgtagaccatgccgctgccgctcagctccagctggaacgcctccccggatccccgccccaccatgtcccgccagcccagcgcggtcgacagcttgttgcggacgtcaccgtgatgggcgacgtaggcctgcgggtcgacgtggaccgggcgctgcggggtgatcgggatctccaggaccccgccgtgcgccatgaccgccaccgcgccgtgccccttcagcgtcgtcgtgaacagtccctggcccgtcacctggccgcgcaccatgcccatgaccccgccctgcgagcccatgaacatcgtgccctgctggagggtgccctcgaaggcgagcaggcggtccgcctccacgtacagcgtgtcgccggacaggccgatcacctggatgtggtggccgccgtgcccgaagaagaccgtgccgctgccctccacggtcatcagcggtgtcgcctcgcccgcgacccggcgcccgagcatggacatcaggccgccctggccgccctggatgttcggagtgaaggagacgtcaccccggtacgccagcatcgcgccccgctgactgaacagccgctgccccggcacgaccgtggcctcgaccatcttcgagttgatctcacggaaggtcatctcacacgtcccccgcgatcgtgttccgctcgctcggctgcacgtacaccaggccgtccccctcgaagcggatctggaacgcctccccgccgccctcaccgaggaacgtgcggaagctcacgccggactggaacgtctgccgcaggttcccctggtgcgcgatgtacgcgccggggtcgacgatcagcgggtactgcgcgctcacccgcagcaccaccgccggcccgtccgacatgaccgccgcctggccgtggccctcgacggtggtcgtgaacagcccgttgccctgggacgcgccgcgcagccccgtgaaggtcgtgcccgttctcagggccgcgtccgtcgcgagcaggttgctcgactccacgtacagcttctccccctggagccggacgagattgatctcggacgcccggtccgcgaaccagcaggtcccctgcccccgcacctccatcacggtcatctgctcaccggtgagccgccgcgtcaccatcccgcgcaggccctcaccgccacctgtcagcttcttgaaggccatctgcccgtcgtacgcgaccatcgagccgttcttcgccttcacggcgtccccggtcatgtcgacggcgagcaccttgctgccttgcagtcggaacatcgccacgcactgaaggtagcggcgaagagggaggagacgacaggacccacgggtggagacagcccctgaccgcacccctaggggccgggcacccccggcggtttgccacaatggacgaaactttgtgcctgcgttcacaaacccggccgcagctcccgtgtctctcccaccgaaggtgacctgtggacatcaagaccgccaccgccctccgccgcctccgcctggtctccgcccccgaggcggtcagcttcatcctcctgctggtctgctcggtcctgaagcggaccaccgacttcaacgcggtccccgtgatgggctcgatccacggcgtcctcttcgtcctctacgtgatcttctgggccgacgcctggagccgcaccaagtggccgctgaagaccgccgccctctacttcgtcctgtcggtcctgcccaccggcggcttcttcgccgagcgcaagctcaagcgcgaggccgaggacgcggtcatcgcctcccgcgcccgccgcgaaggagtggtgaacgcatgatcgtcgccttctcggtgaccccgctgggcgtcggcgaggacgtgggcgagtacgtcgccgacgccgtccgtgtcgtccgcgagtccggcctgccgaaccgcaccgacgccatgttcacctcgatcgagggtgagtgggacgaggtcatggacgtggtccggcgcgccgtggccgcggtggaggcccgcgcaccccgcgtctccctcgtcctcaaggcggacatccgcccgggcgtgacggacggcctcacggccaaggtggagacggtcgaacggcacctggcgggggagtagcgccacgggcgccttgcactccgccggcgcccgtcacccggctgaggacggccgcggaccggtgcgacttccgccggccaccggccaccggcggcggccggtctgcccgcggggccatccgctccgcgcccgcctcaccgccggccgtcggtcaccatcgcacgtccgtccgccccgcctcactccccggccgttggtcacccccgcacgtccgtccgctccgcctcactccccggacgccgccaacgccatccccagcggggtccgctcgtacagcacccggtgcccgtaccgccgtgacgtgagcagacccgcgtcgcgcagcaccgtcagatgcgcggagaccgatgacggggccagggcgaggcggtgggccaggtccgacgtcgtcgccgggtcggtcagcgcggccagcaccgccgcgcggccccgccc

SEQ ID NO: 352 - DNA, 3266 bp, Unknown
  Kingdom: Bacteria, Phylum: Actinobacteria, Class: Actinobacteria, Order: Streptomycetales, Family: Streptomycetaceae, Genus: Streptomyces
cccatggagggcgaggaactcgaccggctgcacctgccgcagatggtcgaggacaacacggagtcgatgaagaccgcgttcacggtctccgtcgacgccagcgccgcgcacggcgtcaccaccggcatctccgccgccgaccgcgccaccaccctccagctcctggcgagcggcaccgccgttcccggcgacctcgtccggcccggccacgtcttcccgctgcgcgccaggcccggcggcgtcctcgtccgcgacggccacaccgaggccgccgtcgacctcgcccggctcgcgggcctgcgcccggccggtgccatcgtcgagatcgccggcgaggacggccggatgctccggctgcccgagctgctgctgttcgcccgcaagcacgggctgacgatcatctccatcgaggacctgatcgcctaccggcgcggcagcgaacccaccgtccgccgcgaggccgaggtcagcctgcccaccgcgcacggcaccttcaccgcctacggcttccgctccaccgtcgacggcgtggaacacgtcgccctcgtgcacggcgagatcggcgacggcgacgacgtcctcgtccgcgtccactccgaatgcctgaccggagacgtcttcggctcccagcgctgcgactgcggcccccagctggacgcctccctggaacgcatccagcagcagggcaggggagtggtggtctacctgcgcggccacgagggacgcggcatcggcctgatgtccaagctgcgcgcctacgaactccaggagcggggccgcgacaccctcgacgccaacctggaactcggcctgcccgccgacgcccgcgactacggcgccggcgcgcagatcctgcaggacctcggcgtccgcagcgtccgcctgatgaccaacaaccccgacaagaccgaggccctgctcagccacggcatccaggtcaccggccgcgagcccatgcccgtccaggccggcgagcacaacctccgctacctgcgcaccaagcgggaccggatggggcacgacctgccctggctggacgcgaccaccgcgtccacctgcggcaaccagtgacgacacagcactgaccggcaacgacacagcaccgaacagcgcaacaccgagcagcaccgaacagcactgaggagacacgtgagcggcaagggtgcaccggatctgtccgtccggaacgtcggggacctcagggtcgccgtcatcgcggcacagtggcacgagaaggtgatggacggactggtggacggcgccctgcgcgccctgcacgagctggggatcgacgagcccaccctgctcagggtccccggcagcttcgaactcccggtggtggcgaaggtgctggccggccgcggctacgacgccatcatcgccctgggcgtcgtcatccgcggcggcaccccgcacttcgactacgtctgccagggcgtcacccagggcctgacccaggtctccgtcgacaccggtgtccccgtcggcttcggcgtactgacgtgcgacgacgaggagcaggccctggaccgggccggtctggcgggctcccgggaggacaagggccacgaggcggtcaccgccgccgtggcgaccgcggccacgctgcgttcagtatccgaaccctggcggtgaccagtggcccggaccgcgtagggtaagcagcaccatgtccaagaagacgttcgaggagctgttcaccgagctccagcagaaggccgcccacggcgaccccgccacctcccgcaccgccgaactggtcggcaagggcgtccatgccatcggcaagaaggtcgtcgaggaggccgccgaggtctggatggccgccgagcacgagggcaaggaggcggcagccgaggagatctcccagctgctgtaccacgttcaggtgatgatggtcgcccgcggcatctccctggacgacgtctacgctcacctgtaaccagcccgcctaagagcaccgcacacccccctcacacgaaggaagccgacctcatgctgcgcatcgccgtccccaacaagggttcactctccggccctgcggcggacatgctgcatgaggccggctaccagcagcgccgcgagtccaaggaactgcggatcgtcgacccgcagaacgaggtggagttcttctacctccgcccccgcgacatcgcgatctacgtctcctccggccgcctcgacatcggcatcaccggccgtgacctgctcgtggactccggcgccaacgccgaggagatcctcccgctcggcttcgcccgctccaccttccgcttcgccgccaagcccggcaccgccgacgccgtgagcgacctgaacggcaagacggtcgccacctcctacgagggcatcgtcgccaagcacctcgccgacggcggcgtcgacgcctccgtcgtccacctcgacggcgcggtggagaccgcgatcgagctgggtgtcgccgaggtcatcgcggacgtcgtggagaccggcaccagcctgcgcaacgcgggcctggaggtcttcggcgagcccatcatgaagtccgaggcgatcgtgatccggcgcaccggcgccgacaccgaggagcccaaggtgcagcagttcctgcgccgcctccagggcgtcctggtcgcccggacgtacgtgatgatggactacgactgccgggtcgagcagctggagaaggccgtggcgctgacccccggcctggagtccccgaccgtctccccgctgcacaacgagggctgggtcgccgtccgtgccatggtccccgccagggaggcgcagcggatcatggacgacctgtacgcgatcggcgcccgcgccatcctgaccacggccatccacgcctgccgcctctgaggacgaccgaccgatgtccgacctccctcccgccctccccgtcaccttccggccgggacacacccgcgcggtgctgctcacggccggggtcgcgatcttcgtcgtgatcgcggcggtggcggtcctcctggagcagctcacccccggcgagcgcatcagcttcgtcttcaccggcgccctcctcttcggcgtgctggccctgctggcccggccgaaggtggtcgccgacgactccggcgtcaccgtggtgaacatcacctcccagcggcacctggagtgggcggaggtcatccaggtgaacctgcgccccggcgacccctgggtcttcctcaacctgagcgacggcaccagcctgcccgcgctgggcatccagcccggaatcgccaggcagcgcgccatcgccgacgcccgtgccctgcgcg

SEQ ID NO: 353 - DNA, 2001 bp, Unknown
  Kingdom: Bacteria, Phylum: Actinobacteria, Class: Actinobacteria, Order: Streptomycetales, Family: Streptomycetaceae, Genus: Streptomyces
gtagatggtgcctccgacggcgttgcgcacgtcgatctcgagcccggactcgctcatgtagccgtggccgccgaagacctggaccgcggtgagggaactggcgaggttggcctcgctggtgaccagcttggcgatggccaggtcctcggtgatgttctcgcccgcttccaggcgttcggcggtgtcgtagagccacttgcgtgcggactccaggccgatcttcgcgtcgacgatcttgttggcgacggcctggtaggagccgatcgccttgccgaaggagcggcgggtgcgggcgtactcgacgcagcggtcgaagcggtgctgcatctcgccgacgttgacgatgaacgagaagaggatctcgcgtttcatcacgtggtcgaggacgatgaagccgccgccgacgcggcccaggacctgggtgcgcgggacgcggcagtcgtcgaagtacagctcgctcagcggtgaggtgcgcaggcccatcttcttgacgggcctgccgatcgtcaggccgggggtgtcgcggtccacgaggaacgcggtgacgccgagggcgccgccgtcggggcgggtgcgggcgtagacgacgaacacgtcggcgacgggaccgttgctgacgaagcacttgctgccgttcagcacgaagtcgtcgccgtcgcgttcggcccgtgtggtcatgcccatcgcgtcgctgcccgattcggactccgtgatggcgtgtgctccgatggcctcgccggagcagatcagggggaggtacctcgctttctgttcggcggtgccgaacgcggtgagggggatgcccgtgctggcgagcgtggtcgtgacgcagaagttcaggcccgcgtcacgacagtgctcgccgaggccttccagcacgtacatggtggtgagcagggactggccgaggcctccgtgttcctcggcgaagggcagggcgaggatgccggtctgccggaccagcttccacttgtcccaggagaactccgcccgttcgtcctgggcgatgtggccggcgctgagcgcctcgccccaccgggccaggccggcgcgcaggtcggcctggtcggtgttccagcggatcactgaggcccccttccggggttcgtgccaggtgcggtcagtaggcggacgaggtgtgggcgtcgaggctgtgcacctcgtcgccctgcagggccggggtgaagacgcagaccaggcgcaggtcctcgtgcggggaggcgacgaggtagtgcgcgtcgtgctggtcgagggagtacaggcggcccggtgtgatggggtgcacggtgccgtcgagttcgaccacttctccggagccctcgatgcagtagcaggactcgaggtggttgcggtactccaggcgggacttggtgccggcacgcacggtggtgtcggtgaccgagtagccgactccgtcgtccttggtgaggaagcggcggctgagtccgttgccccagtcgacggtcttgacgttctccaggtcgcgaatgatcacggtcagctcctttgatctggtgaggagacggttgaaccggttgcgtccgatcgaggtctgatcgaccggacgaagtcgcgcagtgccgtggtgacggagccctcctcgtcgagggccgcttccacccgggcgacgcccgccgaaccgacgatggcggcgtcggccccgctggctgcgacggcctcgacgtggctgcgcgtactgaccccgaagccgacggcgatcggggagttcgtgtgcgctcgcagtccggcgacggtgggggcgagcgcggcgtgacctgtggggggtgcggtgccgctgcggccgtagtgggccacgagatagaggtaggcggaggattcgcgggcggcctgttcgcgggtctcctcggggctggtcgggtagcaggtggtgacgacggcggtgccggccgcctcggtcgcctcccggtaggcggtgcgcagccggggcggcaggccgtgcacgagcaggccgtcggcgccgcaggcggtgatgtccttgac

SEQ ID NO: 354 - DNA, 5860 bp, Unknown
  Kingdom: Bacteria, Phylum: Actinobacteria, Class: Actinobacteria, Order: Streptomycetales, Family: Streptomycetaceae, Genus: Streptomyces
gtcgggggcggggtgagcacggcgaacgcccggtcgtgcagggccgcggggtcctgtgtgccgttgctgtcgctccatgtcgtggatcaggtctcccacccacgcgcgccgttcctgtccgccggtcattcgtgttcctttccgtgcagctcagcccacacccacttcccccatggcagcggctcgctgccccagtcctctgccagcgtggccacgagggtgaggccacgcccgtcctcgcgctcagggtccggttccccgcgcaccggccgggccttcgagaagtccgcgacaccgatgcggacgcgcgccgcttcggggcggtcgatgacgacccggacggactcccgccgggcatgctggactgcgttggtcaccaactcggagacgatcagggccccgtcatcggccaagtcgtccaggccccaggcggccagggcgtcgcgcaccagacgccgggcgctcgcagcactcccgggcgcgcacggcagggtctggctgtacccggggtgcccggtcggccgggcccgcgtcgtaggttgcggcatgtcggtctgctctctcagatcggccgagccccggggccggtcgcacggccgccggggcgttgtccgctcatgaaagcgtggggccaggggcaccgacagggacgcgacgtcccactttccgcacgctattcgctgacccccaggaactctgccaacgacccgagccccggcggatggttggggagagcccacaggtcgcgcacgatggccacggccagcgtgtggtgctgcatccacgtgggcgcgacacggcgcagggactcaagggttttcaccgcaccggccgcgtctccgatgtccgtgtgggctcgtgccacgtccagcagcagccaggtccgccaggaaggcggcgtgtccttgctcagccgcattcctttggccagtgccagggcgtcctgcgggtggccgtactggactgcgagccgcacacgttcgatgcggaccgacgacgggctgaagacgctgaccatgcggttgtcccccgcgtcgggcagcttcacgacgcgggcggcttccttctcagccgtctccatcatcgctgccgcgcgctcgtagtcgccgcttcgtgccgccgacgtggcggcgctcatggtcagcgcgccccagaccttcaagccgtcggccgtgtcggtacggcccgcgcccgccatgtcgtcggcggtacggagcgcgatgtccaacgcgtcttccaggcgtccctgccgctggtaggtccacgcagtggagttgacgagcatcggcacgagcagcggatccgaggactgccccgccgcgtctatcgcgcgttccaggctgatgagagcgagatccgtctttcccatccgcacggcgacgtgcccggcgagctggagcgccttgcccagagcggcgaaaccagccctgcggtcgtcgtcgctctcagaggcagtgacggcgcgcgcatccgagatcaggtccggcagcgtcttcatcaccgcgtcgaactcggcggagtggtactgcgtccagccgtccgcgatctgctcgcgcaggcgttccagcgagaagccgggccccggtggctcgggctccgggccccagagcgccggcatgatggcccgccgcaccgccacgaagcgcggcccgtcgttctcccctgtggaggagaccgcaggcgggtcgcccagaagcgtggtcagttccacgccgagaccgttcgccagcgcgtgcagcgtggggagacgtgcggagtgcttccgcccctgttcgagatggcggatcacatcgacggacacactggagcgttcggccagctcttcttgagtcagggaggccagacggcgcaagcggcgcagggtccgtcccaggtcatcgtttgccacgctgccacggtacgcctgctatggcgggggcagcgggctgatggcagcgcctgcctcgggtcatctggtgacggtggctggacctccagcgctcatcgtggatcggtggcagcgggcacgctgcgatcaccggccggcagctttgaggcacgggtgcgccggggcccaccgagctggtgcggccccggcacacccgcgacccacggggggtgacgtagcctcagctcgtgagccccagctcccgagcgatcagcatgcgctgcacctcgctcgtgccctcgccgatctccaggatcttggagtcgcgccacatgcgggcgaccgggtactcgttcatgaagccgtagccgccgtggatctgggtggcgtcgcgggcgttgtctacggcgatcgtcgaggagtagagcttggcgagggcggcctccttcttgaagggctcgccggcgaccaggcggtaggccgcgtcccgccaggccaggcgggaggtgtgggccttcatctccatgtcggcgatcttgaactggatcgcctggttggcgccgatcgggcggccgaaggagtggcgttccttggcgtacttgaccgactcgtccacgcagccctgggccaggccggtcgccagggccgcgatggcgatgcggccctcgtcgaggatccgcaggaactgcgcgtagccgcggccctgttcgccgagcaggttggcggccgggacacggacgtcggagaaggacagctcacgggtgtccgaggcgttccagccgaccttggagtaggcgggggccacggtgaagccgggagtgccggacgggacgatgatcgcggagatgaccggcttgccgtcgggcgcgcggccggtcaccgccgtgaccgtcaccaggccggtgatgtccgtgcccgagttggtgatgaagcacttggtgccgttgatcacccactcgtccgtggcagggtccaggcgggccgtcgtccgggtcgcgcccgcgtccgagccgccgtccggttcggtgaggccgaacgcgcccaggatctcgcccgcgcacaggcgcggcagccactcacgcttctgctcctcggtgccgaacagatggatcggcatggtgccgagcgagaccccggcctccagggtgatggcgaccgaggagtccacccgggccagctcctccagggcgatgcccagggcgaggtagtcgccgcccatgccgccgtactcctccgggaacggcagcccgaacagacccatgcggcccatctcgcgcacgatctcgtacgggaactcgtgccgctcgtagaagtcgccgatcttcggcgccacgacatcgtgcgcgaactgctcgaccgtgcggcgcagttcctccagttcgggggtgaggtggtggttcatcgtcgttcactgctccttgtgggagagggcgcggagggtacgggaagggctggggcggcccaggtgcgcggccatccactcgctcgtggcgacgagacggccgagatccactccggtgtcgatgccgagaccccggagcatccacaccaggtcctcggtggcgaggttgccggtggcggacttggcgtaggggcagccgccgaggccgcccgcggaggcgtcgacggtggtgacgccgtgctggagggcggccagggtgttggcgagtgcctggccgtaggtgtcgtggaagtgcacgccgagcgccgagaccggcacccgctgctcgctcagcgcggacagcagctccaggacgtgcccgggggtcgcgacgccgatcgtgtcgccgaggctcagctcgtcgcagcccatgtcgagcagggcccggcagaccttgaccacctggtggacggggaccgcgccctcccacgggtcgccgaagcacatcgacaggtagccgcgcacgtgcgcgcccgcgtccttcgcgcgccgcaccaccggctcgaacatggccagcgcctcgtcgaccgtccggttgaggttggccttggcgaaggactcggtggcgctggcgaagacggcgacccggttcgcgtgcagggacagggcgcggtccaggccgcgctcgttcggcacgaggaccgggaggtccaccgggaggtcgctgacgagcgggaagagggcttccgcgtcggcgagttggggcacccacttcgggtggacgaagctggtcgcctcgatcgtcgtcaggcccgcctcggccaggcggtggatgaacttcgccttgatctcggtggggaccgtcgccttctcgttctgcaggccgtcgcgcgggccgacctcgtggatcctgacccgggcgggcaggtcgggggccgggacgaccatgggcagggcttcgggggtcattgctgtcattcccgcgccgtcccttcctcgtcgggccgtgcgatggcctcgtcatgcggtgcgatgaccgcgagcacctggtccatggcgaccgtcgtgcccggggtgacgtccagctcggtgaccgtgccggcgtgcggggcggagatgacgtgctccatcttcatcgcctcgaccaccagcaggctctggcccgcggtcacctcgtcgccgacggcgaccttcaccaccgtgaccgtgccgggcatgggggcggtgagggagtcggcgcccgcgtgggccgcgcgggtgagggaggcggccaccgggtcgtggtcgcgcacgtgccaggcgtcgccgtcgcggcccagccagtcggcggcgcggtggaaggtgtggcggacgccgtcgagggtgacggtgaccgtgttcccggtgacggtgtgcgtgccgcgcggggcgtactccaccgggtcggtcacccgcagccagaaggccaccggcttcggctcgccgcccaggcgccagccgctcggcacggagaacgggtccgtccagcccccttcccgcggggactttgggcgcagcgcgtccaggcggaccgccgccgcggcctcgtagacctcctccggtacgtcggtggtgaccagctcgtccaccaccctctccaccaggccggtgtccaggtccccggccaccaccgccgggtgggccagcagccggcgcaggaacccggcgttggtctggacgcccagcgtgaccgtcccggcgagggccgcgcgcagcttgcgcagggcggtcgcgcggtcggggccgtaggcgatcaccttggacagcatcgggtcgtagaggctgccgacctccgtgccctcgctcagcccggagtcggtgcgcaccccgtcgccctggggctcgcgcagcctgagcaccgtgccgccggagggcaggaacccgcgcgcggggtcctccgcgcacagccgggcctcgaccgcgtgcccggtgagggtgatgtcctcctgctggtacggcaggtgctcgcccgccgcgacccgcagctgccactccaccaggtccaggccggtgaccagttcggtgaccgggtgttccacctggaggcgggtgttcatctccatgaagtagtacgacgacgggtcgccgccggggacgatgaactccaccgtgcccgcgccccggtagccgcacgagcgggccgcctggaccgcggcctcgcccatcgccgcccggatctcctcgtcgaggagcacgctgggcgcctcctcgatgatcttctggtggcggcgctgcagggagcactcgcgctcgccgaggtggatcacatggccgtggccgtcggccaggacctggatctcgatgtgccggggcgtgtccacccagcgctcgacgagcagggtgtcgtcgccgaaggaggcgcgggcctcgcggcgggcggcggcgatctcgtccgccagcaggtgctcctcgcgcaccagccgcatgcccttgccgccgcctccggcggacggcttgagcagcaccggcatgccgatggcgcgggcggcctcggcgagctgcccgtcgctcagcccggagccgctggagccgggcaccaccggtacgcctgccgccgcgaccgtctccttggcgcggatcttgtcgccctgatg

SEQ ID NO: 355 - DNA, 4882 bp, Unknown
  Kingdom: Bacteria, Phylum: Actinobacteria, Class: Actinobacteria, Order: Streptomycetales, Family: Streptomycetaceae, Genus: Streptomyces
cccggcgccctcgccgcgccgcacgggcccggtcccggggagcgggggtcaggggtaggagacgacgttcgaggggacggtcgacgtacccgacgtggccgacccggcgtcgttgatgacgtgctcgtactggccgttgccgcccagcgagaccaccaggatgtcgtggaacttcaccccgggcttcaccggtgcctcgaagccgtggtcctgccggatggacggatccgcggtgtagttgcagtagctgcccaggccccaggcctcgtgggtggtgacggagtcgtcgaccttgtaggcggcgtaccccttcgtgctgccgttctggaccgcggcctggttcggggcgtcataggccttctcgttctggaagaagacggtccggccgcgctcgccgtgccattcgacgtcgtacttgttgaagtgctcgacgaacaggccggtggccaggacgtcgtcgccgttgacgcggacgccgtagtcggcccggttggtctcccagcccacgccgtcgccgtggtccgcgcgccatacccaggtgtggtcgatgatggtgttgtcgctgttgacgaccaggctcgtggtggccttgcccggacccgccccgccgatgcggaagtagacgtcctgcatggtggtcgggtccgcggagtggtccgcgccggcgcccgaggggccgatctccaggagggtgggggagttgaccggcccggcgtcgatgaggaagccggccagccgcacaccgtcgacgtcggcgaccttcatggccgtcacgccgttgtccgggacgatggtggccaggccgaggccgagcacgatcgtgtccggccggttcacctggatcgtctggtcgacgtggtagatgcccggggtgaacagcaggttcagtccctgcgcgagcgcggcgttgacggtggccgcggtggcgcccggcttgacgacgtagaacttgctcagcgggatcgactggccctgcggggtgccgttcgcccaggtggtgccgcgtgcgttcgtgcgcttggcgggggcgaacaccttcagctcactgccgtccaggtagaggaacggcttctcgcgggagaccggggtggtgtcgagcgtggtgtacgggggcgcggggaaactggtggcgggagcgccttcgacgccggagaacgtcatgttccacacgccgttggtccagccgccgatgctgctgtcccgggtgtaccactgctgctgggagtacggtcctacggtgccgtcgaccttgctgtcggcgatgtatcccccactggcccaaccgtaaccggacggcgcgaggtcgaggccgcccttgacgtgcatccgccggaacgaggacgcctgggcgaccgcccaccggtccgtgccgctgaccggagcgagggcgaggttctccgccgcacgccagaagttctgcgtggcgttgccgcccgcccagcccgcgtcgacggtcacgtcgccgtggaaggtcgtgtcgtcgggccgcaggccgaggccggcgatctgggtgtagaagccgatctgcgcgttgatgtggtcgtacgtacccggcttgaagaggaacgcctgccgcccggtgccgaactgggccgactcctgctgcttgaagaccgcgtccagcgtgccctggatgtccggggtggaggggtcgatgatgtgcacgttgggcccgaggtcaccgccgcccggcagggtggggccgccgtcaccggtgctgccgtacacctggaactcccacagcgagtagccgtactgcgtcgcccgggtcaggccgtacatacggacatagcgtgcggtgccggagaggtcgagcgtctcggtgccgccggcgccggcggtcgtggagtaggccgtgctccaggtggtgccgtccgtggacagttcgatgcggtacgccttggcgtaggcggtctcccagcgcagcaccacctggctgacggcggtcggggcaccgaggtcgatccggatccactgcgggtcggagtcggcgctcgaccagcgggtggtgaggtctccgtcgacggcgtcggaggccggggtcccgtagttctcctggctggacgccgtcacgggtttgccctgggacagcagcacgggggcggcctgcgccgcggcggccggaagcagcacgagcagcgcaccgaccagcgcgctgaccagcgccccggccccgactcggcgcgcgggagcgaagcgtctccttctgatcggtgtcaccatgctgggttcactggggggcatgaagtggcctcctggggagtggagtcgacgggagcgcgcgggactcggagagcgctctccggaaccatgcccggcagtcatggcgcggtcaaggagttcaacggccttttctttaggcttgacttaagcagtcatggtgcggtttcactccagcaggcggagcaggcgggtggtgcgccggcggacggaagcggtcgggaggggagatactcgcagcccgtggacctgaggggagcaggccgtatgaatcaccacgaggccacacgcgacgaaccggccgagcacctccgcttcgtcgctcatctcagccggctcgagcaggccacggcccgcgaggaagcctccgtgatcagcgtcgtgctctccgatccggaccggacgatggcccagtccgccgtcctgcggcacttggacctgcgggccgaacgccttcaccttgagcccgcctacgaaccgtggaaggagtcgatggctcacacgctcacccgccaccccttcctggcccgccgtctgcaggaatggaccctcttccgcgccatcgcgctgaaccagtcctggagtcccgacgcgctgctcgccgcctccgactggctccagcgcaaggtggccgccgcaccgaatgctcacgccgtcgagacgctggccgagcacggccgcaccaagcgcatccgccacatcgccaggaccaccggcaagctcatgcgaacgcgccgaaccatgcgtcagccgacccacaagtccccgacgactactccctgacagggcgtccacccacccgctgtcagtggcgggtgccaccctgaccggatgttcacgcaaaagacggcggcacggtgcttggcagaagcagcatgcgcctgcccgatcccgctggctcccggacagttccggcgcaaagaccgggccccgcacgacttcgtgttcttcggccacatgccggtgtgcgcccacaagtccgccggccggtggcggtacctggacgccgaggccctgcgcgcggggcgtaccgtggcgcgactgctgcggctcacgcacgaggaagccgaccttgtcctgccccgcaccgtcggggaagggctcgcacgggacgcccaggctgtgccaaccagcagaagtcaaaagccagttgtcagccggtgcgtgtcacaccagcgcctgcccaggtgatcgtgtcacgcgcttcgcggacaggagcggaggaagtcgaggagggctgcgttcacctcggccgggcgttcctgctgggtccagtggccgcagcccgcgagttcgaggggcgggcgcagcagggtggccatgcggtcggggaggctctcgatgagttcgggcgtgccgggaaacgcggggacggggtcgcggtcgccgtagacgtacagggacggcgcggtgacgacggcgtcggcccacggcgcggtcaattcccagttgcggtcgagattgcggtaccagttgagggcaccggtgaagccctcggagaagctctcggtgagcgcgtcgagatcgctctcggtgagccaccccggcagggtcgcgggatcgggcatggctgcgagccaaccccgctcggggtcgacgagcggctgcttgacgccgccgggagcatcgcccgaggccgagtagaggaacttccgcagcgccacgcgggtgtcccgcccgaactcggcgtcggcgacaccggggcggtcgaagtagttccagtagaagcgtccgccgaacgctctgtccatggcggccagcggaggctccttgccccggaacggcggcggcacgctcaggcccgccaccccgaggaccaggtccggccgcatcagcgcggtgtgccaggcgaccggtgctccccagtcgtgcccgacgacgtaagccctcgtctcgcccagggcccggatcagccccacgacgtcacccaccaggtgcaggatggtgtacgcctcgacgtcggaggggtggtcgctgcgcccgtagccccgctggtccggggcgaccacgcggaaccccgcttcggccagcggaccgaactggtgacgccaggagcgccaggactcggggaagccgtgcagaagcacgacgagggggccttcgccctgctcggcgatgtgcagccggaccccgttcacatggaccaagcgatgttcgatcacgagccgagcgtacccgccctcacgctctcggcgcgggacacgcgccccgtccggtatccaccgcctggaggcgggggtgcccttgcggcgcgcggggacggcgcctgttccgtagctgtgcaggcggcgtagtcgtccgacgaacgacgaccggacgaccggccgaccggccgaccggaaaccggaaccggcctggctacatggcgggcagggccggaacctcgtagggatcgccgctgaaagtctgtcaactgaccctggactgggcatgattgctgttgtccggagttccgcgtgcagaggggggaatctcgacctctgcgacggcggcgcgcggtgccggactcgtcgggctgccgctcgcgatgggcgtcaagccgcgttggcggcacacctacaacgacctgcccccgcaccagaagccacagaccgggagagcttcatgaccactccgcccccgtgccaccgccggaggagctaccgggcccgccgcccgtcgc

SEQ ID NO: 356 - DNA, 626 bp, Unknown
  Kingdom: Bacteria, Phylum: Actinobacteria, Class: Actinobacteria, Order: Streptomycetales, Family: Streptomycetaceae, Genus: Streptomyces
ctcacgccgggcgcgctgcgcgccctggccgaccggctggccgagaccggcgacccggacgtgctggtcttcgactacgcgcgcacctactggtggggcgggacgcggcgcaacgccctggcgggcgtcctggccgaggcgggcgagggcacgttcacggcggccgagcggccggagatcctggacctgctgatggtcgtgtggaacaagctgtaccggcgcgacttcgtcgaggcgcacggcttcgccttcccgcccggctactacgaggacacgccctggacgttcccggtcctgctcaccgccggccggatcgccgtgctcgaccggatctgcctgctgtaccggcagcgccggcagggcaacatcctgtccaccaccagccgcaagcacttcgacatccacgaccagtacgagcgggtcttcgcgtacgtggacacgcacccggagctggcctcctggctgccgtacctgcaccgcaagatgggcgagcactgcctggacgtcctcgccaaaccggaccggctgccgcccgcggacaaggccgagttcttccgccgcacggccgaactgtcccgcgcgcaccggccaaggacacgccctcgggccggtgcgcgcgggacagt

SEQ ID NO: 357 - DNA, 1753 bp, Unknown
  Kingdom: Bacteria, Phylum: Actinobacteria, Class: Actinobacteria, Order: Streptomycetales, Family: Streptomycetaceae, Genus: Streptomyces
gccgggacgagcagcgcgggcgccggcggccggcgcaggaagtcgtccacctcgagtgcgtcggcctccgcggcgagtccgggtcgcacggagtcgaagtaggcggccagttccgtccggctcgcgggcaccgtgtccgggtcgaggccgacgagccgggcgctcgcgcggtgttcggcgacgtaccggtcggcccgggcgccggtgagcgggaatccggaccgccacaggacgtgcagataggagtcgatctccgcgcagtgcacccacagcagcaggtcgggggcgtcgatgcggtaccggctgcccgttcccgggtcggtggccgacagcatgcggtggatcctacgcacccgggcgcccgccttctcggcggcctcggcggtcccgtacgtcgtcgtcccgacgaagtccgcggtgcgcagcagcctgccccaggcgtcgcggcggaagtcggagttctccagcaccgcgcgcaccgcgcgcgggtgcagggcctggaggtacagcgcccggatgcccgcgacccacatcatcggatcgctgtgcatctgccaggtcacggagtccggcccgaagagccctggatcgccctcacccgtgggcacggtcgcaggcgtgcgtatggtctccacctcaggcaggctaacgcgggcccggcggcgcgtcgacgggccgccggggccgcgccatccgtccggggcgtccgggccggtccgtccctccgtcgaggccggtcccgttcagcccaggaccgcggtgaactccccgcacgccttggcgcaggtccggcaggcgtcggcggcctgctccgcgccggggtgccggtcgaagacgtgggcggtgtccaggcagacggtcacgcaccagtccagctgggcgcggataccggcctcgtcctggctgttctgctcggacagcaccctgcaggtggcgtcgcagacctccgcgcacatgatgcccctgcgccgcaggaggtcctgctcctcacctccgcccacatccaccaggctcgcgcgcagcgcgcaggcccgcgcgcactccgtacacgcctgcgcacacgcgaaacggtcctccaggaactggacgagttcctgttgcgaaggcgtcgatgatgtcgtatgcgtcgtggtcacctctcgcgagtagccggtgccgcacccgccaaacgccggtgctcccacgggtcgcgcggttttccggccaccctgccgggcacccgtgcggcggcccggcggcgcccccacgggaaccaggaagcgccgggaagcagccgagaacaaccgcaccacggaggtggatgtccgtgcccggacgacaggagctgccgtcgacgctggagcgctcctcccgggacgcccagcgcacctggatcaaggcccacgactccgccgtcgagacgtacggcgagggcgagcgggcgcaccgggtggcatacggcgcgctgaagcacatgtacgagaaggtcggcgaccactgggagcgcaaggagggcggccggaagggcccctccgacccgcggtcggcccggccccgcggacagggaggacgcagcggcgagggcgtcgacgagagcgcgtccaaggaacacctgtacgacatggccaagcgcctggacatcgaggggcgctcacacatgtcgaaggacgaactcctgacggcgatccgcaaggcgaaccgttcccgcacccgcccgggcggcggcgcggaggcgttcactcggagcgggcctggcgggtgcgggaacggttcg

SEQ ID NO: 358 - DNA, 1193 bp, Unknown
  Kingdom: Bacteria, Phylum: Actinobacteria, Class: Actinobacteria, Order: Streptomycetales, Family: Streptomycetaceae, Genus: Streptomyces
gccccgagcaccaccaccgcccggagggtgggccgcagcaggtgcagttcctgcaccagccagggcctgcaggtgtcccgctcgccgggcgtcggtttgttggcgggcggggcgcagtgcaccggcgaggtgatccgtacgccgtacagttccaggccgtcgtcggcggagacggaggtcggctgggaggccagccccacatcgtggagtgcctcgtacaggacgtccccggagcggtctccggtgaacatccggccggtgcggttgccgccgtgcgctgccggggcgagcccgatgatcagcaaccgtgcgtccggtggtccgaagcccggcacggggcggccccagtaggtccagtcggtgaacgcggcacgcttggtgcgggcgacctcttcgcgccaggtcaccaggcgcgggcaggcccggcaccgggtgatccgccggtcgagagcggcaaggctgctggtgtccatgcctccaccgtaaattcgtgcgggacgatgggcccaggagactaaggtcgggaccatggcttccggagacgacatggaccacgagcagggcccgggcagcgaggttgaccggccgacacgaaggcactccccgcagtccggcgcaaccgcggatcccactgccgatgcctctgccgcctccacggaccccaaggccggagctgctgagccccagaccggtgccgccgcgggtccggaggacaccggtgccttggatcccaagatcgccgctgccgtcgccgccgccgaggccgccggcccgggccctggtgagacggtgcggatcgacagctggatctgggccgtccgcctggtcaagacccgctccgtcggcgcgaccgcctgccggggcggccacgtccgggtgaacggcgagcgggtcaagcccgcccactcggtccgggtcggcgacgaggtccgcctgcggggtgagggccgggagcggatcgtcgtcgtcacacggctgctccgcaagcgggtcggtgcgcccgtggccgtccagtgctacgtcgacaactccccgccgcctccgccgcgtgaggccgtcgccccggccggtgtccgcgaccgcggtgccggacgcccgaccaagcgggaccgccgcgagctggagcggctgcgcgacctgggcggcctggacggcccgagcggccccgcgggccgcccgcgaagccggtagac

SEQ ID NO: 359 - DNA, 5511 bp, Unknown
  Kingdom: Bacteria, Phylum: Actinobacteria, Class: Actinobacteria, Order: Streptomycetales, Family: Streptomycetaceae, Genus: Streptomyces
cgggcatcagccgcagcgcgccttccaggaagccgacgtaccagtccggctgggcgtcgatggtcacctgatcggtgcggtaggggccgtaggaccagatggcgttgatctgcatcagcgcgctcatcagggtcagtacgcccatcacggtgaagaacagaccgagggacttggccgagtagctcggcaggaggggcttgccgatcacgttctggttggtgtggccgggcttggcccactgggtgtgtttctgccacacgatgaaccccaggtgcacacccaccagggcgaggagcaggccgggcaggatcaggatgtggaacaggtacaggcgctcgatgatctcgtgcccggggtactggccgccgaagacgaagaactggaagtaggtgccgaccacggggatcgacagcatgatgccctcggcggtgcgcaggcccgttcccgacaggaggtcgtcggggagcgagtagccgcagaagccctccagcagggcgagcccgaacagcgagacgccgatcgtccagttgatctcccggggccgccggaagacgcccgtgaagaagatgcgcagcatgtgcaccccgatggccgcgatgaacaccagggcggcccagtgatggatctgccgcaccagcagaccgccgcggacgtcgaagatgatgtgcagcgtcgaggcgtacgcctccgacgtcatgacgccctgcagcggcccgtacgagccggcgtacggtctctccgaactggccggatggaaatagacggcgaggaaagtgcctgtcaccaccaggatgagcaggctgtacagggcgatctcgcccagcaggaacgaccagtggtcggggaacgccttgcgcaggaactccttgcccgccgtcgcgagcggcagacgcttgtcgagggcggtcaccgcccgctgggtgcgcgagggcggcgaccagacctcctcgtacgacttccccacgccgtgcccgcccttctgcgttccgtgctcggccgcgcacactcggtgctcgtcctgagcctggcacgtgtggcaggaggccgcgcgtccgcagcggcaggtcagccctgcccttcgtgctgttctcgcggggacgcttcgatccgctgggtggacgcctgagcggtggccacatcgcgcgggtagctgcgcatcgccaccaggcccagcaggccggcggcgaccagggtgaggaggaagaagagcagcgtgtaccgcagccctgtgccgttgctgctgtccgggccgccgaacacgttggccgagaagtagccgaagagggtgggggccgcggcctcgcacagggtgcgcagcatggtccgcaccccttcgcccgtgccccacaggaacggggggaggatgtcgagccgggcggcgtccaggggcggattgaccgcgcccagcagcagcgcgcccatgatcagcaggggcaccgccacggcaagggacgcggcgtagatcgcgggagcgaagaagaccggtaccgtcagcatgcacacggtgggcaccagggtgcgggcgttgacccgcccgccgcgcagcagccggtcggcgatccgccccccggacaggacaccggccacggcaccgatgcccacgacgagcacgagggaggtggccacggaggtggtcacaccgtagtgccgggtggtgtagagagtggcgaaggagcgcagtccggtgaagtagaagtagccgagcgcggacgccaggatcagcaccagattggtgcgcacccgcaggatgtagcggatcgaccaccacttggacgcacggcgggggtcggagtcgagaacgaggtgctggtgcggttcgatccgtgcacgctccgctgccctgacgaccgggttggcgtcccgccggccggcgccgggtgagggcggcggcgcgtcccgggaacggtgttgcccgtccctctccgctgcgtcccgctcgtcggggatgtggtcctgtcctggctccaggcgggactggccgccgcgcgcgggctcggcgaggcggtggatgaaccaggccaggacggcgcctgggaccaccagccaccagaaggcgaagcgccagatgaggaaggagccgatcgaacctgacagggcgaagcccatgccggtgccgacgaggtcgccggcgaggatgagcccgtacatgcgggcccggttcctgacggggaagtagtcccccaccaaggaggcgatggtaggcccggcggtggcggagacggcgcccagggccgcacgggacgtcagcagccacaggtaggacgtgctcgcacccgccaggagcatcgccaccgcccacagtgccacgctgatggcgagcagccgggtccggcgggtgcggtcggtgagcagaccgacggggacggtgagcgccgcgctggacagggcggtcacggaggccagcagcccgatctgcgtgttgttgatgtcgaacgcgtgagtgagctggggcgccatggccgacacggtgcccttgtccgcgccgtccagggccagagcgccggccagggtcagcaccacgcgagcccgggccggcccgccgagagcccggatccctcgttcggccaggacccggacgcgcccgggcagcctcatctgtggccctcgggcggcgagcccgtggcttcctcagagcccgctcgacgggcgttttcacgttcgccgccttctccgctcagcaaaggggagcgggcgaggaccatcacggccgccgcgacaaccgcggcggacacgaccgccagcaggatgaacagcccgccgcggacctcctcatggaagatcagcaccccccacaggatggccaccaccggatcggccatggtcaggccgggctgagtggccagaagcttgcccgcctgcatcgccgactgcagcaggaacagggcacccgcgccggcggcgagcatcgcccacagctgccagctggtgaacaggacagcgaagccctgcgagaaggtgtccgtcatgcccttcatcaacgcggcggtcatgccgaaagcgcagccggtggtcgcccccagaaccgccgcccgccgggcacccgacgcaccgcgcccccacagcaccccggccgcgatcagcaacacgttggcgccacagccgaccacccatcccacccaggagaccgacgcggccttcccactgctcggcccgagcccgaccagcaggccggccagacccgccaccatgaccgcggacgccccccactcacgcggccccagccggctgcccaggaggaaaccggaaaggatcagcgccgcgggcagctccagggcaagcagcggctgcaccaccgagagccggccgttgcccagcgcggtagcctgcagcagaaacgcagcgatcatcgacgcgatcccgccgaaccacaccggacggtgcagcaggtgccacaccaggcgcgggctcaggttttcctccgcaggttcctcacgggcagccttgcgctgcagcgccgaggccagcgcattggccacggccgccagcacggccagcagagcgctaaacacagcaccggccggcccacagcaggaccgaccgccccacgaaccggatccccaccgaggtcagggagacatgcaccctgccggagtaccacgatccaccccacctcaccccaggacggcgaaaagccctcactcgtcgttcagcgagaagacgaccactccctgaggcggccacctcgccggtgacgctcaggccctcggggcggttaaagagatcgccgatccccgggatggtgtggccgatgcagcgggaggcgtaggccttgtccgcgatcacgtgctccggccggcgacgtggccgtccccggcggtcgcaggcgacgtggatcttgctggtcaccgaccagcccgtgacgggtggtgcccggtcgggatatccgctggtcgccgcttgtcgatggtcggcatactgccgcgatggatccagtgactcttgagaccgaccggctggtgctgcgggccttcgcagctgccgacgtggatgcggtgtacgaagcctgccaggacgaggacatccagttctacaccccggtgccggtgccgtaccggcgtgcggacgcggagaagctcgtaggcgagaagctgcccgcgcagtgggccgaggacagggactacaccctcggcgcgttccgcaaggacaccggtgccctggtcggctcgtactgcctgaccctggtcagccgcggcgtctgggagctcggttactgggcggtcaaggcacagcgcggacgcgggtactcggtggaggccgctcgggccctgtgcgactggggctgggccaccctcgacgtccaccgcgtcgagtggtgggccatggccgggaacaccggctcgcgtgccgtcgccgagaagctcggcttcaccgtcgaagggacactgcgcaatcgcggcatcgccaacgatggaaagccacacgactggtgggtgggcggactgctgaggccatgacgcccgggcgggtgcttggacggctgacgggcacaccgggtgcgggaagcggtccgggggatcgggccgctcgacgagagcggcaccgcaccccggatcgacttcaccgtccacaaggacgcccggttgagagtgcccatcgacacccgcgactggatcacctgctccttcctcccgcccacacacccgacctcaactccggaccccctctgccgtgcagctctctccgcaccgcacgccgtctcgtcgtccagagcctttcccccgtgaacgcggcggggaggccgggcggggcgctgtgtatatccctgaccgcggctatcggggggagggttcgccgttggtgcggcggccgccgaggtagttcgtggaccggtaggcgtagccgccgggggtgacgtagagcgagtgatcggttgctccgtgagggtcccccgcgggcacctccaccctgccgaggaggatggaccgggggatcgggacccgtacttcggggaggtttgctatcgccttcgggtcgagcggtgcgctgcgcagctcgaagtgctccgcggtctcctcagacagttcgcgggctttcgtctgagtgtgagtcggattgctcatggtttctccctgccgatcagtcgtattccgtggtgccgggccccgacgcgagggttcctgcagcctgtgggtcttcgtcctccacgtggactgacttcatcctcgagggccgctggcacggcgtgttcggacaagacccaccgtgccggagacttcctgaagccaggctgaagtcacctgaagccgtcttcaggttgggcctgcggggtgccagcgcgcggaggccgtcgacggcctcagccgcagtctctgctgctcaggcgcccgccttcgcgtgagacggtgtacgacgcgcaaagcgtcgtcggcgccgggccggcgctgcgtggggggcgtcggtgccggcctgccggatgacggcgcgcggcgtgagggcgacggcgatgacatcgtcggcgtagccgaagacgggggaggggagcgggaaccaggtccgcgggcagggctgggc

SEQ ID NO: 360 - DNA, 4217 bp, Unknown
  Kingdom: Bacteria, Phylum: Actinobacteria, Class: Actinobacteria, Order: Streptomycetales, Family: Streptomycetaceae, Genus: Streptomyces
gacctcggtacgtacgtcgtgaagttgtccacgggatggccgctgacctgcggtgatttccattacgccgaccaggccctgtagatcgtccatcgccgccgcgacgtacgcaccggcagcgtcagcatcgagcgcgtccacgcggtcatcgacctgaccatgcaccggatcacggcgccccagctcgcccaattcgcaggatgccactgggagatcgaggccccgcacaacgtcagggacgccacgctcgccgaggggcgcctcgaagatctccaccggggaccgcaccccgtgcgatcaccattttccgcaacctcgagatcggactcgcccatctagccggtgggcgcaaccaggccgccgcagtcgatcaccagagtcacaccccgaccacgcattcgacctcatcacgcccaatggctgagaacacccggcgccgtggggcgcgttcggtgctggtgcactcgagtgcgcggggtccggcgctccaacccgttaccgtcccgaggcgatcgagcaaatccatgtgcgcctacgtcagaacagcgagttgttgcccctcagccggcgtcgcgggaacgtggcgaaggtctgatcctctaggcctggaccagcagttcgaaggcctcggggacgacccgcccggacccctcgtcctccggtcgcgtcggggcgtcgatgccaagcagtcggatgacgtcgagatgattcatgtgttccaaccatgcactacgggacttgatgcaccaggccgccctcgatgccggacatgacccggcccgggcttccttcaccccggcccttcgtgtcgtccgccgccacgtcaccaggccccgcctcttgagaggcactcagtccacggccgccatgaacgtgagcatccggtcatcgaccttgtccgcgtggtcgatctgcggtgcgtggccggcggtggtgacgatctcggcacgggcgcccgggatcaggcgaggcacgcgctccagctgccgcttcgggtgcaggagcaggctgcgctggccgagcaccaggtagagcggggtgcggatcgcggacagttcggcatcggacaagggcagtggtgcgggccgacggatgcggtaggcgcggacgcccgttctggccatcgcgaggagctccggcatcacgagcaccggctgcgccagccaggccgccagcctcggccgcagccccttcggtgcataggacgcgaagaggctcacgaagagccagccgaagaagcgcagccccaccttctccagaccgccagggtcgagcagggtggccgacgcgagccggcccggcgcgcgatgcgcctggttgagggcgagccagccgccgtaggagatgccgaccaggtgggcacggtcgaggccgagtccggcaagtgtctcgtcgagccactgcgcggcgcgctcgggctggtggagggcttcgcgctggacgctgcgcccggggtcgcccggggtgtcgagggcgtagacgggacggtcggcgctgagggcgggggtgttcgggtaccacatcgcggaacacgagcccgctccgtggacgaggacgacgggtgtgcggtccgcgcgggccgggtccacggggccgtaacggtagacgtgcgtggtgccgaaggacgtctccacgtcctgctctgccacggcgggggcgcccagggcgtgggcgacatcgcaggccgcgaagtggcgttcgcgccaggcgtcgctcacatagcggccgacgtcgggtcggggacgggcagtggtctcggacacggcctcgcactcgccgggcgagaaatatgccgcggccgtggtggctcccgcggcgtgtgctgaccgtggtgtcggccgacgtcgatgccgctgccggcgtcgggcgatctggatcgtgcgacgtccgaagtcactgcgcgtgcgggcacattgcgctcctggaacgagggcggcgcggcgcgcggcgtacgcggcaccgtcctcgcccccgacgaggttgatggcctacgacgccgaacgaggtgcccccctgtgacccatcggccaccgcgtactgcgctgactcacacggccccgtcccttgggacgaaccgcacgaccattgcgcgcgtacagcgagcagggctgtccgcctgcggcaggcagttcccggccgagctgactacatggggacgcgaccggggaggcgagttaccgacaagacctgtggatcgtgtgttctaggatctcgggatgagcgacgagcttcttcacctcacggtcctgggctgcgcgacgccctacccgagcgtggacaatccgtgctccggctatctggtgtcgagcggggacactcgtatctgggtggacgcgggcagcgggacgctcggcccgctccagcgtcatgtgcggttggatgagctcgatgcgatctggatctcgcatctgcatgccgatcacagcgcggacttgctcaccgcgtactacggcgccctgtacgcggacattcgcctcgcagcgccgatccctctctacggtccgcccggaatcgccgaccggctggccgattttctcaccaacactccggctcgcagcccgatcgaatccgccttcgcggtaaccgagttgcacgatgggcatcaggcggccgtcggttcgctccgactgaccagccgggcggtgtcgcacggcattccggccttcgccgtgcgcatcgaggcggcgggcaagtcgctggtgtactccggagacacggcaccgtgctcgagcctcacggagctggccgagggatgcgacgtactgctgtgcgaagccgagagcgcacaggcgccagtcgagggcggacaagtgcaccacacgcccgaggacaccggcgagacagccagcacggccggggcgggccgactgatcgtcacgcacgtcggccgtttcctcacgccgcagcaagcggtggcacgtgcctcggcgcggttcgacggtcccgtcgactacgccgcccccggtgccaccttctccatcggctaggccacggccgcctcgggggcgttcgacaaggcagccacgttcgaagcgggctccggcgcggacgagggcgttgatcgccgcctcggcgcggtcgtggtcctccgcgttgcagatgtcctggatcgccttcttcgcgcccggctgcgcggacttcggcagggagtcgaagacattggccgtttgtgaacccagtacctctgctcgcgggtttcggggaacacgcccgcctgggccttccagaagccccggggccgtcgccgactcccaggaccgggcgcgcatgccccggcgggagcagtcgcgcagcgggtcggcccaggactcgccggattctcggtagccgtccttgagggcgacgagcagctcggagccatcggcgcggactccgatgagtaccaggacgcaagcctcaggttcagtccttgcgcccggtcacggcgacagtgacaccgagaccgatcatggtcagcccgccgacaccgccgatcagggagagccgctgcggtgagcgggcgaaccagtcccgcgcggtggaggcggccagcccccacactgtgtcagaggcaacggcgatgatgttgaagaccagaccgagcaccagcatctgacccgcgacatgctcctgcccacggtccacgaactgcggtagcacggcggcgaagaacacgatggtcttcggattggtcacaccgaccgcgaacccctccccgaacgtccgcagaccgctctgcgcagcccccgcccctgtcaccgaggcctgcagcgaaccacgttccctccacgccttgaccccgaggaacaccagataagcggctcccgccagcttcagcacggtgaagacgagaatcgaacgttccacgaccgccccgatcccgaacgccacggccacgatgagcacataggcgccgacggtgttccccaggaccgtggtcagcgcagcccggcgaccttgcgccaacgcccgcccgatcacgaacagcacactgggccccgggaccacgatcaacaggaacgacatcgctgcgaaggcgagcaaacggtcggcagacaccatgaagctcatgcaagcacgaggaaggctcccgattccagcctgagtgcggccatttcacgttcctgcggccacgcgtgcttgtccacccgtccgccgtcgacgactgacccctgcccctgcgggaccggtgcctgcatcgcgtgcagaaccggacacgtcgacggcggacgggtgga

SEQ ID NO: 361 - DNA, 2964 bp, Unknown
  Kingdom: Bacteria, Phylum: Actinobacteria, Class: Actinobacteria, Order: Streptomycetales, Family: Streptomycetaceae, Genus: Streptomyces
gtcgagctggacgaggcggccggccggatcaccgtcgacaagctcggcgacggccgtacggccacggcggacggcggcctgctgctcataccgacgagcctcggctggccgcatctgatggtcctgcaccgccacggctggcagccggtcctgcactacccggtcggctcccccgagctgtccgccccgccctcggtggagcagctcacccggcggatgtccgcgctgtcccacccggtgcggatgaggctgtgccgcagcctggcccgcagcgcgttcaccaccagcgagctgacacaggcgcacggcatgaccgcaccggagatatcccggcacctgagcgtgctgaagaaggcgggcctggtcaccacccggcgccgcgggcggtacgtctaccaccagctggacgtggcgatggtggcccggctgggcagcgacttcctggagggcatcctcaggtaggcccgcccgggcagctgccgggggaccgggtgctcagtcgaaccgcacgtgccggatgccgactcccgcctggcggagccgggtgcgcagcggacccgcggtgtggggccgcagagtcaggccggaaaggacggcgatccggtccgcggtcttgggcacgctggtgcggtccgtccacaggtgctcggcgaactccggctcccgcagccgctccaggcagtggtcgagccgctggacggcccagctctccccgcgcgggccggtgttcttcccggcgacgtacggcagcagatggccgaggcggcgctcccgcagccgtttcaggacggtctcgcgctccgcgagaagcgtgaagtgccgtacgtcatggccgagttcgcgcagccgtccgacggtctcggcgaagcagaccgggtcggtgacggtcatgggggcgatcaccacgccgtcgtgcccggtcagggccaggtcgagcacttcgaccacgccctgccgccaggacaccaggtcctggaagtccccccgctgtgcgggcggcagcatgcgccgcaggccgaagcccacgtgctcgggatcgcagatgacgctgcccgccaggcggcgctggatctcgtgtgcggtctgtgtcttgccgcccccgaagggcccgttgatccacaggagcatgcgcagaccctaccggcgcccggccccggcccgagagcccgtggacgcgggttgctcagccgtggccgccggcccggaccagacccgtctcgtaggccaggaccaccacctgcacgcggtcgcgcagccccagcttggtgaggatgcggccgacgtgggtcttcacggtcgcctcggacagcaccagccgggcggcgatctcgccgttggacaggccctgtgcgaccaggatcatcacctcgcgttcgcgctcggtgagccgctgcagctccttgtgctggggttcctgcccgccggcgggcagcatcggcgcgaaccggtcgagcaggcggcgcgtggtggagggcgccaccacggcgtcgccgctgtgcacggcgcggatcgcggcgagcaggtcgccgggcggcacgtccttgagcatgaacccggaggcacccgccttcagcccggagaaggcgtactcgtcgaggtcgaaggtggtcaggatcagcaccttgggcgggttgggctccgagcagatgcgacgggtggtctccacaccgtccagcttcggcatgcgcacgtccatcagcaccacgtcgaccgcggtggcccgcagcacctggagggcctcgacgccgtcgcccgcctcggcgacgacctccatgtccggctgggcggcgagcaccatccggaatccggtgcgcagcagcacctggtcgtcgacgagcatcacgcggatcgtcatggggtcctcttccgtttccgtcggtcgggcagcgggcgggcgggcggcggcgggtgcggctcgccgcccagggtgcggcgggcgcggggcgtacgccggtgtcagtgcgccggcttgagcggcagcagcgcgctgatgcggaagcctcccccggggcgcggccccgcgtccagcgtgccgccgaccataccgacgcgctcccgcatcccgatcaggccgtgcccctgtccgtcggcgccgccctcctcgtacagctcgtgcggggcgcccttgccgtcgtcctcgacgagcagcccgaggccgtcgtcgaagtacaccaggcgcacgctcgcacccgcgtccgggccgccgtgcttgcgggtgttggtgagcgcctcctgcacgatgcggtacgcggtcagctcgacgccgctgggcagcgggcgcggcgttccctcgacccggaagtcgacgggcaggccggagccccggcactgctcgaccaggtcctcgatctgctcggcgcccggctgcggcacgtactcgccgctctcctggtgctcgccggtgcgcagcacgcccagcaggcggcgcatctcggcgagggcctggcggccggtggaggaaatggtctccagggccttcttggcctggtcgggcgcggcgtccaggacgtaggcggcgccgtcggcctgcaccaccatcaccgacacgttgtgcgcgaccacgtcgtgcagctcgcgcgcgatccgggcgcgctcggcggcgaccgcgaccttggcctgcgcctcgcgctccttctccaggcgggcggcccgctcctccagctgcgcgaagtaggcgcgccgggtgcgcatggagtcgccgaggacccaggccagggcgaacggcacggtggtgaagacggcgatcgcgacgttgcccacgacgctggagttcccctcgggccagcggatctgcgcgagcgtcgccgcgcacatcccgccggccagggcgaaccgggaggcccagcgggcgccgatcgcggcgacggtgtagatgatcaccagcatggcgaagtcggcgaccgtcgtctcgatgtccagcaccagctgcgccgcgccggtcgccgccgccagcagcaccatcgc

SEQ ID NO: 362 - DNA, 10902 bp, Unknown
  Kingdom: Bacteria, Phylum: Actinobacteria, Class: Actinobacteria, Order: Streptomycetales, Family: Streptomycetaceae, Genus: Streptomyces
gggagggggcagacgctgcggacgtaccggaccgaggagcctgcgcccctcccgccgggtacgcagcaccggttgcttcccggagggggaacgagcacggcgcggggaaggagcacagttccgggaaggagcaccggcgctaccgcagaggatcgtggccccagttcatcagtgagtggcgccagcgtgttccgcgtacgtcaccggacggccgctgcgcgaggtggcggcggatgtaaccgaccaccttgcgcatgtgctcgtagtccggctccgacagatccgccttcttcttgcgcaggatggccacgatgcggcgccccgaggcatggcccgtcgactcgccgccgtccgtgtgctgaccggccgcccgggactcctcggtcgccagccactcctgcaacgcagacggtggcatgttgaccaggtcccggaacgcgtcccacgtctcgcgtcggtcttcgaccggcaccgcggactacttcttcctcttcagggccgacggcttgtggacggccgaccgtccgctcttgtcactgcggacctggtactggggctcttccggcgaagcatccacggtgcggccggccgcctcggtccgctcggtgatcttcttctccacctggcccggggtctcgctgccgtggctccgccaggcgacttcgtcacccttggcggggcccttccccctggacgaactgtgcttggccgtcatcgcggccggtcggccatctccggcatgcacaaccaggaatccatgggcaaccacttcgcgacgttcatgcgcgacatgcggatcatggacaaggatgcgtactggctggacacgcggatgaatgacggcggtacctgcacatacggcatcggcggcggtcagccggtgatctgcaagctggccgcggagtaacaccaccgggcctcaacagcgttggcccccactctgcgatcagggtgggggccggcctcatgtacgcggcagacggtcaggccggagcgatgaggacggcgggaaggtcaccggccctcacggcgccctggtcgatggccacgcccgtgtaggcgcccacggcggtgaacaccagctcgggcaggcgctcgctattctcctcgaagtacgcgacgacttcggcctcactggcttccggcatcgacggaaacaccgctcccgcggcgccgagggcggcatcgagagccgagccttgcccggtgtcggtgccgaagccagcccggtaggcgcagacatcgggcgcatggatgatcagggccggggggctgaaacggttggcggtcaggcagaggacctcttccccctcgcagggaagcatcgactcggccttgccttggtagccggtcgcccaggtcgccatgccccagtcctccagcacgtacgtccactcaccgcacgtgccgtacatggcgcggttgaagtgggtggagggctggcccggctgcccggccggtgcgcgcagctccctgcacggagtacgcgcggctagctcgtcgaggtcggcgcccagattgatgaggaactcgtccgtctccaggcctcgggccagagtcagcgagatgccaccgagcatgccgggcacggccgatgaaggagtgtggtgatgtgtgcctatccacgcgatgccgtcactcatgccggtcagactatcggccggtactggcggcggtcttgatgctgacaacgggcccgctccgtatcctgcgtaggccgtcacagccagcaggaacgtgcaggaggtagtcgaagcctccgctccactcgctcgggcctcaacggggcacgggacgggatcaggtacggcatcacgccccatgatccctcacgctggctcaacttccgtgaagcgacacggtgagtgaccactgacgtcgagataggccgtctggaagagcgagcgttcagtcccaccagtcgttgccggtgcgccaccgtcgcacccactcttcaaagccccatgtctggtcgccgggcgccggaatggccccgacgtcggcgaccatccacacctctccgcggcggtggccagtggtgagcaagagccagaacgactgcccgtcctcggacccgagaacgacggatcccttgttgaacacggcatcgatccgcgggtcctcggggtcgacatcttcgtcgtcctcccagccccaggcggcctccaggggaaacggttcgcccggctgtctcgggccgaggtcgggccacgcgccgggcagccggccgagcggctgaagaccgccgtcacgggcagggccaaggctggagccgttgctgatctccgcgatgaaggtcctgtacggctcgggaaggacgacctggttctcccgttcccactccgcgacggcctcatgtccgagcgcggactcgcgccattccagcgggaatgcagaccgcaggaagtcgacagtggcttcggaggggcgctgatcacattggttcgtcacgacagcatgctgtcagaacgagctgagcccctcgcggccgcctcacccgacagcaggtgtctcccgaagcggcgaacatctgctgttcgttctcagggtctggctcacttctgtggtgccgacggtcgcaccgggagcggaacgttgccgtgcccgtactcccgcaggtcaggcaggtggagcggcttcttggagacggtgctcctccttcacatcacagaagttgagccagaacccgagggacggcagcgtttccaggggagtttgggaagcaccggggtgctggccggggtccgaatgttcctgagtgagtttcggcagcgggcggagtccgtaacctttgggttgcagaccgtgcctgttcgaccgcgaggaacatcggtctcggggttgcagttgccgttgcggcagctcctaccgtcctggacagggccggagagactggcccggcgacacatgtgcgagggagacggtgatggactggccgatcgcggaggtcgcgcggatgtccggcgtgactgcccgaacactgcggcactacgacgagatcggcctgctcccgcctgcccggatcggggccaacggccacctgtccgccccgctcaagggcaccgcccgctgcgtccagaaccgcgcccgcctcgtccaggccctctacacccggctggaccgcctcaccgaacccgccccggccgccacgtagcccgacggcccggtgggtcggacgcccttgagaacgctgcgtccgcgcccggagacccaaagcagctacgcctcgtcttcttcttcgtcggggcgatcgaggtcctggttcaacctggtcgatgagacgtccggccgaagacatcgagggagccgggactggccaaatgcagcccgggccgacgcagcgcctcacggcgaaggcgctccggaaaccgcctggtgagctcgccgcgcagacgcgcgctcaacccgcacaacggctgcacggctgcggccgacatcgccaaggaggtcctcgccaccggccgcagtgtggccgaactggtactggagaagggtctgcagccggccggctgatctgctgcgtccggagatcgtcgcgggcagcggcgcaccggccgcctgacctgcggtgacgccacctcgacaaggctcgggaaccggccgggaggcacaatggtgatcatgacaacgacgtcgtccgccgcttttctgccggtcctggagcgcatagccgaggagatcgaccacacgccggggcgcggccgttccgccgactacatcccggcccttgccgcccgcgacgcgcgcagcttcggcatggccgtcgccgagccggacggcacggtgtacggggtgggggactggcgggagccgttctccgcccagtcgatcaccaaggtcttcacccttgccctggacctggccagggaaggcgacgaactctgggaacacgtgggccgcgagccctccggcagcccgttcaactcgctggtccagctggagtacgagaacggcatcccgcgcaacccgttcatcaacgcgggggcccttgtcgtcaccgaccggctgcagacccgcaccggggacgcggccggcgaactgctggacttcctgcgcgccgagagcggcaactccgccctggacttcgacacggaggtggccgcctccgaggccgcgcacggcgaccgcaacgccgccctcgcgcacttcatggcgtcctacggcaacatcgacaacgacataccggtcctgctcgaccagtacttccggcagtgctccatcgccgcctcctgcgccgacctggccctcgccaccggtttcctcacccggcacggcatccgcgccgacggcagccggctgctcagccgcagccaggccaagcaggtcaacgccatcatgctcacctgtggcacctatgacgcggccggcaacttcgcctaccgggtgggcctgcccggcaagagcggggtcggcggcggcatcatcgccgtcgtacccggccggtgcacgctgtgcgtgtggagcccgggcctggatgaacgcggcaactcggtcgccggggtagcggccctggaccgcttcaccacactcaccggcctgtcgatcttctgaaccggggaacgcatccggcaccccgcggacccatacgtcaccgaccgccccgtcccccagcagcaccgggagcgggaccgggtgcagcagcatgggaccaggcgatacggcggcagcgggacccgcggcgccagcagggcgcgacggaggcaggacggcatgaccggccggcggcggcgcgggccggacacggcgggccctggggcggctgcggggcgggacggcaggcgcggcccgagcgggccaggcggaggggacggccaggcgggccgggacggcgcgaggcgtgccgcgctgaatgcctcctgcagaaggccagggagccgcgcggcgagggcgcggccgaggtgcacgagacgcccgccccaagaagaggaccgcggcgaagaagcagcccgccaagaagacagcgaagacggcgaagaaggcgacgggccggcggctgcggagtgccgagctgtcggtgaagccgagctcgctgtccggtcggcagtgcacgcctccacgcccttgacgaggagaccggcgagacgttgacgacctggccggaggaggcctgggcctgtcgtttggatcatcccggcggcacgtgtgctgcgccatggaagtttcgctgaccggtcggcagccgcccggggcactcatcagccacccggtatcagcttgaccccgttcgggagtgccgctcactggccggggctgcttcctgggacctggtcgccgccaagctggcgaggaccttgagccggtcctcgtcgggagtgcccggctcggctgtgtagatggtcagcgagtgcacctcacgcagggaaacgggcaggtcaagcggctggtagacgagtttcagaggcccggcgtcggggtgctgcagctgtttgaccccgctgtgatggacgcgcacgtcgtgggcggcccaacgggtacggaactccgcgctcatcgtgcacagttcgccgatcaattcccgcagcgccttgtcgtacgggtatcggccggcctcggcgcgcagcatggcgaccgttgtggtcagggcgccctcccagtcggcgacgaagtcgggtgctccggggtcgaggaaccagtaccgggcgaagttggggcggcctcgatcgtccgtggtcctgctgtcgtacagcggcgagaacagggcgcgggccagcgcgttgccggcgacgatgtcgaggcggccgttggtgacgtaggccgccgacagggtcatggagtcgagcagccactggacgcggggcggcaggtcggcggccttgtggcggcgcggggtgcggctgggtggctgggcggcttgggccagaccgaacaggtaggtgcgttcgtcgtcgtccagctgcagcgcgcgggcgaccgcgtcgaggacgtcttcggacacgcctccgatgtggcctttctccagccgcgtgtaccactcggtgctgaccccggcgaggacggcgacctcctcacgccgcagccccggaacccggcgccggccgctggtcggcagcccgacctgctcgggggtgaccttggcccgccgggtggcgaggaagtcacggatgtcggcgcggttgtccgggaggcgttccatgccttccacgctacggccctggcctccgcgcaggggggttgagcttgtacccccataaacacagcctcccgcgcccgaggaagaagcggtttcgtgggatgcgcccaccgccgaactcgatccgctgcggagatgaagcatgaggacgcgaggagacaccctccacgcccccgacaccgttcagggcactggtccagggcagccgcctgcgcggcttccgctcgtcgtccacgtcctggccttgggcaccttcttgatgggcacgacggagttcgtggtggcgggcctgctgccggagatcgctggtgatgtgcaggtcagcgtggcgcaagccggtctgctgatcactgtcttcgcagtcgggatgatcatcggtgcgccgctgatggcgatgctgaccctgcgcctgccccgcaggctgacgctgatcctggcgctggggatcttcgcggccgggcacatcgtcgtcgccatcggctccagcttcgcgctgctcctggccgcccggttcctgaccgcgctggcgaccggcgcgttctgggcggtggccaacgtggtggccgcccgcgccgcgggtccggccgcaagctcgcgggccctgggcatcgtcggagccggtgcgatgctcgccaacgtcgtcggtgtgcccgcgggtgcgttcgccgggcaggtcatggggtggcgcggcccgttctgggcgctcgccgcgctcggggcggccgccatggtgctcatcgcccgccacgtcccgcacgacggcctcggccaggcagcggtgtcgatccgctccgagctgtccgccctgcgctcgggtcggctgtggctggtcctcgccgcctgcatgaccaccaacggcggcgtgatgtcgacctacacgtacatctcgccgctgctgaccgaccacgccggtcttgcgtccggcctcgtaccgctggtcctggtcggcttcggcatcggtgccctggcgggattcctcgtgggcggacgcctgggagaccaccacccgtacgcgacgaccatcaccgtggcggccatgaccacggtgttgctcctggcgctgtggctgctgccctcgtccgccgcggtcacgatcgtgctggtcgcccttctcggcctgttcgggctcagcgccaacccggtgctgatctccctgggcgtccgcttcgcgggcacggcccccaccctggcgtcggctctgaccgtctcggcgttcaacctcggcacggccggcggctcctggttcgcgggccatgccctggactcctccctgggagccaccggacccgccaccgtcggtaccgccatcgccgcgctcaccctggtccccacgatcagcatcgcactcatccagcgccgccgggcgggggcggcacacacccaagtgtctgccgaagcatcgacgccgggctcgaccgcttgagtagccgttttcagcgggctcggcggggtccgggcccttgaacgaacccagtcgaggcactcgtgcctccctggaacacaaaccggcgcctcgggcgcccagcacaacagagcaaggagacccaccatgcgtggagtagtgatgtacaccgccggcgacgtccgggtcgaggagcgcgaggacccgaagatcgtcgagcccaccgacgcgatcgtgaagctgaccgcgacctgcatctgcggctccgacctgtggccgtaccgcggcatcgagcccgccgaccaccaggtcatgggccacgagtacgtcggcgtcgtcgaggaagtcggctccgaggtgaagaacgtcaagcccggggacttcgtcatcggctcgttcgtcatctccgacaacacctgcgaaatctgccaggccggcttccagtccaagtgcgtgcacgccgagttcgtcgcccagaccatcggcacccaggccgagaaagcccgtatcccgcatgccgacggcaccctggtcgccacccccggacagcccgacccggagctgatccccgccctgctggccgcctccgacgtgctcggcaccggctggtacgccgccgtcgcggccgaggccggccccggcaagaccgtcgcggtcgtcggcgacggcgcggtcggcctcatggccgtcctcgccgccaagcagctcggcgcggaacgcgtcattgccatgtcccgtcaccccgagcggcagaagctcgcccgctactacggcgccacggacatcgtcgaggaacgcggcgacgaaggcgtcgcgaagatcaaggaactcacgaacgggctcggcgcccactcggtcgtcgaggcggtcggcacgcaggagtcgttcatgcaggccgtcggtgccacccgcggcggcggacacctgggctacgtgggcgtgaactacgacgtccagatccccggcatcgagctgttcttcgccggcatccacaccctcggcggcccggccccggtacgccggttcctgcccgacctcatccagctcatctggaaccgcaagatcgaccccggcaaggtcttcgacctcaccctgcccttggaggaggccgccgaaggctacaaggcgatggacgaacgccgcgccaccaaggtgctcctcaccctctgaccctccaccccgtcccgcgcgcccgaggcggggcgggcccggagactcgcgcctgtgcatggtgcgcgagccccggcacgacgcacacatgtggcctcagccgacggtgcgcggcccgcaccgccctcggtgaccacgattccgtcccgccgtgctcccacgcgcggctggtccgtccacgatgcgaaggcgaacgacatcccttggcatcaggcggaacgggccatcgagccagtgtggacaatttcggtctatcggccggatcggaggcaaaaggcccggccagccgtgtccgaccagtttcaggttctggtgctgtcgccgggcgcccgggctgtgctttccggcgccggtgccgcaatggtcgagggtgtgggctcagctggcggcggtgatggtgaccttgaagttgccgctgtgctgggcgaagccgtcgatgttgtcggtgaactcgccgagcttgaccaggccctcggagtgggggaagtccttgtagaagatggccaggttgccccaaggggcgtaaagggtgaggtcgccggccttggcggctgtcccagagggggagcctgcggtggacagcttcttgggcaggtcgctgatcttttccgtgccggcgtagtcgttgagggtgagggtcagcggcagcagggcggcgaagtcacgagcggcggcgctgtcattcaaggtggcgtggtagccgcggttgccggtggtgatcttgatgtccatggtggtcgtgctctctggtgctgatgcggtggtggactgtctggtctgggtagtcgtggtgggcgcgcccgtccgatggccggtgtcgctggtgcagctcgcggcggtgaggatcgtggccgccgcggctgccggcaggacggtgcggcgcgggcggaagggggcgtgcggcatcaggtgtccatcggcgaggcgtagtggcggaagtcgccgcgctgctggtggatcgtccacaggatgtccgcgaggatggcggggtcggtgtgctcgtctccgggggcggtggcgccggggatgatcagctgggcgacgtggatgccgtcggcggcgaggctggcgtggagcatgcgggcgtaggcgctctcggcggcgaacgcgatggaggtaccggcccgttcggggtgcgggcgcaccgcgctgccgccattgacgaagaggatggttccgcggccggcctgccgcatgtccggcaggacctgctcgacggccgtcatcgggccgaacagtgagaaggccagggggccttgcaggtcctcggggcgcgtgtgctggacgggcttcatgaaatccttgtgcgggacagggctgtactgaaggacttcgatgggcccgagagcgctggtggctgcgtccagggcagcgctcagggctttcaggtcgcgtacgtcggcggcgaagccctgcgcggtgatgttgtcctgctgcaggtcggcggcgagcgcgtcgaggtgttctgtgctgcgggagatgagcgcgatgtcgaagccttcgcggccgaagcggcgggcgacggcagcgcccaggcccggtccggcaccgatgagagcgaacgtggtcatgaaaggcgtctccggtttcgggagggggcgggtgtgaggtcaggtctgcggggtcaggcgcagagtggtggcacgggcctgctcggcgatcatgggttcgacatagccggtgtaacggccgtacttggtgcggtaggcgccgtccacgcggtcattgacggcagggtcggtgaccggggtgaaggagacatcggcatcgatcccgccggcgctgatgtgtccggtgccggtggagcgggccgttttccaccaggcgccgtcggtgccgcgccaggagcggacgaacacttcctcgccgtcggtgacggcccagatggtggtgggcttgcgcagcgagccgtcgctggcgcggggagcaatgtgcagttcgtcggcggtggcgaggtgctcaagcgcttgggggttccacggggtcatcggctggtctccttcactgtgcagggctgggcagggtgcggcagggatcctttcgccgctgcggtggggacggcgggagccggggcggggccggctgggtgatccgcggcaggtagcaggaagcgggcggccaggcccgcggcgccgacgatggcggcggccagcagcaggctggtgcgcacgccggtcagcatgtgggtttggccggccag

SEQ ID NO: 363 - DNA, 5785 bp, Unknown
  Kingdom: Bacteria, Phylum: Actinobacteria, Class: Actinobacteria, Order: Streptomycetales, Family: Streptomycetaceae, Genus: Streptomyces
ccctccccaccgcgcacccggaaggcgaccccacctcatgaccggccagaccaccgccgacgaccagctcacctggctcctggagggcctgttggagcggaccccgggcgcgcggcacgcgctcgtgctgtcccgcgacggactgaagctgtgccgcaccccggagctgacggtcgaccaggccgaccagctcgccgcgatcgccgccggcatccagtcgctctcccacggcgcgtccgccgagttcggcgacggcagcggcggggtgcgctcggcgatgaccgagttctacggcggtgtgctgttcatcgtggaggccggtgagggcgctcatctcgcggtcgtcaccaccgaggacgccgacgccgggctcgtcgggcacaacatgagtgagctggtggagcagctcggcgagtacctgaccgcgcagccccgtacatcatgagcaggcccggcagggacgacgccccggaccgtctctacaccatcaccggcgggcgcaccagctccggccccgacaacccgttcgacctggtcaccctggtcgtcgcggagtcgcagccggcgccgggcatgcagtcggagcacgcgacgatcctgcggctggccgagttccccaccgccgtggtggagatcgccgccgagctgcggctgcccgtgagcatcaccaaggtgctgctgtgcgacctgctggcggcgggccgcgtcagcgcccgccatccgcgcaaggccgccgtctacgaccccgacatcctggagcaggtgctcgttggactccgtaacctctgacgcccgcaccccgttgggtgcctccgccgacaacggtctgaagatcgtcgtggtgggcggtttcggcgtcggcaagaccactctggtccgctcggtcagcgagatacgtcccctcaacaccgaggagaccatgacgcaggcgggcgaggcgatcgacgacgtcagcggtgtgcgcggcaagaccgccacgaccgtcgccttcgacttcggccgtatctcgctggacacgcacaacgtgctgtacctgttcggtgcccccggtcaggagcggttctggttcctgtgggaccggctgttctccgggacgctgggtgcggtggtgctcgtcgacacccgccggatcggcgactcctggtacgccatcgaccggctggagcaccacggcacgccgttcatcgtggcctgcaacgacttcggcgggcccgcgcacacgcacgccgagatccgcgacgcgctcgacctggacccgcaggtcccgctggtggactgcgacgcccgctcccgggagtccagcaagcaggtgctcatcaccctcgtgcagcacctcaaggaccactacgccgctcaggccgccgacccggccctgccccgacaggagttcgtgtgacgacccccgacgccgtcccgctcgacgccgtcccgctcagcggcccccggttccagaccgaacccgccgtcctgtaccgggagatgcggcgcgaccacggcgccgtgacaccggtggtgctcgacggggacgtaccggcctggctggtgctgggctaccgcgagctgcaccaggtgaccggtgacccggtgctgttcagccgggactccgagctgtggaaccagtgggagaacatccccggcgactggccgctgctgccgatgatcggccacaagcagccgtcgatcctctacacggtcggtgaacgccaccgcgagcgcgccgcgatgatcagcaacgccctcgaggcggtcgagccgtccgaactgcggcgccactgcgagcggttcgccgacgagctgatcgacgccgtgtgcgccgacggcgccgccgacctgatcgccgactacgcgatgctgctgccggtgcgggtcctcgcccgcctgtacggattccccgacgaggagggcccggcgctggtcaccgcgctcaacgacatgatcgacgggcgggagcgggcgatcgcgggccagacgcatctggccctttccatggcgcagttgctggccgaccgccgggagcggccggcggacgccgtggcctcgcggatgctggccgacaccggcgggttcagcgaggaggaggtcgcgcaggacctgatggtgatgatggcggccggtcaccagccgaccgccgactggatcggcaactcgctgcgtctgatgctgaccgacgagcgcttcgccgcctccctgttcggcgggcgcaacagcgtcgccgaggccatgaacgaggtgctgtgggaggacacgcccacgcagaacgtggccgggcgctgggccagccgcgacacccagctcggcggacgccgcatccgcgccggcgacctgctgctcctcggtctgcagggcgccaactccgatccccaggtacgcacccacggttcggcgctgaccggcggcaacaacgcccacttctccttcggccacggcgagcaccgctgcccgttccccgcgcaggaggtcgccgaggtgatcgcgcggacgggcatcgaggtggtcctcgaccggctgccggacatcgacctgacggtgcccgccgcgtccctcacccgtcgtccctcgccctggctgcgggggctgaccgagttgcccgtgcgcttcactccgacccctgccctgggaggcacgtcacgatgacgaccggcatcgcagaaacgaccggcgacgacagcacgcgcatcgctctcgatcccttcgtcaccgacctggacggcgagagcgcccggctgcgcgccgcgggtccgctggccgccgtcgagctgcccggcggcgtcccggtgtgggccgtcacccgccacgccgaggccagggccctgctcaccgatccgcggctggtcaaggacatcgaggtgtggggtgcctggcggcgcggcgagatccccgccgactggccgctgatcggcctggccaacccgggccgttcgatgctcacggtggatggcgccgagcaccgccgcctgcgcacgctggtcgcccaggcgctcaccccgcgccgggtggagcggatgcgcgagcgcatcgagaagctcacccaggatctgctcgacgaactgcccgcggacggcgggaccgtggacctcaaggcggcgttcgcctacccgctgccgatgtacgtcgtcgcggacctgatgggtatcgagacgtccctgttgccccgcctgaaggtgctgttcgagaagttcttctccacccagaccctgcccgacgaggtcgtcgccacgctgaccgagctggcgcggctcatgggcgacacggtggccgccaagcgtgcggcgcccggcgacgacctgaccagtgccctgatcctggcctccgaggacggcgaccacctcaccgacgaggagatcgtctccacgctccagctgatggtcgcggccggtcacgagacgaccatctcgctcatcgtcaacgcggtggtcaacctctccacacaccccgagcagcgcgcgctcgtgctgtccggacaggccgactggtcggcggtgatcgaggagacgctgcgctactcgacgcccacctcccacgtcctgatccgcttcgcgaccgaggacgtgccggtcggcgacaaggtgatcccggccggggacgcgctgatcgtgtcgtacggcgcgataggccgcgacgagcaggcgcacggcccgagcgcggacggcttcgacatcacccgcgagtcgaggacgcgccacatctccttcggtcacggcccgcacgtctgcccgggcgcggcgctctcccgtctggaggccggggtggcgctgcccgcgctctacgcccgcttcccgcgcctggacctcgcggtgccggcgtccgagctgcgcaacaagcccgtggtgacccagaacgacctgttcgagctgccggtccggctggactcgtagggtggggggcgtcccgccggtcccggcgggacgcccgtcaccgcaccacccggagaaacacccgatgacccacgtcgcggaccccgagcgctacaacggcacgatgcgttaccggcgcaccggacgctcgggactcgacctgcccgtcctgtccctcggctactggcacaacttcggcgacgaccggccgttcgagacgcagcgcgagatcgccctgcgcgccttcgacctcggcatcacccaccacgacctggcgaacaactacggcccgccctacggctcggccgagaccaacttcggccgcctgctgcgccatgacctcgccccgtaccgcgacgagctggtggtctccaccaaggccggctgggacatgtggccgggcccctacgggcagggcggcggctcccgcaagtacctgctcgcctcgctcgaccagtccctgaagcggacgggcctcgagtacgtcgacatcttctactcccaccggctggacgcgagcacgccgctggaggagacgatgggcgccctggacaccgccgtccgccagggcaaggccctgtacgtgggcatctcctcctacgacgccgagcgcacccggcaggccgccgcgatcctgcgcgagctgggcaccccgctgctcatccaccagccctcgtacagcatggtgaaccgctggatcgagacggagggcctgctggacgccgccgaggaggagggcttcggcgtcatcggcttcaccgccctggcccaggggctgctcaccggccgctacctgaacggcgtccccgaggactcgcgggccgcgcagggcacgtccttcgacgctgcgtggctgtccgaggacatgctgcgccggctgcgcgccctgaacgacatcgcggcgcgccgcggccagaccctcgcgcagatggcactcgcctgggcgctgcgcgacgagcgcgtcacctcgctggtcatcggcgcctcgcgggtcgagcagctggagcagaacgtggccgcgctggagaacatggacttcagcgccggggaactggcggagatcgacgagtacgccaccgacggcggcgtcgacctgtggcgcgaggcccgcaccggcacgctctcctgagcgacggaccgcggaccatgcggcaggcccccgccctgtacgggacgggggcctgcgcaccagagcgttgggcaggccttgcacctgcatctccccgcgggaagcggggtgtctttccttggaccaccaacgcacgcccggacgccgggagttgcggattccggcggcctgctctgcctcaacggtagccaaggtccgtgagccgcgccgcacgggacgcgcccggcttcacccggacgcgcggacacccctggtcagcaccctgtccccggctccggccggggccgcgcaccgtccagggcgagggcgaccagccggcccacgtacgccgcgtccagcggggcgccgctgagcagcacacgcgtgaacagcggcccgctgaccgcctcgacgagcaggcccggatcggtcccggcggccagctccccccgttcgacaccgcgccggaccatcacggcggcgcgctccaggcgttcgctccagtaggggccgcggtggtcgtcgagggtgtcgtcgtgctcgacgctcagccgcagcagggcctgcccctgcgcggtgcccagcagcccggccagcgcggtgaagaagccctccaggtccgcgcgtacgccgccggtgtcggggatcggcagcgcggcgtccagttccgtggtgagggcgtcgaggatcaggttctcccgggtcttccagcgccggtagaccgacgtctcgtgcaccccggccgcgcgggccacggccgcgacggtcgcgcccgtgaggccctggcgggacaggaggtccaccgcggcggcgagcacggcct

SEQ ID NO: 364 - DNA, 3751 bp, Unknown
  Kingdom: Bacteria, Phylum: Actinobacteria, Class: Actinobacteria, Order: Streptomycetales, Family: Streptomycetaceae, Genus: Streptomyces
cgtccggggagcaccagccggccgcgtggcaggcggggcgcggcgcagcggtcgaggagtgagtccgcgcggggtgcggctcagccctccggtacgcgccgatccgggtgcggctcagccctccagcacgcgccgtgccgcgacgagcagtccctccagggcgagttcgaaggcctggtccgtgcggctgccgcggaccgcgtccagtgcctcggccaggcggggggtggccgaggcgtcggcgatctcccacatggcctccggcgcggcgaggtccagggccgatccgaggacgacgttctccagggcgatgatgacccgcatgacgtcggccgtcgcgaagcccgcttcgagcagcagggcgacggcccgctcgtactgggccaggacccgcggggcgcgcaccgggttggccatgagcagggggatggcccgcgggtgtgcggcgaaggcggcgcggtaggagcgggcccagcccgccagggcggcgtcccagggccggacgtccaggggcgcggtgtcgatggcctcggcgatccgctcgcgcaccagctccacgatcccgtcccggccgtccacatggtggtacaccgaaccggtctgcaccccgagccgccgtgcgatctgagggacgctgaactcgccctgcgcgtcgaggagttcgagtgccgtcgtggtgatgcgctgctggtcgagcagagccgtgcgcgggcgccccatggcgtgcttcccccttcgagggtcttcccatccgttcgaacggaaggttacattgcggaaaccgaaagcctttagatttacggctccggagatcccgcacgcctgccctcctcccgctgtgcccgcacacccgtgggcccccgccgtgtccgcacgtccgtcaccactgcgctgtctcccctcacgcgtcgtccctccgctgtcatccctccgcgcccgtagccagaagggctctgccaccatgcccgtcaccactcccagcaccagtcaccccgggagcgccgcgcccgcggccccgaccctgcgtcccgggtcgctcggcaccaccgacatcgccttcttcgtggtgtccgccgccgcaccgctcacggtcatggccggggtcgctccgctcgccatcctgctcggcgggatcggcgccccggtcggctatctcctcgccgggatcacgctggccgtcttcgccgtcggcttcaccaccatgagccgccacgtccggggcgccggcgccttctacgcgtacatcacgcgcgggctcggccgccgcgtcggcataggcgccgcgctgctggccctgctcgggtacaacggcatggagatcggcgtgtacgggctcctgggcaccgccacgcaggacaccgtccgcgccctgtccggcgcgcacgtgccatggctgcccgtctcactcgtgggtctgctgctcatcggctacggcggctaccggtccatcgacttcggtgcgaaggtcctcggcgtcctgctcaccgccgagacgggcatcctcgtgctgctcgccgcgggtgtgctgctcaagggcggggcgcacgggctctccgcggcctccttcgcgccgggccatgtactggtgccgggcatggcggccgtgctggccttcgcgttcgcggcgttcaccggcttcgagtcgaccgtcatctaccgccgcgaggcccgcgatcccgcgcgcacggtcccgcgcgccacctacctcgccgtcggattcctcggcttgttctacgcgttcgtcgtctggatcgcgatccaggccttcggtgacgccgaggtcgtgaaggcggcgggcggcgacccggccgggctgttcttctccgcgatcacgacgtacgtgggcggctgggccgccgacgccatgcacgtgctcatcgtgacgagcgtcctggcctccctgctcgccttccacaacgccatcaaccgctacggtctggccctcgccgaggaagggatcctcccgaaggcactggcccgcgtccacccgcgccaccgctccccgtacatcaccgggatcgcccagaccgtgctcggcgccgccgtcgtcctcgtcttcgcggccgccggcgcggacccgtaccagcagctgctgctgtgggtcaacacgcccggcatgctcgggctgctggcgctgcaactgctggcggcgctggccgttccgctgtacttccggcgggtcaggcaccatgagggcgtcctgcgcacggtggtcgcgcccgtgaccgccgcggtgctgctggccaccgccatcgtgctggtcgtcacgcacctcgacctgttcaccggcgcgtccacggcggtgaactccgtgctggcggccgtcgttccgctcgtcttcctcgccggcttcccgctcgcccggtggctgcgccgcaaccggcccgccgtctacgaacggttcgccaccgaaccggtcaccgaccccgcgcccgcagcagccccctgagccgccgccccctgttttcaccattcttcccgtgttccactgctcagcccaggagttcccagcatgcccgcagccgacctcgtcctcaccggtgccgaagtccgtaccctcgaccccgaccgtccgcacgccaccgccgtggccgtacgcgacggtctgatcgccgccgtcggcgacgagagcgacgtacggcactggcgcggtccggccaccgacgtcgtggacctggccggggcgcatctcgtgcccggcctggtggactgtcacagccaccccgtgatgggcctggagatgaccaccggcgtggacctgtcggccgtccgcgatctcgacgcgctgcgggcggcgctcaccacggcggaacggatcgacgggtggatcgtcggcttcggactggaccacaacgtgttcggcggccggcccgtggaccgggccctgatcgaggacgtcctggacggggcgcccgccttcctgcgcctgtacgacgcccactcggcgctggccaccaaagccgcgctgaaggcggcgggcatcaccggaccacgcgcgttcacccagcgggcccacctcgccacggactccgccggacggctgaccggtcacctggtcgaacacgccgcgatggagctggtcaccgcggtcatgccgcggccgtcgcgggccgcgcggcgcgcccggctggtcgagctgctgtccgccatggcggccaccggactcaccggcgcccatgtcatggacatcggcgacccggagctcgtcggctccgtggccgaagacaccgtgctccccctgcgcctgcgcttcgccccctggtgcatgcccggcgccgggagggaggacctggaggaactggtcgcgctgcaggggcgcggcggccggcactgggagatcggcggggtgaagttcttcatggacggcaccgtcgagggcggcacggcctggctcgaacaccccgactgccacgggcagggcaccgacgcgttctggccggacccggccgcctacagcgaggccgtgcgcttcctggacggtgccggagtacgcaccgcgacccacacgatcggggacgcggccgtgcggcacgttctcgacaccgtcgcggcgctcggcgagggcgcccgcctcacgcaccgggtggaacacatcgagtccgtcccggacgacatcgtcgcgcgcatcgcccggaccggcgtcatcgcctcgatgcagcccccgcacaccgcctacacccgcggcgaccggtccgacgagtggtcccagcggctgggcgagacacgagcgcggcgggcctggcggctgcgc

SEQ ID NO: 365 - DNA, 563 bp, Unknown
  Kingdom: Bacteria, Phylum: Actinobacteria, Class: Actinobacteria, Order: Streptomycetales, Family: Streptomycetaceae, Genus: Streptomyces
gggcggcgcgggcaccgtcggccggggcgccgcccggggcggtgaggtcgacgtcagggctcatacaggcaccgttaccctgaagtggccgtttcttgtgcgcgggttgtacacggccgtatgcgcacggcacgcacaccgcacctgagccaccccgggaaccacctatgcgtctgctgctcgtccgccacggcgagaccccgtccaacatcgactccctgctggacacggccgtcccgggacccggactgaccgaactcggcacccggcaggccgccgcgctgcccgaggcactcgccgacgaggacatcgacgccctctacgcctccacgctcgtgcgcacccagctcaccgcggccccgctcgccgccgcccgcggactcgacgtgatcgtgcgcgacggtatccgcgaactgtccgccggagacctggagcgggaaccgggcgacaccgaacgcggacagcgctacatgcggacggtcctggcctgggccgacggcgagcgcgacctgcggatgccgggtccgggcggcgagagcggcaccgaggcgctggcccgctac

SEQ ID NO: 366 - DNA, 2985 bp, Unknown
  Kingdom: Bacteria, Phylum: Actinobacteria, Class: Actinobacteria, Order: Streptomycetales, Family: Streptomycetaceae, Genus: Streptomyces
acatccgcatcgacggcggcgacgacatcccgtgctcctgcggcaacaccggctgcctggagaccgtggcgtccggcgccgccgtcgatgcggatgtgggtgatgtcgccggcggctcccgtggcgccccggtagaggcggccgtcggcgatgacaccggcaccgatcgccgagccgatcttcaccgtgatcgactgccggtgcccggcgggcctgacgctgtgctcgccgaccgccatgcagttggcgtcgttgtcgacgacggccgggaccccgaagcgctcctccagccaggcggcgaccgggaagcggttccagccgggcatccgggacggcaggacgacggcgccggcggtcacgtccaccggccccggcagggacagcccgacaccgcggagccggtcgcggccacgctgctcggcgagctgctccaggtgctcggcgagcctcggcagggcggcctcgggaccgtcgccgatctcgaacgggacggtggcgacatcaccgacaccgccgcccgggagcaccgcaccgatccgggcgtggcggccgccgacgtcggcggcgagggcgtactcgtcggtgctgcccgccctgagcaccctgcgcgggcggcctccggtggaggactgggtgccctcctcggcgaggagcccgcgctcgaccagctcggccacggtgagggagatggtggaggcggccgcgccgaggagctgcgcgagttcggcgcgggacgacgcctgcccggaggcgacgagttcgaggacccgcgtggcgagggtcgcgcccttggtgttcttgcggtcccgtgcacttatttcaggcatgtacgaagtaacttccgcggtgttgggtgtgacggagacagtacgcccgtcctgccggacggggaacagctccgcgaagaaagtggagaacgctgatgcacagtgaattcgcctcaaaatggtgcatagacaccgcccgaggcggccaaatcggtccggagggactttcttcgagatcggagtaacttagttgttactaattcttgtttgtttgttcggcgcgtccgtcgttgactgtcgccatgcacagcgccgatcccgcggcgccggcccgggtcctcccgggactttgcgggtcctttcactctgaggagagtcatgttccttgctcacacggcggccggccgccgctgggccctcgtcgcgggtgccgccgtcctcaccggcgcgctggtcaccggctgttccggcggcggtacctcgtcctccggccggtcgtcgtcggacaccgtcaactacgccctccccgcgaacttcacaccgaactggatcctcccggtcggcaccgccgcgcacctgaacacgaacaacgcctccatatcccaggccgtctgggagccgctgatcgcgtacgacggctccaccggcaaggtcggctggaacaaggacaactcgctggccaccgacgcgaagttcgccgcggacagcaagagcgtgacgatcacgctcggcaaccgccactggagcgacggcaagccgatcacctcgcgcgacgtggagttctggttcaacctggtcaagacgaacaaggcggactgggccagctacagcccgggcaaggcaccggacaactggacctcgttcaagacgaccgacgccacacacttcaccctcaccttcgacaaggcctacaaccaggagtggatgctcgccaacgagttgagcatgatccgggtgatgccgcagcacgtctgggacaagaccagcgacgcgggcgccgtctccgacctggaccgcaccgccgccggcgccaagcaggtctggacgtacctcaacaacgcggccaagaagatctccggttacgcgaccgacccgctgtggaagacggtcagcggcccgtacaccatcaagtcgttctccaccgcgggcaaggtcgaactgaccgccaacgcgaagtacgacggcggcggcaaggccaacatcaagaacgtcaacctgctgccgttcaccaccaccgacgccgaggagaacgcgctccgcgccggcaccgtcgactacggctacatcaacgccacggacctcggccaggaggcgtccttcaaggccaggggctactcggtcaagccgtggagcggctgggcgatcacctacatgccgtacaacttcaacaaccccgccatgggcccggtgttcaagcagctctacgcccgccaggccatccagaagtcggtggaccagaccaccctgtccaaggtggtcttcaacggcagcgccgtctccacctacggcccgatcccgcagggccaggagtcgtccttcgtctccgccgagcagaagaacaacccgtaccggttcgacaccgccggcgcgcggaagctgctcaccgaccacgggtggaccgagcagggcggcaccatggtgtgcaccagccccggcaccggctcccaccagtgcggcgcgggcatcgacaagggaaccaagttcgagatgcaggtgctgtcccagtccggttcgaccgtgaccgacaacatgatgagcgcgctgcagtcgtcgttcgcgaagaccggcatcaagttcggcatcaagaccgccccggtcaactccgtgctgtcgcaggccggccagtgcaccgccggcgactcgggctgcaaatggcagctgtccttcttcggcaccgcgggcagctggtacttccccgcctacccgagcggtgactcgctcttcgccaccggcggcggctccaacttcggcagctactccaaccccgaggtcgacaagctgatcaccgcgaccaccacgtcgtcctcgaacgaggcggtgcagaagtacagcgccgcactggccaaggacctgcccgtgatctggctgccggagcccgactaccagatctccgtggtccgggacggcctcggcggcttcgcccaggactccctcgccaacttccacccggccatgtggaagtggaccaagtaggcccggtcggtggcccgcgcgggcc

SEQ ID NO: 367 - DNA, 5820 bp, Unknown
  Kingdom: Bacteria, Phylum: Actinobacteria, Class: Actinobacteria, Order: Streptomycetales, Family: Streptomycetaceae, Genus: Streptomyces
gacggtgctctgccggcggactggtctcggcggtccgccggcagagcaccgtcccagagcagggtccgtgacgggggtggagcaccgttcaggagaccggggcgttctgtccaggagatgacacactgtgttgctcagcgtccgcgggcgcagtggtcttgagcagagcggtgccgatgatcaaggcggccgatgtgaatccggcggcggcgagaaacgccatgtggtagccgccgatcagtgattccgcctcggtctttcctgcgccggtgaggctgtgcgtacgcgcgctgacgatggcactcagtacggccaggccgatcgctcccccgatctgctgagtggtgttgaacaggccggaggcgatgcctgactcggccggcgtgacggcagtcatgccgagccccatgacggccggcgcggccaggccgaagcccaggcccacgacgagaccggcggggaggaagtccaccaggtagacgccgtcggcgcgggcgaacgacagcatgacgaacgccccggcgatgagggcgagtcccaggaggagtaccgcgcgctgcccgaacctggtgatgagccgggtcgagaggccgagggacaccaccgcgatcaccacggcgatgggtacgaaccccaggccggcccgcaacgagtcgtacctcagcacctgttggaggtagagcgtgccgaagaacaacaggccgaacatgccggcgatcatcaggaactggacggcgttggccgcagtcaggctccgcgagcggaagagcttcagcggcagcagcggttcggcggccgtggcctggcggaggacgaacccgatcagcagcaggagcgacagaggaccgagcaggagcgtccgggccgctccccagccgacccgctcagcgtccacgatggtgtacaccaggagcgtcatgcctgcggtgaccagcagggctcccaggaagtcggtgtccttgcccatcccgtcgccgcggtcttccgggagcgcacgcaggccgaccagaacgagggcgacaccgatcggtgcgttgatgaagaagatccagtgccagttgagcagatcagtgaggacgccgccgagcagcggtccgaccgcgccgccgcctgcggaggcgaagctgtaggcggcgatggcctgggcctgctcgcgccgatcggagaacacggtcgcgaccatgccgaggatgcaggcggaggcgaacgccccgccgattccctgaaggaagcggcacgcgatcagcacggtcgcgccggtcgcggcaccgcacagcaccgaggaggcgctgaacagcacgattccggtgaggacaacggtcttccgcccggccaggtcgccgagccgtccggccagcagcaggagcccgccgaacgggatgacgtaggcgttgaccacccagacgaggcttccggaggagaactcgaggtcttgctgcacagcgggcagtgccacgttcacgatgttctgatccaggacgatcatcatctggccgacgcagagcagggtgacgatcagccacggcgacgcactcgcccgcatggtgggcagggacatgcttgaaccttcctgtggggcactatttgttacagcagtcatcttctgtaaccatcaggcgtcagggaaggaggcactttcatgtcacgtagtcacatgaatgtgtccgaggaggtcaccgacgaggcgtgtccgctcgtcgaggtgctcgatcacgtggcgggcaagtggagcatcagcatcctggtcgccgccgcgcgtggccccgtcaggttcaccgaactggaacgctcgatcgacggcatcagccgccggatgctcaccttgaacctgcgcaggcttgaacgcgacggtctgttgacgaggaccgtgcaccccaccgtcccgccgaaggtcgagtacagcctcactcccatggcgcgagagctgtactcctacctcaccggcctcgtggggtgggcggagcggcaccgcggtgccatcgcccaggcccgggccgtctacgactccacggcagcggcagcgacccgggagggacaggcacgccggtaattgactgcggcgcctgttccgtcccggggcgggtcggcggggccgggtcaccgtccgacccagcgagcttgggggcctccggtgcgaacgcctcgtatcggcgaggccgcggtcatgaacggcgccgggagctgcgtggcgacgccggccgcctccggcgcggaagctcccgcctgtggcccatcgctcctcgtgtgggcctggtgtgtgacagccggttcctggggcctctcgttcggtcatgcaggggggtcttgcgccgcaccctgatccgccctggtccgaacgaaagaccctagccgaccaggcgacggcgccagtccagggaggtaacggtgatggcccggccggggtcatggtcccactcggcgtgcagaccgactgcttcaagcgcggccacgacctcgtggccgatggctgccgtggtctcggacgagccgtcgaagccgccgtagaggagcgtcagcccgtggccggctgcggcagagtccgtgcactgggtgtggaagtagacgaagccgcgggcgtcggggccgccttcaccgccgatctcggactggccgcagctacggcagcaggtgaagttctcacgggccgtgataccggcatcctgcagggcggtgaacgcacgggtcagccgctcaggatccgtctccccctgccactcggcctgctccgcgacccgctccagccacaaccggtcggccagcgcccgtgcctgctcgcgtgagacgggccggcggtcaccggtcaccaaatactcctcagccagctcggccagttcggcgcgggaggcgtagccgccgcgcagcacctcacggacgcgtttctccacctcctcccgctcgccctcgccgaggtcgagcggcggcacctcgcgtgcgggccccatgtcgagcagcgaccaagccggaccacggtcccatccggcctcctggcgcgcccagccggtgatagccgcgatcacggcctccggcccgtcgacgaccgactggaaatgccggtcagcggcgccgtcacggtactccagcgtgtagccgccaccggtcttgtgccacacctgggcgaagacgtcaggcaggtcgggtatgcgctggaccaccaggaaccggtcaccgtcaccaccgatccgccggaccagcccggccaactccccggcggacacacggacgtgccgctcccagttctccgtcttcaccacgatctcgagcatgcgccgactctgacacacccccctgactacaggcctcccgggactcccgacgcacctgctgccgcgacggcacgacccgtcccgatgctggacggccgttggccgaagttgacggcagtccgtgcccgccgtgccgctcatccggcgcttcgccggcgcactccggccggcggtgcgcccagcgggcagggcggcgcgggccgccctgcccccactcggcggctgcgtgcgctgtcgtggatctggtgttctcaggatcagagaccgggaaaggcgacctctgctcgtcggatcagcgcagtccggcgaagaggtcgttctcggggagggccgctccggtggtgtcccggacccgtacgaacgtctccatgcccatcaactcgccgaaccgctcccgacccattttgaggaagaagatgttctcgccctgactggcgtgcgcggccagtgcgtcgaacttctgaccgctgaactcggtggtgtccacccacgtggtgatctcctcgtcggggaggcctatctcggccatcgcggcggcttcggcgggatccggctccggcatgtcctcgtggaactcgcgcatgacctcgccgaaccgccgcatcgccgagcggggcatcgtcgtccagtacaccttcggggtcagctcggtcatctccagtgccgccatggtgatgcggtgggcctggatgtggtcggggtgcccgtagaagccgttctcgtcataggtgacgaccacatcgggccggtagtgccgcatgagttccgcgagtcgggcggcgccttcttccacgggcgtctgccagaaggatccgggggcgtcattgctcggccagcccatcatcccggagtcggcgtagtccagcatctccagatcgctgaccttcaggacctgacagctcgcttccagttcctgacggcgcatcagggcgacggtctccggatcgtgtcccggatcgcccggcttgacacctcccggcccgtccccgcaccggccgtcggtacacgtgacgagaaccgtgcgcatgccctccgccgcgtaccgtgcgaggactcctccggttccggtggcctcgtcgtcggggtgggcgtgcactgccatgagcgtcaagggccggtcagtcatcagacagtcctcctgcggacttgcgtgtcggtccgggtgcgcggcggacgtaccgcgatcccaagagggcccggatcccgcgggggcgacgaccttgcgtttttccgcgctctccgtccccgctgtcccggtccctcggtccgtgcaacaccgccggtcgaaccgactgttcccggaacgcggcgaaggcttcgcgaacggggacggcaagcgcggcagacgacgtcagcggcggcatcggcgccatgggcggcatcgcgcctacgccaccgcgcgctccgtcgagggcagcctccgccgcatgggcgtcgaccgcttcggcgtcgtccggggccacgactcgcccaggacttccacacttccacggcgacgcgtgggcccagaagttcgaggaggcccgcaccggagccttccgcgtcctgacccgcctgcgggaggggggagtagtaaggcctggggtatgggcgtcaaaaggaccgagccgatggagatgaccctggcgtcggacgagccccagcccgacggcttcctcctcgccggcggtgccaacttcgggtaccggcaggccccgccggagatcattgagcgcgtcgaccgtctcaaggctcgcaccgaccagcccggcagcccctcgccgtccgccgtcaccccggacacctcgacccttccgtgcgcctcgctgcggcagtcctgcgcaaggcgtccccggcggcgtggaacgggaaggcgggttcgctggatgggaccgctgggaaaccgtcgagcacctcagcgacgacttcttcacctgcgccgtgcaactgggccccatcaccccgccgttggacggggaggtccccttcctgcgggagagccggcgccccggcggtcccgcggacgcgatgcacgcggaccgtgagacgggacctgccggcctgttgcaggtgctggaggccagcggcgccctgctggtcgccatggtgcccacgactcccccgcagactcgcgcccaccacgtcttcggtgtctccgacgccgagggtttcgccgtgatggggatcgtggggacactggcgcacccgcacgatcttgcgcaaggacccgggctcccttggaacccgcccgccggtctctgctcccgagtgctcgcccggctgtttccggatgccccgcgcgctacggatccctgacccaccctgctgtgggccaccggacgcgccgaactgatcgggcgccctcgtccggccacctggcgccgggacggcacaccccgcgcgtaggggcacgcgtcttctgtcttccggtggacgagaggtccatcggggggcagatgctctgaggccctgggacggatggcgggagccgacggccggtcgacgagcgtcatccggcagacccgacgggtgcaggcagcggccgggcggggccgggccggccgctgcctgcacccgt

SEQ ID NO: 368 - DNA, 1142 bp, Unknown
  Kingdom: Bacteria, Phylum: Actinobacteria, Class: Actinobacteria, Order: Streptomycetales, Family: Streptomycetaceae, Genus: Streptomyces
cctgagagcaccccggcccgcccccgcggcctggccggtgcccggacggaaaaccaccgctccgctttgaacgccgcgccccccgcctccgtactccgtgcacgagcgaccgactgggggatccgggatcccccggacaccggaggtgggcgtgcgcaaggatccggccgtggccgacgaacgcggaccgagggcccggcatcgcatgtcaccgcagccctccggacccgacgaggagctgatgcgcgcgctgtaccacgagcacgccggccccttgctcgcctacgttctgcgcctggtggccggagaccggcagcgcgccgaggacgtggtgcaggagacgctcatccgtgcctggaagaacgccggtcagctcgatcgggcgaccggctcggtacgcccctggctggtgacggtcgcccggcgcatcgtcatcgacaaccaccgcagccggcaggcccggccgcaggaggtcgatccgtcgccgctggaggtcatccccgcggaggacgagatcgacaaggcgctgtggctgatgacgctgtcggacgcgctcgacgacctgtccccggcccaccgggaggtcctcgtggagacgtacttcaaagggcgtacggtcaacgaggcggccgagacactcggcatacccagcggcaccgtgcgctcacgggtgttctacgcccttcggtcgatgaagctggctctggaggagcggggggtgacggcgtgatgagcgggtacgggggagatcagggattcggcacgggtggttcgggtatgtcaggccccatgcaggggtcaccggcgccgaacgagcacgagaccgtcggtgcctacgccctcggcatcctcgacgacgcggaggccaccgcgttcgaggcgcacctcgccagttgcgagtggtgcgcgcgtcagctcgacgaactggccggaatggaaccgatgctggcggccctcgccgacctgcccggatccggtacgcccccgatcggcgcgtccctgtcggcccggccgggaccgcgcctggcggacaggctcgtcggcgaggtcaccgagcagcgcgcccgcaagcgccggcggaacttctgcctggcggcggcagcggcggtgctcgtcgtcggcggcccgctgacggtgtacgc

SEQ ID NO: 369 - DNA, 3018 bp, Unknown
  Kingdom: Bacteria, Phylum: Actinobacteria, Class: Actinobacteria, Order: Streptomycetales, Family: Streptomycetaceae, Genus: Streptomyces
  misc_feature (2876)..(2877): n is a, c, g, or t
ctggcggcggcgcggcagttccacgagcgggaagggcacctgcgggtgccgcgcaagcacgtggaagccctgcccgacgggaccgaggtcaagctgggcagcgtcgtcgacaacacccggcgccgcgccgacaaactgaccgacgagcagcgcgcgcagtggaccaccctcgggatgcgctggtagcggcgtgagccgcagtcggaagcttttccggagcgaccggtatgcgccttgcggcgggtccgtgagcgcgtcaccgtcacattggaaggttgaatccggtggtgtcctgagggcgacggggggacgggaatggacgacagcgacgaggagagaattcgcagggctgttgcgcgcggcgtacgggatgcgaacggcccggactgcgggggatgcatcttcacgttgctcgtcttcctcgcgtttctggccttttttcagagtttcatatccacctccgggaggtgacgaggccgcctgccggcgggcggagtggaccgccctcggaatgtgctggtagcgatcaggcgtaggacagacaggagggcggtcaccaccaggtggtgaccgccctctctcttctgtctcgctgctggccgtggttcagctcgcggtccgggcctcgtccgtgctcgcccgtatcatccgcccggggttgaaggtgctgcggtcggcaggtggtccttggtcatcggttccctgcttcgggtgagtatgggtgaggttttcgggccgcccgccgcgccggttgcctggcacgcggcggtcctcatcgggcgggagtccgggccggggcggtcagcccttcggtgtgtaccagctgaattcgaggatggcgtcgttgtagtcggcgtcatcaccgttctctccgacaacgaccatcaggttgtaggagccgatctcgtacgggccgccgctgttgagcttgctgggcaggagctggtccccggcggtgtgctcgaaggtcgcggtgatctggcgctgcccggtgatgactgcctgcccggcagcggcgttgcgttccccggagccggtgaacgtctcgttcacgctgccgtcgtcgctggtgagcttcaccgtctggacagcggacgagttggtcttgaccttggccgtgaccgaggcgccttcagggaggtggacctcggccttgtttccgttgatgacgacataggcgtcagacactgatgagttccttcggctcagccgggccccagacgtcatgcacacgctggggagccggtcgaatactgtgtgtgatcagtgcacacgatagccacacggagccggacaagatccaaaaccgtgagattcggggcaggtgccgcgcttgcgtggtaaagcgcggacgaggaatgagggcggaacggtcaccacgcggtagccggaccgttcttgtcgcccggggatggacggcgcacctgtgctcacgcggaaggaaggtccgcgacgtgcttgcactcgatgtgtccgatggttcgccttcactcgcgcgcatgacggagggggtggtcgccaccaggtggtgaccgctcctgcgttgggcacgggtggctatcagttcgctaccgccgtgggggtgggagggcagttaatgccctcggttgggtggttttcgtgtgccgcggcgttcgggccgtggtggtgtcgcgcaagatcgacaaaggcatcggcagcaccgagtctgcgggctggcaggtgctgatcaatcgcgtggccaaagggagaggatccactgtggcacccgtaaccgccggtacttacgtgatcgccaacgaggccgatctgcgactgaccctgctcggcggatacgccgacgtcaggacccaggtagtcctgctcccgcccgatgaactgggcatggagaaagcgcagcggtggcaggtggaggagtcgggcaacggcaacgtcaccatccgcaacgccgcctcggggacgtatctgggatacgaccacgactcgagcgactgggaggtggtgttcggctacctggagccggacgagtggcagctgcgcgaggtgacgggcgaggacgggggcgtgcagctggtggtggccgacggccctgacgacggcagcacggtcgcggtcggcctgcacaagctgggcgtcttcccgcccctggccggtctccagccggccgacccggacgacttcacgcaggtctggtacctcaccagcgtctgagcagccttgcagcaccgcaggcaggttccgggcactgcgcctgttgggcgcctgcgcccctgctgtgtcgacgaccgccgttcatcgccgcgccggctgcccggtcgcgtgcggcgcatcaccgagcaagggagcacatcatgaccaccgaggatgccgccaccaccgcgctgtcgccggtcgaccaggacttcatccaggccgcgacgatgctgcacagcacccagatcgacgcggcgaagatggcacacaagaacacgagcaacgccgacgtgcggtccttcgcacggcacatgatcgccgactgcatgcggctgaccgtgcagctgaaagccgtcgccccgcacggagtgatcgtccccaaggacaacagcgacaccgccctcctggactcactgcgccccctggtcggcgccgacttcgaccgcgcctacgtacgcaaggtcgggctggaggcgaaccggatcgccatcgccgcgttcgagaaggaagccaaggacggcgaaaccccgtcgctgaagcaggccgccctggacgccctgccgacgctgcgtgagcactacctgatgtcgcagaagctcgcgcagaagctgggtgtcaccgagtgagctagcctccgccgggctacggggctggggggcggacgaacgcacaccggagaagggggcggtcaccacctggtggtnnacctggtggtgaccgcccccttcttgtgtctggcctggcaggcgcccggctcggtcttgtgcacggtgtacccggcgggcagcggccctccgtacggggacagcgcccgtcgatctcgacagggggcggtcaccaccaggt

SEQ ID NO: 370 - DNA, 3952 bp, Unknown
  Kingdom: Bacteria, Phylum: Actinobacteria, Class: Actinobacteria, Order: Streptomycetales, Family: Streptomycetaceae, Genus: Streptomyces
gacggcgacgaaggtacgtactgcttcgagatccacgctgacccaccttagtgaacaactagtggttgtggattggtggcatatcagttgtttgacctgcagttgtcctgcccgcttacctctctttggtcaacgtcagtttgttcgggtgggacctcaaggggagtgcgctgagcatggtgggcaggagacggttgggccggcagttcggctggctgtgggcgtcgtatgcggtgagcgcgtatgggtccgggctggggttcggggcgttgccgctggtcgccgtgctggtgctgcatgctggccctgctgaggtgtccgcgctgtccgcggtggggcctgcggtgggtgcgctgatcgcggtgcccctcgcgccgtgggtggagttccggcgcaagcgcccggtcatgatcacgatggacctggtccggttcgcggtgatggcgacgatccccgtcgcctacgccttcgggtggctcagtttcgtccatctgctcctggtctcggccgtggtcgccgcagccaagatcgcgttcaacgcggcgagcggcgcctacctcaaggccctcgtccgaccggatgacctgctcgtcgccaacgcgcggttcgagtccaccaactggagctccatcgcggtggggccaccgctgggaggtgcggcgatcggcctgttcgggccggccaccaccgtggtcgccgacgcgctcagctacctgttctccgcgctgggcatcaccgcgatccgcggccaggaagaagcgccgcgaacaaccgacaagagcccgatccgggcgggcgcgctgctcgatggctggcgacacatcatgggccaccccggtctgcggccgctctacctcaaccaaatgctcgtcggcggtctgatcatggccaccgagccgctgctggccgtgctcctgcttcgccaactcggtttcccgccctggcagtacggcctcgccttcgcagccccctgcctcggcggactcatcggctcccggctggcccgccgtgtcgtggcccgccacggccggtccgcggtcttccggaccgtcggcaccctgcgcgccatctggctgatcggcctggccttcgtccgtcccggcgtcgtcggcctcgtcaccgtgatggccgtcgaactggccatcatcatcaacatgagcctgtacacgccggtgctcgccacctaccggctcgaacacacccccaagcatctcatcgcacgcaccctgacggcctggtcgatcggccagcaagcgtccatcgccattctcaccgcgctcgccgggctactcgccgacgccaccagcccacgcactgctctcacggtcgcgggactgctcatcctgaccaccccgctcctgcttccccgacaggagcagacgtcgcagcacgagccggaactggcccgcagccactcatgagacaccgcagctcaccgttgaagcccgcaaccctcagccggtccaccggtgcatatccgcgtcgaccagacaccacaccagcaaggagaacacccgcgtgagcactgcccccgcacttgaccccgcgcacaccgcgcttctcgtcatggactaccagcccgcgatcctggcctttgtgcccgaaggcgaggaccgcaacaccctgctcggccgcgtggaaggggccatcgccgacgttcgtgcaaacggcggcaccatcgcctacgtacgcgtcggcttcgccgagaccgactgggacgcgatcccggcctccaacaagtccttcgccccgctggcccaacaccgcgtcatgcaccacgaggactctgccaccaccatccacgagcgcttggctccccaggacggcgacatcatcgtgcgcaagatccgctacggcggcatgtccaccaccgacctcgaccagcagctgcgcgagcgcggtatcaccactctggtcgtatccggcatcagtaccagcggagtcgtcctgtccaccgtcatcgacgcggccgaccgcgactaccagctctatgtcctgtccgacggcgtcgccgacccagacaccgaagtccacaacgtcctgctccaccgggtcttcccctcacgggcccacatcatcgacactaccgagctgcacgccctgctccgggctacctgactcgaaccacgagccaatcccacatgcggccgccgcacccacccggtgtggcggcccgcccgcaccttcgtgccggaccagcagcagcccggagctctcaccagccacctgccgcacccccgccacgcgtaaccgccactccctccgccggcacgacggatcccggcaccctacgagccggtgaccagtgcaaacgtcaccgcacggtgcaacgacctcgtggccgacgggcagacgttctccgggcaggcacacacactcgacgagcacaccgccgggatcgtcagcccccaaagggctgtggaaatggccaaggcgaagacgctgaaattcggcaagcccacgtccaacagcctgttcgtcgaccagggaccgcccagcaggtcgtggactacgcgctggccaacaacgcgaaccggagcaagaactggctccagaagtccaccaagtcggatctgcagttcgagggaccggcggccaccttccacccgcacccaccgaccagtacatcgccctacccgacgcccgtctggtcagccacccaggcgctgctcaccgcccgcgagaacctcaccgacaccatcgacgcccgcgccatgatgtgcatccacggcggcgccggcttcggcaagaccatggccgtcaccagctgcctgcgccaactcgaacccggcgaggacatccgccgcatcaccttccacgcccgcgccaccacccgcgcggtccgccacgaactgcacgccgcgctcgaactaccaggctcacccccgcgctacgccagcgagttcgaccacctcctcaagaacgcgctggctacccatccgcgcacgctcgtcctggacgaggcccagtggcttcaaagcgaccagctggagtacgtccgatacctctgggaggacccctacacccagctcgccgtcatcttcgtcggcggcgaaggctgccaccacgcgctgcgcaaggaaccgatgctctcctcccggatcttcatctggcagcacttcacccgcctcacccccgaggaggtccgccagacgatcccgctctaccacccgatctgggccgacgctgaccccgacgacatcacttacgccgacagccgcgccgcgcacggcaacttccgcaactgggcccgtctgaccgccctcacccacactgccctgaagcgcacggccgcacccgcgtcgaccaggaagtcctccgctgggtcttcagcaagctcgcctcaccgcactgaccaccccacgcccaactgcaggcgagcaccccgtcagcactcaaccgtcgcaagcgtcagcgtcaccctcccagcacgcgaagacgccagcaggactgtgaccacgatgcagtcccacatggccctcccggagtacgcagatccgcccgaggcctccatgcttggccccacaacgctgctcatcgctcaccgcgacttcctcctcgtaggccaccgctccgccaccggccgccgcatcagactccgcggacggcctaccgggcacgcgccagtgctcaggtatccgggcaagcatccgctgccgctcccgctcatccagacgcccccgacgatgactgttccgccggtacccgagagcaagcagcgcacgctcgcccgccggcatcacatccgatccgccctcgcccctggacgcagaggccggctcctccgcgctcgcagtgaccgaagaccccgcatgcacacgacgctgtggtggcagcccacccttgcccaactcgctgcgcacccaactcgcctgtctggcagtcgagttgtcctcgaagctgagcagccagtgcccgccgtcctccgcacaggacgcgatcgcgtcgagga

SEQ ID NO: 371 - DNA, 566 bp, Unknown
  Kingdom: Bacteria, Phylum: Actinobacteria, Class: Actinobacteria, Order: Streptomycetales, Family: Streptomycetaceae, Genus: Streptomyces
cccgcgcgcggggcgccgcctcccgtaccggcgcgggcgccgtcgctgtccttaccgccgtctcctgggccatggtggtcatgcctccagcctgccgccgcgcgaaccctgtttccaggtactccggctaccaggataaggacactctggtacctgcctcagcccggtagcaggctcggtcgtgtgaccacccgaacgatctcctcccccaccgtccgcaccgccgtcgcgctaccggcgctgggcggcgtcggactgttcacggtgctgctgggcgcggcacttcctctcatcgacttcttcatcgtcaacgtcgccctgcccacgatgggcaaggacctgcacgcgagcgaggccgtcctcgaactcgtcgtcgcgggttacggggtggcctacgccgtgctgctcgtcctcggcggccggctcggcgacctcttcggccggcgccggctcttcctcggcggcatggcggccttcggcctgacctcgctggcctgcggtctcgcgccggacgcctggtccctggtcggggcgcgggcggcggcccgcggtggccgcctggatgg

SEQ ID NO: 372 - DNA, 1905 bp, Unknown
  Kingdom: Bacteria, Phylum: Actinobacteria, Class: Actinobacteria, Order: Streptomycetales, Family: Streptomycetaceae, Genus: Streptomyces
tacccgatcatggtggacctgacacacacctcccgtcgcggtctactgaccgcgctcgccgcctccgccgccgccgcgcccctgggcgccctggccgccgctcccgcccgtgccgccgccgacgccaccagcacggccgtggacccgctgcccgcgccgcccggcctggcctcggcccgttcctcggtgaccctgccgccgctggacgcctcctggttcaccccggtgacactcaccgccccgctcaccaccgccgtgctccccgggacaccggcccgtacggaggtcacctcccagggcagacgggtcgcgctgctgacgcacggagcccggaccgtactgctgccgggcccgcgaagaacgttcgccgagaacaagcggcctttcgtggacgacttcgggcgcacactgccggacacgtcgctgccggcggagcagcgcgcctactgggggacctcgcctggcggcggcagctggtccacgctcggccccgacgccacggactactcggtcgtgcccggcaccggtgtgatcgcgctgaccaccgactacgccagtcgccacgcgagcctgcgcgacgacgagatcaccgacgtcgacgtgcggtccgtggcgcggttcgacaaggtgcccaccggacaggcctgttcctacgcgctgtccttcggctaccaggacacccacaacaactaccgggcccggctgtccttcctgaccaccggcgcggtggagctgcgggtggagaaggaggtcgccgacacggtcacccagctcgccccggccgtcacatcggcgaccggcagcccggcgggcgccgactgggcggtccgggtgcgccgcgagggggccaggatccgggccaaggcctggcgggcggacgccgcggaaccgtccgcgtgggccgtggacgtcaccgacacgaccttcggcaagggccgggtgggactgcgcgccctggccaacaaggggtgtacgaacctgccggtcacgttgatggtgagccgtttccaggtggacgccgcgaactgggccgcaccgccgagcgtgacccacggcgactgggtgcgggtgctgccgcagcccttcgacggcacatggacggcggaactggagcagaccgtgcgcggctgggccgggtccaccgcgccggacgtcctcgcgtacgccgccatgttcctggccggggcgcccgcggtcaccgccggggacggccccgcgcggggcaagcaggtcctgggcgaggccggttacggctacctggacccgcacggctaccgctatgagggcgccgacttccacgagtacatgaacgtcggctggaccttccccgacggcgcctacacgggcccgtcgagcaagcaggtgggcaacctggactgctcgggctacacgcgcatggtctacggctaccacatgggcgtgccgatggcggcgggggcggacacctccggggagcggataccgcgcaagtcacgcgacatcgtcgaccacgcgcccggggtcctcgtcgaccgcaccgacgggaccgcgccgcccgccgccgcccagctccagcccggggacctggtgctgttcaacgccgactcgggcgacgacgaccccgccgggcaggtcgtgaccgtcgaccacgtcgggatccacctgggcacggacgcggccggcaagcgccgcttcctgtccagccgcaagaccgtcgacgggcccaccatgtccgacctcggcggtgcctccctgctggacggcacgggcacctacgcccgctcgctgcacacggtccggcgcatctgaggcggtaccgcgcgaggggcgtcgtacgtccggccggggccggcggccccggccggtccggcggccccggccagtgcccgccggtcgcggtggctgcccggcgggatgaccgggcgc

SEQ ID NO: 373 - DNA, 16507 bp, Unknown
  Kingdom: Bacteria, Phylum: Actinobacteria, Class: Actinobacteria, Order: Streptomycetales, Family: Streptomycetaceae, Genus: Streptomyces
cggcgactggtacgacgtcattgccttgccgtccttccgggcggccctcgccgtgggaggggtctccggacacggcctgtacgcgaccgccaccatgggccggctgcgcacggcggtccgcacgctcgccgacctggaactcgacccgaccgagctgctcacccacctcgacgacggcgttcggcagctggccggggagtccgattccgccggccccgtgagcgcaacctgcctgtacgtcgtctacaaccccgtcgtgcgccagtgtgccgtggccagcgccgggcacccgcccccggtcgtgatccggcccgacggcagcgtcaaggtcatcgatgtgtcccccggtccgccgctgggtgtgggaggcatgccgttcgagaccgccgtcgtcgacctggaacccggcagcgtcctcgccctctacaccgacggcctggtcgaacgtgacgacggtgacgccgacggcggcctgcggtggctgacggacaagctcgcgacgtcgtgcgcccctgaggtacccctgcgcgacacgggccgcgcgttgctcgccagcttcgacgacgagccggcccgggacgacatcgccctgctcctggcccgcacccgcgccgtcccggcagagtccacggcgagctgggagttcgccgcggaaccgtccgtcgtggcggccgcccgcgagaccgccgcccagcagctcagtgcctggggactggacgaggtcgccttcaccaccgagctcatcgtcagcgagctggtcaccaacgcggtccgctatgcgggcggcccgatcggtctgaggctgatccgcggcgaggtgctggtctgcgaggtctccgaccccagcagcacccagccccgcctgcgccgggcccgctggacggacgagggcggccgtgggctgttcctcgtcgcccagctcagcatgcgctggggaagccgctacagccggcggggcaagacgatctgggccgagcagtccctgaccccggcggcggtcgacttcgccgcgctcatgtgacggacgcccggcgggccgggtccggtcgcgccgccgaaagctctttggcggctacgccgttacgtcaggaagcgctccggcgcgggaaggtccggcttctcggacacttcgtcgtccggggcttccctcgccggaccggtccggttcaactggtgcggcagagcaggggagttcgccgagtcgtgcggggcaggccgccgtcggccagatgggcgtatattatgtttcgatggcgttcccggaggggagccggcggcgccggacgtgcgtcgtgagctggagacccgatgctccgtgcgagaagaggtggcctcgcgtgtacagcgcttcgcaggatcctcacgtcgggcggtcgcggcccgagatcgagtcctcgtggacccgatcgcgcctgaacggtctgcacgaggacggcacaccggctctccagtacgggccggtggccggagggagcctgctcgtgcgtgcggcggggccggtgctggagcgggtccaggcggagctcgacgacacgcacttcaccctcgtgctcgccgaccgggaggcacgcgtcgtcgacatccgctgtgcggaccggcggctgcgcacagcgctcggcgccctcggtgtcgtgccgggtgtccggctcggcgaggaccaggtgggcaccaacgcgatcggaactcccctggagacacgcaaggggctgctggtacgcggcaccgaccacttcatgacggcgttcagcgatttcgcctgctacggccatccgatcatccatccgatcacccgtcggctcgaaggagtcgtcaacctcggcggccggtcgggagcggagcatccgcttcccccttctgatacggcgcgtggtccgggacatcgaggaccggctccagctcggttcggcccggcaccagcggcagttgctggcgtcgttccaggcggccgcgcgctcctcccggcggcccgtcatggtggtggggccgggcgtcgtcctggccacccccgccgcgctggcgctgctggaacccgccgaccacgcggccgtccaggcgtgcgcggaggacatgcgctccgagggcgggacgagccatcgactcaccctggtctccggccgaacggtcacgctcaggtgtacgccggtcgagggaacggagggggcggtggtggacatcgtccccgaacggcccggcccccgcggcacgcctgacccggcccctgcggaggactggccgctgctggtcgtcggcgagcccggaagcggccgtaccaccgaggcgcgacgagcggccgggcccgacgcggtcacggtcgacgcgacggacgccgtgtgccggggcgagcagggctgggccgtggacctggcggcactgctgcggagcgaggggcccgcggtgatcatcgagaacgtccagttgctgaccgagcaggtgacggcgctggcggccaagtgcgtcggcaccacccggcgcaggaccgtgctgacctcgacaccgggccgccacctcgacaccctgcacgcgcccctgaccacgctgtgcaccgcacggcgcgacctggcccccctgcgccgccgcaggcacgagattcccggcctggcgcagagcatgctgggcgacgcggccggccgtcccggacatccccggctcaccgccgacaccctgcgggtcctggccgcgcagccatggcccgggaacctcgccgagctgcgccgggtgatccagtacctcgccgggaggcgctccgcgggggacatcatccccgccgacctgcccgcctcgcaccgggggacaccggttccggcgtcaccgctgcgccaggccgagcgggagatcatcgtcgccgctctggagggcgtcggcgggaaccggctgcgggcggcacgcgcactggggatgagcaggtcgacgctctacaaccgcatgcgggccctgcacatccactgacccggcaccctgccgcgcgggcgtggaccgatggaggggtgtgcggcacgggttcagaggaggcttggccgtgttgccggagcccgcgttcttcgccgagatgcgcttcctgggggtacgacaccggccgcacgtcgggtcaccagacggaggcggtggtggaccggccgtcgggcgccacaccgtcaaccgcccggggcggaccccgtggtcccggatgtgccccgaccgccccgacggcgcctcgggtattggacactcgtttcccggcgctcgaatcgctcggacgaaaggggcgagaaacgcatcggccgcattcccgcggcacgggtacggacggacgattcgtcacggcattgcggcgcagcggagcagcacggaattcagcagtgccttgccgctcggctcggccgaaatggatcggcgtgtcggccacggcagacagccggccctcccggggcgggaaggccggctgtcgcgtggtcgcgggagggcgtggggtgtgggtgaccgatcgcctcggggttcaggagtgcgcgaagaggacgccgacggcgagcagttcctcgacgcgtgacgcgtcgtacacctcgcctgcgatctcccgtgtgtgctggccgacccggggtgccgcgcctccgcggtcggggcgggaaccgccgaaccgccacggcgggcgcaacaaggagacgccgttctgctctggctcgatgatgtcgagccactcggtctgcgggtggtccagatagccggacatggtgagtactggagcgaagggcacgtcagcgtcggtcagccgcttctcccattcctcggccggccgccggaggaattccgcctgcaccacctcgaccagctcgaagtagtggcgttcacggtccggatagcgggcgaaccgggggtcctctcccaggtcgcgccggtccatcgcctccagcaggcagtgccagaacttctgcgacgacgacaggtggatcgcgatgttctcaccggacgcggttctgaggcagaaattctgtgcctgagggtgcctgctctgccggctcgggtccttgcgcccgtcgtcgaagtactggctgatggcgtcggcggtgagcgtgctgatggcctccatgatggaggtctccacatgctgtccggcgccggacgcggcgcggccgaccagcgcggcgagcacaccggtggcagtggtcagaccggtgaccaggtcggcgaggatcgtgccggtcagctgcggggcaccggcatcgccgagcagggcgtacaggccgccgaccgactggccgatggtgtcgtaggcggggcgctgggcgagggggccgccgttgccgaagccggtcacggacgtgtacaccaggtcggggcggagggcgacacagtccgcctggcccagcccgagggcctccagcttccccgtgcgcaggttctccagcaccacgtcgaagcgggggaccagggccttgacgagtgccacgccctcgggcttcttgagatccaccgcaaggctgcgcttaccggcgttgtactggatgaagtagggactgcggtcgttcttgtggcgccggaattcatcgccggtgcccggtcgctcgaccttcaccacctcggcgcccagtgcgcacagcaacgagctggcgtaggggcccgaaatgtatcctccgagctccagtatgcggatgccgtcgagtggcttgtgctgcatcggtgacctcgctccatgggtgacggtcgccttggccaggcaggattatgtaaaatatatttctccctggatgtcaagaggtttcggtcggccggtaccgatcgagacccccgctgatcgcggctgtgctcgtcgccgcctacggcgtccccgagcacacccgccacgttgtaagcgaagccggtcgcggtggagcgggcccgggctccaggatgagggcgccggggcgcgacccctgtaccgagctcttgccagctctgacattgaatacttaatattttggatgagccttgccgccggggcgacgacctgggagcgatccgccatctgtcccgcggtctggaggccggaacggtgtgagtgaacacctgccgtcatccggcgagcccgtcggtacatccgagagaacgaagacgatgcgggaggcggccggtggttcgccacgccgtcacgcgagaggactcagaatcaccatggccgacacacttgttgagcagctggccgagttcaccgacaagagcgacttctcgcggctgccgtccgatgtcatcgacgagtccaagcgcatcgtgctggactcgatcggctgtgccctgggcgccgtcgacgtgcccaaggggcgcatcggcatcgagtacggccgcatgacaggcggctcggacggcgatgcgacgatcatcggcaccagcggaaaggtgtcggtcttcggcgccgcgttcgccaacggcgagctgatcaacactctggacgccgacgcggtgctgccgccgggccatgtcaccccgtacgtgctgccgggtgcactcgccgtcggcgagagcgtgggcgcttcgggcaaggacctcatcaccgcggtcgccgtcgcgcacgagatgtcgtaccggatcggcaaggccatggactacctgcgtgaccacaaggacggcaaggtgtccccgccgcaggtgtacggctacagcagtacggtcttcggcgcgaccgccgcggtcgccaagctgaagggactctcccggcccgtcctgtcgaacgcgctgggcatcgccggcctcatctccccggtcaactccttccgttcctggagcatgcacgcccccacgtcgaccatcaagtacctgatggcaggcgcgctgacccaggcggccctgacggccgcgcacatggcacagttggggcaccgcggcgacccgcgggtgctggacgaccgggagttcgggttcccgcggttcatcgggacgaagcggtgggagccggaaggcatcacgcagggcctggggaccgagtggcggttcccggccgagcaggcgttcaagccgtacccgcactgccgcatcctccacgcgctgctggactccctgacgcagatcgtggaggacaacgacatcgagccggaggagatcgacggcatcaaggcgctggtcgagggattcgtcgaacagccgctgtggttgaaccgcaccatcgaggacgtgcacgacgcgcagttcagcatcgcgcacggcctcgcggtgggcgcgcaccgagtgccgcccacgaaggcgtggctggatcccgagctggtcttcggcgactcggttctcggcctcatggacaaggtgacgtacgaagtccatcccgactacgtgaagctgctctccggcaacgcggccagtcggccggcccggatcgaggtctccgcccgcggcaggaccttcgccggagaacggcgctaccccaagggcagcaagtccccggagcccgacagcttcatgaccacggaggaactggtccagaagttccgccggaacgccgaaggggccgtcccggccgcgaacatcgaccgtgtggtggaagccgtcctcgacctggagaacgtcggcgacatcgggacggtcatgagcctgctgagcgcgtgacgcgagccgctgcgcctcgcgtgggcgggcgccgtaccggaggggacatccggtgcggcgcccggcttcgtcaggtgtgcgcgccgcatgtgtgcgcgccgctcagggacgggtgcgccggatcgtctcggagggaggaacaccgaagccccggcggtagtggtgggcgaagcggctggagtggtacaaaccttacttggcggccacctccgtgaccgagccgcccgggccggcggccagttccgagaggggcccgctctcccacggcctgcattcggggtgtccgggccccatcgcggccgagtccgaccccggggaggcggacgaggagcggctgatgttcgccgccgtggactgacgacgggccgtgcggtgaagagggctcgggcggtccgccggtagaaccggcgggccacccgagggagttcggccaccgcggccttggtcagacggcgatgtccatctccggtccgatgtactcctcggcctggacgaccttgccgttctgcacggtcgccacctggatgatgtgcacgtgcgtaccgtcgagcgtcgttgacgtctgcgtgatgaagcccctgtcggtcaacgtgtaacgggagtcacggaagggcgggaggccgccccggctgtgcaccgcgtcgatggcctccttgagagtcatccacttgtcgtcggcgctgtgccacacccggcactccggtgcgcagaactcgtagaacctgtccacatcggacagcgcctggagccactcctgggcgatttccgcattgctcggtacagccatggtcgcgtgcctttccctggggtcgtccggtgggacaggcgcccaccatcggagggacgatcacatgcgatatataaaatctcaaggcgtctttcccggagtgtgcaattctctggacgctgatgacgtcgtggaccatgtctacggtcgaacatgcgcggtgtgcggacttcgtcgtagcccaccacctccccgtggacggcctctacacccatgcgtggtcgctggaccaggcggccgaggcctacgagtggttcggcgcacagtccgacggcaagggggttttcgagttcgcggactgatccgcgccatgcggcagcagcggtgaggtgcccggtggactcgtcggtggagtctgccgggcacctcggtggctggggggggcggggtcagtccttgtcctcgcagaggccagcgccggaggtgacggaggcgccgccctcggccgtcaggccctcgacggtgccggacccgtgggcgttgaccggctgttccgtcagacgaactcggcacgcagccggtgcttgagcaccttgtggctggcgttgcgcgggagctggtcgacgaagcggacgtgccgcggcaccttgaagttcgccaggctcccgcgcgcccaggtgatgacctggtcctccgtcagccggtggccgtcccgcgggacgacgaaggcgcagcccacctcgcccagccgcggatcgggcacgccgacgaccgacacctgcgccaccgactcgcaggcttgcagcagtcgttccacctcggcggggtagacgttgaacccgcccgagatgtacatgtccttgagccggtcgatgatcgacaggttgtcctcgtcgtcgaggctgccgatgtcgccggtgcgcagccagccgtcctcgtcgatcagggccgccgtggcctcgggattctgccagtagccgggcgtcacggtgtagccgcgtaccaccacctccccgggctgcccggccggcagcgtacggcccccggcgtcgacgatgcggacctgcacgccgggtgccgcgcgcccgttggtgcgggccaccgtgcggaccgagtcgcccaggcgggtggtggtcaccagagcggaagcctcggtgagcccgtaggcgctcatgacgacgtcgaaggagagctcgtcgcgcatggcgtggacgagcgcctcggggatgatggtcgccccggtcatggcgaagcgcagtgaggtgaggtcgtagcgggagcgctcgggatggtcgatcaggtcctggaacatggtcggcggcccggacaggacggtgaccttctcctcgctgacgacttccagcgtgcgccgcgcgtcgaagcgcggcatggggatgacggcgaccccgtgcagcagggaggcgagccagcccgccttggaaccgaagcagtggaagaacggcgggacgatcagtgagacgtccgaatcgcggtagccgtagttctcgcccacccagccgtacagacgcagcaactggccgtgcgtcagcatcacacccttgggatggccggtcgtgcccgaggtgaacatgatgtcggcgacatcggtggcggcgagccggtcgatcgacgtatgggcctcggcctccgtgacggccgtgccggcgtcgaggaaaccggtccaggagcagtccgccgaaccccgctcggcgagcagcgagaccgtgcggcgcagtgcgggcagttcggggtcggcccggcgcagctccgcgatgtggtcggtgccgaggaagtcggcgcagaagagggccttggcgcccgaggtacgcagcacataggcgagttcggcgggcttgaaccgggtgttgaggggcaccacgatgccgcccgcgccctggatgccgagggcggcgaggatccattcgggcgagttcggcccgcacaggccgacgcgttcgccggggcggacgcccagggacagggcggcgcgcaccgcctggatcatgccggcccgaagctcgcggaagctccagcggcggggactgtcgatgacggcgggcgcctcgccgaagcggtcggcagcccggcggatggcgttcgggatgctcgcgtactgctggtcatgtcgcacttcgactccgaggggcagctgggcagggaagaccgtccggcctggcgtggggcatggatcaccccggtgggtgccgctcaggctggtgccgggccggatgggaggagtcttacggtggatggcggccgcgtcgagagttcgtacatgatgttttctatcggggtccgggcagggtccgggcagaggggccgggcaggcgtttccaacagcacgggagcccggcccgcgggcgtgcgggagcaccgacgaggcggcgctccggtacgaggaggcggcgctccggtcccccgcggtcccggacgccctacccgccgagtgccgcgcgcaccttcggcaggacctcggtggccagcagccgcagggatcgttccgcgtaggtgtcctccatgtccttgtagagggagagcaaccagtggtcgacgttccgggcccgggcgacctcgatcatcttctccgcgaccgtgtcgggggagccgatcaacaggtggtcgcgctcgaagagcaggtcgaacggcttgagggcacggatcttcgggtcgtcggggtcctcgccctggtccagccagatcccgcggccgcggaccttgtcgatgaaggcgacgctctcgtcgaccttctcctcggtcagctgccgcgcctcggcgtcggtcggcgcgaccaggcagccgcgcaggatcgcggacgagcgtgcgaggccggggtgcggcttctcgatgcggtccagttctgcctggtatgcggcgttgaggccgtcgagcacgcttcgggtggggaaccaggtgatgacattgagcccctgctgcgccgcggtggcgaacccaccgggggtgtcggtgacgctgtagagcggcggaccgccgggctggaggggctgggggatgatgctgagcccggtgacgcggccctgctcgtcggtgtgcttgtcgccggcgccgggccacttggtgtccgggtgcgggatccggaaccgctcgctgctccaggagaacggctccgtcgtccaggcggcccgcagcatctccaggcgctcggcgaagatctccttgctgcgcttgtcgtcggcgcggtcggcctccgggttcaggttgatgatctcggcctgcagaatgccgcggctgagtgcgacgtccaggcgtccgtcggtcatgtggtcgagcatcgcgaggtcctcggcgagccggaccgggtgccacgtgggcaggatgatcgcggcgatgccgatgcggatgcgggaggtccggccggccaggtcggccatgagcatggcggggttggggcactggtcgatcccggcgtggtcgaagtggtgctcaccgagccagaagccgtcgaggccccactcgtccgcgagcgtgatccggcggcgggcctgttccaggacgtcccgccagggccgaacatttccgacgttggacagcgaatgcaggatgtcgactctcacgaggcatctccctcgcggcgaacgcgccctgtggcggtcgccgctcgtcaggtggtcgggtgagcaccgcgggaaaggccgcggcgtgcgctcaccccgtacggcgggtccgctccgcctgcaggaagccctgagacgttgtacgcccaggaacacggtggaccccggggaccgggggtgagtgggctacgacctggcggccacggcctcgatggcgatgcggcagccgccggggaggccggcccgcagggtcacgcgctcgggatacacacccggggcgcactcggcccggtaggcctcgatgaactcggtccggtgggcgtcgtcggtcacccagcacgtcgtcttgagcaggtccgcgcggctgaggccggcctggtgcaggacgtcgtcgatggaggcgaagcagtgctggatctcgtcggtgacggtgtcggccgcctgcgcgcgccggcccgtcgccgggtcgagggccgtgaccgtgacgaaggtgaagtcgccgacggtgacgccggacgagcgacgcgggtgcgtctcgttctgtgactgggcgctgatgaaggtgggcatgcccctcctcgttcacggctcgtgggcggcgggtcgcgtttccggccgctctctggcggggccgagcttagaaaccgttcggtatgtaagtcaatggctcggtgcgctttctgcgggtcgcccttggccgcgttgaaaggcagctccagcagcggtgtccggcctattgccaacggttgcccaggagatttagcgtaccaactcgtcggtctgttgaagagttgggagatggcatgcgtgaaccctccgactcgcggtggttccgcgaggtgctcgggcagtatccgaccggtgtctgcgtggtcacggcggtgcagccggacggctcgcgcgcgggctttgtggtggggtccttcacctcggtgtcgctcgacccaccgctggtggcgttcttcccggacaagcggtcgaccagttggccccggatcgagggggccgggcgtttctgcgtcaacatcctcagcgccgaccaggagcatctgtgccggcagttcgcctccaaggcgccggacaagttccagggcgtcgccgcacgggcggccgggtcggggtcgccgatcatcgaggatgccgtggcgtggatcgactgcgacctcgaatcggtgcaggaggctggcgaccactacatcgttctcggccgtgtgcgggagctcgacatcgagagcccgcagctgcccctgctgttcttccagggcggctacggtcgtttcgcccccctctcgctggccgcttccagccgccgtggcgcgtcggccgagcagttgcgcaaggtcgatctggtgcggccggcgatggagagcctcgccgcggacctgtcggcacgctgtatcgcgaccgcggtcgtcgacgacgagctgatcgtgctggcgagcgccggcagccccgatgcgggcgcgcgggccacgctcgtaggggtgcacctgcccttcgcgccgcccaacggctccgtgctggcggcgtggtatgacgacgggcgcgtcgacgagtggctgaagtcgctgcccggcgacgccgatcgggacgagcaccaccgccggctcggccgggtgcgggagcgcgggtactcggtcgggctgctcaacgacgcgcagcgcgagttcgccagcgtcctcgaccggttggcggccgatccgtccgcgatggagacggaggacctccgcacgctggtcacgcggctcaactacgatccggccgacctgtcggcacaggccaagcgggcgattcgggtgatcgccgtcccggtccgggggagcacgggcgaggtggacctcgccttcaccctgtacgggttctccaagccggacgacaacggcgggatcgacgtctacatcgatcgcgtcgtggaggcgggccgccaggcgacggcctcgctcgccggacaggtgccggtcccgcaccgaccgcgttccggtccagcccggaacgcccgcgtgtgaacacccgcgtgcgacggaagccgcccacgcacgctcgaattgcccgaatccaaggagacccccgatgagtaccaccgccaccaagagcccgttcgtccatgcctccagcctcgccatcgacgtgaccaccatgaagctcgtaccggaggccggcacggtcaccgacgagacgcgcgtggtgttcgagcgcatcgcggcccggctcgccaaggacggcctgacgctgcgcgatgtcgtgaaggcgacgtgctacctcagcgacgagtcgcacctggaggagttcgtccgggcctacgaggcgatgttcgcccccggcccgtacccggtgaccaccacgctcttcctgggcatcgcaggcaactgccgtgtccaggtcgaggtcgtcgcggccacctgagccaccgcggctgacggcgatggtcttctccgaacgaccggcgagcgggcgcgcggtggtcgcggtcgtgctcagccggcgcggacgcgtcgcgctgttccggcgcagcgccctggtgcactccgaaggaggacgccggcactgcgtcaccggttacgtcgagtcggccacacccctgctcgacgcggcgcgcgagctgcgcgaggagacggggctagtgcctgtccggcggatcatgccgcagacgcggggtgtggcacgcccatctgcggcgttgtcgtcggttgccgacgctccgcgtcgacgccctcctccgccttgcagctgcacgcaccacaccccgctcacgtgggcatacagggcgccgtgtctttcctgcgacttgacccgccgacaggccctgggcgccggcgatctcgccgcgctcagcgccggtcccgtcctgtcgctgccggaccggacggacgcgacctggacggtgcacaccttctgggccgagacggagcgtcgccgcctgacgctcaactgggagcacgacgcgtaccgctgggtcgccccgcggcgactgccgcgcttcgaggggcaggtcgagtggctggggcaggtgccggcgtcgatgccgcagctcgccgcggccggccgtgaccggggcgcacgtcgccggacggcaggggttgccacccgaggtcgcgctcgctagggtcgcgctacaaaccaaccggtcggcatcatcggtgtcgtccacggacaccacctccatcccagggcccgtcctgaggcccccttcagaagggatcccgacagcatggcccagaaagacctgacagagaagacgccgcagcacctgatcgacggcgcatggcacaccggttccggcacggaggggatagccgtcttcgacccgtcgaggggggaacaggtcgccgaactgaccgcggccaccgcggacgaggtcgacgcggcggtcgccgccgcctcggccgccttcgagagctggagcgagctgtcgctgcagcgccgcgtgcagttcctgtacaagatgcgccagcagctcgcggacaacgccgagtccctcgcccgcaccatcacgctggaccagggcaagaccctggacgaggcccgcggcgaggtgatgcgcgcgagcgagttcatcgagaccgcgctcgcggcgccgatgctctaccactccaaggcgggcaacatcgccgccggcatcgacgcgcaccacgtccgcgagccgttgggtgtgtgtgtcgcgatcacgcccgccaacttcccggtgatgaaccccagccagttctccgcctgggcgctggtcaccggcaacaccctggtcgtcaagccgtccgagcaggacccgctggcctcgaccgccgtgatccgcctgctgcagcaggcgggcctgccggccggtgtgctcaacctcgtccacggccgcgcggacgtcgcccagcgcctgatcgaccaccccgacgtcgcggcggtctcctgcatcacctcctctccggtggccaaggccgtgcacgagcgcgcctcggcgctgggcaagcgcgtccaggccaacggcggcgccaagaaccccatcgtcgtcgccgcggacgccgacctggacctcgcggccgagggcatcgtctcctcggccttcggcatggccgggcagcgctgcctggcgggcacccgcatcatcgccgtcgacgaggtctacgacgaggtcgtcgccaaggtcgccgcgctgagcgacaagctggtgacgggcagcggcttcgacgccggcaccacgctcggcccggtggtgagcgcggcctcccggcagcgcctggaaggccttgtcgagcgcgcggtcgccgccggcgcgacgctggtgcgcgacggccggggcgtgtctccgcaaggcccctcggccaccgcggacggctacttcatcggccccaccgtcctcaccggcctcagccacaccgagccggtcgagcgggaggagaccttcggcccggtcctggccgtccaccaggcggcgtccctcgacgaggcggtcacgatcgccggcgacacccctttcggcaacgcggccaccatctacacccgctcaggctccaccgcgcgcgcgttcacgaagcggatccgttccggcaacgtgggcatcaacgcgttccccgccccgccggccaccttccccatgggcggcctcggcgactccttcttcggcgacacccacatctgcggcgacgctccgctgcgcttctacaccgaggagaagctcgtcgtctcgcgctggtgacggcacgacggcccacgcgcagcccctgccccacaggaaggactcctgaactcatgaaccggttcatcaacgaggcgggctccgacccgtcgaagtacggcctgtcgtcgggcgccgtcgccggccccatggtcttcgcggccgcgatggccctggacggcgcgacgatgcagcgcgaggccgccgccgtcaccatcgccgacgagacgcgcatctgcctggagcagctggacggcgtcctgaaggaggccggttgcggcctcggggacatcgtcaagatcaactgttatctctccgaggacgcctaccgcgccgagttctggcagacctacgacgagatcttcgccgaactcgactccaccgccgtccgcatcacccaggtcgtgggcatcgcctgcggctgccgcgtcgaactcgacgccgtggctgtggcgccgtaacgggccctgatcggcatggacacgctctggttcgacgaggcgcgggtggggatgcggttccgcacggcagcgcgcaccatcaccgagaccgacgtcgtcaacttctccggtctctccggagacttcaacgaactgcacacgaacgccgaacgcatgcgcggcagcccgttcggcgaacgcatcgcccacggtgcgctggtgctctcaatcaccaccggactgcgcagcgggctcggcatcttcgacgagtcgatcatcgccttcgccgagatccgcggctggcgcttcctcgccccggtgttcatcggcgacaccgtccacgcgatgaacgagatcaccgaactgcgggagacctccaagcccgaccggggcgtcatggtccagcgggtcgacgtcgtcaaccagaagggcgacgtcgtacagacaggagagatggtcacgatggtcaagcgacgtggtgcggcgtgcgggtgagagccggagcggccgcggacgccgacgccctgagcgggctcggcggccccgacggcggcatcgagggcggcctggt

SEQ ID NO: 374 - DNA, 8248 bp, Unknown
  Kingdom: Bacteria, Phylum: Actinobacteria, Class: Actinobacteria, Order: Streptomycetales, Family: Streptomycetaceae, Genus: Streptomyces
ctcgcatcggtgggccggggcccggccgtccgcgtgcggacccggccgggccccgggaggtcaggccggctgggagacctcgtggggcggcgtgaagttcttcatcagcgggaagacctcgcggcccatgcgcttgatgtcctcgacgtagtcggggaagatcagcatgtagccggcgacgtcgatctcggcccactcgtcgagttgccgggcgatgctctgcggcgagccggtgatgaagtccgtggacatctggaccgagcccttgcggtccatgccggccaggatctccgaggtgccgccctgggcggagtcggtcaccgccccgctgatcatgtactcgatcgcgcccatgtcggcgtggtcgacgtagttctgcagcttcgcctcggcctccgcgtcggtgtcggccatgacgatgccgagcgcgacgtaggggcggatggtccggccggcctcgtccatctgcgcgttgaagcggtcgacgacctcgcggagggcgtcctggccgccccaggccaggcggaaggagtagtcggcgtacttggtggtgaacttgatggcgtcgtcggaggtgcctgcgcacacgatgttcatgtggtggcccggcttcggccccatccgcaggtcctcgtactggaagtactcgccctggaagtcgcagacgccgttctcccagagttcgcggacgacctggcagtactctcccgcgtactgccagcggtaggagttgtactcgtagccgggccagacgttcatcgtctccagctcgcgcgggtgccagccgccggggacgatgttgagcgagaagcggccgttgctgatcgagtcgatcgtcatcgccatccgggccgcgatggccgggtggatggccaggatgttcaccgagccgaccagcttcatgtgggtcgtgtcgcgggccagcgccgccatctgggtcatcgactccagtgcgtcgtcccagaacccggtggagccgccgtggccccgcagcgccgacagggacagggcgaacgagaagccgttggcctcgccgctctggacgatctcccgcatgtggtcgtacgtcggtgagtacaagggcgccgtctccgacatgatgtagccgttacgggcgctggggatgaagatcccgaattccattcctcaggttcctctctgtggtgagtgctggtcaggccgagcggtccgaccgctgtgtggggggcgcgctgtacggggccggctcgtaaggtccggccgggaccggctccggacaggccacctcgccgatgaccgcggagtcgagccgcgcgtcgaggccttcgtcgacgcgcgtgtcccgcagtccgacggtccgccccaccatgacggtgacgacgagcgcggacaccggaccgaggaccaggaagacggccacgccgggcagttggtgccccatgccgatcgagacctgctggaagccgttctgccggggagatcacggcgctgtcgacgccgggtcccagggtcaggagtacgacctcggggtcctccagccggagcctgaggagcgggtgcggcacgccgcaggcctggttgaactgccggtcccggacagagaaaccgaccaccgacatgccggcagcggcgacgaaggccgcggccggcttctggacgaacgtgtgcagtacgttgccggcgcggctgaggccgaggtcgaagtgctcttctctcggcacaaaggtcgctgtcagcggctatgcgttgagcagcagctcgaacgggcggttgtacagtatgtcctcgaccacggcaaggggaatcggcagcggcatctgaagttcggagacggcgaggaactggtcggcggcctcgcggggatcgaacgaggggaagtccgagccgaagaccaggcggtcggtgacatgtccctcgatggcgaggcgcagaccgttgtacaactgccaggtcttgaccggcagtgtcgacacgtcggcgaagacgttgccgttcttcatcatgagttccacggcctcgttcatccacggcttgccgaaatgcgcgagcaggatcctggtgtcgcggaactcccgggcgaccttgtccagcagcgtggggctcgcgaactcgttcatgccctgcggggcgaagacgctcgcctgatggaacatcaggaagatcccgaggtcggccgccgtgcggtacacctcgtacgcctcctgtgagtgcgggtggaaaccctggtagggaggcgagagtttgacaccgtgcagtccgtgcgtccggacggcgcgcttcagttccgcggcagcccccggctgggtggggtccacgctgccgaccgctatggcgcgatcgcggtgggcggcgaggtactcaccgacgtagtcgttggggacgtccatgccgatccgctcgatccgcagtccgacgatcaggaatttgtcgacgcccgcggcggccatggcacgcgtgtgctcctggagatcggcgcggccgaagcccgggcgtccgacgagttccgtcccgcggtcggtccagacgggtccgaggtgctcgggacggtagacgtgtgtgtgccagtcggtgaagggccggtcgggcatgtcagcgacgccccgtcccgggccgcaccgcgatcgcttcgatctccacccggcagtcgccggcgatgccgaccacgaacgtgttgcgcgccgggaacgggccgggagcgaagacctccgtgtaggtctcccagaactccttgcgatacgcgtcgtcgctgaggtagcaggtggtcttgacgatgtcccgcaggccgcacccggtcgcttcgagaatgccccggatctcctccagcgcgatcctcgtctcgtcggcgatcgtgccggcctcctccttgcggcgcaacgtgtcgaggtcgagtgccatgccgccggcgaagacgaggtccttcgtcgcgacgccggggttcatgccgtagcgggggtagggaaggtctcccgggttgacgaactcggtcactgtctctcctggggtggtggtggtcagcggccggcggtgaccgagcggtcgagcttgcggacctggggcatgacctcacgggcgaacaggtccatcgaccggtcgacgtccgccgcggcgatgcccgggaagcccatctgcagcagccagttctggatgccgtgggaccgcgtcatccggctcatgcgctcggccacgctctccggcgagccgatcatgaggtggtcgcgttccatgagcagctcccacgggtccatccgctggaagcgttcgtcgtccgggtcctcgtcggcgtcgagccacacgccgatcccgcgcaccctgcacaggaagtcgaagaactccacgacggccggctcggcgatgcggcgggcctgctcgtcggtctcggcgacgaggcacagtcgcaggacaccgcagccctccccgagcggcggcgtgacaccggtggtcgcgcccacctcgtcccggtagcgctcgaacaggctgcgcaggacgcggccggtggggtaccaggtgatcggccggaggttcttccgggccgcggagaggaagccttccggcgactcggtgaccgcgaactgcggcggggccggctgctggaacggcttgggcgtcatgccgaaggcgatgagctcgtcgttctcgccgacccagccgtccggcatccgcgcacccggggcgtggatgaacttcgtgccgggttcggggaaggtgtagcggtcgccgctccagctgaaggggtcctgcgtccagatcgcgcgcacgatctccaggtgctcgtcgaagatctcgcggctggtgtccgagccgttccaccggttcgccgcggggttgaggttcatgacctcgatggggaggatgccgcggccgaacgccacgtcgaggcggccctcgctgaagtggtcgagcagcgcgaggtcctcggccagacgcagcgggtgccacagggtgagcgagacagcggccatgccgaagcggatgcgctcggtgcgggccgccaggtccgtcgccagcatgaccgggttcgggctcgcgtcggtgccgtccgcgtcgaaatggtgctcacccagccagacccggtcgtagcccagtcggtccgccatcacgacgtgccggcgcgtctgctgcatgacctcgtgccatgtcagctcacccgaccggttcgtcagcgcgtggagcagatcgatttccatatccacctcgaattggttggcgttcggcacactgccttcgacggagcgtcgtgacgactccccgtcagcatccatgcgggtgggtggtggagcgatccgggcaactacgtatccactacgtatcctcggcggctacgcggtctcgggtgtgcggagacggtcgcggtccggcacggcaaggggcccgcactgcggcgggccccggtggacgtccagtcggtacttcggcgctcagtacagcgtgtagcccccgtcgacggcgagggtcacgccggtcacgaacgacgccgcgtcggagagcagccacagggcggcctcggcgtgctcgaccggctcgctggcgcggcgcagggcgtgggtcgccgcgacggtgtcggcgtacgaggggttcagctcgaggtactccaggtacatcggcgtcttcgcggtggagggcgcgatggcgttgacgcggatgccctgctcaccgtactcggcggccgcggccttcgtcagaccggccagcgcgtgcttcgacgcggagtactccgcggccttcgggatgtagatgaaggaaccgacggaagcggtgttgacgatggcaccgccgcccgatgcgagcatggccggtatctcgtgcttcatgcacaggaacgggcccgtgacgttgatcgcgaagatccggtcgaactcctcgcgcgtgatgtccacgaggttcttcccggtgttcggcacaccggcgttgttgaaggctccgtccagccggccgtaggcggagacggccgcgtcgaccatgcccttgacctgctcctcgtccgtcacgtccacggtgacgaactgcgcggtgtacccggcgccggtcagctccttcgcgagcgcctcgcccgcctcgccggccaggtccgcgatcgtgacctcggcgccgttctcggcgaagagccgcaccgccgcctctccgataccgctggcgccgcccgtcacgatgatggagcgtccgtcgattcccgccatgatgtccttcttctgttggtgacgcgcgaacgaaaaacagtgggtgaggtgcgtgatgcgcgcatgagacgtgggtgcgaaagccggttcagttcccgcggtccggcgtggccgagggttcctgctggagaaccatggtcttcgtctccaggaagggcagcagtccctccgtcccgccctcccggccgatgccggactgtttgaagccgccgaaggcgatcgagaagtcggtccgtggaccgttgtgccccaccgtgccgctgcgcagccggcgtgcgatgccgtaggcgcggtcggcgtcgccggtgaacaccgcggcgttgaggccgtagggattgtcgttggcgagcgccacggcgtggtcctcgtcgcgggccgcgatgaccgcgaggacgggcccgaagatctcctcggtcgcgatggcggaccggttgccgacgccggcgaacaccgtcggctccacgaagaagccacggtccaggcccttggggcggccgccgccggtgacgatccgcgcaccgtctgcgcgtcccgtctcgatgtagtgctcgacacgcgcacgctgccgggccgaggcgagcgggcccatgtccacggcgtcgtcgaacgggtcgcccaccgtcagcgcgctcatcgccgcgctcagggcgtcggccatctcgtcgtgccgcttgtcgctgacgatgactctggtgaggctgtggcagacctggccgctgaggtagctgatgcccgccgcgagcgtcgtcgcggccgtacccaggtcgtagtcgtcgagcacgacggcgggtgacttcccgccgagctccaacgtgcagcgtgccacgcggtcggcgcagatcgcaccgatcctccggcctgcggccgtcgagccggtgaaggtgaccttgtcgactcctgggtgccgtacgagggcctccgagacctcccggtccgccgtgaccatgttgaggacaccgggcgggaggccgaccgcgtcgcagatctccgcgaacaggtacgccgagcacggtgcttcctgcggcgccttcagcacgacggtgcagcccgccatgagcgccggagcgcacttgtaggccatgaggccggcggggccgttccaggggacgatcgcggcgaccacgccgaccggctcgcgcacgagcagtccgctgccgccggccgcgggtgcgtgccgttcccggaaggggaaggccgccgccaggtccgcgtaggcctcgaaggcacccgagaggaacagcggcagtctcgtccgcgcgagcgagtaggtgatacccgactcgatcgaccacagccgggcgaagtcgtctccccgtcgggtcagttccgcggcgatggcgcgcaggtacccggcccgctccgtgggcgtcagcgacggccacggcccctggtcgaacgccttccgcgcggcggccacggcggcctcgacatcgctgaccgatgccgcgccgacccgcgtcaccacgtcctcggtgctgcagttcacgacctcgaacacctcgttcgaggacaccgggcgccaggcaccgtcgatgtacgacgcccgggggcgggccggcagcaccgtggcggtacccggctcggtcatgggaactcctccccgatcgcaaataaaatatgtcgcgaactgtaggggtggcgccctgagcgtggtgtccaggattttggacacgtatccgaccaccgtggcattccaccgccgccgttgatggtgacggtgtccgagcggagccgccggccgaacgcgacggcatccgtggccggagcccacacgttggcgttgagggcgtacctgacgtcgttcgcgaggcggacggtgagccgggggccacgacgagcacatgcccggcagcggccccagccgtacggagttcggcgatcaggcgccggtcagcgccttgacgacgggtgaccagcgctgggcgtacgcctccagtgcggggtcggtggcgtatgcggtgtcgagcaagtacaggcccggcagcgcgcacaccgcgccgagttcggacagcaggggacgcagcgtggtctccggggcgagggcatgggcggggttggcgccgagcatgaacggcagcgcgaggacgccgtcccaggcggtgttgccctggaagcggtccaggaacagcttgagcaggccgctgtacgtcgccttgaacgtggggctgcccaccaccaccagcgacgaggagcggaccgtggccatcgcctcggcgacggccgggtcgtccccgccgagcaggccgggagccagttccgccaggtcgacgacgtgctcgggctccgcacctgtgaccgtccgcgccaccagggtggcggcggccagggtgcgggagccggggcgggggtttccgacgaggacgctgacgctcatgagggcctccgggctctctcggggatggggtggtgtgttcacggaacggacaggacgcggcctgcccaggtgtgggcctgccccaggtgtgggtgtgcctcaggtgtgagcgtgcctcaggcttgggtggccggctgccggtcgccggtggccgcgtcgacgagcaggtactcgtgccggtcgaggtgttccagtttgtaccagaagcggtcctgtccgggcagccaggtcggtacgacgaggacgttggtgacccgcttcagcagttcggcgggccacagttcctcggcgcgcgcgtactcctcggcgctcacctggggccgttgacgggtcgtcgtctcctgccgggtcatggtgtccttcgctcgtggttcgtggtgggctggtcggcgggggcgatgtgctcggcccagtggcaggcgacggcgtggccgccacccaggtcgcgcagctggcgaccacgaggcgcgggttcagcgcgagggcgcgggcgatcccgatgcgccggcgccggccgccggagaactcgtgagggtacttccggccggcggaggcgggcagccctacctggtccagcaggtcgcgccccctggccgtccggtcgtacgggatgccgtgagggtcatgaccgtcagccctgccgcgagggcgcgggatcgtgctctgcgtgtgttcactgtggccttcggtgccttcggttgtcgggccgccgcgcccgccg

SEQ ID NO: 375 - DNA, 3746 bp, Unknown
  Kingdom: Bacteria, Phylum: Actinobacteria, Class: Actinobacteria, Order: Streptomycetales, Family: Streptomycetaceae, Genus: Streptomyces
ccccacctccgaggcctcctgcgcgccccggccgccgcgcccggcgcaccgccgtcgccgccggcacgagcatggcgctggccctgctcggcctgaccgccgcggccggcaccgcccccaccaccgcccaggcggaaccgtccgccgccgtgcccgcgaccttcaccgcgagcggcgtgccgaagttcgaccacgtcgtggtggtcatggaggagaacaagttctacgaggacgtcatcggcagctcccaggcgccgtacatcaactccctggccaagcagggtgcttcgttctccgacttccacggggtcgtccaccccagccagggcaactacgtggctctgttctccggttccacgcacggcgtcaaggacgacgactgcccgcacgactactcctccgacaacctcggcaaccaactcctcacccacgggaagacgttcaccggctactcggaggacctgcccgccgacggctcgaaggactgcggcgacgacggcgacagcggttacgcgcgcaagcacaacggctgggtcgacttcaagaacgtcccggcctcgtccaacctgcgcatgagccgcttcccctcggactactccaagctgcccgacgtcgcgttcgtgacgccgaacctcaccgacgacatgcacgacggcaccgtgcgcgagggcgacgactggctgcgcaagaacctggacggctacgtccagtgggcgaggacccacaacagcgcgctggtgctgacctgggacgaggacgacagcgacgacgacgtcaaccacatcccgaccctggtcgtcggcgcccacgtcaagcaggggtacaaggccaagggccgcggcgacctgtactcgctgctgcgtaccctggaggacatgcacgggctgccggcgctcggcgaggcggcctcgcgccagccgctcaccgacatctgggacgacggcggcaccactccgcccggttcctcggacgacctcgcgctgaaccggcccgtcaagacctcctccgccgagagcagttcctacgccggcgccaaggctgtggacggcgaccccgccacccgctgggccagcaaggagggctcggacccgcagtggatccaggtcgacctgggcgccgacaccgacatcaaccgggtgaagctcacctgggaggacgcctacgccaaggcgtacacggtgcagacctcccaggacggctccgcctggtcgaccgtgtactccacctcggccggcgacggcggcaccgacgacctcaccgtcgcggggcacggccggtacgtgcgcgtgcacggcaccaagcgcggtacgtcgtacgggtattcgctctacggcttcgaggtgtacggcaggaccggcacctccacgccgccgcccgcgacctccggcgccgacctgaccgacccggccaagaaggagatcgcgatggagctggtctccagcgcggagaactcctccctggactggaaggcccagtacacctacatcgaggacatcggcgacggccgcggctacacgggcggcatcgtcggcttctgctcgggcaccggcgacatgctcgacctcgtcgagcactacaccgacctccgaccggacaacgtcctcgcccagtacctgcccgcactgcgcaaggtcaacggcagcgactcgcactccgggctcggctcggcgttcgtctccgcctggcacaccgcggccaaggacgccgtcttccggcaggcgcaggacgacgagcgcgaccgggtctacttcgacccggccgtcaagcaggccaaggccgacgggctgcaggcgctcgggcagttcgcgtactacgacgcgatcgtgatgcacggccccgggaacgacgccaccagcttcggcggcatccgcgcgaccgcgctgcggcacgccaagccgccgtcccagggcggcgacgagacggcgtacctcaacgccttcctggacgcccgggtggccgccatgaagaccgaggaggcgcacagcgacaccagcagggtcgacaccgagcagcgtgtcttcctgaaggccggcaacctgcgcctcgacccgccgctgcgctggaaggtctacggcgacccgtaccagatcgacggctgacccgaccgcccgccgggcccgccggccaccgcgccggcgggcccccgcgcgacaccccccactacgggacaggtcacgagaggacaccgtcagccatgtacatctcatcgagccgggcagccgcgacccccggggcccccgagacccccaccgtgcccgcgtcggcatccgccgcacagacaccgcccccggacaccggacgccgtacccgcgccacggcccgggtctcccccaccgtgctcgcactcggctcggtcagcctggtcaccgacatctcctccgagatgatcaccgcggtgctgccgatgtacgtcatcttcacgctgggtctcagcccgctccagttcggcgcgctcaacggcatgtacgtcggcgtgaccgccctggtccggctggccggcgggcacgcggccgaccgctggcagcggcgcaaactcgtcgcgggcggcggctacgccctgtccgccgtgtgcaaactgggcctgctggcggcggggtcgtccgtgccggtgctcggcgcggtgatcgccgccgaccgcaccggcaaggggctgcgcaccggcccgcgcgacgcgctgatctcgctcagcagcaccccgcagaacctgggccgcgccttcggcgtgcaccgcgcgctcgacacggcgggcgccttcctcgggccgctggtggcgttcggcctgctgctggccacgccgggccgctacgacaccgtgttcgtggtgagtttcggcgtcgccgtcctcggcgtgctgatgctcgcgctgctggtccaggagcggcgcacaccggttccggccggggggtccgcgccgcgggcgggcctgcgcgacgtgctcgcgctgctgcgccaccgtgcctatctccgggtgggactcgccgcggtgctgctgtcggcggtggtgatcggcgactcgttcgtctatctgctgctccaggagcgcctgggcgtgcccgagcagtacttcccgctgctgccgctcggtacggcgggcggctatctgctgctcgccgtgccgatggggcggctggccgaccgcctcgggcggctgcgcgtcttcgccgccgggcacctcgccctgctgtcgggctgcctgctgctgttcctgccgtggtccggactcgcgccgatcgtcgtggtcctggcgctgcacggcgtgttctacgccgcgacggacggtgtgctgatggccgccgtcggcccgctggtgcccgagcggctgcgggcgggcggtctgtcgctgatccagacggcccagtcggtggccgcactcgcctcctcggtgctgttcggggcgtgctggtccttgtgggggctgcgcacggcgctggccgccgcgctggtcgcgctggcggtggcgagcgcgctcgcggtgtggatcctgccctggcgcacggagcggcggggcctgtcgtcgacatccgagagcgtggagggcgtcaagtgagcaccagggtacggttgttgatcgtcgtcgccgccgtcctgctggtggtgggcgccggcaccgggtacgtgtggcacgtgcgcggcgctacggacgcgggcgccgggagcggcacggtgcgtctcgacgcggccgggcggatcctgttccggaacaccgcgccgggttccgggttcggcaaggtggccaccgtgccgct

SEQ ID NO: 376 - DNA, 6827 bp, Unknown
  Kingdom: Bacteria, Phylum: Actinobacteria, Class: Actinobacteria, Order: Streptomycetales, Family: Streptomycetaceae, Genus: Streptomyces
ggctacaacttcctcgtcgaccgctgcggcacgatctacgagggacgggccggcggtgtcgaacgcgccgtcaccggcgcccacacccagggcttcaaccaccgcacggccggtatcgccgcgatcggcacgttcacggccggcacgcccgtgccgcgcgccatgaccgacgcgatcgccgcgctggccgcctggaaactcggcctggccggagtcgacccgcgcggcagcgtcacgctggtctccagcaacaagctggcccgctacaccgcgggcaccgccgccctgctcccggccctcgccggccacaccgacggcttccgcaccaattgccccggcgcggccctggccgtccggctccccgcgatccgcgaggcggcggcccacctgcagggccgaggctgaggccgggccccggccgggccggggccccgtcagtcgcggaaccggtccccagacggtagtcaggcggtcagtcgcggaaccggctccacagccggggatagcgctcggccagcgcgtcgtcgttctcgaactcgacgggggtgccctccggttcggccggggcgggcgggatgccgaggtcgggggcgaccgtgccggtgagctgctcgtaggcctcgtccgccgcgtagccgagttcctcgccgtcgccgtcgatctcctcgtcgaagtcgtcgagcagctcggcgagcgtgtccgggtcgtgcagcgcgccctcgaacacctcccggccctggccgatcagccagcaccggaagtagtcgaaggcgtcgtcgctcgcgccgtccagcaggacccacgcggcgccccacaggtcccagcggtacgcgcggttgtagcgggcctcgaagtgacgggcgaagtccaggacctgctccggatcgaacccgagcagccgctccacgagcagatcggcctgctcctcgggatccccctcggcggccccgcgcgtcgtgtcgatcagctcccagaactccgtctcgtccatcacgggtcaagcatcggtcctcggacccggggccgcacgcggagtacggcggatcgttacgagccgtacagggcggccaggcgggccgcgtcccgggcgaaccgctcgcgcagcgcccgcggggccaccacctccgcctccgggccgagcgaggtgagctgggcgtgggcgacctcctcggattccaccggcagggtcaccgtcacccacccccgtccgtccggcgcgcccgtggcgtcgagcgccagccgggcggcgaccgggtccaccgcgtgcggcagcctgcgcacgccctcggcggacagccgtacgaccacgtcggcgcgcagcagggaccgggcgaactgctcggcccgctccgcccagaacgcgggcaggtcgaagtcctcctcgcgcgtgaaccgctccccgtccgggacggcctgcgtgaaccggtcgatccggtacacccggtgaccgccggtgccgccgtccgcgacccgcgcgcacaggtaccacacgcccgccttgagcacgagcccgtacggctccagctcacgtgcgacctcgtcgccgtcctcgccgcccttgccgccgcgccggtagcgcgcgctgatccggcggtcgtcccacaccgcgctcgcgacggcgggcagcagctcgggcgtctcgggctcccggaaccaggccggtgcgtccagatggaaccgctgcgccgccgtacgggaggcgtcgcgcacggtgggcagcagtgccgcggacaccttcagacgggcggccgacgcggcgtcctccaggcccatgtcccgcagcgcgcccggcaccccgctcaggaacagcgcctccgcctcaccgcgcgcgagcccggtcagccgggtgcggtagccgcccaccagccggtagccgccggcccgcccccggtcggcgtagaccggcacccccgcctccgacagcgcctgcgcgtcccgcgtgaccgtccgctccgacacctccagctcacgggccagctcggcggcggtcatcggctgccgcgactggagcagcagcaccatcttgatcaggcgggcggcacgcatacggccatcatgccgggggccaccgacagttcgaacgacggtccgaacgacaacgaaggggcacggcgagcgccgtaccccttcgtcacgagacgtcagcccttacaggccgtacttctcccgggcctccttgaccgccgaggccttcacctcgccgcgccgggccagctgggccagggccgcgacgacgatcgactcggcgtccacgccgaagtggcggcgggcggcctcacgggtgtccgacagaccgaagccgtcggcgcccagcgaggaccagtcctgctcgacccactgcgcgatctggtccgggacctggcgcatgtagtcggacacggccagcaccgggccctcggcgccctgcagcgcctgccgtacgtacggcacccgctcctcgccgcgcagcagcgccgcgtccgcgtccagggcgtcccggcgcagctcgccccaggaggtcgccgaccacacgtcggcggccacgccccactcctcggccagcagctgctgcgccttgagcgtccagtggatcgccgtgcccgagccgagcagctggatgcgcggggcgttcgccggggccgtcagaccggccgactccgccgtgttgaagcggtacaggcccttgacgatgccctcgtcgataccggcgccggacggcttggccggctgcggcatcggctcgttgtagacggtgaggtagtagaagacgttctggtcctcgccctcggccgcctcgccgtacatgcggcgcaggccctccttgacgatggccgcgatctcgtacgcgaacgccgggtcgtaggacagcgccgccgggttggtggccgcgatgaccggcgagtggccgtcggcgtgctgcaggccctcaccggtgagggtggtgcggccggcggtggcgccgacgaggaagccgcggccgagctggtcgccgagctgccacatctggtcggcggtgcgctgccagccgaacatcgagtagaagatgtagaacgggatcatcggctcgccgtgcgtcgcgtacgacgacgaggcggcgatgaagtcggccatggaaccggcctcggtgatcccctcgttgaggatctggccgttcttggcctccttgtagtacatcagctggtcgcggtcgaccggctcgtacgtctggcccttgggggagtagatcccgagggacgggaagaggctctccatgccgaaggtgcgcgcctcgtcggggacgatcggcacccagcgcttgccggtctccttgtcgcggaccaggtccttgaccaggcggacgaacgccatcgtggtggccacgctctgcgagccggagcccttgtcgaaggcggcgaaggccttgtcggcggcggccggcagcggcgcgaccgggtggacgcggcgggccggagccgggccgccgagggccgcgcggcgctcctggaggtagcgcacctcgggggagtcggcgccggggtggccgtaggggaccaggccgtcgacgaagtcgctgtccttgatcggcaggtccagcaggtcacgcatctgcttgaactcgtccaccgacagcttcttcatctggtggttggcgttcttcgacgcgaagccctcaccgagggtgtggcccttgaccgtctgggccaggatcaccgtcggggcgcccttgtgctccagggccgccttgtacgcggcgtagaccttgcgggcctcgtggccgccgcgcgagtagtggaagcactcgatgatcttgtcgtcgctcagcagcttcgccatctcggcgagcgccgggtcggcgccgaagaagtcctggcggatgtaggccgcgtcgcgcgtctggtacgtctggatctgcgcgtccggcacctggcgcaggcggcgcagcagcgcgcccgtggtgtcgagctggaacagctcgtcccaggcggtgccccacagcgacttgaccacgttccagccggcgccgcggaactgggcctccagctcctgcacgatcttgaagttggcgcggaccgggccgtccaggcgctgcaggttgcagttgatgacgaaggtgaggttgtcgagctgctcacgggcggccagcgcgagggcggccgtcgactcgggctcgtccatctcgccgtcaccgaggaacgcccacacgtgcgaggcggagacgtccttgatgccgcggttggtgaggtagcggttgaagcgcgcctggtagatcgccgacagcgggccgaggcccatcgacaccgtcgggaactcccacagccagggcaggcggcgcgggtgcgggtaggacggcaggccgtcgccgccggactcctggcggaacttgtccaggtgggcctcggtcaggcggccgtccaggaacgcgcgggcgtagatgccgggagaggcgtggccctggatgtacagctggtcgccggaaccgtcgccctccttgccgtggaagaagtggttgaagccggtctcgtacagccatgccgccgaggcgaaggtggcgatgtggccgccgacgccgtacttggagccacgggtgaccatcgccgccgcgttccaccggttccacgcggtgatgcgggcctccatggcctcgtcaccggggacggccggctcggccgcggtcgggatggagttgacgtagtcggtctccaggagcttcggcagggcgacaccagtgccctcggcgcgctccagcgtgcggcgcatcaggtacgcggcacggtgcggcccggccgccttggcaacggcgtccagggaggcctgccattcggcggtctcctcggggtcgcggtccgggagctggtcgagctcgctcggctggatggcgttggggtcggtcatgtcgccgccttcctcagtcgaagggggttccctcatctgcaagggttcggggggtgccctaggtctttggcaggacagggctcaaggggctctggtgggagcccgtcgccgactgtaactccctgatcgatgatcgatcaaagggttgacggcgaaaacctctcgattccgagaaagtcggcacggggtgcctccggcggtggcacccggtgacctgcgtcgaggggtgtttgcgcaggtgagcgcggtgcggctcgggtgcttccggggtgtggcggctgcgggtgcgccggggtgcctcgcgcagttccccgccgcccctgccaggggcgcggccctaggggcgcggggcgcagcccaggacgtgcgccttcaccagctccgcgatccgcggatcacgccgccggaacgcctgcaccagctcctcgtgctcctccgcgtacgactgctgcaccgtgcccagccagcggatcgacagcgccgtgaacacctcgatgcccaggccctcccaggtgtgcagcagcaccgagttgccggccgcgcgcaccagctcccggtggaagcccaccgtgtgccgcacctgcgcggtgccgtccgccctgcggtcggcgtcgtagagcgcgctcacgtgcggctccagggccgagcagtcctccgccagccgctcggccgccagctccgccgcgatggcctccagaccggcccggaccgggtagctctcctccaggtcggcggcgctcaggttgcgcacccgtacgcccttgttcggggccgactcgatcagccgcagcgactccagctcgcgcagcgcctcccgcaccggggtctggctgacctccagctcggtggcgatccgccgctccacgatccgctcgcccggcttccagcgcccgctgacgatcccctccacgatgtgctcgcggatctgctcgcgcagcgagtggacgacgggcgcggtcatgagggctccttaaagcgggaccctgcggccccctggggcgttgacgcttagacaatacggcggtccgcgcacggcggaagggcgcatgggggcgctttcgcgcaggtgagacgaggcttacacgcagtgatggccaagaaacggcaaacagcggtgcccctgcccgacggcgaacggcggtgcccccgcccggagattccggacaggggcaccgccgtaccgtggggaggggtcgccggcccttacaggcccagctcgacctcgaactcgcccgcctccaggatcgccttgaccgccgtcaggtaacgggccgcgtcggcgccgtccaccaggcggtggtcgtaggagagggtcaggtaggtcatgtcacggacgccgatgaccgtaccctcctcggtctcgatgacggccggacgcttgaccgtggcaccgaggccgaggatcgcgacctggcccggcggcacgatgatcgtgtcgaacagcgcgccgcgcgaaccggtgttggagatggtgaaggtcgcaccggacagctcgtccggcgtgatcttgctcgcccggaccttgcccgccagctcggcagtggccttggcgataccggcgatgttcaggtcaccggcgtgcttgatgaccggggtcatcaggcccttctcggagtccaccgcgataccgatgttctcggtgtcgaagtaggtgatggtcccctcggcctcgttgatcttggcgttgatgaccgggtgggccttcagcgcctgcgcggcggccttgacgaagaacggcatcggggagagcttgacgccctcgcgcgccgcgaaggagtccttcgccttggcgcgcagcttcatcagccgggtcacgtcgacctcgaccaccgaggacagctgcgcctgctcgtgcagggccttgaccatgttgtcgccgatgaccttgcggatccgcggcatcttcacggtctggccgcgcagcggggaggcctccagggtgggggccttcttcgcggcgggcgcggcagcggcgg

SEQ ID NO: 377 - DNA, 7482 bp, Unknown
  Kingdom: Bacteria, Phylum: Actinobacteria, Class: Actinobacteria, Order: Streptomycetales, Family: Streptomycetaceae, Genus: Streptomyces
gggcggcggcgaaagggttcgccacgcccgccgtcccgttcgacgtctacctcgacgaccagggccgcatccgcaagctccggcagagcttcgcctttgtcaacgcccggcagaagggcacggtggaggtgttctccaccacgctgctgtacgcgttcgggacgcccgtgacggtgacgctgccgcacgcgaaggacatctacacgggccgggtggcggagaagtgaccggcgggcgcggccggcgcgggggccggaaatgaccggcggactagcccttccgtgccatgcgcgggccgtgcgcggctccctactctaggtctgttgtcgccgaagcaggtgacgcagagacgaggtgatgcacgtggctccggtcggcggtacggcggttcaggaccacgaggccctcgccgagatcgaactctgcggcgacctgatcatcgccgcttcggcggccggtgagcggctcagcctggagtacatcgacgaggtcctgagagtcaccgaggaacgcggcgccgccccgggccggtgacgcctccgcgggccccgcgcccaggtgacccgtctcacactgccgggccgcgcacgccgtctcaggtgcgcagcagccggccgatggccttggtggcctcctcgaccttcgcgtcgatctccgtgccgcccttgaccgccgcgtcggcgacgcagtgccgcaggtgctcctccagcagctgcagggcgaaggactgcagggccttggtggaggcggacacctgcgtgagtatgtcgatgcagtacgtgtcctcgtcgaccatccgctgcagcccgcggatctgcccctcgatccggcgcagccgcttgaggtgctcgtccttctgcttgtggtagccgtacgtggcgtggtcgtgacccgcgctcccgcccggtgcggtgtcctgcggcccggtggtcccggagggcgccgtggcgccggcctcggtggtcgtcatcgcgtcctcccgctcggaacggaaaacaagctcaaacccagcagacatacccctgccgggtatatcctaccgaatttccccgggttccaaggccctcggaacggcccgggaccggcctcgaaccggcaggggaccggccttggaccgcccccgtgccgactactgtgcctgatgggcgacactgggggacggccccttagccgtggccggatgatgcgcctagcatcaccctgaccgaaaccgatgcaccccgaggaccccttgtgcgctttcgtctgacccccagggagacgagcttctacgacatgttcgccgcgtccgcggacaacatcgtcacgggctcgaaactcctgatggaactgctcggggcggacgcatccgcccgggccgagatcgcagagcgtatgcgggccgcggaacacgcaggtgacgacgccacgcatgcgatcttccaccagctgaactcctcgttcatcacgcccttcgaccgcgaggacatctactccctcgcgtcgtccctggacgacatcatggacttcatggaggaggccgtcgacctggtcgtcctctacaacgtcgaggagctgcccaagggcgtcgagcagcagatcgaggtgctggcccgggccgcggagctgaccgcggaggccatgccgcacctgcggaccatggacaacctcaccgagtactggatcgaggtgaaccgcctggagaaccaggcggaccagatccaccgcaagctgctcgcccacctgttcaacggcaagtacgacgcgatcgaggtgctgaagctcaagcagatcgtggacgtactggaggaggcggcggacgccttcgagcacgtggcgaacacggtggagaccatcgcggtcaaggagtcctgaggcgtccatggacaccttcgctctggttgtgaccatcctggtcgcgctcggtttcgcttacaccaacggcttccacgactccgccaacgccatcgccacctccgtctccacccgcgcgctcaccccgcgcgccgcgctggcgatggccgcggtgatgaacctcgccggtgccttcctgggcagcggcatcgccaagacggtcagtgagggactgatcgacaccccgaccggcagccaggggatggggatcctcttctccgccctgctcggggccatcgtctggaacctggtcacctggtacttcggcctgccctcgtcctcctcgcacgcgctgttcggcggcctggtgggcgcggcgctcgcgggcggtacggcggtgcactggtccggcgtcgtggacaagatcgtcattccgatgttcctgtccccggtggtcggcctgatcgtcggttacctggtcatgacggcgatcatgtggctcttccgccggaccaacccgcacaaggccaagcgcggcttccgcatagcgcagacggtgtcggcggccggcatggccctcggccacggtctgcaggacgcccagaagaccatgggtgtcgtggtgatggcgctggtcatcggcggcgccgagacgtacggcgacccgatcccggtgtgggtgaaactggtctccgcgctgatgctgtcgctgggcacctacgcgggcggctggcgcatcatgcgcaccctgggccgcaagatcatcgagctggacccgccgcagggtttcgcggccgaggcgaccggcgcgtcgatcatgttcggcaccgccttcctcttcaaggccccgatctccaccacccatgtgatcacctcggcgatcatgggcgtgggcgcgacgaagcgggtcaacgcggtgcgctggggcgtcgcgaagaacatcgtcctcggctggttcatcaccatgccggcggcggcgatcgtctcggccctcgcctactcgctgatcgacctcgcgttcctgtaggagccccggttcctgtaggagccccggcacacgccggaacgcacacgggcccgcccccgaaagccaggggcgggcccttctgcgtcctcgcggtggcaccgccatgcagcaccgcgaggggtctcgtccggccgggaccggatcagccgaagcggccggagatgtagtcctccgtggcctgcaccgacgggttggagaagatccgctcggtgtcgtcgatctcgatcagccggcccggctggcccacgcccgccaggttgaagaacgccgtacggtccgagacgcgcgccgcctgctgcatgttgtgcgtcacgatgacgatcgtgaagcgttccttcagctcgccgatcaggtcctcgatggcgagcgtcgagatcgggtccagcgcggagcagggctcgtccatcagcagcaccttcggctcgaccgcgatcgcgcgggcgatgcacagccgctgctgctgaccgccggacagcccggcgcccggcttgttcaggcggtccttgacctcgttccagaggttggcgcccttgagcgacttctcgactacgtcgttcagctcgctcttcttgtagttgccgttcagccgcagtcccgcggccacgttgtcgaagatcgacatggtggggaacgggttgggccgctggaagaccatgcccacctcccggcggacggagaccgggtcgatgccggcgccgtacaggtcctcggtgtccagcatcaccttgccctcgacccggccgccgggggtgacctcgtgcatccggttcagggtccgcaggaacgtcgacttgccgcagccggagggcccgatgaaggccgtcaccgaacgcggctcgaccgtcatcgagatgtcctcgatcgccttgtgggagccgtagtaggcggtgagtccgctcacgtcgattcgcttggccatgactacttcttcacttccgtctcagtcggctgaggggtcggccagcgaccggccacgcggcgggagccgcagattgcgcagttcgcaacgagggacccggtcaacgaggggccttccagcgggcgatgccgcgggccgccaggttgaggatcatcaccgcggcgatcagggtgagcgaggccgcccaggcacggtcgtacgccgctccgctgcccgcgctgttcgtgtactgctggtagatgtacagcggcagcgaggactgcgcgccctcgaacgggttggtgttgatgaacgggttgccgaacaccagcagcagcacgggagcggtctcaccggcgatgcgggcgatggccagcacgatgccggtggtgatgccgccgatcgcggtcggcaggaccaccttcaggatggtgcgccacttcggcacgcccagggcgagcgaggcctcgcgcagctcgttcggtacgagcttgagcatctcctcggtggagcggaccacgaccggcatcatcaggatggccagggccagcgaaccggcgaaaccgaacggctgcatcttgaagatcagcatcaggctgaggatgaacaggcccgcgacgatcgacgggatgcccgtcatcacgtcgacgaagaaggtcaccgcccgcgcgagattgccgcgcccgtactcgaccaggtagatcgcggtgagcacaccgatcggcgcgccgatcgcggtggccagaccgacctgctccaggcttcccacgatggcgtggtagatgccgccgcccggctcggtgtcggcgacgacccccatggagtgggacaggaagtagaagtccaggaccttcacaccgcgccgcacggtcgtccagaccagggagaccagcggcaccagggcgagcaggaaggcgacccagacgaagctggtgaccacccggtccttggcctggcggcggccctcgacccgcgccgtgatgccgtacgtgcccaggacgaacaggacggcggcgatcagcccccactggacccggctgtgcaggccgccggcgagaccgatggcgacggcgacggcgatcgagccggccgcgacggcccacggggtccagcgcggcaggcgggcgccgcgcaggctgccggcgcgctggtcggcgatggctgcggtgctcatgcgttggcccccgagtactccttgcggcgggcgatgatcagccgggccgcaccgttgaccagcagggtgatgacgaacaggaccagaccggaggcgatcagcgcgtcccggccgaactcggtcgcctcgctgaacttgctggcgatgttctgggcgaaggtgccgccgcccgggtcgagcaggctggccttgatgtcgaaggtcggcgagagcacggtggcgacggcgatcgtctcgccgagggcacgcccgaggccgagcatcgaggcggagatcacaccggagcggccgaagggcagcaccgccatgcggatgacctcccagcgcgtggcgccgagggcgagcgcggcctcctcgtgcatccgcggcgcctgccggaagacctcacggctgacgttggtcacgatcggcaggatcatgatggcgagcaggatgccgacggtgagcatcgagcgcggggcgccgccctcccaggagaagacgccggtccagcccaggtagtcgttcagccagccgaacaggccgtccaggtgcggtacgaggaccagggcgccccacaggccgtacacgatggacggtacggcggccagcaggtcgatcacgtacgagacgggaccgctgagcctgcgcggggcgtagtgcgtgaggaagagcgcgatggcgaccgcgaccgggaccgcgacgaccatggcgacgaccgaggagaccaccgtgccgaaggccagcacggcgatgccgaagaccggcggctgcacaccggtgttccactcgaaggtggtcaggaagttgccgtcgtccttgccgatggccaggcacgcgcggtaggtgaggaagaccgcgatcgcgcccatgatcgcgaggagcaggatgcccgatccgcgggagagcccgaggaagatccggtctccggggcgggtggtgccgcggccggcacgcttgtggccggcccgggcggactgcggtggaagtgggggagcgtctgggtctgtctgctgtgtggatatgtccatcgagttctccggtctgcggagccctgcgcggtggcgggctcgtggcggcggtgcaccggacggtgcggcccggcccccggacggggaccggaccgcacgcgggtcagctcaggccctcgatggtggtgcggaccttgctgatgatcgcgtcggggatcggcgcgtagtccttctcggtgaggacgttctggccgtccgcgctggcgatgtagcgcaggaacgccttggtggccggcagggtgtcggacttgttgcccttgtcgcagacgatctcgtaggtgaccaggaccatcgggtacgcgccctcggccttggtggtgtagttcagctgcagcgacaggtccttgccggtgccgacgaccttggcgtccgcgatggccttgctggcgttctcgacggtggccttgaccggggcggaggcgccggtgtcgatggcgaccgtgtgcacgtccttggcgtaggacagctcgaagtagccgatggcgccgttggtctgcttgacctgctgggccacgccggaggactgcggggccgcctggccgccctgcgcctgccaggccttgccgccggagtacttccagtcgttcggcgctgcggccttcaggtacttggtgaagttgtcggtggtgccggactcgtccgagcggtggaacgcctggatcttcaggctgggcagcttcgccttggggttcagcttcttgatctccggggcgtcccaggacgtgatcttgccgtcgaagatcttggccagggtcggggcgtccagcaccaggtcgtcgacgccggagaggttgtagccgaccgcgatcggaccgcccaccatcggcaggtcgatgccctggccgccggtgcagaccttcttcgaggcctcgacctcttcgggcttcagcgcggagtcggagccggcgaaggcgacctggccctggctgaacgcggtgacaccggcgccggagccgccgcccttgtagttgatctgcgtgccgcaggcctggctgaactgcttgacccaggcgtcgatcgcgttcttctgcgcggaagagccgtccgccagcagctgccccttggcgccgtcgcacttgacggagctgttggaggccgcggtgctgcttcctccgcccgcgttgctcttaccgccggtgtcgtccgaaccgcacgccgtgagggccagggcgccggagacggcgaggacgccgagagcgagtgcccgccggttcttgcgctgaagcttcacttgagggagttccttccaggagccgccgtcctgatcggcggcgtgcgaagagtgactggcaccgctgcgcggacgcgcctcagcaccggtaaggccgaaattaggcagaacaggtgaagccgccgatggccggaagtgaacgtggagtgaacccctgccgacggcccggtgaggtcacggaatgctcacggggagaacacgcccgagccgcggaacacagccctccgccgacctccgcccgcacccggcgccgccgacctccgccggcgactccggccactgccaggcccgccggccatgaacgcacgc

SEQ ID NO: 378 - DNA, 1045 bp, Unknown
  Kingdom: Bacteria, Phylum: Actinobacteria, Class: Actinobacteria, Order: Streptomycetales, Family: Streptomycetaceae, Genus: Streptomyces
gccaccgcgcaacgggccggcgatgccgtggcccggcactggggcactgccgtcaagggcgtgcgggccgcgctgaacaccgcccacgccgtgccggcccgttgcgcggtggcgccgtggcgctcggcgcgcagcctcttcatgaccgcgccggtgtcgatggcgaccgggcaggcggtgacgcagagactgtcggccgcgcagctgtcgacggccgcgtaggcgtagtcggcttccagggcgcgtcggcgtccgtcgtcgcctgcggcggtggccagcgcgatctcgcgtcgcagggcgatgcgctggcggggtgtcgtggtcgcgtcggcggtggggcagaccggctcgcagtagccgcattcgacacacgcgtcgacggccgggtcgacctccgggacgctcttgaagctgcgcaggtgggcggccgggtcgtcctccaggaggacgccggggttgagcacgccgtgcgggtcgcacagccgcttcacctcccgcatgacgtcgtacagttcgtcgccgtactggcggcggacgaagggggccatggcgcggcccgggccgtgctcggccttcagcgtgccgccggcgtccaggacgagatcggccatggcttcggtgaaccgtgcgtagcgttcgatctcccgggcggagtcgaagtcctgggtgagcatgaagtgcaggttgccgtcccgggcgtgaccgaagatcaccgcgtcctggtagccgtaccggtcgaagaggccggtgaggccgtcgcaggtggccgtcagccgctccatgggcaccgcgatgtcctccagcagcgcggtggtgcccggtcggcgcgccccggcgacagcggtgtacaggcccttgcgcaggtgccagagccgggcccggacgcgcgggtcgctcaccagtgaggtgtcgccgacggcgggcagccggtccaggacgggccgtacggccgtcatccgctcctggagcagttcggcactgtcctcggcgaactcgaccagcagggcggcctgcgtgtggagccgcaggccgccctgctggtcga

SEQ ID NO: 379 - DNA, 3287 bp, Unknown
  Kingdom: Bacteria, Phylum: Actinobacteria, Class: Actinobacteria, Order: Streptomycetales, Family: Streptomycetaceae, Genus: Streptomyces
ggctaccacgtcggctccggcgagtgggctcacttgccggagccgacgtggtagccgaccgggtcgacgtagacgtcgggcgcgttgccgctgccggtggggacggtgatgcccgagccgttgaggttcacgacgatgaatacggtctcgttgggcggggtgacttcgagccgggtgtaggtcttgctggagttgccggtggccgggatgtagtggagcaggaagcgggtctcctcgccgggcgcgatggtgacggcggacgccgaggtgtcggtgcgggcggcatcggggccggtgtcgcccagaccgtcggggcccagcagcttgacgccggcgaagccgtgcatgctgcacgtgctggagccgttgttcctcatgttgacgacgatctcgttcttgacccccgcggaggaggcgctcaggccgaggtcgtcggacttgcaccgggcgcccgaggccttggaactggcctgaccggtggtcgacttgccgcccgcacgcgaaccggaggaagaacgggaggacttaccggcagaggaaccggaggaagaaccggcagaggagccggacgaacccgaacccgagcccgagccctgggcggaacccgagcccgaagtcgaacccgggtccgaggccgaggacccgtcgccggtggaactctgcgcaccggccgacgcgctcgtacccgaggccgcactggatccgtcaccgctgccgcacgcggtcagcgagaggcttgcggcggtgacgacgagggcgagggcagagagcttcttgacgcgcatcggtactcctgggaagcggtgtcgtcccgctcgttcggaccgagcggggcgctgtcactccataggacacccactgccaggtgatcggatacggcccgagcgcgatcaagacgcccctgtgacaggcgagtcgaaacgccgtgacgagaagacgccgaagtctgcacagacgggacagaacgacggcgaggcgaccggaaaccgtcacgcgggcgggaccggtccggggcttacgatcgagaggtgacgatcacgtacgcgtggcggggcgacttcgacaacgccgctctcgacgcgctccacgccgacggcttcggtcatccggtcgacccgaccgactggagggaacgcctcgcgcggcacagtctcggctgggtctgcgcaggggagaacggctctctgatcggcttcgtcaacgtggtctgggacggaggcgtccatgccttcgtcctggacacggtggtcgcgcggacccaccggaagagaggcgtcggcgccgcgctggtctcggccgcggcccgcgaggcccgcgcggcgggttgcgcatggcttcacgtcgacttcgaggagcacctgcgtccgttctacttcgacgcctgcggcttccgggagacggcagccggcctcatcgctctgtgaggcacacaggcgcacctctccgtcggcgtgggtcgatggggcggacctgggctacgggtgcaccaggaggtgggcgagtgccacgcgcccggtgccggtgcgccggacgcggacgtagcgggccgtgctgtcggtgtccaggacggtgggacgcagtgccttgccggtgacgtgcacggtggtggcgtcggagaagtccgccgagccggcgagctgcacgtcgaagtcggcggtggtcatggcggcgtcgttccagatctcgacctgtccgacgtggtgggcggcaccgaggtcgacctgccaccaggcgcccggctcggagagggtgcgggtgtcggtggaggtgtcgccgtcggtggcgtaggccgccgaggccgtgccgtcggtggaggactgggtggcggtgccggtacgggccaggtcggggcggagctgttcgacgcggccccggccgttcgcgccggcggcctcggcgacctggacggcgtcggccgggagccggtccagcttcgtgtggttgccggtcatggtcgagccggtgccggcgagggccggggcgtcggtgtcggtccagttgccggtggcgtggttgtcgatgccgtagtcggcccagttggagatccacttgtagccgacgcgcgtgatgacgttccgggtgacggcgatgtggctggactgttcgtcgaggtagatgccgttgccgtcgcgttcggtgttcccgtacgcgctgcggtcgatgtagttgccggagatcacggtgccgggctgggcgccctgggtgtagatggcggcgccgtcgtgctgcgcgtgctcgacccgcatgacgtcggtgatccggttgtccgtgatgcggttgtcgcggagcacggactgccgggcctcgggctggttccagccccagccgacggagatgccggagtacgggaggtcgtcgagggtgttgtggtcgatgacggtgccggcctcgtagcccgcccagatgccgacggcgtccgtgtactccacgccggcgcggcggacggtgttgtacgagaccgtgttgcgggcgcccgcgagttcgggggcgggcatggggtcggtgtcgccgatgtacgcggcgccggaggagaggtcggtgaaccgggaccgggtgagtgcggagtcctgggtgccctgctcgaaggtcacgcccgctccgccgaggtgggtgaaggtggcgtcgtcgatcaccacgtggcgtccgccgcggacggtgagggcggcggcgggcttggtgtagtagcggcccgcgtggtccacgggaccggtggcgccggtcagggtgagtccggcctgggtgcccgcgtagccctcgtcggtgttcggctgctggtaggcggcgtaggcgaagccgatgccggtgacgcggacgtcatgggcgccgtcgagcacgagcagcccttcggtgaccggggtgacggctcgggagcggcgcgggtcctcgcccttgcggggcaggtaggtgacggtgtgcgcggccgagtcccagacgaactcgcccggctggccgaggagttctcgggcgttctcgaagaaggccactcccgagtagcgggaggagtcgacggccgtcgagtcccaggcgggtccggtgcggccggtcccggaggccgagttggtccagcagggctgggcgaaggtcatgatgtcgccggtgacggcggtgatgcggcagtggtagttgcgccagcggacgctgatgacggcctcggcgtcggtgggccgcgcccagtgggcgatgccggtcttctcggcgccggtcatgccggtcttcgtggcgtcgcagacggcggcggggcaggcctcgccccgggcgcgtacggcgcgcaggactccggcgtcacc

SEQ ID NO: 380 - DNA, 7970 bp, Unknown
  Kingdom: Bacteria, Phylum: Actinobacteria, Class: Actinobacteria, Order: Streptomycetales, Family: Streptomycetaceae, Genus: Streptomyces
cgccctgctccaccgggtcacccccgtccggtcgcggcgtgcccggcgccgccaggctcgtcggccgcctcagggtccagcccccgcccgcctcaggatccagccggactccgacgcgcccccgcgtcgccccagcgacgtattgactagctctattcaaggagccaggatgtgaatagaagccgtaacaatccctcgggagcaaccgccaggaggcagcccatgtcaggaccccgccccgttcgagcaccgcgcggcacggaactgagcgccctgggatggcagcaggaggccgccctgcggatgctgcagaacaacctcgaccccgaggtcgccgagcaccccgacaagctcgtcgtctacggcggcaccggcaaggccgcccgcgactggcgctccttcgacgccatggtccgcaccctgcggaccctcaaggccgacgagaccatgctcgtgcagtccggccgccccgtcggcgtcatgcagacccacgagtgggccccgcgcgtcctcctcgccaactccaacctcgtcggcgactgggccaactgggaggagttccgccgcctggaggccctcggtctgaccatgtacggccagatgaccgccggttcgtggatctacatcggcacccagggcatcctccagggcacctacgagaccttcgccgccgtcgccgcgaagaagttcggcggcacgctcgccgggacgatcaccctcaccgcgggcctcggcggcatgggcggcgcccagccgctcgccgtgaccatgaacgacggcgtggccatctgcatcgactgcgacccgcgcgccatcgaccgccgcatcgagcaccgctacctggacgtgaaggcaaacaacctggagcacgccctccagctggccaccgaggcccgcgaccagcgcaagccgctctccatcggtctcctcggcaacgccgccgaactggtcccgcagctcctcgccatgagcgcgcccatcgacatcgtcaccgaccagacctcggcccacgacccgctggcctacctcccgaccggtgtcgccttcgaggacatggccgacgccgccgccaaggacccggccggtttcaccacccgtgcccgcgagtccatggccaagcacgtcgaggcgatggtcggcttccaggacgccggagccgaggtcttcgactacggcaactccatccgcggcgaggcccaactggccgggtacgagcgcgcgttcgccttcccgggcttcgtccccgcctacatccggccgctgttctgcgagggcaagggccccttccgctgggccgccctgtccggcgaccccgccgacatcgccaagaccgacaaggcgatcctggacctcttcccggagaacgagtccctggcccgctggatgaagatggccggcgagcgcgtccacttccagggcctgcccgcccgcatctgctggctcggctacggcgagcgcgacaaggccggcgagcgcttcaacgacatggtcgcgagcggtgagctggccgcgccgatcgtcatcggccgcgaccacctcgactgcggctccgtcgcctccccgtaccgcgagaccgaggccatgctggacggctccgacgcgatcgccgactggccgctgctgaacgccatggtcaacgtggcctccggcgcctcctgggtgtcaatccaccacggcggcggcgtcggcatgggccgctcgatccacgccggccaggtgacggtcgccgacggcacgaagctcgccggcgagaagatccgccgcgtgctgaccaacgaccccggcatgggcgtcatccgccacgtggacgccggttacgacatcgccgactccgtcgccgacgagcgcggcgtgcgggtgccgatgcgtgagggtgaggacgcgtgaccacgccggagggcggtcccgccggctcacgtcccgggccgtccttccaggagatgtggcgcgacctcgcacccatcggacggcacgccgactccggcggctaccggcgcttcgcctggacggcggccgacgccgagtgccgggcctggttcgaggagcaggcccgctcacgcggactgacgtacgaggtggaccgcaacggcaaccagtgggcctggctcggcgacccggccgccggggacgccgtggtggccggatcccacctggactccgtgcccgacggcggggccttcgacgggcccctcggggtggtgtcggccttcgccgcgctcgacgaactgagccgcaggggagcacagttcggcaagccggtcgccgtggtcaacttcggcgacgaggagggcgcccggttcgggctcgcctgcgtcggatcgcggctgaccgcaggacagctcaccgtcgagcaggcgcaccggctcaccgacggcgaggggatcacgctgccccgggccatggaggccgccggctacgacgcggacgccatcggcccggacccgcagcgcctcgcccgcatcggcgccttcgtcgaactccacgtcgaacagggccgcgccctggacctgaccggcgacccggtcggcgtggccagcgcgatctggccgcacgggcggtggcggttcgacttccgcggtgaggccaaccacgccggcaccacccggctggccgaccggcgcgacccgatgctgtcgtacgccgagacggtgctcgccgcccgccgcgaggccgaactcgccggtgccgtcgccaccttcggcaagatcgccgtggagccgaacggcgtcaacgcgatcccctccctggtgcgcggctggctcgactcccgcgccgccgaccaggtcaccctggacacggtggtcaccggcgtggagaaggcggcccgcgcgtacgcggaggcgcacgggatcgacctcgacgtggtccgtgagtccttcacgcccgtcgtcgagttcgaccacgccctgcgcgacgaactcgcccgcatcctcggccaggacaccgccctgagggtgcccgtcctcggcacgggggccggacacgacgccgggatcctgtccgggaccgtcccgaccgccatgctgttcgtgcgcaaccccaccggtgtctcgcactccccggccgagttcgccgccgaggacgactgcgtggccggggtgcgcgccctcgccgacgtactggaaggactggcctgcacgtgaccaccaccgagcgcgccgtgaacaccaccggccggacacggacgtactggctggagcacgcctggctcggcacgcacgtcgagccgggggtggcgctcgacgtgcgcgacggtcgcatcgcggccgtccgcacgggggtggccgccccgccaccgggcgccgaacccctgcgcggcctcaccctccccggcctcgccaacgcgcacagccacgccttccaccgggcgctgcgcggcaccgtccaggtcggctccggcaccttctggacctggcgcaaggtcatgtacgccaccgccgaccggctcaccccggacacctaccgcgccctggcccgcgcggtgtacgccgagatggcgctggccgggatcacggccgtcggcgagttccactacgtccaccacgcgccgggcggcgcccgctacgccgacccgaacgcgatgggcgaggccctggtcgaggccgccgccgaagccggtatccgcatcaccctcctcgacacctgttatctctccgccggcttcgggcagccgcccgacgagcaccaggcccgtttctgtgacgggacggccgaggcctgggccgaacgctgttcagttctcaaggaacaggatcacgcgcggatcggagccgccgtccactcggtgcgggccgtgcccgcgcgggagctggccacggtggcgcgctgggccgaggaacggggggccccgctccacgtccacctctccgagcagaccgccgagaacgacgcctgcctgcacgcccacgggtgcacgcccacccggctgctggccgaccacggtgtcctcgggccgcgcaccaccggcgtgcacaacacccacctcaccgacgacgacatcgccctgctcggcaccaccggcaccggcacctgcatgtgcccgaccaccgaacgggacctcgccgacggcatcggcccggcccccgcactccagcgcgccggctcgccgctcagcctgggctccgacagccacgccgtcatcgacctgttcgaagaggcccgcgcgatggagctgaacgagcgcctgcgcagccgcacccgcggccactggacggccgccgccctgctgcgcgccgccaccgaggacggtcacgccgccctcggctgggccgacgcgggcagcctcaccaccggcgccctcgccgacttcacgacgatcgcgctggactcggtcagaacagcggggccgctgccacggctcggcgccgagacggccgtattcgccgcgagcgcggccgacgtgcgccatacggtcgtgggtggacgtcatgtcgtacgcgacgggacgcatacgctcgtccccgacgtgccgtcacagctggccgccgccgtcgaagccctgcgcggctgaaccccatcgccacccccgaggacaccatgagcagcacgaacaccggcaccagcaccctcatcaccaacatcgccgcactcgtcaccaacgacccctccctcggcgacggttcccccatcggactggtccgggacgcggccgtcgtcatcgacggcgaccgcatcgcgtggaccggtgaatcaagcaaagcacccgccactgacaaccgggtcgacgcgggcggccgggcggtgctcccgggcttcgtggactcccactcccacctggtcttcgcgggcgaccgcaccgaggagttcaacgcccggatgtccggccgggcctacagcgcgggcggcatccgcaccacggtcgcggccacccgcgccgccaccgacgaggaactggaggccaacctcgtccggcacctcgccgaggccctgcggcagggcaccaccacgttcgagacgaagtccggctacggcctgaccgtcgccgacgagtcccgcgccctgcgcatcgccgccgcgcacaccgacgaggtcacctatctcggcgcccacatcgtctccccggactacgccgacgatccggccgcctacgtggccctggtcaccggcgagatgctggaggcctgcgcgccgcacgcccgctggatcgacgtcttctgcgagaagggcgccttcgacggcgaccaggcccgcgcgatcctcaccgcgggccgggccaagggactgctcccgcgcatccacgccaaccagctgtcctacgggcccggtgtgcagctcgccgtggagctggacgcggccagcgccgaccactgcacacacctgacggacgcggacgtcgacgccctggcgcacagcgacacggtcgccacgctgctgcccggcgccgagttctccacccgcgcccagtggcccgacgcccgccgcctgctcgacgccggggccacggtcgccttgtccaccgactgcaacccgggctcgtcgtacacgtcgtcggtaccgttctgcatcgcgctcgccgtacgggacatgggcatgacgcccgacgaggcggtctggtcggcgacggcgggcggggcggcggccctgcgccgcaccgacgtcggccgtctggcgcccggcgcccgcgccgacctgctcgtcctggacgccccgagccacgtccacctggcctaccgtccgggcgtgcccctggtgagccaggtgtggcgccgcggcgtccgcgaggtctgagcagaggcgacaaaaacaaacaacgtgaaccggccccctcgcgcggggggccggtttggcgttcactcctcgaccgtcagcgccttgcgcagccgtaccagcgtccgcgacagcagccgtgagacgtgcatctgggagatgcccagctcgtccccgatctccgactgggtcatgttggcgacgaaccgcagggagaggatcttccggtcccgggaaggcagttcggcgatcagcggcttcagcgactcgacgtactcgatgccttcgaggccgtggtcctcgtagccgatacggtccgcgagggctccctcggagtcgtcgtcctccggctgggcgtccagggatgaggcggtgtacgcgttggacgcggccatgccttccaccacctcgtccgcgctcaggccgaggtgctcggccagctccgccaccgtgggggcgcggtcgaggcgctgagccagttcgtcaccggccttggccaggtcgagccgcagctcctgcagccggcgcggcacgcgcacggaccacgaggtgtcccggaagaagcgcttgatctcgccgatgatggtgggcatcgcgaaggtggggaactcgacgccgcgggagagttcgaagcggtcgatcgccttgatcaggccgatggtgccgacctggatgatgtcctccatcggctcgctgcgggagcggaagcgggaggcggcgaacttgaccagcgccaggttgagttcgacgagggtgttgcggacgtacgcgtacgcgtgcgtgccttcttcgaggacctccaggcgctcgaagagcgtcttggacagggcccgggcgtcgtccggggccacttcgtcgtacggcgggatgtccgggaggccggccagcgcggcggacggatctccagccggtgcggcggccctatcgccccgctcggcgcgtacgccgtcgtccaggtcgatgggatcgaggtggtccggagggagtgtcgacgtcgccgtctgggtatgcgaggcgtcgagccggggtgacatgatgtcctccatcgttctcggcatatggctgccgaagccagttcgtgcactgcggtgtgcggcgcctccaaagccggccgtgtcggttacgtgtccctactagccctacccgctttcctgacgcgaccgcaagtgccttctgtgggcatatgtccgtttgtgtgtggttgttcgggtgtcggggaggtcagggaaggcgtagtgttcgagggcgtcagtcagcagccaagactccgggagtgagagacggcatggaccgcgggacggtcggcagtgcacagtcgggccggcttctggtggaagtgcggcaagaaggctccagcgccgtcgtgacaccggcgggtgaactggaccatcacacggccgacctgctgcgtgagccgctcgaggagtgcgtcgacaaggggcgctcgcgcctggtggtggactgctcccggctggagttctgtgattccacggggctgaacgtgctgctgggggcgcggctgaaggcggaggcggccgggggaggtgtgcacctggcggggatgctgccggtggtggcgcgggtgttcgagatcacaggggcggacgcggtcttcaccgtgcacgccacgctggaggacgccctggccggtgagaccggcccggtcggcgggacggacgcggccggcggcgccgacgcgaccgggccgaccggatcagccggcaaagccgactgaaaccgacggcggtgccgtcagcgtgtcctcttccgtactccctgcctactccttcctgctccttccggctccttgctcgcagcggctcctggcggctccgtgcgcgcggcctcgcggtgcgccgtgggatccctccggccggcccgtcggacgtttcgctccgcgagccgcaaacaggggggtgttccgcgggatcggtcgggcaggagtcatcctggaacggatcgaccggtggcgcaccggccatggacgaacgtggtgacttttgaatcgtgaactggtgaatcggtgaggtgaagcgctgatgagcaccacccggccctgttcgccgggcgaccgtggcccggagcccagcggcgcttccggggcgtccgagggggacgtgccggccgacgacgcctccgcagggggtgcgacggccgtgccggcgaccccgtcggggggccgccaggtccgcagactgagcttcgacggcgcgagcggcgtcgtaccgctcgcccgcgacttcgcccgccaggcgctgtacgcg

SEQ ID NO: 381 - DNA, 5249 bp, Unknown
  Kingdom: Bacteria, Phylum: Actinobacteria, Class: Actinobacteria, Order: Streptomycetales, Family: Streptomycetaceae, Genus: Streptomyces
caggacctgctggacgtgctgcgcacctacctcgccaccggccgcaacaagtcccgcaccgcactcctccaccacgtctcccggcccgcgctctaccggcgcctggaggccatacagggccgtctcggggtggacctcgacgacttcgagcaggccgcgtcggtgcacatcgcgctcctcgcgcacgacgcacagcagcggtgaagccggtgacggccgacgggaacggcggcgaggcacggggcggcgccagggtgacacggtggaacgccgcacccccgcggacgtgacaccgtgcacctcaaaagcaggcccgctccctccctacgctcaccccacaccgaccgagcagcggaggtttcgatgagccgagtgatccgtgccgccctcttccagaccgcctggaccggcgacaaggagtccatgatcgcggcgcacgagcaggcggtgcgcgacgccgccgcccagggcgcccaggtcctctgcttccaggaactgttctacggaccgtacttctgccaggtccaggacccggcgttctacgcgtacgccgaacagatccccgagggcccgaccgtccgccgcttccaggcgctcgcccgggaactgggcatcgtcctcgtcctgccgatgtacgaggaggagcagcccggcgtcctctacaacaccgccgcggtgatcgacgcggacggctcctacctcggcaagtaccgcaagacccacatcccgcaggtgcacggcttctgggagaagttctacttccggcccggcaacagcggctggcccgtcttcgacaccgccgtcggcaaggtcggcgtctacatctgctacgaccggcacttcccggagggctggcgggcgctcggcctggccggcgcggagatcgtcttcaacccgtcggccacctcacgcggcctgtccggctacctgtggcagctggagcagccggcggcggccgtcgccaacgagtacttcgtcggcgccatcaaccgggtcggcgtcgaggagtacggcgacgacgacttctacgggacgtcgtacttcgtcgaccccgaggcgcagttcgtcggcgaggtggccagcgacaaggaacccgaactcgtcgtgcgcgacctggacctggccaagctgcgcgaggtgcgcgaccgctggcagttctaccgcgaccgggcgccgggcgcgtacaccccgctgaccgccccctgacccaccacgtccacctgcaaggagtgggagcatgagcagccgtaccgtcatccgcggcggcctcgtcatcaccgccgccgacgagacgcacgccgacgtcctcatcgaggacggccgcatcgccgcactcgccgcctccggcacccccgcggccgaggcgttcacggcggagcggaccatcgacgccaccggcaagtacgtcatcccgggcggcgtcgacggacacacccacatggagatgcccttcggcggcacctacgcctcggacaccttcgagaccggtacccgggccgccgcctggggcggcacgaccaccatcgtcgacttcgcgatccagtccaagggcggcgccctgcgcgagggcctggacgcctggcacgccaaggccgagggcaactgcgccatcgactacggcttccacatgatcgtctccgacgtgaacgaggacacgctcaaggagatggacctgctggtggaggaaggcgtgacctccttcaagcagttcatggcctacccgggtgtgttctacagcgacgacgggcagatcctgcgggccatgcagcgtgccgcggacaacggcgggctgatcatgatgcacgccgagaacggcatcgccatcgacgtcctggtcgaacaggccctcgcccgcggcgagagggacccgcgctaccacggcgaggtccgcaaggccctcctggaggccgaggccacccaccgcgcgatccgcctcgcccaggtggccggcgccccgctgtacgtcgtgcacgtctcggcgcgcgaggcggtcgccgagctgacccgggcccgcgacgaggggctgcccgtcttcggcgagacctgcccgcagtacctgttcctgtccaccgacaacctcgccgaaccggacttcgagggcgcgaaatacgtgtgcagcacacccctgcgccccaaggaccaccaggcggcgctgtggcggggcctgcgcgccaacgacctccaggtggtctccaccgaccactgccccttctgcttcaccggccagaaggaactgggccgcggcgacttctccaagatccccaacggcctgccgggcgtcgagaaccgcatggacctgctccaccaggccgtcgtcgacggacacatctcgcgccgccgctggatcgagatcgcctgcgccgccccggcccgcatgttcggcctgtacccgaagaagggcaccctcgcccccggcgccgacgccgacgtcgtcgtctacgacccgcacgccgagcaggtgctctccgccgggacacaccacatgaacgtcgactactcggcgtacgagggcacacaggtcaccggccgcgtcgagaccgtgctctcgcgcggcgagcccgtcatcaccgagcgggagtacaccggacgcgccggacacggcgtctacaccccgcgctccacctgccagtacctcgactaggagcggtgcccatggacttcggactcgtcctgcagaccgacccgccggcctcgcgcgtcgtcagcctgatgcagcgcgccgaacagaacggcttccgctacggctggaccttcgactccgccgtgctgtggcaggaacccttcgtcatctacagccagatcctcgcgcagacacagcacctgacggtcggcccgatggtcaccaacccgtccacccgcacctgggaggtcaccgcctccaccttcgccaccctcaacgacatgttcggcaaccgcacggtgtgcggcatcggccgcggcgactccgcgatgcgcgtggccggccgcaaacccaacacgctggcccggatcagcgaggccatgaaggtcatccgggcactcggcaggggagaggaggccgacctcggcggcacgaccgtccgcttcccctgggtcgggccgggcgccgaagtacccgtctggatggccgcgtacgggcccaaggccctgaagatggccggcgaggaggccgacggcttcatcctgcagctcgccgacctgtacctcaccgagtacatggtcaaagccgtgaaggacgccgccgtcgccgccggacgcgacccggccgaggtgaaggtctgcgtggccgctcccgcctacgtcaccgccgacgactcgcccgaggcgctcgcccacgcccgcgagcagtgccgctggttcggcggcatggtcggcaaccacgtcgccgacctggtgagccgctacggcgagcactccgccgccgtgcccgacgccctcaccgactacatcaaggcccgccagggctacgactacgcccaccacgggcgcagcggcaacccggacaccgcgttcgtgcccgacgagatcgtcgaccggttctgcctgatcggaccggccgagaagcacatcgagaagctgaacgcgctgcgcgagctgggcgtggaccagttcgccgtgtacgccatgcacgacgcgcgcgaagccgtgatcgacgcgtacggccgcgaggtcattcccgtcgtcaaccccagatagcccaacacccctgtcgattggggccgtccatgaccgacaccgcacccccgggcataccgccgaccgcccaggtcaccctccccgacgggcgcgtggagccagcccccggcgctccaccgcccagcggcccctacgccaacgccgacctgctcccggtcccggtggcgcggcgcacctggaccacgtacaacttctccgcgctgtgggtcggcatggcccacaacacggcctcctggaccctcgcctccggtctgatcgccgtcggcatggactggaagcaggcggtgttcaccatcgccgtggccaacgtcatcgtgctggtccccatgctgctcaccgggcacgcgggacccaagtacggcattccgttcccggtcttcgcgcgggcgtccttcggggtgcgcggcgccaacctgcccgccgtggtccgggcgttggtggcgtgcggctggttcggcatccagacgtggatcggcggcgaggcgatctacttcctggccgggaagctgatcgggagcggctggagcgacgcctcccgcatcggcgggtacgcctggacgatgtggctgtcgttcgcggtcttctgggcgatggaggtcgcgatcatctaccggggcatggacaccatccgccggttcgagaactgggcggcgcccttcgtcctcgtcggcgcgttcgtgatgctgtggtggatgagcgccaaggccggcggcttcggcccgctgttcgaccagccctcgaagctggggtggggagccggcttctggaagctgttcgcgccctcgctgatgggcatgatcggcttctggtcgacgctgtccctgaacatcccggacttcacccgctacggcaggagccagcgggcacagacccggggccaggcactgggcctgcccacgaccatgacgctgttcgcgttcctgtcggtgctcgtcacctccggctcgcaggccgtctacggccaaccggtctgggatccggtgcagttggcggcgaagacggacaacacggtgggcctgctgtacgcgctggtgaccgtgctggtggcgaccctgtcggtgaacatcgccgccaacctggtctccccggcgttcgacttctccaacgtcgcaccgcgcaaggtcagtttccgcagcggcgcgctcatcacggccgtgctcgccgtggtgatctgcccgtggaagctgtacgcggacccgcagggctacatcttcacctggctcggcctggtcggcgggctgctcggcacggtcgcgggcatcctcatcgccgactactggctcctgcgccgcgcccgcctggacctcggcgacctgtaccgcaccggcggacgctactggtacgcgggcggctggaactggcgggccgtcaccgcgttcgtggtgggcggcgtcctggccgtcggcggcgcggacttccatccgctgatcgacggccgtcccatcgctgccctgaagccgctggccgactacggctgggcggtgggcctgggcacgtcgacggtgctgtatctgctgctgtccctgccgggccggcggacccggcccaccggctgaggggcgcgggtacgcggg

SEQ ID NO: 382 - DNA, 4959 bp, Unknown
  Kingdom: Bacteria, Phylum: Actinobacteria, Class: Actinobacteria, Order: Streptomycetales, Family: Streptomycetaceae, Genus: Streptomyces
gtccttggcgagccgcttgcgctccgctgccacgtcgatcgtgccggacaggtccagcgcgacctccgcaccggccaccggcagggtcgccgtcgcggtgaacgcctcgccctcgggctggagccgcagcagctggcggatggcggcctcgtgcggggcgagcgccgtgccgtccagggtcaggcgggccgggacgcgctgccccggctgcaggccctggtcggcgcggaagcggcggacctcggtgatgaccgactggagcgtctcgatctcccgctcggcgtccgcgtcccggaagccgctgtcggccggccactgggcgacgacgagcgactcgccgcccgtgagcgtcgtccacagcgtctcggtgacgaacgggacgaccgggtgcagcagccgcagcgtgacgtccaggacctcgccgaggacgcgcttgctgacctcggcggcctcgccgcccgcctggaaggtggtcttggacagctcgacgtaccagtcgaagacctcgtcccacgcgaagtggaacagcgcgtcggacagcttggcgaactggaagtcctcgtagaacgcgtcgacttcggcgacgacggagttgaggcgggacaggatccaccggtcggtggcggacatcgccgacgcgtcgggcagcgggccgtccaccgtcgcgccgttcatcagcgcgaagcgggtcgcgttccagatcttgttggcgaagttgcgcgagccctggacccagtcctcgccgatcggcacgtcgacgccggggttggcgccgcgcgcgagggtgaagcggagcgcgtccgagccgtacttgtccatccagtccagcgggttgaccgcgttgccgaaggacttcgacatcttcttgccgaactggtcgcggaccatgccgtgcagggcgatggtgtggaacggcggggtgccgtccatcgcgtagaggccgaacatcatcatccgggcgacccagaagaagaggatgtcgtagccggtgaccaggacggagttcgggtagaacttcgcgagcgactcggtctgctcgggccagcccagcgtggagaacggccacaggccggaggagaaccaggtgtccaggacgtcggtgtcctggtgccagccctcgccggtgggggcctcgtcgtcggggccgacgcagacgacctcgccgtccgggccgtaccagaccgggatgcggtggccccaccacagctggcgcgagatgcaccagtcgtggaggttgtcgacccagtcgaagtaccgcttctccatctcctgcgggtggatcttgaccttgccctcgcggaccgcgtcaccggcggccttcgcgagcggaccgaccttgacccaccactgcatggacaggcgcggctcgacggtggtcttgcagcgcgagcagtggcccacggagtggacgtagggccgcttctcggcgacgatccggccctcggcgcgcagcgcggcgacgatggcggaacgggcctcgaagcggtccaggccctggaaggggccgtgcgcggtgatgacggcgtgctcgtcgaggacggtgatggcgggcaggtcgtgacgccggccgatctcgaagtcgttcgggtcgtgggccggggtgaccttgacggcgcccgtgccgaactccgggtcgacgtgctcgtcggcgacgacggggatcgagcggtcggtcagcggcagcttgatgagcttgccgaccaggtgcttgtagcgctcgtcgtcggggtggacggcgacggccgtgtcaccgagcatcgtctcggcacgggtggtggcgacgacgatggtgtcgtccccgtcgccgtacttcatcgagaccagctcgccgtcgtcgtcctggtactcgacctcgatgtcggagatcgcggtcaggcagcgcgggcaccagttgatgatgcgctcggcgcggtagatcagctcgtcgtcgtagagccgcttgaagatggtctggacggcctgggagaggccctcgtccatggtgaagcgctcgcgcgaccaggcgacgccgtcgccgaggcggcgcatctggccggagatctgcccgccggactcgcccttccacttccagacgcgctcgacgaacgcctcgcggcccaggtcgtggcgggacttgccctccttggccagctcgcgctcgacgacgttctgcgtggcgatgccggcgtggtccatgccgggctgccacagcgtctcgaagccctgcatgcgcttgcggcgggtgagggcgtcgatgagcgtgtgctcgaaggcgtggcccaggtggaggctgcccgtgacgttcggcggcgggatgacgacggtgaacggcggcttgtcgctcttctcgtccgcctcgaagtagccccgctccacccagcgctcgtacagcggcccctctacgtcggccggcgcgtactgggtcggcagttcggtgtcgggcgctggtggctgctgctgagcgttctcggtcacggggtcagtttagaggcgggaacctccctgacgaaaagccagggtttctgccttccgcaatcattcgggtggtagggctggtgcccggccgggtcaggtgtgacagcggcaccaccgtcgtgatccgccctgctcaaagaaatcaggggcggcagctacacctctgccttggctcgcctcggcaagggtggcccggttcagggcgctactacgcgcttcacgccttcgttacaccggcacgcagccgtgcgcgctggtgaaaaccatggcgttcccgctggcccgtggaccatccgggttgggctcgtagatacttcacccggacctcagtaccgggtgctaccgggacgaaagccccgtcgttgacggcaagggtgtgaatgttcaccccgcccactacgtcccggtgcagcacccgggcgcagtccatgttcgcacacacatatgtccgccctcgcgccttccgtcgactcaggcaaaacggacatgtctgcgaggaattcacttcgctgacgtgctggatcggtactccgaccttgtaggaaagttgccgctcctgtgtgccgcgctcccactgcgacagctgttgcctggttgaccgtgtcgcgcggcgccgcctcttcgtgctcctttcgatgcctcggacgtcaccagcaaccaccctgagtctcacgttgacgccatcggacagtgttgccgtgtgtgccgccgcttgctctcggatgaaacggttggctttggcggtgacctgatgattgaagtcgcgcagtcgacgcttggccctggcccttaccttccgcttagcctcgcggagccgccggtgtcggcgcgatccagttcgacagcgggaaatccgggcctgcaactcggccacccccttgttccgctcctgcttgatcgcccgagcactgcgcccgttcagcaccaggacctcgtagccgccgtcgggggcgacagtggcaagcgtcatcgggttgatgactccctcgtcgatagcaacagtcagaacgcgctctcccggcccagcgcaacgacccagccctcttgaatgcgacgcactcggcagcccgtcatcgaacgaccgatacgagatgtgcagggcccagcaccgggtcactgcgtcccagcacagcttcatctcgccccaccggtcaggcgggaccagtaggccagacctgtccacgagctccggaaccgggagcactagccgcccttgggaacgaccgagagagagagaacgagacgcgcgtcgtctttgaccttccatccgaagcgagcggagaagacgaggggtcggtagcgcttctggcgccaaggaaaccgcacgcccctcttcccctgagtcttgttggctcgcgccaggtcgatggcgtccgcaaggtcataggccacagcctgcgcggtatgcgcatgaacagggcgcatatccatcggtagggaggtgacgtagcgacgaatgtcctcccggcctggcgccctaccggcccgccactcctccctcgtccatgccacggtccgattccagagcagagctgaggcatggcacgccgcatgggcccgcgcgtgatccacacggttcagccatacggggacgactgccgtgaggacccgggtcccaggggtcacaaccgcgccactcctcacgaaacaccctccgtacatcagaactgcgaccacacgtccttgcgataactgatccaacgacgcagggctgcttcgggtcacgcttcatgtcacaacgacgccgtgaacctgaaggaagttcgtaacgatgcaccccccgtatgcccttgcgggtgtgcgctccgtcaagatgttcggaacgcgtaagcaacggaggggacacagagttccatgagcttcaaccagccgggcccgtacggcgggcagccccagcagcccggaccgtacggccagccgggcccctacggccagcagccgccgcaggcgccgcccgcgcagcccggctacggctacccccagcagaccccgccgccccagccgcagccgggctacggctacccgcagcagcccaaccagccgggcccgtacggccagcagccaccgccgggcgttccgccccagcagggcccctacggccagcagccccaacccccgtacggccagcagcctccttacggcggcatgccgcagcccccggccgccggtggcggcggcggcaagaagacggcgctgatcgtgggcgcggtcgctgtcgtcgcggcgatcgcggtgggcgcgtacttcgcgatcggcgggggcagcggcagcggcggcggctcggtcgcggacgacggcccacacaagctggtgctcccggcgacggtcggcggctacaagaagtccgacagctccggctccgacgacggtggcccgaccggcgccaacagcgcggacaagctgaaggccctcgggatcgagaacggtcagacggtgaagggcggctacggcccgaccgacctctcgaagatcggaaagtcgctgctggtcaacggcgcttacggg

SEQ ID NO: 383 - DNA, 17067 bp, Unknown
  Kingdom: Bacteria, Phylum: Actinobacteria, Class: Actinobacteria, Order: Streptomycetales, Family: Streptomycetaceae, Genus: Streptomyces
tgagccggcaccgccctggccgacgccgggcggctgcgggccagggcggtgccggctcaggcgcgggcgcaggaactgcggttcgccggcgccgcgttcgacgcgtgcgtcagtcacctggcgctgatgctgatgggcgacgccgagcgggtcgtcgccgaagtcgcccgggtgctggcgccgggcggccgactggtggtcggcgagttcttcgaccgccactggatcgccttcggccgcctgcaccgactcgccgacaccgcgggcctccacctgaccacccgccggggcccgacactggcgtacctggcccggttccacccggcggaggcgcaccgctgacccggctgcccgtgccggaccggcgcacgcgggtcgatcgatcgcgtcagcggcggtggccgccgccgtggccgtggtcttcaccgtcgtggccgtcgtggccgtcgtggtcgccctggccgacgatcgtccatggacgcatgaggtcgtcgtcttcgtgttcgaggaggtggcagtggtggacgtacgtcgccggcaactcggcgccgctgcccggaatcgacgcgatcgtttccttcggcgggacgaattcccggatgatgatcctggtcaccatcttcgcatgggccttgaccgtgtccttgtaggacagcgcttcgtccggttccggcggaacgggtgggccggtgaagtatttcgccagcaccggccggtcctccggtttgcggctgccgtagacccacctgtcgtaatccgcctggtagcgggccgcgtcgatcggctgcctgttcagcacctggaagttgacgaggtggacatgcatcggatgggcgtcatggttgggattgatgtactcccagatctcggacgagccctcctcgatgaagtcctgggacggttccatgaagggcaccgcgttgaacgtcatggtactgaaaagctggtgctggtacacgacccattcccgccgacgggtgtgcggttccggctcgatgggctcgacggccggcagcctgagtttctggggcggcctcgtgctgtccccacctccggacagcggcttggtgacctggaattgcatgatttctgcgatttccggtccgcagccggtgattccggggaagtggacctgcgttcccgggaagttcgtcaaggtgacgttcgtgcccatgggcagccgactgaagtcgacgatgaggtcgtaccgctcggccggactgatcaggaaatcgagcatgtgcagcggggcgcggaagccgccgtccgtgccgatgagccagaacggcagttggggctcaagaagcacatccctgggaacgtcgaaccgcagtcgccagaaacgctcgttcgaagcgttgagaatgcgcagccggtagcgtctcggctcgacggccaggaaagggtacgccttgccgttgacgaccggggtgtcctcgccttcccgctggtccatggtgtaggcgagcgagccgtccgggtggaaggtccggtcctgcaggacgagagggacctcgaattcgccgcgcggcagcccgagccgctcgtcggcgggttcacggatgaaatagagaccggcaagacccgcatagacgttgaggctggtcatccccatgccgtgatcgtgataccagagcatgcacgagtggtcgtgattggtgtagccgtagatcgcttcgttgggttcgacccgggccgggtccagagtgctgtaggactcggcgtgaaaaccgtccgggctgtacgactgcaacggcatgccgtcggactgcggtgccgtgtaaccgccgtgctggtgcacgacgttccacacgttgatgttcggggggaagggcgggacgctcttgtagggaggcggggcgatcggggcgagctgtgggtcgccgttccggatcttgtcgatgacgggctggaacatgtgggtggtcggcagctcgttgcgccacttgacgaccgtcggacggtcacgcatcgtattgatggtcggcccgagatagcccatgccgatcggcttgtggggggcgcgcgggtccgtggcccagtaaccccagacaggtgacggcgcgagatcccggtgaaatcgccacgactcctgccgcatggtgatctcgtagtagtcggcgcccggatagacggaaggatccgggatcgctgtcaccggcctgggcagcgggtcgacgtacttcttcagcggaggggtgttcagtcccggggtgttcgcgcaccctgccggcgggtggtcagccgccgcatacgcccgcacccccagaacaccctgcgaaagcatggccgcggcccccatggtgccggccgcgaggaatttccttcgctcaatcatcgtctccagccttccatcgccccgcataacagccaagagatacaggggcgattcaggcgtgctgttgcggcgcgcgggccccgcccgacgcaggccactcattgagccgatctcgatggaaattcagccgacattacatttggaatcgaattactaccgtcagtccgatccggggctcggggacatcgccgccggggcggtgaacagcgcgtggacagcggcgcgtacctggtcggcgaccacctcggggctggaggcgtcgagcttgccgtcgaggtgcaggaacgccagaccgtggacgagggcccacaccgtgatcgacagcgcctccgcgtcggcgccggggaatgcgccgcggacgatgccgcggacgtactccgagatggcggtggtcgcgctgagccgttcctcgctgctgggatcgcagggctccgcgaacatcacccggaacagcgccgggcggtccagcgcgaaacggacgtaggcgacggcgaccgccgcgagttcgtcgggagtcgcgggcgagggatgcgccgcggccagatactcggcgagttcgcggtagccctgcgcggcgaccgcggagaccagcgcgtcccggtccgcgtagtggcggtagggagccgtcgcggacacaccggcccgccgcgccaccgcccgcagggacagcccggcactgccgtcctcctccagcagttcccgcgcggcgcgcagacaggcggcacgcagatcgccgtggtgataggcactgcccgctcgcgacataggtcacactccctcatgtttacggcactcacatcgctgccttaatgtgaacgctgcatacatcgtaagcgatcgagatcgagagggaaactcggatgaccagcgagctgttctcggccctgtccctgcgctccgggcacgtgctgaacaaccggatcgccaaagcggccatggaggagaacatggccgccgacggccagctcccgggcaaggagctgttcgggctgtaccggcgctgggccgccggcggcaccggactgctgatcaccggcaacgtcatggtccacgccgaggcgctgaccggtccggccggcgtggtcctcgacgctgccgccccgctggagccgttcgtcgagtgggccaaggccggcaagtcgggcggcggagcgatctggatgcagatcaaccaccccggccgccagatcggctccgagatgcccggagtcgtgtggggcccgtcagcggtcgccgtcgacctgggcaggcacagcagccgcttcggccggcccgtcgccatgaccccggagcagatccaggccaccgtgacccggtacgcggtcaccgcccagcgcgccgagcaggcgggcttcgacggcgtggaggtgcacgccgcccacggctacctgctgtcgcagttcctctcccccctggtcaacaagcgcaccgaccagtggggcggatcgctggagaaccgggcccggatgctgctggacgtcgtccgcgcggtccgcgccgccgtctccccgtccttcgcggtcgcggtgaagctcaactccgccgacttccagcgcggcgggttcgacgccgacgacgcacgccaggtgatcgagatgctcgcgccgctcggcgtcgacctggtcgagctgtccggcggcagctacgagagcccggcgatgtccggccgccccgccgacgcgcgcacccaggcccgcgaggcgtacttcctcgacctggccaaggacctggtcagcaccagcccgctgccgctgatgctcaccggcggcatcacccggcgcgagaccgcggaacgcgtcctcgaaagcggtgtggcgatcgtcgggatgggcacggccctcgccgtcaccccggacctgcccgcccgctggcgccaggaccgcgaggccgacgagcggctccgagcggtcacctggtccgacaaggccctcgcctcggccgccggcatggctcaggtccgccaccagatgcgccgcctcgcccgcggcagccgccccacgccccgcacccatccggtgttcgccctcgtctgcgagcagcgccaacagcgacgggccctgcgccgctaccgcagctggctggccgcgtcacagggcgccgcgtgagtgcggccctccgatgggagcgccgtcagcgatctcgcgcgaggcatgacgaagccgggccggcaccgccgcgagggcgttggcgggcccggcccgggagtcgccgcacacgagggagcggctgaggcggacgagggagcggctgcgcgacttcctcagctgccgtgcagcgccgtcctcaagaagtcgacggcgatcttgcgggcgatgttggcggcgcgggtgtcgcgcaggctgtccaggaggaggaagtcgtggaccatgccggccacccggaccgaggtgacgtccacaccggcctcccgcagcttgttggcgtactgctcaccctcgtcgcgcaggacgtcggcctcgtcggtgatgaccatggtgggcggcaggccccggagttcctccagtgatgcccggagcggcgaggcatgcacttcggcgcgctgggcggggtcggtggtgtaggcgtcccagaaccacttcatgccgtcgcgtgtgaggtagtagccctcggcgaactgcaggtaggagggcgtgtcgaagtcggcgttggtcaccgggtagagcaggcactgggccttgaggccgatgccgccgcgctccttgttcatcagggcgaagacggccgacatgcagccgccgaccgactcgccggtgacggcgacgcgtgaggtgtccaggccgtgctccgcgccgtgtttcatgacccactggcccacggcgtagttctgctccacctgggtggggtacttcgcctccggcgcccggtcgtagacggggaagacgcccgcggcgttcgcgccgacggtcagttcacggaagagacggtcgtgggtcttgtcgtccccgaagacccagccggcgccgtggatgtagaagagcacgggcagcggccccgtcaccccgttgggccggatgacgcgcgtacggaccgtgccccactcgccggcgtcgacgtcggcccattcctcgtcgacgtcgggacgggccacgcccgggccgctctgcaggtcgagcaggatgtcacggccttgctccggcgggacctcgtagatccgggggtgcggatcggtcgcctccgccagctccttcgcggcgggttcgaggtacggggtgatcggcggtggaagatcagccatgctcactcactccacgtctcgggcacacgagtgccccgtcgtgcggcctgacggacggccgctgctggtgacggtcaccccccggacggaactcccccgatccatcgttggcgcacccaccgcaccccgcaaccgccacgcaccggccccgccgaccgagatcgggccggccacctgtgccggtcgtccactccaccgtgcccgggcggacggccgccggccacggaagccgccgcggatgtgagactacgaggatgcccatacagttcgtgaccgcagccggtgtcctggcggtgccggccatggtcccgggccggacatgggcgtcgtgaccaggcgtaccgtggcctccggccggcaggacggcccgcgaaccgttgtcctcgtacacgcggtgctcaccgcggtccggctcggtgggtatgtcctgctgccggccaaggcgcgcgccttcttcgagaggccggccgtacgcggggggatggaccgcgtcaccggagccgtactgttcggattcgggctgaaggtcgccatgaccgagccctgagtgtgagtgctgcggcccacgcagcgaccgcagttgcgatcatgtaccccgcccggagcaccaacgtgaccggccctgggcgcccggcgaacgcgtccaccagaagaggatcagcacggcgatgaacgacgacccggtactcgacgacccggcactcgacgacccggtgggtcagtcgctcggcggtcggcaccggcatctggcacggcggctcggccgggccgccacctatctcaccggagcggcgacgttctcctccgtgtccgccgatccggacacggaggactgggccgacctcgcgcggttgctcggtcccggcgctttcgccgacatgttcaattgcccggctctcccgccctcggcctgggagcccgtcttcagcctcgaaggccggcagatgatctggcccggcgacggccgccccagtcgctccggcaccggcaccggcaccgacgtagtcgaactgcgcgcggacgacgtagccgagatgctcgatctcgtcgcccggaccgagccgggcccgttctggccgcgcacccaggaactcggcacctacctgggtgtccggatggacgggactctggtggcgatggcgggagagcggcttcggcccccagggtggaccgagatcagcgccgtctgcaccgcacccgaagcgcgtgggcggggttacgccacccgtctggtcgcggcgcttgccgaccgcgtcctggcgcgcggtgaacgccccttcctgcatgtggccgagacgaacaccggcgcgatcgccttgtacgaacggctcggtttcaagacccgcggggcggtcaccttccgaggcttccggaccccctgacggccagccccgggcgggcgcccgaagcggtcagcggtcgggctgccgtagatctgcttcccaagcaggacgcccgcgtggtgtcacatgaccggccatacctgtctcggtcccgaagcaggtcgcgtggtgccgcggggtcggtggcgatgacgtggacgcgggtgcccggtgacgtgccgccgatccgctcgcgcaggcgcgcgacggctccgcaggcgtcgccgcaccgtctccggtggacagccgactgctctgctcggtccgggtcggccgacgcccgtcatcgtgagccatacaggggagtgataggggcattcggcccgggcccctaccggcgaacgcggcggcttcctacattggcggcggcccgccgtcacctgcgacgccgcacccgtcagccgcacccgtcggccggcacccggcacccggcacccggcacccggcacccgaaggaggagtcgtgcacgaactgcaggcgctgttgagggagtacgaccgtgcccgcggttacaccgacgagctgtggcgggacctcacccccgacgaggtgatctggcgtccacgcgaggacttcagcgccatcgggtggcacctgggccaccaggcccacgtcgcccacttcatgatccgcaatctcaccgcggccgaacccagccccgatccggccctggacgcgctgatggactccgcgttgccggaacagttccggggcgcccttccgaccgtgcgacggctgaccgcgttccgggagaccgtcgccgagcgggtgcacgcccgtatcggtgacatcgcggccgggaaggtcggcgctcccgcacagatgaccatcgtcgcgacgcatctgctgaccgctctcatcaaccacgagtaccagcacgaccagtggatcggcgaggtccgcgccgagcacctcggacacgccctgcccactgacccggattccgaccaggtccgccgcgtcgacggctacctcgtcctggacctctgcgtgtgacggttcatgcgacgcgcggagagcggccggccggacgtgatcggggtgacgtgaagtgatgtccgtcatctcgctgttccgtccgtcggctgtgttcacccggcgcgtccggtcacggccctgcctcctcaccctgctgtcgctgctcgtcgtgatgagcgcgtgggagtgcgggacacgtgccctctcggccgacgacctcaccgtggcgtcgaaccgtgcggccgtgaccatgcccacggaaacgatcgctcacgcgtcaccggcgcaggaacaacgtcacggcaccgtcgaagcggtgcggcacgactccccccagtgcgagacacccggcagtccggctccgtgccggaaggcgctccccgcacagccggacgtgcgcctcccggcggcgccggacaccgtggtgcaaccggtcgccctggtcgttcgccagccggctcttctacggcgaccgcgacctcctggtcaccatcggcggctggaccgtgatcgcgctgggagtcgcgcagatcctcgggctcgggttcggcgttcgccggctccagcaggccgcgggcgcgcgccgttccggatcggccgtctccgtcttcgccctcggcaccgtctacggcctggcgggcttctgcgccgggcccatcctcggctccgtcctgaccctcgcggcgctcggcggccgacccgtgcacgggggcctgctgctggccgtctacgcactgggcatggccgtccccctgttcgtcctgtccctgctgtgggacagcttcggcctcgggcacaagcgctggctgcgggggcgcaccctgcgcctggggcgcttctcctggcacaccacctccctcaccggcggggtcctgttcgtgctcctcggcgcggtcttcccgctgttcgacggcacggcggccctgccctccccggtcagcgtcgagacggaggcggggctggaagagcacctggcacgcctgggcggcgccgtaccggaccgcgtgctcctgctcgcgctggccgtcgcggtcgcgatcaccgccgtcgtcctgccggcacgccgtgacggcccgcgcccggaagacggctccaggcccctgcccccgcacggctcctgaccacggcggagccgtcccgtcccgaccttcacccaccgagtcgactaccgaggagtgccggcacgtgagcgcgccagacgacatatccatgaagccggggcaggcacccgcgaagccgtggcagacggacgcccgggtcagtgccgtgcagaagcgtacggtccgggtcctggccgcggcgcagatcgtcggcggggtcggcgtcggcgtggcggtgtcgatcggcgccctgctggcggagtcggtggcccagagcgagacctacgccgggctgtcccgtacggccatgacggccggcgccgccggggtcggtgtccccctcgccctggtcgcacagcgggccggacgcaggacctcgctgagcctcggatggctcgtggccgccctcggcggggcactgctcgtaggggcggccgtgagcctgtcgatgcccctgctcatcgtgggcatgctgctgttcggcgtcggcagcgcgacgaaccagcagagccgctacgcggcggccgacctggccgctccccaccgccgcgcccgggcgctgtccatcgtggtgtggtccacgaccatcggttcggtgatcgggcccaacctggccggtccgggcgccgccgtcgcgtcggccctgcacctcccccgactcgccggggcgttcgtcctggcgaccatcggcatggcactggcagcccttctcctgtggggcctcatgcgccccgacccgctgatgctgtccctccagtaccaggacgccgaggagcggcaggagcgcgacgcgggcaccaaggcggcgccggcggacggcaccgcccaggagaagaagccccggagcaccgggacactgcgcgcgggcctgcaccaccttcgccactgcccgcgcgcggcgttcgcgttcacggccatcgtcctggcccacacggtcatggcagcggtcatgacgatgacgccggtcagcatggagcagcacggcaccggtctcaccgtcgtcggcatcaccatcagcagccatctggtgggcatgtacgcgttctccccggtcgtcggctggctggccgaccggatcggtcacctctcgacggtggtggccgggcaggccgtcttcctggtgtccgccgcgctgtcgggcatgggccacgactcggtcggcctgatgacggccggcctgttcctcctggggctggcctggtcgttcaacctggtagccgggtcggcgatgctcagtgaggccactcccgctccgctgcggcccggagtgcagggcaccgcggacaccgcgatgaacgccgtcgcggcggtgggcgccggtctggccgggcccttgatgggctggatcggcttcggcgggctgaacgccgtcgccgcgatcctggtcctgcccgtgctcgcgttctgggccctcctcgcccgggcgcgctgaagaaccgtcgtacagccgccccggtttcctcgggacgcccggtgggcggcccgttacgggcgccgggcaccgggcacccggcgcccatggcttccatacagcgaacgctcggctcacgaggctccggccggggggcggccgcgtccgtcgccatcggtgccgcggcaggcgtgacggccgcggccggccttcttctcggccgtaaggcggccacgatcagcaagatcggcaagggacatccgctcaagcaccgcgcactcgacgtggcggccggggcgatgcagtcgaagtacccgctcgacgcgatgagcacctacctcaacggtttccacatgtacgccgacgacatggggcggcaggtggaggcgacgcacttctgcatccacctccagcacgacctgcaccagtgcgtgatcttcgaccgcaacgcgcccgacgcccggctgatcggcatcgagtacatcatcagcgaggaacgtttccgctcgctgcccgcggacgagaagcggctgtggcacagccaccactacgaggtgaagtcgggcagcctggtcgcccccggtatccccgatctggccgagcacgcctacttcgaggacctcgtgaccacctacggcaagaccttccacacctggcagtacgaccgcgacgacttcccctacggcatcccgcagctgatgatgggcttcaccggggacggacaggccgcggacgcgatggtccaggcccgggacgagcggctcggcgtctccacctccggcaagcggcacaaccgggcggacatccccatgccggaagtggccccgggcgccaacatgtgggagaccggcaggaccgtgcggacccgcgtcgaagagacggacttcaagcgctgacggcgccggccgtgtcagtcggaggtgacgccggagccgtacagcgccgaggacaggacagcgtgcgcggcgcgctccccggagtgcagagcgccctcgatgtgtccggcgtatgcggtggccgtctcggtcgaagcccagtgcaggcggccatcgagtgccggccgctggtagcgggggtgtccgaagagggagtggtcggcaagggcgtgcacggaccgcggcgccgtccaggactcgcggctccagtcgcgcacgtgcagggcctcgggtgacgcggcggcgggcccgaagcacgcggcgagctgggcggccaccgcgtcctcgaagcccggccggacggcgcgggcgggggcgaacccgaagagtgccgccggccggccgtcgacgccggacatgtcgtggatctcctgaagcggtccggatctgctgaaggccgcgccggcgagaccttcctggcgccagaaggcggaggagtagtgggcgacgactttggcgactgtgcccatccataccggggtggagcgcgccagccggacgatgtcggcggggagcgcgtctgcgaagtcgatgcgctccagcgccagcgcgggcgggacggccaggacgacatgggcggcccgcagcgtacggtccggggtgtgtacctccaggccgtcctcgccgacggggtggacggcggtggcgggtgtgtccagcaggacggcgtccgggggcaggctcgccgcgagcgccgagggaaggtgctgcgctccggcggcgaaacggtaggacgggacgtcgatcatgttgccccgcaggcggcgggtcccgcccccgtcctggaggacggcgtcgccggacaggtgctggtcgaagactcccgccccggtgcgagcggccagcgtggcgacgcgccgctcccccggccagaaccaggtggctcccagatccagggtgccgccgccgacgggggtggtcagcatgcgcccgccgacccgcgtccgtgcctccaggcacaggacacggagtcctgcctcgtggagggcggtggcggcggtcagtccggcggcgccggcgccgatcacgatgacgtcaggactggcgctgcgggacatggacgggttccctccgggaggacgtgcgccggcgcgaccggggttgcgtggcggggcatcgaagacgatcgggtacggtcacgacacctgcgccggatccagcacgatccggaatcggggggccgcggaccgcaggcgtgagacggcctcgccggcgtccttcagcggcatccgttcgatcatgggacggactccgttggtgacggcgaaggccatcgcctcctccgtgtcccgggcactgccggtcaggtgccccgtcaccctcagcgctcggctcaccagcaggcccaccgggagacgtacagcgccggcgtccacacccaccagggtgagcagaccgtgcgcccgcagcccggtgaccagttcgtccagcgcctcggtggaggaggcggtgcacacgatgtggtcggcgccgcccagttccgcgagagccgctccgggggaccggcgcgtgctgtcgatgtagtgccgggctcccagaccgcgcgccagttcctcgcggtcggcgccccgggcgacggcgaccgtctcgtggccgagccgggccgcgaactgcacggcgaggtgcccgaggccgcccagcccgaagacggccacccggccaccggcccgggtaccggccctgcgcacggcgttgaaggtggtcacccctgcgcagccgaacaccgcggcgtcgaaggggtccaggtcgtcggggatccgcgccaacgcgtcggccggcacggtgatgctctgggcccagccgcccgggtaggacagccccggcaccttccgctcgggacagtgcacgacatcaccggcacggcagaaggcgcagtggccgcagctgccgccgaaccagccgacggccacccgctccccgaccgtccagccggtcacgtggtcaccgacctcggcgatgactccggcgacctcgtgtccgggcgtcacgggcgcgtccgcgtgtgccttcgcggccctggccgtaccgatgtcggcgtggcacaccccactggccaggacggacacccgcacctgatgcccctcaggcgggacgacggcggtggcggacgggaccagcgggccgtccggctcggtcacgaccatggtcacagcggagtccggcacgatgcacttcctgaaggagcgatggcagatgttataagggtgggtgatgacgaggtcacccggcgcacacactagacaccggtggacctgagcgggtaggcgacgacagcgaatggggcgataggccatggctatgaccgaacggctgaacgccgaagggctccgctacgcgcaggcggtcgccgagacacgatccttcagcgccgcggcacgggcctacggcgtcacccagcccgccctgtccaacggcatcgccaaactcgaggaacgactcggggcgaggctcttcgaccggtcaccgcgcggtgtcacccagaccgcgttcggcacccgcatcctccccctcatcgagcgtgccgtggccgccctcgacgccgtcgccgcagaagccagacggctcaccgaaccgggtgaccagaagatccgcatgggtgtctctccgctcatcggcccccacctggtggcccgcgcgttcagcgcggtccgggagctgcccacgccccgcgatctggtcctgcgcgaggccaacatgcaggacctgcgggacggccttcgggccggacagctcgacatcatcctcatcccggccgtctccgcgatgccgcgcttcgagcaccgggtcatcgccgtcgaacccgtcgtcgtcgtcggccccaccgccgaggacgactcctcgctcgaactcgccgaagccggaggcgagcagttcatcctcgtgcccgacgcgtgcggactgaccacgttcaccacccagctcttccacgcgaacgaagtgccgctgcgcacctacccgggggaagcggccagttaccgcgtgctggaggaatgggccggcctcggactcggctcggccatgctcccccggtccaggctctcctccccggccgtcccccaccgccccctgctgaacgacggccgggaggtacagatctccttcgaggccgtgtggaacccggaatccgcactgcgctcagacctgtccctcctcgcccaagcactcgtcgcctcgcgctagccatacgcgacacttataaccagattcaatggccgcccctaccggatctttcggcgtgctcctaagttcgggctgtgctgcggtaaccccgtagcgcatccgacgagcacgaaggcgagccatagccatggcctatcttgagatcaccctgcacgtggacccggccgaccgtcccgcagcggcggccgtctacgagaagtacaagcaggcgttcctggactccgtcgccggcgccaccagcaaggaactgctgatccgggacgaggacgtgcaggtgctccacggcttccgctccgtggcggacgccgacgcgtacctgggcagcgccctgttcaccaaggacgtcgtcggtgaactcgcgccgctgctgcggacggaccccgacgtccgcgtctacgacaccgtctgacacccgcacacggcgaactcgccggcgaaggagcacaacatgagcgatgtacgcgtcaccccgtggcaggaaggcgacgcccccgcgcccccgcccgaactgctcgcgggcatgcggggccgccgcccggacggcgagctgatcggaatcgaccgggtcctgctgaagagcttcccgctcgccacaggatggaacgggctgctcggccgcgtccgcgccgaattcggcctcgaactggagtaccgcgagctgatcatgctgcgggtggccgtgctgaacaaggcggacttcgaatggggcgtgcactacccggcatacctgcaagcaggtggcaccgacgagaagtgcgaagccctgaaggagccgagcgcggccgacaacgccctcttcgacaaggaggagcgcgccctcatcacgctcaccgaccagtcgacgaagcaggtggaggtggacgctgaggtcgtcgaagagctcaagcgcctgttcggtgagaccgcaaccgtggaagcggtcgccacggtcgcggcctacaacatggtctcccgcttcctcgtggcactggccatctgaagcaccgcccgggacggctgcgccctgcggccgcgtcacggaccacgacgggagcggacgtcatccgggcggctcttcgctgagccccctgcggcttcttcaccgcggcggcggcaggggctgccgtcctcagggtgacgacccatcagggtcagcgtcgaacgagcgtcaggacggccggctcctctcccgcgccgggaccatgccgaaggcgctcacaccccggcacggaccgcggaagccctggccagatggcccgcccagacagccaacgcgctttacgtcatgcgcctgcggaaacatctcgacacgacccgcccgcaccccggggaatcagacctgcccgcgccccggggaatcagaggaacaacaggtcatacgccctttgctgcgggctcaacggcgggcctggggccggcgggtggctgactcaggcggggtcgaccagccggtagccgatgccgcggacggtccggatggggtcggggtcaccgagccggtggcgcagccggccgatcagcgcgtcgaccgcggccggttccggctggtgccgcccgcccgcacagcgcatggccagccggtcgcgggtgaccagcgcgccgccggccagcaggagcgcctggagcaccgcggcctccgcgccggtcagggtcagcggcgccccggcgcgggtgaaccgcccgtcggcgcggtcctgttccagatcgccgaggcgcagcggggacgcctcgtgcggcaccacgggggcgcggcacaggacgcgcacgcgggtggccagttcatcggcggtgaagggcttgaccaggtagtcgtccgcgccctgcgcgacgagggccgcccgctcgccgcgcgaatccagcgcggtgagcatcaggaccgaaccggcccagccggactcgcggtgagcggcggccaggcggagcacgtctccgtcgggctgcgcccggtcgcctacgaggccgtcataggcggtgccgcccaacttgcggtcagcggcagcgagttcggttactacatcgacgtcgtagccggtgtggagcagacacccggacatcacggccgcaaggtccgcgtcgtgctgcacgacgagtatgcgcatgggttttgactccagacggatgagtccgatgccagaggttcaggagcggtcgctgaggctggcggccacggcggtcagtcggtccatggcgtgagccacgccgagcccgtccatgtagtcgcggacatgcgcgatctggccgttccggacccggagcacgaggaggccggggaagctgaaggaccggccggtcgtggtcacggtcccggagacgacctgctcgacgacgatcacctccgggtcggtgttctcgtgcacgacgacgtcgcggatctcttgcggttgcgccgcgctcgcgccccaggccgcccggcagcccgcgcggatctcttcgcgtccctggtagcgcgcgggcatgccgggaaagaggaaggggaagtcgtggacggcgtcgaccgcgtacaggtcggccaggtcgtctgcggactt

SEQ ID NO: 384 - DNA, 7178 bp, Unknown
  Kingdom: Bacteria, Phylum: Actinobacteria, Class: Actinobacteria, Order: Streptomycetales, Family: Streptomycetaceae, Genus: Streptomyces
accgcagcggctaccgcgccgccgtggcggacgaagcggaggaactcggccaccagcagcgggtcggaaccgccgtggccgccctcgcccggagccggcatcgcaacgacgaggtcggcgtcggcgcggtagccgctgcggtgtttccacacccggacctctgccgtttccccgtggtcgccgaagttctccaggcggccctcggtgccgatgaccgtgtagttgcgccagtagtcgggcgtgtagtgacactgctggtagctggcgtgtacgccgccctcgagccgcatgaccatcatcgacaggtcctcgacgtcgacgaccgggttgaggccggtgttggacagcgggggccagttgttctcggggtcgtaccagtcgcgcatgacggcgccgggagcctgccccgagcggtcggtgatgtcgccgtagacggtgagcccgccgagcgcggtgacgcgctcggtgtacgcgccggccagccagtggatgacgtcgaggtcgtgagcgcccttctgcaggagcaggcccgtggtgttgcggcggtcggcgtgccagtccttgaagtagaagtcgccgccgtgcccgacgaagtgccggcaccacaccgccttgacctcgccgatctcgccgcgctggatgaggtcgcgcatcacgcgcaccaccggcatgtgccgcatgttgtggcccacgtacagccgggcgccgctgttccgtgcggcttccaggacgcggtcgcagccctcggtggtgatcgcgagcggcttctccacgaagacggcgaccccggcctccagcaggtcgacggccagggcctcgtgggtgtggtcgggggtgatgacgaagaccgcgtccagctcttcggcggccagcatctcccggtggcccgggtagacgtggacgtcgtcgccgaaccactcacgggcccggccgaacgcgccgggcgcggtgtcggcggctgccaccaccacggagcctccgccggggtggtgggcctcccgtgcgagggtggcgcgcagtcccagcccgatgacgccgaggcgcaggtcgcgtgtgtgcgcgtggccggccgccggggcggcggagtcgagggaggtgtcggtcatgtgtactcagcccttcatgccggagaaggcgatgccctggatgaactggcgctgcatcgcgacgaacaccacgatcaccgggagcgtggcgaggagggacccggccatcagcaccgggtattcggtcaggtgggcgccctggagcgaggccaggccggccgacagcggcatcttggcggggtcggtgttgacgatcaacggccacatcaggtcgttccaggaccacaggaacgtcaggacgcccagcgccagcagtcccgggcgggccagcggcagggccacccgccagaagacggtgaacgggttggcgccgtccagccgtgccgcctcctccagctccacgggcagccccatgaagaactgccgcagcaggaaggtgccgaaggcggagaacatcccggggaccaccagcgcctgcatggagtccagccagccgaggtcctgcatgatctggtactgcggcaggaggaagagctggccgggcaccatcagcacggcgaggaacccgaggaagatcaccccgcgcccggggaagcggatgcgcgcgaaggcgtacgccgccatcgagcacagcaggagctgggccccggtccgcagcaccgccatcacgacggtgttcacgaactgccgcccgaacgggaccgcgtcgaagaccgccccgtagttcgaccagtcccagtgcgcgggcaggatcgtcggcggcacctgtacggactcgccgaagctcttgaaggaggtcagcacctcccacaccagcgggaagacggtgaccaccgcgcccagcgcgagcaggacgtgggcgggccacagcctgccctgacggcttccgttccccgagcgccgggagccccgggcgccctgcgccgcctcacgcacaccccgggcgccctgcgtcgcctcacgcatagtggacccacctcttctgcaaccggaactggacggcggtcagcgccatgatcaggacgaacagcacacagacgatcgccgcgccgtagccgcgctggttgtcgaagaacgccttctggaagaagagcatcacgaccgtctggccctcgccgtaggccgggttctgcagcgcgttctgcgtgttgccgccgatgatcaggtacaccaggtcgaagacctgcagggactggatcaccgacagcacggtggtgaagaacagtgtcgggctcagcagcggcagggtgaccgagaagaactgccggatgtgccccgcgccgtcgagcgacgcggcctcgtagtagtcaccggggatgctctgcagtccggccagcagcaggatcatgttgtagccgacggtcatccacacgccgacgacggccaccgcgaagcggatggtgtgcgggtccgacacccagtacgtgccgtggatgccgatcgcggacagcgcgtggttgaggatgccggagtcgccgttgtagagccagcgccagaccaccgcgaccgcggcgggcatcgtgaccaccggcaggaagtagagcgtgcggtagacgccggtgccggtcaggcccttcaggttcagcagcaccgccagcaccatcgacagcgggatgcccagcaggaccaggccggtgtacatgccggtgttgccgagggactgccagaactcgggatcgtccaccagggtgcggtagttggacaggccgatccaggtggttccgccgaaggcgccccactcggtgaagctgtagtacaccgtctgcaccacgggccacaggtagaagaccgcgaggcccagcccggccggggcgatcagcaggtaaccccaccacttgtcccggtgctggaatctgcgctcacggcggcgcagttcccgctggtcgggtgtgtccggcccggggcgccgtgccggtggggcggtttccgtacgcacatcgaggctcatcaggaccggcccttcctctcctgtgcgagcaactggttcatcgcgtcggtcagggaggccgtggcacgctccaggctctcgtccccgctccacgccttggcgagccacctctgttccctgtgctgccaggcggcgctgttggcggagctggggaagggaaccgcgtactcgagcgcgtccaggtgcacctggaggtcgaacttcggcattccggcggcccacggcttcgcggtgccgttgcgcgccgggatggcggtgccgtacttgccctggagcagcgatgcctgctccccgccgaggaaccggacgaactcccgggccagttcaggatgcggggtgcgggcgtagacgacgttggcgaggccgtgcaggacggtggcgcgccgccggcccttgggcatcggtgcgacgtcgaccttggcgcgcagctcggggtcggcgtagaaggtcgccgcgttgtaggacgcctcgtaggtcatcgccagcgtcccggactggaacatctgggtggggtccgtgtcggccatctgctggagggccggcgaggcccggtagcggtggatcaggtcgatccacagcttcagcccctcccgggtgtgctcgtcgcagtagccggagcgcgtcttgtcgggggagatgacccagccgccggcctgcggtatcgagttgtagtagttctcctgcgcgcggaccggcgccccgacgccgtagatcccgcgtttgcggtcggtgaggcgctgggcggtggatatcaggtcctgccaggtccaggaggcgtccgggtagtcggccttggcccggtcgaagatctccttgttgaaccacagcgcgaccgtgtcgaagtccttcggggcgccgtactgggtgcccttccagcggtagagggagatcaggtcggacgggaagtcggcgggccgcaccacggcgtcgggcccgtcggtctccagcgggaggagctgtccggcgtccgcgtagaggccgaagttgggcccgttcatccagaagacgtccggagcggtgccgccggtgcacgcggtgcgcagtttggtccagtaggtcccgttgggcgtgagctggacgtcgacgctcaccccgggccgggtgcgctcgaactcccgcgccgcccgtttcatggcgggcacctggtagacgtcccagacaccgtaggtgaggtgcccgcggcgggagccgccggtggaggccgatggcggcgaggaggggccgcagccggccgcgagcgggcccgccgcgagcgtcgtggcggcggccgccgtgaggagggaacgtctgcgcacgccaagccttccaggtgaggggccgcagccccgccacgcgggagaggctgcggagccgacggaggtcgttcgtggggaccgctgtcccgcaatcggaatgccagaacgctatttgctcaaagttgattggtcaacgcctctttcaatcatctttacgcagagaagctcagggtgggattggtcagcaggccggggccgggcctgggaccggcttcgttccgcggcggtaccgcaaggacgccgtccgggcggtgttcccggtgcgcagggcgggccggcgtagtccagccgggcgccggggaaccaccccggccggccagcctggagcgtcgaggcgcacctcgacctgatggagcgctcggggatcgagaagtcctgcctgccggtctcgtcccccggggtgcacttcggggggcgacggcgcggctcgctcgtcctccaggtgcggcgaaggccaggtgggggagggccgaggtggcgtcgaaggcggcccgcgccgccgcacccggatcggacgcggggaagtcgccgctctccacgccggccgcgacgatcgcgcggacctgaccgacgaggacggccgcctggtcggcgaccacaccgctctgcccgggggccaggaccccgcagccggcggtcagttcggggtcctggagcgccttggcgctttcaccggcggacagttcccgcagccaggaccgtagccgggtgcggccgtgccggggtcgccggcgacggccgcgatcgaaggcgtggtaccgcagccgcggtccctccctgcgctgcgttcatccggtctcgcgcgccggttccgtcaactgccgccatgtccgcacgagttggctgaactccttgacctggacgagtacgtggtcgcgggcggcgttctccgctgtctcggcgtcgccgcgggtgatggcgtcggcgatctcgcggtgctcggccagggagcggcgcatgcggtccgggacgcgcagctgcagccgccggtacggctgcagggctcgcttgagggcgtgggcctgctgtcgcaggtagtcgttgccgcaggagtcgtagacgatgccgtggaaccgggcattggcgtagtagtaactgtccgcgtcgccggccgtcgcgtggctctcgcactcctgcagggcgcgttcgaggtcgtccagcgccgcccgctcgatccggccggcggagagccgcgccgccatcccctccagctcggccatgacctcgaagcgctcggccagctcggggacgctcagctcggtgacgtacgtgccctgcttggggcggatctgtacgagtcccgagcgctccagggcctggagggcttcccggatcggcgtgcgagagcagccgaactcctgctccagccgtgcgggatccagccgctcgccgggacggtagtgaccgtcgacgacagcgttctcgagcgcgtcgcgaacgcgctgggattccgggacccgggccatgcgtacctccgagcggtcaggctgtccgggcgtgcggggggtggtgcacggccctcgatatgtcctacggtagcgctgttatatatatcgccgccacggaaggttacggaaggtgcggacatggaacgccccgacggctggctgctgaccgacctgtcccaggctctcgggcggcggcgtggcgcggatccggcggccggagaaccgccggactccccgctggaccagctgctcgccgcctgcgaagtcctgatgagcgacgtgggtgaggcctcgatgcgcgcggtggcggccagggctctcgccgcctacgccgaactcgacgacgagagcaggcgggccttcttccgccacatcacccagacctacagcgccgacgccgatcaggtccgtaccgccttccgccgctgggaggaggcccgcagcgccgggttcccgggcgaggaggagctggtccggctcttcgacgtggtcgagccggcccgccagcagctgctccgccggatgaaccacgcacccgacgccacgctcgccctggtcgggatgcgcgcggacctgcgccggctgatgggccgccaccccgagctgcggcccctcgaccacgacttccaccacctgctcacctcatggttcaaccggggcttcctgcgcatggcggaggtcaccgtggacgcaccggaggaactgcaccggcacctgatgcggggcgagaaggtccacccgatgcggagcagtgccgagctgcgccgtcgcctggagccgcaggaccgtgctgtctacgcgttcgtccatccggccaccggggaggtaccgctgatcttcgtggaggtcgctctggtgcgcggcctgccggaccggatcgctccgctgctggagcccggcccggcgctcagccccgcggacgcggacacggcggcgctctactcgatcaacaacgccctggacggtctggccggagtctccttcggcagcttcctcatcaagcaggtcatcgagcaggtgggcgagcagctgccccacctgacgcagttcgtcacgctctcgccgctgcccggattccggcgctggctcggtgagcaggcggaacgggacgccgggttgcggctgctcgtccgtgagctggaggcgctggaggggccggcggatctcggtgcggcggacgccggacggatccgtgcccggctccttccggccctggcccggtacatcgccctcgaacggcgcgaggacggacgccccctcgatccggtcgcccgcttccacctgggcaacggggccgccgcctggcagttggactggccggcgaacgactcggccgaagcctggcggcagtcgtacggcgcgatgatcaactaccgctacgagccggggcagctggagcgccggcacgaggacttcgtgcgccacggcgccgtggccctcg

SEQ ID NO: 385 - DNA, 1497 bp, Unknown
  Kingdom: Bacteria, Phylum: Actinobacteria, Class: Actinobacteria, Order: Streptomycetales, Family: Streptomycetaceae, Genus: Streptomyces
tccttctccgcggcgccgcggcgccgcggagaaggagaactggcctgcatcatgcccggactaacgcgcggcccccgcggacgttgcgccgccgggccgtccggccggccgacgcacggcaagcccggccgacgcacggcaaggaaggactttgccctcggccccgcctgcctagtaccgtggggggcgattggtgacaccccgcttgtctgtgtcatcatctgcacgcaccgatcgcgcgctcgcgtgagcggttgtgctggaggcgtcgcctagtccggtctatggcgccgcactgctaatgcggtttgggccttaaagcccatcgagggttcaaatccctccgcctccgcgcaagagcaccgaagccccggtccgatggaccggggcttcgtcgttcccgcgcgtcattgctgcgaccgccccgcctggccccccgcatcggcggaccagtctccggatcatcctccagaatgcgtttccgcaggtcagaaggggtgcggggaatggatttcacatggcggcggcagtcatgtaatgttcttcctgtcgccgcgagcgggccggaagggccgggagcgaagacagaaaacagaacaagcactcgtagcttaacggatagagcatctgactacggatcagaaggttgcaggttcgaatcctgccgagtgcacatagaaccagaggccccggagagatccggggcctctggtttttggtgcatgcggtccggtgtgagggtccggcccggaagtcgctggggggcctcggggcagcggcgccggagaggtgcggtggatgatcggggcatggagtacttctgtttccaccgtgaccggccggggtccctggcgttgcgtgaggagctggtggaggcgcactggtcctacatggacgggtacgcggaccggatgatcgcccgcgggccggtcttcgacgagagggacacgctcgtcggcagcgtgcacatcctcgacctgccggaccccgccgccgcccgcgcgttcgccttcgacgagcccaactaccaggccggcgcctaccgggacgtgctgctgcggcggtggcgcaacatgctggggcgcacgatgtgggacttccccggcgggcccgacggcggacggcggtatctggtgctcgggctggggcccgccgccggcccggcacgggatgaccaggacggggatccgctgtccgggcccgcggtgccggacgcacgggacgatctgatcgcgtacgggccgctgctgtccgacgacggcaccgtatggctcgggacggcggcgctggtccgggcacgggacgcggtcgcggcgggcgccgtgctgggcggcgaccggtacgacggtgtcgaggtgcacgcctgggagttcggcggccggcgctgagggggcaccgtccgccgggagccgggagccgggagccgggagccgggagccgggagccgggagccgggagccgggagccgtgggcgggcgccgggagccgggagccgtg

SEQ ID NO: 386 - DNA, 4879 bp, Unknown
  Kingdom: Bacteria, Phylum: Actinobacteria, Class: Actinobacteria, Order: Streptomycetales, Family: Streptomycetaceae, Genus: Streptomyces
ggagcggcaggggcgcgcccgggcgggcacggcggcgccgcggctcgcccgtgcggggacgggccgcggcgccgggctcggtgggcggggccacggcgccggacctgtcgggcgggtcgagcggggtcacggcttgaggaacccggcctggttcagcaccttctggccctcggcggaccgcaccagcgcgatgaacgccttggcggccccggtgttcttcgcacccttgagcagggtgatcgggtagtcgttgacggccttggccgattcggggaactccacgccgtccaccttgccaccggcggccttcacatcggtctcgtagaccaccgcggcgtcggcctccttcaggaccaccttgttcagggcggacttgacgtcctgctcgtaggagaccggggtgagctcgaggccgctggcgtccagcgccttctgcgcggcggcgccgcacggcaccgtcttcgcgcacaggacgaccttcaggcccgacctggtgaggtccttcagcgaggcgaccttgtccgggttgcccggcagggtggcgatctccagctggttgcgcacgaaggtgacgggcgtaccggccgcgtcgccctggtccgtgacgatcttcatcgtcttggggctggcggaggcgaacacgtcggccggggcgccgctggtgatgcccgccgcgagggagtcgctgccaccgaagttgaaggtcaccttcgtcccggggtgctccttctcgaactgcttgcccagcgtcgtgaaggactccttcagggaggcggcggcgaagacggtcacgcctccggacaccttgtccgaggcggaggccgacgcggaggagtccgagccggaggagcccgaaccggaggagtcggaggaggacgagcaagcgctcagggccagcagcgcggcggcgcccgcaccggtcacctgaagcatccggcgggtccggcgcgcggaacgggtcatcacggggctactccctcaaggtcctgaacggacgcgtctacggtcttgctgccttactgcgatcacgtcgtcgatctacccgggggcgctccggcggcggcccgtccccggtgggtgcgcaacgccgatgatacttccgcagatgcgaggcagaagtctctagtctcatcgcatcagccggatcatggatcggtccggctggtatgtgcgtttgtacggaggtgctcggcgggtaccgtccctgcggaggtggtagcccgtgagccagaccctcgcagcccccggccaggtcgccggtccgccggcggagttcgtcctcgacggcgacctggaccgtccgtcccggctgaccgtgtccgacctgctcgcctggccgcagcacgaggcgcgggtcgccttcgagtgcgcgaccagcggcacgcagcaccaccacttcaccggcccgctcctgcacgacgtcctcacggccgcgggccccgccttcgaccccggccgccgcaaggaccgcctgcgcttcgtgatctccgtacgcggtgcggacggccaccacacgctcctgtcctgggcggagatcgacccagacttcggccgcgcgcccgtcctgctcgcggtcgccctcgacggcacaccgctcgaccgcaccggcgcccagctggccttgccgcaggaccgctgcgggggccgctacgtcagcggggtcgaggcgatccgggtggacggcgggtaccgggcctgggcttgaagcggaccctccggccgccgccgggcccgggacccttcactggaaccaccaggtcagcgcggctgtcaccacgtacacggcgaccgccatgagccagacggggaccgcacggtggcgggcccggcgggcccgcgcggacccggccggtgcccggtcgcccgctctccggggcacgaggtacccggcgttccgcggcgatggcggtgccgccggcggcaccgcggtcatccgcaacggccgcggcgtcggcgtcgtggaactctccggccgacccagcgacgaccccggctacatggcaggcatcaccgccgccgccgccctcgaccgactgaccgactgactgactgaccgacggcagcgggccgcggcccggcgcagtcactgcgccgggccgcggcccactgtcaccgccgtgtcagaacagccccttgaacccgttccagccaccggtgccgatcagcacccggccgctgtacgtaccggcccccgtggaggcgtaccgccacagcttcccggcggtgtcccgggccaccagatcggcgcgtccgtcaccggtcaggtcaccggtgccgacgagcgcggagtaggtgtcccagccgccgccgacccgcgcccgcgggctcacgccgccggtggaggtcccgtagtaccgccacagcacaccggcggagtcgactcccagcaggtcgccgcgcccgtcgccgttcaggtcgccggcgccgacgatcctcttgtacagcttccagttcgtgccgatgtgcacccggctcttcagccggtggtcggcgctcccggcgtagaagtacatgtccccggtgggcgcctggcgcgcgatcaggtcggcgaagccgtcgccgttcacatcgcccggcgacgtcagctggtcgtactggccccagccggagccgatcagcgtgtacggcgacgaggcggtgacgatcttcccgcatcccggccggtaggcccgcagctggtcacccacgcggacgagcacgtcggcgcaccggtccgcgtccacgtcaccgaagggcacgagcacggagccggcggcgaacgcggcgccggacgcggggatccgggacgacagcccgccggtcccgttgccccggtagagggtcacggccccggcgctgtccgtcgccagcaggtcgccgaacccgtcgtcgccggccatgtcccgccacacggcggcaccgccggtgaccggcaccgtcccggagacggagaggtccgcctggacgccgtcggcgggcttcgcggccagggtccaggtgtaggccccgttcgcgacgtacttcccggcggtgtccttgccgtcccacgagggcgcgatcagcccgcgtgcctccccgccggtgagcgtccgtacggtcttcccgctcgccttgttcctcagcgtcagcgaccaggaagcggcgggcttcgacagccaccaacgcggctgccaggcagcggacttgatgttcagtgcgggcgtgtcggagtcgatgacggcgagggcggaggccgggacgcccgacgggacgatccgcacccggcggtcctcgcccgtgtaggcgatgtggccgccgaagcggtcgacggtccacccggagcggcgcccggtgcggtcgccgagccggtcggcggtgacgacgacccgctggggcaggtccgcctccttggcgcccgccgggaagccgttgtgcaggtcgacgagggtgaggccggccgcgtccgagcggtggaccaggtagccgtcgccgaggagcgtctcgtcgctcccgagcctcagggaccgcttggtctgccggtcgtagacgccgccgcccctgtagtggttccagaagtggtcgctgcaccgccagtacacccagcggcccacggcctgcaactcgccggggacgcacccggcgtcgaaggactcaccggccgcccccgtcaccaggttcttcgccgtcaccccggtcgacgcgtcctggctggggtcgtcctcctgcccgagggcgctccacagcgtgtcgccccagacggaggccgcgaccgacgcacgtttcagaagcgtgctgccggtgtcgggttcctcgaagcggacgaccgcctgcgcgccgcccgaagcctcgcccacgacgccgaaccggccggagagatcgacgagttgcggtgtctggagcccggaggtcagccgcgggccccacgcggcggcgccgttgcggtagagcatggtggtgccgtgctcggtccccgccttgcggccgtggtagccgtcgccgctcgcgaacatggtcacgcagtagacgccttcggcggtactgcaaccgtcgtcgtcccggccggaggtgaggccgtcggtggtcgacctcagctcctccggacggccggccgtcttcagccaggtgctccggtagccgccgatgtaggtgccggggtcgtagtactgcgagtcgtcggccgtggtgaggatgccgctgcccagcgagataccggccggcttggcctcccggtccgcgatgtccgcgaggcgcttgcgggtgacggtgccgtccgcggccggggtgaagaggtagtaaccccagtcgagcgcgccgtagtcggtgcgcttctccgcgccggccaccaggagcgagccgtcgggcgtgcggtgcaccgagggggaggcggcggccagcagggtcctcagctttcccgcggtgtcgtgcaggaagagctggctgccccggtagccgccgtcgttgccggggctgggcggggtcacggtgaccaggccgccgccgagcggccgcacgacgtcgttgttctcggtgacgtcccgcaggtcgagggtggccggctccgcgtccaggtcgtcccggcggtacaccagcgcggcctggctctccggggcgccgtactggaagaccgtgtcacggtcgaaggagacgctctcgccccggctggacagcgccttcacggtcccggtggcgaggtcgacgacccaccacccctgggacatcctggtgtcgtcccacttgatgccccggacggcgacggaccggtcgtcgccctcggggacggagaggttccagccctgcggcaggccctccagctgccggtcccgtacctcgccgttctccagccgcagcaggtgcaggctcgtcacggcgttctcggtgccggtccgggtgatgacggtgtcgccgtacgtcgcgacgtacg

SEQ ID NO: 387 - DNA, 959 bp, Unknown
  Kingdom: Bacteria, Phylum: Actinobacteria, Class: Actinobacteria, Order: Streptomycetales, Family: Streptomycetaceae, Genus: Streptomyces
agcgactcgcggtactccacgccctccagcgcctcgtcctccgcgccgagggtgtcggcgaccgccggggactcgtcgtcggtgtcggggacgtccagggacagcgtggagtaggcgttggccgactccaggccctccaggacctcctcctcggagatggcgagcttctcggccagttcgtgcaccgtgggggagcggccgtgcagctgggacagctcggccgtcgccgtggtgagggagagccgcagctcctgcagccggcgcggcacgcgcaccgcccagcccttgtcccggaagtgccgcttgatctcgccgacgaccgtcggggtcgcgtacgtcgagaactcgacgccgcggtccgggtcgaaccggtcgaccgacttgatcagcccgatggtggcgacctgggtgaggtcgtcgagcggctcgccgcggttgcggaagcggcgcgcgaggtgctcgacgagcggcaggtgcatccggaccagctggttgcgcagctccgcgtactgcgggctgccctccttcagcgcgcgcagctccacgaacatcgcgcgggctccgctgcggtcatgagggtcgtgccgcgtgccgtgcacgctcgggacgccccgcgcggcgtcctcggagtaccgctcgtgctcgctcatcgtcccgcccgtcgcccttccccgagccctcgcaccctcctccgcccccggccgcgaggaacggacgggtgggcccccgtggcccggggaggcctcgctccgcgtcgtaggcgtgcccggcacggcgtcgtcccgctcccgcggtcgctcacccgcatgaccggactgcgtcgcgcccgtgtgaccggactgcggctcgctcgcgagaccggcccgcgggcggcatcgagggcatcgacggcatccccgagcaggccaggccacacccggacgacgagagcccgcggcccggtctcgcgagcgagccgc

SEQ ID NO: 388 - DNA, 10505 bp, Unknown
  Kingdom: Bacteria, Phylum: Actinobacteria, Class: Actinobacteria, Order: Streptomycetales, Family: Streptomycetaceae, Genus: Streptomyces
gccaaatgagatgccctgttatagggcgaggccaggcaatgcgcccggtgatcatcggatgcctgccgacggcgcccgggtaccgattgggccgacgacgaacagcacggccctgtccagggagacgatcagctggccgatacgctgttgaacgccagcaggctcggctgcccctggcagatcgggcaggcggtcggggacaaccaggtgagctcgtagatgccgggtgcgcgctggacgcgcttgacgtggaggccggcgcggaagcggccggtgcgcaggtcctcgacgaaggccgccacggtctggcggaagcggcggcgctgttccggggtgaggcggtccaggtcggtggtgaagcggggcagggtctcgtaggtcggcacgtcggtcctccaggcagcaagaagcccccggcggtgccgggggcggagagtgggtgacgtggtgcagggggcggcgtctttggccgctgggtgggggagcggtacgcagatgtgcgctggttgacggtgaagtcgtctgctggcggttttcggtgttgacggccacctgcccggcgagcgcggccgtcacggactgggctggtgggcggcgcaggagacccggcccgcgaagaagaagccgaagccgctcgcgcagctgctcgcgtcatggcgggactccgcagtcctccgcttcacccaggagctcatcgacggcctcctggagaagtgccgggccgcgggggcggcgatccgggcgcgggtggatcccgccgtggacgtggcgctcgccgccgtcgacgtcgccgcaatcgtcttcaccgtgcgcgagaagttctcccggcgccacatcctggccgaagcacgccggcacctgctggagacgctgcgcggccgcgagttcacccgcggcctggacgactacatcaccgaccgggctctgctccgctactcccgccgccacacggtcacgaagcccggcagggaagcaccggcggcggaccggatgacctacaccgccgacttcccggtgccgcaccggtggtggatcgcccccgccgacggcacgccgccgcgggagtccagccgctacgagcgggcccggctcgcgagccgggccgtgcaggacgcgatccgcgacgcccgcatccgagccggcaccgccaccgaggcgacggcctcagccgcctccgcacccgccgatcaccgcgacctcaagggcgagacggcgtccactccccacgccgtcgaccacccgggccgggacgccaccctgaccccggcgcagcgggccgccaccgtccaggcccaccaacaggccgcgatgcccgaggagtacctggagggccgcacgaccgacccggcgacgtggctgcgcacaccgaagaacctggaccggctcgccgcctacacccgcgctgccgaaacccgccgccgcgttatgggggaccgaaaggcgtcggccgccgacccggtcagtccggtcgacggccgccgccaggagcacgagtagcagcgccagcagcccgaccccggccaaggccagggcctccggccgtaacgcgacgtgcgcggcccgcccggcgggacggacgacgaagtcaccgcgccagccgccgggacgcgaccggtcgcccaccctcgaagccacccggtagcggagagggtgccgaggaccactccctcaaaagcacggaggccccatggttgccccgaccccgccgcacctttcgccggagcagcgcgagcgcctggagcagctcgccgacgcggcccggctgcgcatggcgctgttcccgtcgccgaagccgccacccgtccggcaccgctcctgctcacggcagtacttcggcggccggccgaacccgtggcgcaccgcgcggggccgccgccggggatgagtggagccggtggactccaccgcgcgtccggggcgcggagaccacggtggtggggaccaggcggtccacccgatgcgctccacccggtaggggagtgcagaacatcctggcatccggtgcgctcggtgcggtgctcgggcgcgccggtgcgcccgccgacgatgccgtgcactcccacccaccgcaccaccgcaccggcgcgccgcaccacacgctccacccggcgcgcttgggagtgcctgtgccgccgtggattccatccaggcccgtcgggtggaaagcaacccttgtccaggcatgagtttccgcgttttcttcgacgtttccccttgaccacgtctgctaccgccccggagatgacctgcaccgggccttcgaggcgcggtggcggaggggagatctttccctcccggcgcaccacgcaccgtcaccgtccgtaggagtggtgcggggcgtggacgatgctgtgcatccccgcattgcagtgggttccagcgggtggggagtggaggccatcatgcgggtgtagtccactcggtgcgctccactgggcgggggagtgcgttacatcgtccccaactcaacgcaccgtgcgcgcgccacgcgccccgggcatctggtgcgggtggcgcgcgtcgtccactggctggatgccggtctcccgctcggctcaggccgcggccgccggctgcccggcgtaggtgtcgccgtggatgtcggcgaggaacgggtggacctggtcgacctcttgcatgccctcgatcaggaacccggccgcgatccacgcggtgtgtgcgccgccgcctgcgaggcaccaccgcttgaggtaccggctccgtcaccagctgcccgaaggcgtacgcgggctcgcagccggcgtactcatcgggcacatcggtgaggtagtcggccagcagcacgttgggacgtactcccggcaaccgccatggcggcatcctccgaagcgccagcgtatgccctcgcaccgtcgcgtgcggcccgccaccgaggggtggcgggccgcacgcggtcggtccttgcttgtggtgtcggtcaggcaccgggctgcacggggccgatctgggtgccgaagtcgacggacagcttgccgtcggcctcctggttgcccgggatgatcccgccgccgggggtcttgagggtgaagacgacccggttggccgttgcgcccttggatgtggtgggcacctggatgtcgaagtggacggggtgaccggggccgaaggacaccttggtgccctgcgagccgtaggacttcgcggtgatgcccttgagtgagccgttgttgtagaacttcacgtcgcgaggggagccggccagctggcaggcgctggtcttgggagcggcggtcagcgtgacgcggtagtggcggtgcccggagctggcggtgtccggcgtgatcttcgtcttgagattggctgggcggcacgaggacggcgcgccggagttggccgagtgcgcggcggtggatgcctgagcgacacccgtagcggcgattcctgccagtgcaacgccggcaactgccatcacgaacttggtggacttacccatggtcgactctccgtgtctcgctgtcgtacgtggggccgccgccccgaactcctgacgccacgaagcctgccgattcccttcgctgtgggcgtcacggcgatgtaacgccttcgccacagcgaccgtgagcgtcgtagaaggttccgtcgcggagcatggcgaagaagacgtcggcccggcacagggagccgatcgtgatgcccgggcacggtctgcgtacatagcaaaaatgatcatggcgggcccctgtagccactcacgcttggatggggctgatcttcttgccaggtaggccgccgcgacgtatctcgtcacggtcgcgccgcagaggtcgaagacgcgcatgaagcggaccgggtcggcggtttcccgcgcctcgtcgccacgaccccgaggggcgcctcgacgcggaagtccccctcgaccgggagcgccacaaggctgcggaaagccgtgctgtgatggaccagcaaccccggcctgccgcctggcgccggatgcccggcagcagaggtgcccttgacgccggtcccagcctgcgggacggtctgcgcaactacgcgcaaccgactcacaggggagcaagggatgacgctacggttcgtcgggatcgaccccaacaccggcggcgagggatcaccgacggtgtgggtggaagaggagagcgcggacctggtcctgcagggcgaggaagtcgacgaactcctgaaggccctggtcggctccccgagtgggtcgccggccacaagacggggatccccgcgcacgagcgggtgatccggattccggcccgcatggtgccgattctgagggaggcgtgcgatgccgctgaacgcgcaagcgctgaacaccgcgacgttcgctgagctgctcgccgatacccaccacacggcggtccacctggagatgcgcgacctgtacgccgtcggcgacgagacggacgatttcgagagcttcttgcggacgggcctcccgaacctggatccgggccgctcgttctggccccagtggatgccgctcgtgaaggacgcggtcgcccgcggcgtggtgatgcgccgggcgcggatcgtctccgagccggtcaccgactacatccgctacgagcacgccatcaccccgctcaacctccaggccggagaggacgtgcgctggctgccccgccgccgcgcctccgacatcgcgctgcccggcaacgacttctggctcctggacgaacagcttgtgcagttccaccacttcaccggcaccggcgactgggcgaaggacggcagggaacgcaccaccgacccggccgccgtcacgctgtgccgagccgcgttcgaaaccgtctgggagcgcggcatcccgcacgagaagtacaccgtctagacccctgagcagcgcaatgaccgcctccccctcatccagcgcacaaggagcccgcgaggcgctcgctgtgcgacttacgcacctgcgcaaggacgccggcctcaccgggaaggaactctccgcccggtgcggctggcaccccgcgaagaccacccgcatccaaaagggcgcggccctgccctcggacaccgacatccgcacctggtgcgcggcctgcggcgccgacgaccaggcggaggacctcgtcgccaccgcccgcgccgttgactcgatgtacatggagtggcgccgcctgcaccgcaacggcatgcgccaggtccaggaagactggtacgccctgcacgagcggacccgccactgccgggtctatgtctccaacgtgccgcccggcttcctccagacgccggcgttcgcaacggacctcatggaacagatcacccgcttccagggaacccccgacgacgtcgccgaagccgtcgccgcccgcgtcgcccgctcccgcttcctctacgagggcggccaccgctacgtcgtcctcatcgaggagtccgtcctgcgctaccgcaccgccggccccgacgcgatgcgcgggcaactccgtcacctcctggcggtgatgcccctcgcctcgatctcgctcgggatcatcccgttcaccgcgcagcgcaccgtgtggcccctggaagcgttctacgtccacgacgacaccactgcggtggtcgagacgctgacggcggagatcaaggtgacgcagccgcgggaggtcgccgactacgccaaggcgttcgccggcctcgcggagatggccgcctacggcgacgccgcccgcaccctcatccgggccgcgatcgacgccctggagtgaagttccgcaatttcacgcaatttcgttgagaactgagcggcgggctccgtagcgtcgaacgacaccgacgcgacgcactcagcacacggaggcggtgccccatgagcgcacccacacccgccggcgcccaatcggaagaccgcggcctgccgcccgccttcggacggccctctccggcgctgatcgcccgcgccgaccgcggctacgcccgcttcctcgccgcccaggccccagccgccgacaccggcgaccacgaccaggacgacgacgcggcgggcacccgatgaccgacacccccgtcgtgctccacgaccccaacggcctgatcgaggccggactccccctggaccgcgccccacacgaggcactcgtcaccgccgtcctcgcgtggaaggatccggacctcgcgccccgcgactacgagcagatcgccctccagctcaccgggcacgcccgcgcggtcgccgccgaagtccaacgtcttgccgccgccctgcccaagagcgacggccgcggcgccctcgccgctgccgcctcggccggggccggggcgccgtgcagggagcgttcctgggccaggttccagccgtcgaccaggcttccttggccgactggctgaacatcccgaggcacacactctcggcacttgtgggggcggtcgtgccccgaggtcaggacaacgccgaggcgctcaaactcgcgtgccctggcatcgacgtcactgccgagtaccacgcgcgggaagccgccggacgcggtgaacgcctggacgagagcgacctgtacgaggacgtgcggccgagcgggcctgggagctctcggccgcaggcgcgacgctgcgggtgcggtgggcggccggcgcacccgagctcgccgggcacgtcgccgccgtgtatacgacgccgactccagccgactcaccgtgtgccctgacacctggcgctgcgccatggggcgcccctggtggcgtaggcggcgccgtgatgggttacccgacgggtatggcgaagctgcatcttcccgggcggaaagcacaccacggcagcaacgaggcgtcggcatctgaggaggccgggcccggtcccgaggtggagcgccgggcaccggacacgccgacgaagctgcccaagcgggcctggggcggcgtgctcaagggagcgttgcgggagttcaaggacgatgagctgaccgaccgtgcggcagcgctgacgtactacgcggtgctgtcgctgttcccggcgctgctggtgctcgtgtcgctgctgggcgtcaccggcaaatcgacgaccgacgcagtgctggccaacatcaagaagctcgctcccggctcggccagggacatcatcacccgggccgtggagcagttgcagagcaacgtcggcgtcggctccctcatggccattgtcggtattgcgctggcggtgtggtcggcctccggctacgtggcggcgttcattcgcgcggcgaacgccgtctacgacatgcccgagggccgcccggtgtggaagatccttcccgtgcggctgggcgtgacggtcgtgctgatggtgctggcggtggccagtgcgctgatcgtggtgttcaccggcggcctggcccgccatgcgggtaccgcgctgggcatcggggacacggcgctgacggtgtggtcgatcgccaagtggcccatcctggtggtcctggtcaccgtcatgatcgcgatcttgtattgggcgagcccgaacgcgaaggtgaaggggcttaggtggatcacgccgggcagtttccttgccctggtgatctggatgatcgcttcggccgggttcgcgttctacgtggtgaacttcgcctcctacaacaggacgtacggcaccatggccggcgtcatcgtgttcctcgtctggctgtggatcaccaacctggccatcctgctggggctggagttcgacgccgagaccgtacggcagcgggccatcgcgggcggcctgtcgccgcacaccgagccgtacacccagcctcgtgacacccggaagtgggacgaagacgaccgacgtcgcctgggtgagggctgaccggtcacgcgatgatgttgggcataggtcgatgacctgcgggatatctgctcggcatgaggcttttgccggggttgcgtgatgctgaccggtcgctgaccggtcgctgaccaagcgggcggcctcgcgtatcccgccaggcgtcggaaaggtgctgtcggtggtggaggaggcggccgagagcaccaagctgtggtgcggcgccgccgccgcgatggcgtggctgggcgggcggcgcggccgtagagcggcggcctccggccttgtggccctggccgtggcgcagctggtctcgaatggcgtatacaagcaggtggccgaccgtccccggccgccgaagcagtggttccctcacgacgaggtcgatgaccgccccgactcttcctccttcccctccgggcacaccgccgccgcggtgccttcaccgcagccgttgcccccacctggccggccgccggcgccctatgcacggtgccggccgtcatggtggcgctcgagcgggtgcaaagcggtgcccactacccagcgacgttgctgctggcaccgccatcggcctgggcagcgcctggctcacccaccgggctccgtgcctgatcctgcgtcactggcctagcaggttcggggcgggcccgggggacaggcgaaagcaggcagacatgcccaggcgtacgcccgccctgaactcgcctgctcgggggaatcgcgccgaggcgctcgcagcgaagaccgacgtcaaggcgcgcgcccaggagaaggccgccgaggtcaaggagcaggctgccgcgaaggccggcgagctgaaggaacaggccgccctcaaggccggggaactgaaggcgaaggccgccgacctggcccaccaggcgcaggaccggctgcccgatccggtcaaggacaaggctgcccaggccggtcagctgtgggaggagaaggcgcccgagccggtgcgggagaagactgcccagggggcgcagctggcgcgggacaaccgcaaggtgctgctggtcgcggcgggtgtggccgtcgtggtgtggctggcctgccgccggaaggggtgagccgggtaaaggcatcgaagatcgcctacaagccggtgggtctcgcgctcggcgccctcagcggcgtggccgcgggagcgctgttcaagcagacgttgaggatgctcggccacgacgaggacgccccggacgccaccgacgaagaacgctcctggcgcgaggtgctgctcgccgccaccctccagggcgcgatcttcgccgcggtcaaagcggctgtcgaccgcgccggggccaccgccacccgtagtctgaccggaacctggcccggctgacgcgcatgagaaggtgggggagggctggtaggacacgaccggccctccccggccccgagccagtacccgtgcacctaacacggccaggcagacgacttggccccgatccgtggtctctgtccacagggcccccgacagccagcctgccggtatgacgatcaacgactcgcatcagtcggccccgcgtcgcggcaagatccttcaggccctcgcccaggcggagcggaaggtgagcggtaccgcagcatccccgatcgaaccgggccggtatcgtcgcgctgcttgccatccaggctgaagtgctcaactgaccggaggttgatcggtggcaacggacgttgcgccgcaggttctcgcgttcgacgacgagttcggcgtgctgctgctcggtggccaggcgaggggagttgaagacgccgataccgaagttgccaagcctttcgtgctcctccatcacttcgtccaggttggccagttgagctggcagcggcgagcgttcaagtacgtcgtgtcggtggcggcctgagcggcgcgaatccacaacttctgacggcgattccgagtcatcgggtgctcctagcgggactgcccacgtttccccgcgcggatgctcgataacctggcggaagtgttgggcgcgattcggagaaccttgtcttcgccgccacagcggacgtgggccaccgtgactcggagcgggcaggcgctgtctgccaggggcggcatacccgtctgctcgcttatgaagccgctgcgagtacgaaccagcgtgcaccggagtggtcccagtgcctgcgcccgcccgatacgtggtggcacacgcccgttcacgccctggaggccctcgatgagcgaacagccggcccccgccgaccacgcccggcagcagctggagcccaccgccgccgacggattgcgcgcatacgcggcccggacccgcgagagcgcagaccagctcgctgccgtcctggaagacatcgccgccaacggccggccctcggtggacgactgcacgccgtgggaggagctgcgcgaggcccacctcgcccggctcgccgcccagcgaccggccgtcgcctgatgcccacacagcacggcccgcgccgcgcccggatcgcgttctccgactccgccgccaagcagttgggctccatcaccagcgaagctgagctgcacgccctggaccgcgccttggtcgtcatctccgtcgatcccgaggccggcgaaccgctccctggcggcagcagcggcccacggcttcgccagtacgtcgacgacatcgaacgcgtatgcgcgaactgcttctcgctcagcctcggcagcgatgcgggcccctgcgaccgcagagcccgcggacctccctcgtcccacatccgccgccatcgctgcaccgagcgcacgctgacccgcaggtccctaggccctttcgtttggatc

SEQ ID NO: 389 - DNA, 7301 bp, Unknown
  Kingdom: Bacteria, Phylum: Actinobacteria, Class: Actinobacteria, Order: Streptomycetales, Family: Streptomycetaceae, Genus: Streptomyces
gaggacggcgagtgcggacgcgagcacgtcgccctcggcgtcgcggtccgcgtcctcctcgccgtcctcctcggtgcccgcgcaccgcaccgccgtcccgagcgccaccgcgtccctcgggaacggccgttcgggagcggtgccgatcacggtcgccaccacgccgtactactgggacgtgccctgcgagcagagcttcctggtggaccgcagtccgcagaacgtgccgacgccgcccgggctgcagcaggtagtcagctggagcacggggctcggtgcggtggccgccgaccaccagacggtcgtgctgaccgtgcagggcaccggcagcgagacggtcgtgctgcaggcgctgcacgtccgtgtggtgcgcagtggcgcgccgctgacgtgggactcgtacgcgatgggcaacggctgcggcggtgatgtggacaccaagtccttcgaggcctcgctcgacctgggcaccccgctgacccagcccatcggcggccagcggaacttcccgttcaaggtcagcgagtccgaccccgaggtgttctacgtcaacgggcacaccaccgaccacgacgtcagctggtacctggagctggactggtccagcgggaaccgccacggcaccgtgcgcgtcgacgaccacggcaagccgttccgcatcagcggcacccggggcaagcgctacgtcaatccgctgggcggccacggctgggagcgggaactcgggtcctgaggagtactgcggagtcctgagggcgggcgcgccgggttgcccgaccccggcccgctcaagtgccgtgccgggttaggttgttgccgatcggacgaccttccagggagacgcgccatgcccggtgatgccctcagccacgactccgccgagctgcggagacggatcgactcgacgaagccgcacccggcccgcgtctacgacgtcttcctgggcggcaaggaccactacccggtcgaccggcaggcggcggccaaggccatcgcgcaccacccccgcggcttcctcaccgcccggcacaaccgggacttcctgcgccgggcggtcaccacgctcgtgcgggacgagggcgtacgccagttcctggacgtcggcaccggcctgccgaccgccgagaacgtccaccagatcgcccagcgcctcgcccccgagacccgggtcgtctacgtcgacaacgacccgatcgtgctgacccacgcgcgcgccctgctcacctccgggcccgagggccgcaccgactacgtcgacgccgacctgcgcgacccggcgcggatcctcggcgaggccgcccgcacgctcgacttcgaccggcccgtcgcgctggtcctgctcgccgtactgcacttcatcgaggacgaacaggcgtacggcctggtccgggagctggtggacgcgctgccgccgggcagctggctcgtcctgagccacctcgccgaggacctcaacccggagggcaccgccaaggtggtgaactccttcaagaagagcgggctgaccttcgtcctgcgcacgcgcgaggaagtggaacggttcttcggcgacaacggactgacgcccgccgaacccggcgtcgtgcccgtgcaccactggcggccggacggcgccgcgcccgtgctcaaggcgcccggccccgagtacctggcctccctggaactgatcgaccggatcaagtacgaggacatcaacgacccctcgacgggcgatcccagcgtctacgcggccatcgcccgcaagctctgacctcgcgacaggccgcagctcacttcagcgaggccgtgaacgcttcccaagtcgccggtgagacaaggagagtgggcgcgtcctcgctgttcttcgagtcgcggatgtggatggtgtgggggcaggtggcgacttcgaggcactgcccgccttcgtcgccgctgtagctggacttccgccaggtgtaggcggtttcgaggcactgcccgccctcgctgccgctgtagctcgacttgaaccactcgagtgaggtgctcattgatctcctagcagacggtcgagcaggcccttcgactcgccgggagtcatggcctgtgaccgcagcatcgcatatttgcgcgccaggatggacacctcgtcgggagcggcaacccactggctgccgcgttgtccctcggtgtaggcaagctgctggtgatcgggcgtctccagcagagtgaaggggccgttcagccccgcgtgccccgctgtccgcatcggcaggaactgcaaggacagcccgggccgttccgcgcactcgcgcaagtgccggagctggtcccggcgggccctgtcgccaccgatccggaggtgcagtacgggctcccagacgatgaagctcatcgtcggcgggcatttccgttggaggatctcctggcggtccatgcgcgcggcgaccttcgtcgccagctcgtcctcgtcgtacgcgggtacccgctcggacagtacggcccgcgcgtacggctccgtctggagcaggcccggcagtaccgcgctgtcgtaccaggacagcgagacggcctcccgctcgtgcaccatgtactgctcggcgtacatggggaactggtcgatctccggcagcttgtccaccccggccgacaacgtccccttggtatccagcagtccgtccatcgccaccgcgagatccggcatcaacggccgtctgccctgctcgatcgacgcgatcgtctcctcgtccaccatcagccgttccgccagctcgcgctgggtgaagccggccgccttccgggcggcctgcacctgcgcgcccagcatcttcagtgtcgagaagttcttcttccgtggcagcttcttggtgctcatgccggtccaactccccacgccccacccggggtgacccttgccgacccgtacagatgacgagtacgggttcactcactgatccacgttagtgactctgcgcgacattcgctccgtgaagacggaatcaggactcccctgccagcgcgaccagttctacggccgcagccgccactccgtgcccgccgcccggcggttcgcggcgtggtcgctgcactactgggggctggccgagtgggcccgggccgacgacgtggccctgtgcaccagcgagctggccaccaacgccctgctgcacggcgtaccgtcaggccgcggctttctgctgcgcgtgcgctacgacggcgccgtcgtgcgcgtcgaggtgcacgacagcggtggtggcgtgccgtgcatcccggaggatcccgcggacgcggctgagggcggacgcgggctgctgctcgtgtccgccctcagtgacaagtggggcgtgggggagcggaacccgggcaaggtggtgtgggccgagttcgctcggtgaccgcgtcgccggtccggccggatcagagccgctcgggcgtccggatgcccagcagggccatgccctggtgcagcgtgcgggccgtgacgtcgctcaggaagaggcggttctccacctgctcgggcgtctcggccttcaggaccgggcacttgtcgtagaacgtcgtgaacagggacgccagctggtagaggtacgccgtcagcttgtgcggggcgtactcggcggcggcctccgcgaccgtctccgcgaaccggtcggcgtgcaggcccagcgcccgctcggcgtccgacagctccagctcggggtgcgcggccggagcggtctcgcccgccttgcgcaggatcgactggatacgggcgtacgcgtactggaggtagacggacgtgtcgccgttgagcgagaccatctggtccaggtcgaacttgtagtcccggctcgccgacgtcgacaggtccgcgtacttcaccgcgccgatgcccacctgggcgccgcgctcggtgatctcctcctcggacaggtccttcgccttctcgcgcaccaccgcagaggcacggtcgatcgcctcgtcgagcaggtcgaccagacggaccgtctcgccctcacgcgtcttgaacggcttgccgtccttgccgaggaccgtgccgaaggcgagctgctgcgccttgacgtcctcgttcagccagccggcccggcgcgcggtctcgaagaccatcttgaagtgcagggactggcgggcgtccaccacgtagagcagcgtgccggccttcaggttgaagacgcggtcgcggatcgcggagaggtcggtggccgcgtagccgtagccgccgtcggacttctggacgatcagcgggacctggttgccgtccgggcccaggatgtcgtcgaagaagacgcacagcgcgccctcggagcggacggcgacgccggactcctccaggaggcggcaggtctcggccagcatgtcgttgtaaccggactcgccgacgatgtccgcgtcccggatctccatgtccagcttctcgaagacggagaagaagtagatcttcgactcgtcgacgaacttctgccacatctccagcgtgcgcgggtcaccggcctggaggtcgaccacccggcgccgggcgcgcgtcttgaactcctcgtcggcgtcgaacttcttgcgcgcggccttgtagaggcggtcgaggttggacatcgcctcctcgccgctgaccgcgccggccttgtggtccagctcgtgggggtgctcgtccaggtactggatgagcatgccgaactgggtgccccagtcaccgatgtggtgacggcgcaccacgttctccccggtgaactccaggagctgcaccaccgagtcgccgatcaccgccgagcgcaggtggccgacgtgcatctccttcgccacgttcggctgggcgtagtcgatgaccgtggtgcccgggtggtcggcgtgcggcacgccgaggcggccggccgggtccgtggcgcgtgcggccaggttctccgtgatcgccttgtcggtgaccgtgatgttgaggaagccgggtccggagacctcgatgtccttgatcacgtcaccggcgaccacgcgctccacgacctgcgcggccagctcccgcgggttggccttcgccttcttcgccagcgccaggatcccgttggcctggaagtccgcccggtcgcttcgtcgcagcagcgggtccgcgtcggcggtctccggcagggcggcggagagggcgttcgcgaggcgctggtggacggaggcggtgagggacgtgaccgaggccataagaatgggtgccgttctcctcgtgggatggatagtcacgcccagtatcccatgcggggtaaagcgaattttcctcccggccggtcaaccccgggggcgtcgcgcccgtccaacgcggtgaaaaggcgttttcgtggatgcctgcccgcctgggacaatggagcggtcagccgtgcgaccgcactggcagtacacggagaacttcaggaaagaggacgtgccgatcgtggctcagagcaccgagaccaccgactgggtctcccgtttcgcggatgaggtcatcgaggagtcggagcgtcgggcccccggcaaacccgtcgtcgtcgcgtccggactctccccgtccggtcccatccacctgggcaacctgcgcgaggtcatgaccccgcacctcgtcgccgacgagatccgccgccgcggccaccaggtgcggcacctgatctcctgggacgactacgaccgctaccgcaaggtcccggccggcgtccccggcgtcgacgagtcctgggccgagcacatcggcaagccgctgacctccgtcccggcgcccgcgggctcggcgtacccgaactgggccgagcacttcaaggccgccatggtcgcctcgctgggcgagctgggcgtggagttcgacggcatcagccagaccgcgcagtacacctccggtgtctaccgcgagcagatcctgcacgcgatgaagcaccgcggcgacatcgacgcgatcctcgcccagtaccgcaccaagccgaaggccggcgccaagcagcagcagaagccggtcgacgaggccgagctggaggccgccgagggctcgggcgccgccgctgaggacgacggcagctccggctccgccgggtacttcccgtacaagccgtactgcggcaactgcgagaaggacctcaccaccgtcaccgcctacgacgacgactcgaccgagctgacctacacctgcacggcctgtgccttctcggagacggtccggctcagcgagttcaaccgcggcaagctggtctggaaggtcgactggccgatgcgctgggcgtacgagggcgtgatcttcgagccgtccggcgtcgaccactcctcgccgggctccagcttccaggtcggcggccagatcgtcggcatcttcgacggcaagcagcccatcggcccgatgtacgccttcgtcggtatctccggcatggccaagatgtcctcgtcccggggcggcgtgcccacccccggcgacgcgctgaagatcatggagccgcagctcctgcgctggctgtacgcccgccgccgtcccaaccagtccttcaagatcgccttcgaccaggagatccagcggctgtacgacgagtgggacaagctcgccgccaaggtggccgacggctccgcgctgcccggtgacgtcgccgagccgacggagatggccggactcttcggcgccgcgcaggaccggttcggcggcatcgacgtggtcgtcaacaccgcgggcatcatgctgctgtccccgctcgccgagacggagctggacgacttcgaccggatgcaccgggtgaacgtccggggcaccttcgtggtctcccggctcgccgcccgcctgctgcgccccggcggcgcgctgatcaacttctccacctcggtgacccggctccagcagcccggctacggcgcctacgcggcgaccaagggcgcggtcgaggccatgaccctcatcctggcccgcgagctgcgcggccgggacgtcaccgtgaacgcggtggcccccgggccgaccgcgacaccgctcttcgtcgagggcaagagcgaggagctgatcggccggatcgccgccgccgcacccctggaacggctcggcacccccgaggacatcgccgaggccgtcgccttcctggccgggcccggtggccgctgggtcaatggccaggtgctgttcagcaacggcggcatcgcctgatcctcctcccccgggacccgccaggccgcccgcccgaggagctgcaccgcctgggcagggggcccgagcggctcgacctgcacgtggtcgaactcggccgcgcctcgcaggagtccgccgacggcgcggtggcggccgtcctcgacgacgcgggagcgctccacgtcgtcatccacgacgccggacacctggtcaccggctatgtccaggcgtgcacgcc

SEQ ID NO: 390 - DNA, 3278 bp, Unknown
  Kingdom: Bacteria, Phylum: Actinobacteria, Class: Actinobacteria, Order: Streptomycetales, Family: Streptomycetaceae, Genus: Streptomyces
  misc_feature (2857)..(2867): n is a, c, g, or t
cgccggccgcctcggcggccgtggccagttccggggagacaccggccgggacggccaccagcaggcccccggagcgcaggaccctcagcgagcgggtgctggtccggtcctgcgcgtcgcccaccaggtcgatgacgacgtcgacgtcggcagcggcgtcctcgaagcgggtggtggtgtagtcgatcgtctcgtcggcgccgagttccttcagccaggggtggcgggcggcgctcgcggtggcgatcacatgggcgcccaggtgccgggcgaactggaccgcgaagtggcccaccccgccggcggcggccgtgatcaggacgcgccggccggcctgcacacgggcggtgtcgaccacgatctgccaggcggtcagcgccgccagcggcacggcggccgcgtgcacatggtccaaggtggccggcttcctggcccactgacgggccggtgcggtcacgtactcggcgtagccgccggcggcgcgcgggaaccacggcatgccgtacacctcgtcgccgggcgcgagcgtggtgacgccgaagccgacctcctcgacgacaccggagacgtcccacccgaggaccagcgggaacgtctgcagccccgccatgccctgaccctcgcgggtcttccagtccaccgggttgacgccggcggcgtgcacacgcaccagcacctcggtcggcagcggctcggggcgtgtgacctcctcgacggtcagcacctccgcgccgccgaactccctgagggtgacagcccgcatgacgtgcccgctcatgttgtcctcgctcatgtccgtctcgctctttctcgctcttctgctcctgccggggccgtgaccccggcaggagaaagagtggcgtgtgcgcgcggaggcgggtgagtggccgggaggtcatctgtcgtaccattccggccatgccgcaccgtgtcgccgttctcgcgctcgacggggtcctgccgctggatctgggcatccccgcccgggtgttcaacgaggcctgtgaaccggacgggacccggctgtactccgtcagcacctgctccctcggcggccggccggtgcgcacgcacgaggactaccggatcgtcgtcgaccacgacgagtcggtgctggagagcgcggacaccgtcgtaatcgccacgcaggagcccagcgagcacctgctcgcgaccggcacgctccccgccgaactcgccgcggcgctgggccggatcgggccgcggacccgcatcgtcagcctgtgcacctcggccttcctgctcgcggcggccggtctgctggacggcgggcgggccaccacgcactgggcgctgtgcgacgcgctggcgcggctgttccccgaggtcgaggtggatccggacgtgctgttcgtcgacaacggacgcatcctgacctccgccggcggagcggccggcatcgacctgtgcctgcacctggtccgtctggaccacggggcggcggtggcctcggccgccgcgcggcgctgcgtggtggcgccgtggcgcgagggcggccaggcgcagttcatcgagcacccggtaccgcaggacaccggccgttccacttcggcgacccggcagtgggcgctggaccggctggccgagccggtcacgctggaggacatggcccggcacgcgcacatgagcgtgcgcaccttcacccggcggttccgcggcgaggtgggcagcagcccgctgaagtggctggcgcagcggaggctggcgcacgcgcgcctgctgctggagtccaccgacctgtccgtcgcccggatcgccaccgtctgcggcttcggcgaccccgtcgccctgcgcaagcacttccacacgtacctgggcctgtcacccctggcctaccgccgcgcgcacagcgcaccggagccgacgacggcacgctgaccccccagccgcgccctcacggtggttcctccgggggggggagtagggctggtgactgacagcgcgcgcaggcggtcagcccgcgtcgctgcggcccatgaaggacacgaacccggcccacgcctccggcgcgacggccagacgcgggccgtgggcggtcttggagtcacggatgcggatcgtggtgggggctatggctacttcgacgcagtcgtttccgtcgccgctgctgctgtagctgctcttgaaccatgccggtgcggaggtgtcctcggggaccgaagagcggatcatgactctgactctccaagcaatcgctcgatgaaggcccgcgactcccggggtgtgagggcctgggcccggatcatgccatagcgcagttcgaggatccggagctgcctgggatcggtcacgggtcgcccgttgaacgccccctcggagcgcccgaccgccgtcccgtcggggaatttcagcacctcgatcagtccgcccgtgccgatgtggtcctcgcagtcgatcggcatcacctggatcgacacgttgcgcaacgcgccgaggtccaggagccgttggagctgcgcacgccacaccattctgcctccgaccggccgtcgcagcgtcgcctcctcctggacgaagtggagggccggtgcgggggaccgctcgaagaccgcccgccgcgccagccgggcggccaccatgcgctcggtctcctcctcggtgtgcgcggggagccagacgtcgaacagcgcgcgcatgtgctcctccgtctgcaacaacccatgcacgttgtgcgtgctgtacagcccgatctcgaccgcccgcgcctccatctgggcaagatcccgcaccctcttcgggtaccggaccttcttcacgtcctccttcatcgccgagatgaggccgtcggcgttcaggaccttgtcggccatgtctaggtactcggggcgggggatcnnnnnnnnnnnggctcgtccgtctcctcgaccgcaccgtccaccgacatgcgccgcacccctccgtcgtccgcgtcctacgcgtcgtatcgcgatgtcgctcaccgtagagaaggcggcgacgaggagtgacgtgaatcggcaagctccacccgcgggtgaagggccggcggggtatgcggacggcgcgcgtgccgcgccccgcagccgaccccaccctctcccgctaggctctggccagggcaggtgtgaggtgacgggagaccgggatgacggcgccggggcgcaggagtccagcagccgctcggcggcggaggcatcggtgaagccgtgccgcagcagccgagtgaaggtactgctcctgcgccccggcgccgtcatcccggtctcccgtcacctcacacctgccctggccagagccta

SEQ ID NO: 391 - DNA, 3022 bp, Unknown
  Kingdom: Bacteria, Phylum: Actinobacteria, Class: Actinobacteria, Order: Streptomycetales, Family: Streptomycetaceae, Genus: Streptomyces
gccgtcagccgtcagtcggcggcgcccggcagcacgaggcccgccggcggggccccaggccggccgggcccgccggggcgttacgccgaccgtgcggtgttgtcccggttcccgggacgggtccgccgcgcgtccggcacgatcgcttcgtgtcgagcaccgctgcactgcgcgcccacctggtgcgcgccggactggccggggtcgtggccaccacgcgtgaggtgagcctgcggagctaccggctgttcgcggccggtgatccccgtgcactgatcggaatcgaccccgaacgcccctggggacagcgggaactgatcgctttgatggccgagaagtgcggcgtttcggccgatccgctgcacaccttcggccatgatgtgattgaccccgagctgacgctggccgcgctcggtgccttcgcggaccggctcggcctggctgcccggcggggtgaggcggtgcttctcggcaccgggcacccgcaccggctgctcggtttctacgccgctctggcggacgccttgtcggcggctgggtgtactgtcctcaccccggcgcagggtcgctgtgtcgacataacgacccggttcggtctacgtacgcaccacctcgactacgtacgccgcgtcgccctggtacggcccgccggccccgaacgccccggttgtgagcccggcgcacacacgcattcaccgctcccggttcgggtggccctcgacgcggccgcggacgccggcggcccgctgccggggctggtggtcggtgatcacggctgggtctgcggggcaggtcagctggggttcgacgccatggggctcgccgacacggacgaccccgcgccgttcgtcgggcaggcggaggggcgcgtgtccgtcgtcgttccacttgatgacggtgtgcgagccgactactaccgtccgctcatccgctacgtgctcaatcgagcgggtctgtcgccttagacggtcgatgcgtgcacctcttccccactcgtaccacccgcccctagtctggggagtgagcacgcagcgacgaagagtcaccggaaggggaagccggtggccgtcgagtgcggaaggtgcaggtgtgtcatggctgcagctgaccagaggcctctcaacgaggttcagttccttaccgtggcggaggtcgcctcggtgatgcgagtgtcgaagatgaccgtgtaccggctggtgcacagtggtcatctgcccgcgatccgggtggggcggtccttccgcgtcccggagcaagcggttcacgagtaccttcgcgagagctatgtgggggtggaaaccgcctgacggcaccggaggggacccgtaccgtgcaccgccgggtccctcccgaaccaccgattaacaagtgcgccgctcctgcgggtaggctagcccctcgtaggtcgtgtgggcccatggcgcccaaacaccgagtgatgagaagtgagcgagggtagtcgtgggctctgttatcaagaagcggcgcaagcggatggccaagaagaagcaccgcaagctgctgaagcgcacccgcgtccagcgtcgcaacaagaagtagtgacgccggtcgccactgtgtagtgcgcgacatcgcgagagcgtgtccgtggcccctcacccgtgtggtggggggccactcgcgtcacataccgcagtcggtggtcatcacagcgcgacaccgaccagataggttggccgcacacggggaacgcggcatgcgacgtgaacccgcgacgcgacgtgaatgcgcgacgcgacgtgaaggagggcgctgagcttgggacagatcgtgctcgtgaccggagcggcccgccggctggccggccggttcgtccggcggatccagcgtgacccgcaggtggaccgcgtggtcgccgtggacgcggtcccgcccgagcaccatctgggcggcgcggacttcatccaggcggacatccgtcagcccaccctcgcgcgggtgctggccgagacgtccgccgacacggtcgtccacatggacgtgaccggcaccgcgctgggcggcggcagccgggccacggtcaaggagaccaacgtcatcggcaccatgcagctgctgggcgcctgtcagaagtcgccgagcgtacggcggctggtggtgaagtccagcaccaacgtctacggctccgcgccccgcgatccggccgtgttcaccgagaccaccccggccaagtccctgcccagcggcggcttcgccaaggacaccgtcgaggtcgagggatacgtgcggggcttcgcgcggcgccggcccgacgtggccgtgtgcgtgctcaggttcgccaacatcctcgggccggtggtggacacgccgctcgcctcgtacttcgcgctgccggtgctgccgtcggtcttcggctacgacccgcggctgcagttcgtacacgaggacgacgtggtcgaggtgctgcggatcgcctcccacgaggcccgcaagggcacgctgaacagcggcaccttcaacatcgccggggacggtgtgctgctgctgtcgcagtgcgcgcggcggctgggccgtcccacggtgccgctgctgctgccggcggtcacctgggcgggctcgctggtgcgtacgctgggcatgacggacttctcgcccgagcagatccggctgctgactcacggccgggtcgtggccacggacgagatgcgccggacgctgggattcgcgccccggtacacgaccgccgagaccttcgcggacttcgtccgcagccgcggccccggactgctgccgccggaggccctcgcgggggccgtcgaccggatcgccgcgttgtcccaccggggcggcggccaccccccgacgccgagcgccaactgaggagcgcagcaacgatggcggacgccaaggtcattccgttcgacgacgaccggtcccgagggggcacgggagcgcggccgtcgcggcgcaggagcgcgggcagccggcgggccggcggggattccgcggtggtcggggaggtccagccgctgccgacgggcgcgctcccgtgccccctcgg

SEQ ID NO: 392 - DNA, 3865 bp, Unknown
  Kingdom: Bacteria, Phylum: Actinobacteria, Class: Actinobacteria, Order: Streptomycetales, Family: Streptomycetaceae, Genus: Streptomyces
gtcgggggcacggtggtggggccggtggcgttcgggtgccgtttgtgtgtggcgcggcgtacccgggccgcggtgcgcgtggtgcggtgcggtatgcgcagcggtgggagcgggtgtgtacgccacgggcggtggtcttggtacgcggacgccgatcagaagctggagcaccttggtctgcgcggatccccggaagtggccgcggagcagcggcggtggtccggagtggcccggcgcgcggcatggcggccatgctggcatggctccccccacaaccggccccgcccggcagacctgaacgtgaccggcctgcggaccagctgagcacggtcgaccgaatgccccgcgtgtccctgaggtgcacggggtccttttcaatccctgaccttgagggaacgcattcgggtcgccccgttgctgtcggtgccgccggcttcggcgtcggagatcgcaccccccgtgaggacgaacatcaggtgcaggcggaccgtccgggggccggacgtgaccgtgtactcggtcatgatgtgggtggttccgccctgctgctcctgcccttctgcgttgatcgccgcgatctgggtgaagctggtcaggagggtgtctgttgtctcgtccctgagccagccgatgatgtagccgctgccgccggtcgcggtaccgagcgcgtaccgtacatcgctgtcgatgtggtataccccggcttccgggagcacgatgtcggactcggggatcggcacatcggtaccggtctcggccaagagatcggcatgctgccgctcggcgttgcggaacgcgctcaccggcgtgaggcgggcgccgatcctccagctctcggggcaaccgggcatcccggcgacgtcgatgtccaccgaccgttcgttgctggtgttgccgcccggagcgatgcccgtcaggtcgacccgcggcacgagtaacccgccggtcgtgttccgtgctgcgttgcacggggacgggtcaagagcgggcgtgtcgggcgcgtacagacatccgtcgctgccccgggtgatggcgttgcccaggtcggtggagatgcacgggggccggtcggtggagcaatcatcctggcaggagtcgaccgggatgaccggcgggaccggcgtgtagggggtcgagccgtcgagggtgtcggtcgtgcaggtgatcacgccgtcgcagttgcggcaggtcgtacggaggaacggcctgccgcagccgtgagcggatgcctggacggtgaggaccaagctgtcgacggtccactgcttgggaccgactcggcaggtgtcgtcgttgcccgtttcgaggttgagctcgacgacgatccttcccgcgaggacgtccgcgagggacacggtggtcggtgggatgacgcccttgtcgtcaccgcctgccggcagattgggtgggcccaggaggttggtacggatcgggttcgtgccgttccacagcgcgaagcggccgtagagttggcaggctgcgttccggccgtcgttgtggacatggaccgaggcgctgatcgtgacgctggtggggtcgccgcgcagtgacgcggggtcgatgtgcacgactccggcgagccaggtgtgttggccgttgtgcgtcccgtcgtcggccgggaacgtgcccgtgccgccgttcaggatggtctgagcgacgacagggtccagtgcggcatgggtattggcgatggtgtagtacggcgccgggtcggtgctgctcgcggtcgccgcgacccggtacggtgcggaatcccgcagtgagatcgtctcgcagtgccggctcggcttggagccggggcaggcacagtggacaccgacggggtgacagcccgctccggtgggccggcagtcgccgatgacgatcggggactgcctgcagccgcatccgctcatggttcaactccagtgttgggtggggtggtggcctcggtggtggcctcggtgtgtgcgaagcctctgcgggcacagtggtgttcggggtggtggtgtgccggccggccatcggtgtgtgcgaagcctctgcgggcacagtggtgttcggggtggtggtgtgccggccggccatcggtgtgtgcgaagcctcttcgggcgcagtggtgttcggggtggtggtgtgctggccggccggccgcggcggtcgaatgtcggtctcgggcaggcccgttgagggataccggtgttcccgggaaccggtcgcgcaaccgggcagaggaagaagggcgtccaccggtccgctcagcgggccgtggctgatatgacgtcggtcgtcaaccagttgcgtgcgccctcagccggtcatgcccttgagatggggaacagaagcggccatgtcgttccctcttcgagaggctgccgttgggcaaaccactgggggcgcgcgctcggacttggaaagtctcaagcttagtcacttaccgtcttcttgcgatacttaatgtactgtcccagcatccccctggcattaccccgttagggtgaccgctttcaccgtcggcgcggcagagcgctcgcattccttccgccggaagacccaagggcggatgggcgggccgcgccacaagcggatcttgtcgacgcaacgccccggcatcaccgtcttgggtcgggtgccctgcggtaccgacgctgccgcgtacgtcatcgttgcgcagtgggtgggcagttcgagccctacggggtttggtggtgtagaacgcacgcgtcacgccggtcgagggcccgttgccgggcgcggtgttaccggctgcgtggaacggcacgggggcggccgttcacgaccgctcgggatacgggctgtgcctgccgatcggcaggcacagcccgatgaacttccgctaggatccggtgggttgcctacgcgtcacggcccatgttctaccggcttccgccccgcgaagaggggggaatcgggcaaccgatcacggcatcgcacaggccctagcagaactggttgaaggtcgatgtgccgaatctggcgaacgccgcttgtgtttccgggccggcgatgccgtccagggcgccggtgtatccccagttaccgttcttgaggaagtactggagtcccttgatcgtctgcgggccgacgtcgccgtcgacgacgaggtgctggccccagtcgccgttgagccagcgctggattcccttccagctttctgtgccgagatacccgtcgatgacgaagttgccgtagaccgagccgtccaggaagcactggacacccttggcctggttctgggtgagtccgaggttgttgaccgcgcccgcggctgcggccgcgggccggggagcggatgaggtatcggccatgctgggggtggcgagggcgagacttccggccgatatggcgatcactgcggtcgtgctggcgacaacccgcgtcagactgcgcttcatgtttggggtcaacccttctgtcaagtggagacaccctccccacgtgcgcctcagaagtaacttgacggcaggtccggatttcgatctttcttgagagccgtcgacggagtcagggtgggcccgacgagcacgccgactgcgagtccgcgtacgtcctgcggcagttggtggcggtggtggcggtacgtcaagcggtggtgcctcgcgagcggcggcggggccgcagagcgcgtggatcgcggccgggctgcttttcgtgatcagtgcatgcaggagtgtcgaccagatgtcccagttcctcgtctgcatccgcgggcgaggccggtgccgggtacggatcgctcgcggcctgagccgggcaaaggccggcgccgcgcctggggacggaggcctctccccccccgggcgctgtcgcgtttcggggggaatgccgcaaggggcggaggtggacaagggggtgaggcgagcgc

SEQ ID NO: 393 - DNA, 16490 bp, Unknown
  Kingdom: Bacteria, Phylum: Actinobacteria, Class: Actinobacteria, Order: Streptomycetales, Family: Streptomycetaceae, Genus: Streptomyces
gcctcgtctccgaccgcaccatcaacacctgacaacaggccacgaccaggccaaacaggcctcacccgctatcacgcaccaactcgttaccgggcagcagctgcatcaccaggtaggcgtgcagacgctgctctacatcgcggatccgaagtcgtgcacggtgacgatgttcgggtgggacagaccgccggcgaccgcagcctcacgggggccacctgtcggtcgtggtctgcaccgccgtcgccagcgaggacgttgaccgccaccttgcggttgaccctgggccgcacgctcttgccgggcccggcgcaaggcggcggcctcagtggccgcggccttgcggcggcgctgtgcccgggtcgcctcgatcgaggccggtacgtcatccggctcggggaacgcgcggcggctcagctccagcaccgcggcggcctgtcgctccactacttcgtcgatggccggggcagccgagacggccgggcgattacggttgcggccggctcgtcgcccgcaagctcagggggcgagcccaggagccgtaggtggcgaatgcttgcaggacaggctcgatccgctcggcggcgtcgtggtcgaggccgccggggacgagccagacccggtggcaggccggactgcccatctccgggttgtagtcctggtacttgccgtcctcgtggcgcatcaggtccggctcgacgtcgatcaggccgaacgcctcgagctgggcgtgggtctcgtaggcgtcgcggcccaggccaaagtggccggcacgctcgacgccggtgacaagggcttgcgcggcgggcaggtgctccagaagccggcagtccgccggcccgggggccgcaccgcggtgcagccgccgacgcaaggccagcacggaccggcggtcaccgggcgccagattcggatgcggtacgacggtgacacccagttgcacggccagcgcccgggctcgtacagcccgctgctcctcctgcccggcctgctcggcgatccgatcgcacagctccagattgcctgccgccgcccatgcgttaagcggcatgccggccacacgcagcagtgccgtgccgcccagccgggcgaccccactcacctcagtcccccgtcatcgacgagggcctgtgccggcaagcgctgtcgggccacgggcagccggccccggatccagccggcctccgacaggccgtcgcggaggcggacagaccggccgtcaggagggtgctgcgggccgtctcgtaagccgggtcacccgcgtcgaccggcaccgagtcgcgcgcctcccggagacagtcggccagcagctggtggacgtcgagcacggtgccgcctcctcggattcgcccccactcctctggcttccgcactatccgccgcgtcaaaaaacgaggggcaagtcttcatacgatcgacgggagtacgccggtctacggcccgggccctttacgccacctccgtccgcccctgcatccgtacgcccaccgggcgcggggagccgcacgcactcccaccacgacacggctcatctgcgaatggtccgacggctcttgaacgcctcggacgcaggtctgcaggtgctggagggcagaacacgcgtcggcgtcccacggggtcgcctgcgcgaggggctgcacgtcgcatcccaccatcaggcttgggtcggacggcttgcggcagcacccggaactgaaatccggccgaatacggctggcaaggcatgctgacgccgtgagcccgcgagactggcagatcaccgacgcagcctcgtggcggcaggaagtgaacaggaggggtggacggttgtgccctggcggtgcaccggcctggtcagtttcagcaacctccgggggcttgcggtggatgcacgagcgcttgacataaggagcctcgatggtcccgaagccgggtttcccacccgttcccgtggtcagatcggacttcgctctctcatagcccttgttgagctgggtgatctgttctagacaggacaaccgtgaacgagagcgtggccgctgtgctggcggcactcataggtgtgatcggcgcccttggtggaacgtgcgtgggtgcatggatgcagcggagagcgaccctggagcagatcgctgcacaggagcgagcagagcgacgaggccaactccgcgcggatcgcagcgcatcctatgcggaggtcatggaggcttctgaacggttcattgcttctctggacgatgtggtggcagcccgacgtaacgctgcaggttcgcccggtgtgacaatcaggtggggggagatgcgtgaggagagccaggcggccatgaggatgctgcgccgcgcgatctggaaggtaagggtggccgggcctgaagatatggctgatctggcaaagggtatttacgacgtaaacatgcaacgattcaaaatcgcgttcggtgaagacatgacctttgacgtaatggacgcacagctgaacgagaagaacgctgtcttccggcggtcacgctcccagttcgttacaggtgctcaacgtatcctcggcaacggaggaacgggccctcaagaaatcaggcaggtgtcgtagacgtctgccgtggggcctctgcacccggggcgcacaagcgttgtcccgtaactgacggtgtcctcccacctcagtgaggttcggccgacgccggcaagagccagtgctgagcggcgaaatcaggtcgacgtaggtcagtgcggtatccgatcatgcgttcatgcccctgagagagaccctcacccgagtcgatgcagacctggccgctggtcgggttcccgtcgcgcgccagcgtctgcgcggtctcatctcgtccttcccgtacgacctgacgctccgccgtcgtctggccgaggtgtaccggctctatggcgatgctgccgaggctggacgctggatgtacctcgaagaggaccggaacgccgacgagaccgctgccttcgaggcgcggtacgggtctcccgggtggcggatgaaagccctcgcctggcagggccccgaggcgaaggccgccaccgtcttcgcagaggagcaactggtcgcggtgcggaccgcctgcgccgaggaattggggcacccagtcgactggaacgaccccgcctcctaccgggacagcctgggaggggattacgaggcgccctacgagccgtggacggtcggcggtgtgctggcaggcgtcggctgcctggtggcgacccttgggttcctcgcgatctgggtgaatgggctcgtcgccctcttcgattgacacaggtcacccgggcttgtgagaagcgccgctcggggcttgtcggcggctcggatccaatgagatccgatggcggctgatgagagggtttgctgacagctagggtccgatgcgccgacaggaacgaggaagagcgtgaccaatctggtctacaagcgggtgtcgacggaccagcagtcgaccggccgtcagaacctcgtccttgccgaggccaggatcgaggacccggtcgtcctcgaggaataggctggcacctccagccgcctccacgcgcttgagcgcccgaagttcggcgagttgctcgtgtacgcacggccgggcgatgtcgtgcccatctccgagatgttccggctcgtgtgcggcactcagcacatcctcgacgtgctcgacgtcctgcaccgcgaccgtctcgccgtgcggatccacgacggcgcgttctccgcgatggacctcacccgcccgccgcccgcgcaccggggaactgctgtccaccgtgaagttcatggtgcagaccctcgccgccgccgacggactccaacgcgacctccagcgcgagctgacctacgacggactacgggccgccgaagcgaagggcaacaaaggcgggcgtcgcccggccatcccggcagacaagagcgacgacgtacgcaccgcgtacctggagggccgctccatcgccgccctggcccgcgacacaacgtcaaccgcggggccatctgtaccgccgtcgccgacctcttgaccgaccacaccgccgtcgaccaggacgcccccgacccggagccgccggtgaccttcgacatgccgggcaaggccgacttcccctccgcgccgccgaactggagcccgccgagcgggccgcgcccgacctgggcgtgaccgtacgacgcggccagggatacaccctctgcatcagcgccgtcccggcggtacaccgccagctcctcgacagctgccagcccctcgacaacaccgcggcgatcccggcccagcgcaaggcccgccgcgagtacgcgaaccgcgtcagcaacctcgaccagtaaccaagatcatcccgtggcgggattctggcgtatctgggtcatgcccctgatggcatgtccgccacggctacgccacctccctgccctcgccagagcagcgcgcggaagggaccgggcaaagcccggtaggtggcacatagggcaggctagtcttctgagtctggaattctgttcagatagctggcgaggcgttcgaggatctcgtctgcggtcttcgtccagacgtagggcttggggtcggtgttccatgcggtgatccaggtgcggatgtccttttccagtgcctggacgcttctgtggacgccgcgccgtatctgcttgttcgtcagttcggcgaaccaccgttcgaccaggttgagccaggaggatccggtgggtgtgaagtgcaggtggaagcgggggtgggccagcagccaggttctgatggccggggtcttgtgggtggcgtagttgtccagcacgagatggacgtccaggcccgccggtatctcctggtcgagtttgaccaggaacttcttgaactcctcggcccggtgccggcggtgcagggagccgatcaccttccccgtggccacctccaaggcggcgaacaacgtggtggtgccggcgcgcacgtagtcgtgggtgatgcgctgtgggacgccgggcatcatcggcagcaccggctgggaccggtccagggcctggatctgggacttctcgtcgacgcagaacaccagagcgcgctcgggcgggtccaggtagaggccgacgacgtcgtggaccttgtcgatgaagtacgggtcggtggacagcttgaacgtctcggtgcggtgcggctgcaggccgaaggcccgccagatccgcgacacggtcgactgcgacatgcccgtctccttggccatcgcccgtgtcgaccagtgcgtggcgttcttcggcgtcgactccagcgtccgcttcaccaccgcggcgacctgatcgtcggtgaccgtccgcggcccgccaggccgtggcatgtctcccaggccggcgatccggtgctcgacgaaccgcttgcgccagcggcccaccgcatgcggtgtcgaaccgagttgcgcggccacgtccttgttcgacgcccccgacgcgcagcccaggatgatccggcaccgcaaagcccacgcctgcggcgtggaacggcgccgcacccatccctccagcgcagaccgttcctcatccgacaggatcaactcagccttcggccgcccagcacgtgccaccaggcaagcctacacaactgaacagaactcctgactcagaagactagggcctctcgtttgggtcaagttgttggagcggtcctcggctacagtgcgagtatgacgatccgtcgcatcatgcccaacgtcgtcacccaggacatcgaagagagccgaagcttctacagcgatttcctgggcatggacgtgcgcatggacgagcccggcttcttgatgttggcctcgccgggtaacccgacggcgcagatgaccgtggtctcccctgccgcagactcatgggacccgcataccgcccattcgacactggcggtcgaagtcgaggacgttgacgacgcgtacgccgcagccgagcgccaggggtaccaggtggtctatcccttgaccacggaaccatggggaatccgacgtttctttgttcaggcacccgacggaagtgtcatcaacgtccacagtcacgtctgagcatgaaggatcgggcagaccagaggaagataccggcgatgtggagtccggccaggtagacggtggcggtcttctcgtagcgggtggcgttcccgcgccactgcttcaggcggttgatgcaccgttcgacagcgttgcgccgcttgtaggtctcacggtcgaaggccggtggtctgccgccgcggctgccccggcgtatccggtgtccgcactgttcggcggggatggggatcactgcccggatgccgcgcttgcgcaggtgctcgcggatcgcgcgggaggagtacgcctaatgggaagtgaaggccggtggaagctgaccttcaggggcgcgagttgagcctttgagtatgcccgggcctgagagccctgttgacaagacgaggctggctcgcgcccagcagtctgggcatgagtgctcggatccaggaccggttctgtctgtttgggcctcgaagtggtcctgttgctgcgggctggtccttctgcgtccaccgggcggtttgctgtccgttgtccgagccggttgtgcggatcacctcgttcagtcccaccagtcgttgccggtgtgccaccgtcgcacccactcctcaaagccccatgtctggtcgccgggcgccggaatggccccgacgtcggcgaccatccacacctctccgcggcggtggccagtggtgagcaagagccagaacgactgcccgtcctcggacccgagaacgacggatcccttgttgagcacggcatcgatccgcgggtcctcggggtcgacatcttcgtcgtcctcccagccccaggcggcctccaggggaaacggttcgcccggctgtcgcgggccgaggtcgggccacgcgccgggcagccggccgagcggctgaagaccgccgtcacgggcagggccaaggctggagccgttgctgatctccgcgatgaaggtcctgtacggctcgggaaggacgacctggttctcccgttcccactccgcgacggcctcatgtccgagcgccggctcgcgccattcccgcgggaatgcagaccgcaggaagtcgacagtggcttcggaggggcgctgatcacattggttcgtcacgacagcatgctgtcagaacgagctgagcccctcgcggccgcctcacccgacagcaggtgtctcccgaagcggcgaacatctgctgttcgttctcagggtctggctcacttctgtggtgccgacggtcgcaccgggagcggaacgttgccgtgcccgtactccgcaggtcaggcaggtggagcggcttcctggagacggtgctcctcgtactcgtccttcacatcacagaagttgagccagaacctcttctcctgaacaaagccaggacgacttccgctgaacctgtgcaatccggggcggccgctctggcggccgcggtcgccgcgcaccgggccgccatgtggcaccgggagactctgcgcctgacaggggagggctggaccgacgagcgccgtcacagccagaccacccgcgctgccatctctgcccccgccgtccgtctcgcggtcctggcccccgtcctgcgcccggtcgccgacgctgccgcccaagcttcctgcgccctgcggcgcgcagtgcaccgaggccctgaccggtctggttgttgtagatgcggtaggtccgtcgccggggcgtagagggcgaccctttacggtccggcccgtgcgcacagcgcacgggccggcggcaagccgcggggtgtgtcctctgtgtcgcctcggcggtgtctcttcaggagaagacgacggagcgcaggaggaggcggtcggatgcgcccgtgttggggggcagggtgtagtaggtgtcgccttcgcagtcggcgtcgaggaagacggtggcggtggcgtccgtgcggttcttgggtgccctggaggccgcgccgggggcggagcccggcgcggggaggttgatgcattcaccgctggcggggttgttgaggaagccgacggcctcgtatccctcggcggtggtgtaggtgtagcggaactggccggttgccgcggaggctgagccgggtgcggccagaagcagaacgaaggcgctgcaggcggcgctgacggccgccgtgatcgatcgacgggtcatggtgggtctcttcctgtcggtgcttgggctttccatgcctgtgattcctgaggacgcgggttgccacggcaactgggcggtgaccgggggcagaccagtccgctttagccgggctggtctgcggtgaagcggtagatctcgccgccggcgtagatgtgccagacggtgccgtcggcggctgcgccgatgtcggtcgcgccgccgcggaccttctgccagggggaggcgtcgttgttggtgtagcggtagatgccgtcgtcgacggctccccagacgttggaccgcgacccggcggagatcaccttcagtgagccggagacctgcttccatcctgcggaatcctggtcgccggtccagcggtagatgttgccggcggagttgacgtgccagacggtgccgtcggcggctgcgccgatgtcggtgcccgtgccgggcatctggattcagggggaggcgtcgttgttggtgtaccggtagatgttcccggcggcgttcacccccccatacgttcgtgcgtgagcctgcctgccgcaatccgtacgagagcgccggatacccgctgccactcagccatggtgtcgactcccttgtcgaggaggggcgtgcggggaaatgctgacggcataaccggaaggtgcggaaggccggaatatgtatccgaattcttttttcgtcgtaaaagtgatgtttgctggttgaggagcgtgttcctgcctgacttccggcctcgtccgctgggaaccggatggcccgatggaggtcgctcacgtgggctaccccatccctagccggtgctggtccttggctgtgcggcgggaactgtctgcgccaccgggttgcccccgccagcgatgtgctgtgcaacgagggcgggacgacgccgccgtcacgcctcgggctgtgaaggctccacctggcgcaggcagtacacgcacctggactccgaagcgacgcggcccatgcacttcgccgcccggttggcggtgcggtacgtgcccgagatgcgtgtggtccccgccggaagagccggcggggaccacacggagcgggtcgggggatgcgtgatgcatgagcactcagcatgacggcccggacggtgcgcaccggcggccgccgggtgtctcggacactctcgtgcaggctctgggggggtgcccctatgtagttcgtcaaggtggcgggtggctctgttcacgagggacggctctggtccaacttctgtggaactgtcacgctctgtaatgtctcggggctggatggcccttcgtgactcgttgacagacctgtttgggatcatgcccacatggtcttcgacctcgccccaccaaacgatgttggcccgttgcggatcggtatgactcggcaatcggccaacgcggcactgggctcgctccgcgatctccccgcggtcttggagtccgaccggccgggccagcacgtcttccgtcccagtgggctgatgatcagcatccactgcacgcgagacatactcgaagccattgagctcgggaggccgtcgactcagacagaccgagtcatcttccggggcctggacgtgttcgcaacccccgcccgcgaactggtgcaacgcatgggcgagtacacctcgatcgaggcagatcccgacgacccagcgtctttcgtcgcctctgacctgctgctgagcttctggcgcccgttcgcagccgacgacgagccagaggaagagcagggctattacttcagctcggtcctgctggcacggcctggctactacgacacccctgctcaggctgcggagcgactccagcagagctcgtgactgcctcgtcaggatgccagcaggactcgtttccgtaacgagctcgtgcacggtaggcggtgaggcgtcgaggacttcggcggggctcagtgttcacatctgccgtgccgaggtcaggtccgcagtttgctggtgggacagcagggcggcgacggcttgcacggtgtcgctgatgtgctcgcggcggccgaggtggcgggccagtgcccgccagttcttcagatgcgcgatgccgtgctcgactcggatacgccgcgaggagtgggccttgcgttgccgctcgtgcatctcctcgtaccagtccggggcgttcttcttgaacttgcggtgcggtggcgtcaccacacgcccgccggtctgggctcccaggccctgctagccggcatccgcgaggatcttcagggcgggcccgccgtccaggagcctgaccagccctaactggcgggcatgggtgatgtctgcgcagctgccgtgctgagccggactgcagaagaggacgcggccggcgccgtccgtgacgaccatggtcttgaccgcgttctgcttgttcttgccggagatgaacttgtcccggtctttacgtccggcagccgggcgcctgactcgaatctcggtgccgtcgatgatgccggtcttcccgctggcgccgaggtggtcgacgacctcggcgagggtccgcagccgcactccgcggctgatggtgcagcctcgctcggccagcagaggccgcacctcaccgatggcacgggggatggtcgagcggtcgacgccgaaccagcaggccagcacgtcgtgagtgacggcgtgacggagatgcaccagcgtggccaggagacggtcgacgaacaccagctggtgcttcgcgccgacacccaccgcccgcttccgtggccgggacacgagcttggcctggtgtcgctcatgccacaacgggccgacctcagcgatgagttcagcgagcacgccggccgacaggcccgtgatcctccggtcgctgatgatcgctgcacgagacatgttccccatcacacgaccatgatcaacgatcgagaactcgaagcctcaccgcttaccgtgcacgagctcgttaggcgctgggagggctgctgaaggcggcactccaggtttggttgggctggttagcgccgcatgcgtaggtggcgacggtggaggaggtgctgccgacggtgccgccgtagacgtccaggcaggtgctgctgccctgggtcaggttgccggagcggtggtatgtccagacctgcttggcgtctgaggagttgcaggtggcgagttgggcgccggtggtgtcggcggagatgcacagcgacggcgcggcgtaggaggagatcagaccgttggtctgtcggacccactgctggttgccgctgccgttgcactggtagagggcgactttggtgccgggggtggcgccgttgtacgcgtccaggcagagcgcggtcttctggaagtctgtctgcgcggtctggatctgcccggtgggcaacgcggcgccgcaggagccgggtgcgatggtgtacatcgcgttgtcgtgcgaggcgatggtcgcggtgatcgagcccgtcacgttctggtcggtgtgcgtccacagattgcgggcggtgcgagtgcacccgaggttgccgaagccgacgcggccgaggtcaagggcgtaggtggtggccgaggcgttcttgttgaggacgactactgcgcggccgccgcctgccagcggcttgacgacgacgtcgatgcccgcggtggccgaagcgttgtcgcgcgaggcgaggtagccgcccgcgccgagggagtcctggtcgacgccgatgatgtcgctgttcttgaggatgttcagctgcggcgcgtacgtggcggggtcggcggccatcttacggacgtcagtgctgatctccaggggagaccccatagccgaccacagggcgaactggctgcgctgctcgggcaacgtgagctggttgttgtcgccgatcagcagcatgtcggcgtcgctgaagtcgccgggggcgtcgtagcgggccagcgccaccgtgtctgtgaagttctggtacacaccgccctcgtagtagtcggagccgtgctgccagtcccaggcattggtggtgggcgagtgccagaccgcgatgtcggggctgaccctccacatctggccaagtccgcgcacgtagttcatcgcgtcgtacttggccgagctgtcagggccgtagcccgccggcgcggactcgttgagcaggatcttgcggctgttgccggctgtcgcggccttgagcgcgttcgcgaccttggtcagctcggtctggcggttgctgctgtcggtgccgcaattgtcgaccttgagggagtcgataccccagtaggcgagggagttggcatcggcctgttcgtgccccatcacccccgcgggcacaccctggcaggtgttggcgcccgaggtggtgtacaggccggcctgcatgccctggctgtgcacgtagtcggcgtaggcgcccagctcatagtcgaatccgggctgggaggagccgccccaggtcaaggcgccgtgcagatagccggagctgttgcgctgcatccagcagtcatcgacggtcaggttggtgtagcccgccgcgaccaggccgctgtctttcatggccttggcttggtcctccatgaactgctggaaggagtacccggtgcgcgtgccgtccagccgggcctgcgcggcgcaggtgaacctggcccagttgttgaaccccatcatgggcttggtcccgatggcggtgtcggtgttcgcggccaccgggtcggcgacggcaggatatgtcgccaccgcgatacccgccgcggacagcaccaccgcggagccccaacagaccagccgctcatgccaactcatgtgcgatctcctcgcgcggggggaatgatgaaggggaagccgtgctcggagccggaccccctccggcccactcctgccgtgcaggacccatgcagttgacgaggggtctgtgtacgaggactccaaagagtcatgcaataagttgtagtaatgcagtgctctgcgagcaagtacgcgcaaggttgacaggctgcctcctgtagggtcaagaggctggaacgcctcagcaacatgtacgcctacaccgcggccttccagctcaacgactacggccgggcggcaaccgcctccgctcttctcgccgtcgccgcccccgtcctgtccgtcgtggtcacgcgcgccgggcgcgggcggtccgcccggcggctggaggtggccgcatgaccccgctcgccacacatcgggacgcggcttcccggtcccggtgatggaccctgtcccgcgcaggggtgaacggcgctctggtactggccgccgcatacaccccgctgccgctggcctggctggtcaccccggccgcgaagaacaccggtgacctgctggcaggccgcagcctcaccctcgccaactggcctggggcggaaccggcacgacctgttctcggcagggacgggatctaccgccgctgatatctcaactccctcctctggcacttccttgatgtacctggtggcgtccaaggccggcgccgtccgcaccttctgggcggtgttcatcccaagcctcctcaatccgttcggcgtctacctctcgcgcgtcttctccgccggctacatcccgccggcggtcctcgaagccgcccgcctggacggcgcaaggaagctgcacatcttctggttgatcggcctgcgcatggtgatgcccggcttcgtgacggtgttcctcttcagcgcaccgccatctggaacaacttcttcctgccccctggtcctgccctccgacaaccatctgccggtcggcctgggcctctacacgtggaacacgcggaccagcgcgttccccgaataccacccgctggtcatcaccggctccctgctggcgttcgtcccgctcgtcgtcgccttcgtcgttctgcagcgccactggaaagccgggctcaccgcgggcagcgtcaagcgccccccccacacaccggtcagtgcacatcatggagaactcggtgaccgactcccctgtgccgcacaaggcgagcccaccacttcggccgcccaccttcggtggcggggaggcgtcccaaagcgctcctggccatgcacaagggcctagtcgacgggctcttcgagcaccacaggaagaccagactgaccgaactggcggacgtggacatcgcactcgtggccgacgaccccaccacgcctcaggcggcagcggcactgcgcgatgccgaggtcatcatcagcacaggggccgccggctcctcgacggcgccgccctggcagccccgcggctgcgggcgtcatccacggcgcgagcttggtcaagcaccccatcaccgacgcctgctggccccgcggtatccaggtcagctcggtgcatgggccaacgcgctgcccgtcgccgagtacaccgtcaccgccgtcctggccgggaacaagctgctcctgcggttcagcgccgactcgcgcagcccttgttccatgtggaaggcgtagaacagccggacgggcaccaccgcatggccgcacaacaagatcagctggtggccatccatgcaccacaccagcggacgtgatcgtcggacgcaatgcccggccggacgaaaatgtgccggcctcacggtcaggatgtggctgtcgtagcaggggtggggggaacgccggggcggcaggcgagggaggcatccggtgaacgccaggccggaggggagaggaaggtcctggtgtccgtgccgtatgtcggtgggccgttcgccggggccggcgcgcagtggcgcggtttccccggcgggtttgcgcgccgcctctgcattggccacctcgccccggaccaggagaccggggatgaggacccgtaccggtccgaggccaccggctgctgggcgtcaggtccgcagcgtcgacagttcccggcgcgcctcgtcggcgccaagagcggtgaaccggtagtacgtacgggccggggcgacactcgccccgtccacctccttttcccgcgccacccggccctcgtcggagaggcgatagaggatggggcagatgctgcccgaacgcaggctggtctccgccttcgtgggccccggcgtaccggctatctctggaccgagccccactcgctccggcaccccgaggtctcgccgggcgcggctcggcgatctcgggatggggtgtcgtggtccgctcggcctgctggtcgggcgcggtgctcctggcggtgtggtcggcgctgtcgctccggtagggagtggccccggctgggtgccggaccgtagggtcctggacgtggatgcactgcgtggtgtctctgtggtcctccggcccgccgtacgtgcggacgcccccgctctggccgccattcgggccaggcccgaggtccgtgaacggtggcggggcggcgaggacctggaggccgaggtcctgaccgggctcgacgaccccggcacgcactgcctggccatcgagtacgcgcggcgggtcgtcggcatgatccagtggcacgcggaggaggacgctcagtaccggcacgcgggcatcgacctcttcctcgacccctcggtgcacggccggggcctgggcaccgacgccgtacggacgctggcccgccatctcgtcgacgaccacggcttccaccgcctggtcatcgacccggcggccgacaacgcggcggcgatccgctgttacagcaaggtcggcttccgcccggtcggtgtcatgcgccagtacgagcgcggcgcggacggtacctggcacgacggcctcctgatggacctcctggccgccgaactggtccgctgatcgcgcaccccgccctccagcccttccagcgtcaccgtgatcaaggatgcggccggccggtactttgcgagcttcgtgatcgagaccgaccgggacgccgaccctgccaccgcacccgacgccgagggcctgctacgcggcgcagaccccggaccggaaggccagcatcctctcccctcggggagaggatgcgcgtcactgcttgccgtagccgacggggtcgaccgtgacgcccggaccggactccgagccgtccgtcaccgggaggctgaggccgatccggagcgtcttggagtgcgtctcgttcggcggggtcacgacgatggagacgatccggaggccggtgccgccggtgtggttgggcggggtgtggagcgtgaagcgggtggtctcgccgccgccgaggacgacctcctgcggggtgttcgcgctgcggcccgcgctgaaggtgtcgccgtccgacgtattcaggtcgacgccggggaagcccttgagcgagcaggcgtcgctgttgttcttcaggctgaccaggacgtcgccctcgctcatgccgtggtcggcggtgatagtgagatcggccgtcttgcaggggccggtgttgatctggccgccgccgctgcccttgtcactgccgttgccggagtcgccgcccttgctgccgtcacccgtggcggtgccgccgttgccgccgccgctgcccttgtcactgccgttgccggagtcgccgcccttgctgccgtc

SEQ ID NO: 394 - DNA, 10571 bp, Unknown
  Kingdom: Bacteria, Phylum: Actinobacteria, Class: Actinobacteria, Order: Streptomycetales, Family: Streptomycetaceae, Genus: Streptomyces
taccagggcggccctccggcagggaggcgggtcggcgccgacgtggcgacgacgcctgccctcgtccggacgccaggtaatgcgttgcgtcccgtcttccagcccgagcggtgaccgccctcagatccccgggccgcgtcgagtcggcggtaccgaccgggtgttgagacgaccgtccccgtcagccgccctggtagccgtggcgtctctcctcggcggagcgggcccgtgcccggtcatcggtgaccgcgacgggcaccacggcgaccgggcagggcgagtggtgcaggacggtgtgggagatccggccgagctggagcccgaagtgccccggacgacggcaggcaccgaccacgagcagatcggcctcgcacgcggcgcccaggagcacgcgccgggtcagcccctccacgaggcggcgtcgtacctcgaccttcggcgggacgtccggcagcgccgctcccagagcttcggtggcttggtgctcgcaaccgactgctggactccggaccgtatgcgttcatctgggtggacgcgctgacccggcggtgcagggtgcggtacatgcggcgccgttctgtcggcggcagtaacggtcgaagtcgcccagcctggggctaccgtccgcggacggcggggccccgggagacgaaaccccgcgcgcgctgagggagactggcggcctccagcgcaccgtatctcccgctcgccacgagttggaacttgacaccctcccgaccttcggggtgctcgtagccatcggggaggaaccgccggtagtgctcgctggcgcattggaagaactgagggcgctcggagcgggagagacatccctccagattgaggaggaagaggtagtgacgaatcatacgagtgaagagaaagggagccacaacgtccagggcgtcgcgctcctcgagcaagtcgaagctctcttcgtaccggccgaagacgtcgaagtgggtgccgtccggtgagcctgcggggtgttgagtgtgccggcggcggatctggacgcagttccatttcaggacggcgacccggtcagcggcgagcatggcgcggtggccgactgtgacctcctcgtggagaccgtcagggaacgcgagttcctgccggatccacaagtcgcggcggaccaaacggtcccaggagtaggcgggagcaccgaacaactcgggctgatcgagcggggcgaaaggctcacgtccttgccgggcgagcagatcggcggcggcaccgggccatgagcggccgcgatggaggcgagtgtgcccgaagagaagaacatccggctcgcctgacgcttgcagccgatcggccatcgcctgaagcgtttcacccccgacgatgtgatcgctgtccaggaacagcaggtagtcaccggcggcgcgctccgcccccgcgttgcgtattcggccgatgccggcgacgcccgtcagccgcacgaccgagacccgcccatcgcgccgagcatagtgatccaccaagtccgcagggcattcagcagactggtccaggaccgcgacaacctccacgtcccggaaggattggttcagtatcgaattcaggcagacccccagttgtccgtgaaggtcgtacgcggcgactatgacgctgatcatcggcgtgaactccgctcgaaacgctgcgagatgaacagggggcgggcccgcccctgtcttgatgccgcccgcgtacctccccccggagagcaggcggcgtgacccccgaccgggggacactgtgttcagcgcgtcccaggtcctgcgtgtcacaggtggcggcccatcgttacaagatcgccaagcttgtgctcgatctcctgctgctgtagcggcgcgtgctgccatggccggtcccggtcggatggtgcgtcgctgtgccggggcgacgtcgcgcgcccggtgctcgcgggtgaccggctggttgtgtgacacccgggcccctcggtgcgctgtatgcgtggggccctcctcccgccggtgcctgccgccctccagtgcgggctcctgcgccacgggggcaggcagatgccttttcgctggcgtctgcctgcccgccgcgggcctggccgggtccgtggtccgtcatccggcaggccccggtacgctgagccgaatacagtccaaatcggttgtcaacggtccttttcgggctgaccgggtgtggagtgttcgagggatgcggggtgggtgtacgcgtgctgctgacggaccgctacgagcttgaggaactgctggggccgtggcgcgatgggcgacgtgtggcgtgccgccgatcagctgctcgaccgcccggtggccgtcaagctgctgcgcgcggcggagagggcggacaccgcacgtttccgcagagaagcccagagcgcggcgtgcctgaatcatccgaacgtggtgggcatgtacgacttcggctcccacagtgaccagctctacctggtcatggaattggtcgacggatggaacctggcccaggagcgggccttgcggggcacgctggccctgcacgaggcatcgggcatcgcggcgcagattgccgcgggcctgtcggccgcacaccagcaaggcgtgatccaccgggacatcaagcccgccaatgtcgtgctcaccctggaccgcaccggtgctgagagggcgttactgatttcggctcgttggggtgaaccttcatgaagtccgtgagggacccggagcgatgcctgtatcccctggtgggtgagatatgcggatgggggcgggctgactcctgcggggcggcaacgccgggagacggtgcggatgcaggcggccgagctgttcgagcggaagttcaagccgccggaggtggcacggcgcctgagggtgagtgcgaagtcggcctaccagtggcatcagttgtggcgggacggcggcgtgcaggcgctggcctcccgaggcccgagcggatcccggtgccgtctgtccccgcgctgcctggagaagttggccgcgtatctggagcagggtccggccgcgcacggctgggcggaggaccaggtatggaccgcatcgagagtggccacgctgatcggcaggaagttccacgtctcctacagcgtctcgggtgcgacgaggctgatgcgccggtagccggcatccgcgaggatcttcagggcgggcccgccgtccaggagcctgaccagccctaactggcgggcatgggtgatgtctgcgcagctgccgtgctgagccggactgcagaagaggacgcggccggcgccgtccgtgacgaccatggtcttgaccgcgttctgcttgttcttgccggagatgaacttgtcccggtctttacgtccggcagccgggcgcctgactcgaatctcggtgccgtcgatgatgccggtcttcccgctggttccgaggtggtcgacgacctcggccagtgtcggagccgcacacccgggctgatggtgcaccctcgctcggcgagcaagggccgcacctcgccgatggcacgggtgatggtggagcggtccacaccgaaccagcaggccagcacgtcgtgagtgacggtcaaccacagcccgcacttcgccccggtgatgcagccgaccctggacacgggcgcggccgcgctgaggatcgcggcgctggagtggctgggaaccgccgcggggacgggggcggggacgtccggcgagggtggctgatgcggtacggcggcactgatgccggggccgggagcggccagaacaatgcgatggccacgaaccggtgtacagaaccgatacacagaatgaacgcgagacgagaaacaccttccatgagagtcatggggcagtcgatactgtgggggagcaaggccccgccggatgccccgagttgccacgcacccggtgtcagcacgagcacggaaaggacaccggtgggtagtaacactgctttcgacaaccgtatgaggcagccggctgttccacagccccggcccctcatacgcggcgcgaagaatctggcgggggcgccggaccgccacagcatcggaccgatgatggggtccatacaggcgctcgccggcaacagggccgcgtccgccgtcgtccagcgtctcgcggggaacgacgagacggcgaagcccgccgacgagcaggccaagccggaggcgaagaagaagtcccgtaccgggctgaacatccgggagcggatcgccagcgcgctggagcgggccaacaagcacctcgacgtcctcgacaccttcgtcctgcgcggcatggtcccggccaacgcggagatgaactggaagtcgtcccagaacgccgacacgcacttttcggagcaggccggcgcgtccaccgccgcggccggtgccgagatggggctcaccgacggggtcacggcggtcaacaacgtcatcgacgccaccaaggcgtacaaggagtccaaggagaacccgacgggtccctcctcccacgccccgcgcaagaagtacccctccaagatgctcgacgcgatccagaacacggcgaccgacgcctccgacttcatcggcgtcgccaagaacgctctgcacgcggagggcctcgtgacggcggcgagtgtcgccgaggccgggagcgggatggtcggcgccgtcgcgggcgtcaagagcgtccgtgcggcgcgccggttcgggatgacgacgcgcaaataccagaacgtcaagaagatcgacgtgcccgcgccgccggtgcaggagcccgaaatcaaccggctccgtaaggcggaggtggacagccactgggcgctcgcgcgggcgtatgtcgcgctggagcgtgcccatgacggcgacgacgagggcctcgcggaccgactgggcgccgccctggaccagaccagtgccgccttcacgagcatcgagaaggccgccgacgacgtcaagaaggcacaggacaccatcgccctcaacaccgcccgggactacgcgctggcgaagcagcgcaacaagctctggaagcagggggtcggcgcggtcggggacggcgtgaggtcggccggcggcgcggtggcgatcgcagcggctgccacggggacgctggcgagcaacccggccggctgggcgctggccgcgacagcggcggggctcctgctctcggtcaccgcgtacaaggccgggcgcgccagcaagaagcgttacgacggcgcccgccaccccgagcgctgggccccgcccacggaggagggcgagcagacgacagccgagcccgcctcccgccaggacgccctcaaggaagcgctgaagttctggaagaaggccgaacacagcaagcgcgacgccatggcgcgcaccctctacggcctcgccgcgggccccggggtcccggccggcaagggcacctcgcccgaactgcgcacctcggcccgggaactgctcgtcgcgctgaagtcgggtcccgggaacctgcacatgacggaggaggcgtgggcggcgtccctgaacgatcccgccgacgccgagaagtggcacaaggagatcgccaaccagctggcttcgagctgaggttggccggatgtccgggtgtccggttgcccggttgcccggttgcccggttgccccgctgacggtctccggcgagaggcaccgccccggcgacgcctctcgccgaccccggggcgcggaccggaaatccggaggagccgggcggcattcggatccgtaaacgccgggtgctcagcttgtcatgccttccaagcgtgggtctgagacggtcattcgtgacatcgtcgggccccagggggtccgggtatggctgtcagcttgtcgccgttggatgggtcaaatgacttggccgcccgaagcctcgcgacgactcgaccgctcattgggatacgcgactcgatcgctgtttaggacaacgtcggcgaggtcgtctgctgggctgcatttgaacgacgagctggcggagacgaccgtgcccgagatctggcccggagtgaacatcggcaaggcacaccaccactgcgtggtgatcgacgcgcagggccaacgcctcctgtcacggcgagtcctggacgacgagtccgcgctgctgcagctgatcggcgacgtactcgcactctcccaggacgcgctgtgggctgtggacatcaacgacggtggtgctgccttgctcatcggcctgctgcacggccacgaccagccgatggtctacctcaccggccttgccgttcaccaagcatcagccgcctaccgcggccagggcaagacggatgccaaggacgccttcgtcttcgccgatcaggcccgcatgcgcaagggcctcggcgtcctccgtcccggtgacgagatagccgtggacctcaagatcctggtcaggcgccgtaccgacctggtcgacgatcgcacccgtcacatcaacgggctccgggaacaactcctgcagatattcccggccttggagcgtgggctcagtctgacgaacaagaggccgatcctgctgctgaccggctaccagacgtcggccgctatccgccgcagcggcgccaagcgagtcgagacatggctgaagaaccgcaagatcaaaggcgccgccctgctcgcccaggccgccgtcgaagcggtccaggcccggcacaccgcactgccccgcgagaagctggccgcctcgatggtgggctgcctcgcgaagggggtgatggccctcgaagaggagatcgccgagctcgacgcactgatcgaggctcggtttcaccaacacccccatgccgaagtgatccgcagcctgcccggcatgggggccatgctcggggccaccgtcgtcgccgcgaccggtggcgacatggaaccccttcggcacatcagaccggctggccgcgttcgccggcctgtcaccggttccacgggactgaactgccccggttctcgtagagtccgcgatcgtgtgatcaagcggtctgcgggacttgctccagtttcgaccagtacacctgttcgtactcgtcgggtggcatgcagtcgagggacgagtggagtcgttcaccgttgtaccacgcgtcccgggcttcggcgccctcccgtgtcgcggtgtcgcgatgccgtacccacgatgttctccaatcggacgtacgaagatcccggtggtccgcagacttctgaccgcccggcgcagccctcgccgcggccacggcaaccgcctgtgccggcgggcgcccatacggcgctacgacggtgctcccccgcccgccgctcccagccgtccaggaaggtggccagggcgcggcgttgctcttcctcgcgggcgatctgccgggcgaggacgtcgcgatcgacgtacggggcgacggcggcgcccgcgcccggcgcgaactaggcacggcggtggggacgacggcgtaggaccaggcccgccacgggccgccgcccgcggcccccgaggcccccggggccggtgggctgcggccttcccggccgctccctcctgacggattgtctggccggtggccgaggcggtcagtacctcgagaccttcgaggaaggttccgcgcgggccgccggtggtggcccggaccggccgcgcccggccggacgacctgaccgccggttcggtctcttgttgtgacgttctcttacagtcacgctcgtgatcttgagactgcgaagacttgaggaaacggtacgagcgagggtggcaccggtagttctgaccttgctcgccacactgatgacagtgacgagcggtcagcaggccgtggcaatggacagggacactttcaaaagcgaggacgcctcctcgttcgtgttgtatccgcgcgaggtgccgagcctggaagcgggcgagacggcgcgggacgtgatctgcgtgcccggtcgccggcactgcggtcgatgccgaacttggtggccagctgcacctggtcccggcggccgtggatggcccggcccaccagcacctcgttgtgcccggtgccgtaggcgtcggcggtgtccaggaacgtgatgcccagctccagggcccggtcgatggtggccaggccgccgttccagtccgcggcgccatagctctcgctcatccccatgcatcccaggcccatcgcactgacggtgagaccgggcgagccgagcgtggttcgggtgatcatgcgcggatactcctcctgcccggcggaccgggcggtacctcgagggcggacgaacgcctccgaaactaggactttgagtgcgcccgaagtcaagccggaggaccggcccccgtcggcggagcaggcgcggcgggagcgggcgaggatgaagcagtccaccggcagcaggtcgccacagggcccggacaccgcgtatttcccggccgtcttcaccagcgggtgcagcggcccagcggccggaccttcgtgcgggccatggtgtcctcttctctcaccggccccgggtatctgcacgggacctccgcttcgacaacgaacggcccgacaggtcgggtgcgtcgcccatcgctcctcgtcttcgcttcctcgacggcgtccgggtccatcactgcagtccgggcggtccgttcgctcacggtgccgcgggtcggaccctgcgagccgcacggcagggtggttctgggtccacccctgtgggggtgctggaccgctggtgggccgaaggagccgttcatagcgttgtgttcatgatggatgacacgaacgaagaacgaaaaggtgccagccggcggtcggcactgcgtgggctgggtctcgcggtgggaggcatggcgctggccaccgggcccggagcctcgccggccgcggcggccccgcgtcgcgggcgcggaacctacgtgctggtgcacggtacccacagcgccggcgcgttctggatgccgattgcgcgggaactggtgctgcgcggccaccgcgtcgtcatggtggaccagccgcggcacggcgcggaggctttcgtggcggagtcgtaccagcggcaggacctcacagcgatggcggtcgagccctccccgctgaagggcctcgggctggacgactacgaggcgcgcgtcacgggcatcgtgcggcaggccgcacggaacggcccggtggtgctggtcgggcacagcctgggtggcgtgtcggtcagccgtgtcggcgacgccgtcccgcacctgcttcaccacatctgctacatggcggccttctgtcccagtcgcgtcctgcccacggcggacgcctgcacggcggcacccgagaacgcgaacgccgtcagcccggtggagctgacggtgggtgacccggaccggctcggggtgttgcggctgaacttccgtacgggtgtcagcggtgagttggccctcctgaaggagatgatctgcgcggactaccccgacgccgacttccgccggatactggccggcatgcagaccgacgagcccgtcgccgcctatgcgggccgagcggtcggccgggccggcagctggggacgcattccccgcacgtacctgcgtttcggcagggaccgtacgatcgccaccgcgctccaggacagaatgatcgcggaagccgacgcgtttacccccggcaacagcttccgcgtgcacgatttccccgatgcgtcacacgtcggccctctggatcccaccccggttgcggacgtcctggacacgctcgcagggcaggggggctaggttctgtccggcggattatgcgaccgtctgatcgatcgctcgttggtccggtcatgcgtcggggcggatctgacgaatcgcgagtgatcgcttctggagccgcagctgccgccgtcgggtggtcgggaggccggtggagtgaccaccgcacacgccggacggggccgtactggttgcctattcctccggggaggacgggcggccgcccccggtggcgcggacaccgggacccgaggtgggtgcggccgcgctgaacgccgctgcggcttcgagtacgtgggccgggccgtcggcggtgtccgacgtggcccgccccgctctgctgctcgatccgtcgtccagtgcgggagtgggtaactccaagagatggtcgccgagttggtggctttgcccaatgggggcggccgccggaggctggctagcgtcggggccaggaatcgccgggtgtgcctccgaggtgtgctgtgccacgggatcctgcccggctctgcggaatgagagtgagtgtgacgagcacagcgggcaagacggaccgtttcgtgcgcgggggcggagtggcgccggtgctgaccgccgccttcctgtggggcacggtcggacccgcgcaggtcctggccgagagcagcgcgtctccggtgtcgatcggagggttccggatgcttctcggcggtttcgtcctgggactgttcaccgcgcggcgggccgggatgcgtaccttggtgcggcggcggacgcgcggctggacggcggtgagcatcctggtcaccgcggccttccaggtgtgcttcctggaggcggtggcgcgatgcggcgccgctatggcgaccgccgtcgccttcggcaccgtaccggtggtgtcgggggtgtgcgggcgcgtcctggccggtgagcggctgagccgggtgtgggcgtgcgggaccgtgtgcgccgtcggaggtatcgccctgctcctcgttccggccgacggccggccggccgacagcgt

SEQ ID NO: 395 - DNA, 7903 bp, Unknown
  Kingdom: Bacteria, Phylum: Actinobacteria, Class: Actinobacteria, Order: Streptomycetales, Family: Streptomycetaceae, Genus: Streptomyces
tgcggggactccttcggcgtcgaggggcgcggctgcggggccgccgtcctggggcgggacgaccgggctgccgtcgggggtgcctgccatgtgggcgcggatcagcggggagggcggtccggcggtgccccacaggtccgacagttccggggtgcggcgccacaccttgcagatccaggcgtcctcgacgacctgggcgacctccgaggtgtactcgcagaccaggccggtcgggtcggtgaagtaggagaaggtgttgttgccgggcccgtgccgtcccggcccccactcgggagtgatgccgtggtggcggaggcggccgaggccgcgcatgaagtggtcgaccgaacccatctcgtaggcgacgtggttgagtgacacccatggcgcctggttgaaggcgatgcagtggtggtcggcgttgcagcgcaggaacgccatctggtgctcggaccagtcggagacgcgcatgccgaggacgtcctggtagaaggcgaccgaggcgtcgatgtcgggggtgttgagcacggcgtgggtgactcccacgggcacggcgccgtcgcgtccgcgtggcgcgaccgcccaggtgtcggcggtgagttcgaccagccggccgtcgttgtcgtggaaccgcaggccgtagccgccgcccacctggtcgagcggtccgggaccggtgaccgcggtgatgccgcgcgcttcgagccggcgtgccgcctcgtcgatctcggcgggggtggcgacggcgaaggagagccggccgaggccgatccggtcggcgcgggtgagctggagggcgtggtgctgctcgccggtgccgcgcagccagctcgcgctgtgctcggcctcgacgacctccagtccccatgcctcctcgtagaagtcggtggcctcggcgaagcgcggggtgagcagctcgaccgagcggagcgcgcgcagcctggcgatcggcgggcgaggggggtgtgtcatggtgaggtctctccgggggtgcgtcggtccgggggcgggtgcgtcagtcggcccagggcaggggggcggcgtcggtgccccagtacagggacttctgccgctggtaggcgcggatgaggtcgcggcccttctccgtgccgaggccgctgtccttcatcccgccgaacggggtggagacggagaactgcttgtacgtgttgatccagacggtgccggcctcgatgcgccgggccagccgccaggcggcgcgggcgtcgcgggtccagatgccgcaggccagcccgtacacgctgtcgttggcctgctcgaccaggtcgtcctcgtcctcgtacgggagggcgagcaggaccggtccgaagatctcctcctggcagacccgggcggagttgggcagccggtcgatgacggtcggcaggtagtaggcgccggcggcgagggccgggccgtccgggacggcaccgccgcacaggatgcgtccgccctcggcgcgcgccagatcgacgtacgcggcgaccgcgtcgcggtgtcggtggtggacgagcggagcgacctgggtgcccgggtcggtgccgggaccgacccgcaacttccgtacccgctcgacgagttcgccgaggaaggagtcgtacagcgagcggtgcaggaagagccgtgaaccggcgatgcaggactgcccgctggaggagaagatgccgaacatgactccggcgagggcctgttcgacgtcggcgtcctgccggacgatcgtcggtgacttgccgccgagctcgagtgaggcggggacgagtctgccggcggcggcgcgtgcgatggtgcggccggttgcggtgccgcccgtgaacccgatccgccgtacgagcgggtggttgacgatggcgtccccgacgacgctgcccttgccgggcagtacggacagcagcgcggtggggaggccggcctcggtgagggcccggtggaccaggcgcccgaaggcgagggagaccagcggtgtccattcggcgggtttgagcaggaccgcgttgccgccggcgagggccggtgcggccttctgtgcgtcggaggcgatcggcgagttccacgggttgatcgcgccgaccacgccggtcggctcgtgcacgctcatcgtgacgtaggggccgcgcgagggagtgagggagtcctcggcggtctccagagcggcggcggtgtagcggaaggtgccggccgcgctgagcgcgagcgcccgggtctcggtgagggtcttgccggtgtcggcggtctgcagcgcggacaggtcggcggcgtgctcctcgatcaggtcgccgatccggtacaggacacgggcgcgctgatggggcagcaggtcgcgccaggcgggctcggccatggcttcggcggcggcgcgggccgcctcgtcgacgtcggcgggcgaggcggcgtggacggtgctgagcagggtgccgtcggccgggttcacggtctggaccggcccgcccgcgccgcgcctgaaacggcccgcgatgaggatctcgtcggctgggatgcgcggcatggagtgacctccggacaggggtggtacggggcggtggtacggagagaagtggtacgcggcggtacaggtggtacgggcggtacggggaagcccggcaggcggccggcgaactggaccggagccgcgataccgaagtgctggaaatctaagggcttaaatatctcgtccgcaagggggcgcgctccacaactttttcccccgcttggcgacgaacccttgacgccccccgacgggcagacggtagaacctaagcactaagaggttcagtccttacccaaatggccaccaccgccgacacacccaccgtcaccacggctgtcgcgcagcaccgccgacacacccaccctcaccaccgccgtcgcgcaccaccgccgtcacctcccgcccctcaccgccccgcgtacgcggcgccgcccggccccgcctcgcccggcccgaaccctcccgcgtgcacgcgctcgtcccccggtacggcacgcgggagccggaggaccctgcatgacgatcgacgccccccgcgccgccgccggccgccgcccggacaccgcggcgctcgccgcggccatcggcgcccgcttcgaacgcctgcccctgtgccgctggcacgtcaccgtccgcctcgtcatcggcgcggtgacgttcttcgaggccttcgaccaactgctcatcgcctacgccctgccccagctgcgcgccgcatggcacctcggcaccgggcagaccaccgccctgatgaccgtgggctcggtgggcatgctcgccggagcgctgctgtccggccgcctggccgaccgcgtcgggagggtcaaggtcatcgcggtctgcatcgccgtctccagcctgtgcaacctggcgctgaccctgtgcacctcgccggccccgttcatggccgcacggttcgtccaggggctggccatcggcggtgaggtgccggtcgcggcgaccttcatcgccgagatcacccgcacccaccagcggggccgcttcgtcctcctgtacgagctggtcttcccggccggcctgacggcgggcgcgctgctcgcctcctggctggtgccgctgctcggctggcgctggatgttcgggctcgccgcggtccccggcgtactgtgcctggtcatcgcccggtacgtgcccgagtcgccgcgctggctcgccgaccacggacgccacgagcaggcgctcgccaccatggcctcgatcgagcggaaggtcgagcagatcaccggcggaccgcttcccgaaccggcgcctccggcgcccgccccacaggcacaggcacaggcacagacacacgcggacgcacaccggtccaccggcaagggcggcttgcgcgaactcctctccggccgctaccgcaggcgcacgctggtcgtcggcgccctgtggttcaccggttacttcgtcaactacggcatcacgtcctggctccccacgatctacgggacccgtttcggcctggacctgtccaccgccctcggctactcgaccgtgacctcctgcgcgggcctgatcggctgcctcgtcgtcgccctgaccgtggaccgcgtcggccgccgccgtatcgtcatggcgtgcctgggcgcagccgccgtcgccctgctgctgctcggcctgttctccggcggctccgcgaccggcgtgctcatctggacctcgctggcgagcgtcttcctcttcggcgccaacatctgcctgtacctgtacacacccgagctgttccccacccgtatgcgggccctgggttcgagcgtcggcggcgccacgaaccggctcggtgtcatcctcggcccgatcgtggtcggcgccgtgtacgcggacggcgcgctcggcaccgtcttcgtgactctcgcggccgtggccctggccggctcgctcacggcggtcgccgccgaggagacgagcggacggcgcctggaggaactggcgccgtaacagacttcgtacgaacggcctcgcccccggtccgtgcgaccgggggcgagtgggcgaccgggtgtcaggacgcgatgtagccggagctggctttcacgccgttgaactggaggtagtactgggcccccggcacggagtccttgaagatgaccgaccacttgcccttgagggcggagacccagccgtggcacttggtgtgggtgcagaccctgaccaggcggttgccgtcggtgggcttgatgttgatgtcgttgcagtggcccttcacgctggcccagtgtccccggttcgggtagtgggcgttgtcgttggggccggttccggcttctcccgtgtagtggtacgccgagccgtagcaggtctggacggcccgctcgctcacgggtgcgtcggacgcctgcgagggcacgacgaccccaccgaggatcgccgcggtaccggcgagcgtcgtgacggcggagatggccagcttcttcttcacgatgtccctttcgtcgacttgtcgtggtcttgtcgtctggtgaccctgcggcgcggctgcgagccgcgccagaacaggcttcaccccctgcgagcacgcggtcgaggtgattcggcctggctcgaatagcggcggaccggaagaacggggcagcacggcggaaatgcttctcttcgcgggcgatccgccccttgccccgtccgcggcccgcacgtcctgcccggccccggcttgaccttgacacggtgacaaggtcttggctgcggtacaggaggtggtcccgatgaccagggcggacgaggacacgaccacggcgcgggtgctgcgcgggctggagaacggcggcgcgtcggtacggctgcgggctgcgatggcggtcggcacgaccccggatccggggtacgtcgacaagctcgtcgaacgatgcgggaccgagcccgaaccgtacgtgcgggaaatgctgacgtgggcgctgacccgccacgcgtcctccctgacgctcccccggctcatcggtgaactccgctcggaacgcgcgcaggcacggagccaggcgttgcacaccctgtccaagatcggggaccggcgtgcatggccggcgatcacacgcacgctcctgaccgacggcgacgacgaggtggcgcggtgcgcctggcgggcggcggtcgccctcgtgcccgacgacgaggcacccgagctggcggacgtcctggcgacacaactcgggcgcggcggacgggagatgtggttgagcctcagccgggcgctgatcgatctcggcgaggaggtcgccatgccggtcctgagcgcggcgatggaagacgccgacccccgcgtgcggcggcatgcgaccggcacggaacggctgttgcgcgatccggacgccggacacgagttcgcggtcgaggaggccaggcgcgtcgtggccctcggaggccagaccggccagactggccggaacggccacaccggccaccccggccaggaggagtgacacacgtgttgatcggtgaagtggcgcggcgctccggggtcagcgcccgcatgctccggcactacgactcgctcggcctggtacggccctcggtgcggaccgagggcggctaccgggagtactccggcgaggacatccagcggatcttccacatcgagagcctgcggtcgctgggtctgtcgctgcgcgaggtcggacgcgcgctggacgatcccggcttccagccctcggcactcgtcgacgacctcatccgccagagccggcagcgcatcgcggacgagacggaactgctcacgcggctccgccggatcggcgccacggaacccgccggctgggacgacgtactgcggaccgtcgccctcctgcatgccctcgggtcgcgggacgccgcgcaacgccagcgcgcggccctgtcctgcgtcgagcaggttccgatgccggtggaagcgctggtcgaggcggcgttgagcgagaccgacccgaacgtcgccggagccctgcggtgggcgctgacgcacgcgggcgagggagagggcgcgggcgtgctggcactgctcgcgcagggcctcgcctcacccgccgccgaggtgcgcgcacgtgccgtccaggccgtcgccgagatggcgaacgacgaggcgaccgcgctgctgcgcaccgccctcaccgactccgccggggcggtccgccggtgtgcggcgctggcgctcggtacccgtggagtggccgacgcggtcccggtactcgtcggcatggtcgtccaggagacgaacggcgccgacgcggccgacgcgctgagcacgctggcggcggccgaccccgcctcggcggaacggatcgccgcccacctcgtcgaccgcctcgcccgagacaccctcgcgccgtccgcacgcctcggtctgacccatgccctcgcgggcgtcccggcgcccacgtcctcccgtgtcctggcggagctgtcgcacgacgaggaccgcgccgtcgcgctcaccgcggcctacgtcctcacactgcgccgggccgcgcaggacacctgaggaacacactggagggacacacttgcgagacacacttgagggacgcacctgagggaagccgtttggccggttcctcgctgtcctcgcgcgcgggactcctgaatgctgaggacgccgtccgtgcgtcacggccgccacgggaggggaaggaaaggggagggagtcaggagagcgtggtctaccgcatccacttcacggtggaggacctggcccgcacgcgggtcgccgcgtccccgccgccgctgatggagctgagcgcgtcggtgcggaccctgcagagcggcgaccacccggtgctcttcgaggcgtggaggcgccgtgcgcgcgccgctctgcgtcccgccgcacgcatggtcctggacctgatcccgcccggtggctgggcaccgacgttcctgaccgccggtcaagaggtcgccggcggtccgcgggaggcgctggaccaggtgtacgccacgccccgcgcgcagatccgcaaggacctggcgcacgtggccgagtggcagccgctgccgccctgggcactccgactggccgacgaccgcgacctgatgcggcagctctgcgagagcctggagcacgtctgggccgtgctgctcgacccccactgggaacgcatcgccacggagacggccgccgaccgggcagcccggatgcgccaggtggccgacggcggtgtggagcggctgctcgccggactgaacccgcggcgcatccgctggaacccgcccgtcctggaaatggcgatgctctccggtttcgacggcgacctgcgtctcgagggccgcggactgctgctcgtcccctcggtcttcggacccggctcccccaccgtcgacatcgacgcccagccgcagcccgtgctgagataccccgcggcagacgtcccgtccgcgaacgcggcacccgcgtccgcccagtcaccgctgcccgcccggtcaccgccgtccgcgccg

SEQ ID NO: 396 - DNA, 18276 bp, Unknown
  Kingdom: Bacteria, Phylum: Actinobacteria, Class: Actinobacteria, Order: Streptomycetales, Family: Streptomycetaceae, Genus: Streptomyces
cttcgggcgggggcagcggcgcgggcgagggacgctgttcggcgcgggcgctgcgcggcggcacagcgagctggagcacgtcggccatgcttcccgcgtaccggtcggcgacggctcggaccagcgtcagcagttcctcgctcaggaccggctcgggcgacacgacctgggcgagcgcggccagcggccctgagtagtcggactcggcccgcctctcgatcaggaacccgtcgatgaggccgccgccctcgcgccggccctcccgcacccggtgccgtccggcgccgaaccgcaccctcacccgcacgccgggctgcgcgtcggcgtccagttcggcgggcacggcgtagtcgaaggagcggtcgaggtggagcacgcccttgtcgacgagcacccgggcgaccggcaggtgctcggccagcgccgcgccgcgccaggtgcggggcttggcccgcggctccttcgccttgcgcacgctctcccggatgagcgcaagctgctcgggcggcgcgccctcggccccgccgccgccccccggcccgttctcgctgctcacgcttgcattcttaccaaacgggactgacaaccggcgcctgccctggcctcccggcggccaggcccgcacgggcccacgggctcacaggctcacgggccgaccgaccggccgcaccgggaacaggccatcgtggcgcgcaaggcgctcatccgccggctggaggtgccgggccgcccgttgtcccgcgccaaccactactacctgctgacgtaccgggagcgccgcggtctgaagacgtggctggaccgcaggtcccggcgcgcgccgccccggtccgcgccggaacagacctcccgggaaccccggtgaagccggtacctccgtacttcgcctgtgacgacgacgccggctcccaggaccacgatcaggtcctgggaggcggcgttctgtacgggcgccgcggagcggtcggctagaggcccacggcctcgcgcagggcgtccacgcggtcggtgcgctcccaggtgaagtcgggcagctcgcggccgaagtggccgtaggcggcggtctgcgagtagatcgggcggagcaggtcgaggtcgcggatgatggcggccgggcggaggtcgaagacctcgtcgatcgccttctcgatcttctcgggctcgaccttgtgcgtgccgaaggtctccacgaacagaccgaccggctcggccttgccgatggcgtacgcgacctggacctcgcagcgcgaggcgaggcccgcggccacgacgttcttcgccacccagcgcatggcgtacgccgccgagcggtccaccttggacgggtccttgcccgagaaggcgccgccgccgtggcgggccatgccgccgtaggtgtcgatgatgatcttgcggccggtcaggccggcgtcgcccatcgggccgccgatctcgaagcggccggtggggttgaccagcaggcggtagccctcggtgtcgagcttgatgccgtcctccaggagcgacttcagctcgggctcgacgacgaactcgcggatgtccggagccagcagcgactccaggtcgatgtcggaggcgtgctgcgaggagacgacgaccgtgtcgaggcggacggccttgtcgccgtcgtactcgatggtgacctgcgtcttgccgtccgggcgcaggtaggggatcgtgccgttcttgcggacgtccgagaggcgcttggacaggcggtgcgcgaggaagatcggcagcggcatcagcgtcggcgtctcgtcggaggcgtagccgaacatcaggccctggtcaccggcgccctgccggtccagctcgtcgtcgtcgccctcgacgcgggcctcgtacgccgcgtcgacgccctgcgcgatgtccggggactgcgcgccgatcgagaccgacactccgcaggaggcgccgtcgaagcccttcttggaggagtcgtagccgatctcgaggatcttgttgcggaccagggtcgcgatgtccgcgtaggtcttggtggtgacctcgccggccacgtgcaccaggccggtggtgatcagcgtctcgacggcgacccgcgaggacgggtcctcccgcagaagcgcgtcgaggatggtgtcgctgatctggtcagcgatcttgtcggggtgaccctcggtcacggactccgaagtgaacaggcgacgggacacaacgctccctggggttgcagcggctgctggctgatcattggcggacggcacggggggctgcgcccggcgtcgtccgagaacagtttatcggtcgcactcggccaccggcccacctgtctcgccactcgggagccctgtgacctgcggcacgggcattctgcccgctgcccgcggagattgaacagggcgccgggtgacggtgtgcggtgttcgagtggtgcacggggcgactgggacgatcaggccagccgggcggcgaccaggtcccacacggtctcggccagcgcctccttcggcccgtgcggcaccggtgtctcaccgccgtcggcggccagcaccacggcctcgttctcctcggagccgaaggtcttgcgctcccccacctcgttcaccacgaggaggtcacagcccttgcgcgccagcttcttgcggccgttggcgaggacgtcgtcggtctccgcggcgaagccgacgatcacctgcccggtccgcgcccggtcggccgatatctccgcgaggatgtccggattgcgcaccagggcgatgggctcgggctcctggtcgtccttcttcttgatcttcccggccgcgtagaccgcggggcggaagtcggcgacggcggcggccatcaccaccgcgtcggcgtcggaggccgccttcagcaccgcctcacgcagctgcatggcggtctggacccggacgaggtccacgcccgccgggtccggcagctcggtgtgggcggcgaccagcgtgacccgggcgccccgggccgccgcggtgcgcgccagcgcgtagccctgcttgccggaggagcggttgccgaggaagcggacgggatcgaggggctcgcgggtgccgccggcgctgacgacgacgtgccggccggcgaggtcgggggtgcccgcgccccgggcgaggacgcggcggcagacctcgaagatctctaccgggtcgggcagccggcccttgccggtgtcgacgccggtgaggcggccgacggccggctcgacgacgacggcaccgcgccggcgcagcgtcgccacgttctcctgggtggccgggtgctcccacatctccgtgtgcatggcgggggcgaagacgaccgggcagcgggcggtgagcagcgtgttggtcagcaggtcgtcggcgaggccgtgggcggccttggcgagcatgtccgcggtggccggggcgacgacgaccaggtcggcgtgctggccgatgcggacgtgcggcacctcgtggacgtcgtcccagacctcggtggcgacggggttgccggacagggcggaccaggtggcggcgccgacgaagtggagcgcggaggcggtggggacgacgcgcacctcgtgcccggactcggtgaaccggcgcaacagctcacaggccttgtacgcggcgatgccgccgctgacccccagaacgaccttcggcttgtccaccgtctctccctgactcggccccggtgcgcccggtgcggcgcacgcctcctatgacacaccacaggcccggcagtcgcgctgccgggcctgtggaaaaacctaccgccgtctgaagatacgacttactgcgcggggccctcgatggcctcggacgtcagcagaccggcgttgatctcccgcagggagatggagagcggcttctcgtggacgtgggtgtcgacgagcggaccgacgtactcgaggaggccctcgccgagctgcgagtagtacgcgttgatctggcgggcccgcttggccgcgtagatcacgaggctgtacttcgagtcggtggcctcgaggagctcgtcgatcggcgggttgatgatgccctcgggcgcggagatggaagaggacacgctctaccttccgatggatgggaaagaatcagtcgtgatggtcggtgacgatcacacgacgtccatcaaggctagcagctcacgcgccacgtcctcgacggaggtgttgaccagggtctcgtcgaactcgggctcggccgccagctcgaccttcgcggcctggagccggcgctcgatgacctcgggcggttcggtgccccggccggtgagcctgcgcaccagctcctcccaggagggcggagccaggaacaccaggcgcccctcgggcatggactcgcggacctgccgggcaccctggaggtcgatctccaggaggaccggcacacccgcctccaggtgctccagcacggcggcgcggggcgtgccgtagcggttgccggcgaactcggcccactccagcagctcgccgttggcgatcagcttgtccatctcctcgtcggtgacgaagaagtagtggacaccgtgctgttcgccggggcggggcgcccgggtcgtcgccgacaccgagagccagacctcggggtgttccttgcgcatatgagcgacgaccgtgctcttgccgaccccggaggggccggagagcacggtcagccgcggacgtgcgtccgggggtacgggggtcgtcccccggggtgttacagccatgcagcgattattccagcaatcccgcagtgcccgggactcgtgtcccggagtcccgggacctcaggaaccggtgctgccgaactcacgctccagggaagcgatctggttggagccgaggccgcgcacacgacggctctcggagatgccgagtcgctccatgatctgcttggcgcggaccttgcccacgcccggcagggactcaagaagggcggacaccttcatcttgccgatgacgtcgttctcctggccctgcttgatgacctcgtgcagggaggcgccggagtgcttgagtcgattcttgacctcggcccgctcccggcgagccgcggcggccttttcgagcgcggctgcgcgctgttcaggggtaaggggcggaagagccacgcctacgtcacctcggatgtcgaactgtcggatacggaccggtgaggaacctagtcgccccacacctggggagccacgagcaacacgctcgcccgatgactctcgacggagactagcggtcgagggcgccagagtcagcgagaacagcggaaaagtcctggtcagcctcagtgaggtcgggcatttaggacatattgccccggatttgagaatgtatccagactcaggaccgggctcggggcaccgcccgaacgttcgtccgggactcagccggcccgcacagcaccccggatctcctccgcgaaacggtccgtcgcgtcacgcagcgcgaccacgtcgggaccgtgacgcaacacaccccggctgacgttcggcaccacgttgcgcaccgccgggccgaagaccgcgggcagatcggccggcgtcgccccctgcgcaccgatcccgggcgccagcagcggcccgttgatgtccaggtcgtacgacgaaaggtcaccgagcgtggcgccgaccaccgcgccgaaggagcccagcggaccctgcccggcgttctcccgcgccaggtgcgcgagcatggtcgcgcccacgttccggccgtcgggccgcaccgcgtgctgcacctcgccgccctccgggttggaggtcagcgccagcacgaacaggcccgcaccgctctcccgcgccaggtccacggcgggcttcagcgacccgtagccgaggtagggcgagacggtcagagcgtccgagaacagcggcgcgtccttgcgcaggaacgactcggcgtaggcggccatggtggagccgatgtcgccgcgcttggcgtccatgagcaccagcgcaccggcggcccgcgcctgttcgaccgacttctccaggacggcgacgccgcgcgagccgaaccgctcgaagaaggcgctctgcggcttgaggacggcgacccggtcggcgagcgcctccacgacggtgcggctgaaccgctccagaccggccacgtcgtcgttcaggccccactcggcgagcagggaggcgtgcgggtcgatgccgacgcagagcggaccgcgctcgtccatggcgcggcgcaggcgcgtaccgaagggctccagagggctcatgcgggcttcctcacgtcggcgccgaccgcgtcggcgagggtggcgtacgggctggtgcgcaggcgcgcggcgagacccttgtggatcgcgcggccccagaaggggccctcgtagatgaaggcgctgtagccctggaccagggtggcgccggccaggatgcgctgccaggcgtcctcggcgttctcgataccgccgacgccgatcagggtgatgcggtcgcccacgcgcgcgtagaggcggcgcagcacctccagcgagcggttcttgagcggcgcgccggacaggccgccggtctccttcaccagggcggggttcgagcgcaggccgagtccctcgcgcgcgatggtggtgttcgtggcgatgatgccgtccaggcccagttccacggccaggtcggcgaccgcgtccacgtcctcgtcggcgaggtccggcgcgatcttgaccagcagcggcacgcggcgggcgggcaccgcgcggtcggcggcctcgcgcacggcgctgagcagcgggcgcagcgcctcggtggcctggaggttgcgcagtcccggcgtgttgggcgaggagacgttgacgacgaggtagtcggcgtagggcgcgaggcgctcggcggacttcacgtagtcggcggccgcctcgtcctcgggcacgaccttggtcttgccgatgttgacgccgacgacggtcctgaagaccggcgtacgggaggccagccgggcggcgacggccagcgagccgtcgttgttgaagcccatgcggttgatgagggcgcggtccgcgacgaggcggaacagccgcttcttggggttgccgggctgcggctcgccggtgaccgtgccgatctcgacatggtcgaagccgagcatggacatgccatcgatggcgacggcgttcttgtcgaagccggccgcgagcccgaagggaccgtgcatgcgcagcccgagcgcctcggtgcgcagttccttgtggcggggagccaggacggccgcgacgaaggtgcgcagcaccgggacgcgggcggccaggcggatccagcggaaggcgaggtggtgggcctgttccgggtccatgcgccggaagaccagacggaagaagagcttgtacatcactgtgtcctcatgaaggccctcatgacgagggggacaccgtttccggtgtccccctcggggcctgctgctagtcgcgggccgcggtcaggaattcggcgtgttcctggagcgatcgcacgcccacgtcgccgcggttgagggcgtcgatgccctggacggcggcggcgagcgcctggaccgtcgtcaggcagggcacggaccgcgccacggccgccgtgcggatctcgtagccgtcgaggcggccgccggtgccgtacggggtgttgacgatgaggtcgacctcgccgtcgtggatgagctggacgatggtcttctcgccgttcgggccggtgccctcggactgcttgcgcacgagcgtggcgttgatgccgttgcgcttgaggacctcggcggtgccggaggtggcgagcagttcgaagccgtgggcgaccagctcacgggccgggaagatcatcgagcgcttgtcccggttggcgaccgagatgaacgcgcggcccttggtgggcagcggtccgtaggcgcccgcctgcgacttggcgtaggccgtgccgaagacggagtcgatgcccatgacctcgccggtggagcgcatctccgggccgaggaccgtgtcgacgccgcggccgtggatgtcgcggaagcgcgaccacggcatgacggcctccttgacggagatcggcgcgtccagcgggatggtgccgccgtcgccgttcttcggcagcaggccctcctcgcgcagctcggcgacggtggcgccgagcgagatacgggcggcggccttcgcgagcggcaccgcggtcgccttcgaggtgaaggggacggtgcgggaggcgcgcgggttggcctccaggacgtagaggatgtccccggccagcgcgaactggatgttgatcaggccgcgtacgccgacgcccttggcgatggcctcggtggaggcgcgcagccgcttgatgtcgaagccgcccagggtgatcggcggcagggcgcacgccgagtcgccggagtggatgccggcctcctcgatgtgctccatgacgccgccgaggtacagctcctcgccgtcgtagagggcgtcgacgtcgatctctatggcgtcgtcgaggaagcggtcgacgaggaccggccgggaggggctgatctcggtcgactcggcgatgtacgcctccaggcgcgcctcgtcgtagacgatctccatgccgcgtccgcccaggacgtaggacgggcggaccaggaccgggtagccgatctcgtcggcgatggtcttggcctgggcgaaggtggtggcggtgccgtgcttgggggcgggcaggccggcctccgccaggacctggccgaaggcgccccggtcctcggccgcgtggatcgcctcgggcgaggtgccgacgatcggcacgccgttgtccttgagcgcctgggacaggccgagcggggtctggccgccgagctggacgacgacgccggcgaccggtccggcctgctgctcggcgtggacgatctccaggacgtcctccagggtgagcggctcgaagtacagccggtcggaggtgtcgtagtcggtggagacggtctccgggttgcagttgaccatcacggtctcgtacccggcgtcgctcagcgcgaaggaggcgtggacgcaggagtagtcgaactcgatgccctggccgatgcggttggggccggagcccaggatgatcaccgcgggcttctcgcgcggggcgacctcggtctcctcgtcgtaggacgagtagaagtacggcgtccgcgcggcgaactcggcggcgcaggtgtccaccgtcttgtagaccgggcggatgccgagggcgtggcggacctcgcgcacgacgtcctcgcgcagaccgcggatctcggcgatctgctggtcggagaagccgtgccgcttggcctcggcgagcaggtcggcggtcagctcgggcgcctcggccagctcgtcggcggtctccttgatcaggaagagctggtcgacgaaccaggggtcgatcttcgtgtactcgaagacctcctccggcgtggcaccggcgcggatggcctgcatgaccgtgttgatgcggccgtcggtgggccgcacggactgctccaggagcgcctgcttgtcaccggtctcgccggtgaaggtgaactggctgcccttcttctccagggagcgcagcgccttctggaaggcctcggtgaagttgcggccgatggccatggcctcgccgaccgacttcatggtggtggtcagcgtggagtcggcctgcgggaacttctcgaaggcgaaccgcggtgccttgacgaccacgtagtccagggtcggctcgaaggaggccggcgtctcctgcgtgatgtcgttcgggatctcgtccagggtgtagccgaccgccagcttcgccgcgatcttcgcgatcgggaagccggtcgccttggaggcgagcgcggaggagcgggagacacgcgggttcatctcgatgacgatcacacggccgtcggccgggttgatcgcgaactggatgttgcagccgccggtgtcgacgccgacctcgcggatgatggcgatgcccatgtcgcgcaggacctggtactcgcggtcggtgagcgtcatcgccggggcgacggtgatcgagtcaccggtgtgcacgcccatcgggtcgaagttctcgatggagcagacgaccacgacgttgtcgttcttgtcgcgcatcagctccagctcgtactccttccagccgaggatggactcctccaggagcacctcggtggtcggggagagcgtgaggcccgtgccggcgatgcggcgcagctcctcctcgtcgtgggcgaagccggagccggcgccgcccatggtgaaggaggggcggacgacgaccgggtagccgcccagctcctcgacgccggcgaggacgtcgtccatggtgtggcagatgaccgagcgggcggactcgccgtgcccgatcttccggcggacctcctcgacgacctccttgaactggtcgcggtcctcgcccttgtggatggcctcgaccttcgcgccgatcagctcgacgccgtacttggccaggacgccgttctcgtgcagcgagatggcggtgttcagggccgtctgcccgcccagggtgggcagcagggcgtcggggcgctccttggcgatgatcttctcgacgaactcgggggtgatcggctcgacgtaggtggcgtcggcgatctccgggtcggtcatgatcgtcgccgggttggagttcaccaggacgaccctgaggccctcggacttcaggacgcggcacgcctgggtgccggagtagtcgaactcggcggcctggccgatgacgatcgggccggagccgatgaccaggacggactggatatcggtgcgcttaggcacgctggccctccatcgggactgtgctcatcaaagacgtgaagcggtcgaacaggtaggcggcgtcgtgcggaccggcggccgcttccgggtggtactggacgctgaaggctggcttgtcgagaagccggagcccctccaccacgttgtcgttcaggcagacgtgggagacctcgacgcggccgaagggggtgtcggagaccttgtcggtcggggcgtccacggcgaagccgtggttgtgcgcggtgacctccaccttgccggtcgtacggtcctgcacgggctggttgatgccgcggtggccgtacttcagcttgtaggtgccgaagccgagcgcgcggccgaggatctggttgccgaagcagatgccgaacagcggcgtgccgcgctccaggacgccctgcatcacggagacggcgtggtcggcggtggccgggtcgccggggccgttggagaagaacacaccgtcggggttgacggcgtagacgtcctcgaccgtggcggtggcgggcaggacgtgcacctcgatgccgcgctcggccatgcggtgcggggtcatgcccttgatgccgaggtcgacggcggcgacggtgaacttcttctcaccgatcgccgggacgacgtacgcctccttggtggcgacctccgcggacaggtccgcgccgaccatctcgggggcctcctggacgcgggccagcagcgtggcctcgtcctggacggcgtcgccgctgaagatgccgacgcgcatggcgccgcgctcgcgcaggtggcgggtgagggcgcgggtgtcgatgccgctgatgccgaccacgccctgcgcggccagctcctcgtccagggagcgcttcgagcgccagttggacggcacgcgcgcggggtcgcggacgacgtagccggccacccagatgcgccgggactcggggtcctcgtcgttgacgccggtgttgccgacgtgcggggcggtcatgacgacgacctggcggtggtacgacgggtcggtgagggtctcctggtagccggtcatgccggtggagaacacggcctcgccgaacgtctcccccacggcgccgtaggcgcggccccggaagacccggccgtcctccaggacgagtacggcgggaacccttgtggttccccttgtggaggtggtcatcgttcgacgccttccgtgatgttcgtgtggtgcttcgttccggtcatggagttgagggcctcgacccactcggtgtgctcggccgcccggtcggagcggaaccccgagtcgagcagcttgccgccgtgttcccaggtcaccaccagcaggccgccctcggtgaggaccttgccggcgatgcccttgtcgagcctggcctcgcgcagctgtgccgccgggacgaagaagtcgtgcgcgccggggcgtacgacgtccagtcccgcgtccgtcagggtcagctcggcccggctgcgggtgcccaggccgtgcgccacgatgcggtccagccactgaccggcggtggtggagccgtggtagcggccggtcatcgtcagtttcgcctcgccgggctcctgcggcgcgctgggcagctccggcaggtcgctctggagggtgccgcgccacttccagccttcgcgcatcagccagtagacgagggcgacgaagagggcgagaccgaccagccagccgatgcgtccgccccagttggtcaccgtcgccgacttctcttcggcggcgaggtgggtggtgagcccggctgcgagcagtgttgcaggtgtcacgtgagcttcccgtcgacgagcgtggccttgccccggagccacgtgtgggtgacacggcccggcagctcacgtccctcgtacggagtgttgcggctgcgcgaggcgaagcccgcggggtccacctgcccacggtattccgtgtcgacgagggtgaggttggcgggctcgcctgccgagacgggacgtccgtggccggccgcctgcccgatgcgggccggcgcgaaggacatccggtcggcgacggccgaccagtccagcaggccgctgtcgaccatggtctcctggaccaccgacagggccgtctccaggccgaccatgcccatggcggcggcggcccactcgcagtccttgtcctcgtgcgggtgcggcgcgtggtcggtggcgacgatgtcgatcgtgccgtcggcgagcgcctcgcgcagggccagcacgtcgcgctcggtgcgcagcggcgggttgaccttgtagaccgggttgtacgtccgcaccagctcgtcggtgaggagcaggtggtgcggggtgacctcggcggtgacgtcgatgccgcgggacttggcccagcggacgatctcgacgctcccggcggtcgacaggtggcagatgtggacgcgggagccgacgtgttcggcgaggagcacgtcacgggcgatgaccgactcctcggcgacggccggccagccgcccaggcccagctcggcggagacgacgccctcgttcatctgggcgccctcggtgaggcggggctcctgcgcgtgctgggcgacgacgccgccgaaggccttcacgtactccagggcccggcgcatgatcaccgcgtcgtcgacgcacttgccgtcgtcggagaagacggtgacgcccgcggccgactcgtgcatggcgcccagctcggcgagcttcctgccctccaggccgacggtgacggcgccgatgggctgcacgtcgcagtagccgtgctcctgcccgagccggtagacctgctcgaccacgccggcggtgtcggcgacggggaaggtgttggccatggcgaacacggcggtgtagccgccgctcgcggcggcgcgggtgccggtgaggacggtctcggagtcctcgcggcccggctcgcgcaggtgggtgtgcaggtcgaccaggcccggcaggagcaccttgccgccggcctcgacgacctccgcgccctcggcgctcagaccggtgcccacctcggcgatggtctcgccgtcgatcaggacgtcctgcggttcgccgccgagcaccttcgcaccacggataaggatcttgctcatgctgtcttacttctcctcgttggtgcgggtgtgggtgacggcgggctcgttgcctccgagcagcaggtagagcacggccatgcggatggagacgccgttggcgacctgctcgacgaccgtgcagcgcggggagtcggcgacctcggcggtgatctccatcccgcggaccatcgggccggggtgcatcacgatggcgtgctcgggcatcttcgccatgcggtcgccgtccaggccgtagcgccgcgagtactcgcgctcggtggggaagaaggcggcgttcatgcgctcgcgctggacgcggagcatcatcaccgcgtcggacttcggcagcgtgctgtcgaggtcgtacgacacctcgcagggccacgtctcgacgccgaccggcaccagcgtgggcggggccaccagggtgacctcggcgccgagggtgtggagcaggtcgacgttggagcgggcgacgcggctgtgcaggacgtcgccgacgatggtgatgcgccggccggccaggtcctggccgaggcccgcgtcccggccgaggaggcggcggcgcatggtgaaggcgtcgagcagggcctgggtggggtgctggtgggtgccgtcgcccgcgttgatgacggcggcgtcgatccagccggagttggccagccggtagggggcaccggaggcgccgtgccggatgaccacggcgtcgacgcccatggcctccagcgtctgggcggtgtccttcagggactcgcccttggagacgctcgatcccttggcggtgaagttgatgacgtcggccgacaggcgcttctcggcggcctcgaaggagatccgggtgcgagtggagtcctcgaagaagaggttgacgacggtacggccgcgcagggtcggcagtttcttgatcggccggtcggccacccgggccatctcctcggcggtgtcgaggatcaggacggcgtcgtcgcgggtgaggtcggcggccgagatgagatgacgctgcatctgtcaggctccgtaaggcggttcatcagggagaattcgggcacagctgcgcgcgggggcacacgcgcggggcgtacggcggtccgtacgcgcgcgtgggctacgggcggcgctcgcccggggtgtccggcttggcaccgagcagcacggtgtcgcgaccgtcctcctcggcgagctggaccttgaccgtctcccgcagcgacgtggggaggttcttgccgacgtagtcggcgcggatcggcagttcgcggtggccgcggtcgacgaggaccgcgagctgcaccgcgcgcgggcgcccgatgtcgttcagcgcgtcgagggcggcgcggatggtgcggccggagaagagcacgtcgtcgacgaggacgacgagacggccgtcgatgccgtcaccggggatctcggtgcgggccagcgcgcgcggcgggtgcatgcgcaggtcgtcgcggtacatggtgatgtcgagcgagccgaccgggaccttgcgctcggtgatctgttcgagcttggcggcgagccgctgggcgaggaagacgccgcgggtcggaatgccgaggagcaccacgtcgtcggcgcccttggcgcgctcgacgatctcgtgggcgatacgggtcagtacgcgggcgatgtcggggccttcgagaacgggccgcgcatcggacgcctgcgcaccggcgtgcgtgtcctgcttgtccatacgaaacggacctccttctccgcctcacgggacggaccttaaaggacgtcggaattgcgccatccacggtagcaggtgccgcggacggctccgggcccccctcaccgccgcacaccacccgttcggcgcaaccgggtgccgttagcacggaagaggcggcgtggaccattcggcttgacgcggcagagtaacgctgcgtaacctcacagtgagttaccagccgcccggcgtggcagccgagccaggccgcgtcgacacagtgtccggggagccatatgtccagcgaatacgccaaacagctcggggccaagctccgggcgatccgcacccagcagggcctttccctccacggtgtcgaggagaagagccagggccgctggaaggcggtcgtggtcggttcgtacgagcgcggcgaccgtgccgtgaccgtgcagcgcctggccgagctggcggatttctacggggtaccggtgcaggagctgctgccgggcaccacccccggcggtgccgccgagcccccgccgaagctggtcctcgacctggagcggctggccaccgtgccggccgagaaggcgggcccgctgcagcggtacgcggcgacgatccagtcgcagcgcggcgactacaacggcaaggtgctctcgatccgccaggacgacctgcgcaccctcgccgtcatctacgaccagtcgccctcggtcctcaccgagcagctgatcagctggggcgtgctggacgcggacgcgcgccgcgccgtggcgtcccacgaggaggcctgagccgctttcgggccccaccggctccggcagtaacgccggaccctgcagaaacgtgccgccggggtggccggaacttcacggttccggccaccccggcggctttctgcgggccttgaccgccgcacgggcagcccattgcccccagacacgtgcgagggcccgcagcacggagctgcgggccctcggacgtgtctgtgcctcgtgctcgttacgcctcgtcgcggcgcagggagggcttgaggtccttcagccggccgagcagaccgttgacgaacgagggcgactcgtccgtggagaactccttggccagctgcaccatctcgtccagcacgacggcgtccggggtctcgtcgacccagatcagctcgtacgcgcccagccgcaggatgttgcggtcgacgaccggcatgcggtccagcgtccagccgaccgcgtactgcgcgatcagctcgtcgatgcgccgctcgtgctcggcgtagccctcgaccagctgcatcgtgtactcgctgaccgggggctgccgggtgtcggaccgggagagccggacccagtccgcgaggacggtgaggacgtcggcgccgcgctggtcaccctcgaagaggatctggaaggcgcgcttgcgggccgtgttgcgggcagccacggttagctgttcacccggccgaggtagtcgctcgtacgggtgtcgaccttgatcttctcaccggtggtgatgaagagcgggacctggatctggtggccggtctccagcgtggcgggcttggtgccgccggtggagcggtcgccctggacgcccggctcggtctcctgcacgaccagctcgacggcggccggcagctcgacgaagagcacctcgccctcgtgctgggcgacggtggcggtgaagccctcgatcaggaagttcgcggcgtcgccgacggccttgcggtcgaccatcagctggtcgtaggtctccatgtccatgaagacgaagtactcgccgtccatgtacgagaactgcatgtcgcgcttgtcgacggtggccgtctcgaccttgacaccggcgttgaaggtcttgtcgacgaccttgccggagagcacgttcttgagcttggtgcgcacgaaggccgggcccttgccgggcttgacgtgctggaactcgacgacggaccagagctggccgccttcgagcttgagcaccaggccgttcttgaggtcgttcgtggaagccacggttgcggaatctcctggactgacgtggacgacctcggggcacgcaccgagcgggtccaggggacgtgcctgcacttccctgggcgctacagcgcgagcagctccttggtcgtgatggtgagtagctcgggtccgccgtccgcctcggggcgtacgacgagcgtgtcatcgatccggacaccgccccggccggggaggtggacccccggttcgacggtgaccggcacgcaggcgtccagtttacccatggccgcgggggccagctgagggtcctcgtcgatttcgagtccgaccccgtgtcccgtgagggattgcaggccctcggcgtacccggcggagtccagcacctgtcgtgcggcacggtcgacgtcacggtaggcggcgcccggcatcagcgcctcccggccggcccgctgggcggcgaagaccaggtcgtacagctggatctgccagtccgcgggggacgtgccgatcacgaacgtacggccgatctcgcagcggtagccgcggtaggcggcgcccaggcagacggagaggaagtcgccctcctcgacccgccggtcggtgggccggtgcccgcggcgtcccgagttcgggccggtggccaccgaggtcgggaaggcggggccgtcggcgccgtggtcgacgaggcgccgctccagctccaaggcgaggtgccgctcggtgcggccgacgaggatggactccagcagttcgcccagggcctggtcggcgatctcggcgccgatccgcaggcaggagatctcctcctcgtccttgacgaccctcagctgttccaccgcgctgcccagggcgccgactcgctggcgatcgaggagcaccacgtcaccgtggcccgccaccgggcgctcacctcggtcgccccgcacctgcgcatcgcggacctgggcagcgcggtggaacagctg

SEQ ID NO: 397 - DNA, 1064 bp, Unknown
  Kingdom: Bacteria, Phylum: Actinobacteria, Class: Actinobacteria, Order: Streptomycetales, Family: Streptomycetaceae, Genus: Streptomyces
gtgtggctcgccgtctgcggtggctggagctacttcgaccggccctacaagcagggcctgcacgacaaggcggccaagacggtggtggtcagcaccggccccgccaggtgagccgacgcggcgtcaggaggcttgcgccggaccctgtcccggctccgcgccggcggagacggtctgccgcggcgccggcacccgcgcgtgcccgccggtccgcggcgaccggccgatccgcgccgcgccgccggtccgtgcgggcgcaagcctcctgacggccggcccggaagcctgcgccgtctgcgaatcagcgcccgccgcggcggccgacgcgcgcgccttcggcagtggcaccgtcatggcgaccaggagcccgagcgcgagcgccgccagggcgatgacagcgatcccgaggcccgaactcgtctgcgacagcagcagcatggcgagcgtcgagcagatcacggtgcaggaaccgtaggcgagctgtgcggcggtcggacgaggcatggcaatcgtgtcctcggaagatctcgggggtgcgacagcgggccggcctggctttccgccggcttccgggcgttgtgccaatcgactgtaatcccctggatgcccgccaggaacggttggtaagcgtgacctaacccacggtgccggtgcacagggggcgcacggagtcacggccgcggcgtgctccccgcggacagaccgacgcgcccgacggcccacgcggcgaccctccgcagcccgacggcccacgcagcggccctccgcagtccgcccgtccacgcggcgaccctccgcagtcctaccgtccgcaaagcgaacgctgtctccgcatagtgcacttgaactgtccaagtcaaggtctgtcttttctcgtaaacctctagtcaaatgtcgtcacttgactaacacgcgttgatcgcgcgcggactttctcgtgcctcagagaccccccttccgcgcgtacgggcgcgtcaggggaggacagcaagtgaccagtagaccctggacgttcagagcagccgcgatcggtgtcgcgctcgcggcggccaccgccacgttct

SEQ ID NO: 398 - DNA, 10585 bp, Unknown
  Kingdom: Bacteria, Phylum: Actinobacteria, Class: Actinobacteria, Order: Streptomycetales, Family: Streptomycetaceae, Genus: Streptomyces
gggccgagcacctcggcgagcacgtccgcaccggccgcgccgcgggcgatacggtccggcaggaagccgggcgccaggacgtacggcgcgaccgccacccgggcacagcccagctcccgcagtccgcgcaccgcgtcctcggtgcgcggaagggatgcggaggcgaacgcaggccgcacggcgcaccaaccggtacgccaccactcccgcgcgatgtcggcgatcactgcgatcgcctccgggtccgaggaccccgccgaggccagcacgaccccggtcgaggacttgtcggcggggctgagtcccgcctcgtacagccggcgttccagggccgccgtcagcagcggcgagggcccgagcacgtcggcctgccggatccgcagccccggcggtgcctggcgcagcaccgccgggatgtccgccttggcgtggaaggcgcgggtcagcagcagcggcagcgccaccacgtcccgggccccgtcggcggccagggactccaggatgccgggcacggacggcacgttgaagtccaggaagccggtctccacccgcagctgcgggcgcgcggcccgcacccgccgtaccagggcgtgcacggtggcggcgtgccgcggatcgcggctgccgtgggcgacgaccaggaggactggctgctgggacacgggcggtcagctcttcacgaagaggccgcggctgcgcagcacccaccgctccagcggactgaagatcagcaggtcgatggcgatgccgacgaacaggatgaggacgatggcctggaacaccatggacatcgagctggcgttgcggccgttctccagcagcgcgccgaggccgatgccgaggtccggcgaggaggcgatgatctccgcggccatcagcgagcgccaggagaaggcccagccctgcttcagaccggcgaggtagccgggcagcgcggccggcagcacgatgtgccaggcgccgcgcaggcccgtcgcgcccatcgtgcggcccgcccgcaagaacagcggcggcacctggtcgatgccggagaccaggccgttggcgatggacggcaccgcgccgagcaggatcaccgcgtacatcatcgagttgtccaggcccagccagatcaccgcgggcggcacccacgccaccgacggcagcgactggagccccgacagcaccgggccgatggcggcccgtacgaacctcacccgggccaccagcaggcccagcggggtgccgatggccagcgcgaacaggaagcccagcaggccgcgcgagacggacgtccagatgaagccgaggagcgtgccctgcagccaggcgtccttgaactcgccgcccacgtcggcgggcgagggcagcttcgtcgggtcgtcgaccacgtggaaggtgatcagcgcctgccacagcagcaggaccaccacgacggccgtgatcggcgggacgatcttgtcgacgaaggtcttgcggaacggcgtacggccgctctgggtgacctccagcgcgtcgagtcccgcctccacaccgcccaggcccgcgtcgcggccggtcggttcggcgtcctgcgccgacgtcgtctcagtgctggccatggcggcggatctccccacgcagtacttcggtgatctccagggacagttccgcgacgggcgcgtcctcgatgcggcgcggctgcgggatgtccaccgtccactggcgggccacccggcccggccgcgaggacagcagcaccacgcgctgcgcgagccggaccgcctcgcgcacgttgtgcgtcacgaacagcacggagacacccgtctcctgccagatccgggtcagctcgtcgtgcaggacgtccctggtgatggcgtcgagcgcggcgaacggctcgtccatcagcagcaggttgctctcctgggcgagcgcgcgggccatcgccacgcgctggcgcataccgcccgacagctcgtgcacgcgcttgccgtacgcgccgttcagccggaccagttcgagcagttcctcggccctgccgcggcggtcctgcttcggcacgccccgcagccgcagggcgagttcgatgttcttgcccgcggtcagccacgggaacagcgcgtgctcctggaacatcagcgcggggcggccgtccgtggtgatggcaccggcgctcggccggtccagtcccgccaccaggttcagcagcgtggacttgccgcaccccgaggctcccaggagggtgacgaactcgcccggagcgacatcgagactgatgtcgtccaggacgagctgctgcccgcccggagccgcgaaggacttcgagacgttctcaaggcgtgccgcgtgctcgacggcctcaggggccttggcgagggtggtcgtggccatggtcgtcacctcctgggaactcttcggtcagggtctgagggctctagcgggcgccgagaccggcgtcgctgacagtgggctcgccctccgccttcaggaccttgttcaggagggagaggtcgtagatgccgtccagctcgggctgctgcagcaggccggccttgacggcgtgctccgcctcggtgttcagggtcccggccagcgggtcgtcggtgatcctgatggacttccacgccgggtcgaggacgtcggcgggcagggccttgccggagtcgaccgccagctgcttgttggcggcctccctcgcccggtccgggttggcgttgatccacttgttggtctcgacggacgccttcaggacggcctcgaccgccttggggtgcgccttgaggaacttctgcgacacgatgacgttcgtgatgacgaacttcttgtccggccacagcgaggactcgtcgagcagtaccttggcgccctcggcgaccagcttggacgcggtcggctccggcacccaggcgccgtcgatggagcccgacttgtaggcgtccggggtgaccttgttgtcggtgcggaccaccgacacgtcgcccttgccgctctgggcgtcgaccttccagccctgctcggcgatccagttgaggaacgccacgtcctgcgtgttgcccagctgcggcgtggcgatcttcttgcccttgacgtccttcagcgacttgatcttcttcgggttcaccacgagcttgaccccgccggacgccgaaccggcgatgatccgcaggttcttgccgtcggacttggtgtacccgttgaccgccggggaggggccgatccagccgatgtcgatggaaccggagttcagggcctcgatctcggacggcccggcgttgaagacctggtacttggccttggtcgccccgagggccttctggaagaagcccttctgcacgcccaccagggcggtcgcgtgcgtgacgttgccgaagtagccgatcttgacggagtcgaggccgtcggtcttctgggcgccggcggctatctgctggtcggcggggtcggccttggcgttcgagccgtagccgcaggcggcgagcgtgagcagcggaagcgcggtgaccacggcgaggccgcggcgcagggcggtggagcggatggcaggcacgggaggtgttcctctcgttggcccggcggtcacggtctctcaggtcgtggccgggaggtcggcaggtcttcgtctactgcgcaggtggggggtgagggcgcgcatgcggtgcgcgtacgtcagcgcacacatcgcgccaccccgccctgtccgctgccgagggcgccgctgccgacccggccgccctccttggcgaacaacgagtagaagtcgcaggagttcacggtcagaagtcccagccgtcctcgtcggcggcggccttgaccgggtccggcgcggcgaacgactcgccgaccatgcccgcggtcagcgtggtgccgtccgaggggtcgatcaggatgaacgagccggtgcggcgcgagtccgcgtaggagtcgaccggcagcggctcggcggtacggatcttcacccggccgatgtcgttggcgacgagctgcccggggtgcgggtgcagcgacaggtcgtccagggtgagccgggacgggatgtccttgacgatcgccttgacggtgcgggtgccgtgcttgagcagtacccggtggccgaccgtcagcggcgcgtcggcgacgtggcagacggtcgcctccacgtcctgggtggtcgccggggcgtccttgctgggcacgatcaggtcgccgcgcgagacgtcgatgtcgtcctcgaggagcacggtgaccgactgcgtcgtccaggccgcctcgaccggcacgccgagcaggtcgatcccggagatccgcgaggtgcggccggagggcagcacggtgacctcctcgccgacgcggaaggagcccgcggcgatctgaccggcgtagccccggtagtccgggtgctcggcggtgcgcggccggatcacgtactgcacgggcagccgggcgtggcagtgcgccaggtcgtggctgaccgggaccgtctccaggtgctccaggacggtcgggccgccgtaccagtccatgacggaggacggctccaccacgttgtcgccggcgagcgccgagatcgggatcgcggtgacctccgggacgcccagctcggtggcgtacgccgtgaactcctcggcgatccgcgcgaacaccggctcccggtagtcgaccaggtccatcttgttgacggcgaggaccacgtgcggcacccgcagcagcgcggcgatcgcggcgtgccggcgggtctgctcgaccacgccgttgcgcgcgtcgaccaggatgaccgtcagctcggcggtggaggcgccggtgaccatgttccgcgtgtactgcacatggccgggggtgtcggcgaggatgaaccggcggcgcgcggtcgcgaagtagcggtaggccacgtcgatggtgatgccctgctcgcgctcggcccgcaggccgtcggtgagcagcgccaggtccggggcgtcctggccgcggccggccgaggcgcgctccacggcctccagctggtcggtgaggaccgacttggagtcgtgcagcagccggccgacgagggtggacttgccgtcgtcgacggaccccgcggtggcgaaccgcagcagggtcgtctccgacagctgttcgaccgacagcggctcggtgggttcggtggtgctggtcatggttagaagtacccctcgcgcttgcggtcttccatcgcggcctcggagagcttgtcgtcggcgcgggtggcaccgcgctcggtgagccgggaggcggcgatctccgtgatcaccttctcgatggtgtcggcgtccgagtcgaccgctccggtgcaggacatgtcaccgaccgtgcggtagcggacctgccgcttctccacggtctcgccgtccttcgggccgccccactcgcccgcggtcagccacatgccgccgcgcgcgaagacctcccgctcgtgcgcgaagtagatcgccggcagctcgatctcctcgcgggcgatgtactgccacacgtccagctcggtccagttggacagcgggaagacgcggacgtgctcgccgggcgcgtgccggccgttgtacaggttccacagctcggggcgctggcggcgcgggtcccactgggagaactcgtcgcgcagcgagaacacccgctccttggcgcgggccttctcctcgtcgcggcgcccgccgccgaagaccgcgtcgaacctctccgcctggatcttctcggtgagcggcagcgtctgcagcgggttgcgggtaccgtcggcgcgctccttgagcacaccccggtcgatgtagtcctgcacggaggccacgtgcaggcgcagcccgtgctcggccacggtccggtcgcggtactccaggacctcggggaagttgtgcccggtgtccacgtgcagcagcgcgaacggcaccggcgccggcgcgaacgccttcagcgccaggtgcagcatgaggatcgagtccttgcccccggagaacaggatcaccgggttctcgaactcgcccgccacctcgcggaagatgtgcaccgcctcggactccagcgcgtccaggtgcgagagggcgtacggtcccgccgtgccctcctcgacctcggcgacggtcgtcgtcatgccagtcccctttcgctgagcagggcgtacaccgacgccgcggactcctggacgctctggtgctgcgactcgatccgcaggtcgggcgtctcgggctcctcgtacgggtcgtcgacgcccgtcaggccggtcagctcgcccgccgcctgcttggcgtacagccccttcacgtcgcgcaccgagcacacctcgaccggggtggcgacgtgcacctcgacgtacgccgtgccgttctcctcgtgccgcttgcgcaccgcgtcccggctgtccgcgtacggcgcgatcaccgggaccagcgcgaggacgccgttgcgggcgagcagttcggcgacgaagccgatccgctgcacgttggtgtgccggtcctcgcggctgaagccgaggcccgccgagatgaactcgcggatctcgtcgccgtcgaggacctcgacgcggtggccctcctcgcgcagccgggtcgccagctcgtgcgcgatggtggtcttgccggcgctcggcagacccgtgagccagacggtggctccggtcgtcacgtggttctcctgtatgtgtgtcatggtcagccgtgcagcccgcactcggtcttggcgcggcccgcccagcggccggcccgcgcgtcctcgccctccagcagccgccgggtgcagggcgcgcagccgacggagccgtagccgtccgtcagcagcgggttggtgaggacgccgttctcgctgacgtaggcgtccacgtcgtcctgggtccagcgggcgatcggggagaccttgaccttccgccgcttctcgtcccagccgacgaccggggtgtccgcccgggtcggggactcgtcgcggcgcagtccggtggcccacgcctggtagcccgcaaggccctcctggaggggctgcaccttgcgcagcgcgcagcacaggtccgggtcgcggtcgtgcagcttcgggccgtactcggcgtcctgctcggcgaccgtctgcctcggggtgagggtgatgacgttgacgtccatcacggcctcgaccgcgtcgcgggtgccgatggtctccgggaagtggtagccggtgtcgaggaacaccacgtccacgccgggcatcgcccgggaggcgaggtgggcgaccaccgcgtcctccatggacgaggtcacgcagaaccgcttgccgaaggtgtcggccgcccactggaggatctccagcgcggaggcctcctccaggtcgcggccggcctgctcggccagtgccctcaactcctcggcggagcgctcttgctgagtagccgtcacgtctgctcgtcccctccgttgtcggcggtccgctggagcccgcgggccagtagcccgaggaacttcagctggaagccgcggttgcacgccgcgcattcccaggccccgtgggtctgctcacccgggcgcaggtcctcctcgccgcagtaggggcagtagaagggcgccgcccgctcgctcacgacaacgcctcttcggaggcccgggccgcccaggcggcgaagcgctcgccgtcctcgcgttccgcctggaagcgggtgaggagccgctcgatgtagtcgggcagttcggcggaggtcaccttcagaccccggaccttgcggccgaaggacggctccaggccgagggcgccgcccaggtggacctggtagccgccgacctggttgccgtcggcgtcggtgaccagctggcccttgagaccgatgtccgcggtctggatacgggcgcaggcgttcgggcagccgttgatgttgatggtgaccggctcgtcgaagtcgggcagcctgcgctccagttcgtcgatcaggtcgctgccgcggtccttggtctcgacgatggcgagcttgcagaactcgatgcccgtgcaggccatcgtgccgcgccggaacggggagggagtgaccctgaggtccagcgcctccaggccgtccaccagcgagtcgacccggtccccgggcacgtccaggacgatcatcttctgctcgacggtggtggagacccggcccgagccgtgctcctcggccagcgccgcgaccttggtgagcagcgagccgtccatccggcccacgcgcggggcgaaaccgacgtagaaccggccgtccttctggcggtgcacgccgatgtggtcgcgccaggcctgcgcgggcatctcgggcgcgggaccgtcgatcagcttgcggcccaggtactcgtcctcgaggacctggcggaacttctccgcgccccagtcggcgaccaggaacttcagccgggcccggttgcgcagccgccggtagccgtagtcccggaagatcgaggtgacgccctcccagacgtccggcacctcggcctccggcacccaggcgcccagccgcacaccgaacttggggttggtggacagtccgccgccgacccacaggtcgaagccggggccgtgctcgggatggaccacgccgacgaaggagatgtcgttgatctcgtgcgccacgtcgagcagcggcgatcctgagacggccgtcttgaatttgcgcggcaggttggagaagcgcgggtcgccgatgaagcggcgcgcgatctcgtccagcgcggccgagccgtcgatgatctcgtcctcggcgacacccgcgaccggggagccgagcatgccgcgcgggcagtcgccgcacgcctcggtggtggacaggccgaccgactccaggcgttcccagatggcgggcacgtcctcgatgcgcacccagtggaactggatgttctgccggtcggtgatgtccgcggtgccccgcgcgtactgctcggacacctcgccgatcgcccgcagttgctcggtggtgagccgtccgcccgtgatgcggacgcgcatcatgaagtactcgtcctccagctcctcggcctccagcaggcccgtgcgcccgccgtcgatcccggggcggcgctgggtgtacagaccccaccagcggaaacgtccgcgcaggtcattggggtcgatggcgtggaaaccgcgcttggagtagatcgtctcaatgcgtgtccgcacattgagaccgtcgtcgtccttcttgagctgttcgttgccgttgagcggggtcaggtgccccacggcccactgtccctcgccgcggtgacggctcaccttgcggcggggcgcgacggagttctgcgaagaggcggcggccatggtcgatacgtccttcgggacagctggatatgcggctctgacctgcgcggatgcgggcgcatgggcagacaggcaggcgtgcgcgtcattgcgcggaggaaggggggaagagaagatccggtggtgctgtgcgcgtggcctcaggccaccgcgggcgagtcagctcgccggacagatggcgctggacatgcggccgtggtcgacgtgccgtcggctcaccaaggcggttccagttccagacatgaccgcagcgtggcacggcgatctggacacagtccagctttgtccaaagtgcggacacccttgtcccgagatgcgggacaagggtgtcggtggtcgcgcggtcggaaagcggttgcccccgcccggaacaggccgggaacgcgctgggcggatcaggccgggaacgcgccgggccaaggacccggagtcgctgcgtccgcctcctcctcgaccttggtgtcgaacagcttgaaaccgcggcgctggtagttgtccatcgcgtgctcgccgtccttgctgcaggtgtgcagccacacccgcttcgtcgtcgcgagccccggccagcggtcggcgaggtcccaggcgcgggcggcgccgtgggacagcaggtggccgccgatccgccggccgcggaaggcggggatcagcccgaagtagacgatctcgaccaccccgtcgtcctgcgcctccagttcgacgtaccccgcgggcgtgccccggtcgtacgccacccaggtctcgacgcccgcgcgctccaggtacgcgcgccactgggcgtacgtccagccgagccggtccgtccagcggatgtcgccgcccaccgacgcgtacaggaaccggttgaactcgggcgagggcacctcggcgcggacgatccggacgtccccctcgggcgcggcggccggcaggaggtcggccggggcggtctgctccagggaccaggtggtcacggcgatgttcgtcatggcggccagggaatcatccggccggggttcctgtcgatcgagggcgtcggagccggggggcgaggggctgggggcggtgctagtgcagttcgtgttcgagcgcgggcaggggcaccgcgaacagggtgcggccggagacggaccacagttcaccggtctgcggcacgtaggacagggagccggcgccgtcgccccagcagcggtgcgtgtcgcccgacgccccgcactccgtcgcctgggcaccgtcctcgtcctgccgccacagagtgccgtgcccgccccgcttgcccgccgtccggcccaggtaccagtcggtgtggccggaggggcccatacggtgcgcgaacaccccccgcacgccgttcgcctcggtctcgtacgcctcgttcgcgctcacggtccctcgggcgtcggcggccagcagtccggcgcgcgccgggtccgtg

SEQ ID NO: 399 - DNA, 20922 bp, Unknown
  Kingdom: Bacteria, Phylum: Actinobacteria, Class: Actinobacteria, Order: Streptomycetales, Family: Streptomycetaceae, Genus: Streptomyces
  misc_feature (340)..(341): n is a, c, g, or t
ccaccttcatgggcgagcacagccgcctcatctggcccgacggccacggtctgcgccgcatcccggtgaccgacccgacgcctgtctacccgcactcgctcctctggcaccgcgagaacccccacccagcgctggccgccctccgcacccacctcgccgccacaacggccggccacgacgccgccaggacctggaggccgggctgggtgattccgcgctgaacgacgccgcgtcctcgatcaccgtggccggatcgacgaacggtggctgaggggcagacgtgtccctcgggtgcgcgcaggagatcacgccgccgtcgcgcggtttcgaccacaccggnnccgggcctgggcctcaatgtccttgaacggctggtagtacgtggcgttgcaggccgcgacgatctggaacgtccagtgccccgggatcacgttgcggcccaggatctcccgctgcacccgctccacccacggctggtggccggcctcccgcagcaacgccaccgcacggtccagggtgaagtcggcgcccccgggtgagctggtggaaggcgtagaggtgaccgcgggcgcgttcggtcgtctccagcgcctccgacaacgcccccagggtttgcacgagagtgcccgagacacccggcagccgcaggtgcgcaccgtccgggccgtcatggtgagtgctcatgccctcacgcatccccgacccctgcagcgccaactggcctcccgcccaccgcagattacgcatgcccgtcatgccggcgacctacgtggccttgtccacgagaacgggcagccgatgttcaccacttcgggaggtgtcgctccgcccccgcttcatcccactggctgccctgatgctagacaggccctgcaccaagccgaactccggggagccgtcgcgctggaactccgcctcaccccgaagtcctccagacagccctcaccgccccgtgaccgcacgcgccggcaccgccgaccggcctcagccggagggctcctgccctgcacccgtaccggcctcgccgctcgccctgtcgcgtaccggcacttgagagcaagcgctccccgagctgcgaccgtgatcaacatcccgggcactcccccggcgccactacataggcattctcactgcacctgcggcagtctcacccaacctgcagtaccacaggtcaaacggcttgcacagggccccggaaaccggctcagtcaacttgcagcaccgcaggtcaaccgagtgcagctaccgcaacattgatgagacatcacggttgggtcgacggtggctaccgccggcacctcgtcgaacatgccgccgttctcggcatcgacatggaaatcaccgctcgcaagcccgggaccagaggtttcactcccatcccgaagcgctgggcggtcgaacggacctacggctggctcatgctccaccgccgcctcgcccgcgactacgaaaccctgcccacccgatccgaagccatgatccacctcgccatgaccgacctcatggctcgccgcctcaccagcgagagcaccatctctggcgcgacccgacatcacagatcaaatagccgcttccgggataaaacatcgggcgaaaacgacctctcaggagttctgctgcgctcggaagaccatgagtgccaactggacgcggttgtccaagccggtcttggtgagtgcgcgggagatgtgcgtcttgactgtgccttcgctcatgaagagtgccttcgcgatggtcgcgttggaagcgccttcagcgacagcctcggcgacggcgcgctcccgatcggtgagcgtctccagtgcctgctgagctttggcgctggtggagtcctcggctgtgcgagtgtggcgtgccacgagttggcgggtgatcgttgccgagaacgcggattcgcctgatgcggcaaggtgaatcgcgtggcagagctcttgtggcgcgacatccttgagcagatatccgctcgcgccggcctgcaacgcgtcgaggacgtgtgtgtccaggtggaaggtggtcagcatcagcaccgcgaccgacggcaccgccgctcggacacggcgggtggcctcgacgccgttcatctccggcatctgcaggtccatcagcacgacatcgggacggtgccgcgtgaccgcgacgacggcctcggctccgccggatgcctcggcgacgatcgtgatggtggggtccaccgacaggaccatcgacagcccggcgcggaccatcgcgtcgtcgtcgacgatgagcaccgacgtgggtgcgccgggggcgctgctggaacgtggagagctggtcatcgcaggggcactcgcgcagtcagtcggaactcgtgggtgttctcaccgcggtcgacgacctcgtgttcgactacgcctcccacggtggcgatccgttcgacaagaccgctcaggccggcgccggttccgggcaacgctgactcggtttcttcgatcgggttggtgatcgtgacgagggcatcgctgccctcgcggcggacattcaccgtcaccagtgcgccgggggcgtgcttgcgcgcgttggtcagcccctcttgcacgacgcggtacacgtgctcggcgctcggaagttcccgcagcgtggctgtgccgccggtgctgccgctgttgtcgggcagatcaaggtgcgcgacgatcaactgaccggcttgtctggcttcgtcgatcagtcccgcaacggtgtgctcgtgcccggcagtttgcggtgtcacgacggtgccgtcgcggagcatcccgatcaccgtgcgcaactcgtcgagcgcactgatcgcggtcgtgcgaatcgtcgcggctgtcgtgccgacattcttggcgttgcccccgccgaccgcgagcccgccggcatacagcgcgatcagcgagatgtagtgcgcgaccgagtcgtgcatgtcccgggcgattctggcgcgctcggccatctggatctgttccgcacgctgctcccgctcgcgctcgatacgggccgctctgtcccggtagaccgcgaccaggtcctgctgcttctgctgcagtgcgccccaggccacgacggcgagtgcgatcgcggtgttgaccaccacggtgaggctcagcgcggagttggccggatacaacagccagaagaccagggcgccggcgatatcggccaacgccaccacgaacgcctgctcgatgccccggctgcgtgccacggcgaacagggccacgtagttggccacgccggcggtggcgcagaacgccccagcgaccgccagcaccaggccgaccacgaccggagcacggtaacggaccagcaggacgagactcgcgacggcgcccacggagatgtcgaggacgcgccacccgcctcccgggcgttgctcgaggaccaggaacagcatggcgagtccaccggcgaacgaggagagaacaagcaacgccgaccggccgcgctcgatccacggccctcgacgcaccggtatctcgtcgttgcgaccgccgacgagggcgaggggaggagacatcaccgaaccaccctagaccggcggcctcgacgaggcagtcaacgaaagtcgtagaaactgtcggccgttcgtggacgggatcggtccgatcggcagacgtccggcacatcggccggccgacatggttgaggacatgaacaccacacgtcctcgccgacacctgatgacgctgctcgggctcgacccgaccgatcagcgctccacgacccggatccgcttcgccgtcaccacggtggccgccttcgcgaccgccgtccagatcatcgtttggttgctgatgggcatcttccgcactgacctcgacggtccgtggtggatgtggacgcccggcagcgcccttctcatcaacgctgcgctgctgtccgtggaccacgtccgcgaccagtggctacgcaccggttcatcgcaccgcctccagaccggaaacctccgtaccgacgacgtcacccgggagtcactgtgaccacgccatcgtctacgcagaacctgtctgcctcgtctcgtcacgcagccgacgcatcggacctgtccaccaccaccttcgccggccgggcggggatggcagtgggtgccctctcggtgccgatggtggccttgtacttcgtctactcgggaccacctccggagtggaacgtcctgacgcgtagcctgctgacgctggtgatcatggctgtgctgacggcgttcggggtcgctctggcgcgtctgcttcccagggacgacacgggccggcgcgccatcgtcggtcagctcaccatcgtgtcgctgctcacctacgtcgcggtgatcctcttcgccacctcgctggaggccggtactcccttggccttcccggatcgggggatggacccgaccacggacggccctctggcggccgccatggcactggctcatggtccgatcgcacacctgtggatcgcgatgttcttcctcgggttcgcccgtgccgcgcagcggtacacggcagccgcgtcgccggtggtgccacggtggaccctgcgcggttccatcgtcgtcggagtcatcaacctgctggccatcccgtcgctctacttcggcatggacgccacccacttctacgccgtcaacgggtggggtgcggatgccctcgtcggtctgatcactctcgtctgggtcggcttcaccggtctgggcatccaccgggccggcaagaagcgggcacgcatgctgacttgacgggccggactgacctccgcctggcacgaccgcctgcgaaagagaacccccggtgtgttccggagaggccttggagcccttcctctcaccgggggttctcgccgtctccgcgttggccctgtggcggctgagagcccatctcgttcggtgattcggtagccggagacatgcggggcgggcagcggtgacacaggctggaacgggctatggcaccgaggctggcaagtcgccgtctggtcgccgtgttcagcagcccgctgaaccgtgccatgcggacggcccgcatccgggcaccctcagctttctggccaccgaggacgggcagcccttcattgcggcctggaacgttccgtagggcaagcccgctgcctcacagctgagccgagaggcgccggaagcagacgagcgtcgcggcgaggccggcgaggcctcgtccggcacggtggtcctcatccgtcccagccctcgcagaaggcggagccgaacggacggaatcgccaccgcgaccaccacgcaaacgcatgaggccaacacaatgcaggtgcccggtgtccgccttttcgggcagggcgccgggcaccatttcactcagccgcgctgtagcgcggggcctcgcttttcagtcggccgtgcttttgactcggccgtttcctcacttgctccttcgtggtgccggctggggcttgcaggtccactcctcgtcgatcagctcgatcacggactggtcgtaccgggagggggtccagccgtcgtcgaggaacagcgcggtcaccacgtcgaccgggttgtccagggcaccgggcgagcaagggtccgctgacgcgccgctgcgcgtcagaaggttctgcgcggccttcatgtcccgaacgccgatgcggtaggtcgcctcgacggtgaccacagcgggctgctttcccttcggggtcttctccggggcgggttcgtccttctccgtccggaccgcgaacgggtttccccagcgggtttccgtgaagcaggcgtccgcgtatctctgcaccgcctgcgtcagcccgttgaccgccgacatgacggccaccgagtcgtccgggtcgctgtgcagttggagtgcgtgcgcccgcaccgcgtccgcgagggcgtcggcgagggtgagcaggtcgtccgccgtctcttcagccattgctgcggtctaccatcggtagtgctccgtgtgggagatctcgccccacttgttgtagtagtcgacgtgcacgtggttgcccttgcgtcacggtgccggcatacacgtgaacgtggccctggcaagatttccgtgaagccggggtgtgccaccgtgcgccggtggcgctccgtcacaggtagctgcgccggagcagagccatgaggatgacgcgctggcgtagcagcggcacccctgcacgtccggccatgatccgtttctggagtttcaggtcggtgatgcggccttcgttgacgccggagttgaacggggtggtgatgccctggacgaccgcgggctggtcctcgcggatggcgttggccaggctggccagggccgggaggcgagcgactgtaagttgctcgagcaagcccggcagcggggcggcgtcgcgggcgtcgagcatggcggcgaactgacgcaccagatcgtgggtgcggtccagttcagggcaacgctcgaacaacgtctggagtgcgtgggctgcgtgcaggctgcggcgggatggcgcgctggtgatccagcgggcgacttcgcgaggcgagggcggtcgttcgcgtggagtgttgatcggcaggccgaggcgcaacggcgctatggccatcttgacccgctggcagtggccacggtagcccttggcgatgagctcctggtgtagcaccgtcgcggtgtgctcgccttcctcccagcgttgccgcaagtactccaggtatggatcgagactggtgggtcggcggggccgggtggctcgtacacattcctgccaggtggctgctcgggcgtattcgcgcacggtgcgccggttcaagcccagttcgcgggctgcggcgttgagcgagcgaccggtgtcggtcagcgcgtgcaccgcctcgaacagctgcttcgcgtggcggcgggctagggtgtcggcctggtcggacggtccccctggggtcgccggtggcggtgccggttcaggctcgggaactgcggcgagtaggcagccgcggtgggcgacggcgacatccccgacccgcttcgacaacccctgccacaagtggaagcggtcgccgacctgcaccgcgtccggggcgccgtcggtgatgccttggcagtcgaccagcgagccgtcccggcagaccacctcaacaccggggtacgtccgcagccaggcggccagttactcggcgtcgcggccgacccacagctcgatcagcaaccgggtatcagcatccaccagcaaagttccgtacccgtccgcatacaatgcgaagtcatccacacccagcacccgcagggccgccggtgacggaagcggcaagcgcatcaagtggaacaacacgccggtccgcgacagcggcactgggcccgtgaggccttggtgagctgtcggtgctggtgctctcgcgcttggcagtcaggatggctggacttggtcgaagagggcgagagcttcggcggggtccgggctcacgaggcgttccagaccggccgtcgtgatcttcgcccacctgccggcccgggcccacatctgttcctcgaaggcgcggacggcctcgtccagatctccagggccggtggcgatggactcggcgagttcggcgccctccagcatcgcgaggttcgcgcccgctcccaatgggggcatcagatgggcggcgtcgcccagtagcgtcaccccggggacgtgggtccaggtgtgggacacgggcaggacgtagagggggcggtggacgaaagcggtggcgtggcggaggaggtcgaggacgggagcggcccagccgtcgaacagcgccagcaggctcgatcgcacggcctcaacgtcggccaggtccaggttcgcgtgccagtccagcgggccgcggaactgggcgtacaccttgacgtgaccgccgctgttgcgctgggccacgagagctcggttcaccccgtacgcggccacggaaccgtcgccgatcaaccgggcgaggtcgcgatggcgggtgtcgacgtcgtcgaggaaggattcgacgtaggtgacgccggtataatgcggcgtcaccgaggagactgccgggcgtgtccgggaccaggcgccgtccgcgccgaccacgaggtcgaacgtctcctgtcgcccgtccgcgaaacggactactacaccctcgtgggtccccggcactatctgcctcacgctccgcccccaccggacgttgagagggccgagcagcaggtcccggagttgcccgcggtcgatctcgggattggcccggtcatctggacggggtcgccagtcgcgcaggacggtcccgtccgcgtccaggatgcgcatggcctgcccctcggggcgggacagcgcctggaactccgccagcagtcctgccttgtccagggcgagctggcctagcccctcgtgcaggtccagcgtgccgcctggggggcggacgtcgggggcgggatcgcgctcgaggacagcgacggggtagccgtggcggtgcaggacgcgggcgaaggtaaggcctccggggccgctcccgaccacagcgatacgatgtctcatggcaatacactgtattgctcggtacgatgcatcgcagcagaacggtgtgaaccatgagtgtgtgggaccggccggagccgccgactcgccccgtaccgctcgatcgggagcggatcgtggccgccgccatcgcgctggccgacgaggccggactggacgcggtgtcgttgcgcaaggtcgccgcccggctgaacgcgggcccgatgcggctgtacggatacatctccaccaagcaggagctgttcgacctcatggtggacgaggtctacgccgagatcctcccccaggagcagcccggtgactggcgggaggcgctgcgcatcctcgcccaccgcaccaggcaggccgctctccggcacgaatggctggccgatctgcttggcggccgcccggccctgggcccgaacgccctcgccgtgggcgaggccacgctggccgccctggacagcctcaccgacatcgatactgccatgcgcgcggtggagactgtcggcgcctacttcaccggcgcgatcaggcgcgagatcgcgaacctgcgggccgagcgcgccacgggcctgtcgaaacacgactggcagcgcgcctccggcccgcatctgacaaggatgttggccaccggtcgcttcccggcgctggccaaggccgtgtacgacggcgcggacgtggacgccgaggcatccttcgcgaccggtctggactggatcctcgatgccgtggccaccaaactcacccagccgccggcatgacgctcagcccttgccgaaggtgagcgagctcgacgcctgatgcccatgggccatgaagttgacgctcggtgagaagccgttgtctttccgagagtgacgggtttgtttccgctggtcaggtgtaggtgcggtgttccggcggcagggacggggtgtcgtgtcgtctcttcggtggaggtgtcgggatgccgtcggtgatggggttgctggaggagcgtgaacgcgccgctgtgtcggatgaggaacgggctgcgctggaggggtcgaggcggggacccaggacgcgctccagactggggtggaactgggtgagcaggccgcgtatccggttggacgtgcgggtggcctcggccgcgagatcctggtcgaagcccacaaggaccgtgagttcggcggtgatctcgtcggtcagttccagggaccgcagggtgtgcggcatggtgcgggccgcgtccgcgatcaccgcggcgtccttcgcgtcggtcatggcctcgcccgggtagagatcggcgatccggcgcatggcaagcccgggcaggtaggccacttggcagcctgcgtcgcgggcgacggtcagcggcagcgcgccgatcgaggcgggctgatccacgatcaccaggacggtgccgaacttttcgcgcagcttgccgaagacggcccgcagcctgggctcgctattgggcagcggcttgtcgaagaccttcttcccggccggggtgagtccgtggccgtggtgggcactcttgccgacatccaggcccaggaacacgcccacgtcttcgatctcgaacatcgcgccccttcccaaggcatgttggcggtgccggcctcggctcgggcgtcgtgctcgcgcatccacgttatgcagacctgccgcccgcgaactgcccggcgttgcgccggaccaggcggtggccggacccctgatcagcgtctccgacggcacgtcccgggcccggtgacaccacccccaggtcatccgttcaacagggggacacagtcatgccgggcacggaggccagcggcccgttgcaggaccgcagaaaacagaacgggagggcgggcggagaagtcgacgctgccgaatctgcccaccgtgtcggtcgcgcggaaggaactggccgggctgaagaccgcggcgccggcctcgatgcggggctactcgcgggcgaagttcccgcactgggccgagcggggcgagcactgcgacacccgggagaccatcctcaaccgcgagggcacccacgtgaagcgcgacgcccagtgccggaccatatccggcagctgggcctccgtctacgacggcaaggaggcgaccgcggcctcccagctcgacatcgaccacaccgtccccctcgcgcctggcgctccggcgccgccgcctggaccaaggaacagcgaaaagcgttcgccaacgacctcaccacccgcaactgctggccgtctccgcatcctccaaccggcagaaaggcgaccagtcccccgaccagtgggctcccccgctgcgctcgtactggtgcacctacgtccgcccctgggtatccgtgaagtccacctaccgcctgaccgtcaccacggcggagcggacgaaactcaccgagatgctggacacctgctcatgacccacgacaacaacagcagcagcggcgacgacacagccccagccccgggccaggctcgggaagacggccgactggtcgacgatgtgcaggccgggccgggcggtgcgatgaccgacgaggtcggcgttatcaccggcgacctcatcctcgccaccaccgccctccccggcagccaggcccgcctcgcgatccagtacgccgaagccgacgagtggtacaccctcaccggcagccccacccccataccacccgccggaccccaggccctccaccaggacgtcctcgaccgcatccgccgcggcggcggcgcccaggccccacattgacccagccgctcagacaccgctcgcaggctcagcacgtacagccctcgagagagaccaggcgggcactcgttcatcgacctcgcctcaggccgctcgtcggccaggcgatcgcgaatcacatgcgaaccgatctcgtcatcgacaccctggccgccgccgatcaaagacacccatcgctccacctctcgatcaaggtgttgcgacgatcgattgaatccgccctttgctccgggggccacacccgtcggtaggggccggctgaccgaccgcgccgccggccccggcgctaccgccggggcccgaccgtctgcctcagtggtacctgacctccagcggacggtgcaccgactgggccggtgcggtgacggtcagggtccgcgagcccgcgtcgaaggaccagtgggaggcggagacccgccgcccgttgacgaagacctgcttcggcgcgtgcgcgttcatgaaggagaccgtccacgcgcggcgggagacctggcccttgaacgatcgcgacgccggggcgatcgagaccgtgtggttcgcgccgtgctcggcgtagcggatcgccgtcgtggcgctctgcctgctgtcggccgtggtgccgttgtcctcgtacaggcgcgtggcccccggcgcgccctgcgcgacggtgaccgtcgccttggtgagggggttctggtcatcattggcgacgttgccggtgcgcgtcgtcatgatgccgcccgacttgatgaagacgggcatcgtgtccagacccgtggtgatcttctgcgtggtgccccccgcgaacgtcttgccggtgaagtagtcggtccacgaggagccggccgggaaccagacggacgtcgtggccgattcgccgggcgtggtcaccggggcgaccagcacgtcggggccgtagaagtactcgctgcccgccgtcgcgtacgcgtcctggctctccgggtactgcacgtaggtcggccgcaccacgggggtcccggtgcggttggcctgctcggagaggctgtacgtgtacggcacgaggtcctcccgcaggttcaggaacttctcggcggacgcgtcagaggccgggccgtactgccagggcagccggtcggcgtggttgccgtgcaggcggtccaccggctggaaggtgcccagctgcacccagcgggcgtacaggtcgtcgggcagcttcgtggtcccgggttccgcgcccttggcctgggtgccgtcgttgttgaacccgccgatgtcgtgcgacacgttggacaggccggtggacgccgactcgcccggggtgtagccgacctcgaacttgagggtggcccaactggacgtcgagtcgcccgtgaagtgtgcggtggtgcgcttgtcggcccatggccctgtcggcaggccgtgtgggttgtagttgccctgcggcagcgccccgaaggcccgggagagcgcgaaggagcgctggccgttcttcgccgagtcgtcggcgtactgctggttgatccaggcgtcaggcgtcaccccgccgagggacgagacggacgcgtcgcagcaccagtcgagccaccagacgtccacgccggccttgtccatgggctcgtgcagatcgaagtacgctctgagctggtcggggtcgccccagtcgaaggtgtaggtgttgttgccgctgtccttcagcttgcccttggccgtggcctgcgcctgggcgaacctggggtcgtcaccggagatgctcgggtggatgttgagcgagttgtgcagcccccgggcggccgaccagtcgaagaacgccttggcgtcggggaacttcttcgggtccatctcccagccgtcccaggtgctgggcgacttgaagtccgtgtcggtcaccaggacgtcgagcgggacgccgtccttgcggaacttgggcaggatggtgttctcgtagtccgcggcgctgcggtcgtagtactcggagtaccagacgccgtacgcccagcgcggcagcagcgcggagggcccggtcagggtggcgaggtcggccaggccctgctggtagtcgtgtccgtagccgaacacgtacccgtcctgatagccctttcccgcgtggtcgccccgctgcgtgaccttccgggtggcgttgtcgaagatcgccgaggcggtgtcgtcgagcagcgtccagccgtcctggtagagcaggcccggcgtcgtgggcgcctcgccgttgacgccgtcgaggctgcggcggtacccgccgagcggcgcgtgcggggagagcagcggcgaggtgcgcgaggtcaccgctgcggtgtcgaggttgacgcggcagccgtcgtcctccgggcagccgacggtcacgtcgttggcccccgcggccaggtgcaccggcacggtggcggtgcgccaggcgtcccagtcgctcgtagcgggcagcgaggccttcacggggacgcccgcgccggccttgacggagatgtcacgggcggcgccgctcgcgtcgccgttggagtaccgaagctggagggcgtagtcgccggccttgggcacgtcgacgacgtgcagcgtgtcccgcgcgcccgaggactcgagaccggccacgaacccgcggcccgagtagccgttgtggtcggacttgagcgcggcggaaccgccgaggcccgcggtctcggcctggcagacggtgccgaaggagcagtcctcgaccggtggcgtcacggggtccgggtagggcgctcccggcgccaggacggcaaggttgtcaaggttgacgttgccggagtcggccgcggtgcgtgcgaaggtgacgatgtgggtgccggccgacaggttgagcgtgaccgacgtcgtggaccaggtgtcccagctcgcggtcttcaagagcgtcagcgtcttcgcggcgccgccgtccgccgacacgctcagggtgcggtcctcgtcgccgccgtcgccgccgacggcgttcgcgtagcgggtggcgacctggtaggtgccggccttggggacggtcacggagaacgacagagagttgcccgtcgactggaagcccgccgcgaagccggagccggtgtaaccggagtggtccatggcgacgccgacgccgttgagggtctggtcctctgcctcgcaccgcgtcccgacggcgcagaccggggcgttgggccagggagcggcggtgaccgactgcttgccggccttctccgtcaccttcaggttgtccgcggtgaacttccctgagccgaccttgtacgtcagcgtcatggcgctcgtgcggatcgtcagctcgccgtggcgcgtcgacgacgtgaacggggtcctgccgaacgtgtcgcggccgatggcgttgaaggtcgccgcgtcgacgaacttggcgtcccccgcgtactcggtgcgtatgagcgtcgaggagaggacctcgaaccgggcgtcgcccgagacgacctcagaacgcgcggcgctgtgaccgcgagccgcttgcgcgccttgcgctgcctgtgcgggggacccggcggcccccagggccaccagcacgccggccgcggcagcggccgccgtgagtttgcgacgttgtcgccatctgtgagtcatggaacccggtactccttcggtatctcctggagggcgtacttcgcgtgcgctgacaacgatgtcaagaaccggtgaagcggcagccggggcgcgcacaccggggtgcgggaaaggacgggggcgcgtctcgaagagtgagtacgagtacggcggttgccgacgggacccgttgtccgagccatccgcgaccgcctctcgaccggcaccggtacctcagatcatgctcctttcaatatcaacccaccgcgccacacttcgtcaatgcgtcggcgtggccgggtagatgggtcgacgggcggcccctcggccagggtcggcggcggtctcgcccgtcctggcgaacctgttcctccactacgcgttcgatgcttggacggcccgggagtctccgacgcgtagaggcagtccgttcgcatccgacaggacgtgcatcctggaaccgggcctaccccggtccacggggctcggacctgcaagttcgccccttttttagcgcggacatgcgccgagtcgagcaccgctcgcgatagagcgatcaggtcctggccgtccaggaggtggagcaccttctggcgcagccgtccccacacgccagcccgggaccagatgaggaaccggcgatgcacggtcgacttcgacgccccgaagcacggcggcagggcccgccaggcgcagccactgaccagcacgtagatgatcgcggcgaacaccgcctcgtcatcgatgttcgcgaccccaccaccctgcggacgcacccgcgccggcggcagcagcggccccgcgacctcccacaagccatccggaacaatccatccccaccgtccactcccccaggtccggcacaactgctaacagaccatgtaggacacggtcttaccttgttctttatctaccaagatctgccaggtctgccgatggccttgagggtctcgggacgtttgacggttttgccgacgtcgtagcgggtggcgggccgccggttcttcgagccgagggggcgtcctggcccggttcccgtcggttgaggaacacgggctgggcagagcaggtgcgcgcggatgttcctgaacccgcggcggacccgggccggggtgaggcgttcgggtttggccggcttctcccaggggcggcggaggtcggcagcgaggggtcgggcgaggcggagctgggtgtgggcgactgccaagagccaggtccagaggtccgccgcctggggagtacggactttcggggtggtccagccgagcgtctgtttccccaaccggaaggtgtgctccaggtcgaatctcctgaggaacacctgccaccacagggccacgtccgccggggcggcgccgctcttcgaggaccacaaccacaccggcggggcttcccgctcctcgagagatgctcgaccttcaagcggaccagagtgccctcgacgatggggagttcgtcctcgtgctccagccaggccgagcggtgggtcagtctcgggtggacccggtcccatgcttgggcttcggcctttccgtagttcaccgtggcggtggccgtggtgatcgccggttcggcccaggtctcgggcttggtgaaggggaactccggtccgtgcttgggcggccggccattgacgccgtgcatcctcgggggtttcggcaagcgcatcacccggtcgctgcggatccgcccaaccagttcaacgggcagattccgcagcacccaggccagacgggtgacgtcgtagccggcgttcatgacgatcacgatgtccgagtctccgggcgtccaccggccggcagcgacgagccgctcgaccacggccctcagctgggcggcggtgaccgcggtcgcatcgtcctcgggcccgagccggaccacgcccaggatcccggtccacgacgtggcaccgggctccaggacggcgacgaaggagtacggccaccccggaatgaactgcgacgcggatttcgcccgcccgtagacgtggcagaacagacgttccgccgagcagggtgcgtccgaccgcagccacggcgacacgtcgactgccagcaccaggcggccaccatcgaaccgtggcaacggcagcccggccagcaccgttcgcagccgctcgacgttgatccggccgtggttgagggctccgtacaaagctccgtgtccacggcggtgctcgggcaccagcgtcaggtccacgggcgagaccaccggcccgtcggcgcacagcagtgcgtcggccagttcgaacagttcatcgcgtcgggcggtcaggcactcgtagaactctccccggaagcgtgacgcttccgcgaacgcttcccgacggacatcgtggtgcagcagactcgccctcacggccttcgtcgtggtcacgtgtattccttggtcggagcacatgactcagacgaaggccgctcctacgtccggcgaatcccctggcggacgaacccgttcgaggcgccgttcgaggtcgtgccaccatggacggcatgacgaccaaccgaaaggtccatgccgcgtagacggccaggacgcatccgggcggggatcccggaccggcagcagtcacagcaatcaaggccgtccatcgaccgcctctccccgcgagccctgtccgagatcgtccgccttgaacgcacgcggaactacctccagccgggagacaccagcgcggcattgcgcctgtggaaggactacgtccaccgtcccgaacgcgagctctggcacgacgacgagttcggaaacgtgcactggtactgctgcggcaacccacttgaaggccgtgccctgctcgacagcgtgatccgagcaatgtcgcctcacacagcccgcgagctccgcaagatcatcaaagagcttgatgcattcatgccgtcttacctggtcgcagaccgccgaagatgaagaacaagcttactgcctcttctctatccgctcgcgcggtcggacaggttcgaacaggggccaggttcgggtgagttgtccggggcgggtgcatgaagaaagggcctcttggtagctcgcggatgtcgagtccagcgagaagcaagaggccctgttgtcgaagtgtcgcgtggtcgtggtcgccgagtccagttcgtccactcgtgggtgtgactgcctcgcccacaggttcgggaacgcggtcgaccggccgcagcgccggccccgacacggctcggacatgagcgatgccgcgtgggccgtggtgaaggatctgctgccggttccgggctggctatcgggccgcggcgggcgtccggagggctactgccaccggcagatgatcgacgcagtgcgctacctcgtcgacaacggcatcaagtggccggcgatgcccgcggacttcccgccctggccgcgcgtctacgccttcttcgcccgctggcgggacaccggattggtcaccgaactgcacgaccggctgctggaagccgtccgcgccagtgaaggccgcggcaccgagccgagcgcgggggtcgtggactcgcagtcggtgaaggcggacgccaccgtcaccttcggctcacggggcttcgacgcgggcaagaagatcaacggccgcaagcggcacctgctcaccgacacgctcggacttctcctggccgtgctggtcacaccggcgtccgtgaccgaccgggacggcgcccgtcccttctgccgcaggctgcgggccgcttccggcggctggcgcgggtctgggccgacggcggctacgccggccacctcgccgactggaccagccagcatctcgggctcgtcctcgacatcgtccgccgcagcgaggacgtccgcggcttccagccactgccccgccgctgggtcgtcgaacggtccttcgcctggtttctgcgcagccgacgcctggtccgggactacgaacgacgcaccgaaacgagcgaagccgtcatccgctggtcgatgatcgccctcatgaaccgctgcctggccgcacagcctcatcagtgcgctgttgtgccggcagggtgaacctcccgggctttgcctccaccagccagccccgttccaccagcctcttcaaccgtgctctcgcaccctcgacgcgtgaggccgaggcgctgtcccagccgagcaccacggccgcccgccgggcacccagcccgtcgttcccggcctcggccgcggctgccatcaccgcctcgtagtccaccgacaggtcttcgaccccggccgcgttctcccgatgcggcaccgcacggcgcgggcccaccggcttcctcggcgacggcccaacgaccgtctcggtcggctgttcctcctcggcgagcgcttccaggtactggtcgagaccgatcgtccgaagcttgagaacctccgtggcatccatcaagtccgcccgcacccgctccagttcggcttcaagctcttccacccgcacggcagcggccttccgccgcgtttccagaaccgcccgcatcgacggcatctgccacccccacgccgactcgatcagcaacgagtcgagactcccgccacagccgcaacctcatgcctgaccagcagaatccgcacacgacattcggaaagcgaacggcctctcagcccgcggtcattcctcaaaccagactggccacccgccgacgaggaatgacgagcgccctgcccctgcttcggcagacgccggggcgcctcgtgctctacgggcaggtttcgccgaacttgaccgtggtgagagcgaccggctgcccgttcagcgaggcgcctgctgcccgctcctgcgtgcacacctgccagttgctctccaccaggacgaaccggtcctccgcggaggcgtccttcacggtgagggatgtccccgaatccagggcggcgcgcgcggccttcaccgacttgcccttgaagtccggcatccgaccgccctcgaccgtcggctccttctcatccttggcggggcaggactcctcgagtttcaccgcaccaaagtcgaggatggtgtccgtaggcaccgtcttcccgacggccacgttctgggaacacaccttccagttccggtcgaaagtctgcatgcggtcacggccgagcgcgtcatgcgacttcaccgagtagaagccgtcggcctgcgcggcgtcctgcgcggactgcaaacccatgccgacgaagttctgcaccgtcttcgacgcggctccggccggtttgtcgtccttgggcggcacgctgctgggcgcagtcgacgggctgctgcttccgctggagttggtgtcggtcggctgacaggcgacggtcaggctggcggcagcgcagagcagcgcagcactgatgatgcgtgtacgcacgtttcccccgggtgaagcgagtacaggcggaacacgttagagcacctgtgaaggatatgtgaaaccgcgtcatcagaccgtgatatggcaacgggcccccgcgccttcccgcacacgcggcggaggcgcgggggtcttgtactgcctcgccaccacgttcggtcagaccctgggcaagttccgcctggtgcacgacgcatcgaaagtagtcgacctcaacgccacccgcctgcacaccgtgcacttcctccccgatcccgcgcggccgggcgagttcatgacccccttcatgggcggatcgagttcgcggacagcaaggaccacccgcagctccaggtggcggactgggctgcgggcgcgacgcgccagtgggcgcagtggatggcaggtggcggcggggaccagttctcccgcggcctggaaccgattgcccgaccctggctcatcgacggcatatggccggctcccgtggagggctcagagacatgatggcgacgaggggcgcctgcaggatctgaacaggctccgctgaagtcggagtcgcccttggaccacaccaccaggaggaaccagtgtcatacccgcaactgctcgccgatgcgaagaagctgctgagcctcccgtgtatcgtcgtgatctgcggctccacccgcttcatgaccgagatgaacgaggccgatctgcaggagaccaaagccggaaagattgtcgtcaaaccggcctgtgacatgaagtcgccgcatgaactttggtccggtcctgcccaggccgaggcgctgaagattcgactcgacgatctacacagggcgaagatccggctcgctgatgaggtgctcgtagtcggcaactacattggagacagcacccgagctgaaatcgcctacgcccggtcgctgggcaagcccgtgcggttcacgcaccccgaagtcgaccctgacgcatgaccgcctcagcgcgtacgtcaggccgagcagcagtacctactgaggttcaactcgtg

SEQ ID NO: 400 - DNA, 4490 bp, Unknown
  Kingdom: Bacteria, Phylum: Actinobacteria, Class: Actinobacteria, Order: Streptomycetales, Family: Streptomycetaceae, Genus: Streptomyces
cggccggggccttgacgaggaagtccagcagggcgtcccagtcccgggcctccagggcgcgcctgccccagtcgtcgaactcggacgaccagctcggcacaccgtcgccggtgtaccgcagggcggcgaggttgtgggtgaagaacccggagccgacgatcagcacgccttcgtcgcgcagtggtgcgagcctgcggccgatgtccatgagcttcacggggtcgagggtcggcatggagacctgcaggacggggacgtcggcgtcggggaacatctcgacgagcgggacgtaggcaccgtggtccaggccccggtcgggcacgtcctgtacgggcgtgccggggccgcgcagcagcttccgtacccgctcggcgagcccgggggcgccgggagcggcgtaccgcacccggtagtagtgctcggggaagccccagaagtcgtagacgagcgggacggtctccacggcgccgagggcgagcggggcctcctcccagtgggcggagacgacgaggatcgcgcggggccggggcagagcggcggaccaggcggcgagctggccgggccacaccgggtcgtcggcgagcggcggggcgccgtgactgaggtagagagcgggcatgcgctcgggggcagtggtcatggcggcggcttcctcctggcggcggtgacgggcggcggacggcggacatgcgggcgtaggacctgaacttcttgaactttaaagctctacccgcctcgccactgtacgccccactttgtttaacgttcaatgagcggcctcgtagagtggtctacatgaacacggcacccgtttccgcgcccggctccgcccatgccgcatccggctccgcccatgcctccgccgacgcccatgccgcatccgcctccgcctccgcctccgcctccgccgacacccagcgctggctcaccgccgaggaacagcgcgtctggcgcgcctacctccacgccacgaccctcctcgaggaccacctcgaccgtcagctgcagcgcgacgcgggcatgccgcacatctactacggcctcctcgtccagctcgccgaggccccgcgccgccggctgcgcatgaccgagctggccatgaacgccaagatcacccgttcccgcctctcgcacgccgtcgcccgcctggagaagaacggctgggtccgccgcgaggactgtccctccgacaagcggggccagttcgcggtcctcacggacgagggcgccgacgtgctgcggcgcaccgcccccggccacgtggccgccgtacggcaggccctgttcgagcggctcagccccgaacagcagaagtccctcggcgagatcatgcagatcgtcgccgagggactgcagccgaacgaagcgggagcggacctgccctggctgcgctgagccgccggccaggtacccgtccggggtggtacgtcagtgggcgatgacgggcaccgccagctcgtcctgggcgccctcaccggcggcaccggaaccggtcaccatggtggtaccggtgcccggccgccccgcgttgacgaaggtcagcgcgatcacggcggccagcaccaggatgccgacggcgaaccagatggcgctggtgtacccgtgcaccagaccctgcagctggaccagctgctgcccgggccggtcggtcccggcggccgccatgtggtccttgatgtacgacgcggtcgcggaggaggcgatcgtgttcagcagggccgtaccgatggcgccgcccacctgctgcgaggtgttgaccatcgcggaggcgacaccggcgtcacgcgactgcacaccctgggtcgccagggacatggccggcatgaacgccgtacccatgccgaggccgagcagcagcatcccgggcagcagcagggccgggtaggaggtgtcggtcttcagctgagtcagcagcagcatgccgagggccgcgaccaggaagccgggacccatcagcagccgggccgggacccgggtcatcagccgggtgccgatctgggtggagcccgtgatcatgcccgcgatcatcgggaggaaggcgaagccggtcttgaccggcgagtagcccttcacgatctgcaggtagtaggtcaggaagaggaacaggccgaacatgccgatgatcgccaggcccagcgagaggtagacaccaccgcggttgcgctcggtgaccacgcgcagcggcagcagcggagcccgcagccgcgactccacgagcacgaaggcgacgagcagcacggccgagcccacgaacatggagatggtcagcgcgtcgctccagcccgcggactcggcgcgggtgaacccgtagaccagcgccaccagaccgagggtcgacaggatcacgccggggatgtcgagcggcgagcggttgcggccgccggccggctcacggatgacgaagtaggcgccggccgcggcgacgacggcgaacgggatgttcacgaagaacgtccagcgccagtccaggtactcggtcaggaacccgccgaggatcaggccgacggcaccgccgccgccggcgatcgcgccgtagatgccgaacgccttggcgcgctccttggcgtcggtgaacatcaccgcgagcagggagagcgcggccggcgcgagcagggcgccgaacgcaccctgcagcgcacgggacccgaacagcagggcgccgctcgtggccgcgccgccgagcgcggacgccgcggcgaaaccggtcagaccgaccacgaaggcgcgcttgcggccccacaggtcggcgatccggccgccgaagaggaggagaccgccgaaggcgagggcgtaggccgtgacgacccactggcggttgccgtcggagatacccaggtccttctgggccgagggcagggcgatgttcacgatcgtggcgtcgaggacgaccatcagctgggcgagcgctatgaagacgagcgccttccagcggctggcgtcaccggacttctccaggacgccgggagcctttgcggctgtttcggacatgggggtacccacttcaggacttcgtgacggataacgtgacggaaaacgtgacggtgacgaaaaacggaaaacgtgacgaaaaagggtgtcgaaagctgcaccgacggccttcgggcatcgcgctcggccgccgcgccgggagcgggcgtcagagcgttcgaaggccttcggaggaaggaggagcgggaagaaggagggaggaaatgagggagggagggcgggcgccgatcccggcccccgggctggtccgtgccggtcggtcaggcctggcggagagcctccatggtcagggccgtaccgggcaggtcggaacgggccggggcccgcaacccgtccaggaacagctgcagatgacggtggacgaagcggtcgtggctgagacagccggtgccggccggcgggcggctgagctgggccgcggcgaccatcaggtcacccacgcccacgtcggcccgcaactgtccggccaccttggcgcggtccatgacctcttcgacgaggtgttcgacgcggtggcgcgaggcctccaggtcggggtggttctggtcgaaggtgctggagaccatcgggcagagcgcgctgatccgctcgtcggcggcggcgtgcacgaagcgcgacagcgcctcgaaggcgtcgccggtctccgcgagcgcctgctcggccgcctccgccgtacggtccatcacggagcagacgacctcgcggacgagggcgtcgcggtccgggaagttgcggtacagcgtggcgttgccgacgccggcccggcgggcgacctcgtccagcggcacctcggcgccgtgctcgacgaacatctcgcgggccgcggtgacgatccgctcccgattgcgcagggcgtcggcgcgcggcctggtcgccttgcgcgctgcggggttcgcgatcgtcgcggcagacacggctcgctcctctggtcgtcttgctcttcagacctcaggtcacgacctcaggtcacgaccctcaggtcacgaccctccggtgaagacctcaggtcatcagggtcttctggccgcctgatcgggcgatcacgcggtcggtgaggcgatccggggagctgctccccgtttcgctcggacacagggctaaacggggaaggggtccccggatatttcccgccgccgagaagattctccgtgacctgggtcacatccatctggccctgtcctttcccacgacagggccgcgcgtcgcacgaccggcccgctccagcgcgcgcccgccgcacccccgacacagggtgatcgaaagggtgcagccggagacgagaccggtgaccgcctggcgcgaaccggtgcggaccggtgccgcgcggcgcgagaccggcggctgcctggagcgaaaggtccacgcatgcagccgcagccgccccgccgccggacagaccggacgcaccggacccgcaggacggatcccggtggggctgcgttcggtggggcgaagggatcaggccccgcagccccctccccggacgccgcaccggacggcag

SEQ ID NO: 401 - DNA, 5945 bp, Unknown
  Kingdom: Bacteria, Phylum: Actinobacteria, Class: Actinobacteria, Order: Streptomycetales, Family: Streptomycetaceae, Genus: Streptomyces
  misc_feature (5241)..(5324): n is a, c, g, or t
cggcccggccgggccctgaacccgcccggagcggacccccgagctccaaacccacgtccaggcggcgccccgcccggtgagccgggccagtccggcggaccgagccgacgaaccggacttcctggccggaccagcggaccggatcgcgtcggcgttccagcccgttcatccatccccgggccgagcccgccgctgcctgacccgtcggctgctacgcgtcgatgcgcgagcggtcgagcgtggccgccgagctggcgatgaactccttgcggggtgccacgtcgttgcccatcaggaggtcgaacaccccttccgccgactccagatcggagaggttgatccggcgcagggtgcggtggcgcgggtccatggtggtctcggccagctggtcggcgtccatctcgccgaggcccttgtaccgctggatcgagtccttgtaccggatgttcttgctctggaactccagcagcttgtcgcgcagttcacggtccgagtacgtgtagacgtacttgtcctggcccttcttgggctggatcagctcgatgcggtgcagcggcggcaccgcggcgaacacccggccggcctcgaccatgggccgcatgtagcggtggaacagggtcaggagcagggtgcggatgtgcgagccgtccacgtccgcgtcggtcatcatgatgatcttgccgtagcgggccgcgtccaggtcgaaggtccggcccgagcctgcccctatcacctggatgatcgcgccgcactcggcgttcttcagcatgtccgtgacggacgacttctggacgttgaggatcttgccgcggatcggcagcagcgcctggaactctgagttccgggcgagcttggcggtgccgagcgcggagtccccctcgacgatgaacagttcgctgcggtcgacgtcgtcactgcggcagtcggcgagcttggcaggcagggaggacgactccagggccgtcttgcggcgctgggcgtccttgtgctggcgggcagcgatgcgggtccgggcggcggcgacggccttctccatgaccacacgggcctgttgggctgcgtcccgcttggtggaggtgaggaacgccttcagttccttcgtgatcacgttgttgacgatgcggcgggccgccgaggtgccgaggacctccttggtctgcccctcgaactgcggctcggcgagccggaccgtgacgaccgcggtcaggccctccagggcgtcgtccttgacgatgtcgtcctcagcgacgcgcagcatcttcttcgcccgcagcacctcgttcatcgtcttggcgacggcctgctcgaaaccggcgacgtgagtaccgcccttgggcgtggcgatgatgttgacgaacgaacggagggtggtgtcgtagccggttccccagcgcatggcgacgtccacgccgagatcgcgggtgacctccgtgggcgtcatctggccgtgctcgtcgaggacgggcaccgtctccttgaaggacccctgtccgctgaagcggagcacgtcgcacaccggcctgtcgctcgccaggtactcgcagaactcgctgatgccgccgtcgaagcggaaggactcctcgcccttgctgccgccgtcaccgaggccgtactcgtcgcggacgacgatggtcagaccgggcaccaggaaggccgtctgccgggcgcgctggtgcaggttctccagggagagcttcgcgtccttgaggaagatctgacggtcggcccagtagcgcacgcgcgtgccggtccgcgacttggggatcttcttggccttgcgcaggccgctgccggcctcgaacttggcctcggtgccgctgcccgtgaacgccccgggcacgccgcgccggaagctgatggcgtgcgtgtggcctccgcggtcgacctcgacgtccaggcgggcggagagcgcgttgacgaccgaggcgccgacgccgtgcagaccgccggaagccgcgtaggagccgccgccgaacttgccgccggcgtgcagcttggtcatgacgacctcgacgccggacaggccggtcctgggctcgacgtcgaccgggatgccgcggccgttgtcgcggacctccaccgagccgtcgtcgtgcaggacgacctcgatgtggtcgcagacgcccgcgagggcctcgtccacggagttgtcgatgatctcccacaggcagtgcatcagaccgcggctgtcggtcgatccgatgtacatgccggggcgcttgcgcacggcctcgagcccctcgaggacgagcaggtgccgcgcggtgtagttggagccgtcacggtctgctcctgccagcagcgctgtggacggcacggacgtatcggcggtcacgcggttcgctcctcgctgaatttcaggtgaggccctcgtgggtaagggcgcggcttcggttgccgctcagagggtaccgaggcctggtagagcccttgtaacgcaaccctcggcagcgacccagactagtcgacgatcgtatgtacgttcgatccctcgatggagtgaagcacatatcacgttcccttcgaggcatgaaccatttaggctccgggcacgtcctcatgaacaaccggcaagccggccggggaggattgaccatgaccgacagcgcgaacccgtaagacacacagacgtaatacggcacattcgccgccaaaccggcaacggacagccgcctcgggaagttttttcgaggaaaagccacgagcgggaacgtttggggctggttggatgttgaccctggtacgacagctcgtcgagctagagaagaggcgacgtgactactgttctgacccccgcgagcccgctgacggccgctgatcgctgcgaccgctgcggcgcccaggcttacctgcgcgtcgtcctgctgagcggcggagaactgctcttctgcgcccaccacggtcgcaagttcgagccggaactcaagaagatcgccgctgagatacaggacgagacggagcgcctcacctccgtgccctccaacgcgtccgaagaagagcgctgaccatctcgcacgacgagccagctccggcacaggccggcgaacgggcggccgctcctgacccacaggagcggccgcccgtcattgtgcccgtcgagccaggtcagccctggccggccgctccaggcagagccttggacccgcgggcttggcgtagcgcccgcaccacggcggagacacgcgtgtagacaccggggttccccgctcgcccgcagccgtttccccaggacacgagcccgatgaggcgccccttggccaccagcggaccgccgctgtccccctggcaggcgtcccggccgcccgtgctctcgcccgcgcagagcatcgtgtccggcctgtaggtaccgtcgacactgcccggatacgcccgctcgcactgggcgtcgggcaggacgtgcacccgtgcggcatgcaggctctgcgggtaggcggagcctcccgtcgtgtccccccagccgtagaccacggcgcgggtccccggcaggtacgcagagtcgcccgcgcccgccatcgggatgaccgcgcgctggggcagcggctcggccagggtgagcacggcgaagtcacccgagttcgtcgccgcgtcataacgcggattgacccaggcgtcccgtacccggatctccttgccctgaccggagagcaggtccgtgcgcccctcgatgaccttcagatcccgtgtcggtggcgcgccgaccacctcgtcggccagacagtgggcggcggtcagcacggtggtgcgggcgacggccacagctccgcagaactgcccggcacgggtacccccgaaccggtcacggctggccagggccacggtccacggactctgcgacacgtcgacggggaagcccccgacgaccacgctgtcggcgaccgccggggcagcgttcaccagcggtatcgcggcccccacggccgcgaggaccaggggcccggccagtgcccgggcaatacggcatcgcatgcgcgctcctcactctggggtgatcatggaacacccagagtcgggcagggtggggcgcagcgcagcacgaagacccggcccccacacggggaaccgggtcttcggcgtcgtacgaccgtgcctagtcgaggtagtcgcgcagcacctgcgaacgggacgggtgacgcagcttcgacatggtcttggactcgatctgccggatccgctcacgcgtgacgccgtagaccttgccgatctcgtcgagggtcttgggctggccgtcggtgagaccgaaacgcatggagacgacgcccgcctcgcgctccgacagggtgtcgagcaccgagtgcagctgctcctgcaggagcgtgaagctgaccgcgtcggccgggacgaccgcctcggagtcctcgatgaggtcaccgaactcgctgtcgccgtcctcgccgagcggggtgtgcagcgagatgggctcacggccgtacttctggacctcgatgaccttctccggggtcatgtcgagttccttggccagctcctccggggtgggctcacggcccaggtcctggagcatctggcgctgcacacgcgcgagcttgttgatgacctcgaccatgtgcaccgggatacggatggtgcgggcctggtcggccatcgcgcgggtgatcgcctggcggatccaccaggtggcgtacgtggagaacttgtagcccttggtgtagtcgaacttctcgaccgcgcggatcagaccgaggttgccctcctggatgaggtccaggaagagcatgccgcggccggtgtagcgcttggccagggagaccaccagacggaggttggcctccaggaggtggttcttggcccggcggccgtcctcggcgatgatctccagctcgcgcttgagcttcggcgccagcttgtcggcgttggccagcttgtcctcggcgaacaggcctgcctcgatgcgcttggccagctcgacctcctgctcggcgttgagcaggggaaccttgccgatctgcttgaggtagtccttgaccgggtcggcggtggcgccggccgcggcgacctgctgggcgggggcgtcgtcctcgtcctcgtcggagaggacgaaaccggcactctccgtgccctccggctcctcggcgcccttggggtcctcgagcacctcgtcctcgaggagctcgccgtcgtccttcttggcaccggtcttcttcgccgccgtcttcttcccggcggcagcggtcttcttggccgccgtcttcttcgcggcggcggtcgtcttcttggcggcggccnnnnnnnnnnnnnnnnnnnnnnnnnnnnnnnnnnnnnnnnnnnnnnnnnnnnnnnnnnnnnnnnnnnnnnnnnnnnnnnnnnnncgacgctctttcgggtgcgcttgttgggctccgcggcactgaccatcagcgtcacaccctcttcctcgaggatctggttgaggctgcgcagtacgttcttccactgagtggccgggatctggtcagcttcgaaggcccgacgcacatcgtcgccggcgatctgcccctcagcctttccccgctcaatgagcgccatgacagagacggactcggcgatctccggcgggagcgtacgggatgtgctggccgacacgaacaacctctcggaacgttggaaaacggcttccggccccgtccacgagtggacaggagccgaccaccggcctggggatgggccgacggcgcgggcgggggccgggaggatgcacagcgccatgaacggcgtccgtattccctccgcggctgtcacctcttaggtcatcgcgttgtttccacgagcgttacgcccaatccgcgtggcccgagtcacaccccgtaagcgctcaaaaacggtcagaagtggacagatgagatcggccgtgtctcgtctggcctcgcagaagcttgcgcccgaccgtcacgcacggccccgcctggcgcgctggatccagcaggatcggccagggagccgctcaccggccg

SEQ ID NO: 402 - DNA, 1589 bp, Unknown
  Kingdom: Bacteria, Phylum: Actinobacteria, Class: Actinobacteria, Order: Streptomycetales, Family: Streptomycetaceae, Genus: Streptomyces
gtccgggctgctggtcctggggctgcctgtcctcaggcggcccgaacccgccctcgtgcggcggctgctggggcggcgggggcggcggctgggtcatgagcggatgcacctctgggcgacgagaagggggaccgggaacggaaggggacggtggaggagatgaggccggcaggagggggacggcgccgcggcgccgaagccgtcctgccggcggccgggccgcctcacttgccgaaggcgagcatcagcttctccttcgtcttgttgttgccggtcagcctggtcgtggagatgtagaaccgtccgtcgacccagtcgacgtcccgggagaagaagccgttctcgatctccgcggtgccctgcgggttctgcagcagcttggccggggtgtggttcgtgcccccggccgcgatggacacgacctgcccgccctcgtcgtacgacggctcgacgtacgcgatgagctgcccgttctccaccttgagcggcatcatcgaggtgtccgagggggacttgacccgccacttctccttgccggtggtgaggttgacggcgacgatctcgttgggcccggtggtctccttggtgggcaggtagagggtgccggcgtcggccgccacgccctggcagccctggaggtcacggttgaggatggcccagccgcactccggggcgaaggtgcccttgacgtcggcctgcgaacggacggatccgtcgctgttgagcgtcgagaggttccagtgcttcttgtcttcgtcggtggagtacagcaccagcgggtcgagggagtaggcccgctggaccgaccagcccttggggatcttccgggtccacctggccttgccggtggcggggtcgagttcctgcacctcgtcgtgggcgttggcgccgccggccccgcaggaggcgaccgagatcagccgtgagccgcccgcgaacgcggtcgggaagcaggcctggccgtacttcgtcttctcgtacatcttggcgccggtgtcgacgttgtacgcgacacccgactgcgagcggcccaccatcagcgtcttgccggtgacggacagttcgatggtgagcgcgctgtcgaagagcgcgccgtcggcgaccgtcgcggtccagcccttcttgccggtgtccaggtcgacctgctggagctggttgcacttggcgcggtcgctggtgccgctcatgtacgccacgacgaccttgtcgtcggccgtcttctgcccggtcaccgcgcagatcttctgcgggaaggtgatcggcgcccaggtggggttgccgtcgccgacgttgtacgcgaagacctgcttgtacgcggccttcaccgcggccttgccggtgatccacatgccgggggcgtcggcgccgtcgccgggggcgtccggggcctccttgtaccagagcacccgggcctcgcccgccttgcggcccgcgttgaggtcgccggagtccttggcgccgtcgccgctgccgtcgccggggttgaccggggcgtcggacgccgggccggccgagccggacgcgcccgacgccttgccgtcaccgctcttcccggcgaccggtttcttgtcgccgggaagagcggtgac

SEQ ID NO: 403 - DNA, 1154 bp, Unknown
  Kingdom: Bacteria, Phylum: Actinobacteria, Class: Actinobacteria, Order: Streptomycetales, Family: Streptomycetaceae, Genus: Streptomyces
acgggcttcctgaagaaggggacgcggtcggcgggggtgcagcggcagtactccggaaccgcggggcggacggaaaactgccaggtcggcgtcttcctcgcctatgccaccgaccgtgggcggacgctgatcgaccggcgtctgtatctgcccacttcctggaccgacgaccgggaaaggtgtcgccgggccggcatcactgatgaggtcgccttcgagaccaaggtggccatggccaaggcgatggtccgccgcgccatcgcggacaagatcccgtttcggtgggtgaccgcggatgccgcctacggcttctccaagggctggcggtccgagctggagcgggcggacgtcttccacgtcatggccaccacccggcacgacaccgtggtcacccgctgggcgatcgaccatcccgtccacgacctgttcaacggcctggcacggcagaaatggaagcgtcgttcctgcggcaccggggcccacggcctgcgcatctacgactgggcacgcgtcgaggtgcggccctggcaccggcccgatcgccgccactgggtgatcgcccgccgcagcgtcgcacgcccgcaggagatctcctactacatcgcctactgccccgccggaaccacactggatgacctgatccgcatcgcgggcagccgatgggccatcgaggagtgcttccagagcgcgaagcaggaatgcggactggacgactaccaggtccgtcgctatcccggctggcaccgccacatgaccctcgccatggccgcccacgcctgcctgaccgtcctgcgagcccgcgagctggatgccgggaaagcagaaacggatcctcccagctcatccacctcagcctcgccgagatacgacggctgatcacccgactcaccaaccgccgacccacacccgtcgagcacatcctgcactggtcgacctggcgccgacgacgacaacaccaggcccgcaccagccactacaaacgacgcggacacagcccctgacctggccacccgtcacggcaagcaccgttgcagtactaaggtccgtcttcctacatggtctgttagcagttgtgctggacgtggggagtggacggtggggatggattgttccggatggcttgtgggaggtcgctgctgccgccggcgcgggtg

SEQ ID NO: 404 - DNA, 12955 bp, Unknown
  Kingdom: Bacteria, Phylum: Actinobacteria, Class: Actinobacteria, Order: Streptomycetales, Family: Streptomycetaceae, Genus: Streptomyces
ggcgtacacactcggcggcagtggctcctcgtagagatgcctttcggtcagaccggagtccgcaccgagcgggaacggcgggcgtccggtgagcagttcgtagaagacacagccgaagcagtacacgtccgtccgcgcggtgggctcgcgctccagaagctgttcgggcgccaggtagccgcgggtgcccagcgtggagccgtgcgccgtgtaccgggtggcgtccgcccgcagcggcttggcgataccgaagtcgatgaggacgaccgccccctcgacgtcgatcatgatgttgggtggcttgagatcccggtgcacgacgggcaacgtgtgcgcgcaggccagtgctcccgccacctgtacggcgacggcgatcgccgtcgcggacggcagcggcgtgtgctcgtcgaggaaggtccgcagactcaccccggtcacgaggcgcatggcgatgtactgcacacctcggtgcgatccactgccgtacaactccgggatgccagggtggtcgagcgcgcccagaagagtggcctcgcgccggaaccgggcgttccttacggcgagttcggccgccctctcctccgggcccagggcgtacagggcctcggagtcgtggcgcaggaacttcactgcgacctcgcgcccggcggacacctcgtgattctcgggagcctcgtggccggagaagacctcgcgagcgcgccagacttgggccatcccgcccttgccgagcgactccgtcaactcgtaacgcccgtcgatcagatctcccgtgccgggcctgtacatctccgcgtacgaatccgcgtccacgccgcgcagctccttcgcctcccgcaccattcagcacatcagagtagcgtgaaggaacgctcttgcgagaagtgcatggacttagttcacagatgcatgtcatgctggagtcgtgtccgggacttcgtgtgagggtgtgcgaagcccgacggtcccggacgtcctcctgcccatgccgccctccacgggggtcaccatgcagaatccaccgggcgtcgccggagacgactggctgatcagggcaagtccccggatggcccggcccgacgccgcggcctgccccacgcaccgccgcatcgcgatgcgtccccagctcgtggccgagccggccgtgccgttcctgaccacgccgtacgaggagttcgggttcggcccgctcttcacggcgctcgaccttgtggagcaccacggctggtccgtcgagcgggtgcgtgcggaactgcgcggcagccgcgggccgttccgtggccgaggcacgccggttcaccccgttcacctcgcgtggaccgtccacgccctggagcggtacgtcgcggcccgcacccgggagcaggccgccgccgaggagtcgggactgccgccgaccgcggcggtcaagcacccatggacgtggcgcacacgccgcacggacgcacccgacccgcgcggtgcccggcagtacgagcacaccctgtggggtcgcatgtactcctctgccgacgggacggtgcgcgatctgtggctgccctcgctgggccgggccaagaccagtcgccatgaagccgaactcggggcggtggcacaggtgatggcgtacggggcgcccacgcgccggcgcagggcgcgtgacgaacccccggccgaggccagtgacaccatccgcccgcctgacctggtgcgcgtcttcgacgtcggatgcgccgacggctcggtggagccgttgctcggcgaggcaccacggttcggcgaaagtcccgccgaggcgaggaagcggttcgagggcgacacggtgccggcgttcctcgccgccacgaccgcgaccggcacccggcccggcgagagctgcgtcgactgcaaggccgtcgccggctgtacggacctgaggcgcaccccgggtctgtggggagggcggcccccctccttcgcacgcaagcgccgctccgtctccgtctgggacctccggctgcacgcggagtgccccgcccagtaccacctggtacggcgtttgcatctcaacgatctgtccaccgagaacgagggagcgcggcgcgggagggccgtcgactcctggctggacgcgcgacacggcgaacggccggtgcgcggctgccgggaccgcgcggcccccgacccggccgcgctgcggtccgggaccggcctggacgacgcgtccgcgcgtgaggccgccgggatgctggccgagcaccggctgctgtgcccgctcaacggactcgacgccggcgagcgcgtactcgtacagcaccgggtgacggcctacgtgccggagctcgatgtcgtcgtcctcgccgtacccgatctggtgtacacccatcgcggccggtggatctggcgcgagacgaagacgtccgcccgcccgctgcgggaacgggagccgctgctccgcacgtacccgcaactggccctcggcgtcctgctgttccacgcgggtgcactgggcgacgaccctcgccgctcctgggtcgaactggagcacctgcgcgagggccacggggagagcaggctcgaacgcatcgaccccggccgcgccgagatcgtcgaagaagcccgggaggtcatcgccggcctcgcccagccgctcctggacgacaccacgtacgaaccgaggaccgggcgccactgccatggctgccaggcgcggacctggtgcccgcccggcaccgcctacgtcaccgaccatcccctgccacacgacgccgacgcgtcctggcgtgcagacggcccgaagccgggcgtccgcgtcccaccccagtcgcgaggagatgttccggtccatgactgaccaacagctcgtaccggactggctgtccaacccggacgtcgtcctgctgcgggacgtcgccaccgccgtcctccatctggcggccgtcggcgacctcgacgccttcgccctgccctacccgcccagcgcgcaacgcgccctggacgccctggtccttcagtgcctgcgcaacggggccacgcccccggccggtgtccccgagatgatgcgctgggcccgcatccggccgctcagcagctggcccctcgaccagttgcctcccgacctgttcgacaccgccgaccggctgatcgacgcgggctcgggggaacctgcgcagctctgccacgaactcgctgtggacggatacggcgacagcactgggcgtcagtacgaccgcctggtcatccacgaggctctgcgggcctgccgcgccatgtcatcacccgagtcgtacacggccttccgccgcctcctggtcacccggcccgttctcaccgaggaggaatgggccgaggtcagctgcgacctcttcctcgacccggtccggttcctcgtcgaggagatctacgcccccgtccccgccggattccggcgggacggctcctatatgtgctgccaccgctgcctgaccctgctgcacccggtgtccgacaccgagtggtggtgcgagcgggaccagtgccggcatcggggccccgcgccacacggccgggaactcgtggcggcgcaggtgggagagctgcgccaactgcgcaaacctctgaggctgttcgtcaccgggcccggacaggcggagacctccttggagggtgagctgcgtgcgctggggctcaccgtcgagatgtggcccaacttcgactcgtacgacgtacgcgtcacgttccccgacggccatgtatgggccgtggacgtcaaggactgggcgcatcccgccttcctcggccgcagcgcgaccgcggtgcgcgccgaacccccctacgacgaagcctgctgggtcgttccggaattcagggtccgcgcacgccgcgactacctcgacagctattccagggagcggggcgctcaggcgggtggactgaggctgctgacggacagacagctggtgcgggccgcacggctgcgtctgtcaggagaccgtgggccgggcgcctgcatcggcccgctgccccccggaacggaggaatcgtcgtacccgggccgacgagccaccgggaaccgccccgcggacaacacaacgccggccgaggacgccgggcaggacggagtggacgatgcgtgaccgcagtagctggtaccagccggtcgtggccgcgttgggaccctggcccgaagaacacgccaggacccggcccgctctgctgtgccaggtcgagctcgccctgcggctgatggagaccgtggcgcccggccacgccgccgacggagcgtggacgctcctgggcggctatggcctcgccttcgcacgcgccgcgaagctgcccgtaggtgaggtggaacaggtcgcgctcgccgcggcccggcacctgctctggcctatgcgccgcggccggatgtggcgccagtccctggacgcgtacctacaactgccggagaggctgcgcgcgtaccgtgtgccggcggagggggcaccggcttaccggcttcccctcgtggtcgccgccgatcgcttcgccgcgtacgacgaagccctcgcgcacctgccgggcttcaccgtcaaaccgctggagcaggcggcggcgggcgagcaccgcttcatggaccgccgccagcggcgcacctccgtcaccatcccggccgacctcgtacgagaccctctcccggcccaccccctcaccaccgaacgcccggccaccgcaggccctctggacgtgccgctgagcgaactcgccgatgtggcacggtggatggacgaggaggagcggcgtcgcggtcgaaaggcgggcaactgggcccagcgtctcaacgacctcgacctcgacacccgcaccccggacggcaccgccttcgcgtcggcctccgcgctgccgctcgaccggctcacccacctcgtcggcatggtcggcgcaggcaagtcgaccctgatgaccctgctcgccgtatgggggcaccacaacggcctgcgcaccaccctagtcgtcggtgacgtggccgaacagctcaccctgaccgaactcttccgcgggctcggcctgaacgccgcactgatccagggcggcaccacaaggcctcagcacacccagcggctgcaccgcaggctcgccgcacgcggagcgcactcgctcctcgcccacaccgatgcggccttcaggcacctcagcaccgcctgcccgctggacgcgctgcgcgcgctcgacacatcggagccgctgcgctacaacgacgcaccgtgcggcgctctgcaccccgtgcggccggccgcgcgctccggcgacacagccgacgcttcggcggccgaagacgccgtacgcgcactcgaacgcgcccgtggcgccgccgggaaccggccccccgaggacgacagcgacgaagaggaggagtggggcactccgcacgcctgcccgttgtggagtgcctgcccccgccactccgccgcgcgtgacctcgtggacgcgctgatctgggtggcgaaccccgccagcctcgtccagacgcccgtacccggccagctcaatgccgaacgcctgcgctacctggaactggcctgtctgcgcagcgacatcgtggtcgtcgacgaggccgaccgcgtacagatgcagttggaccagatgttcgcgccgtcggccaccctcgtcaccaccggagtctccgaatcctggctcgaccagttgcagacccatgagatcgctgaactcgcgcgacagggacggctgcagctctccgaccaggacgtggaacggtggtccgccgccctcgacatcgtcggctccgcggcggaccggctgtacgccatgctcatcgacgacgaagggctgcggaactgggcacagatcgactacttcagcgcatggaccctccaggagaagctgctgaacgcctggtatccgctgacgcccggccggtccgtccggcgtcccgaccccacggagacggcggacgtcgaggacgagagcgcactgtacgaggacgaggaggacggcgaggacgacggcggagatgagccgggacagcagaggctccctgagccggaggtgccttgggcgcaccgccgcagcgagatcaccgggtacttcgacaccttccgggacgatccgctcggcgggcggggcccctatctgacgcccgccgacgaactcaccgccctcgctcacgacgtcctgcacaccctcgacgaaaagcggacacgcagccgggtccgcgcgctcctcgactccttcctcgtcggagcgccgggtccgcagcagcgcccgccgtccgccgcccgacagggcaaggaggtgccacgccaggaggtaccccttacggaggagtggcgcgagctgaatgcgcggagactggagttcaccctcgtgctcgccgctctgcaccagcgcctggaccgggtcacattcctgtggccccaggtggaggcggcgctgcggctcgacacggcgagccacgaactgacccgccgaccacccctcgactacgctcccctgctgcccgaggcacccatgggcaacgtcctgggcttccagtacctcatcgacgaacgggcagccgcccgcgacaaggacggtcgtcgcaccggaaccctgcgcttcttccgctgtgcgggcgtgggccgggaactactcctcggccttccccagctcggcgccgatcccagccggagggagcccggcgcgcacgttctgctgatgtcgggcaccagctgggccggcacgtccacccgcgcccacgtcctcgctcccgtccgcgcggtcctcaaaccgcagagcaaggcgttgcggtccatccgggacaccgtgttccgcaccgagttcgtctacgacgcggcggggcagccgatccgcctctccggacaggaccccgacaaacgcgaggacgtcctgcgcctgatgatcgaccggcttgcccgtccccgccgggacggaaccacctccccgctgcaaggcgaactggcccagatccccgacgagcgccgcaggcgcgccctgcttctggtgggcagctacgcggaggccggggtggccgccgcagccctggacgagatcccgcgctggcgcggccgggtccgcgtcctggccgccgacgacgcggaactggaggccgcggtcgacggcgcggcatcggcgggaagccgggcacggagcacaggggcggtgcgacgcggagacctcgcctccttcgccgaggacccggacgccgaactgctcgtcgcccctctgctcgccgtcgagcgagggcacaacattctcaccatcccccagcgccccggcgaggagagggtggcggcgttcggaacggtgttcttcctggtccgtccccaccctcgtccagatgacctgtccctggcggtgttcgccatcaacgactgggcgagccggttcgtacgcggtcacctgacgagccccgagggaaccttcggtgagttggtgacagaggcagacggtctcgacgctgcgggcggcaccttccggaccgtcgcccgccgcgtctggcggcacgtgctgtcccgcccctacgtctactcctcgctctccgacgacgagaaggagtccttcgtctgggaccagctcgtcaccatctggcaggtcatcggccgtctcgtccgcggtggtgtgccggcccgcgtggtgttcgtcgacgccgccttcgcaccccggctggcggcggcgcaggcacccgtcgccgcgaggagccgacggtccggcaccagcgatccgggactgctggtacgccttcgggacgtcctcgccccgtacttcaccggcaccgaggacaccatcggcggcaccgatcctgacccggccgacatcgaactcgtcaagctgctctaccggccgttgtacgaggcgctgtgcgacctgggtgctccgcccaggccgcgcgacaccgactgacacacgacgacccgccacttccagagctgccgaagacccggcgcgcgaccgaccacgtacgacaccgcagggagaacggacatgtaccagcacatccgccgatccgcgtaccaccttgccgagggctgcgggccctggaccgaggactaccgcgcactcacctttcccgagcactggcacgcggacctcctggcactgcacaactacgggcgggacgaggagaagcggcgtatgaccctgcccacgcgtcggctcgacggcgtactgcagaccctcgcccccgacgtgatcgtccgcccccgccctcgtgtccccgtcgagtcggggccgggacagggctccccgaacagcgaggacttctggatgtacgtccccgccgcggcgcccgatcccctcccggaccgctccatccggcagctcctggacgcctggctgcgcacactcggcccgaagggcgcggggcaggatcccggattccgctcgctgctgatcgcgagcagcgccgagctcaagaggaacctgcccgagtggcagccggtcaccggcgtcgaactgctcaccgctcccgtcaccgtcggtggtaccgcagcccctgatccccgccagttccagctcgccaccgacgcgttggcccggcgcatcctggctctcgacccctaccccttcgaaggcggcgagctgcgctttcgcgcggtgcctcgcggacctcgcgaccagggcgccgaactcatgtcgcagcccctgccccgaacggtcaagcgcaaggagtggtggttctccgtcgtactcaacatctccctgcacaccacgccgttcgatccacgaccgcgtctccatctgcactggggcgtacgccgatgggcgacgcatccgcgggccgccaccaaacggctcaacctgccctaccaggaggccaccactgtctacttgcggcccaccatcccctggctgcccggagcgccggccaccgagcgctacgcactcgcccgactgcgccgggaccgggcagccgacgccttcgcctggtcggagaacgacacggccggcatcctgcgcgggctcagcctcgccggaaacttccccgaccccgaacaactcctcgccgaaccgggctcctggatcggcgagggccgtggcgtccgcgcggccgtggtgcacagcaccaggatggggaagcacgagatcggcaccggcttcatgcccaaccagcgtgcccagttgaccgaatgggccgagcaggcccttacggagacggtggtgcgggtgcccgatctgacgcggggacgcggcaagggcatcggcgcaccggacaaccggcggcccaaaccgaggaccgacgaggccaagaagaccgagctgctgcgcgaaacacaggcacgtagggcgaacctggcgacgcaggtacggatcgccgggcggcacccgcatcgcagtggcccgccgctggtggaggttcggttgctgtggcagtcaccggaggtgcggaaggaagcagtggcccagttcgcgcacgccctgggcctggacggggacggtggtgcctccgccaccgcgctcacggaccgggacttcgatgaagccaggcccggagcaccggtcgttctcgaatggcggacggaggaactcaccctacgactgcgctgcctgcccctgaccgacgggctcggagaccggctggtgcccgacccggccgtcagcgcgaagggtgcggccatggcgacggccatcggcgagcgccgccgcgccctgcgctcatggctgagcgcggacggcgccgaccccgaccaccctgaactcgccctggtggagatcgcccaccgcagcaccttccgcccgccggcgaccgaccccaagttcgccgtccgcctggggtgtgccgacgcaggggtactgacccagttcgtcgtgaccccgtccaccgaccggcagatcgacaacgcggagagcatcgagcatcgcacccacagctcctggctcgacggactgcgccagctcggcgtccgcgtactgccgcagcacacgctcggcgacgacctgcccgacggacttcagtacgccgcgatctggatggtgaagcgccgcaaggacggcccgacgcggctgcccaagcacctgcccgtggcggtcctggccaccccgctgccggaggcggcgggcctggcagccgtacggggctgggatgacgtcgcgggggagtgggtgccgtatccgcgcttcctcctcggcctggtgaagcaggccgagatcgaccccgagacatgcgcggagcccgacccggaggacagcggtccgcattcccgggccccccgtgtgaccggcaagcagtggcgtaccaatcttgcccagcagcgcaaggagaccgcggcattcctccagcgtgtactgcactcgctgcgaggtcagcccactgtgctgatcacccacgcccagaacagcaggctgcactggccgtggctccaggacggccggattgagcgggacctgatgcaggcgggccacgctcccgcgggccggctcgacgacgaactccgcctggtgcgcgtccgcgggtgcggcggacgggaggccgcgcagtggtggggactggcgaaacccggtaagccgcacggacagccggccggcttctggacccagaccgtcccgccgcaggccgagtccccctcacgtgaccgaatcttctacagcaccacggaacgccccggtacccatgcggtgtcgcccgccctcgaccgtctggccacccgggtcaacgccgcgggcaacctcacctcacaggcgggcaccagcgcctggaacccgaccttggtcgagatcgcggtcctcggctgccacgcggacgacgacccggccgtccccgcactgggcaagccggacgaggccgaggctctggccctcgccgtacaccaactgcgccaggcgccggactatgccgctgcgctgtccctgccgctcccccttcacctggcagggctggcccaggcgtacgtcctcccgatgctcgcggagagtgatgcgagtccaggaggggcgacggcggagtccggcgtggagcgggagcaatggagcaggacggagggcgatctgggcccggacctcttggacgcggccgggttgaccacggaacccgaaagggaagacggcgatgggtgaagcccttccacggcgacgtggtgagctgggacagtgtggttctgcgtgggtacgtttggtgaccttgcggttcctcgtgaccagtggcagcgcccgtcctcctggccccatggcaacgccgcaggcagcgtgacgggtacgcccgaggagttgcccggctttccccgccgctccgaccccttggcgaccggggcggtcgttgcgtccgcggctctactccgcggaccgttcgagcatcggcgcgtaggacgactcctcgtcctcgggaacgccggggaggaatccgtccgggacggtgcgggcggcggtggtgaggaggcgggccaggacttcccggtcggtggccgcagggagcctcagtgcggtgaggaggcggtctcggacgacggggtggtccgggcggtcgtcgaggtagtcggagttgagggccgagggccggaagccggacagggcgtcgtgccagcacggcaggacgatggcgagggtcagggcctcggctagggattcggcgatgagggaggcccggccctcggagtcggtgtagaggacggggcgggggccgcccgggacggtcgggccgcagaggtagtgggtcccgcccgcgttgcagccggcgaccggctccaccgggaggccgttgggcaggatgatcgactcgatcgggtcggtgcgggccaggtcgaactcgccgtcgcaggccaggtaagcagccacctcgggtcgcgcggcgatcctctggagcagcgcgtcgtccgagagggcggccgggttgagggaccgcgcgatcgcaggggcgaggggatgcccggccaggacgtggcggacggcgtcgagggggacggggcgctcgtagtagtcctcgaagtggccctggacggcctcgggggagcggccggtgaggagagggaagaggaagccggagccgtccgggtcctcgttgcctgccgggaagtcgatggccgagccggtacgccaggcggagtcaccggtttcccgccacaggcaggcggtgatccggggagcgtcgatgccctcgtcgtggaacgcgggctcgtccagcagggggcgcagcgcggcgggcacgtcgtcgatgacgcccggccagacctgctcgtcgtccgtcccgtacggactcatctccgattcgtggtcgaacccgcgtatgagcacgcctgccggggtgaagacgacggcgaagtcgtcccccgagccgttgtccatgagggccgcctccttgccggggccccaggcggtgtcgaaggtgtactggcagaaccgcggatcgtcgcagatcgccgcgtccaggacggccagtgcgcgcaggtgggcgcggagctcggcgggctcagggagaagggcggcggcctcgtgcacagtgctcatggggtcatggaagcagccgccactgacaatccggcgcggccgaccgaggcggcgtactggcccacgggccaggaaccggctaggaaggagatccccgggcagggcgaacgacatggccgcgacgtggactccggtgtcgtccgcgcggctgcccgcagagcccgaggctgatcacggctgggctccgccggcggacccgtactcgtgcaggagtcggaagaacaccgtcagcgggtcctcttccccggcatgccgttcgatggcgtctgcccagccgcaggacaacgaccagcctcggcgcgtgcgcaaccactcggcgaacgggccgacgggtgacagggcgaaaggctcgtcgaccccgtgcacggacaaggccgcggcataaccggtcaggatgttctgcaggtcccgcaggctcccctggcggacccacatggaaggacgcaaccggatctgctccaggacgtcctggacgttccggcactcctcgatcggccgcggtcttggtctctgttcggctgccacggacccgaccctaaggcggtacgtcgtcgaagcggaggggggcggagaggagggaggaggg

SEQ ID NO: 405 - DNA, 5260 bp, Unknown
  Kingdom: Bacteria, Phylum: Actinobacteria, Class: Actinobacteria, Order: Streptomycetales, Family: Streptomycetaceae, Genus: Streptomyces
gctcaggctaccccgcgatgcggacaccctgttgtcgggccgtgcgcgcggcccgacggctgctcgggccacgtgcggctgcggccggggtccgcggcctgtcgaccggccgggcagcacagggccccggaaccggcgcaggggttccggggcccggtcagggggcggacggtgagcccgtccgcggcggtctcagacgcgccgcaggactgccaccaccttgccgagaatggtcgcgtcgtcaccggggatcggctcgtacgccgcgttgtgcgggaggagccagacatggccgtcctcccgcttgaagcgcttgacggtggcctcgccgtcgatcatggcggccacgatgtcgccgttctcggcgacctgctggcggcgtacggtcacccagtcgccgtcgcagatcgcggcctcgatcatcgagtcgccgacgaccttgaggacgaacagctcaccgtcgccgaccagctgccgggggagcgggaagacgtcctcgaccgactcctcggcgaggatcgggccgccggcggcgatccgcccgacgagcgggacgtaggacgcggcgggcttgcccacggtgtccgtgggctgcagtgtggcggcctggtctgaaccgcggacctcgtacgcgcgcgggcggtgcgggtcgcgccgcaggaagcccttgcgctccagcgccatcagctggtgggccaccgacgaggtgctggacaggcccacggcctggccgatctcccgcatggacggcgggtagccccgccgctgcacggagtccctgatgacttcgatcacccggcgctgccgatcggtgagtcccgagctgtccgcccggatgcctggaggtcggcccggcagggagcgcttgtgtccctcagggttcgctgcttcgttcatggcatgcaccggctcgagtcggccctgggggcggtcctgggcagtgatggtggcactgtctgcggtggtggtcacgtcggcccctctcgatggtctccctccggcacaacggtagttgctttcgaaaggttgcgccaaacacacgttcgagtgaaaaaccgcgaatggcctggcttgatcatgtgtccgggtgtataggtgacgcggtgtccggcaggcgaaagggcccgttgctgtactcttcaccgccggggtgcggccccttgagacactgccccagtctgccatccggtgccctgccggcagggtgccggtcgctcatctgcgggacagtcccacgcgtcctccgtgcggtgttcacggtatctccgtacgcctgcgggcggagacggcgggcgtcggcgtgtctcccttcgcggcgacggtccgcggcgtcggcccacggcgccggcccacgggccgagaccgcccttccgcgacacgcgcgcctcgcgcggtacgtacggccaatccctacatctagtggttggatagctacagcagcccacaagttgtgttcccccgggtcttcggtcctctcgtcatcgcctatgcttggggctgcttccgcggggcccatgaggccctgcgtagccattgagtctgctgtgaggagggttggagtccatgcactgccccttctgcaggcaccccgacagtcgcgtcgtcgacagccgtacgacggacgacgggacgtcgatccgcaggcgccgccagtgccctgactgctctcgccggttcacgaccgtcgagacgtgctcgctcatggtggtcaagcggtccggagtcaccgagcccttcagccgtaccaaggtcatcaacggcgtgcgcaaggcgtgccaggggcggcctgtcacggaggacgcgctggcccagctcgggcagcgggtcgaggaagcggtacgggccagcgggagcgccgaggtggccgcccacgaagtggggctcgccatactcggtccgctgcaggagctggacctcgtcgccttcctgcggttcgcgtccgtgtaccgggcgttcgactcgctcgaggacttcgaggccgccatcgcggagctcagggaaggaacgcggcgccccgtcgcggagacggaggacggcgacggcgccgccccggggagccaggaagacgatcgcgggtgcggcgggacagctgaggtccccctgcccgcacgcgccgccgactgatcggcgggccggtccggacccgcgggtccggggccggctcagcggcggcgaggaagacggttgcgggtggcagcgacaggggcgcccgcagcaccagacagaacatcgtgtctccggaacatcggggcacttcagggcgttttcgcccgtatcagggaggcggcatgacagagacggcgagcggtccggcacgaggttcccgcgccaagggcggcaaggcggggaacaagggactgcacatcgagcgcatccacaccacccccggagtacacccgtacgacgaggtggcctgggagcgccgtgacgtcgtcatgaccaactggcgcgacggctcggtcaacttcgagcagcgtggcgtcgagttccccgacttctggtcggtgaacgcggtcaacatcgtcaccagcaagtacttccgcggtgccgtcggcaccccgcagcgtgagaccagcctgaagcagctgatcgaccgcatcgtgaagacgtaccggaaggccggtgaggactacaagtacttcgcctcgcccgccgacgccgagatcttcgagcacgagctggcgtacgccctcctgcaccagatcttcagcttcaacagccccgtctggttcaacgtgggcaccccgcagccccagcaggtctccgcctgcttcatcctgtccgtcgacgactccatggagtcgatcctcgactggtacaaggaagagggcatgatcttcaagggcggctccggtgccggtctgaacctctcccgcatccgttcctccaaggaactgctctcctccggcggcaacgcctccggtcccgtctccttcatgcgcggcgccgacgcctccgccggcaccatcaagtccggcggtgccacccgccgcgccgccaagatggtcatcctcgacgtcgaccaccccgacgtggaggacttcatcgagacgaaggtcaaggaggaggagaagatccgcgccctgcgcgacgcgggcttcgacatggacctgggcggcgacgacatcacgtccgtccagtaccagaacgccaacaactcggtccgtgtgaacgacgagttcatgaaggcggtcgaccagggcggaaagttcggtctgcgcgcgcggatgaccggtgaggtcatcgaggaggtcgaggccaagtccctcttccgcaagatggccgaggccgcctgggcctgcgccgacccgggcatccagtacgacgacacgatcaaccactggcacacctgcccggagtccggccggatcaacggctcgaacccctgcagcgagtacatgcacctggacaacacgtcctgcaacctcgcctcgctgaacctgatgaagttcctcaaggacgacggcaagggcaagcagtccttcgagtccgagcgcttcgccaaggtcgtcgagctggtcatcaccgcgatggacatctcgatctgcttcgcggacttcccgacccagaagatcggcgagaacacccgcgccttccgccagctcggcatcggctacgccaacctcggcgccctgctgatggcgaccggccacgcctacgactccgacggcggccgtgcgctggccggtgccatcacctccctgatgaccggcaccgcctacaagcgctccgccgagctggccgcggtcgtcggcccctacgacggctacgcccgcaacgcccagccgcaccagcgcgtcatgaagcagcacgccgacgccaacgccgtcgccgtgcgcatggacgacctggacacgccggtgtgggccgccgccaccgaggcctggcaggacgtgctgcgcctcggcgagaagaacggtttccgtaactcccaggcgtccgtcctcgcgccgaccggcaccatcggcctcgcgatgtcctgcgacaccaccggtgtcgagcccgacctcgccctggtcaagttcaagaagctggtcggcggcggctcgatgcagatcgtcaacggcaccgtcccgcaggccctgcgccgcctgggttaccaggaggagcagatcgaggcgatcgtcgcccacatcgccgagcacggcaacgtgatcgacgcccccggtctcgcgcacgagcactacgaggtgttcgactgcgccatgggcgagcgcgccatctccccgatgggccacgtccgcatgatggccgcgatccagccgtggatctccggcgccatctccaagacggtcaacatgccggagtcggcgaccgtcgaggaggtcgaggagatctacttcgaggcctggaagctgggcgtcaaggcgctcgcgatctaccgcgacaactgcaaggtcggtcagccgctgtcggccaagacgaaggactccgcggagaagaagaccgaggccgtccgggagacgcagcccaaggtcgagaaggtcgtcgagtaccgcccggtccgcaagcgcctcccgaagggccgtcccggcatcaccacttccttcaccgtcggcggtgccgagggttacatgaccgccaactcctacccggacgacggtctcggcgaggtcttcctcaagatgtccaagcagggctcgaccctcgcgggcatgatggacgccttctccatcgcggtctccgtcggcctccagtacggcgtgccgctggagacgtacgtctcgaagttcaccaacatgcgcttcgagccggccggtatgaccgacgatccggacgtgcggatggcccagtcgatcgtcgactacatcttccgccgcctggcgctggacttcctgcccttcgagacgcgttccgcgctcggcatccactccgccgaggagcgtcagcgccacctggagaccggctcctacgagccgatcgacgaggaggtggacgtcgagggtctggcccagtcggcgccccgccagaccgacctgaaggccgtcgccacgccgaaggccgaggccgaggtggccgtgcccgctccgaaggaggcgcacaccagcgccgaactggtcgagatgcagctgggcatccaggccgacgccccgctctgcttctcctgcgggaccaagatgcagcgggccggctcctgctacatctgcgagggctgtggctccacgagcggctgcagctgaactgacggccatgccgtgaggtgagaggtaaggggcgtcggccatggccgacgccccttacctctcatcggctacgactg

SEQ ID NO: 406 - DNA, 1684 bp, Unknown
  Kingdom: Bacteria, Phylum: Actinobacteria, Class: Actinobacteria, Order: Streptomycetales, Family: Streptomycetaceae, Genus: Streptomyces
ccctcggctgacgaaccgagcgccgacggctcggccgacgccccggccgctgacccggccgccggcccctcggccgaaccgcccgcccccggcgttcccgacggcccagatgtccccgacagccccgacaaccccgaaaatcccgacgaccgagaaggaggcccgcagtgaacggcgtgctcgacgtcgccctgcgactcctgatcgtcttcgtggtcttcctcaccttcccgctgatcgtcggacagaccgagcacaaggtgatggcccacatgcagggccgcctcggccccatgtacgcgggtggcttccacggctgggcccagctcgtcgcggacggcgtgaagttcgcgcagaaggaggacgtggtccccgcgggcgcggaccgccgcatcttccagctcgccccggccgtcgccctgctcccgtacctcctggtgctgctcgccatcccgatcggccccggcgagggcgcggtcggccaggtcctggacgcgggcatcttcttcgtcctggccgtgatgggcgtcggggtgctcggctcgatcatggccgggtgggcctccgccaacaagttctccctcctcggcggcctgcgcaccgccgcccagctcctcgcctacgaactgccgatgctgctcgccgccgcctccgtcgcgatggcggccggcacggtctcgctgcccggcatcctcgacgccttccactggtggtggctgccctggcagatcgtcggcgcgatcgtcttcttcgtggccggcctcgccgaactgcaacgtcctccgttcgacatgcccgtcgccgactccgagatcatcttcggcgcgtacaccgagtacacggggctgcggttcgccctgttcctgctcgccgagtacgccgggatcgtggtcctgtgcggcctgaccaccgtcctcttcctgggcggctggcacgggccctggggcgccgacgggctcggctgggtgtggaccctgctgaagaccgccgtcctcgccttcgtcgtcatctggctgcgcgtcacctacccccggctgcgcgaggaccagctccagaaactctcctggaccctcctcgtccccctctccctcgcccagatcgccctcaccggcatcgtcaaggtggtgatctcctagtgtcccgcccgtcgcccgacgaccgcccctcaacgacgccctccgggcggccccgatcgatccctggatccggtctcgccaagggcctggccgtcaccctgcgcacgatgacgaggaagaccgtcaccgagcagtacccggacacccagcccgacctgccgccccgtactcgcggtgtgatcggcctgttcgaggagaactgcacggtctgcatgctctgcgcccgcgagtgcccggactggtgcatctacatcgactcccacaaggagacggtgcccgccgcgacccccggcggccgggaacgcagccgtaacgtcctcgaccgcttcgccatcgacttctccctgtgcatgtactgcggtatctgcatcgaggtctgtcctttcgacgcgctgttctggtccccggagttcgagtacgccgagaccgacatccgcgacctcgtccacgagcgcgacaagctccgcgagtggatgtggaccgtcccggccccgcccgccctcgaccgcggcgcggaggaaccgaaggaggccgccgccgcccgcaag

SEQ ID NO: 407 - DNA, 1650 bp, Unknown
  Kingdom: Bacteria, Phylum: Actinobacteria, Class: Actinobacteria, Order: Streptomycetales, Family: Streptomycetaceae, Genus: Streptomyces
tcaggcggtcaggcggtcaggggaaaacgatcaggaggaaggaaacggcatggacaaagtggtggcccgggccgcgctcgcggtggcggacatcccggacggagcctcgctcgcggtcggcgggttcggcctgtgcggcatcccgtcgacgctgatcggcgcgctggtcgaggcgggcacctccggtctgcgggtcgtgtccaacaactgcggtgtggacgactggggtctgggtctgctgctgcgggccggccggatcgcccggatgacctcctcgtacgtgggcgagaacaaggagttcgcccgccagtacctctgcggtgaactggaggtggagctgaccccgcagggcacgctcgccgagcggctgcgggccggcggctcgggcgtgccggcgttctacaccccggcgggagtgggcacgcaggtcgaggagggcggcctgccctggcggcacacgcccgacggcgccgtcgcggtggcctcaccgcccaaggaggtacgggagttcggtggccgccgctacctcctggaggaggccatcaccgtcgacttctccctcgttcgggccgctgtcgcggaccggcacggcaactgcgtgttccacgcggcggcgcgcaacttcaacccgctgtgtgccatggcgggccgggtcaccgtcgtcgaggccgaacgcgtcgtcgaggcgggcgagttgccgccggacaccgtccatctgccgggcgtgtacgtggaccgggtggtcgccgccgatccggcgccggccaagcgcatcgagcgccgtaccgtccgcccggcccccgccgccaccgcggcggcgacgccccgtaccgcctccgaggagaactgaccatgccgctcgaccgcgaccagctcgccgcccgcgccgcccgggaactgcgcgacggccagtacgtcaacctcggcatcggcctgcccaccctgatccccggtcacctgcccgagggtgtgcacgtggtgctgcactcggagaacggcatcctgggcgtcggcccctacccgtacgacggtgaggagcaccccgatctcgtcaacgccggcaaggagacggtgaccaccatcgcgggcgccgcctacttcgactccgcgttctccttcggcatgatccgggccggccggatcgacgtctccgtgctcggtgccatgcaggtctccgtccacggcgacctggcgaactggatgatccccggcaggatggtcaagggcatgggcggtgcgatggacctggtgcacggcgcgcgccggctgatcgtggtcatggagcacaccgccaaggacggctccccgaagatcgtcgaggaactgacgcttcccgccaccggccgccgtgtggtcgaccggatcatcaccgacctggccgtcctggacgtcaccgccgggggtctgcggctggtcgagaccgctcccggtgtcacggttcagcaggtccgggccgcgaccggcgcaaagttcctgaccgccgcgtcctcgcgctgacggtgacgactcccgggcgcgccgggatggggggttgtgcatggggtcgggcgcagcggtgttgccggcggcgatcgtcgcgggtctgagcaggcgggccgtgacgctcgccttgcggaggtgacctgacggctcacgtgccgtccggtgccg

SEQ ID NO: 408 - DNA, 14249 bp, Unknown
  Kingdom: Bacteria, Phylum: Actinobacteria, Class: Actinobacteria, Order: Streptomycetales, Family: Streptomycetaceae, Genus: Streptomyces
acccgcaccacagccccccggtcccggccgtggtgctgtcgccgggtccggggggctgtggtgcgggtggtgtcaccggaactccaggaagaccgtctcgccctcgccctgaaggcggatgtcgaaacggtaagccccgccgtcctcccgcgccgcgatcagcgtggcgcgtcgctcctcgtccagccgggcgagcagcggatcggcggccagggcggcctcgtcgcccggcaggtagatccgggtgaacaggtggaccagcaggccgcgcgcgaacacgcacacactgacgtacggggcactgtgtccgcgcgcgccgggccgcagggtccgcgcgtaccagtgaccgtccgcgtcggtctggatccgcccgaagccggtgaactccacgccgttgcggccgaggaacccgccggaggccgggtcgcgccgcatggagccgtcgacggccggcatcctcccgtcagggccggggccccacagctccaccagcgcgtcgggcagcggacgcccctcgccgtcgtacacgcagccgtgcacggtgaccgtgtccggatgccccacgggcgcgatgtcctcgccgccgcggaagggcagcgcgtagccgtagaacgggcccacggtgtgcgacggcgtgggcggcacgccccccgcgacgccctccgggccgctcgtgtcgatcttggtcatggcaggtcagcgtccttcttcgatccaggtggcggccgggccgtccagcacgatgtcccagtggtagccgagcgagaactccggtacggacaggctgtggtcgtaggtggcgaccagccgctgccgggcggcgtcgtccgtcacggactgcaggatcgggtcgtgggggaagagcgggtcgttcgggaagtacatctgcgtcacgagccgctgggtgaaggccgagccgaagacggagaagtggatgtgcgcgggacgccaggcgttcacgtggttgcgccaggggtaggggcccggctggatggtggtgaagcggtagcggccgtcggcgtcggtgagggtgcggccgacgcccgtgaagttcgggtcgagcggggcgtcgtgctgctcgcgctggtgggcgtagcggcccgcggagttggcctgccagatctcgacgagctggccgcgcaccggccgcccggcccggtccaggagccggcccgacacggtgatccgttcgccgaccggctccccggtgtgctggcgggtgaggtcgttgtcggtctcggtgacgtcccgctcgccgaacgcgggcgaggacagctcgaccagctcggggtccttgctgacgtcgatggcgaccagcggctgcctggggtggcgcagcaccgaggagcggtagggcgcgtagtcgcggcgcgggtggtgctcgaccggcgcgccctcggccagacgcttctcgtaggcggcgtgttcggccgcgatctcctggtcgatgtcgtgctgggtgagagtcatggggtacctgacgcttccttagcgttcgaggacgagggcgaggccctggccgacgccgatgcagagggtggcgacgccggttccggagcccttgcgggcgagctggtgcgcgacggtgccggcgaggcgggcgccggaggcgccgagcggatgaccgagggcgatggcgccgccctgcgggttgaggacggcgggatcgaaggcgggccattcggccaggcagcccaggacctgggcggcgaaggcctcgttgacttcgaggacgtcgaggtcggcgaaggacttcccggccctggcgagggcgcggttcaccgctgcgacgggcgcgagcccgaagtggtgcgggtcggtcgccgacaccccggtggcacggacccgggcgagcgggcgatggaggcgtcccccacagcgatggcgcgggccgcctggatcaccgcctccaggcccgaggcgcacagccggttgaccgtcacgccgggcacgctggtgggcagccccgcgagcagggccgccatccggccgacgttgcggttctcctcgccggcgccgttggcgttgccgaagcagacgtcctcgacccgtgccgggtccagctcgggtgtgcgggcgaggagttcgcggatcgcgtgcgcggccaggtcgtccgggcgtacgcccgccagggcgccgccgtacttgccgaacggggtgcgtaccgcgtcgacgacgtagacgtccttcacctgactccctccgcgacggccagttccgcgtcggtcctggcggcgatctcctcggcgctcacgcccggcgcgctctcgacgagcaccagcccgccgtccgtcacgtccaggacgccgaggtcggtgatgatccggttcacgcaacgcctgccggtcagcggaagcgtgcactcccggacgatcttcggggagccgtccttcgcggtgtgtgtcatcacggcgatgaccgtgcgggcgccgtgcacgaggtccatggcaccgccgatcccggtgatcatcttgcccggcacggcccagttcgccaggtcaccgcccgcggacacctgcatggccccgagtacggcgacgtcgatgtgcccaccgcggatcatcgcgaaagacagcgccgagtcgaagaacgaggcgcccggcaggaccgtgacggtctccttgccggcgttgatcaggtccgggtcgacccggtcctcggccggatacggtccggtgcccaggatgccgttctcggactccaggaccacctcgacacccggcggcaggtggttcgggatcagcgtcggcagcccgatcccgaggttgacgtactggccgtcgcgcagctcgcgcgccgcacgggcggccatctcctcacgcgtccacgccatcagcggctctccgtccccggtgcggcggcgggggacaccgtccgcttctcgatctgcttgtcggcggcctgctccgggctcagggcgaggacccgctgcacgaagatccccggcacatgcacggcgtccgggtccagcccgccgggctccaccagctcctccacctccgcgatcgtgaccttgcccgccatcgcggccagcgggttgaagttgcgggtggacttggtgaagaccaggttcccgtgccggtcgcccttcgccgcccgcaccagcgcgaagccggtgcggatgccgcgctccagcacgtactccacgccctcgaactcgcggacctccttcggcggcgaggccagcgccaccccgcccgagccgtcgtagcgccagggcagcccgccgtcggcgacctgcgtgcccacgccggcgggcgtgtagaaggccgggatcccggcgccgcccgcgcgcagccgctcggccagcgtgccctgcgggatcagctcgacctccagctcaccggccaggtactggcgggcgaactccttgttcgcgccgatgtaggagccggtcacccgtgcgatccgcccggcggcgaggagcaccgcgaggccggactccatggcgccgcagttgttggagacgaccgacaggccgcccacgccgcgctcgtacagcgcctggatcagcacgttcggcacaccgctcagcccgaaaccgcccaccgccagcgacgcgccgtccggcacgtcggccaccgcctgagcggccgtggcgaccaccttgtccatcgaaacaagcctcatctctgccgagcgccgccgattcctcccggaacccagatagtcagggcactgagtatttcggcgaaggttccttcacgctgccatcagcgcagtgagcagtcaagggggcgcaggggcagggtggtggagcggtccacggcatggtcgcgcgctgtattgttcagtgcacgtatgaaatgcggggcggaaaccgcagagccggaaccgcagacctacccgaggagcgcacatggccgcggtggacctcaccacgcaccccgggcacctggcccggcggctccagcaggcccactacctgctgtggaacacgatggtctccgaggagatcacctcgccgcagttcgcggtgctcaacgcgctcgtcgccgaaccgggactcgaccagcgcaccgtgggggagcgggtgggcctggaccggtccaccatcgccgaggtcatcagccgcctcgaccgccgcggcctgctcggcaaggtccgcgacccgcaggacggccgccgcttcctgctccggctcaccgacgagggcgagcggacccaccgcaggctcgccctgcgcaccgcccggatgaaccaggtcttcctcggcccgctcagcgcggcggagcaggcgcagttcttcgacctcatccggcgcgtcgcggacgcggccgaaggcctgcgcaacccggtggaaccggccgccgcgcgccactgatccggggcagcccacaaggagacccgccccgccggttcgcccgcacggccccgggtacccggccgtccggcaaggcaccggagcgtgacggaaggggcgcgacacgatgaaggcagtgacctggcagggcaagcgcgacgtccgcgtggaggacgtacccgacccgaagatccaggagccgacggacgccgtcatccgggtcacctcctccgggctgtgcggctcggacctgcacctgtacgaggtgctcaccccgttcatgacccccggcgacatcctcggccacgaaccgatgggcatcgtcgaggaggtcgggtccgaggtgacgaacctcaagcccggggaccgggtggtcgtcccgttccagatctcctgcggccactgcttcatgtgctccaccggcctgcagacgcagtgcgagaccacccaggtaaccagcgagcacatgggcgccgccctgttcggctacacccgcctgtacggcgccgtcccgggcgcccaggccgagtacctgcgcgtgccgcaggcccagtacggcccgatcaaggtgcccgagggcccggcggacgaccgcttcgtctacctctccgacgtgctgcccaccgcctggcaggcggtcgcctacgccgacgtcccgcgcggcggcaccgtcgccgtgctcggcctcggcccgatcggcgacatggcgtgccggatcgcgcgggcccgcggcgccggacgggtgttcggcgtggacctggtcaccgaacgcctgacccgggccgaacggcacggcgtcgagacgtacgacctgcgcgccttcgacaacgagaaggagctggtcgccgcgatccacgaccgcaccgacggacgcggccccgacgcggtgatcgacgcggtcggcactgaggcgcacggcagccatgtcgcccggctcgtccagcagacggccgcgatgatgccccgcgcgctgagcggaccgctggcggaacgcttcagcgtggaccggctcaccgccctgtacaccgccatcgacctggtccgccgcggcggcaccatctccctgtcgggcgtctacggcggctccgccgacccgctgccgctgctcaccatgttcgacaagcagctccagatccgcatgggccaggccaacgtccgccgctggaccgacgacatcctgccctacctcaccgacgaggacccgctcggtgtcgacgacttcgccacccaccgcgtcccgctggcgcaggcaccgcacgcctacgagatgttccagcgcaaggaggacggcgcggtcaaggtcctgatgacgccctgaggcgccccctcacggcgccgggaggccgtccccctcgcggcgccgagcccagggtctccgttcacggtgccgagcccaggatctccgagaggtcgtagcgcaccggctcctccaactgggcgtacgtgcaactctccggggtgcggtccgggcgccagcggcgaaagcgcgccgtgtgtctgaaccgcgccccgttctccatgtggtcgtacgccacctccgccacccgctccggccgcagcggcacccaggacaggtccttcttgcccgaccagcggctcggcgcacccggcagccgcgccgactcgtgggccgcctcctgcgaccacgcggcccacggatgcccggccgcgtcgtccatccgcagcggcgccagctcctcgatcagctccgcgcgccgcttcatcgggaaggccgccgacacgccgacgtgctggagggtgccccggtcgtcgtagaggccgagcagcagcgagccgactacgggaccgctcttgtggtggcggtagccggccaccaccacgtccgccgtccgctcgtgcttgatcttgaacatggcccgctcgtcctggaggtagcgcagccccggcggcttggcgatcaccccgtccagacccgcgccctcgtactgctcgaaccactgccgcgccacctcgatgtccgtggtcgcgggcgccacgtgcaccggcgcggtcgcctcctgcagcgccctgaccagcagggctcgccggtcctccagcggtacgtccagcagggactcgccgtccagcgcgagcaggtcgaaggcgacgaacgaggacggggtccgctcggccagcgtccgcacccgagagtcggccggatggatccgctcggtcagcgcgtcgaagtccagccgcccctcccgggcgatcacgatctccccgtccagcacgcacttcgcgggcagccgctccctgagcgccgccaccagctccggaaaatacctggtcagcggcttgccggtgcggctgcccagctccacctcgtccccgtcgcggaacacgatcgcccggaacccgtcccacttcgcctcgtactgcatgccgggcgggatcttcgccaccggcttggcgagcatcggcttcacgggcggcatcacgggcagatccatgcaagcgattctgcgcgcccgcggcgccttccgcccggtgtgcgaggtgtgcggggtacgcctaccgtggctcgcatgggcgatgcggtggaactggacgtggccggccggaccgtcaggctgtccagcccggacaaggtcttcttcccggagcgcggctacaccaagctggacgtggcccggtactaccaggcggtcgcccccggcatcctgcgcgccctgcgtgagcggcccaccaccctggagcgctacccggacggcatcgacggcgagtggttcttccagaagcgggcgcccaagggcatgcccgactggatcccgaccgcccacatcaccttcccgagcggccgcagcgccgacgagatgtgccccaccgagcaggcggcggtcgtctgggcggcccagtacggcaccctcaccttccacccctggccggtgcggcgcgacgacgtcgaacaccccgacgaactgcgcatcgacctcgacccgcagcccggcaccgactacgccgacgccgtccgcgccgccggtgaactgcgcgccgtcctggacgagttcggggcgctgcgcggctggcccaagacctccggcgggcgcggcctgcacgtcttcgtgcccatcgagccccgctggaccttcacccaggtgcggcgggccgccatcgcggtcggccgggaactggagcgccggttgcccgagcaggtgacgaccaagtggtggaaggaggaacgcggcgcccgcatcttcgtggactacaaccagaccgcccgcgaccgcaccatcgcctccgcctactccgtacgcccccgcccgaacgcccccgtctccgcgccgctgcgctgggaggaggtcccggtggcccacccgcaggacttcgacatcacgaccatgcccgcccggttcgccgaggccggtgatgtgcacgccgacatggacgaccacgcgtacgccctggacgcgctgctggaactggccgccagggacgaacgcgaccacggcctcggcgacctgccctatccgcccgagtacccgaagatgccgggcgagccgaagcgggtgcagcccagccgggccaaggcgcacaaggagggcccggccgtcggctgatcacccgacggccgggccccctcgcccgtcgaccgaggtgccgctacagctccttgatccggatgtcgcggtaggagacgacgtccgacgtgctgtgcacctggatcccgatgtaaccggagtcgaaccgccggccgtccgtgcccgggtcgtccgagcgcggcggggagaactcctggccgccgatgttgtcgaactcgttgatcagcgtgccgttgcggaacaccgagaagtgctggccgacgacgcggatctcgtagtcgttccacgtccccttctgggtgacgccggccccggcgaggcccacccggtcgaacccgtagaccgaaccggtcttgtacatgtcgccggacgggctgtcgaactcctggatctcgtgcccgtacttgatggcgacccactcgggccgggactcctccgggtggtcgtggacctgcgggaaccgcacgaacacaccggagttggcgttgccgtcgcccggggcgtcgtcacgccactgcagccgcagcgagaagtcgccgtacttgcgctcggggaaccacagcatgcccatgcccggcctggtggtgccgctggtgagcgtgccgtccgcgttcagcgcgaaggaaccgccgccgacctgctcccacttggcgagcgaggcggcactgccgtcgaagagcgcgcggtagccggtgtgctggccgggcttgccgatgcccgactgacgggccgccttctggatcgcccggtactcccgctggtcgaggacaccctccttctgcagccggtccaggaccgtcttgacgtgcttgaggaagagcgcctgggacgtccactccttctcgtcctcgatcagctcgttgatgcggcaccggttgtccgtcacccggttcggcacgcccgagtcgaccgtgccgacgatcaccgtgcgccgctcgtcgtactccgggcagcccggcgccggaactccgccgcccgccacgaccgtgaggctcacggaccgcggttcggaggtgttgccggccttgtcggtggcccggtacgccacggtgtgcgcgccgacgcggtcgacgaccaccggggcggagtaggccaggtacgggccgccgtcgagcgagtactcgatgcccgcgacacccgagccgccctcgtccgccgcgctcacggtcacccgggcgctgccgacgtaggcaccgtcggagttgcgcgtgccgtcgacgctcaccccggtcaccggagccgtggtgtcccgggccggcgcggagaccaccgtgaagcgcacgctctgctcggcggagacgttgccggccttgtcggtggcgcggtagcgcacggtgtgctcgccgagctggtgcaccatgaccggcgcggtgtacgcctgccaggcgcccgcgtcgagcgcgtactcgacggtgttgacgcccgagccggtgtcggacgccgagaccgtcaccgtcgccatgtcgacgtaggcgccgtcggcgttccgttcgccgctgacggtggccgaggtctccggcgcggtggtgtcgtcggagggcggcgcggccaccgtgaacgtgacggtcttctcggcggacacgttgcccgccttgtcggtggcccggtagcggagcgtgtggtcgccgacctggtcgacgacgacgggcgcggtgtacggctgccaggcgtccgcgtcaccgagggcgtactcgacgcggtccacgcccgagccgccggtgtcggtggcgctgatcgtcacgctcgccgaaccggcgtactggccctgggcgttcttcgcgccggccacgctcgccgaggtctccggcgccgtcgtgtcggacccgccgccctcggtcaccaccagcacgccctgcatctggctgtggccggggatcgtgcagtggtagaagtagcggcccggggtcagggtcacctcggcggtgtgccggccgccctggtcgtcgttcgggttggcgaggatgttgacctggacgtcactgttgtactccgggtcggaggtctcgaacgtcagcgtgtgcggcatgcccatggtgttgccggtggccgcgctgttctcgaagacgatcgtcgcctggcccgccaccgcgctcgccggtgcggaggcgtacttcgtgatgtcgtcgccggcggtccaggtgagcacctgggcggcggcccgggtctgctgtccgggctgtccggcggcgggcgtggcctgcagcccgagtgtcatcagcaccgcggccagcagcgccgtgagaacccttcggtgccgtatcactgtgccccccttgccagctggtccgcggccggcgtcgggccgccgccggtgtacgtcacgcgccacagcgccgacttggagtccgaggtgaagaacccgcggccgtagtcgaggacgtacagcgcgccgtccgggccgaacttccagtccatcaggttcttgatgccgtcgttgccgaccggcacgatcttcttcagcgactccgcgtgcaccggcagcccgccgtcgccctgcgtcgccggatccatgaggacggcgttgcgcggctggtcggcgtcgtagaagtcaccgacgaaccacttgccgtcccagtacgcgggccacttcgcgtcgctcgcgagggcagcgtcgtaccggtagacgggaccgtccatcgcggcctgaccgccgcccttgagccacggcaggctgtaggtggcctggtccttctggtacgaggggacaccggccgcgtcacgcggatagtccgggccgccgccctgcggcgagtaccagatgttgttgccggtgaccggcgggaggttgacgagaccgtcgttgttcggtgactcgttcttcgggtggtcgcagtcgtaccagcccagcggcttggaggggtcgggcaggttgcggtcgcggtagggctgcttgtcgcccatgcagtacggccagccacggttgcccgccttggtgatcacggcgaacgtgtcgtacttcgccggaccccaggtgggcgacggatcggtcgcgtccgggccgacccagcccgcgtacagcacgtcggtcttcttgtcgacggagatgcgcgccgggttcctgacgcccatcacgtagatctcgccgcgcgtcttgccgccgccctcggccgtctccttgccggtgaagaggttgccgtcggggatcgtgtacgtcccgtcgggctcggggtggatgcgcaggatcttgccgttgaggttgcgggtgttgccggcggtgcggcgggcgtcggcgaaggagacgcccttgtagttgggctgcgggttgttgccggagtaaccaccgctgaactgactggagttgttgtcgccggtcgcgatgtacaggttgcccttggagtcccaggccatcccgccgcccgcgtggcagcaactgtgcacctggaccggccacttcagcagcaccttctcgctgccgaggtcgagcttgtccgtggcggggtcgagggtgaagcgggagacgcggcgctcggccagctgcctgtcgcggtcgagctgcgcgtgcggggtgtagtgcaggtacacccagccgttctgctcgaagcgcgggtcgagttcgatgccgagcaacccctcctcgaccttgaccagttcgtcgccgccgcccttgttgccgaagacgctcagctcaccggccagggtgaccttgccggtcttcgggtcgtagacgtgtatctgtcccttgcccttgccgacgttcgggtcgctccagtcggtcaccaccggctgggaggcgtccgcgccgccgcggccgatgtacaggacgcggccgtccggagcggtgaccaggccgtgcggttcgccgatctggtcgttctgcccgggctggttgggcttggtgaggcgctccgccttgtagtttccggtgatggtggccttgcagtcggcctgcaccagccgggtggtccacagcagggcgccgcgcagatgggcgcggaagtccgtctcgtcgtaggacgcgacggtgccgcccatgccggtgtagaaggaccggccgccgtcgtagtcccggcaccagctgaccgggtggtcccagccgttggctccggcccccggcttgtaggtcgactcccgcacccgggccaccgtgtgcacctcgccggaggggttcttcacccagttcggccactggtccaggcgcttccactgcaccggcaggtccttggccgccgggtgccgccggtcgccgacctcgacggtcgcccgctgcacggccgtcgggctgttcgcggccgggcgggcgccgatgagcccggtgaaccagtccgagtacggctccgcgcgggccgcgtcatggatgccgacgaaaccgccgcccgcctccatgtaggcctccagacccgcctcctggtccgggtccaggacgtcaccgccgccggtcaggaagacgaccgcgttgtagcggccgagccgggtcgcgttggtgaagaccgacgcgtcgtcggtggcctcgatcctgaagcgctgcccggccggtccggacaggccgatccgttcgatcgcctcgatcccggcgttcaccacgggtgactcgtcgccggccgcggcggagccgtagaagaccagcaccttcacgttggcgccgcccggcggcgacttgatcgacatcgttgtcggcagggcccccggatcggggcgcgcctgcgcggcgggcgccgcgagcagcccggccgccatgactcccgcggtcacacccgcggcccagagccgtcctcgtgtgcttcttgcgctcaaccctcgtaagggcatgggcacctcctcggtcccggcaacagcgagaagaaagctaggcgtctttgcacggtccgccaatacctatgaccgcgatccgacgaactttgtcctgagtgtggataaaccggcggacggccggtaccgtcgcacaggttcgtcacaggtacgcctccgcaacacccgtacgagcctggggagttccgcatggacagacgcgtgttcaatcgcaccgtcctgctgggcggcgccgccgccgcgacatcgttgtcgtccgccgtcgcggcccgggcggcggacaccgcgccgcgcaccgcgccggccgggggcgaggtgagacacatcaggctgtacgccgagaaactctccgacgggcagatgggctacggcttcgagaagggccgggcgacggttcccggcccgctcatcgaactgaccgagggcgacacgctgcacatcgagttcgagaacaccatggacgtcgccgccagcctgcacgtgcacggcctggactacgagatcaccagcgacggcaccaagatgaaccacagcgacgtcgaacccggcggcacccgcacctacacctggcgcacccacgtccccggccgccgcaaggacggcacctggcgtccgggcagcgccggctactggcactaccacgaccacgccgtcggcaccgagcacggcaccggcggcatccgcaaggggctctacggaccggtggtcgtccgccgcaagggcgacgtcctgccggacgcgacgcacaccgtcgtcttcaacgacatgaccatcaacaaccgtcccccgcacagcggtcccgacttcgaggccaccgtgggcgaccgcgtcgagttcgtcatgatcacccacggtgagtactaccacaccttccacatgcacggtcaccgctgggccgacaaccgcaccggcctgctcaccggccccgacgaccccagccgggtgatcgacaccaagatcgtcggccccgcggactccttcggcttccaggtacttgcgggcgagggcgtcggcgcgggcgcctggatgtaccactgccacgtgcagagccacgccgacatgggcatggtcggcctgttcctggtgaagaaaccggacggcacgatcccgggctacgacccccacgagcacggccactgacggatcatgggcgggtgacccttctcctcacccgccgcgacctcgacgccgtcctggagcccgccgcctgcgccgacgccctgcgcgagggcttcaggagcgcgccgcacacttccgtccaggggcagcgggtccgcaccgacctgcccttcccgggcacggccaccgccctgatcccgggtctgctgcccggcatcgacgcctacaccgtcaaggtcaacgccaagttccccggcgcccgccctgccctgcgcggagtgatctgcctgcacagcggccgggacggagagctgctggcgctgctggactccgccacggtgacggcctggcgcaccggcacggccgccgccctgggcacccatctcctcgcggcggagggggactcgagggtgctgggcgtggtgggcgcgggcgtccaggccgaggcgacggtgcgcggtcttgacgccctgcggggccgccgtgacctcgtcgtccacgacacggaccgcggccgcgcggccgagttcgccgcccggcac

SEQ ID NO: 409 - DNA, 707 bp, Unknown
  Kingdom: Bacteria, Phylum: Actinobacteria, Class: Actinobacteria, Order: Streptomycetales, Family: Streptomycetaceae, Genus: Streptomyces
ccccgccgtccgcgttcgcgccgcgcgcgtgcctcagccccgtggcgcgaagccgtccaggacccgggtcagggcccgttcgaacaccgcctccaggtcgatggggcccgcgtcctgcgtgaaggacgccgccagtcgtggaaaggcgccggtggcgacctgaccgccgaggtaggcgatccgcaccgcggtctcctgctcctcggaccagggcagggagcgggtgcgctccgcggtggccagctcgttggagacgtacatggtcaccacggcgttgaccatggccaccagttccatcttcgtgccgtaggaggcctccagcgggtccaggcaggccaggcagtgctccaggtagcgcaggacgttggggctgaaaccgtagatcccggacatcaggcgcggcagccaggtgtggcggcgcatgaggtcccgggactggtggcccacgcggagcatgtcggcgcgccagtcgccgctcggttcccacagctcgtgctcgccgctggcggcgtccaccatcagctcgtacaggtcctccttgcgggggacgtagttgtacagcgacatcgtgccgcagcccagctcggcggcgacgtgccgcatcgacaccgcgtcgagcccgcccgcgtcggccagccgtacggccgccgccgcgatgtctgcgcgcgtgtaggcaggccgcggtccccgtcccgcccgctcgggac

SEQ ID NO: 410 - DNA, 2635 bp, Unknown
  Kingdom: Bacteria, Phylum: Actinobacteria, Class: Actinobacteria, Order: Streptomycetales, Family: Streptomycetaceae, Genus: Streptomyces
cggggaagccggggccgtggtcccgcacccggatgacccggccctcgacgctcacctggatcggcggcttgccgtgccgggccgcgttggtgatcaggttgaacagcacccgctccaggcgccgcgggtcggtcgtgaccatcgactcgtgcaccacccggacctccacgtccgggtccttggccgccacccgcctggccacgaactcaccgagcacgatgtcctggagttcggcccgctcggaggcgccgtcgagccgggccacctccaggacgtcctccaccagcgtgcgcatcgccttcgcacggtccaggaccagttccgtcgggcggcccggcggcagcagctcggccgccgtcagcagcccggtcaccggagtgcgcagctcgtgcgcgatgtccgcggtgacccgccgctcggcctccagccgctgctgcagcgtgtcagccatcgcgtccaccgcgcgcgcgagatcgtcggtctcgtcgcgtacgacaccgccgatggcgtcccggacccggacgtccggctcaccgttggcgacccggttcgcggcggcggcggccttgcgcagccggcgcgagagctgtccgccgatcagcacgcccagcgcgctgccgccgaggacgaccgcgatggagccgatgaccagggcctggtcgaggtccctgaggatgttcgcgctgcggtccgtgaaatgggtgtgcacggacagcacatggccgcccttgatcggcatggccgcccagatgtccggcaccccgccccggtggtcgctcacgaaggtggcccgccggccctggcggaccttctgctgcagcgcgggcggcagcagtggatcatcgatcttgatgctcgacgaggtcggccggtggccgggccgctcgtacagcggctgggcgtacacgagccgagagtcggcgaggtcgcgcgcgttgtccagcatggacacccgcgcggcgttgtgcacgaccaggctcagcgcgatcgcgatcagcgcgcccaccagcgcgatggccgcgctgagcttccaccgcaggcccgtacggatgtccgcgtttcccaggcgcccggggatcaggcgccgcgtgttcccccgcatccgcgccccgctcaggccttcagcttgtagccgaagccgcggaccgtctcgatgcggtcctggccgatcttggcgcgcagtcgctgcacatggacgtcgacgacccgggtgtcaccgccccagccgtagtcccacacccgctccaggagcttgtcgcgggacaggaccgtgcccggtgccgaggagaactccaggagcagccgcatctcggtcggggtgaggcccaccggccgcccggcccggcggacctccatgccctcggtgtcgacctccaggtcaccgaaggtcagcaccgcgccgtccaccgccgcggaacccgcctcgccgcggtcgccgccggcgtgcccgaagcggcgcagcaccgcacggatccgggcgacgagcacggcaccgtcgaatggcttggtcacgtagtcgtcggcgcccgcctccaggccgaggacgacgtcgatggagtccgcgcgcgccgacagcatgatcaccggcaccgtcgactcgtcgcggatgcggcggcacaggctgacgccgtcgaggccggggaccatgacgtccagcagcgcgatgtcgggctgccgcgcccggaacgcctccaggcccgacagcccgtcgggcatcgccgtgaccgcgaagccgtcccgctccagtgcgagctgggtggcctcgcggatgacgtcgtcgtcctcgacgaacaggacgtgggtctggtctgccatcccggtgctctcagtcctcgtgtgctcaggtggtgcgccctttgggggacgcgcctgatcggtgatgcgttcatcggcgccgtgcaccgccggtgcgccggcgccagtgccctgccgtcagcgccgtgccgccgccgtcggcgctctgcttcaagtgcggtccccggcggtgccgtgtccgcctgtcgcctacccggccgatgccgggttcaccacgtgatcggagggccggcgggcccggccggtgcaccccgccggatctcccggcggtcagctgggcgggtcctgtgccggctccggctccggctcgtccggggccttggacgccgccgcgccgccgacggccttgctgtactcgttgcgcgtgctgaacgccttggtgaaccggctgccggaccagcggtaggtgatgacgtcctcgccggacgggttcgagaacgcatcgcctcgctcgtacacctgcttggtcaccacgaggtcaccgcggtcgatctcggcgtacaccgggggctcctcggccgcgaacacgttctcatagtggtcgccgccctgctcccggtacacataggcgccgaggcccaccgcgtccccgcaggtcagcacgttgatgacgatgtcgtccgcggaaccgccggtcatcttgccgtacgacacgtccacagggtactcgtcggcgacgcacggcttgagcctgctcttgatcttgggcgagaccttcgggtcgtccttcaccagccggaccgcgtccaccggccggggcgtgtcgctgggagtcggggacggcgcggccggggttcccgccaccgagctggcgtcggcg

SEQ ID NO: 411 - DNA, 521 bp, Unknown
  Kingdom: Bacteria, Phylum: Actinobacteria, Class: Actinobacteria, Order: Streptomycetales, Family: Streptomycetaceae, Genus: Streptomyces
ccgcccgcgccggccggccgggtggcgccgtcgctgcgggccggttcgagaatgctcgtcacgtcagcctcctagcggcgcgcgatggtgacgcggaagttgttgaagaacttgtcctcgagcgtgtaggcgaagatgtcgaggtagcgctcgaagcgggccacgacctcctcgccctccagggcgacggcctcgtcccggcgctcggcgagcagctggagccaggcacggcaggcgacggcgaacgactcgcgctcgttgacgatctcgacgacgtcgaacagcccctcggcggcctgggtcagctcgtgcaggtgcgggatgtggcagttctcgaactccgagcgctgcaggaacttcaggtcgtcgagcagctgccggttcatcggcagcgcctcggcggtcatcgtgtgcagcacgaagcgggcgcccggcttgagggtggcgccgaccttctggaagaacacccggtacttcttggtgcgctcgcgcggcggcagcgtcgaggagacgaagtgctc

SEQ ID NO: 412 - DNA, 4113 bp, Unknown
  Kingdom: Bacteria, Phylum: Actinobacteria, Class: Actinobacteria, Order: Streptomycetales, Family: Streptomycetaceae, Genus: Streptomyces
ctccgaacggccccaccaccacaagaggtgaagaacgtgagcaacctgcccggcgcgtccatctcgcgcagagccctgctcggagcgacgctcgcgggcggcctcgccctgagcggctgcagcggctccgccgtccccagcacccggcccacgggggccccgaccggcccgcgcaagcgtggtggcacgttccgtttcgcgccctcggacttcggcggcgccgtcaccaccgaccctcagtccagcgactcgtccttctccctgatcgccgcgtacaccgacacgctgatgcgccgcgaccacaactgggtggcccggcccgcgctcgcggaggagttcgcccctcaggacaaggacctcagcacctggaccatccgggtccgcgacggcgtcaccttccacaacggcaagccgctcaccgcggacgacgtcatcttcaccatccggcgcaacctcgacccgaagaacccgggcttcgtcgccggcctgctcgactccgtcgaccccgcacacctgaccaagctggacgcacggaccgtgcggctgaagctgaagtaccccaactcgcagctcccggacggcttcgcggaggtgccctcgggcatcgtcccggtcggctacgacccgaagaaacccatcggcaccgggccgttcaagcagcagagcttcaccccgggccagcgctgggtcggcgtgcgcaacgagaactactggatggagggcaagccctacctcgacagcgtcgagctgttcggcttctccaacgcggacgtggcccgggtgaacgccctgctgagccggcagctggacggcatcgaccgcatcccgggcagccagctcacccagatccggcagcgccaggacatcgaggtgctggtgtcgccgacgggttccttccagttcttctccatgcgctgcgacaagggcgcgcagttcgaggacaaccgcgtccggcaggcgttcaagctgctcgtcgaccgcccgcagatggtccagatcgcctacggtggcctgggagccgtgggcaacgacgtcggcacctgggccaagttcgacccgatgtacgacgcctcgctcccgcagcgtgcccaggacctcgaccaggcgcgccacctgctcaaggcagcgggcgcggacggcatgtcggtgcgtttccgcgtcggcgacgtcgaaccgggcgcgaaggccgccgcctccctgctggtccagcacgccaaggccgccggagtgaaggtcgagctcgacgtcctcgccgacctcgcccagttctacggcagttccagctaccggacctcacagctgaagaacgactgggacttcacccagtccgtctacgacaacgcctcctactgctggctgccgtcgggtccgttcaacaacaccggcttcgtccaccccaaggtcaactccctgtaccggcaggccctggcgaccaccggcgcgaagagccgggaactgatgcacgagctgtcgcgggtcatctgggacgaggggccgtgggtcgtctggggccgccgcgacatcgccgacgccttcagccggaagttcaccggacccgtccaggacgcctccggcctcggcttcaacggctaccactgggaggaggtctccctcgcctagcccgggtcatgtcggtgacgttctggaaccgtgggagggaaaacgagatgagcgccttcgattacgtggtggtgggcggaggcagcgccggatgtgtggtggccgcccggctcagtgaggaccccgatgtctcggtgctactgctggaggcaggcggggacgaacgccggcccgacgtcgagacgcccggggcctgggcgtcgctgcaggggacggacgcggactgggcgtacgaaacggtgcgtcagccgggaaccgggcggagccatgcggcgccgcgcggccgggtgctcggcgggtcgggctcgatcaactgcatggcccatctacgcggtcaccggctggacttcgacgagtgggcggccctgggcgcgaaggggtgggcgtacgacgacgtactgccgtacttcaagcgctccgaggacgtcccagactcagacccctttcagcgtggccggggcggcccgctgcatccgcgaccggagcaggcgtccggcgcgatgggggcggcctacctggagggcgcggtccgcctggggcatccggtcgtcgacgacctcaacgccggagacatgctcggcgtgggttacgccgacgccctgatccgcgacggccggcgggagagcacggcctccgcctatctgaggcccgtgatggaccggccgaacctgacggtcctcacgcacgcggtggtgcggcggctgacggtccgggacggccggtgcaccggggtcgagtacctgcggcacggtgtgccggggcatgcccgggccgccgccgaagtcgtgctgtgcgccggtgcggtcggctctccgcacctgctcatggtctcgggagtcggacccgcgaaggagctggcggcgctcggcgtggcgccggtggccgacgtgcccgaagtcggacgcaacctccaggaccacatcctgctggccgggatccgctaccgggccggccggccggtcagggaggccgaggagggcggcggccccaccctcttcgtgcgcaccgacgccggtgagcacggtcccgaccttcagctctcggtgatggccggtgactaccgcatgccgtggcaggagccggtggagaacgccttcaccttcctcatcggccatatgcgtccgcgcagccgggggagcgtccggctcgcgtcggccgacccgcaggcggctcccctcatcgacccggcctacctggacgacggctacgacctggaccagctgatcgagggcgtggagcacatcgaccggatcgtccgcacaggtgtcttcgacgcgtggggaggtgtctcggagacctcgtcgatgctggacaacgaccgggccggcgtcgaacaggcggtgcgctccacggtgagcagctacttccacctgtccggcacgtgccgcatgggctcggacccgggcgccgtcgtcgacccggagctgcgcgtgaacggcgtgaccggtctgcgtgtggccgacgcctccgtcatgccggtcatcgtgtcctgcaacacgaacgcggcgacggtgatgatcggggagagggcggccgacctgctgcgcggccgccgcgtcccggccggtgccgacgcggcacaggcctgatgcggtcccgggtgccgaggaggagaccggcgcccctgtgctcccgctcggccgggacgcggggggaactcacgctgcggatcctcgcttgcgcggcggtgtccggcgacaccgcatgcgtcaccatcctgaccccgctgctgccggcccatgtgcggaccatcggcctgtccaccggttccgtcgggcttctgacggcggcctgcacggtggggtgtgctggtcgccgccgtgccttccggggccctcgtcgtccggctcggtccacggccggtcctggtgtcctcgccggcgctgctcgcggtcgcgcccgccgttttcggcttcgcccacgacgcccttcttctcggggcggcgcgacttgtccagggcgcatccggttcgctgacctggtcgggggcgttcgcgtgggtgaccgagggggtgcccgcggcacaccggggcagggccctcggcacggtggcggcggcatcggcggccgggaacgtgctcgggccgtcgccgggggcgtcgccgccctggccggggtcccggcggtgttctgcgccatcgtcgtcctgtgcgcggcgatcgcatggggacggcgctggtgcccgtttcgggccgggctccccagccgacctgccggggcatcccggtgggatcgctctgcgggtgcgacgcggtattgatccgacgcgaaggctccgataatctgcgcattaccaaccgaccggtcggaaggcaaggtgcctccggaaggctgacggcggtcccgagggcgccctggcccgcatcgcccggccgacagaccctgcgcgacgcgctgcagcaccgaacgcacggcgcgggcgaggaacggtcatccgccgctgccggccgcgcggccgcgggccggcacaggacgcggtccggcgcctgaccg

SEQ ID NO: 413 - DNA, 2807 bp, Unknown
  Kingdom: Bacteria, Phylum: Actinobacteria, Class: Actinobacteria, Order: Streptomycetales, Family: Streptomycetaceae, Genus: Streptomyces
cgtctacacctgggtcgacggcaacgaccccgcctggcagcagcggcgcgccgcgttcggctccggcggctaccacaccgagtccgccaacgcggcccgctacatcagccgcgacgaactgcgctactccctgcgcgccctggagcagaacgccccctgggtccgccacgtctacctcgtcaccgaccgccagcgtccggcctggctcaccggcagccacccgcggctcaccgtcgtcgaccactccgagatcttcgacgaccccgccgccctgcccaccttcaactcgcacgccatcgagagccgcctgcaccacatccccggcctggccgagcacttcctctacttcaacgacgacatgttcctcggccggcccgtcaccccgcaggacttcttcctctccaacggcatgacccgcaccttcttctccccgtcccaggtgccccgctgggaactcacccccggcgatcgccccgtcgacgcggccggcaagaacaaccggcgcctgctcatggaacgcttcggcaccgccctggtgcagaaactccggcacgccccctacgccctgcgccgcagcgtgctccacgagatcgagtacgagtacgccgcggagcaccagcggaccgcctacagccgcttccgcagcgccaccgacatctccatcccgtcctcgctgtaccactactacgcgtacctgaccggacgtgccgtgccctcccagatcagcttcgcctacctcgacctggcccggcccgagatccagcgcaggctcggcatcctgctggcccgccgcgaccggcaggcgttctgcatcaacgacaccctctccgacggccgcgacaccgcccgtcagaccgccatgctcagcgcgttcctgcgcgcctactaccccgtgccgagtcccttcgagcggaaggagtgcgaggtccggtgaagatctccttcctgatcaacaacatctacggcatcggcggcaccaaccgcaccgtcatcaacctcgccgaggcactctccgtccaccacgacgtcgagatcgtctccgtcttccggcgcgccaccgccaccaagttcgagatctccccgcgcatcaccgtccgcgcgctggtggacctcaggcccggcggcgccgaccgcggtgcccccggcagcgacgaacccagcgaagtcgttccgcgccaggaggagttctacgcccagtacagcaagttcaccgacgcacggatcatccgcgaactggagaagaccaccgcggacgtcgtggtcggcacccgcccgagcctcaacctgttcgtcgccgcccacacccgtgacggagcgctgcgcgtcgcccaggaacacatgacgcacctcgccatccccccggcggtacgcgccgagatggcccgcgtctacccccgcctggacgccatcaccaccgtcaccgacgccgacgcccgctccttcaaggagaacaccccgatccccggcatcccggtcatcggcatccccaacagcgtccccgagcccgccgtcaccccctccgacggcacccgcaaggtcgtcgtcagcgccggccgcatgcaccacatcaagcgctacgacctgctgatccgcgccttcgcgcgcctcgccgaggacttccccgactggcagctgcgcatctacggcgacggcggcgaggccgccaagctgcgcgccctggtcaccgaactcggcctgaacggccgtgcgctgctcatgggcggcttctcaccgatcgagtccgagtgggccaagggctccatcgccgcggtcacctcgagcgccgagtccttcggcatgaccctggtggaggccatgcggtgcggcctgcccgtcgtctccaccgactgccccgtcggtccccgcgagatcctgcgcgacggcgaggacggcttcctcgtgcccaccggcgaggtggacggcatcgcctggggcctgcgccgcctcatggccgacgaggtcttgcgccgcaccatgggcgccgccgcgctgcgcaacgcggcccgctacgacccggcggccgtcgccgaccgctacctggagctgttcgcggacgccgcccgccgtcgcgccgccgccgaccgcggctaccgggccccggcaggaccccgcaagggcggcgccgaccggctcaccgtcccgccgagcaccctcggctccaccactgtcgacgtcaccgccgacgacgccggctggctcagactctccgccgaaggccccggcgagggccgcagacgctggcagttcgtgctgcgccaccagccctccgacggcgaggcccgccccgaactgccgctgcgcacctcacacaccgccctcgacaacggcggcacccgctacaccgccgtcatcacccccgccgcactcgacgacctcggcgacggccgctggcaggtggccatgcgcagcgccaagtcgcagcccgtgcacatgaaggccggcctgcgcgacacccgcgccctcatcgacgcccgcacccggctggtcacccgcccgcccgccacccgtgtcgtctggaacctgccctacgcccagcccaacggacggctgatgctgcgcaccgtactgcgcgagcagcacgccgagtgcaccgccgtcgaggtcggcgagtcgggcatcaccgtgcgcggcgtgctgtgcgggcaggaccggatcgagcccggcgccctgttcgtcgtcagccgccgcggtccgcacgcccggaacgtcaccgtgcccgtcgagaccctcggccgccaggcgttccgggccctggtgcccgtgcgcgccgtggtcgaccaccggctggcgcgctgggaggactggga

SEQ ID NO: 414 - DNA, 7142 bp, Unknown
  Kingdom: Bacteria, Phylum: Actinobacteria, Class: Actinobacteria, Order: Streptomycetales, Family: Streptomycetaceae, Genus: Streptomyces
ccgccgtggccggtccaacgcgccgtgacctgccgacgcgccacggctggtcggcgggccgtggccgtcggcgccataacggttccggcgtcatgacgaaccggtaccggttccgccggcgccccggtgcggaggggctcagccctgtcggcggaccagccgcagcagccgtgcgttctcgtcgcgccgggcccaggctatggccaggagcgggacgatcagcacgaccggcgtcgccgcgttctgcccgtcgaaggcggtgagctggacgacgaacgcgcccaccatcagcgcgctgagggccaccgccgccaccgactgcagcaccgggaccagcagtgcgatcgctccggccagttccagggcgccgatggtgtacatgcccgcgctgctccagcccatccgctcgaacgactcgaccgcggaagggtgcgcgatgagcttgggaagggcgctcgcgaaggcgtagaagagcgccagcagcacctgcacgacgcgcaggacgacgaccctggcgcgctggccacgggtgacgggggtgctgcctgccgggtcggtcgaggcggccggtgtccgggagacgaggggcgctgcggggacggtggtggtctcggccacgaggttctcctggggaaagcggtccgtggggtgctgtcacagaggtagaccggtctccccggcgaaactcatcggcgtccggcctgctccatgggcaccgcccgcacccaggtcccgtccttggtgaggtacgtgtcggtcctcagcccggcctcgccgagcgcgctctcgaactgctccctgctcagcgggcgggacaggaacgtctgcgtccaggtggcgtccgggaacacgtactccgcgcgcaccgagttcacgccgtcgccgaccggctcggccgacaggatccgcacggtgaaaccgctgggatccacgcgctcgcggggcagggcggtgtggtagtccgccccttcccgctgaatgagtacgcagccgccctccgccacgtgccgtgcgcaggtgcgcagcagtccccgtcgtatctccgcatcgcccgcatgcaccaggaacgaggcgagcatgacggcgtcgaaggtctcgcccaggtccagttcctcgatcgggctgcatatggtccgtgcgccgcgcacccgctccagcatctgcggcgactcgtccaccgccgtcacggtgaagccgcgctccagcagcgggtgggtcacgcggcccgcgccgcagcccagctccaggatgcgggcgcccgcgggcaccgccgcggcgatgatgtccggctcggtgcccacgggcagccgctcgtacagctccaccgcgcagccgtcgggcgtgatcgcacccggtcctgttccctgatagcccatacgcgtcttcggtttcatgcccggacaacggcccgcgtccgcacggccgttcccgtcccggcgtggttcacccgtccgagtgagcccctgctcctcctctccgagtgagccctcgcgtcgcggccgccggtcgcccctttggtgaacgccccggcgaagagtacgttgcaatcaggagtggtgaacggcgatgcgtacgggcagtgagccgacgaccgcgcgcagtgctctgcgggcgcggttctggctgagcctgtgggggctggtctgggcgatcttcggcaccgtcgtgttcgcactgctcggacagcccgggtgggcggccgcgtgcggtgtgctgtgtctggtgatctccgtcgacttcacgatcatcgtccggcacatgcggcagggtccgcactatcagccgggccgtgacgtcccgccgtaccggccgcctgaggggtgggaccggtagccggccgaggtccgcccgcggatgcccggcggcgaggcgcggtcaggtgtcgaacctggcgcgctgcaggtactccgggttcgggtccagcgcggccgccagccggaagtgacgcttggccaggtcgggtcggccctgccgctcgtaggtgcggcccagtgcgaagtgcgcgaacgcgttgtcgggctcccgctccagcacgatggtgaactcgagttcggcgggtctcagttgcgccgcggcgaagaaggcacgggcgcgcagcagtcgggccgccgtgttctcgggatgcgcggcgatgactccgtcgagcagcttcaccgcgccccgtgggtcccgcgcggcgagcagctgttcggcggcgcggaagtcgatgacatgcgtctccggggtacgtccgggtgaaccgctggtctcgggcacggcagagtccttcccttgctgggagggttcaacgccccggcgggacaaccgtattccggcggccttcgcgtgcgtagcgcggcgtggagctatggccgggtgtcggcgggcggggtgtgcgcccggtggaccagttccgtccagacctcccgcacccgctgcctcagctgctcgagcgggacgtcgttgtcgatgacgatgtcggcgatctccaggcgtttctcccgggtggcctgggcggccatgcgcgcgcgggcgtcctcctcggtcattccgcgcagccgtacgagccggtcgagctgggtccgggggctcgcgtcgacgacgatcacgaggtcgtacagcggccccaggccgttctcggtcaggagcgggacgtcgtggaccacgacggcgtcctcgtcggcggcctcttccagccggcgtgagcgggcgcccaccagcgggtgcacgatcgcgttcagcacggcgagccgctcggggtcggcgaagacgacggctcccaggcgggggcggtccaggctgccgtccgcggtgagtacctcctcgccgaaggcgtcgacgaccgcggcgaggcccggggtgcccggggcgaccacctcgcgcgcgatgcggtcggcgtcgatcagcaccgcaccgcactccacgagcagccgcgacacctcgctcttaccggctccgatgcccccggtcaggcccaccttcagcatggccgcagcttaggccctggcttcgctggccggcccggcgggcgtcagttctcgccctcccgctcggccaggaagcgttcgaactcacgcccgatctcgtccgccgacgggatgtcgacgggctcggcgagcatgttgccccgggtctcggcgcccgctgcggcgtcgtactggtgctccagtccctgcaccagggaggtgagttcttcgtcgccctcacggatctgccggtcgatctcggtctgcgtgcggtgggcgtcgttgcgcagggagtgggccacgctcggcaggaccaggccggtggcggccgtgatggcctccagcacggtcagcgccgcgtcggggtacggggagcgggcgatgtagtgcgggacgtgagcggcgacgcccaggacgtcgtgtccggcctccatcagccggtactccaccagtgcctcggcgctgccggggacctgcgcctcttcgaaggggctgcggtggcccgggacgaggtcgctgcggttgccgtgcggggtgaggccgaccgggcgggtgtgcgggacgcccatggggatgccgtggaagttgacggccaggcgcacgccgagccgctccacgatctcccgcacggcggcggcgaagcgctcccactcgacgtccggttcggggccggacaggagcaggaacggcgctccggtggcgtcctggaccagacgcacctcgatcgtcggttcctcgtacgcggtccagcggtcacgcttgaaggtcagcagcgggcgacgggcccggtagtccacgagccggtcgtggtcgaagcgcgccacgagctggtggggcagggagtcgagcagccggtcgacgatctggtcgccgctctctcccgcgtcgatgtatccgtcgaagtggtagagcatgacaagcccggccgactcctgtgcgagcgccatgtcgacgaccgccaggcccttcggctcccatgcgtacaaaccctgcggatcaagcactgtgaccgcccctcctcgtgttcgtaggttcacaacgaggagcgggacgcgggcattccccgacggggcgcatgagacacccggatcttgggacgggcggcaacagggtgacgtgacggacggcaggggcctgacgcagatcgcggtgaccccgcaggcgtgcgcgggacgctcccgcggacacggctgcgaccggtggacacgactgcggcccgtacccccacacggggagtacgggccgcggtcaacggctagcgcctagcaggcgcagcggtgagcggtcagctctggccgccggccagcttctcgcgcagggccgccagggcctcgtccgaagccagcgcaccggaggtgtcgccgccctcggaggagtacgaaccgccgccggacgcggccggagcggcagcctcgccaccctcggcagccgcctgggcgtccgcctcgcgggacttgatgacctgcgcctggtgctgctcgaagcggctctgcgcctcggcgtactggcgctcccactcctcgcgctgcttctcgtagccctcgagccagtcgttggtctcggggtcgaagccctcggggtagatgtagttgccctggtcgtcgtaggacgcggccatgccgtacagggtcgggtcgaactcgaccgcggacgggtcggcaccgaaggactcgttggcctgcttcagcgagaggctgatgcgacggcgctcgaggtcgatgtcgatgaccttgacgaagatctcgtcgttgacctggacgacctgctccgggatctccacgtggcgctcggccagctcggagatgtggaccagaccctcgatgccctcgtccacgcggacgaacgcaccgaacggaaccagcttcgtgaccttgccgggcacgacctggccgatctggtgggtgcgggcgaactgctgccacgggtcttcctgggtcgccttcagcgacagggagacgcgctcgcggtccatgtcgacgtcaaggacctcgaccgtgacctcctggccgacctcgacgacctcggaggggtggtcgatgtgcttccaggacagctcggagacgtggaccagaccgtcgacgccacccaggtccacgaaggcaccgaagttgacgatcgaggagaccacaccagagcggacctgacccttctggagggtcgtgaggaacgtctggcggacctcggactgggtctgctccagccaggcacggcgggacaggaccacgttgttgcggttcttgtccagctcgatgatcttcgcctcgagctccttgcccacgtagggctggaggtcgcggacacggcgcatctcgaccagggaggccgggaggaagccgcggaggccgatgtcgaggatgagaccacccttgacgacctcgatgacggtaccggtgacgatgccgtcctcttccttgatcttctcgatggtgccccaggcacgctcgtactgggcgcgcttcttcgagaggatcaggcggccttccttgtcctccttctggaggaccagggcctcgatctcgtcgccgacggcgacgacctcgttcgggtcgacgtcgtgcttgatcgagagctcgcggctcgggatgacaccttcggtcttgtaaccgatgtcgagcaggacctcgtcccggtcgaccttcacgatgacgccgtcgacgatgtcgccgtcgttgaagtacttgatcgtctcgtcgatcgctgcgaggaatgcttcctcgttaccgatgtcgttgaccgctacctgcggggtggtggcggtggtctcggtgctgctcgtcatgtgggaaagggctccggtacggacattgaagtcgtaggtactgcttacgccgggagcccgtttcgctctgcagaagccggacagccaaggaagcaccccatgaaaccgctggtggcgcctcgagaaccgaggggacatacaacagatgcgagcgcagcctgctccgtctgaggcgcgcaggcccgcagcgcaacttgtagcatacgggggcagccgggcatggtcaatgcgcgaagccgcacacccagggcagaacgcgcattcccggcagagaacctgtctcccgaagcccctgccggcacccggacgcccactgcgggcgcgcaccggtgagggctgcacggaagagccgcagattagtacgagggagccgatcatccaagagcccgaactgcccgagcccgaggccacccgccgtgcggcctcggtcaccgagagcgcccgcgccaaccggggctggtgggaccggaacgcggacgagtaccaggtcgagcacggcacgttcctcggcgacgaccgcttcgtgtggtgccccgagggcctggacgaggtcgaggcggaactcctcggcccgccggaggagctgaagggcaaggacgtcctggagatcggcgccggcgcggcccagtgctcgcgctggcttgccgcccagggcgcgcgcccggtcgcactcgacctctcccaccgccagctccagcacgcgctgcgcatcggcggcgccatccccctggtgtgcgcggacgccgccgtgctccccttcgccgacgcctccttcgacctggcctgctcggcgtacggggcgctgcccttcgtcgccgacccgcggctcgtgctgcgcgaggtgcaccgggtgctgcgcccgggcggacggttcgtgttctcggtgacgcacccgatccggtgggccctgccggacgagcccggcccggaggggctgtcggtgtccgcctcctacttcgaccgcaccccgtacgtggagcaggacgaggacggccacgcggtctacgtggagcaccaccgcaccctcggcgaccgggtccgggacatcgccacgtcgggcttccgcctggtggacctggtcgaaccggagtggcccgactggaacacctccgaatggggcggctggtccccgctgcgcgggcacctgatccccggcaccgcgatcttcgtctgcgagcgcgactgaccactcgcgaccgaccgcggccggtaccttccgtgaacgccccgcacgcgcgcgcgtgcggggcgttcgtccgcccgtacgacaccaggagcgcccgtacgacactagggggcgtgatccgttacgacgccctggacgcactgcccgtacgcacggccctgcccgccctcgacgacgcgctcggcggtcacggcgccgccgtcctggtggcaccgcccggcaccggcaagac

SEQ ID NO: 415 - DNA, 1279 bp, Unknown
  Kingdom: Bacteria, Phylum: Actinobacteria, Class: Actinobacteria, Order: Streptomycetales, Family: Streptomycetaceae, Genus: Streptomyces
ggctgtcgcggcacgccgagcttctccatggcaccgcgggcgcactcccgcacggcggcgaactcacggcgccgcttggcgaccgcccgcgccacgaacgcctcttcctcgggatacagcgtggcggggccggcctgctcgacgccgtacgtctccaccgtcaccaccggctccggcagcagctcatcgatcaccggtcgtgtcctccatcggcatcggcagcacgctgcgcagtctgcccggcggtccggggcgcttgcgccactcgcgggggtatcccaccgacacctcctcgaagcggacgccctcgtgccaggtggtccgcggtatgtggaggtgaccgtagaccatggcggccacgcggaacctgcggtgccagtccgcggtcagacgcgtgccgcaccacatggcgaactcggggtaccagagcacgtccatcggatgccggtcgagcggatagtggttgacgagcacggcgggcaggtccccgggcagcgcgtcgagccggcgctcggtctcggcgacccgcgcccggcaccacgcctcacggctcgggtacgggtcggggtggagcaggtactcgtcgttgcagacgatgccggtgtcgtgcgcgtaggcgaggccgtcctccttggtcgcgcagccctgcggcaggaacgagtagtcgtacaggaggaacagcggcgccacggccaccgggccgccgggtcctgaccagaccgggtaggggtcctcgggcgtcgtcacgcccaggtcccggcagagttcgaccaaatgctcgtagcgtgcgaccccgcgcagggtgacggtgtcgcgcgggtgggtccacaactcgtggttgcccggggcccagatcaccttgcggaaacggccggcgagcgtcttcagcgcccagcggatgtcggtgacggtctccgcgacgtcccccgcgacgatcagccagtcgtcgtccgagccgggcaccatccgttcgaccagggcccggttctcgctgtagctgatgtgcaggtcgctgatggccagcagtcgtccggcaccaccgtccgtcgccgtcacctctgccccctgtcacccacccgatgcacaccacaacaacacacccggccgcgtccggacaaggtcaggaccggcatccggccacggcggtggccggaaccggcgtacgcgcacggccgtcgcagcactcccggattttttctgcggattttttcccggcggggtgtatcaggccccgtatcagcgactctcaagggtggggacgcggggagcacgggggaac

SEQ ID NO: 416 - DNA, 4016 bp, Unknown
  Kingdom: Bacteria, Phylum: Actinobacteria, Class: Actinobacteria, Order: Streptomycetales, Family: Streptomycetaceae, Genus: Streptomyces
acggccccacggcacggcggccgggcctgcgcctacgatggccctgctcatcgatcagccgatcacccgcgccgcgcgcccccgggccccgcggcgccgttcccggggagggacaccttgaccgacctgcacgcaccccgcgatccgcacgccttcatcgccggactgcccaaggccgaactccacgtgcaccacgtcggttccgcctccccgcggatcgtctccgagctggccgcccgccaccccgactccaaggtgcccaccgaccccgaggcgctggccgactacttcacgttcacggacttcgcccacttcatccaggtgtacctgtcggtcgtcgaactcatccgcaccccggaggacgtccggctgctgacctacgaggtggcccgggacatggcccgccagcaggtgcgctacgccgagctgaccatcacgccgttctcgtccacccgccgcggcatcgacgagcgggcgttcatggacgccatcgaggacgcgcgcaaggcggccgaggccgacttcgggaccgtgctgcgctggtgcttcgacatccccggcgaggccgggctgctgtcggccgaggagaccgtccggctcgccaccgacgaccggctgcgccccgagggactggtgtcgttcgggctcggcggccccgagatcggcgtgccccggccgcagttcaagccgtacttcgaccgggcgatcgccgccggactgcactccgtgccgcacgccggggagaccaccggacccgggacggtgtgggacgcgctgaccgagctgcacgccgaacgcatcggccacggcaccacctccgcccaggacccgaagctgctcgcgcacctcgccgagcaccgcatcccgctggaggtgtgcccgacctccaacatcgccacccgggccgtgcgcaccctggacgagcacccgatcagggagttcgtgcgggccggtgtgctcgtcaccgtcaactccgacgacccgccgatgttcggcaccgacctcaacagcgagtacgccgtcgccgcggggctcctcaacctggacgagcgcggcatcgccgagctggccaagaacgcggtgcacgcctccttcctcgacgaggcgggcaaggcgcggatcgccgacgagatcgacgcctacaccgcccggtggctcgcgccctgaccgggacacggcacggggtacggcccgggacacaatggggcccatgcagaccgtgacggccgtggcgcaccgcggcgacccctaccgcttccgcgagaacaccatcgcctcgctccgctccgcgctcgaccagggcgcggacgcggtcgagatcgacgtacggctgacccgggacggtgttcccgtgctgctgcacgacgactcgctgaagcggttgtgggcgcacgagcggatgctgcggtcgctgtccgccgaggaggtgcgcgggctcaccgacggccgggtgcccacgctcgtggaggcgctggcggcgacggagggccaccgcgtgatgatcgacctgccgggggcgccaggaccgcgggcggtgcggatcatcgccggggtggtgcgtgactgcggggcgcaggaccgtgtctactactgcgcgggcgccgaggcgatgctcgcggtgcgggcggcggaaccggccgcggagatcgccctgacgtggacgtcgctggcgccgccgcgggccggactgctggacgcggtgcggcccaagtggctcaactaccgtttcggcctggtggaccgggacctcgcggcccgggtgcaccacggcggccacctgctgtccgtctggaccccggacacccgccgctcgctgcgccgtctcctcgccctgggcgtcgactcgatcacgacgaaccgcgtcgacgtgctgtgcgcgctgcgcggccggggcgactttgccggcgtcaggacggtgtgacgaggcgtacgtcctccacgcccagcaggccgagcagcggcacgttcccggtgtgctgcccggggtcgaccacgaggccggcgccccggacgaggtccaggaggagctcggcgagcggcatgaccatgtgccggccccagcagcgttcggaggagtggccgaagggcaggtagccgggggtgttgtccgggtcgagcgtgtcccagcgctccgggcggaaggtctcggggtcctcccacagcgccgggtcgcggtgggagagcagcggcagcagcaggacgtcgtcgcccgggccgatccggtcgtcgagggccgggtactccggtgaggcgttgcgcaggatgttccaggagggcggcagcaggcgcagcgactcgtggatgatgttgcggttggacatgccgtcctcgaacggtgcgccgagccagagcgcgttggccaccagggtggagacggtgaagcacaccggggcggcggccctgcggtacatgcccatggcgtaccggcgttcctggtagcccgtggcgttcgccgcccgctcccccagcccggtgaaccgtccgctgccggggcggggccagcccgggagggccgcgccgacggcgatcacggaccaggtgagtttcgtggtgagttcgaggttgcggctcatcagcatgcgcagccggtagggatcctgacggaggatcaggtcgcgcaggaacaggtgcccggtcaggggccaggagccggcgaggtccacgccttcgggcagcggcctcttcagcgcctcgcgtacgtcgttgccgatggtccgggtgaccgatgaggcctcggtgcgcgagatcgaccggccgtgcagcggtttgaacgtggggcgttcggtctccgtggcgcgccgggcggcgaggatccggtccgcgacctcgggtccggcgacgccgatggtgtcgggttcgagccggaagacgtcctggccgaggtggtcgtcgaggagggcggcgagccggggggcgaggacggtggtgcgggtgcgcggcacggatgacaggggcatgggttctccgggaaggcggtgggatccgggacggtgcccccgccgccggacaacgatgtcttcgcgtccgtgcggcgggggcgaaccggatcagtaccagaggtaccaggcgctggccttcaggctcttgcgggccgagaccttgttgcggacggcgaagagaagcttcatgggtgtacttcctctctggtggggctggggcacacgaccgtccggggccggtgttccgggcggacccggagaacccgtgaagatcgcgtgcggtggctcggagagcactgcccaggatgacgaccggataatcaccacactgtgcacagtgttggccgactgctcggtacggctacacagtgcactgcccgccggtccggacggggttcacctgcagcgcctccagccgcctgatgcgcctgcgcacgtcgtacagcgggatgatgccgaacaccccgaaggacatgtcgatcaccgtccaccagaacgggatgccccgcagcggcccgcagacgagggcgagcgggacgatgccgacgcacgcgatcatcccgaactccacgacccaaatgttgcgcaccgggtcgcggtaggggccgtagaaggcgaccgcgatgacgaggtgggcgaaggccagccagtccgtgccgtacagcaggaacgggtagtcggcgtcggcggtgtcgagcccgtgccgcacccgctcgatccagccggcgagcgccggcaggtgctcgggcacaaagagggcgcgcaacacgctgtcggcccagtgcagttcgtggacgagcgggaaggcggtggccccgctgagcacgaggcagacgacgaacacgaccagccggacgcggatgcccttcagcagggcggctctgtcgctcatggcaggagcgtacgccggtcttgaacgcgttcaaaacctggggtcggctggtcgcctcaggaaggacctcggcttgactgaccgtcaatagggtcgcttggcaaacgctttggtcagcgcggtcggcgcagcacccgacgtgccaccgcgtgcgacacgaccgtcgccgcactcggctgcgcggg

SEQ ID NO: 417 - DNA, 3326 bp, Unknown
  Kingdom: Bacteria, Phylum: Actinobacteria, Class: Actinobacteria, Order: Streptomycetales, Family: Streptomycetaceae, Genus: Streptomyces
gcaggaggcgctgcgcggcttccaggtgcgcaagtcgctggagcccgccttcacccagctcgccctgaacggcgccggcggccccctcgccgacgaacgcgtccggcacgccgtggcgcacgccctgaaccgcaaggaactcgccgagatcgtcctcaagccgctcggcctgcccgcgacccccgtcggcagccacctcgcgctgtccggtcaggccgactacgccgacaacagcgacgcgctcggcggccaggacaccgcccaggccaaggcgctgctcgccgacgccggctgggtggccggccagggcaaggcgcagaagaagggcgacaaggcggcgggcgccgagagccacaggggcgcgagcgggtcgccggacgcctcgggcgacggggacagcgacggcacgtacatcgtcggtgtcaacgacaacatcgaggacaacggcgacggcaagggtcacgcacggagcggtcaccggacgtccggtgacgacgagaacggcaaggaccgcgccggcgacggcagcggctcccggcagctcgcccaggacggcaggcactacgcgcgcgagcagctcacccagggcggtgcgcccggcgcgtacgccccccggggcaccgccgccccggccggttccgtggccgggccgctggccaaggacggcaagccgctcacgctccgcttcgtactgccgtccgggcccggttccgacacgctgcgcaaggtcgccgaccggatcacggtcatgctggagaaggtcggtatcgccaccgacatcagcaaggtccccgacgacagctacttccgcgaccacatcgccgcaggacagtacgacctggccctgtactcctggccgtcctccgcctacccggccaccgacgcccgcccggtctacgccaagcccctcccggccgccgacggctcgctgaacgtgcagcagaactacacccgcgtcggcaccgaccaggtcgaccagctcttcgccgaggccatcgccaccctggacgagggccagcagcgcgacctggtccgcaaggccgacgcccggatctgggccggcgccggttccatccccctctaccagcggccccagctcgtcgccgtccgcgccaacctggccaacgtgggcgcgttcggcttccagacgccggtctacgaggacatgggcttcctgcgcaagggcgcgaaggcgacggcgagcgcgtcgtcgtagcgggcctcgcggcggggccgcgaccggggccgaacggccccgcaggcccccgcggcggcgcacccgtaccatggggtgaggccgtggcgtgttcagcccggcagggcgcgcgtaccgaggacgtacgcgcagccgtccgcacactccgggagtacgcctcactatggccacgcgccacgacattcgaaacgtagccatcgtcgctcacgtcgaccacggcaagacgaccatcgtcgacggcatgctgaagcaggccggtgccttcgccgcccaccagctcgactccgtcgacgaccgcatgatggactcgaacgacctggagcgtgagaagggcatcacgatcctcgccaagaacacggcggtgaagtatcaccccaaggacggcggggaccccatcacgatcaacatcatcgacacccccggccacgccgacttcggcggcgaggtcgagcgcggtctgtcgatggtcgacggtgtggtgctcctcgtcgacgcctccgagggcccgctgccgcagacccgcttcgtgctgcgcaaggcgctccagcagcgcctgcccgtcatcctgtgcatcaacaagacggaccgcccggactccaggatcgacgaggtcgtcaacgagacgtacgacctcttcctcgacctggacgccgacgaggagcagatcgagttcccgatcgtctacgcctgcggccgtgacggcatcgcgtccctgaccaagccggacaacggcacggtcccggccgactccgacagcctggagccgttcttctccaccatcctggagcacatcccggcgccgacctacgacgaggaactgccgctgcaggcccacgtcaccaacctggacgcggacaacttcctcggccgtatcgcgctgctgcgcgtggagcagggcgagctgcgcaaggggcagacggtcgcgtggatcaagcgcgacggctccgtgcagaacgtgcggatctccgagctgatgatgaccgaggcgctcacccgcaagcccgccgagaaggccggccccggtgacatctgcgccgtcgccggcatcccggacatcatgatcggcgagacgctggccgacccggagaacccggtcccgctgccgctgatcacggtcgacgagcccgcgatctccatgaccatcggcaccaacacctcgccgctggtcggccgtggcggcaccggcaagggcgccgacgcgaaggcggccgtcaaggaccgcaaggtcaccgcccgccaggtcaaggaccgtctcgaccgcgagctgatcggtaacgtctcgctccgcgtcctggagaccgaccgccccgacgcctgggaggtccagggccgcggcgagctggcgctggccatcctggtggagaccatgcgccgcgagggttacgagctgacggtgggcaagccgcaggtcgtcaccaaggaggtcgacggcaagacctacgagccggtcgagcgcatgacggtcgacgtgcccgaggagcacatgggcgcggtcacgcagctcatgggcgtgcgcaagggccggatggacaacatgtccaaccacggctcgggctgggtccgcatggagtttgtcgtgccctcgcgcggtctgatcggtttccgcaccgagttcctgacccagacccgcggcaccggcatcggccactccatccacgagggcttcgagccctggttcggcacgctgacgacccgtaacaacggttcgctggtcgccgaccgcgccggcgccgtcaccgccttcgcgatgaccaacctgcaggagcgcggcgtgctcttcgtggagccgggcaccgaggtgtacgagggcatgatcgtcggcgagaactcgcgctccgacgacatggacgtcaacatcaccaaggagaagaagctcaccaacatgcggtcctcgacggccgacgtgaccgagtcgatcgtcccgccgcgcaagctctccctggagcagtccctggagttctgccgcgacgacgagtgcgtcgaggtgaccccggaggcggtccgcatccgcaaggtgagcctggacgcccgcgagcgcgcccgcgcggccagcagggccaagcacggctgaggccgcttcggcgggtgacaccgcagacgcaggggcccg

SEQ ID NO: 418 - DNA, 2539 bp, Unknown
  Kingdom: Bacteria, Phylum: Actinobacteria, Class: Actinobacteria, Order: Streptomycetales, Family: Streptomycetaceae, Genus: Streptomyces
gatgttggtcttcaccgagccgaggcgcagtggacggcggaccgccgggtcttcgcgcagtacgccggccagggtgcgcagttcgacctcgtcgccgaccctggtgccggtgccgtgggcctccacgtagtccagctgtccgggggtgatgcctgcgctgcggcaggcggcgcgcaccatgtgggcctggcccggtacggcaggctgcagcagcagtccgctgccggcgccgtcgttggtcaccgcgctgccgcgcagcacggccagcaccgggtcgccgtcacgcagcgcgtcgtcgagccgcttgagcaggacggcgcccacgccctcgctgcggacgaatccgtcaccggaggcgtcggcgaacttgcagcggccgtcgggggcgagcatgccgccctgggagtaggtgacggcgtcgccggcggacaggatcgcgttcaccccggcagcgacggccaggtcgctctcgccgcacagcaggctctgccgggcgaggtggaccgccaccagcgacgacgagcaggcggtgtccaccaccacgctggggccgcgcaggtcgagggcgaacgacacccgccccgcggtgaccgcgcgcagccgggcgcccgccatgccgtgtacgtccaggggccggtcgccggcctggtcgccgtagtccgcggtggcctgtcccacgaacaccccggtggtgctgccggccagggacgacgggcggatccccgcctcttcgagcgcctcccacacgacgtgcagcaggagccgctgctgcgggtccatggcgagcgcctcgcggggggcgatgccgaagaaggcggcgtcgaagccgtacaggtcgtcgaggaagccgccgtgccgggagacggtgcgtcccggctcccccgggtggggcgcgtagtggggctgtatgtcgaatctgtcctcgggaaccggtatgacggcgtcggtgttgtccaccagcagccgccagaactcctccaccccgccggctcccgggaatcggcaccccattccgatgaccgctacctgcgctgcgccgctcacgcacatccccctcgtaatgccgtgcgtccaaagatagacctcaggctaacaatgacctggaccggatcaggtgacggcgacatgacggccgggcgacgggcgcatgatccgggggcgaaggagggtcaaaagcggccatattgacgacttgttgaccacacatcggcgctccatgcagccgcatccacgctactgtggaagtaaagctggccttgagtacatcaataaactggtgcacatggacaggggtgacgtccggtcaccggcgaaggaggaatgacccatgatcgccagagtgctcggaccgctccgggtgacggtgaacggcacctcggtggtccccacagcggtgaaggcgaggaagctgatggcgatgctcgtcctcaaccgggggcgggtcgtgcagcgcgccacgatcgagcgggaactgtgggacctggacgcgcccagaagcgcctccaccgggatccagaactgcgtgatgtggatccgcaagggcatcggatgtgccgagcggggagagccgggccgtgccgcccggcagacgctggtcacggagcccaccggctaccggctggaggtgccgggagaccagttcgacgtggtccgccatcagcggctcgtggcccaggccggtgccgccgaggcgcacggggacctggccgaggcctctgccctgctgaccgccgcgctgaacctgtggcgcgacgccccgctcgccgacgtaccggcgggcccggtgctgcgggtccacgtacggcgcctggaggaggaccgcaaggcggtactggcccagcgcctcgccctggacctgcggctgcaccggtacgccgaggtcgtcggcgaactccatgcgctggtcgccctcgacccgtacgacgaggtgctccacgagtacctgatgctcgcgctgtacctctcgggccgtcgcaacgacgcgctcaccgcctaccagcaggcccgcaccgcgctcgccgacggcgtgggtctggagccttcgcaccggctgcgcgtgctgcaggaacggatcctggccagcgacgaggctccggcctcagccctgccgggccggccgggcctcgtgccggagcccgtcagagtgtgagggagaggtccgcgcgatgaccgggccgctggagggacgcggcgagttcctccagcaccatcgcctggccacaggccgtgaaggggaggaagtggccgccctcggccgaccgcgaccggaacgggccgctggtcaggcgtgcccacagcggcagggcggggagcgggacgagcgggtcccggtcgcccgccaacgcggtcagcggtacgccggcacgcaccgcgtcgaccgcgagcagggcttcctgggtcagcgccaggtcgtgggcgagggcccggcgcgccggcgacagggaggggtcctccagagcgtcggcggccagccctcctcggcacccccgcgggcttgacacgtgtcctcgcgctgcacgggctggccgccgacgctctg

SEQ ID NO: 419 - DNA, 1619 bp, Unknown
  Kingdom: Bacteria, Phylum: Actinobacteria, Class: Actinobacteria, Order: Streptomycetales, Family: Streptomycetaceae, Genus: Streptomyces
gacagctgcgggacggccgcgccgcaggcggcgaccagcggggcgagcggcagggtgatcttgtcgccgacgccgccggtggagtgcttgtcggcggtgggccgggacagcgaggagaagtccatgcgttcgccggaggcgatcatcgcggcggtccagcgggcgatctcccggcggtccatgccgttgagcaggatggccatggcgagcgcggacatctgctcgtcggcgacctccccgcgggtgtacgcgtcgatgacccagtcgatctgctcgtcgctgagtccgccgcggtcccgcttggtgcggatgacggagatggcgtccatggccatggcgttcgtttccttccggggtgcgaagggtgttcccgagggtgcggcccctgcgcgccacggtgggcgcggaggggccgcacgggacttacttggcgagatggtccggcccgaaggcctgcgggagcatctcggacagcggcaggatgcccgccggggtctccagcagcaggtccggcccgccgaactcgtacagcagctggcggcagcgcccgcacggcacgaggatgtcgccgttgccgtccacacaggtgaagtgggtcagccggccgccgccgctgttctgcagctgcgagaccagaccgcactcggcgcacaggccgatgccgtaggaggcgttctcgacgttgcagccggtgacggtgcggccgtcgtcgaccagggcggcgacgccgaccgggtagccggagtagggggcgtaggcccggctcatcgccgcccgcgcctgctcgcgcagggccgcccagtcgacggccgtcgcgtccggtgtcacttgccctgtcccttccggtagcgcagtccgtcggccttgggcatccgcagccgttgcgccgacagcgacagcaccagcagggtgacgacgtacggggtggcaccgacgaagtcgctcggcacctcgtccgtgaacaggtaccagagcaggacgagcacggccatgacggcactgatcacaccttgccacagcgccttgcggtagagcttccagccggccagcgcggcgagcagcacgaccaggaggagcagcagcgcgtggacggtctcgccgccgttgcgcagctgcagcgcgtcggagaagccgaacaggcccgcgcccatcgcgaggccgccgggacgccagttgccgaagatcatcgcggcgaggccgatgtagccgcgcccgccggtctggccctccaggtaggtgtgcgaggtgaccagggccaggaaggctccgccgaggccggccaggccaccggagacggccacggccgcgtacttgtacgtgtagacgttgacgccgagcgactcggcggcgaccgggttctcgccgcaggagcgcagccgcagaccgaacggggtgcgccacagcagccaccagctgccgccgaacagcagcacggccaggatcgtcaccacggacaggttggtgaccaggccgccgatgatgccggcgaggtcggagaccaggaaccagtggtgcttctccagcgaggccaggccgtcggagaggccgggcacggtgacgtgcggcagggcgtcggcgggcggcgactgcttggggttgccgcccgccgacgccctgcc

SEQ ID NO: 420 - DNA, 537 bp, Unknown
  Kingdom: Bacteria, Phylum: Actinobacteria, Class: Actinobacteria, Order: Streptomycetales, Family: Streptomycetaceae, Genus: Streptomyces
caccgaggccgccgaggaagtagttcaccgcgacggggctgttgtacaggttccacggggtgatgacgaggccgatgccggcactcaccaggccggccttgcggaagtcgagccgccgggggaacaggttgaccagggcgtagatcggtgccacgaagttggccagcaggttcaccgcgacggtcagggcgatcagcgcgagcgaggcgacggccagcaggaacatgttcgggatggtcctgacgatgtccgtcgggctggtgatgatgtgtccgtcgagcttgaactgggctccgctgaggaccgctacgatgcaggcgaagaagagcatgttcaccgggatgccgatgacgttgccgcggacgatggagccacggctgcgcgcggagcgggtgaagtcgcagaagttgaggacgaacgtcccgtagatcaccacccacagtgcggcggcctgcaggacctggagccacatcgcgccgccggtcagcggcttcccgtcgtcgagcgagatcgagccgcccgcgcggacgaacatcc

SEQ ID NO: 421 - DNA, 2261 bp, Unknown
  Kingdom: Bacteria, Phylum: Actinobacteria, Class: Actinobacteria, Order: Streptomycetales, Family: Streptomycetaceae, Genus: Streptomyces
cgtcgggcacctcgcgcgggtggccgccggtcgcgatcagcaccgcgtccgcggtgagcgtctcctcgctgccgtcggccgtggtgacgacgaccttgcgcgacccgtcgagcgcctgcatgccctccaggcgcccgcgcccgcgcatgacccgggcgccggcccgcgtcacggaggcggtgatgtcgtgcgactgggcgagcgcgagccgcttcacacgccggttgaccttgcccaggtccacaccgaccacccgggcggcctgctccagcggcggggtgtcgtcggcgacgatgatgcccagctcctcgtaggaggagtcgaaggtggtcatcacctcggccgtggcgatgagggtcttcgacggcacgcagtcggtcagcaccgacgctccgcccagaccgtcgcagtcgacgacggtcacctccgcgccgagctgagcggcgaccagcgccgcttcgtatccgccgggtccgccaccgatgatcacgatccgagtcacgtactccattgtcccgcactcctcaagatgctcctcgccgggggcaccgccggcccgccaccagggacaggagggactcctgttacggatgagccgcccgcgccgctgccgtacccttcgacacatgtcgctctacgccgcgtacgccggcaatctcgacgcgcggctgatgtcccgccgcgctccgcactcgccgctgcgcgccacgggctggctgaacggctggcggctgaccttcggcggcgagcacctgggctgggagggcgccctggcgaccctggtcgaggacccgctctcccaggtcttcgtcgcgctctacgacatcgccccgatggaccaggaggccctggaccgctgggagggcgtcggcatggagatctaccggcgcacgcgggtacgcgtccacacgctggacggcgaggagaaggcctgggcgtacgtcctggacgcctacgagggcggcctgccctccgcccgctacctgggcgagatcgcggacgcggccgagtccgcgggcgccccccacgactacgtgatggaactgcgcaagcgcccctgctgagcgaccggcccgcgcaccagtcgtcggaaacgacaagacaacgatcgcgatcccgtgagctccgtcatctacgcgcgtaggcgaattccggctaccctcgtccgcgtgaacgcatctcttcttccggacgacatccagggcgacccttacgccgccgccgacgccgccgccacgcgcctgcgggaactcaccggcgcggagacccacgacgtcgccctcgtgatgggctccggctgggcaccggccgtcgacgccctgggtacccccgacgccgagttccaggtcaccgaactgccgggcttcccgcccccggcggtggagggccacggtggcaggatccgctcgtacaacacgggcaccaagcgcgccctggtcttcctgggccgcacgcactactacgagggtcacggcgtggccgccgtcgcccacggcgtacgcaccgccgtcgcggccggcgtcaagacgatgatcctcaccaacggctgcggcggcctgcgcgagggaatgcgccccggccagccggtcctgatcaacgaccacatcaacctgaccgccacctccccgatcgtcggcgccaacttcgtcgacctgaccgacctctacagcccgcgcctgcgcgccctgtgcaaggaggtcgaccccaccctggaggagggcgtctacgcccagttccccggcccgcactacgagacgccggccgagatccgcatggcccgcgtcatcggcgcggacctggtcggcatgtccacggtcctggaggccatcgccgcccgcgaggccggcgcggaggtcctcggcatctccctggtgaccaatctcgccgcaggcatgacgggcgagcccctcaaccacgaggaggtcctccaggcaggccgggacagcgccgcccgcatgggctccctcctggcccaggtactggaccgcctgtaacccagcgacgccaccggggatcccacagccgcgcacggcgaaccggaaaggcaaccgaaggcggagcccgaaccggtagccgcacacggcgccccggaaaggtgaccgggaacagggaacgagccgtttgccgcgtacggcgggaaggggacgtgtcggggggtgtccgcccgcagcggttggcgcgtcaacgccgggtaccgcacaaacacccgattccgcgccgttccgaggacggacaccccccggcgcggaatcgggtgtttg

SEQ ID NO: 422 - DNA, 11023 bp, Unknown
  Kingdom: Bacteria, Phylum: Actinobacteria, Class: Actinobacteria, Order: Streptomycetales, Family: Streptomycetaceae, Genus: Streptomyces
cgccgttggggcaggcggcgacgcaggcgccgcagccgatgcactcggcgtgctcgaaggcgaagtcggcgtccggcttcggcacgggcgtggcgtgggcctcgggcgcggcgccggtgggggcggtgatgtagccgccggcctggatgatccggtcgaaggccgagcggtcgacgaccaggtccttgacgaccgggaaggcggcggcccgccacggttcgatgtcgatggtgtcgccgtcctggaaggaccgcatgtgcagctggcaggtggtggtgcgctcggggccgtgcgcgtcgccgttgatgacgaggctgcacgcgccgcagatgccctcgcggcagtcgtggtcgaaggcgaccgggtcgtcaccggcgaggatgagccgttcgttgaggacgtccagcatctccaggaaggacatgtcgggcgagatgccgtccacctggtaggtggacatggtgccgtcggcgtcggcgttcttctgccgccagacgcgcagggtgagcttcatgcgtagctccgctgggtggggtggacgtactcgaagaccaggtcttccttgtgcagggtgggggcctcgccggtgccggtgaactcccaggcggcggcgtagccgaactcgtcgtccctgcgggcggcctcgccgtcgggtgtctgggactcctcgcggaagtggccgccgcaggactcggcgcggtgcagtgcgtccaggcacatcagctcggccagttccaggtagtcgacgatgcggttggccttctccagggactggttgaactcctcgccggtgccgggcaccttgatgcgccgccagaactcctcgcggatctgcgggatgcgctccagcgccttgcgcagtcctgagtcggtacgggccatgccgcacaactcccacagaagttcgccgagttcacggtggaaggagtcgggggtgcggtcgccgtcgacggcgaggagcaggttgagccggtcctcggtctcggcgagcacgtcctgcacgacggggtggtcgggggtgaccggctcctggtggggatggcgggccaggtagtcgttgatggtggccgggaggacgaagtagccgtcggccaggccctgcatcagcgcggaggcgccgaggcggttggcgccgtggtcggagaagttggcctcgccgatcgcgaacaggccggggatggtggtctggaggtcgtagtcgacccacaggccgcccatcgtgtagtgcacggcggggtagatccgcatgggcacctcgtacgggttctcggcggtgatccgctcgtacatgtcgaagaggttgccgtacttctcctcgaccttcttccggcccatccgctcgatggcgtcggcgaagtccaggtagacgccctggccgccggggcccacgcccctgccctcgtcgcagacgttcttcgcggcgcgggaggcgatgtcgcgcgggacgaggttgccgaaggaggggtagatgcgctccaggtagtagtcgcgttcgtcctcggggatctcgttcggcgggcgggtgtcgcccttggccctgggcacccagatgcggccgtcgttgcgcagcgactcgctcatcagggtcagcttggactggtggtcgccggtgcgcgggatgcaggtggggtggatctgggtgaagcaggggttggcgaaccaggcgccgcgccggtgcgcccgccagacggcggtcgcgttggagttcatggcgttggtcgacaggtagaagacgttgccgtagccgccggaggcgaggacgacggcgtccgcgaagtacgtgtcgatcttgccggtgatcaggtcgcgggccacgatgccgcgggcccggccgtccacgacgatcaggtcgagcatctcggtgcgcgggtgcatctcgatgttcccggcggcgatctgccgcgacagcgcctggtaggcgccgagcaggagctgctggcccgtctggccgcgggcgtagaaggtgcgggagacctggacgccgccgaaggagcgggtgtcgagcaggccgccgtactcgcgggcgaagggcacgccctgggccacgcactggtcgatgatctccaccgagatctgggcgagccggtgcacgttggactcgcgggagcggaagtcgccgcccttgaccgtgtcgtagaacagccggtggatcgagtcgccgtcgttgcggtagttcttggccgcgttgatgccgccctgcgcggcgatggagtgggcgcggcgcggtgagtcctggtagcagaactggacgacgtggtagccctgttcggccagcgtggcgccggcggagccgcccgcgaggccggtgcccacgacgatgatccgctgcttccgccggttggccgggttgacgagcctggcctcgaaccggcgcttgtcccagcgctcctggaccgggccggagggcgccttggtgtcggtgaccggctcgccggtcgtgtagtcggcgtaggaggtcatgtcagctcaccactccggtcatcacgcccaccggcacggcgatgaagccggccgtgagcagcactgcgaggacgttggcgacggtcttcagggcgcggtcgcgccgccggctgccgacgccgagggtctgggcggcgctccagaagccgtgctggatgtgcaggccgagcgccagcatggcgacgatgtagatcacgtcgccgtaccaggtggagaaggtgtccacgacgttctggtacgggtggccctcctggaagccgccggagtgcacggtgccggtggtcaggtccaggatgtgccagacgatgaacaggccgaggatgatgccgccccagcgcatggtgcgggtggcgtagctcgcccggggcctggcgtgcacgtacttggccgggcgtgccttgatgtcgcggcggctgagctggtaggcggagaccgcgtgggcgaccaccgcgaccacgaggacgatccggatgagccagagcgtccactcgtagtgcatgaacggctcgcccaccgtgcgcagccagtgcgcgtagtggttgaactcgcccgccccgaagtagatcttcaggtttccgatcatgtgggcgaccaggtacagcagcatgatcaggccgctgaccgccatcacggtcttcttgccgacggtcgagtgccacaccgtgcgcgccatggacggccgtcggtccgtccgcgttgccagagccatgcccatgacgctagagccggagggcccgatcggtccaagacatggtccggctcgtttcgataggggacggctatcatggctgggtgcagttccagcagctccagtacttcgtggcggtcgccgagacccggcacttcacccgggctgccgacctggtccacgtcgcccagccgtccctgtcgcagcagatcaaggcgctggagcgggagctgggcgcggacctgttcctgcgggcgcgcggcaacatcacgctcaccgacgcgggcgaggcgctgctgccgctggcccggcgcatcctcgccgacgcggacaccgcccggcacgaggtgcaggagctggtgcagctgcgcagtggccgggtgcggctgggggcgacacccagcctgtgcaccgggctgctgccggacgtgctgcgcgccttccacgaccgctacccgggcatccggctgctgatcgaggagagcggctcgcacgacctcgtacgggagctggcgcgcggcgccctcgacctcgcgctggtcgtgctgccgctgcccaccccctcccccgcgctgaccacggtggagctgctgcgcgaggacctggtcgtggtgtcctcaccggaggccgccccgcccggccccccggggcggcgcacggtccgcatcgcggacctggagggggcccggctcgtgatgttccggcacggctacgacctcagggagctgacggtggccgcgtgccgcgcggagggcttcgaaccggatttcgccgtcgagggcggcgagatggacgccgtgctgggtttcgtccgggccggcctgggcgtcgcggtcgtaccgcgcatggtcgccacccgctccgggcgcggcctgcgcgtcaccccgctggcccgccccggcctgcaccgcacgatcgccctggcccaccgcagcgacgtggctccgccgagagcggccagggaactgcagcggatgctgctggagcggtgaggtgaggtgacagcgggccaccccgggcggggaggcccggcccctgggttccccttggttcagccgaggacggcgggcttgagcacctgctcgcaccactcgcggaacgcggtgggcgcggtctcgggggtgctcggcgcggtgacgccgtagaagccctggtcggcgagggcccgtgtcatgtcggccatggcctgcgcccacgcctcggtcgccccgtagccgagcatcgcccgccgggtggcctcgatgctgtcccgcgctatccggacgggtcgccccagcacctccgacatcacgtcggccatgccctcgggggtcagcgcgtcgggcccgacgagggggacgtcctcctggccggtccaggagccgtcgagcagcagccgggcgcccgtggcggcgatgtcaccggtggcgcaggtgcgcaggacttttccgccgtcggccgtcaggtggtacacgccgttgtcgcggatcgaggcggcctggcgcagcaggttctccatgaggaacggcgggcacagcgcccggtagtgcacgccggtggacatgatccgctcgtccatggccagggaggccgagatctggccggcgttctcggcgatcttgcggcccagtgtggagacggcgacgacgcgctcgacgccctgcgcctcgagcacgtcgcacaacggctcggtgaaggcacggtagtgaccctcgacgctgtcggcgccgggcgccgggggcaccagccagaacacccggtcggcgccggcgcaggccgccccgagcaggtcggggtcgctgtgcgagccctggaacacctccacacggtcccgcgccgccggggcgaggcgtgcggggtcccggacgatcacccgcaccggtccggcgtccggggcgtccaggagatgggcaaggagccggcggccgatctggccggtcggggtggtcacgacgatcacggttactccagggagagaaaggtgtgtatgccgacgtgcctgatcctgcgggcggggccgccggaactgaaggaccggccaggacccggttgttaccctgagggcaataccgaggggaggggcggttgtggaagccctgagggctctgggagccgtaggaaccgtggggacggaaggagtcgtgggagcggcagggcccacgggggcgggggccgtggaatcccgcccgctgcgctatttcgtcgcggtcgccgaggaactcaacttcgcccgcgcagccgagcgcctgggcatctcgccgcctcccctgtcacgtgccgtccgccgtctggagggggacctcggtgtcaccctgttcgaacggaccacccacagcgtcacgttgaccccggccggtgaggtcctgctccgggaggcgcggatcgcgctggacgcgttgcaggcggccggacgccgggcccagcgggccgccgcgccgcgggccgggctggtgctggcgatgaaggcggacggcgacgcgggactgctggaaccggtcctggagcggttcgccgccgaccccgccgccgtgccggtcacggtccggctgtgcggcctgcaggaggcccccgcgctgctgcggcgaggcgaggccgacgtggctttcgttcacgagccctacgaccgtaccggcctggacagcgaaccgctgaccggcgaggagcgggtggccgccgtggccgccgtgcacccgctcgccgcgcgcacccgtctcaccctggccgacctgggtgttggccggcaggagggggatctggaccggttcatcgccgcggcccggcgcgacggccaggatctcgcgcagttgctgacccgggtggccctcggtgaactgatcgccgtcctgccggcctcggtgacccgccgctacccgcgccccggcgtcgcctaccgccccctcgcggacgcgtccccggccgtcatgacgatcgcctggccgcagcagtcccgctcgacggccacggccgcactcgtccgcatcgcctgtgacctggcggcggcccggggcacggaggagaccggaacggtgtgtgcaccggccgccggactccaccccggcgggtggtgacggctacgggcgccacgggcgcgtacggcgagcgcggtcgggccggcacccacagccatgggccgtagccgtgccctgtgcaccgcatggtcaggcccacggtcgggcagtgccgcaggagttggccctgtacgacgatgacagcgcgcgtcctcctcagtccccctcagcccgtcgcgtccgccagggccagttcgtgcagccggtccggcggccccggacgggcgtagtaccagccctgggccgtgtcgcagcccagtatccgcagctgttccgcctgggcgccggtctccacgccctcgaccgtgacggcgaggtcgaggctgtgggccagggcgacgatcccctcgacgatcttgaggtcgacggggtcggccgggaactgctgcatgccctgggtgaaggagcggtccagtttcagcacgctcaccggcagccggcgcaggttggccaggttggagtagccggttccgaagtcgtccagggcgatgtcgacgcccatctcggcgagcctgcgcagcggtttgagcaggtcgtcgtccgcgccgatcagcgccgactcggtcacctccaggcacagcgcgtccggggccacgcccgtgcgctccaggatgtccacggtgtcctggacgagcccgggatggttgagctgacacggcgagaggttgacgttgatgcgcagcggtccggcctcaccgtcgccgtgcagctcgcgccactcgcgggcctgccgcaccgactgctccatgacccagcggcccagcgggacgatcagaccggtgtgttcggcgagcgggatgaaccggtcggggccgagcacgccgtgctgcgggtgcagccagcgcaccagcgcctccgcgccgcgcacgctgccgtcgccgaggtgcaccagcggctggtactcgatgaagaactcgccccggtccagcgcggtgggcagcgccgtggtgagcccgtgccgggtgatggcgcgggcgtcggcctccgggtcggccagctcgaagcggttgccgcccgccgacttggcccggtacatggtgatgtcggcgctgcgcagcacctccgcggcgctgcgtccggccaccgggccctcgacgacgccgatgctgccgcgcacggtcagctcccggccgtcgatacggacgggggccagcagcgcgttcatgatgcgggcggcgaggtcgtcgacctcgccgcggctgtcgggcccggtggtcagcgcgacgaactcgtcgccgccgagccgggcgaccatctcaccgggcgcggtcgcgcacgcctggagccggtcggcgacctccaccagcagccggtcgccggccgcgtggccgaggctgtcgttgatggtcttgaagccgtccaggtcgaggtagcacaggccgaagcggcggtcctcgcccgcgttcagcgccttctccaggcgttcgaagaacagggtgcggttgggcaggccggtgagcgcgtcgtgcgtggcctcgtagcgcagccgcaggttgagcagccgccgctcggtggtgtcctccatgagggccagctggtactgggggttgccgtcggggtcgcggagcagggagacggtgaggttggtccacaggaccgtcccgtcggggcggtagaacgccttctccgtgtggtagtgctcgcgctcgccgcgcaccagttcctcgtacagccgccagatctgcggcgcgtcgtcggcgtgcgtccactcgcggacgttacggacgcgcatgttctgctccgagccgccgaacatgcgcagcagcgcgtcgttgacctgcaggacgttgccgtcgaggtcggcgatgccgatgcctatcgccgcgccttcgaacacggcccggaagcgggcctcgctggcgtgcagcgcctgcgcgaccacgccctgcgcgcgcagcgcggcctgcgcgatggcctcctgctcggtgagcgtgcgctcgcgcagcgcccgcgcgaacccggcggccatggcgtgctggagccgcgcggagcgggcccgcaggtcctccgggtcgccgtcctcgccgcagtagagcacgaggtaggcgtccacgcagtccagtgagcggctcagtgcctcgggcgccgtgcagtgcgtcccgatcagcgcggcgccgaccgcctcgccctcggccgcgtcgaacgccctggcgcgcagcgcccggctcagccggcgggccagcggcaggagttgctcctcgaactccgggcgggtcagtgatgtggaggtcaccgggaagaccgcccggctccagatcgtcgtcagccggcgcagtctgtcctccgggccgtccggctgcgtgttcacgccgtacgtcccacgccggcgtaaccggagagggcataaggatcctcgtcctccggcgccgtgtccggccgccagcgcgccatcggcaccagtccgggttccaccatgtcgtacccctcgaagaaccgcgcgatctcgtcgcgcgagcgcatgatcagcggattgcggatgcccttgtatacgtcgaccgcgccctcgctccgctccggcggcagcgggattccctcgtacgaggcatgcgtgaggatcagcaggctgccgggcgcgagcgcgtcgcgcagttcggccaccgcggtgtacgggtcgtccgtgtcttccacgaagtgaagtatggcaacgagaagcagtgccaccggccgattcaggtcgatcaaccgctgcaactgggggctcgcgaggatctcgtggggcttgcgcaggtcggccgcgaccacgtccgcgtcgtcgttgtccgcgaggacggactggctgtgggtgacggccaccgggtcgtggtcgacgtagaccacgcgggcgccgggccgggcggcctgggcgacctcgtggacgttgccgaaggtggggatgccggaaccgatgtccaggaactgggtgatgccctcgtccagcgcgaagcgcagggcgcggcgcatgaacgcccggttggcctgcatgatcttgggcagtcccggcatgaactccatggccctgcgggccgcttcgcggtcgatctcgaagttgtgcgaaccgcccaggtagtagtcgtagatccgggcgacgctcggcaccgagatgtcgatgctccgtggggcccaggcgggacgctccatcttctctccacaacgtaggcgttccggtgttcgagctgaggctactgatcggctgccaaaggggcgagtggaaacggaaattgaccatccgttcccggtcaccacctgcggcgcacgcgcctgccgcgcgcccgcatcggggtggattgcgccgatgtgcgggcatggtgaagagcccccgcgtgcgctccggcacacgccggaccgccccctcctggcggtgcggagggggcggtccggtcggtaccgtccagcgtggtggtgcggaggggggcggtccggtcggtacggcgtgccgggcgccgtcacttcctgggcgcgccgaccgcctttccgtcgggggccacggcgtaccacgtgccgccgacgccctgaccgcgcatgtcaccgggcgccttgtcgccggagaaggtgtagaccggccagcagtcgacggtcatctgccggacgccgtcgggccgggtgaagcccatcaggcccttcttggccacgccgtcggtgtccgccgccggcaccggagccacggccggccacttctccaggcagcctccggtgcaggccgagacggacttcggccaggccttgtcctcgaggaaccggtagacggtcatgccgtgccggtcgacgacgacgtcgccgagtgcggtcttcctcaccgagagtccgggcaggctcgccggggacgccttctttccgtcgggcgccagggcgtgccacgtgccgcccacgccctggccgttcacctgaccggccacggtgtccttgacgtaacggtagacgggccggccggcgatcgtcagctgttcggtgccgtcggcgcgcgtgaccttgccgagcagtgccttgtcgacgccggaaccggccgtggcgtcgtccgccggtacaggcggccaggccatcgcgcagtcgccgtcgcagtgggacgcgggcggtgcggcggtgtcccggtcgaagcggtacagggtcattccggtgctgtcggtcagtacttcgcccagtccggcgtgggtggtgacgcccagccgtccggcggtgcggacggttcccgcggctcccgctacgccctcggtgctcgtgccgcccgcgccgtagccattggcgttgccgatgcccgtaccggcgccgatgcccgtaccggtgccggagccgttgaggccggcggccggggccgtcgctccgtcgttctggctgcccgccgcgggcgtgccgtcctggccgcacgccgtcgtcagcgccagtaccgccgcggccgtggccacgagtgatgcgctccgccaggaggtgttcatcgtcagctccccattgctccggatggctcgcggcgcctcgctgtgccgccgcacggcactgggtacgcacggggcggacgcccgcgttcaatcgcggcccggtcttcttccaccgcccacggccacactccgtacgcgtgtgcccatcggcgacggccggggagtcgcccggccaaacccccgtcggccccctttccctccttcggaccaatccgcccggcgcgtcggagtgcgggggtccggagcagcccatgatctccgtcgtgcatcgaccgaaaccgacccgattcgccctggccctgcgggtgttggcaccagcggccgtggcgtggacgtgcgtgggcgccccggccgtgccggcctccgccgacgcctgcgcgtacgcctccacgggtcccggcggaacagtggcggtggcggtg

SEQ ID NO: 423 - DNA, 877 bp, Unknown
  Kingdom: Bacteria, Phylum: Actinobacteria, Class: Actinobacteria, Order: Streptomycetales, Family: Streptomycetaceae, Genus: Streptomyces
ccgagcagcacccacccggcgaccgcgatcgccaccacgggaatccaccgccgcacgacatccggcaccggcaccgtcgacgcgaggtggcggagaccggcagggtccgcgtggggcacggcctccgtcgtcagcagggcggccgtacgccgccgtacacgccgcttccgccgtaccgtccgcagccgccgcgccaccagcacgaagaccacgatcaccaccaggagcatccccagcctgtggacaacgtccgcgctcatgccgcctccgcccgtcgcacgatccccagggcccaccacagccccacgccttccagcgcaccgccgacggccaggcagcccatgcccgctcctgtgtgcagcagcacgtgcagcgggtcggcgcccatggccgtgccgagcaggagaccgaggacgggcagtccggcgagcatcaccgccgtggcccgtgcgcccgccagctgggctcgcaggtccgcgcgttggtcccggtccgcgcgcagcgctccttccagccggtcgagtccggccgcgaggccggcgccctggtcgacggccacccgccagcacgcggcgagtccccgcaggccctcggctcccggctcccgggccgcggcggcgagcgcaccaggaacgtcccctccgaaccgcgccgccgccagcacggccgcctgagcgcccccgaagccgcccgagtcccgcgcggcacacagcagcgcctgccccggttgccgcccggcgcgcacctcaccggcgagcgccccgcacagggtgatcaccgcgtccacccgctcctcccgtgcccggcgtgcggcccgggccaaccgggtccggcgcagcaccggcaccgctgccgcacccgcgacgaccggcagcac

SEQ ID NO: 424 - DNA, 2531 bp, Unknown
  Kingdom: Bacteria, Phylum: Actinobacteria, Class: Actinobacteria, Order: Streptomycetales, Family: Streptomycetaceae, Genus: Streptomyces
gcgcaggacggcccgttcaccgtcgcggtggagttcgacgccgagcacctggccatggccgtcaccgtggtgcccggcgtggcccgggccggagagcgcaaggtggtctacaccagcgcgaccatgtacgaggcaatccgcacgttcaaggcggtcaccacgatcgcctcggccgccgttgaggagcagtatggctgacgcgcaggcactggacgaggtcgtccggttcacctccgacctgatccggatcgacaccaccaaccggggcggcggcgactgccgggagcgcccggccgccgagtacgccgccgaacagctggccggggccggcctcgaaccggtgctgctggagcgcacgccgggccggaccaacgtcgtcgcgcggatcgagggcaccgaaccgtcggcacccgcgctgctcgtgcacggtcacctggacgtcgtaccggcgcaggccgcggactggagcgtgcacccgttctccggtgaggtccgcgacggcgtcgtgtggggccggggcgcggtcgacatgaagaacatggacgcgatgatcctctcggtcgtgcgctcctgggcccggcagggcgtgcggccgcgccgggacctcgtcatcgccttcaccgccgacgaggaggccagcgccgaggacggctccgggttcctcgccgacgagcacgccgagctgttcgagggctgcaccgagggcatcagcgagtccggcgcgtacaccttccacgacggcagcggccggcagatctacccgatcgccgccggtgagcgcggcaccgcctggctgaagctgaccgcgcgcggccgggccgggcacggctcccgcgtcaacacggagaacgcggtgacccggctggccgccgcgatcgcccggatcggcgcccaccagtggcccctgcggctcaccccgaccgtccgcgccgccctcggcgaactcgccgcgctgtacggcctggaggccgacccggacaccgcggacgcgctgctggacaagctcggccccgccgcccgcctggtgcaggcgaccctgcgcaacagcgccaacccgaccatgctggacgccggttacaaggtgaacgtgattcccggcgaggccgtcgcccacgtcgacggacggtacctgcccggtggcgaggaggagttccgcgcgacgctggacctgctgaccggcccggacgtggactgggagttccaccaccgcgaggtggccatccaggcgccggtggactcaccgacgttcgccgcgatgcgcgccgccgtccaggagttcgcgcccgagggccacgtcgtgccgtactgcatggcgggcggcaccgacgccaagcagttctcgcggctcggcatcacgggctacggcttctcgccgctgaagctgcccgagggcttcgactacgacgccctgttccacggagtcgacgaacgcgtccccgtcgacgcgctgcacttcggtgtccgtgtgctcgaccgcttcctgcggacgtcctgagcgagttgggagaaggaaacagtggagaccctgccgtacggttcctggccctcgccgatcgacgcggccctggccgccgcgcacgacggcaagccggagttcgtcgggttcgtcggtgacgaggtgtggtggaccgagccacggcccgccgagggaggccgccgggcgctcgtgcggcggcgcgccgacggtaccgaggagtccgtgctgccgccgccgtggaacgtgcgcagcagggtcatcgagtacggcggccggccctgggcggggacggtcgcgaacggcacgccgctggtcgtcttcgtgaacttcgccgaccagcggctctaccgctacgagcccggcgccggcgagcccgtgccgctcactcccgtctcggcggtcggcggcggactgcgctgggtggagccgcagttgctcgtcgagcgcggcgaagtctggtgcgtgctggaggagttcaccggtgagggacccgccgacgtccggcgcgtgccggtcgccgtaccgctggacggatcggcggccgaagaccggggcgcggtgcgcgaactggccgaggagcggcaccggttcgtgaccggaccgtgtctgtcgcccgacgggcggcgggccgcgtggctggcctgggaccacccgaggatgccctgggacggtacggaactcgtggtcgccgacgtcgacggggacggccgcctggccgccccgcgcaccgtcgcaggcggccccgaggagtccgtcgcccaggccgagtgggccgccgacggctccctgctgtacgcgagcgaccgcggcggctggtggaacctctaccgcgacgggcagccgctgtgcccgcgcgaggaggagttcgccggaccgctgtggaagctcggccagcgctggttcgcgccgctggacagcggtctcgtggccgtcgtgcacggccggggtgccaccgccctcggcatactcgacccggagaccggcgaggtcgtcgacgcggcgggcccgtggggcgagttcgacgccacgctcgcggtccacggtgagcgtgtcg

SEQ ID NO: 425 - DNA, 10633 bp, Unknown
  Kingdom: Bacteria, Phylum: Actinobacteria, Class: Actinobacteria, Order: Streptomycetales, Family: Streptomycetaceae, Genus: Streptomyces
gggcggcgtccagttcggccgcggtgggccgatcggcggggtccttggccaggcagcgcagcaggacggcgcgcacctcctcgtccacgccgtcgaggtcggggctgccgtggacggcgcggtacagcagggcggccgccgcgccgctgccgaagggcggccggccggtcgccgcgtaggccagcacgcagccgagcgagaagacgtcgctcgcgtgcccgaggtccccgccgcgggccgtggcctgctccggggacaggaagccgggggtgccgacgacgaggtccgtggaggtgatcgcggtgtcgtccagggagcgggcgatcccgaagtcgatgaggcgggggccgtcggcggcaagcaggatgttgcccggtttgacgtcccggtgcaccagaccggcggcgtgcacggcggcgagcgcgcgggccagcatcttgccgagcagacgtaccgtccgcacaggcagcgggccgtgccggccgaccgcgtcggcgagggacggcccgggctcgaaggcggtggccagccagggctgttcggcggcggggtcggcaccggtgaccttgatcgcccacgggctgtccacgcgtcgcgcggcgttcacctcacggcggaaacgggcgcggaaggcgtcgtcgtgcgcgtactcggcctggatcaccttgacggcggtgagcgcgcccgactccgtacggccgaggtagacgacgcccattccgccctcgcccagccgggcgagcaggcggtggccgccgacgaacgacgggtcggaggggtgcagggagcggtcggtcacttctgggcccccagtcgggtgcgcaccttggtctccatcccggccaccgctcgtgcctggacggtcagcaggtcgccttgaccgaagcccttgccgccctcgacgacgacggcgatcgtcaccggcccgagcctcacctggttccagatgtagtacgtcgaccccttgccgagcgccggattgtcgtaggtgcccatctcgatgaggtagtcgtcggcggaggtgttgccgttcgtaccgtagccggagcccatcgagttcaggccgctgatccgctcggtggcacgcagttgctgatcggggcagcgcaacgcctcctccagcgtctcggccatctcctggtccgcctgggcgacggtgcggtgcagagtgacggtggcggcggtgcggacctcgcccttcgcgccggccgcgggcagccggctgtagcgggtggaggtggcgaggacgtcgccggacagcggcccctgccgccagacgcagtcggtgccgaggacgggccaggcggccgggtcgctctcgtacggggggcgcttgacgtagccggggccatagctgtccgggcctgcggtgatggtgcggaccaggtgaagggcggcggccggcgtggtggggacacgcgcggggtcgaccgtgacgcgcacgggggtgacacccgtcccgcgctgtccggccggtgaggtcacggcggccgaggaggtgctgggaccggtccggtgcccgccgccgctcaagccggaacagcccgcgagcaggaccccgcacacggccagcaccgcgtatccccgccttgcgcgtctttgcgtcgccgcgtacgtcatgaagcccccactcaccatacgtctgtgccagtgtgcgaccggagcgagtgtaggggaaatcagtcaactctccgcggacaaggagcggttggcgcagccacgtgacagccctgaagggcgccggtgggtcaccctcgctgaccccgcccggcgggaccgacaagcgggcacggtggggccgccggctgcgtacgggtgggaaagatccgctcacgcggacacgcgaacgggagcccgcgccgcgggaaccaaacgggactccgtccgtcggcagccagcgatctccttcgtaggacctcgggtggtcagcgggtggaccagcaggaggcgacgcgggcggcgcacccgacggtgaccgccgtggactcggccgttttgcgggggcggcagcaggttcccggccagcggctggccgaccacgacgaccaagcgtgtgtcggcgtcgaggacgacgtctggaccgggtgatcgagcaacgagcttggcctggctctgtgacacgctgtgaagcatggggtggacttacaagctgcacggtggtgttgcggccgggctgggcaccacgcttttggtgctggccacgctcacatggctgcccggggccttgccgctcacgggcacgagatggtgggcggccgcggttttcgtatcgctcttcttgaccttcgcatctgctctggtgcggctgatcatgaggagcgcggacaagtatgcgatatggatggccttccgttgcctgcccggcaaggtgcagatgacactcggagtgctggctctgtggggtgtggtgctgttgctcttcagcacggcaacagaggggaacctgcagtcagccgaggtaaaagatggccgttatgtcgccttcgacacaacgccccctgcgcgcggcacggtcgagatctcccacagccggtaccaagatgtcctcgagagcgatcagcgcaccatgttcgcgattccaggggtactcttcctcggcgcagcctacgcggttctggcagccggggaactacgccgagcagaccgcgctgtagtcccgtccgacgtcacgtaagagcttctgcccactgaaggcgtgctctcgtcagggcgagtccggtgccggtaaggaatccgtcgatgagggcgggccggtactggacctggcgtagtccttgccgtagggcgcgcatcaggtgggcggggccggtgaaggcggtgttgacctgggagcctcttcggagcagggaccagatgccctcgaccgggttgagctgcggcacgtgcggaggcaggcaacagacggtgacccagtcctgggcgtcgatgaacgcgtgtaagcggcggtcgcggtggacattgagattgtcccagaccaggacgatcggcttgcagagctgctggtgggccgcgaggagtaggtcgcggtagtcggtccaggcaatgctgcgtcgcccgcccgctttgtggtcggggtggacgatgggccgatagatcgaaacgcctgccgttcagctgtcagcccaccaccctgcggatacctcatacaagcggcctaccgcgacggtcataccccgtcagccccgacgacatcgcgcttccacagtcagtaacgaagcagccatgacgacggttgatgcggcgcgtctgcgcagagcaggcccccctctgcgatcgcgccgatcaggtgatcaggtgatcaggtgatcagcagccgatcacggattctaggtgtgccggaaaaaggcccgcaagtatcgcttcgcacagaggagttggtggtgctcttggacgtacgcataagacggaggtgtcggtagtgcctgcggccggcaacatgagtacggatactcatgggcgtgggttgcgggagcggtgaccatctcctcatgcgatccatttccctccccaggtcccttgccgtcttcgcgatcggctgcctgacgctcaccgcttgcggcacggaccaggcgagcgattccacacgtcccctgcaggctggagcctccgtgagcagttcctggggcagcagcgactccgaggttcgcttcctcgacctggcgaaccgccttgcccaggagtgcacacctggcgcccccgtctccgccgggccggatgcaccggacccgaagacgctgccgggcgcaccgacaggttctcccgcctacggtcccggcagaaccccgccgggcaccccgaacgctgcgggtgacattcccgtcccggtcgaggacacggccccttccgtgtcagggcccggcacgcgggacgtactgcatgaggttccgctcccgggcgtcgaggcatgctccggcgccaagcactccgagcggatcacgcgggcgttccagagcgagggaccctccggctaccaggcgctggtccgcggtttgcgttcggccggatatccggcgcagcggatccaccgcatggccgaccaagacggagccccgcgggctcggctggatctgcgggtggcggacggcaacctggcgctggaggtcaccggcacgtcccgaagcgtgctcgtggagtcgttcggcgccccgtccggccaggcggtgagcatactggacgtgcgccgcagaccacgcctggacgaaaccagctgacgcggtccacgaccggctcgtactgggccacggcgtcggccttgagctcgtccgtgtagtccttcatcgccatcggcggtcttctcgcttcctccggatcaagcagatccggtatcagcgtgtccaccactcaggggaagctccctcggtcactaggcgcattgatcacgaacgttgtcgactcgcccggactcgatcatggcgaagacctccggtgtggtggagctgtcctggactgcaccccacggaggtcgtcgtgtcccaccgtagcccggctgaccgttcacggcaggcggcttctcatcgagcgtgtccgcacgggctggccggtcgcgcacgtcacagccgagatgggcatctcgcgcgtcacggcccacaagtggatccgccgctggcgggccgaaggcgagcaagggctgcacgaccgctccagccggccccgcacgacaccgcaccgccccccggcgaggaccgggtgcatgccgtcgggcgaggggcgcggctccccgccagccccgctcccccggcccgacggcggtgcgcaccatgcgcgcggcccgatcggtcgtggtggcccaaggacggcgggacgcctcgcccgcgaccccatcggtgtggggcacgcgaccggccgaagctccgtagccgaaccacaggcgcggcgatcgcagaactggatcagcggccgactgccgtcgtccggcgcgcaggctggaccgccgcgtggcggccgttcgtgctgagctcgtgcaggatcttctctacgctctgctgggcgtcgccgaagcgcatgctgctgttctcccggaagaagagcgggctctgcacgcctgcgtagccgtaggtcatggagcacttgaagatgatgacctgctccgcttcccaggcccgcagcaccggcatgccggcgatcgggcggcccgggtcctcgagcgcggccgggttgacggtgtcgttcgcgccgatgaccaggacgaccgaggtgtcggcgaagtcgtcggtgctgcgggtaccggccccttgatccgctgcaccacttctcgggacgtcaccctgggccggtcgatccggttcgccggcgcaccgtgggttggccggccgggtaccggcccgcgcggcaccgcggtcggcacagcaggtggctgcggccctgcaggaggtcttcaccgaacgcagaccgctgtcggagggcgtgcacgagatcggggagccgctggtggcgcttcccgccctgttccattcactgcgggcagggcggcttgtgccgtatctgggtgcgccgctgcacgagcggacgctggtgtgggcgcaggcggtgggatgagggcaggccgcgtgatgtcctgcgggacggtggtggagctggggagccggtgcggttcgaaggccgggcatggacggtcccgggccgcccttgagcgcggcgctatgggcggccccggaccggttcgggagggccgctggacgcccgctcgcgactgacacggcttcagtaagcggcctgtcgctccacaaccccccttgagaccactgggcttgctgttatattcgtgcagctgtgcacggggggcggccggggggccgggcactttctgcagtcgtcgacgcatgcctgatcggcgtcgccatcccgtcacgccttttccttgagaggcccaggaggcgacaatggcccgtcgtaccgctgcccgtggcgtcgtcgccgcgctggccgtcctgaccgtgacggccggttccggctcgctcgccgtcggcgtcgacgcggagaacgcaaaggacgcggtggggagcgccttcgcggcggagaaggtcttccaggccgaccgctacacaccgcgcgcggaccgtatccacaccgcgggtgccagcggctatctgcatgtccaggaaggccgttccggctacctgtggacgtcgtacgccaccggcgcgacgaccgagctgggcaccctgcccccgtccgggatacccgcgtacctgggggcgtcgtccgacatcgtggccgacgccgtctcgcccacccggaccgtcgtcctcaaggacatgtccaccggcaccgccaccgaggtctccctcacccacggcacgtattggggcgcctacggcggccatgtgctgagccaggcccgcaccgacgacggcagccgcgtgctgtggctgtacggcgacggcgcgcccgccgagggcaccctggtcgagggctggccgaccgggatcagggcgaacttcgaggtgctgggcggcgacagcggcaccgccgtcatcagttacgggctggcgagcggggagcggcacctggccctggtggacctggctgccgcgaaggtcaccggcgacgtgaccgtgcccctcgccccgacgtccgtcgcactgagcgcggatcggctggtctggttccggacgaggtacgggtcgggcggtacggcggcacacgtcctggaccgcgccgacctgtccgccgccgagaccacggtgccgctgcccgggaccgagggcacccccaccgtcggcatcgcagggcgctggctggtggtggcccgctccgtgccgcccgagccgtccgactcggttgatgagtcgggcgagcggctcatggccgtccccctcgccggcggcgagccggtcaccctgctccggcacgcgaacagctccctggtcgcggcgccggacggcagtctgctggccgtcggcggcgccgacgccgggcattgggcggtgcgcaggatcaccgacacggggacgggcgccccgacggtgaccgaggtgaccgctgtcccggcggtggcggcgcggatcaaccggctgtcgctgcagaacggcacgctggccaccgacgaggccgacagcagcttcctgggctcctatgtcacgcgccggatcgccgccgacggaacgccgggcgcaccgacctggcagtcctggaacttcggccgcgggaccggcccttacgcgaccggcgacggacaggtggtgacgttcaccgccgactccgaccccaacggcagcggatcatacgtgcagtccttcgacggcgacgccgctttctacctgccctcggccgccggatcggtcctcgacatcaccggccgttacgccctcgtcaacggctcttccccggccaagcagtacgtgggcgacctcggcgtctactccgacctgaagcccatcgtcacccgctccgtcacggccgcctcggtctggggcaccagactgtggacaccgggctccggcgccggtgtgctcaccgcgaaggacctgaagaccggcaagaccgtcgacaccgtcgcgaccaaggctccgtgcactcccaaggagctccaggcggtgggccgttggatctactggtcgtgcggcccgaccgcgacggccggcgtctgggaccgtacggcgaagaagaacatccccgtcccggccggccaggcgctgctcggcgacggctacctcatgcggcacgacacctcggccggggcgctcctgctcacctccttcgccggcggtgccaccaccacccgcgagatcggcgacctcgccgcgggcggctccagtctgcgcggggtgacctggaccgtggacaagttcggcgggcccgcggcctacgtggacgcggaccaccgcatccacctggttcccagcggtgtcgccacccagccgctgagcgtcatcgagtccgcggtgagcgaccaccgctcgcagagcggcccggccaccagcccgtggtggcagtggcgcggactgctctccaagcccgccgcctcctggaaggccacgctgaccagcaaggtcaccggcgccacggtccgtacgctctccggtggcgccgtggccggcaacctgacggcacgctgggacgagcgcgacgccaagggcgcgctcgtccccaacggcacgtacaccttccggctgacggccacccccgccgacggctcgggaccggcgacgacggtgacgcagacggtgcgggtgttcgcgggcgccgccgtgcgccgcgacttcaccaacttcgccaccagggaaccggacgggacgggcgacctcgtgaccctcgcctcgtccggtgaggtcagttaccggccgggcgacggaacgggcggcttcggtgagagcctgcgggccccgggctggccgtcctccgtgacgctggtcccgttcggcgacctcaacggcgaccgccgcaacgacatcctcgtccggttcagcagcggcgaactacgggtgtaccgcccgatacccgggcagtccctcctgacaagtagcccgcacatcaccctgggcaagggctggaaccagtacgacgtgctgacctcgcccggggacgtcacgggcgacgggcgtccggacctgatcgcgcgcaacgcgtcgacgggcgagctgttcctctacaagggcacgagcacgggcaagctgtcggcgcgggtccggcttgcgaagaactggttgggctacaagaagatcgtgggcgccggtgacctgaacggcgacggccgcggtgacctcctggtccaggaccgctccaacacgctgtggcgctacgacggcaccggcaccggagtcttcaaggcccgcgtgaaggtggccaccggctggggcgcgtcgtacaacgtcgtcgtcggcgtcggcgacatcaccggcgacggcaaagcggacctcgtctcccgcgacacctccggcaccttgtggcgcaacaacgggaacggcaagggctcgttcggcgcccgaaagaagatcggcaccggctggcaggcgtacaagggcgtgttctgatcccaccaggacaccatctgcgacccgggccggcatcgcccggccggggtgcgctgggtgtgtcaccgcgcgcgtgccgcaacaccttccccggggaagcgcgagggcgcgcgcggtgacagcgcctcggcggaaccacttgccggctcagccggggcccggttcgatgggttcccgccgcgtccaccgcggccccgtcccgcatcgacaggaccgtcgcacgcctcggcgcaccgagtgagaacgccgtggccgccgacagttgcgcgatcacccgctgggccaacaagggctaatacaagtgcggcaccaaggtgctggacgcggactgggatcagaacagaacgagggacgagtcgttcgtcgtggccgccaaaggcacgatctggcacacctggcgcgccgccgacggctggaaggagatgccgggacacggacgtgccgacaacacgcggggctgggccgcgatcgccgattggcgtgccgtcacggtctgggcaggcagcacctcgtactgcaataccttcaagagcggcaagtgacacagctggaagcgcaagtgcggttaggccgcgccgcatcagacagcggccgatcttgagtgtgcgcagtccgccgtcagagggacggcgttcggccgtcgtcgagacacccgagcggctagggaacagccagtgggagttcatccctccaggccgggggcaccgcgggtgacttccgtctggcaaaagacggcgctgacacgggcccctgcctgcgccagcagcccgatggcgaagctccctgccgatccacgcctcatacagctctccggacccgcggggatggtccctaattgtgctccgggcccagggggttgtcgtcggcgtcgacatactgctcggtcttggtgtagcccatggcgaggctgttgcggcgccgcctgccgatcgagatcacgcgcagttccaggcgcttcgtccagcccgccacgtcggccggggagaccggcccgacctcgcactggcgcagccacagcacggggtcgaagcggtccgcggtgctggtgagggcgtcggcgaggttgaaggcgatggttcggcgggcgtggaagtcctggtcgtcggattcagcgatggccgcggagatggtttcgtagtcggcgcggctcatgttgcggttcgtggccatggggcccctcctggctcgaggtggttgcggttcgggggtacggcacgggccgcctgaggcggatgtcgagtcggacggcccgcgcgcagggggtgcgtatgaatcaagcagcgaaggacgtgcgctgtcttccgacggcgtgggcgctgctcagacgggcggggggatcggcgctgtctctggcccggcgggcgaaggtgctgtaggaggacgtgcgggagtccttcgcctgctgccctcacccgcggggttggtcccggcagcgtcacgcacgaggaccgcgactgtgtccgtcgcgccgccgtcgcaggacagcagacgccaggcgccgggggtccaggcgaagacggcgtcctggccgaagcaccgccccagttcacgcgccgccgagtcgctcaggccggcgacggcgacgctctgctcgatgtgcgtgccgtgcgcatcgcctcccgctgcgggccaccacgcgagccctcgccggtcgagcacgt

SEQ ID NO: 426 - DNA, 6327 bp, Unknown
  Kingdom: Bacteria, Phylum: Actinobacteria, Class: Actinobacteria, Order: Streptomycetales, Family: Streptomycetaceae, Genus: Streptomyces
ctgtggggcaagctcggcgaccagtacggccgcaagaagctgttccagaccgccatcgtgatcttcctgatcggctcggcgctgtgcgggatggcgcagaacatgcccgagctgatcgcgttccgcgcgctgcagggcctgggcggcggcgggctgatggtgctgtccatggccatcgtgggcgatgtcgtctcgccgcgtgaccggggccggtaccagggcctgttcggcgccgtcttcggcgcgaccagtgtgctcgggccgctgctcggcgggatcttcacccagcacctcagctggcgctgggtgttctacatcaacctgcccgtcggcatcgtcgccctcgccgtgatcgccgccgccctgcacatcccgcgcaaggcgcagcaccacgtcatcgactacctcggcacgctgctgatcgccacggtcgccacctgcctggtcctggtcgcctccctcggcggcaccacgtggccgtggggctcgccgcagatcatcggcctggcggtggcgggcgtcgtcctcgcggtggcgttcgtggccgccgagcacagggcggccgagccggtgctgccgctcaaactgttccgcatccgcaccttcagcctctccgccgtcatcagcttcatcgtcggcttcgcgatgttcggcgcgatgacgtacctgccgacgttcctccaggtcgtgcggggcatctcaccgacgctgtccggtgtgcacatgctgccgatggtggtcggcatgctgctggcctccaccggctccgggcagatcgtgagccgtacgggccgctggaaggtgttccccgtgaccgggacggccgtcaccacgatcgggctgctcctgctgcaccggctcgacgagcacagttccaccgccgagatgagcggctacttcttcgtcttcggcctgggtctcggcctggtcatgcaggtcctcgtcctcatcgtgcagaacgccgtcagctacgaggacctgggcgtcgccacctccggcgccaccttcttccgttccatcggcgcgtccttcggcgtggccatcttcggcacggtcttcgcgagccggctcgccgaccagctcaccgccgccttccggggcgcccacctgccgccgggcgtctcggccggcaccctcaagtccgacccgcgcggcatcgccgccctgccgcccggcctgcgcccggcggccctgcacgcgtacgcctccgccatcaccgacgtcttcctctacgccgctccggtggccctcctcgccttcgtcctggcctggttcctgaaggaggacaagctgcgcgcctcggtcacggcacccgacggcacccagacgctcgccaccaacccggtcgaacggtcctcgtacgacgaggtgtgccgcgcactgtccgtgctgggcacgcgggagggacggcgtgagatctaccggacgatcaccgcacgggcgggctacgacctgctgcccgcgacgagctggctggtgctgcgcatcaagcggtacggctgggtggagcccgcgctgctggccgagcgggtgcccgtgccgctgacggtcatcctggaggcggcccgccaggtcgaggagcggcacctggcccagcggctcggtctggacctcgtcctgaccgaccagggacgcgaggtcgccgagcggctggcgcgggcccgcgaggagtcgctcgccgaactgctcggcgactggtgggggcccgaccggccgaccgacctggcgcagctggtgagggaactgacgggagagctgtgcggctccgacgcggaacggccgcacgacgagcggccggtcacccgccagacgtcccggcaggcctaggtgctgtcggaggctcagccgagcggcttgctgaaccagtgctcggcgtacgggtcgtcgttgtgccggccggtctccgtgtagcccagccgcgcgtacagggcgcgggcctccaccaggtcgccgcgggtgtccaggatcatccgccgggcgccgagcgcgcgggccgcgtcctcggcggcgccgaccagcagggccgcgccgccgctgccgcgcgcctccgcgtgcaggaagacgcgcgtcagctcggcggtggccgcgtccagcagccgtacccccgccgtgcccgccggccgcccgccgtaccacccgaccagcaactgtcctgtgggcggggcgagttcggagccggtacgggcggagatctcccgctccagttcggccgggtcggtgcggcggccttcgtgcagcaggtaccagcggtcgctgacctcggtgtagtacgcccgccagagcgcggcggcgacgggggagtcgtagggctcgggggccacggtccagggcgcgccttcggccgggggcacgggcggaagcggcggtgtggcatcggtcctgggctgcatacggacattctcggcgcgggaccgcggggctccgcaaccggttatccacggccacccaccgcgtgccgcaccgggccccgcgcctctgcgtgccgcaccgggccccgcgcctctgcgtgccgcaccgggccccgcgcctctgcgtgtgccgcaccggccccgcgcttctgcgtgccgcaccggctccacgggcgccgctcgccgcaggggcccacgggcgccgctcgccgtgcgggccccgcgaccgccgctattcgctcgccgtgcgggtcctccgcagttcgcggcgctggcgccactcgcctacgacctcttcgacgtcgtaccgcttcagacccagcggggggccgggcgggggcttgagcatcatgtcgaggatcttcgtgttgatgtccgcgatgatcttccggacggtgctctccgagggcgccgcgtacgccgccgtcagcgcgtcctcggcctccttgcgcagggcgagcgagggcggcaggacggacaggccctcgcgggccatcttgcgcttgacccaccacagttcgtcgtacgtggtgtcgtccggcaggggcttgcccgcgccgggcagccggtcgaagtcgccgcgcccctgcgcgtcacggatctccttctcgacccaggactcgaacggcacacccggtggctttcgctcggtcatgaggccattgtgccggacgcgccccgcccaggcgatttatcatgccgccgcggtgcgtcaaccgggcgctccgtcaccggtgttggcgcgcacggccgggcacgcggcgaaggcagcggtccggggcgccccgaaccacgaggagcgcacgtgctcgaactcaccatggccgccgtctccgggacggacgcgggctccacggccggcatgctgatggccgacgcgcccagcgacccgggcgccgtgctgcgcgtgggccgggaccgggcggtgtgccgtctggtgacgcccgacgactggctgttcgtctcccgggcccacctggagttccgctgcggacccgaaggcgcctggcaggtcacctggctgcgcggctcgcagcccgagccgtcatccgaggtccgcctgacggtgggcgagcacacgcagcccctcgcctacggcgacacggcggcgctgccccggggcggctcgggcgagatcatcgtccacgaccgcaccagcccacgcagcgtgaacgtgggcttctaccacgaggtctagtccactcacccctgtcagtcctgtcacccctgtcagtcctgtcagagctgtcagtccactcagccctgtcggcccaggcgctccagtcagcgcggtcagtccagtacgcgggcgagcgcgaagccgtcgtagcccttgctgccgaccgtctggatggcggtgccgtccagacggggatgctcggcgatgagttcgagggcggcccgggtgccccgcacgctcgggtccgtgctcgccgggtcggtcacctggccgccgcgcaccacgttgtccaggatgatcaggctgccggtgcgcgtgaggcgcagcgcccactccacgtagtgcgggttgttgaccttgtcggcgtcgacgaagaccaggtcgaagggtggcgggttctcgtcggcgagcttgggcagcgactccagtgccgggcccacccgcacctcggcgatccggtccaggccggcgtgggcgaggttgcggcgggctacgtcggcgtggtgggcgtcgtactccagtgtgaccaggcgaccgtcggcggggagcgcgcgggccagccagatggtgctgtagccccccagggtgccgatctccaggatgttgcgggcgccctggaggcaggcgaggagctgcagcagcttgccctggttcggcgtgacgttgatgtgcggcaggccctcggtgtcgctgtcacgctgcgccgcctggagggattcgtcctccggggagagcagggcggtgaagtaggcgtccacgtcgtcccagagctgcgagtcgctcatgcaccatgcctttcgtgtgcctagttagatgcgctaactagctgtgctaacgaatatagccccggcgcggacaccacgggaatcagtttcgaggaatttccgccgatcggctcggggacgcgcaggcgcgcggacgtgcgcagcggggcggatgtgcggaagggggcggatatgcggaagggtggacgcggcatcgcgcgcgtccacccttccgtcagagcctcgcagtcaggcctcaggactccaccgccggcggcgaacccggcagcgggcggcccgcagactccgtcatgaaccacaccgccacgccgccgaccagcgacgccgccatcatgtagtaggcgggcatcatcatgttgccggtggcgccgatcagtgccgtgacgaccagcggggtcgtgccgccgaacagcgacacggagatgttgaagccgatcgacagggagccgtagcgcacccgggtcgggaacagcgcgggcagcgcggacggcatcgccgcggtgaagcagaccaggagcaggccgagcgcggccatgcccaggccgaccgccagcagactgccctggcggatcagcagcagcgccggtacggacaggaacaggaagcccacgcagcccgccgcgatcaccgggcggcggccgatccggtcggtgagcgcgccggcgaacggctggacgatcatcatcagcgccatcacggccagcacgaccagcaggccgtgcgtctcgtcgtacttcagctcactggtcaggtagctcggcatgtacgacagcagcatgtagtcggtgacgttgaagaccagcaccaggcccatgcacagcagcagcgtcttccactggcccgcgaccatctcgcgcagcggcaccttggggcggctcgactcggccttctcgacctcggcggcgaacgccggggtctcctcgaggcgcatccgcaggtagaggccgatgatgcccatggggcccgcgatcaggaacgggatccgccagccccaggacgtcaggtcgtccgtggacagcagcgccgtcatcagggtcaccaggcccgcgccgccgatgtacccggcgagcgtgccgaactccagccagctgccgaggaagccgcgccgccggtcgggggcgtactcggcgatgaaggtcgaggcgccggcgtactcgccgccggtcgagaagccctgcaccagccgggcggccagcagcaggatcggggcgccgacgccgatcgtcgcgtacgacgggatcaggccgatggcgaaggtgcccgcggccatcatgatcatggtgacggccagcaccttctggcggccgatccggtcgccgagcgggccgaagaccatgccgccgaccgggcggaccaggaaggccgcggcgaaggcgccgaaggtggagagcagctgtgccgtggggttgccggacgggaagaagaccttgcccagggtcaccgcgatgtagctgtagacaccgaagtcgaaccattccatcgcgttgcccagcgcggcggccttcactgcgcgccggacgagtgccgggtcggtgacggtggcctcggggtggccggagcgggcggaacgtttcttggtgagggacacggaacggggcgcggtgacggtggcagccgacaaggcttcgctcgcctacctttcgacgggggcagggacacggcccacgcggcagcgctgtcggcggaccaaaccggcccacgcggaacgcggaccgaaccggcccgcgtgcggcacggaccggaacggtccttctccacacggcttggccgaaaagcgaccattgcggcgggccggaaatcgaccatacgtccgcctgggcgccttacgtatcgtgagcatgtagctgcgcagtgcagctaaacgcgcgatacgcaggtacgtatgcccgccgccggccgccgcgcacgtgcccgcgttgtgatccttgtcgcgccgcggggacgtcgtgtccgc

SEQ ID NO: 427 - DNA, 12326 bp, Unknown
  Kingdom: Bacteria, Phylum: Actinobacteria, Class: Actinobacteria, Order: Streptomycetales, Family: Streptomycetaceae, Genus: Streptomyces
ctccggccccgcgccccatgcctcggccgccctcccgcgagcccccgccgccccggcttacagccgacttatggccgaaaagggcaggatggaggcaacacacccatgaagatccctgcctgcgtgcgcccgagcggtggcgcgcgggcggacacaggaaggacaagcgacgtgcgcgtactcgtcgtcgaggacgagcagctgctcgccgatgcggtggccaccggactgcgccgggaggccatggccgtcgacgtcgtgtacgacggtgcggccgccctggagcgcatcggcgtcaacgactacgacgtggtcgtcctcgaccgcgacctcccgctcgtgcacggcgacgacgtctgccgcaagatcgtcgagctgggcatgcccacgcgcgtgctgatgctcaccgcctccggcgacgtcagcgaccgtgtggagggcctggagatcggcgccgacgactatctgcccaaacccttcgccttcagcgagctgacggcccgcgtgcgtgccctgggccggcgcaccagcgtgcccctgccgcccgtcctggagcgcgccgggatcaagctcgaccccaaccgccgcgaggtcttccgcgacggccgggaggtccagctggcgcccaaggagttcgccgtcctcgaggtcctcatgcgcagcgagggcgcggtcgtctcggccgagcagctcctggagaaggcctgggacgagaacaccgacccgttcaccaacgtggtgcgcgtcaccgtgatgacgctgcgccgcaagctgggcgagcccccggtgatcgtcaccgtgcccggctccggctaccggatctgatccgcgtggcagcgtcacccgcgccgccccaggcgccaccgaagcccacctgggacccccgcaggcccgaaccgcccttcccgtggctgcgcccgaccatccggatacggctcaccctgctgtacggcggcatgttcctgatcgccgggatcctgctcctgtcgatcatctacctgctcgcggcgcacgcgctgaacgtgggcagcgaactcccgttcaagatcgtctccgggcaggtctccagccagacctgcaacttcccgaaccccacgacggcggacgagctgaaccgcgccatgaacgagtgtgcgaaccagcagcgccagcacgctctggacgacctgctcagccgctcgctgctcgccctgctcgggctcgccgtcatcgccttcgccttcggctacgccatggcgggccgggtcctggcaccgctgggccggatcacccgcaccgcccgcgcggtggccggctccgacctgtcccggcggatcgagctggacggcccggacgacgagctgaaggagctggcggacaccttcgacgacatgctggagcggctgcagcgggccttcaccgcgcagcagcgcttcgtgggcaacgcctcgcacgagctgcgcacgccgctggcgatcaaccgcacgctgctggaggtgcacctgtccgacccgcacgcgcccgtggagctgcagcagctcggcaagacgctgctggccaccaacgagcgcagcgagcagctcgtggagggcctgctgctgctcgcccgcagcgacaaccagatcgtcgagcgcaagccggtggacctggcagaggtcgcctctcaggcgatcgaccaggtgcacgcggaggccgaggccaagggtgtggtgatccggggcgagcgcaagcccgccgtcgtccagggcaacggcgtgctgctggagcggatcgcgctgaacctcgtgcagaacgcggtgcgttacaacgtcgccgaggacggttgggtcgaggtcacgacggacgtccagcacgggcaggccgtcctggtcgtcacgaacaccggtccggtcgtgccggcctacgaggtggacaacctcttcgagcccttcaggcggctgcgtaccgagcgcaccggcagcgacaagggcgtcggcctcgggctgtccatcgtgcgctccgtggcgcgggcgcacggcggccacatcgcggcccaaccgcgtgagggaggcgggctcatgatgcgagtcaccctgccggtctgagaccatggcggcgacaccgcgaggatgttcgctttacgcggaattttcggggccccttaccaacctctgcctgtgtgatcgatcacagggactgatttccggccatctactgtccgtgatcatggagggcggcgaaaagtcggaaaaatccgggttttcaggggtcctgatcacgggaagtacacggtgagaccgctttgaagtgcgacattcgaaccgtgtacggtccccatcgccatccaagccgatcactcttgaggagtgcggttgggtgtcgattgagtaacagaccttgatgtgaggcaaaatctccgcctcgggtcgggcacaagtccggcctctcacgcgttacgtgcgctggagacacccgcagacacccagagggggagagcgacatggcaaccgattacgacactccacgcaagaccgacgacgacgtcgactcggacagccttgaagagctgaaggccaggcggaacgacaagtcgacctccgcagtggacgtcgacgagttcgaggccgccgaaggcctggagcttcccggcgcggacctctccaacgaggagttggccgtccgggtgctgcccaagcagcaggacgagttcacgtgcatgagctgcttcctggtgcaccaccgcagtcagctggcccgcgagaagaacggtcagccgatctgccgcgactgcgactgaggcagggtcggccgtgaccggctcgacccctccttggaagcgccgcttctcccacggggaagcggacccggagccgtcccacggctctcacggcgcgcgtgaccacgagcgaggcccatcccgtccgtccgacggggcagatccgtccgacctgacggatcagtccgacaggacagatgcgacagcatcgacgggatcggcctcgctcgcgcaggtgtcagggcgtggcgaccccgccgcctcggcggcaagtcccgcgcccctcgccaggcgccgtatcgcggtggtccgtgaacgggccggcgaggccgccaggaacggcgtccgcaagagcggaagccgggccagggcggcactgtcccacctggccgaccgcatcatcgacctcgcaccccgcatcccggtgcgcgacctcgccacactccgcaagcagttcccgggcctcggccccgaggaactcgcggacaggctcgtggcgggcgccgcccacgggacgtccaccatcggcgccgggatcggcgcggcggccatgctgcccgtaccgcccgccatgcccaccgaactggccaccgagatcaccggcgtcgccgccgtcgaactcaagctgatcgccgaactccacgaggtctacggagtgcgacccccgggccacctgagagcgcgcagcgccgtgtacctgtcctcctggtcggacgagcgcgggatcgacgtgacgaggccctcgtccgtcgactcggccctcggcggccagatgaagcgccatctgcgccagcagatcatgaagcgcatggtccgggacctgccgcacctcatgccgttcctggtgggcgcagccgtcggcgccgtgatcaaccggcgcgacaccaggagactcgcggcccgcgtccgcgccgacctgcgcaagatccaggtcccctgggacgaactgcccgcgctgccgcccctggagaccccgcagtcaccgctcccgatggacgacggcccgcaggaagctgactgagcggcgaccagggctcgtccggcggatcaagtcgcaggaggggtacggcgctctgtgtgcccaggtgagcggggtgtggtgcgtgccgctgcaaggcggaggagggcgtcgacgcgatgggggtccctgccgcgcgagcgaagccgagcgtgggggagtcggcagccgacgacaacgccgctgggggtccccctgctcgaagagcttgggggagggcgtgccacaccccgcgtctgcggggtgatccgccggacaggccctaagccgccgtctccggagacgtggccgcccgggccgcccgcagggcctccgccagccgctccggctcgcgcgtcgacaggtacagatagggcgtcgggtcctccgggtcggtgacctccacacgcagcgccgtgggaatgtaggcgcgcagcagcaggaacgcccgggtgtcggccttgtaggtgcgccaggcgcgcgcctcctcggcgtccaggatctccgactcgcccagggccgtgaccggcaccttcgcctcgcccgcgatcagcgagccgcccacgacgcggatgcggaccgagccgtaggagctggccacgaccgcggcgaccgccgtgccgccgaccaggccgccgagcaacggcaggatgccgaacggcaagaggatcaaggcgcacgagacaccgatcaggaagctgatcagccaccaggaacggggggcggtgagacgttcttcgtacggctgggcggaaagctgcatgaaaccaagcttggcacggtgtcggggcaacaccgacgcgcgggtaaggtctgcgcctgtgagtggtagttccgcagctcttcagcctcccgccgacgcccagaagcccgtacggcaccccgacgcccccgcgcccggggaactcctcggtgcgcactacggcggatgtttcgggtgcggcggcgaccagccgcacggtctgcacctgcaggcccgggccggggacggcgtccgcatcaccgccgagttcaccgtgcagagcgcccaccagggcgcgccgggcctcgcgcacggcggcatcctcgcgaccgccctggacgagaccctcggttcgctgaactggctgctgcggacgatcgcggtcaccgggcgcctggagaccgacttcgtgcggccggtgccggtcggtacgacgctccacctggaggccgaagtcacggcggtggccgggcggaagatctactccacggccaccggccgcgtcggtggccccgacggaccggtcgccgtccgcgccgacgcgctgttcatcgaggtcaaggtcgaccacttcgtgcagcacggccgcgacgaggagatccaggccgccatgagcgacccggaccaggtccggcggacccgcgccttcgaggtgaacccgtgaaccccagcgccccgctgaacgccggtgatcccgtgaacggtgatcccgtgaaccccggtggctccgtgaaccccgcgggccgcccgcccctggacgtgctgatccgccgcgtcgatcccgacgtaccgcttccggggtacgcgcagccgggcgacgcgggcgccgacctgcgcacgacggtcgcccgcacgctcgctcccggcgaacgggccgtcctgcccacgggcgtgtccatcgcgctgcccgacgggtacgcggccttcgtgcacccccgctccggcctggccgcccggtgcggtgtcgccctcgtgaatgccccggggacggttgatgccgggtaccgtggggagatcaaggtgatcgtggtgaatctcgacccgcgcgagtccgtgcggttcgagcgcttcgaccggattgcccaactggtcgtccagcaggtcgagagggtccgcttccaggaggtcgcggaacttcccgattcggcgcgggccgaggggggcttcgggtccaccggtggccatgccgcggtggacggtgagagcggcacaagcggccggaccgccatgggcggaccggcgggtgggaatcgatacgcttcggtcgtatccgaccgggaaggacagtgacgtgttcggacgtcgcaagaagaagggtgccgccgaggacgcggccggcgaggccgagcaggtcgtcgacagcgtcgacaccgaggcggacgaagaggaagcgggcgagcgcgagcgggtgcgcctcgagcccgaaccgcggcccgacgggccctgggacagcaccgaggtcggcgacccgaacgagggccgcgtcgacctgggcggcctgttcgtgcccggcgtggacggcatggagctgcgggtggaggtcgcgggcgacgcgatcgtcgcggcgaccgtcgtcctgggggacagcgcggtccagctgcaggccttcgccgcgcccaagcgcgagggcatctggggcgaggtgcgcgaggagatcgcgtccggcatcacgcagcagggcggtgtcatcgacgaggtcgagggaccgctgggctgggaactgcgcgcccaggtgccggtgcagctgccggacggtacgggcggcttccaggtcgtgcggttcgtcggcgtcgacggcccgcgctggttcctgcgcggggtgatctccgggcagggcgcggtgcagccgcaggcggccggactgctggagcagatcttccgcgacacggtcgtggtccgcggcgagggcccgatggcgccccgcgacccgatcgtgctgaagctgccgaacgacgcgcagatggtgcccgagggcgtccagcaggacgagggccagtcccgcttctccggcggcatgggccagctgcagcgcggcccggagatcaccgaggtccgctagtacgtaccaccgcaggtcaccgagtacgtaccagcgcaggacaccgagggccgcacccgcgaaggggcggcccttctgcaccgcgcttccgacggtttccacggttttcgtggtcggtcccacggtctttgtggtttccccggttttcgcggattccgtcgttccggcggaactcgataccagttgccgtccgttgagggattgatcgaatgggctgccggtcgtgatactggcgcacggtccacgggggagcacgacggggagggcagtccatgagccaggtcgccaccgacacgatggtgcgtgtcgagaacgtccacaagtcctacgggcagggcgccggcgcggtgcacgccctgcgcggcgtctccttcgaggtgccgcgcggtgaactcgtcgcgctcaagggccgttccggctcgggcaagaccaccctgctcaacatcgtgggcggcctcgacgagccggacgagggccgggtccaggtcgacgggcgggacctcctggaactgggtgaggagggcctgctcgccctgcgccgggaccgcgtcggcttcgtcttccagtccttcggcctgatccccatcctcacggccgcggagaacgtcggggtgccgctgcggatgcgccgcgccgacccccgcgagcgggaggagcgggtggaactgctgctctccctggtcggcctcgccgatcacgccaagcagcggcccggcgaactgtccggcggccagcagcagcgcgtcgccatcgcccgcgccctcgccaacgaccccgcgctcctcatcgccgacgagccgaccggccagctcgacgcggagaccggcctcgccgtgatggaactcctgcgtgccgtcgtccacagccagcaggtcaccgccctggtcgccacccacgacctgaccctcctcgacctcgccgaccgtgtcctggaactccgcgacggcgagatagtcgaacactgaggcgcggcggcactgaggcggcgcgccccgcgtcagagttgcgtcaaagacgtccgctagggcctccccccgccccttttgcccggatccccggccgtaaggtcgacgctgcgtgcacaggtgtgacgggaagacaatgaggccatgggacgcggcaagctccggatctatctcggtgcggcaccgggagtcggcaagacgtacgcgatgctgtctgaggcgcaccgcagggtggagcggggcaccgactgcgtcgtcgcgttcgtggagcaccacgaccgcccgcgcaccgaggtgatgctgcacggcctcgaacaggtgccccgcaggacgctggagcaccgcggttccgccttcaccgagatggacgtcgacgcggtgctgcggcgcgccccggcggtcgccctcgtggacgaactcgcgcacaccaacgtccccggctcccgcaacgccaaacgctggcaggacgtggaggaactgctcgccgccggcatcgacgtcgtctcgaccgtcaacatccagcacctggaatcactcggtgacgtcgtcgagtcgatcaccggagtacggcagcgcgagacggtgcccgacgaggtcgtacgccgcgccgaccaggtcgagctggtcgacatgtcgcccgaggcgctgcgccgccgcatggcgcacggcaacatctaccagccggacaaggtcgacgccgccctgtccaactacttccggcccggcaacctcaccgcgctgcgcgagctggccctgctgtgggtggccgaccgggtcgacgagtacctgcagcagtaccgcagcgaccaccgggtgtcgaagatctggggctcgcgcgagcggatcgtggtgggcctgaccggcggccccgaggggcgcacgctcatccgccgggcggcccggctggcggagaagggcgcgggcggcgaggtcatggccgtctacatcgcccgcagcgacgggctgaccggcgcctcaccgaaggagctggccgtccagcgcaccctcgtggaggacctgggcggcaccttccaccacgtcgtcggcgacgacataccggccgccctgctcgacttcgcgcgcggcgtgaacgccacccagatcgtgctgggctcctcgcgccgcaagacctggcagtacgtcttcggacccggtgtcggcgccacggtggcccgcgagtccggccccgacctcgacgtgcacatcgtcacccacggccagatcgccaaggggcgcgggctgccggtggccaggggcgcgcggctcgggcgggtgcggatcgcctggggctgggtggtggcgctcgccggcccggtggtcctcgccctgctgctgaacggcgtcgacctcggcctggccaacgacatgctgctgttcctcaccctgaccgtggcggcggccctgctcggcggactgctgccggcgctcgcctcggcggctctcggatcgttcctgctgaactactactacacaccgcccctgcaccggctcaccatcgccgaccccaagaacatcgtggccatcgcgatcttcgtcggggtcgccgtgtccgtggcctccgtggtcgacctggcggcccgccgcacccaccaggccgcccggctgcgcgccgaggcggagatactgtccttcctcgcgggcagcgtcctgcgcggcgagaccagcctggaggccctcctggagcgggtccgcgagaccttcggcatggaatcggtggccctcctcgaacggcagagcgacgtggacccctggacctgcgccggccgggtgggcgcggaccggccgctgcagcgccccgaggacgcggacgtggacatgcccgtcggcgaccacatggcgctcgcgctgaccggacgcgtcctgcccgcctccgaccgccgggtcctggccgccttcgccgcccaggccgccgtcgtactggaccgccgccgcctccaggaggaggccgaccgggcccgcgccctggccgagggcaaccgcatccgcaccgcgctcctcgccgccgtcagccacgacctgcgcacgccgctggccgctatcaaggccgccgtgtcctcgctgcggtccgaggacgtcgagtggtccgaggaggaccgcgccgaactgctcgaaggcatcgaggagggctcggaccggctggaccacctggtgggcaacctgctggacatgtcacgcctgcagaccggcaccgtcaccccgctgatccgcgagatcgacctcgacgaggtggtgccgatggcgctgggcggcgtgcccgaggacagcgtgcacctcgacgtccccgaatcgctaccgatggtcgccgtggacgccggcctgctggagcgcgcgatggccaacatcgtcgagaacgccgtgaagtacagcccggcccgcgaaccggtcctggtgtcggccagcgccatcgccgaccgcgtcgaggtacgcgtcgtcgaccgcggccccggcgtgccggacgaggccaaggaccgcatattcgaacccttccagcggtacggcgacgccccgcgcggcgcgggcgtcggtctcggcctcgcggtggcgcgcggcttcgccgaggcgatgggcggcaccctcaacgccgaggacacacccggcggcggcctcacgatggtcttcagcctccgcgcgcccggaccggtcgaagagccttccgggccggacgaggagcggcccggaccggtgggtgggccgtccggatcggctaaggcgccttccgggccggtcgaggagcggtccgggccgcccggcagactgagccccgtacatccagaaaggcaggtttcatgaccagggtgctggtggtcgacgacgagccgcagatcgtgcgtgccctcgtgatcaacctcagggcacgcaagtacgaggtcgacgcggcgtccgacggccgcaccgccctggacctcgccgcctcccgccaccccgacgtcgtcgtcctcgacctgggcctgcccgacatggacggtgtcgaggtgatcaggggcctgcgcggctggacgagggtgccgatcctggtgctgtccgcccggcactcctccgacgagaaggtcgaggccctggacgcgggcgccgacgactacgtcaccaagcccttcggcatggacgagctgctggcccggctgcgcgccgccgtccgccgcgccgagcccgtcgggaccggcgaggacgacgtgacgacggtggagaccgcgcagttcaccgtcgacctcgccgcgaagaaggtcaaccggggtggcaaggacgtacggctgaccccgaccgagtggcacctgctggaggtgctggtgcgcaacaccggccggctggtcagccagaagcagctgctgcaggaggtgtggggcccttcgtacggcacggagacgaactacctgcgcgtctacatggcccagctgcgccgcaagctggaggccgacccgtcgcaccccgagcacttcgtcaccgagccggggatgggctaccgcttcgagaagtgagacgcgcgaagcggctgccgcaagtgagcgcggttacggtcctgtcggcccatcccggtacccttcagacatgagtgctgttcctcgacccgagaagccgacgggcaggttccggcgcatgctcgaccggctctcctcctcccaggaggacctggagtcggaggagctgcgcgaggacgccgagaccgcggggtgcacccggatcggtgactgccacgaccggcagatcgtcacggttactggtaccttgcgcacggtcaccctgcgtccgcgcgccggagtcccggccctggaggcggagctgttcgacggctccgcggccctggacgtggtgtggctgggcaggcgctccatcgtgggtatcgaaccggggcgcaagctgatcgcatcgggccggatctccatgagccggggccgccgggtgctgttcaacccgaagtacgaactgcgacccctcggacgggagtagcccgtgacgtcactcgacaagcggaccgaagacacgaccgcggacgacgagtccagggcggtgacggaggccgcgcttttcgaggcgttcggcggggtccggggcatggtcgagaccgtgctccccggcctgctcttcgtcagcatcttcacggtcaacaaggacctgcactggtcggcgatcgcggccctcgcggtctcggtggtgctggtcgcggtccggctggtgatgcgggacaccgtcaagcacgccttcagcggcgtcttcggcgtcgccttcggcgtggtcttcgcgatgatgaccggcaacgccaaggacttctacctgccgggcatgctctacaccctgggcctcagcctggcgtacatcatcacggcgctcgccggggtcccgctgatcggcctgatcctcggtccggtcttcaaggagaacctctcctggcgcacccgcaacccgggccgcaagaaggcgtacaccaaggccagctgggcctggggcctgatcctgctcgccaagtgcgcgatcctcttcccgctgtactggtgggcgaacaccgcgcagctcggctgggtcctggtcgccctgaagatcccgccgttcctgctggccgtctacctgacctgggtgttcctggcgaaggcgcccgcgcccatcgacgtgttcgcggagatggaggcggaggagaaggccgaggaggagcgcaaggccgcgctggcggccgagcgcggcgagggccaggacggcacgcccccggcgggcccgacggccggccgccaccgccgcggggcgtaggccgcccagtccggcccgtacaaggccgaagcggtacgccgacgagggcgtacgagcgggccccggacttccgtacgacggcgaggggcgcccgg

SEQ ID NO: 428 - DNA, 2893 bp, Unknown
  Kingdom: Bacteria, Phylum: Actinobacteria, Class: Actinobacteria, Order: Streptomycetales, Family: Streptomycetaceae, Genus: Streptomyces
cgagcgccggcagggttacggaaaccgccatggtttcggttgctccttacgaagtacggaagtctgtgtcgtcgcgcccgttgaccgaaggctcagtcgtgggagtggaggggcttgccggccagggccaggtgggcctcgccgagcgcctcgttctgcgtcgggtgggcgtggatgagctgcgcgacctcggccggcagcgcctcccagttgtagatcagctgcgcttcgccgacctgctcgcccatgcggtcgccgaccatgtggacgccgaccacggcaccgtccttgacctggacgagcttgatctcgcccgcggtcttgaggatcttgctctttccgttgcccgccaggttgtacttcagggcgacgaccttgtccgcgccgtagatctccttggccttggcctcggagacaccgacggaggcgacctccgggtggcagtacgtcacccgggggacaccgtcgtagtcgatcggaacggtcttcagaccggccaggcgctccgccaccaggatgccctcggcgaagccgacgtgcgcgagctggagggtggggaccaggtcgccgacggccgagacggtcgggacgttggtgcgcatgtactcgtcgacgaggacgtaaccgcggtccatcgcgatcccggcctcctcgtagcccaggccctgcgagaccgggccgcggccgatggcgacgagcaggacctcggcctcgaactccttgccgtcggcgagggtgaccttgacgccgtcctgggtgtactcggccttctcgaagaacgtgccgaggttgaacttgatgccccgcttgcggaaggcgcgctccagcagcttggagctgttctcgtcctcgaccggcacgaggtgcttgaggccctcgacgatggtgacgtcggtgccgaaggacttccacgccgaggcgaactcgacgccgatcacgccgccgcccaggatgatcgcggactgcggcacacggtccaggacgagcgcgtggtcggaggagatgacgcggttgccgtcgatggtcaggccgggcagggacttcggcacggatccggtcgccaggaggatgtggcggccctggatccgctgaccgttgacgtcgacggaggtcggggaggacagccggccctcgccctcgatgtacgtcaccttgcgggaggcgatgaggccctgcagacccttgtacaggcccgagatgacctcgtccttgtacttgtggacggcggggacgtcgatgccctcgaaggaggccttgacaccgaactgctcgctctcgcgggcctggtcggcgatctcgcccgcgtgcagcagggccttggtggggatgcaaccccggtgcaggcaggtaccgccgaccttgtccttctcgatcagggcgacgtccaggcccagctgcgccccgcgcagggccgcggcgtaaccgccgctaccaccgccgaggatcactaggtcgaaaacggtgctggcgtcgttcgccacgtcacgtcctccatgcatgtgcgccgtgccggtcgtcggtgaccggcgggcggcttgtgtccggccgctcgttcttcggccctttgggtgggggccctgtcctgccgtcgcccatcttcgcacttgtcgggggtgaacgagacgcggggccggggtgtgagacatcccacccaccggccgcacccgctcgggccggaacgaggacggccccggagcggcgtgcgcccggggccgtcctcgcggagggacgagacctcagcccaggtcgcccgccgccgtcagctcggcgagccggacgagcgtgcgcaccgcgctgcccgtgccgcccttgggcgtgtagccgaagggaccctgctcgttgaaggccggacccgcgatgtccaggtgcgcccaggtgatgccctcaccgatgaactcgcgcaggaacagaccggcgaccaggccgccgcccatccgctcgcccatgttggcgatgtcggcggtgggggagtccatgcccttgcgcaggtgctcgggcagcggcatcggccacgccgcctcgccgacctcctcggcggcctcgtggatcgcggagcggaacgcgtcgtcgttcgccatgatcccgaaggtgcgggcgccgagcgccagcaccatcgcgccggtcagggtcgcgacgtccacgatcgcgtccggcttctcctgcgaggccgcccacagcgcgtccgcgaggaccagccggccctcggcgtccgtgttgagcacctccaccgtcttgccgctgaacatgcgcagcacgtcaccgggacgggtggcggaaccggaaggcatgttctcggccagcgccagccagccggtgacgttgacctccaggccgagccgggcggcggcgacgacggcggcgaacaccgcggcggcaccgctcatgtcgcacttcatcgtctcgttgtgaccggccggcttgagcgagatgccgcccgagtcgtaggtgatgcccttgccgacgagcgccaggtgcttcttcgccttcgggctggtgtacgacagcttgaccagtcgcggtgccgccgccgaaccggcgccgacgccgaggatgccgccgtagccgcccttggcgagcgccttctcgtccagcacctggatcttcaggccgtgcgccttggccgcgtcctgcgccagggcggcgaaggcggccgggttgaggtcgttcggcggggtgttgatgaggtcgcgggcgcggttcagctcctcggcgacggcggtggcacgctcgatggccgccttgtacgccttgtcgcggggcttgccgccgagcagcacgacctcggcgagcggcgccttgccgccccggcccttggcgtccttgccgttctccttgtaggtgtcgaaggagtacgcgccgagcagcgcgccctcaccgacggcgccggcgtcgg

SEQ ID NO: 429 - DNA, 2058 bp, Unknown
  Kingdom: Bacteria, Phylum: Actinobacteria, Class: Actinobacteria, Order: Streptomycetales, Family: Streptomycetaceae, Genus: Streptomyces
gggtccgcaccggcgagcgcgtccgggccgcgctcgccggtgcggacccggaccgccgtctcgacgggcagggaccagacctttccgtcaccgatcttgcccgtgcgggccgccttgaccacgacctcgatcagctcctcggcgtcgtcgtcctcgaccagcacctcgatccggatcttgggcaccaggtcgacggtgtactcggcaccgcggtagacctcggtgtgcccgcgctggcggccgtagccgctggcctcggtgacggtgagcccgtggacgccgaaagcctgcagggcctccttgatctcgtcgagccggtgcggcttcacgacggcggtgatgagcttcatgcgtccaccttcttgctcggcttgctcggcttgctctgcctgctcggcttgccctgcgtgcccgctgcggcggccgtggccagggcggtgagggtgccggcgacaccgccgcccgcgccactgaagtcgtaggcggtctcggcgtgctcggcctggtcgatgccggagacctcctggtcctcggtgacgcgcatcccgatcgtcctgtcgatcaggaacgcgaggacggcggaggcgaccagggagtaggcgaggacggcaccgactccggcgcactgcttccagaactggcccaggccaccgccgtagaacaggcccttgacgtcggactggcccgtgccgctggcgaagaggccgaccaggagggagccggtgatgccgccgaccatgtggacgccgacgacgtcgagggagtcgtcgtagccgaaccggtacttcaggccgaccgccatggcgcacaggacgccggcgacggcgccgaccgcgatggcaccgagcggggagaccgcgccgccggacggggtgatggcgaccaggcccgcgaccgcgccggacgcggcgcccagtgtggtgcacgcgccgtggcggatcttctcgtaggcgagccaggccagcatggcggcggcggtggcgacctgcgtgttgacgaacatcagcgggccgacgccgtcgtcgttgccgagccacgagcccgcgttgaagccgaaccagccgaaccacagcagccccgcgccgagcatgacgaggggcaggctgtgcgggcgcatcgggtccttcttgaagccggaccgcttgccgatgacgaggatcacgccgagcgccgccgcaccggcgttgatgtggaccgcggtgccgccggcgaagtcgatcacgccgagcttgaaggcccagccgccgctgccccagacccagtgcgcgaccgggaagtacacgatcgtgacccacagcaccacgaacagcgcccaggcggtgaacttcacccggtccgccagggcgccgctgatcagggccggtgtgatgaccgcgaacatcagctggaagacggcgaagacgaagaccgggatggtgtagccgggccacaggtcggtcttgccgatcccggcgaagccgacgaagtcggacgtccagccgatgagcgagcccttgtcggcgccgaaggcgatcgagaagccgtacagcacccacaggatggtgacgatcccgaggctgatgaagctcatcatcagcatgttcagggtgctcttgacgcggaccatgcctccgtagaagaaggccaggcccggggtcatcagcatcaccagggcggaacagatcagcatgaagcctgtgttggcggacgacagttcgggtgcgtccgccgcgagcatgatggctggtgccatcggcgtctcctcgtcgtgtggtacggccccgtgcgggcgaagccttggcggcggccccggcagcgagtccgggggcgtgaggggcgggccggttctgcgccacgagactcgcgcagcgcggtttcggtggacgcccctcgttgtttcgccggggtgacgaagacgcctgctgtgttacgcgtcggtgaattgcgtacggcggtggagtgcgtgccgcggtggaccgcacgcgccagggatcggtttcggcagcggaccggccgcggcggccttccgatgacctggcatggggggagccgagtcgggcggttcgggagggccggccg

SEQ ID NO: 430 - DNA, 6086 bp, Unknown
  Kingdom: Bacteria, Phylum: Actinobacteria, Class: Actinobacteria, Order: Streptomycetales, Family: Streptomycetaceae, Genus: Streptomyces
gagctgctcggttccgcgcgcgaggaggccggccaggagcgggagcgggcgcgcgagcagagcgaggagctgctggcgtcggcgcgcaggcgggtggaggaggcgcaggccgaggccacccggctggtggaggaggccgaccggcgcgccaccgagatggtgtcggccgccgagcagcacgcgcagcaggtacgggactccgtggccgggctgcacgagcaggcgcaggaggagatcgccgggctgcgttcggccgccgagcacgcggcggagcgtacgaggctggaggccgggcaggaggcggaccgggtacggaccgacgcctacgccgagcgggagcgggccggcgaggacgcggcgcggctgcggcgcgaggcgagcgaggagaccgaggccgccaaggcgctcgcggaacgcacggtggcggaggcgatcgcggaggccgagcggatccgttcggacgtcgccgagcacgcgcagcgggtgcggaccgaggcgtccgacacgatcgcgcaggccgagcaggatgccacgcgcacgcgtgcggatgcccgcgacgacgcgaaccggatccgttcggacgcggcgacgcaggcggacacgctgatctccgaggcgcgttcggaggcggagcggctgcagaccgagacggccgccgaggccgagcggctgcgcgcggacacggtcgcggagacggaccagttgcgggccgccacggtcgccgaggccgaccggctgcgtacggagacggccgccgaggcagagcgggtgcggaccgaggcgctcaccgaggccgagcgggtgcgggcgcggtccgtcgcgcaggcggagcagctgatctcggacgccaccggggacgcggagcggctgcgggccgaggccgccgagacggtcggcacggcgcagtcgcgcgccgagcggatccgcaccgagtcggagcgggtgagggccgaggcggcggcggaggccgagcggctggtgacggcggcccgcgaggaggccgagcggaccatggacgaggcccgccaggacgccaacaagcggcgttcggaggcggccgagcaggtcgacaagctgatcaccgagaccacggccgaggccgacaagctgctcaccgaggcccaggccaacgcggtcaaggtcaaggcggacgcggagtcccaggccgacacgatggtgggcgcggcccgccaggaggccgagcggatcctggccgaggcgacggtgcagggcaacacggcggtggagaaggcccgtacggacgcggacgagctgctcgtcggcgcccgccgcgacgccacgcagatccgcgagcgcgccgaggagctgcgcgagcggctcacctcggagatcgaggagctgcacgagcgggcccgccgcgaggccgccgagacgatgaagtcggccggcgaccgctgcgacgcgctgatcaaggccgccgaggagcagctggcgaaggcgcaggcgaaggccaaggagatcgtctcggacgccaactccgaggcgggcaaggtgcgtatcgccgcggtcaagaaggccgaggggctgctcaaggaggccgagcagaagaaggcgaagctcgtcaaggaggccgaggagctgaaggcggaggcggtccaggaggcgcggcgcacggtcgaggagggcaagcgcgagctggagatcctggtgcgccggcgcgaggacatcaacgccgagatctcccgggtccaggacgtgctggaggcgctggagtccttcgaggcgccgggttccgggaaggacaccggggcccgggcgggcgcgacggtgggcgcaccccggtcgggtggcaagtcgtcagaaggttagcctttaaggtgaattcggggcctcacgggggagcttccgaaggctccaccggggtacttggcaagcgctccggcggtcagccactcaaaagaggtgtcattctccagatcaaacacgtatccgctcgatgacacaccgcttcggcccctaggattcgacctatcacctcaccggtctcattcgacaggaaccccatgagcgacacttccccctacggcttcgagcatgtgcggcgtgggtacgaccgcgctcaggtggacgactacatcgccaggctcgattccgacctcgccgatgcccgcgcccagaccaagatgctggagaagcgcatcgaggagctccacctcgagacgcagtccgcgcaggcccagatcaccgacgccgaaccgtcgtacgcgggtctcggcgcccgggtcgagaagatcctccgcctcgccgaggaggaggccaaggacctgcgtgaggaggccgcgcgcgcggccgagcagcaccgtgagctggccgaggcgtcggcccagcaggtccgcaacgacgccgagtccttcgccgcggagcgcaaggccagggccgaggacgagggcgtccggatcgtcgagaaggccaagggcgaggcgtcccagctgcgcagcgaggcgcagaaggacgcgcagtccaagcgggaggaggcggacgccctcttcgaggagacccgcgccaaggccgcgcaggccgccgccgacttcgagacgaacctggccaagcgccgcgagcagtccgagcgtgacctgacgctccgccagcagaaggcggagaagcggctcgcggagatcgagcaccgtgccgagcagctgcgtctggaggcggagaagctgcgcaccgacgcggagcgccgcgcgcgccagaccgtggagacggcgcagcgtcaggccgaggacatcgtggccgacgccaacgccaaggcggaccgcatccgttcggagtccgagcgcgagctggcggcgctgaccaaccgccgcgactcgatcaacgcccagctgacgaacgtccgcgagatgctggcgacgctgaccggtgccgcggtggccgccgcgagcaccccggccgaggacgagccggtctcccgcggggtcccggcacagcagacgcggtaggcacgggccgcgggccccgtccggggcacacgtcgcaggccggtcgccgtcgagccccctgccgccttcgggtggcggggggctcggtgcgcctttagcgtggccgcatgatcgagctggcggggctgaccaagcgctacggcgagaaagtggcggtcgacgacctcacgttcacggtgcgaccgggcaccgtcaccggcttcctgggacccaacggcgccgggaagtccacgaccatgcggatgatcctgggcctggaccaccccaccggcggcgatgtgcgcatcgacggccggcactaccacgagctgaaggacccgctgacgtacatcggggccctgctggacgccaaggccgtgcacggcgggcgcagcgcgtaccaccacctgctgtgcctggcgcagagcaacggcatccccaccgcccgggtgcacgaggtgctggagacggtgggcctgacggcggtcgcccggaagaaggcgaaggggttctcgctcggcatgagccagcggctcggcatcgcgggcgcgctgctgggcgatccgcggatcctgatgttcgacgagccggtcaacgggctcgaccccgagggcatccactggatccgcagtctgatgcagtcgctggccgcgcagggccgtacggtcttcgtctcctcgcacctgatgagcgagatggcgctgaccgccgatcatctcgtcgtcatcgggcagggccggctgctcgcggacaccaccatggccgacttcatcgagcgcaacgcgcgctcccgcgtccgcatccgcacacccgaccgcgagcggctgctggacgcgctgcagggggccgggatccaggccgtggagagcggggacggggcgctggaggtggacggcggccggtcggaggagatcggcgagctggccgcgcgccaccaggtggtgctgcacgagctgagcacccggcagtcctcgctggaggaggcgttcatgaggctgaccgcgtcctcggtggagtaccacgcgcacgcggagccggccgaacggccgtggggcaccgactggaacagcaggacggcgacgggcacggcgcgggcgagggcgaacacggaagccggaccggaagcaggcacgcaagcggggcggcaagcggggacggaagccgggccggaagagagcgcggcgcggacgacggtggagggctgaggcatggcggcgacccaggtcatccgctcggagtggaccaagatccggtcggtggcgtcgaccgtgtggacgctgtcgctggcggcggtggtcaccatcgccctcggcatgctgatctcggccctgtccaagaacgagttcgggaacatgccggcgcgcgagcggctctccttcgaccccaccttcgtcagcttcgcgggcatgaccctcggtcagctcgcgatgatcgtcttcggggtcctggtggtgtccaacgagtacagcaccggcatgatccgcacctcgctggccgcggtcccgcgacgcggggccttcatggcgagcaaggtggccgtcgcggcggtcctggcgctgctggtgggcatggccacgagcttcgccgccttcttcctcggccaggcgatgctcggctcgctgcacacctcgctggacgcgcccggagtgctgcgcgcggtcatcggcggcgggctctacatgaccctgatcgccgtgttctcgatggccgtcgccgtgatgctgcgctcaccgatgctgtccctgggcatcctgatgccgttcttcttcctgatctccaacatcctcggcaacgtctcggccaccaagaagatcggccagtacctgcccgaccaggccggcagccgcatcctgcgggtgatcccccgggtcggcgacgacacgccctacggtccctggggcgggctcggcatcatggggctgtgggtgatcgcggcgctcgcggtcggctacgcactcctgcgcaagcgggacgcctgagggcgtaccgccgcagatcatgacgtaccagccccacacgcctttactttcttttggccggaaccgtcagcgcccggatatcctcctaagccttacgggggcgtgcgccccgctgtcctgaacttcgggacggctaccttccgatgggaccggagcatgatcgaggcagtcggcctgaccaagcgctacggcgccaagaccgccgtgaacaacctctccttccaggtacggcccggcgccgtgaccggcttcctcgggccgaacggctcgggcaagtcgacgaccatgcggatgatcctcggcctggacaaccccaccgccggcacggtgacgatcggcggctacccgtaccgcagactgcccaacgctccgcgccaggtcggcgccctgctggacgccaaggcggtgcacggcggccgcagcgcccgcaaccacctgctgtccctggcccagctgtcgggcatcccggcccgccgcgtcgacgaggtgctgggcgtggtcggcctgcaggacgtggcccgccggcgttccaagggcttctcgctcggcatggggcagcggctcggcatcgcggcggccctcctcggcgacccgcaggtactgctgttcgacgagccggtcaacggcctcgaccccgagggcatcctctgggtgcggaacctgatgaagtcgctggccgccgagggccggaccgtgttcgtctccagccatctgatgagcgagatggcgctgaccgccgaccacctgatcgtcatcgggcgcgggcagctgctcgccgacatgagtgtgacggacttcatctccgccaactccgcggacttcgcccgggtccgcacccccgacgccgaaccgcagcagcgcgagaagctgtcctccgcgctgaccgagtccggcgggcaggtgctgcccgagcaggacggcgcgctgcgcgtgaccggcctgccgctgccccgcatcagcgacctcgcgcacgaggccggcgtacggctgtgggagctgtccccgcaccgggcctcgctggaggaggcgtacatgcggatgacgcagtcggtggtcgactaccgctcgacggccgacgagaaggccggtctgatgcagccgctgccgcccggcgcccagccgcccatgccggtgcccggccagggccagcccggctggtacgccccac

SEQ ID NO: 431 - DNA, 5210 bp, Unknown
  Kingdom: Bacteria, Phylum: Actinobacteria, Class: Actinobacteria, Order: Streptomycetales, Family: Streptomycetaceae, Genus: Streptomyces
cccctccaccggccagtggagggggccataggccggtgccgtaggcggtaccgcaggccggggctgccctggtcagcgccagcggtcagcgccgtcgccacctgcggcggcgcaccttgctgaagaaccagcccgcgggcggttcgtcggagcgccagggctgtggttcgggcgcctcccggcgccagcgtgcggcaagcatccgggcgcgggcggagggctcggtggcctcggcggcccgtatgaagccggtgtcgaggacgacgtcgtcccagccgtctgtgaccgtcggccggtcctcgcttcgcggagtctcgccgctcatctccgtccctcctggtcgtcagtcggctgagcccagtgtgcgtgtacggcggtgaagcctccgtcaagggtgatcggacccgctcaccctcgacggagtccgcccgtgtctcactcctcgccggcgagggtcagggaccgcagcttctgaccggcgtaccaggtggccagcacggtcaccaggaccagcaggaccgtcgccgtcgtcaggccgacgtcggaggtcaccaggtctccgccggcgaccttgtgcgccacggccagggcccactgctggatgctcagtgtgcgcgccccgggcacgagggacccgaacagcgcctcccagatcagtgcgtacaccaggccgaagaccaccgcgtgccgggagaccgtgcccagcaggaggaacagggcggcgtaggcgatggaggcgaccagcgcggccacggtgtaggccaccgcgatctgctggccgttgccgttgaggatcagtccggcgatcagcgtcggcaccgcggagaacaccatggtcacggcgatcgccacgatcagcttggtgaagatgatgaccggtcgcttcagcggcttggacagcaggtacaccaccgagccgtcgtcgatctccggcccgatcgcgccggtgccggcgatgacgccgatgatcggcaccatggtggcgagcgcgaagccgccgaggacgttgaccgtggtctggtcgtcggcgccggtgagggcgcgcacgacgaccgcgatgacgatcagcagcaggggcagcgcgccgaggatgagggcccggcgacggccgagcagggctcggtaggtgagccgggcgactgtggggtcgtacatttcggcctcctacgccgcgaccagatacgagaagacggactcgagggactcgtcggagggcgagaccgtgtgcagccggatgccgtggtcgcgggccacccgcggcagcaggacggtgaaccggccgaagtcgacggcctggatgcgcagcgcgccctcggcgaggtccacctcgatgccggacgtcgaggggtcggcgatcagcgccgccgcgagggcccggtcgtcgctggagcgcaccagatagcggtgcggccggtcggtcatcaggcggcggatcttgcggaagtcaccgctggccgcgtgccggccggcgacgatgacctcgatgtgccaggcgagttgctcgacctcctccaggatgtgggaggagaacagcaccgtgcggccctcgtcgcccatgcgccgcagcaggtccatcagctgcatgcgctggcgcgggtccatgccgttgaacggctcgtccagcaggagcagcgaggggtcgtggaccagggcgctcgccatcttcacgcgctggcgcatgcccttggagtacgtggagatcttgcggtcctgcgcgtactccatctcgacggtggccagcgccttctgtgccgccttggcgcccaggccgtgcagttccgcgttggcgacgacgaagtcgcggccggtgaggaagtcgtacatcgcctcccgctcggggacgacgccgatgtgccggtagatctgctcgttgcgccacacgggctggccgtcgagggtgacggtgccggtggagggggcgaggaagccgcccatcatgttgatcagcgtggacttgccggcgccgttcgggccgagcaggccggtgacgccggggccgatcgtcatggtgatgtcgttgacggcgacgacgttgccgaaccagcgggagacgtggtcgatgctcagggtagtcacaggcccaccttcttgtagcggcgcagcaggaggccgtaggcgccggcgatgaggccgaggacgaccaggacgtagacgacgccctgaccgctgccggggcccgcggcgccgggtgcggcggaggtcgcgcccaggaacgccgtctgcacgccgtcgatgagggtgatcggggagaacaggccgatccaggggacggcgctcgtgctgttctgggtgtccgcgatggcctcgagcgtggagaccgcgccgtaggagatgaccaggacggcgatcacggcggcgatgccgaatccccggcgcggggtgacggcggcgatgaccaggccgatgccggagaagagcagcgagagcagggccacggagacgagtccttcggcgaatcccttggtctggtcggcgaagtcgagcttggccagcagcgcgcccacgtagaggacgagcagcggcgcggcggtcaggatgaacatcgccgaggccagcgccgcgtacttggcgcgcacgtagtcggcggtctcgatgggccgcgagaagtacagcggcacggtcttgaagcgcaggtcgcgggagacggactggggtgcctgcgaggcgacgtacaggctgatgacgccctgcatgatgatggcgtaacgcgtgtagtcgacgggcaggtccttggccttggtggcgaccgcgacggcgaccatgatggccgcgggcacgcacatcaccacgaacagcagcatgggcagcaccttcgacttcaccgagcggccgaggccgtaggcgccgcgcagggactgcgagtacagcgagcggcgggcgtaggcgcggccgaggcgggggccgtcgtagttgcggtagccgatgttgtggatccgggtctggtcgcccggggccggtgccggattgcgcaggggctgctcaagcgccatggtcggcggcctccttccgctgtccttcgcgctgttcgtcgtcccggaagacctccgagatgtggtgccggcgctgctccatgcggaccagaccgaggccgaggtccgcgatcacgtcccgcaccaggtcgtacgtctcctcgccgtgggcggtgagcagcaggacgtgtcccgcgcccggcaggccggtgccgtcctcggtctgtgtcccgcgcgcgtggagcgcctcgcggaccgcgcgggtgccgtccgggtgctcgtcgctgtcggtgacctcgacggcgagggtggtcgtggtctgcgtgaagtcggtggtggagctggaccgcaggagcttgccgccgtcgaccacgatgacgtggtcgcaggtgcgctccagctcgcccagcaggtgggaggtgacgaggaccgagatgccgaagtcggtgtggatgcggcggatgaggccgagcatgtcgtcgcggccgacggggtcgaggccgttggtcggctcgtcgaggaagaccagctgcgggtcgtgcaccagggcctgggcgagtttgacgcgctgtttcatgccggtcgagtagccgccgatggggcggtagcgctcctcgtagagtccgacgtggcgcagggtgtcggcggtgcgctcgcgggcggcggtgggcggcaggccggacatgcgggccatgtggacgacgaactcggtggccgagacgtccggtggcaggcagtcgtgttccggcatgtagccgacgcgctcgcggatcgcggcgcccttggtggcgacgtcgaggccgagcacctcggcgcggccttccgtggcgggggacagacccagcaggatcttgatcagtgtggacttgccggctccgttggcgccgacgagtccggtcacaccgggtccgacgtccacggagagccggtcaagagcggtcacccgggggaaccgcttgctcaggctttcggtcgcgatcacagtcacgtcttcgacgatagtgacgcccgccacgcgagtcgtcagaccgcagagccgtcttctggtccctcttgagtattacggggccctagggggcgcccccctggggtagcccatgatccgggacatcccggccctgtcagggccgcgacccgccctattgacgttcagtctaacaactgccacagtcgccgaagtcacgtgacgggcgcgcatccccagcgaaggcgagcatggggagtgggccgccgggcggaggaggggtgatgcgcgtgtcgccgctgaagggcgcgcgggaacgccgggtacaggccggcgaggtcgagctgtgcgtggccgaactgggggatccccgccggccgacggtcgtcctggtgcacggctacccggacagcaaggaggtctggtccgaggtggccgaacgcctcgccgaggactgcgggttccacgtcgtgctgtacgacgtccgcggccacggccgctccaccgcgccccggccgctgcgcggcgggttcaccctggacaagctcaccgacgacttcctggcggtcgtggacgcggtcagtccggacgcaccggtgcacctggtggggcacgactggggctccgtccaggcctgggagttcgtcaccgtccggcgcaccgagggccggatcgcctccttcacctccatgtccggcccctcgctcgaccacttcggccactggatcaactcccgtctcacccgccccaccccgcgccgggtgggccagctcctcggccagggcgccaagtcctggtacgtctacctgctgcacacacccgtgctgccggaactcgcctggcgcggccccctcggcagacgctggccgaagatcctccagcgcatggagaaggtgcccgccgacggctacccgaccccctcgctgccccaggacgccgcacacggcgcgtggctgtaccgcgacaacgtgcgggcgcggctgcgcaggccccgcacggacgcccgcgcccacgcgccggtgcagctcatcacccccgtgaacgacgccttcctctccgaacggctgtacgacgacctggagcaatgggtcccccgcctcgtacgccgcacccttcccgcccagcactggatcccccgcacccggcccgaccggctggccgactggatcgccgacttcgtgaacaccgtcgagggcgggcggccctcacctgccgccaccgggcggtacgccgaccggttcgccggacagctcgtcctggtcaccggcgcgggcagc

SEQ ID NO: 432 - DNA, 12018 bp, Unknown
  Kingdom: Bacteria, Phylum: Actinobacteria, Class: Actinobacteria, Order: Streptomycetales, Family: Streptomycetaceae, Genus: Streptomyces
ctgcatcgccttgcgggcgcgcggggtgtcgcgggcgtcgtggtaggcgacggcgagccggaaccaggagcgccagtcgtcgggggcggcctcggtctcggccttgcgccgggcgaagacctcgtcggccgagtcccggtcgatgcgcccgctgggcgtgcgcctgagttcgtcgacgggcaggccgccctcggcgtcgagttcacaggcgagggcgttggcccggcggacgaactgggtgttcttccacaggaaccacaggccgatcaccggcaggatcagcacggcgaccccgaaggtgaccgtcacgaacgtgccggactcgatgagcaggacgccgcggctgccgaccaggacgaagtagaagacgaggacggcggccgtgacgaggtaggtgatcttcgcgcgcatggggctcgggactcagttcaggtcgaggaagtgctccaggccgaaggtcaggccgggagtggtcaccacgcggcgggcgccgagcaggatgcccggcatgaagctgctgtggtggagcgagtcgtggcggatggtgagcgtctcgccctcggcgcccagcaggacctcctggtgggcgaggaggccgcgcaggcgcacggcgtgcaccgggacgccgtcgacgtcggcaccgcgggcgccgtccagcgcggtcaccgtggcgtccggcgccggtgccgtgccggccttggcgcgggcctcggcgatgagctgggcggtgcgtgtggcggtgccgctgggggcgtcgaccttgttggggtggtgcagttcgacgacctcgacggactcgaagtagggcgcggcgagctgcgcgaacctcatggtgaggacggcgccgatggagaagttcggggcgatgagcacgccggtggccggggaccggtcgagccagcccctcagctgcgcgaggcggtcgtcggtccagccggtggtgccgacgaccgcgtggatgccgtggcccacgcagaagtcgaggttgtccatgaccgagtccggggtggtcagctcgacggcgacctgcgcgccgctctcggcgagggtctccagccgatcgccgcggccgagggcggcgaccagctccatgtcctcggcggcctccacggcccgtacggcctcggaaccgatgcggcccttggcaccgaggaccgccacgcgcagcttgctcatctcttgcttcctcttgcttcctttgaccggaggggggcgactgaccggagggggcggccgaagggtcaggccaccgcgtcgtgcagccgggcggcctgcttgtccttgagcgggccgatgaccgacagcgacgggcgctgtcccaggatgtcccgggcgacctcgcggacctcgtccggggtcaccgcggccatgcgggccagcatgtcgtcgacggagatctgctcgccccagcacagttcgctcttgccgatacggttcatcagcgcgcccgtgtcctcgaggccgaggacggtcgagccctggagctggccgatggcgcggccgatctcgtcgtcgctcagtccgtgctcggccacgtggtcgagttcgtcgcggcagatccgcaggacgtcgtgcacctggctgggccggcagccggcgtagacgccgaagaggccgcagtcggcgaagcccgaggtgtaggagtacacgctgtaggccaggccgcgcttctcgcggacctcctggaacagccgcgaggacatgccgccgccgagggcggtgttgaggacgccgagggcccagcggcggtcgtcggtgcgggccaggccgggcatgccgaggacgacgtgggcctgttccgtcctgcggttctgcaggtcgacgcggccggtggcgcgcagggcgcggcggccgtcgcgcggcgcgatgggcactgcctcggtgttggcgagggcgccggccttctcgaaggcggcgcggacctggcgtacgaccttggcgtggtcgatgttgccggcgcaggcgacgacgaggtgggtcgggtcgtagtgcttcttgtagaagcggcggatgcggtcggcggtgagcgcgttgacggtgtcgacggtgccgaggaccgggcggccgaggggtttgtcgccgaacatggtgtgcgcgaacaggtcgtgcacgcagtcgccggggtcgtcctcggtcatggcgatctcttcgaggatcgcgccgcgttcgacgtcgacgtcctcctcgcggatcagcgagccggtgagcatgtcgcagaccacgtcgatggcgagcggcaggtcggtgtcgagcacgcgtgcgtagtagcacgtgtactccttggccgtgaacgcgttcatctcgccgccgacggcgtccagggcggcggagatgtccagggcggagcggcgctcggtgcccttgaagagcaggtgttccaggtagtgcgtggcaccgcccagcgcacgggtctcgtcgcgagagccgacgtgcgcccagatgccgaaggtggccgagcgcacggagggcagggtctcggtgacgatgcgcaggccgccggggagggtggtccggcgcacggtgccgatgccgttggtgcccttgatcagggtttgggtacgggcgacggcccgcgcctccgaagaggtgcgggccgtcgccctgaagccacgggacgtcacttggcggagtcgtccttctgctccgcgtcgccctcttcgccctcgatcacggggatcagggagagcttgccgcgggagtcgatctcggcgatctcgacctggaccttctggcccacgccgagcacgtcctcgacgttctccacgcgcttgccgccggccagcttgcggatctgcgagatgtgcagcagaccgtccttgccgggcagcagggagacgaacgcgccgaaggtcgtcgtcttcacgaccgtacccaggtagcgctcgccgacctcgggcatcgtcgggttggcgatgccgttgatcgtggtgcgggcggcctcggcggaggggccgtcggcggcaccgatgtagatggtgccgtcgtcctcgatggtgatctcggcgccggtgtcctcctggatctggttgatcatcttgcccttggggccgatgacctcgccgatcttgtcgaccgggatcttcacggtgatgatccgcggcgcgttcggggacatctcgtccggcgtgtcgatcgcttccatcatcacgtcgaggatgtggaggcgggcgtcacgggcctgcttgagggcggcggccaggacggaggcggggatgccgtccagcttggtgtcgagctggagggcggtgacgaactccttggtgccggcgaccttgaagtccatgtcgccgaaggcgtcctccgcaccgaggatgtcggtgagggtgacgtagtgcgtctcgccctcgatctcctgggagatcaggcccatggcgataccggcgaccggggccttcaggggcacaccggcgttcagcagcgacatggtggaggcgcagaccgagcccatggacgtcgagccgttggagccgagggcctcggacacctggcggatcgcgtaggggaactcctcgcgcgtgggcagcaccggcacgagggcgcgctcggcgagggcgccgtggccgatctcgcggcgcttgggggagccgacgcggccggtctcaccggtggagtacggcgggaagttgtagttgtgcatgtagcgcttgcgggtcaccggggagagggtgtccagctgctgctccatgcggagcatgttgagggtggtgacgcccaggatctgggtctcgccacgctcgaacagcgccgagccgtgcacccgcgggatggcctcgacctcggcggcgagcgtacggatgtccgtgacgccgcggccgtcgatgcgcttcttctccttgatgacgcgctcgcggaccagggtcttggtcagcgcgcggtacgcggcggagatctccttctcgcggccctcgaacgcgggcagcagcttctcggcggccaggcccttgacgcggtccagctcggcctcgcgctcctgcttgccggcgatggtcagcgcctgggccagctcggggcggacggcgccggtgagcgcctccaggacgtcgtcctggtaatcgaggaagatcgggaactcgccggtgggcttggcggccttggcggcgaggtccgactgggccttgcacagcaccttgatgaagggcttcgcggcctccaggccggcggcgacgacctcctcggtgggggcctcgacaccgcccttgaccagctggatggtcttctcggtggcctcggcctcgaccatcatgatcgcgacgtcgccgtcctccaggacacggccggcgacgaccatgtcgaagacggcgtcctccagctcgctgtgggtcgggaacgcgacccactggccgttgatcagcgcgacgcggacgccgccgatcgggccggagaagggcaggccggccagctgcgtggacgcggacgcggcgttgatcgcgacgacgtcgtacaggtggtcggggttgagcgccatgaccgtgcagacgacctggatctcgttgcgcaggcccttcttgaaggacgggcgcagcgggcggtcgatcaggcggcaggtgaggatggcgtcctcggaggggcggccctcacggcggaagaagctgccggggatcttgccggcggcgtacatccgctcctcgacgtccaccgtcagggggaagaagtcgagctggtccttggggttcttggaggcggtggtggccgacagcaccatggtgtcgtcgtccaggtacgccacggcggaaccggcggcctgcttggccaggcggcccgtctcgaagcggatggtgcgggtgccgaaggagccgttgtcgatgacggcctcggcgtagtgggtctcgttctccaccagcgttttctccgttacttgtcgtctttcgtcccgcctcgcccgtgtggcggggggacggtggcggagaagcgctccgttggtgcgggccggtcttcgatcgaagcacccggggctcgtgatcgcccgggggccactaccgaggaccggcggcggcgcggtgcgctcctcctcgtactcttctgttcttctgtgcgtactgggcgcgtacggttccgtagcgcgcttcgtactgcgctttcgtaccgcgttgcttcgcactgcggtctcgtgctgttctgtgcggttccgtaccgttcggtacggcgttcgcgtactgcgttgcgtgcggtacgtctgcgtcctgctaccacactacaaagcgtgagtgacactccgcacgtttccgcacctacggcgaacgtctgcgcacgtacggcaaagggagcggcccccgatgctcaccgggaaccgctcccttcacggcgtcctacttggcgcccgccgcaccacggcggatgccgaggcggtcgaccagcgcacggaagcgctggatgtccttcttcgccaggtactgcagcagccggcggcgctgaccgaccaggatcagcaggccacggcgggagtggtggtcgtgcttgtgggtcttgaggtgctcggtcaggtcggagatccgacgcgacagcagagcgacctggacctcgggggagccggtgtcaccctccttggtaccgaactcgccgatgatctgcttcttcgtagcggcgtcgagcgacacgcgtactcctcatggtctgttgaatggccaccgagtgccccggctcttgatctccggggagcttccgtgactcgggaggcgggatccgctgggcgcgatctccagggcctgcaggattgcctgcggtggcgccggggatgcgtacacaaacggccgtcagccaggttaccaggcggtggaggccgcccctcccccggtttccggaaggtcctgcgtcgcacgtcccggccactagggtgagcgctggcaccgtgcacgtacaccgggaaggggtcgctgcgagatggcggagacggaagcggagatcaaggcacgcaaggagcgtgagcgcgacgaactgtacgcgctcgacatctccggcgtggagtggcactgcgcgccgggcacggaggagcacgaggaacgcgtcgagatcgcctacctgcccgacggtgccgtggccatgcggtcgtcgctcgaccacgacacggtcctgcgctacacggaggcggagtggcgcgcgttcgtgctgggggcgcgggacggggagttcgatctggagccggccgagcacaacggcgggctcgaggcggcggcggagcagtagtccggacgcggggggggcggcacgcttgggcgggccgcccctggtcgtttgcggtggggcgggtcagtgcttgagccccgtgctcccgaagccgatggccgccagcacgtcgtccttgggggcttcgtcgtcacgggcgagttcgcgccgcccgaagaagatccttcccttctccacgaggatgtccgtctgctcgggatcgctgagatcgctctcgtggtcctggggaagctcgaagaacagcagcggggtctccttgtcggtgcgcggatcccagctgaccaggcccgcaagaccgacggaaccggcgccctcacggtagatcagcaggtcgtcgccgctcatccggagcggatagacgtgctgcaggctgcggccgtcgaacttgcccccggtcttgcccgtcttcagatcgaacgccacgatccagtccacggcctggtcgttggcgatgttctccttgctcatgacgtagacctgagtcggtcccacgacgacgccgtcgcagttctccacgacgccgaagaagatcttgccgtagtaccggtcgccgcacttggcgtcgtatcccttgagggagacggtcgccgcgtgcctgccctggtcgtcgagggtgatcagatcggtcaccagggtgtcgccggccgcgacggcgaggacgggcggatccgacgagggcaggtagaccttgctcactccgcgggcgagtttgtacgtccacaggttcttgccggtgcgcggatcgagcttctgcaccttgtacgtggcgtcgggcccctgaccgcagccggcgagggcgagcagtgcccggccgccggcgaagccctggtccgcgcactgtgccgtggtcgtggtgttccacagctgcttgccgctcttcatgtcgtacgccaccgagccgtgcccccaggcgaccgcgaccacgcccttcgtgagggtcaggttggtgttggtgacgtaggcgaactgggccgccggcatcttcttctgccacagcttgcggccgttgttcaggtcgaagaacaccacctggtcgcagacgccgttgtccggggcggctttgctcttgggcggctggatgacgaccgctgtgcgtccgtcggtggtgacgtgccggctcgtggcacatatgtggccgccgaggtcgagtgtccaggccttctcgtcgtagccgggttcgatgcggtagccctcgacgtggtcggcgatgcccttggcgaagatcttcgcggtcgcccaggaacccggcgcgtagagcgggttggtgtccgggtgcttctcgaggtgctccacgctgtgttcgatcacctcctggccctccggtgagagggggaccttctccaccgtgctgcggatctcgtcgggctgctgcgcggcggccaccttgccggcggccggtgcgctgtcgtcccccgcggacgacaggaacaggccgccggcacagagggcgaccaccaggacgccgcccaggacgccgcccaggattcggttgcggcggcgtctgcgggtccggtcggccgcgagggcggactgggtgtacacggatgggggtgggccgaagctcacggtgtcggtctgcctctcgtcagcgggccgagcggtgcgtccctcggcgggccggccgctcggccgggttcagcgcgcgtccgctcacgggccaagccggtcggcgcgcgtcctcacatcggtcctcggcgtcagttctcgggggcgtggctcccgattccgaggaccagccaggtccattccttgccctgtttcgcggacgggccgtccgcggcgtggctgcccaggaacaggcgcccgttctgcacgacgacatcgctcgcgtccaggacggtgagtctctccgcctcggtcgccacgctgaagtagaagtacggggtctccgtgcctgtccgcggatccaggctgacgacggccgagggcgagatgtggtcgtcgctcaggcgcagggcgaggagctggtcgccgctcatccgtatcgggtacagcagcgcgttggggcccgattcgaacttcttgaccgaggcgccgctcgccaggtcgaaaccgatgacccagttggagttgtgtgccccgccggcctccttgccgcgcacgaagacctgcccggcgccgaccgcgatggtcgggcagtcgtcgaggacgagacggtcgaggtcgtcggagcactcaccgaggtagttgccgttcttcagccggacggtggcccggtcgcctccgtggtcgtcgagcgagagcagttcggtgtagccggtgtcaccggccgcgacggcgaggacggggggctcggtcgacgggactctcaggtccctgatgcccggggtggccgcgtacgtccacaggacgcggccggtccgcggttcgatgcgacggaccttgtagacggctgattcccaggaggtggcgttcgcgtccgggttgcggcagtcgagccggtcgagcagtgcccgtccgcccgccgcacccatgtcccggcacagagcgggggctttggaccgccacagccgcttgccgaggtccatgtcgtacgcgtcggagccaccgccccaggtcacggcgaccgtcgcgtgggtcagggtcacgctcggggtgtcctgtccgccgccggtccgcgacacgggtatctcgtggtcccagatcttccgtccgtcgtcgaggtcgacgaaggtcacgtggtcgcagggtgcctgtgcgtcgtcggcgcgtgctctggacaggacggcggtgcggtggtcgacggtgacatggcgggtgtatccgcagatcagaccggtgagccggagccgccacacttcgtcgcccggtgcggcgtcggtgccgatccggagaccgacgagcgtgctcttgatccccttggccaggatcttgtccgtggcccacatgcccggcaggtcctcgtgctcaccgggcgccatgtcgtcgaccgagaaccggaagtccatgacaccggtcgtgctcgccggccgctgctcgaccgtctcccggacgtcgaggcggtcctggacggcggcgaccggggccttgccgggcccgccgggtgccccccggtcgtgcagcagggtcacgccggcaaccgccgcagtgacggcgacgacggccgcggtcagccccagcagtgtgttccggcggcgcttcctgcgccggccgtccgccgtcatggcggactgggtgtacatggaaggcggcgggccgaagctcacgcacgggtcccttcatccacgccccgactcgtcgcgggcgcatgtggtgtcgtgtgggcggaaaccatgtggtgtcgtggggcggaaaagtcgtacggaccggaaccggtcgacggtgcggaggatcagccggtcatggagcggacggtcgtgtgcacgtcgcagacggccagggtcagcggcaccagcgccagcaggacgaagccctcggcgatctccatgaagcggccccagaaggggctgagcccgccgcgcgggacgatgaggccgatcgcggtgagcagaacggctccggcggcgatcgcggccgtcagccagacggtgcgcaggtcgggggccccgcggtcgccgtggttcaggaagaggacgcggccgtcgcggcgcaccaggtggtatccggtcggcgtgccgacgggctgcgtctggccggtcagacgcaggatctccggatagacgtcggcgacggcgatgtccaccgggagcgccacgtcgatccggctgtcgggtgccacgacagtcaccctgcagaatcccgtcgccgcggtcgtactcaccttcactgaccccctgttcgcggatgcgtacgctgcgtgcgtcaccctaccggcaggcggtgtcagcgctgacaagtaggatcgccggctggttcccgggcacccggcccggaatccgcccgccctgcgcccgaaccgcggccgggcgtgccggcagcgggcgcgctgcagccgcgcagacggcaggggcagggggcccgttccggctgcaacggctagtgctgtgggagctggcggccgctgtcctggtcgtcggctgggccgtcggcccggtgggtctggttgccgcggtggtcgtggtggtgctcctggtgctgtccgccgtggtgcgtcgcaggggccgctcggtgcccgaatgggtggcgacggcacgggggttgaaggcgcggcagcgccgggcagcggccacaccggtaccgccgggcacggcgccggcgctgaggccggccgtggagtgcgaacccaacctgcggatgtacgcatgcgcggtacgggaccggcgcctcgtcggagtcgtaggtgacggcacgttcctcaccgcggtgatccaggtcgaggccgatgcgaccgcactgcgggccgagcgcggcagacagccgctgccgctggcgctggtgcgggacgccctcgaggtggacggcatccggctggagtcggcgcagatcgtccagcacacccagccggcgcccgctctgcgtctgccgcagcagtccgtcgcggtggccaactacctgccgcttcaggaacagacgggtacgtcggcggtgcgcatcacctgggtggcgttgaagctggaccccgagctgtgcgcggaggccgtggacgcgtggcggcgggctgctcggagcacagaagtgcgtcgtgcgcgccgcggaccacctcgccagccggctgaccggggcggggttccgggcgccgtgctcgacgaggaggagctgatcgccgccctcgccacctccgcttgcgcgaatccgctggtgacggccgaatcggggcggacggaggcacgcgaacggcgcacgcgggaatcgggccgcagctggcggcgcgacaaccgcagacacacgacgtactggatccggcgctggccccagctcggtggcgaccgtggcgcgtcgctgcctcagttcctcgcccgggtcgcggcgatacccgccctcgccaccaccttcagcctcaccctcacacacggcgagcggcaggaggtgtctttgtgcgggcacctgcgggtgaccgccgcagtgacgacgaactggtcgccgtccggcactcgttggagggagcagcgcggcaggccggtgccggactcagccggctggaccgggaacaactgcccggaatgccggccacgttgcccgtgggaatccctgccgacgctgcccgacggcgtcaccctctggtgcgccggcggggaccgtcagtatgtgatgacccagcccaccgatgccgagatcggattgttgggtacgccacgacggatggactgaactgtccttccctgaaccttttgttcggggttcttgtggtgcggtcgcggccgactccgctggtttccgggcgcgctgtgaccgggcggacgtgtgctgtgggcgggcggccctgccaggacgccgctcgcggtgattaggctgggagtggacgcgatgccagaacctgtggaccaggcatcggcgagggggagccggtgggatcggcctgcctcgaacgaccacggacgactcggaacgacacgacatggtcgccccggcagcatgagcgtgcccgaccacaccaggaggaactgtgagcagcgatcgggacgggatccgcgggggctgggccacacccggcgatgaccagcccgacgcggagtcggccatcgagacgaccggcgagttcaccatcgactacgcgccgcctgcctggtacacgcagaacgcgcacggcgcctccggggagcaggagtccacgggcgggacgggcggagggaccggtagcgcggggcctggcggcagcggcgccccggagggtccggccagtccggcaccgcccggtgtgcccggccctgcgccgttcccgcccccggcaccgaccgttcc

SEQ ID NO: 433 - DNA, 1886 bp, Unknown
  Kingdom: Bacteria, Phylum: Actinobacteria, Class: Actinobacteria, Order: Streptomycetales, Family: Streptomycetaceae, Genus: Streptomyces
ggccaccacgtgcggccggctgccgtgccggtccccgaacgcccccggccgggccagggcgacgatcagcgtctcgccgggctccagggcgacccgcagggtgacgtcgtcgccgtcctcggagtactgcgccaggcggaccgccttcccgccccacgcgtccagcacgtacggcacggtcgcgctgccccgtgtgcggcgcagcgtcacctcgtggtcgacgcgggcgacgggcggcttgacggtctcggcgtgcttgccgttgcacaggtagtagaagtccgcgtcgtccgtgacccggtgggcgttcaggagcgtggacggcgtggcgtggcgcacgtcgggcgacacgccgaggtcggccagggcatcgccgacgagggccttgtcggcgacctgccgtacgtggggcagggcgaacagccgggcgagcacgtcccgcagttcggcggtctccccggccgccggcacccccggtgtcagcgcctggtcgaaggcgccgagcaccaccgtcggcagaccggccccggcgaactccaggagcttgcgcgcgtgtgcgagggcgagcgtgggggaggagccgtagaagaagtcgccttccaggaacagggccttgtaggcggggccgtccggggcgagccggccggcccggaccttggccttcggcaggtcgagcagcggcccgctcaggaactggtgcgtccagcccagcggcacccccgtcgcggtgaaccaggacgcgccgatcccggtcgcggtgtagccggtctgccggaacacggccacgtccgccctggccgtgcccgcccggagcacgcggtgcacgcgccccaggtaaccggcgacgtcctcggcgtgccgccacgtgggctgccgcggaccccacgactcgccgtagcccggggtgccgttgtacggactgaacgcggcgaagccgggccagccggcgcccggcgcagcggcgtaggagaacccgtgcaggaccgtctggttgacgcccgccgcgtacgccccgcccatggtgcgcaggatccggtcccaggtggtgctgtaggccgctccggcgtacgcgcccgcctcgcaggacagcaccgcgtgcccggccatgtcccggccgccggccaggcagcggtagtcgtccaggttcttgaagccgagcgactcgccctccgggatgtcgagcagcgcggcggaggcgatggcgtcggtctgcagaccgtagggctgcgcgcgcagcgacatgccgaggccgtgcgcccagtcgcgcagcgcgctcacgtgatgccggtcgaacaggaccgagacggtctcccagaagtcgtgccggatctgccgggtcagctccgcctcgaaggcgaagacctggttgctcttgtccagcacgatcgccgggaggtacggcaggagcgggcggccggtgcgctcctcgaaggcctcgggcaggccgggcgtccactgcaggccatcggtctccagctcgatggagtcctcgaagaaggctccgcccgccgccctgagcaactgcctaacggtgggcgtgagcaggttctgttcccagtagccggtgatcgcggccgtgccggccgggctgaagtggtcgacgacgtacgcggcgggcgaggagtgcgggccggactccggctgctggccggagccgcgctgccagtacgagagcaccacccagtcgccgtcggcgggcgcggtccaggtgagggtgccgtcgtggaccaggccggtcaggtcggtcacggagccggcgtccaggcccgtctccttgcgggtggagttcgccggattcacccgggccgcctgcacggcgagcagatgctgccgggtgacggaggaggcggcgcgcgcaccggcgccgggaccgggccgtcgaaggt

SEQ ID NO: 434 - DNA, 670 bp, Unknown
  Kingdom: Bacteria, Phylum: Actinobacteria, Class: Actinobacteria, Order: Streptomycetales, Family: Streptomycetaceae, Genus: Streptomyces
gatgacgggtcacggtggaacggacgcgcgggtccgccacgacgaccatggcggtcggcttgttcgggcggtaggcgaccaggcttgcgggctgctcgaggagaacggacaccaggcctcctgggggtggggggggacggggccggcttgtggggaggaagccggtacgaaccgtgcttgctaggtcacagtcgtcttcggcatcaaacccgttgtcctttagagaatgatcacgatctggtgagtaacaatgcgtgcaattcggacacgttgtcgatcacccgaaggtcgaatcggttcgctcggggccgttcggagtcactacctgcccgaaagtggccgtatcgacaaagacacggcaaggcgccggtaagacgaacggcagcggacgcggcggcgggcacacggcagcggccggcccgggcgggagcaccgcccgggccggccggagaagaggagaagagggggaagagggggagggacgcgtcggtcgtcgacctgggtgactcagcgtgactgcgggtcccgtcgctgcggcagggtcaccacggacgcgtcacccggcccggccggcggcagacccgccacctgggccagcagatcgcaccaggaggccaggtgcgcccccgtgtccgggaccccgcccaggctctcgcgcggcgtccaggag

SEQ ID NO: 435 - DNA, 2596 bp, Unknown
  Kingdom: Bacteria, Phylum: Actinobacteria, Class: Actinobacteria, Order: Streptomycetales, Family: Streptomycetaceae, Genus: Streptomyces
ggtccacgccgagttcgtcggcgaggaggcgccgggtgtccgcgtagacggccagcgcctccgcctgccggccgctgcggtacagcgcgagcatcagcaactcgcgcaggcgttcgcgcagcgggtgggcggcggtcagggcggtgagttcggagacggcctcgccgtggcagccctgctccaggtccatgtccaggcgggactccaggagttgcagccgccactcctgcaggcgtacgcgctgggcctcggcgtacgggccgggcactccggccagcggctcgccgtcccacaggtgcagcgcgcggtcgagcagcgtccgcgcccgccgcaggtccccggccgcgcgggccttctccgcctccgccgcgaggtcctgcgccatgcccaggtccagcgcgccctcgcccaggccgcgcacggcgtacccgccggactcgctgaccaggaccccgggccccagcaccttgcgcagccgggaggcgtacgtccgtaccgccgccagggcctgcgagggcggttcctcgccccacagcgcgtcgatcagctcggaggcggtggccgtgcgcccctcgcgcagcagcagcgcggcgagcagggcgcgctgctgcggtgagccggtgggcagcgggtcctcgccgcgccaggcgcgcaccggtccgagtacgcagaagcgcggcgccgccgaccgctcggcacgccgctgctccggtactcggggtacaccgtccatcgctgctccctggccgccgccgaacttttcttctccgagaggccagtttgccttgttcatggcagatgcgtcagctccgggagacagcgatcacaggccgtggtgcccggtctcacaaggcgtccacaagctctccgcttgcggagggcgcctcagtcggtgagatcgacccgcaccgtgagcaggtccgtgccgaaggcccgtaccgccgcgctgttgaaccggggcaggcggcgcagccgggccacggcgtcgtcgtcgggcaggaggtgcgcggtgccgtggtgccagcggccccggatgcggacgcggacggcggggtcggcctggatgttgcggacgtactgggacttgaggccgaactcggagacgatccagaaggatccgtccgtcaggcgcccgcccacgggtgtgcggcggggcagccgggagacgcggccggtggtctccagcagggtctgggtcggcaggcggcggttgaccgggttggcgacgtaccgctggaagcgggtgaccatccggtgcttcagctcgctgtggcgggtcatggaccgccagcctagggcgtggggcgcccggcggtcactgaccgagcgggccggcggccttcgtcttcgcgttcgtcttcgccttcctcatcgccttcctcatcgccttcgccttgacgtgggcgacatagcggacggtgaagagcatcgggaggacgaagccgccgatctgcacggaggcgggcgcgccggagtacgcgtgcccggtgtgctccagtacggcgacggcgacggcggtcagggcgaacgcggcggtccacacggccgtgatgacgacgttggtccggatgaacggcttgagttcccacatctcgcgcggagtggtgcgcttggcgatgcccagggtgaacggcttgccgatggccagcgagatcccggcgatgacggcgaggacccccgaggagagggcggcggaataagtgtgcacgcccgagccgtggtcggcgaaggcgatgacggtcagcacgggggcatgagcctcagacacgcattgctcggcctgctctcggagcgtcccgccagcggctacgacctgctgaagcggttcgagacctcgttggccaacgtctggccggccacgcagagccagatctacaccgagctgaccaagctggcggggtccggactgatcgaggtggccgccgagggcccccggggccgcaaggagtacgccctcaccgacgcgggcctggccgaactgcgccactggctcaccgggaccgagccgcagcgcagcgtgcgcagcgacatcctgctgcgcgtcttcttcctcggtgtgctcacccccgagcaggctcgcgcctacctgaccggtctcgccgagttgtccgagcgggagcacgacggactgcgcgcgctcatggactccgtcgactggggcgaggacagcctctccgtccacggccggatcgccctggagtacggcctgcgcttcaacaccatgcgccgggagtgggcggcgcgccagatcgggtagcggccggaggcgcggcggagacggtcgggtagcggccggacgcgcgcggctgccccggccgtttcgcgccggcctcctcgccgagcagggtggcggtgaaggagccgggcgtggtggagatggtcttgaacagccggccgaggtgctggtgggcggggctctccgggtaccagggggtgccgccgcgggtgatcaggcgggcgaacatcttcgagtgccggcactcgtcctcgatctcggtgagggcgtagcgcacgtgcgcgctggtggccgacttgtcgtagatgtggcgcacgagcagctgcatcaggatcagttcgaaccagatgccgagggagg

SEQ ID NO: 436 - DNA, 3623 bp, Unknown
  Kingdom: Bacteria, Phylum: Actinobacteria, Class: Actinobacteria, Order: Streptomycetales, Family: Streptomycetaceae, Genus: Streptomyces
aggaggtcgccgccgcggcggcgacctccttgcacagcttcaccatcgggccgtacgcggccagggtgaggtcggtgccctcgcggacgacctgtgccttgtgcagcggtgcggggatggcctcggcgtcgacctcggccttgtcccagtaacgccgcttgggctcgaagtagatcaccgggtcgtcgctctggatggcctgctgcatcatccagtacgcgtccgacgcgttggacggggagacgatcttcagccccgccacgtgggcgaagagggcctcgggcgactccgagtggtgctccaccgcgccgatgccgccgccgtaggggatgcggacgacgaccggcatcttgaccttgccgagcgagcgggcgtgcatcttcgcgagctgcgtgacgatctggtcgtaggccgggaagacgaagccgtcgaactggatctcgaccaccgggcggtagccgcgcagggccaggccgatcgcggtgccgacgatgccggactcggcgagcggggtgtcgatgacgcggctctcgccgaagtccttctgcaggccgtccgtcacccggaacacgccgccgagcttgcccacgtcctcacccatgacgaggaccttggggtccgcgtccagggcgcggcgcagcgactcgttgatggccttggccatcgccatcttctcggccatcagtgacccccttcatccgcgaacgacgcctggtaggcggcgaactgggcgcgctcctcgtcgacgagcgcgtgcccgtccgcgtacacgttctcgaagatggcgaagtggtccgggtcgggcatggagcggaccgcttcgcgcactcgccttcccaacgcctcgctctcggcctcgagttccgcgaagaatccctcgtccgcgtggtttgcggcctccaggtggcggcgaagacgcaggatcgggtccttcgcctcccaggcggcccgctcgtcgtcgtgccggtagcgggtggggtcgtcggaggtggtgtgggcgcccatgcggtacgtgtacgcctcgaccagggtcgggccctctccggcgcgggcgcgctccagcgcccacttggtgaccgcgaggcaggcgagcacgtcgttgccgtcgacgcgcacaccggggaagccgtagccctgcgcgcgctggtagagcggcacgcgggtctgcttctcggtcggctcggagatcgcccactggttgttctggcagaagaacaccacgggggcgttgtagaccgcggagaaggtgaaggactccgcgacgtcgccctggctcgaggcgccgtcgccgaagtaggcgatgaccgccgagtccgcgccgtccttggcgacgcccatcgcgtagccggtggcgtgcagcgtctgggacccgatgacgatcgtgtacaggtggaagttgttgctgttcgggtcccagccgccgttgttcacgccgcggaacatgccgagcaggttggccgggtcgacgccgcggcaccaggcgacgccgtgctcgcggtaggtcgggaagacgtagtcgtcgtcgttcagggcgcggcctgagccgatctgggcggcctcctggccgagcagcgaggcccacaggcccagctcgccctggcgctgcagggcggtcgcctcggcgtcgaagcggcgggtgagcaccatgtcgcggtacagcccgcgcagttccccggcggtgataccggcgacgtagcggtcgtactcggcgttcgtgacgcgctcgccctcgggcgtcagcagctgcacgagaccgggctcggcgccgttcgcggcagccgcggccttcttggcggtcgtgcgggtggtgccggtggtgcgcttggtactggtggtgcgcttggtgccgttggcgccggccgccttgctgccggccgccttcgtgccggacgtcccggccttgctcccggcgctgcgtcgcggtgtacgcgcggcagtgctctcctcggtcacgtgtgctcctccgtcggtccggcccccggggttgccggtaggccagtgcggctcacctgttctggacctcggggcacggggtgggtgccactcggccgggaacaggcgtgacaggtgccccggcgagcgccctgcaacagccacgttacccacagctccacatttctgggaaacccctcctgacctgcgtgtttccttggatttccaagtactttcacttggacggccaagtacctcgcggggcagtggggacagctgctggtcacagccttgcagggggccggaacaccggcacgttatcccggtcaccccgtggtcgggaagagttcacgagtggccggaaccgctcttgaccacgcgcccctccgagtggccgagggccccgaaaccggggcgaacggagaacggcaccgtgatcccaagtgaccaaaagcgactgctggcgactgtctgtgacaagccccagctcacagcctcgcccggtgccctaacatctggcgcgtgccgcgctcatgtgtaccaccctctgtgccccacgcgccccctctgagtgccctgctgcgccagtacgccgccggttccgccgtcacctgcgagccggtcgaccaggggcttctcaaccgcggctaccggctgtgcaccacccgcggccgctacttcctcaagcaccacttcgaccccgacaccgccgacccggcgtcgatcgcccgccggcaccgcgccacccagcgcctcgccgacctcggggtcccggtggcaccggcgctcgagggccgggacgggcgcacggtcgccgtcatcggcggccacgcctacgccctctacccgtggatcgacggccggcaccggcacggcgggcagctcaccaccggccagtgcgcccgcctcggcgcgctcctgggcgccgtgcacgcctgcctggagcgcgtgatgcctcccaagggccgcacccgccccgccacgagcccgcatcccgtcaggagcgccgacccggccgacacgctcgccctgatcgacgacctgctcggccacgtacgccgccaccgcccgccggacgccttcgacgaactggcccggcaccggctcctggagcgccgcacgctcctggagcagcacgccggccgcaggccgccgcccggcggcccggtgggctgggtgcacggcgacttccaccccttcaacgtgctctacaagggccacgctcccgccgcgatcgtcgactgggaccggctcggcgtgcagccgcgcgcggaggaggccgtacgggccgccgcgatcttcttcgtccggcccggcggcaccctggacctgccgaagatcacggcgtacgcgcgcgcgtaccggcgcgctgccggggccacgtcctcggagctggccgccgcggtgcaccgcgtgtggtgggaacgtctgaacgacttctggatgctgcgctggcactacgagcgcggcgacacccgcgccgatccgcagttcccggccgcgtcggccctggtggtgtggtggacacgggagtacgacgcggtgtgcgggacgttcgcggagtaaccctgccgagacgtgcgagacctgccgggacctgcgagacctgcgagacctgccgagaggccctgacagaccggtcccggacggcagcacgcgcgcgtggagccccgtccgggaccggtctgtca

SEQ ID NO: 437 - DNA, 5560 bp, Unknown
  Kingdom: Bacteria, Phylum: Actinobacteria, Class: Actinobacteria, Order: Streptomycetales, Family: Streptomycetaceae, Genus: Streptomyces
caccgcgctctcgtcggccgcgcgggcggccgacgagagcgcggtgatgccgggcagggccaggagcgtggccgtgagtgcggtgagcagccggcgcgccgctggtccgggtcgtctgtcgcgttccacaagtgcctccgggcaagggggagtttggagggtggagcgcgcccaatttggtccagaccaattgggttgtcaagacctctgacgtcgtccggcggcgccgtcctgcggcttccgggatcactggtcgccctccgtcgccagccccgccgccgcctcgtgcatcgccagttccagcaacgccgggtcggtgagggtgcccgagccgtcgggcgggaccagccagcgcagggtgccggcggtccggccggggtacgggacgacgatccaggcgccggggccgacgccgcggacaccggtgccgagccagcgtgccgccgtgcccggcggtacgaggaaacccaggcggccgtcgccgaagtcggcgaggaccgggccgagctggtcgagcacccggctgagcacgtcgagcgtggggtagccgagttcgcccggcaggatcagaacgtcccaggccttgcccgcgggcagcagggcgaccccgcgcggattgcgctcccattccctgcggcaggcacgcggatccggcgcgacggatgccagccactcgaccgccgtcttcgtcccggtcatggagagacctccctcttcgtcctggacgcgcggtggcgcgcccagaggggagagggaggtctgcggccccgcattacgcgggttcgggaaaagggttgtagtgacgtaggtcacattctcggcggcgccgagggcccgtcctgcggcggtcggccggcctcagctgtcgaagccgagtcccagacggtccatcgtccgcagccacaggttgcgccggccgtcgtgcgtgtcggcccgcgccagcgaccacttggtcagcgcgatgccggtccaggccagcggctcgggcgggaagggcagcggcttcctgcggaccatctccagttcggtgcgctcggtgcgctcgccggacagcaggtcgagcatcacctcggcgccgaaccgggtcgcgccgacgccgaggccggtgtacccggccgcgtacgccaccttgccctggtgggcggtgccgaagaacgccgagaagcgcgagcaggtgtcgatcgcgccgccccaggcgtggctgaagcggacgccttcgagctgcgggaagcaggtgaagaagtgcccggcgagcttcgcgtaggtctcggggcggtcgtcgtactcggcgcgcacccggccgccgtaggggtagacggcgtcgtagccgccccacaggatccggttgtcggcggagagccggaagtagtggaactggttggccgagtcgccgagcccctggcggttcttccagccgatggactccagctgggcggcggtcagcggctcggtcatcagggcgtagtcgtagaccgggacggtgtacggccggacgcgcctgaccaggttcgggaagacgttggtgccgagcgcgacctggcgggcgcggacgccgccgtagggggtgcgcacgctcatgccggcaccgtagggcttgagcgtgagcgccggggtgtgctcgtggacgcggacgccgagccgcaggcaggcctgcttgaggccccaggcgagcttggccgggtggagcatggccacgccccggcggtcccacaggccggcctcgaaggtgggcgaggcgacctgttcgcgcacggcgtcccggtcgagcagttcgatgccctcggcgaggcccttctcctccagctccgcgtgccagtcgcgcagttcccgtgcctggtagggctcggtggccacgtcgatctcgccggtgcgctcgaactcgcagtcgatgccgtggcgggcgacggtctcctcgatggcgtcgaggttgcgcgcgcccagcgcctccagccggtggatctcgtccggccagcgggtgagtccgttggacaggccgtgggtgagggaggcggcgcagaagccgccgttgcggccggaggcggcccagcccacctcgcggccctccacgagcaccacgtccaggtccgggtcgcgctccttggcgatcagcgcggtccacagtccgctgtagccgccgccgacgacgagcaggtcgcaggtctgtacgccggtcagggccggctcggggcggggacggccggggtcgtccagccagtagggggtgggctgtgcctcggaaagtgaaccggtccaacgggtcatggcgctcggggccatgatttcaactccctacagggttatgacggtcatgccttttgcttggtacggcggttgccgatggccatggagaccaggacgaacagtacggcgatgacgaacatggccgtaccgatgacattgatctggacgggtgtgccgcgctgcgccgaaccccagacgaacatggggaaggtgacggtggagcccgcgttgaaattggtgatgatgaaatcgtcgaaggagagcgcgaaggcgagcagcgcgcccgcggcgattccgggtgccgcgatcggcagggtgacccgcacgaacgtctggaacgggccggcgtagaggtcctgcgcggcctgttccagcctcgggtccatcgacatcacgcgtgccttgacggcggtgacgacgaagctgaggcagaacatgatgtgggcgatcaggatggtccagaagcccagctgggcgcccatgttgaggaagagggtgagcagcgaggcggccatgacgacctcgggcatcgccatcggcaggaagatcagcgagttgacggcgccgcgggcgcggaagcggtagcggaccagcgcgaaggcgatcatcgtgccgaggaccgtggcgcccagggtggcccagacggcgatctggaggctgagcgagagcgatccgcacattccggcgacgccgcaggggtctttccacgcgtcggtggagaagcgctgccattcgtagttgaaacggcccttgggcttgttgaaggagaagaccgtgacgatgacgttcggcaggagcagatagccgagggtcagcagtcccgcgatgacgacgagacggcgcttgagccaggtgacgaggggcatttagacgagatcctccgtcccggaccggcggatgtagacggtgaccatgacgagaatcgcggccatgaggatgaaggagagcgcggcggccgtcggatagtccaggatccgcaggaactgcgactggatgacgttgccgaccatgcgggtgtcggtcgagccgagcaggtcggcgttgacgtagtcgccggcggcggggatgaaggtcagcagggtgccggagaccacgccgggcatggacagcgggaaggtgaccttgcggaaggtggtgacgggcttggcgtacaggtcgccggccgcctcgtgcagccgtccgtcgatccgctccagcgaggtgtacagcggcaggatcatgaacggcaggaagttgtacgtcagtccgcacaccaccgcgagcggcgtggccagcacgcggtcgccggaggtccagccgagccagttggtgacgtccaggacgtgcagcgcgttgagggcgccgacgaccgggccgccgtcggcgaggatcgtcttccaggccagggtgcggatcaggaagctggtgaagaacggcgcgatcaccaggatcatgatcaggttgcgccagcggcccgcgcggaaggcgatgaggtacgcgagcgggtagccgagcagcaggcacaggatcgtcgcggaggccgcgtagagcaccgagcgcaggaactgcggccagtactcggacagggcgtcccagtaggtcacgaagtgccaggtgaccttgtagccctgttccagggagccggtctgcaccgacgtggacgcctggtagatcatcggcagcgcgaagaagacgaccagccacaggatgccgggcagcagcagccagtacggggtcaggcggccccgcctgcgcggcggtttcgtcccgggggcggtgggcgcgagcgggggcggcgcctcggtgacggtggtcatcaggcggcgtcctcctcgacggagccgacaccggcgtcgatgtcctgtgccgcatcgagaccgaaggtgtgcgccgggttccagtgcaggacgacctcggtgccgggcaccagccgcgggtcgcggtcgatgttctgggcgtagacctcgaagtcggcgcagacgggactgtcgatcacgtactgcgtggagacgccgatgaaactggagtcggcgatgcggccggtgatgcggttgcggccctcgggtatgccgcccgcgtcgtcggcgtgggtcagcgagatcttctccgggcgcaccccggccagtaccttgccgccgacgccggccggcgcggaacatcgcgccttgggcagggcgagcttgccgccgccggccctgaggacgatctcctcgccgctcaccgtggcgacctcggcctcgatgaagttggagctgccgaggaagttggcgacgaacgtggtgcgcgggttctcgtagaggtcggtgggcgagccgagctgttcgacgcgtccggcgttcatcaccgcgaccgtgtcggccatggtcatggcctcctcctggtcgtgggtgacgtgcacgaaggtgatgccgacctcggtctggatgcgtttgagctccagctgcatctggcggcgcagcttgaggtccagggcgccgagcggctcgtcgagcagcagcaccttggggtggttgatcagggcgcgggccacggcgacgcgctgctgctggccgccggagagctggtgcggcttcttgcgggcctgctcgccgagctggacgaggtccagcatctcctcgacctgcttcttcacgctcttgatgccgcgccggcgcaggccgaaggcgacgttctcgaagatgtcgaggtgcgggaagagggcgtaggactggaagaccgtgttcaccgggcgcttgtagggcggcaggtgggtcacgtcctggtcgccgaggtggaccgtgccgccggtgggctcctccaggccggcgatcatgcgcagggtggtggtcttgccgcagccggaggcgccgagcagggcgaagaaggagccctgcggcacggtcaggtcgagcgggtgcactgcggtgaaggagccgtagcgcttgctgatctgcgtcaggcggacgtcaccgctgtggtccgtcgcgtctgctgtggtcttcatcgtcacgcccctgtgagcttcgcgtacttctcttcaaaggccgtctcttccttctcgctcagcaggcggaaggtgtgggacttggcggccgtggccttgtcgggcaggatcagcgggttctccgccaccgacttgtcgatcttcgaaagatagggccgcacaccgtcgaccggcgacacgtagttggtgtaggcggcgagcgcggcggcctgttcgggctcgtagtagaagtcgatcagccgctcggcgttggccttgtgccgcgccttggcggggatcagcatgcagtcggtgcccgtgatgtatccggcgtccgggatcaggtagtcgacgtccgggttgtccgcctggagctgg

SEQ ID NO: 438 - DNA, 880 bp, Unknown
  Kingdom: Bacteria, Phylum: Actinobacteria, Class: Actinobacteria, Order: Streptomycetales, Family: Streptomycetaceae, Genus: Streptomyces
cagcaggtagccgccgtgccgggtggccagcacctccttggcggtgccgggggcgtcggggcccatcgcggtgcccagtctccggcgcagctggaggatgtacgtctgcagcgtcgtcatggcgctctgcggcgagttgctgccccagatctcctccatgagcgtggacacgggcacgacgcgccctgggtagaaggccagcagcgcgaggagctggcgtggtttgccggcggtgggcacgatcgacactccgttgacctcggcgctcagcgggcccagaacctgtattcgcacggtgtcctccccaaggacagatcaaggactgatctcgagccggcgctaccgcccccggtggccgaaagccgtcggctcacgcacgctagccccggctccgccgtcggccccgttctctcgaccggggttcgagcctccttccacgcggggtcgccggcgctccgcaaggccgcctggagaacatccgtacgaccgctcgaggcccgctcgcacggcctgacgccatggcccggcggcggctaccgtccgcgtcgtgaccggatcggacgaaagggccccacgatgagcgtgctcgccacctcgcgccccgagccggtgcgggccgccgccggacacggacgcgtcgagttccggctcctcgggccggtcacggtccacgacggcgcccgcggcacggacatcacgccgcccgggtcgaagcagcgggccctgctcgccgcgttcgtgacgcatgccggcgtactgctcgacgtggaccggctcgccgcggaactgtgggacgggcagccgcccgcgaacgcggcgaacgcgctgcaggcccatgtcgcacggctgcgccggctgctgcccgccccgggcggcgggg

SEQ ID NO: 439 - DNA, 13910 bp, Unknown
  Kingdom: Bacteria, Phylum: Actinobacteria, Class: Actinobacteria, Order: Streptomycetales, Family: Streptomycetaceae, Genus: Streptomyces
gacgtgttccatcccgggatgcagggtttttgagaagtgatcttgtgtccgggttcgtcaggtcagtccgagggcggtgaggggccgcaggtggtcacggccggtgcggcggagggcggcggcgatgttggtgtggccgtcctggcggtggacgccgatggcgaggttgcgcaggccggccatgacgcggggcagattgtgggtgcggatcttcgaggcgtcctcgtggaaggtgcggtcacggacgtggtgcagctggttctcgatgcgccagtggccgcggatccaggctgcgagcgcgctgccgccgaccgcgccgggtggcaggctggtgaccaggtagatccgctcgatcgtcagcttgcccgtgcccagatcgtgtctgcggcgcacgacttggagggcctggcgtgcgtgcgggtagtcgaggtgggcgaaggcggcggtcttcagacggcggatctcgtcgcggtggtgggcccgggtgcgctcgatgtggtccaggcggatgtcgcgccagggaaggccgcggatgcgctcatggagtccgggatggttccgcttgacgacggcaaggtagtgggctccccgttcgtgcaggtaggcagcgtggtcgtgctgggtgtgcagggcgtcggcggtgatgacggcgccggtgaggtcgaggccgtccaggagtggggcgaaggccgggatctcgttgctcttgctgtcgatctgccgttgggcgagaacctcgccgctgtgggtcatggcggcgatcagggcgatggccgtccggccggcggtgcgggagccatggactcgctcggtgctcatacggactcgacacccacatgatcaccagcggccatgcctgttccgcgtccaggatcggcggcgactgaagtcgacaagccatcacatccggtgctcagcaggcgaaccgcccacctccacacttctcaatgcccctggccctcacgacaccacgagttcaacctcagtaggacctctaagcccgaacggtggattcaccgacaagatccccgctgcggtagagcggaatgacagcgtcatatgcaagcatcgtactgaggcccttcccgagatccccagtggatcagcgagcggcgtcagatgtggtctatcgcaaagcggagggtggtcctcgtatgcgatgtacgcggacgatccgacaacgcggcgaggggccgcagtcggcggcgggacccgctgggttcacgggaaggccttagcgattcatcggtgggtgccgcgatgcttgcttgtcctggttctccagcttgaactcggattctgagctggttctctttgccagtggcagtggcggccttcgatagtcattcgatcaccatccgttctgacggctggtgggatctgtcaccgggctgttctgcccgtaaccggggtgaggtcacccccagacgcgacaaggggcatcaatgatgtcttacgacggtacggaccaggtgatctttccagccggtgccgcgacgcagaccagcgccgcggaggctgcgcaaggcgagtgggatgccgttgtcgtcggtggcggcatggcaggttccatcgtcgccgagcagctgggccaggcaggctacaaggtggtgattctcgaagccggccccggcaaggacctggacctcgccgagtacgagtcgtatctgtcgcggttctacggcgcgatcgtcaaggacaaccagtctccgtacccgttcaacccgaatgcccggatgcccaggagcaccgacaccatgccggtgcatccggacacaccccgagacgacttctacctcgtgcaggaggacaagtactgcacggacaccaccttcactcgggtcctcggcggcacctccatgcattgggaggggaaagcgctgcgcatgcttcccgaggacttcgacctgcgaaccaagtacggccagggcctgaactggccgctcagctatgaagacctggaaccctactaccggcaggctgaggccgaactgggcgtagccgccgatgtcgaggatcagacgtacctgggaatgcatttcccgaagggatacgtgttcccgatgcaccgcatgccgccgtcctatctcgaccggacggtcgcccggggtgtggacggcatgcgggtcaccctggcggacgacgaatacacactccaggtgcggagctttccgcaggcccgtaacggcgtgccgaacgccgcgtacgacggcggcaagggcttcgtcccggtcggcgcggtcagcacgagccaggtggaagagggcgagcgctgtcagggcaacaccaactgcgtccccatctgccccgtgcaggccaaatatcacgcgggaaagacgctggccaaggcgctccgcaagggcaacgtcaagatcgtgacgcaagccgtcgcatccaaggtcgagatcaacgagcacgacaaacgggtgaccgggatcaccatcaagaactacgaggcactcaactccgagaagtacgaaacgtacacggtgaagggaaccgtctacatcctctgcgcgcacgccatcgagaacgcccggctcatgctggcctccgacatgcagcgtatgagccgcagcaagctgatcggctgcaacctgatggaccacgcgtacctgctgtcctggggcctgctgcccaagccggccggcacgatgcgaggcacaacctgcacgagcgggatcactgacctgcgcggcgggcgattccgcggaacccaggccggcttcggcgtggacatccacaacgacggctgggggtgggcgaccggctcgccgtacacggacttggtcgaactcgtggacaagcgaggcctacgcggggcggagttgcgcaagacgctcgggaaccagatctcccggcagcttctgctggccttcatgatcgacctgctgcccgacaggagcaacagggtcaccgtggacgaccggtacaaggatgccctcggcaacatgaagccggtcgtgtcgttcaagatcccgccctacaccatgcggggcgccgcgttcgcccgcaaactcgcgaccgacatcttcgagaagctcggtgctgaggacaggaccgcatacgacaaggacagctacagcgctgtcgagcacgagggccagtggtacaacatcgtgggcggcaaccacctggcgggcactcacatcatggggactgacccggcgagctccgtggtcgaccacacccagcactcgtgggaccacgagaacctctaccttgtcgggcccggcagcctgccctcgatcgggacgtccaacatcagcctgaccatggcggcgctcgccttccgcagtgcggcccacgtcgtcaggcacctgcgtgccgcgaaggcgccggccgtcgtccgcaggtagacggcttacagatcggcgggttgaacgcgacaccgcccaccgcccaccgcccacgattgggggaacatgtccgtttcagaatcagagcccgctccggaccccaagatccggaccatcgaggagctgcacgaatacctctacaaggggctccagttggagcacgcaacgctcccgccctacctgaccgcgctctactcgctgcatccggggaagaactcggatgcctggcatgtcatcagggtcgtggccgtcgaggagatgctgcacctcaccctggtcgcgaacgtcatgaacgctgtgggcgggacgccggacctcaccaagccggacttcgtgccgaattatccgacgcgcctgccgtgtggtcccgattacttcgaggtgcatctccggccgttctcgcacgaggctctcgacacgttcctgaagatcgagaagcccgcgcaggcggataccgaggaagacaggttcgtaccggtggactgggcggcccttggactgacgtccaacggcgcggcgccgccaccggcgaaattggcggcactcgaggagtccgggacaatcttcggcctcgtccccggagaccccaccgagcgtttcctcagcatcggtgagttctacgaggagatcattcggggcatcaaccacctggaggaccaggcccgtaaggcagggaagacgattttcaccggcgatcccgctcgccaggtgactcccgagtacttctactccggtggcggcgatgtgatcagggtgaccggccgcgacaccgcagtcgcggcgctcactctcgtcgcggagcagggcgaagggctgtacggcggaatcttcgacagccaggacgagatcgcccactactacaggttccagcagctggaaaaggggaggtactaccagaagggtgatgagccaaacgagccttccggcccggatctgaacgtcgactgggatgccgtctatccggtgaagccggacatcaagctggcggacctcgcgggagacccaggaatcctagcggcggccaaggagttcaaccagttctacgccaccttcctgaccagcatcaatctggcctacaacggtcagcccgaccttctgctcaaggcggtttgggagatgttccggatgcgcgacagtatgcaccggctcgtccgcaacccgctcacagggcatccaggggcgaacgccggcccgacattcgagctgtcgaaggaggcgggatcatgacgcaaagcaaggacgcagaagagaagctgcgtgatttcgtgaagttctctgccgctgcgaccgggttcagcgagttcgacctgtggggaactggtcaggcggaggtgtactacaagacggcggtgagtcaagaagggttggatgcgatcgagaaggcgatggcttccgatccctctgctcaccccgcagtggtgaaaagcatcatcaagctctggtatgtcggcgtctggtatggcccggaactggtgggacgcatggacgtggcggcctggacggcgcccgggcggagcggagcgaagcccgccgtcccggatgacagccagcccgagggaagccggccctggcaggccatgtccggacaacgccaggcgggggaagatcgcgcgcacggcggagacggacgcaaacccccgttggtcgtctcccccgacgcctacaccgagggcctgttgtggcgggccatcggcgcccacccatccggcgccaaggcgccgggctacggatcgtgggccaatccgcccacattcgaggactgccaagaggaggaagtacaatgaccagcactgtcccgaacctgggtcgcgacaaggtgtcactcggcgtaacgccgacactgtggtggaatgacgacttcccgctgatcgacatcggcatcccgttcgagcaatgcgtgagcgagatggcgctcgcgggattccagggctgcagcatcggtcacaagtacccggccgaccccgccgtactgaagaaggcactcgatctgcgcggcctgaaggtgtccgagccctgggtgagcacctacttcaccatcggcgacaaagaccggaccgtcggaaactttaagaggcaactgaagttcctcgagaaagtgggcggcagggacatcgtggtcgcagaattcgggctgtcgtcgcacctgcagcccatcccggttttcaagcagcgccccgagttcaccgacaaagagtgggatctcctcaccagcgggctcaacgaaatcggtaagctggccgcggacaacgagatgcggctctgttaccaccatcacatgggcactggcgtgcagacggccggggacatcgacaggttgatggcggacaccaacccagacgacgtgcatctgctgttcgacaccgggcatctccagttcgcgggcgacaacccgctcaagaccgccgaaagacacaagcagcggattaagcacgtgcacctcaagaacgtccgccagtccgtagccgacaaggtgaagagcgaccacctgtccttccaggagggaatcctgcagggcgtcttcaccgttcccggagactcagaaggcgcgatcgatttcaagcccatcctctcgacgctgggggaagccggctacgagggatggctggtcgtcgaggccgaacagaacccggcgacggcacacccgctgacgtacgccaagatggcccgtggttacctcaccgaagtcctgggatggtaacgatgagtacgcgcgacatcgttgaagtacacccgcatccatgaggcgggaagccccactgcctgcgcggcatcgcagcacggcgacgtggcttgcctggccacggccgcagaacacggcggcggcaccggtggtgcggtaccgggtgccacctgcgcccgtagccagcgctttttggcccgtacgccccacgggcggtcgacagcgtcgccccggccaccaccgcgctgctctccgaagccgtcgacattccacgcaggcagtccttccctaactgccggagaagcgctgctcctcgtcaccgacagagccggtcgggccgtcacaagcgcgttcccggcgcggccccgctaccgagatgcttatctcggcgagccgggcgaactgcatcaggccgggcgggatgtcgcttcgatgtcgccgcatgatctgccgcagggaacgggcccaggctgggcagggggcggtgcgccgtgatcggaatcctcgcagagggtcaccgcccgttcggccgcgccgtcgacgcgcgcccatctgcccggcggccagaacctgacagggcaggcctccggtgctcgcctacccccgttggcggccttccgcagtgcggctccgggcaccgcccacaaatgtgactgtcagtagtgctgccctcggtagacgccgtcggtgccgacgccgcggctccagtctccgaaactcgtgctgcccagttccaggttgacgatgaaggaaccggccgcggcgagggtgatcctgaaaggttcgtcgtactcgtcgggcaggttgttcacggccagcagcgggaactccgccgaggccagggcctgctcgtcggcgatgaggaggaaggggctgtcgggccggtcctcgccgtcacggccaacccgctcctgcagctggcctgcggtgaagcccgtatagagggggttgccgatgacggtgaccgacccgtagtgctccgagccgccctccagggcctggaggaggcgggcccaggagtctggctggtcgaaggaggtgcggaccaggagcgggccggaccgctccgcggcgtgcagcgccaccgcccgcagcacattgttctcgcggccctggcgcagaccccgcatccacttgttgtcctccgccgcgccactcccgcgcagtatctcccgcaccctgcccgcgatgtcccggtcctcggacgcgtccgtcgtcattggcgaccatccgtttcgtcgacgcggtgctcccgcagggcccacgccccacgattcagcacttcgtttgatctcactattcgtgattactccggcaccctccgttatgatgccggatgcccctacaccagcagccgcaacagctcagcacaccggaccccacccgaccccgcccctgcccgccccggctgcgcggacggccggggagcttgtgcgtgaacgcggggaccgtctcgaagtccaggcgcgtgcactgcctgcgccaggtggaacctctcagcccgaggcctgacggccgcgccccccagggcctacacgcactgggctgcgatgctcggaggatctgagctgcggcatcgcactggtgcgcgtgtggatcccaggatcttcgggcgactcccgcaccgaactccatggcggccggcgcgggttcggtgagccggtccagccgcgtgtagagggcggccccgcacgagccgggcttggttctggacgcagcgggcggtgcctttgaacggggcagaacaggggtccgccggccttacggaggacgacttcggcgtgggtgccgcggccgtcgctcttgggcggggcggcagcgtggcggcggacgtcggcggccaccgcgcgggcgtgcccggtgaactggagggcgatctgctcgtagtcgcggggggggcgaggtccggatcctgccacgcgaggacggcggtgacgagtgcctcgtgcggggcgcggtccagggggagttccgcctcgatcagaccgtcggggtcatggagcgcgacgtaggtgtcgctcatcgggcgcccgccacgtcgtcgtcccggtggtggtcgccgggactggcgtccggggcctggacggacgtacccacggtcggctcgggcgatcagcgccggggaaggccggtcgaaggcaggcggctggaggccggggccctccagcgcgggtcggctgccggaccacggcccaacccctgaagccgtccgctcccgccgccatggtcacgcgcggctcggcgcctccgggcgagtcatggcgtagcggccccagtggacggcctggccgcctcggaggacggccaggcggtcggggccggcttccctccagggcgtctcgaacgggccaccgctgtacgggtcgggcgggtccgcgggtcatccggtgaggccgtcgtccggtgcggtgtggctgacgaggcgcagcacccggccgccggtgtcttcgtcggtcggcgcctgtaggagaccgggactgcgcagcgtcccggtcctttctcagcacgtctgacctgtcgtgctggggggcatgatctggtctgtggactactcagactgcgcggacgtcctcgcacaggtgcaagaaaaccctcacggagttcctcgggtggtgcggcaggccaacgtctcgcggctgcttgaagcgttgggccgccctgagcggggactgcgcggcatgctggtggtcgggaagaacggcaaggggtcgacctgtgcgttcgcggtggcggccgtggccgcaaccggcgtacaggtcggcagcatgcccagcccgcacctgcaggagctcagggaacgtatccgcgtcgacggggttcccgtcacacgcgcggagtacgccgcagcgttcacggaagtctggcaggctatcgggcggcatggtctgcccgtcctggcccagggcatctacacggcgaccgcggccgtccacttccaacgggccggggtggggctcgcggtggccgaggcgagcatcggcgggagcagggcggcggctgcggaactcggcctggacgtcaaggtcgtcacgggtatcggactcgaccacacccggctgctcggcggatccctgtcccagatcacccgggccaaggtcgcagccgccaaggacggggaccatgtcgttctcggacgcctggcccccgaagcagccaccgccgcggaacgggtcctcaaggagcggacgggactgtcggtgtggcgcatggaccacgagatccactacaccgcccatgccgccggccgcagcgacaacggcggcatgacgacactggtcgacgtctccactccccgcgccgtgcaccgtgatctgccctgcccgctggccggcgcacaccagcaccacaacctcgcgctcgccatcgcggcgatggactcgatggccgaacgcggccacatccacgaacccgacacagaacgcctgcgcgcacgactggcggccacacgctggcccggccgcctcgaactcgttccccacgcccggctcaacgactggacaggccgcgtccttttggacggcgccaccaatccgcaaggcgtcgcgaccgtcgccccggagatcctgcgccaggcccgagccgacggccactctggcccgcccgtactggtcttcgccgcgatggacgacaaggacgtctccggcatgctcgccccgctccccgaccactggcccctgatcctcacccgcaccgacgccccacacgccgcgaactgcgccaccttgcaccaccggctctcccccgaccaccggggcccctgcctgacagcccagaacaccccgacggcgctgcaccaggctgccgaactcaccgggcccggcggcctgatcatcgtcttcggctcgcaccgcctcgtaggcgaaacacgcaccgcgctggcactgccacccgtgtgacgtggagcctcccgcgagtgcccacacggtgggcgactgacgctccgtcgtcgtctggccgaggtgtaccggctctacggtgacgccgccgaggctggacgctggatgtacctcgaagaggaccggaacgccgacgagaccgccgccttcgaggcgcggtacgggtctcccgggtggcggatgaaagccctcgcctggcagggccccgaggcgaaggccgccaccgtcttcgcggaggagcaactggtcgcggtgcggaccgcctgcgccgaggaattggggcaccccgtcgactggaacgaccccgcctcctaccgggacgacctggaaggcgcgtacgacgctcaggccctggcagacttcctccacacctacaaccaccaccgctgccacaccgcactgggcgggcacccgcccatcaaccgcgtcaacaacgctgcgggtcaatacacctaggtcgcgccgctccgggtcccagcttctctgctgttccatcgcccgcgcggacgcggtccgggccgcgtacgctggcgcggcatcgacttgagcagcgcgcggcctgcgggcggcgcggtgatggtcaacgggtttacgggctagagatcagcacgatgaccgcacctgacagagtgcgcctgcacgccctcgcggaagacaacctcgccgcggcgagtccgccgaggccgaccgctacaccgccaccgcccctcggggacaagctgcgggtgacgcgggccctgggcatctcccgggcgaccatctaccgcaagatcacggcagatcggatccggctctcgcccccggccacgacgtctcggtctgagacacggcgccgcccctcacccggcgacgggctcctgacggcgcgtgtccccgagaccggtccaggtcgccgccagttccgcgaggtcgagcatgtcgctgagggggcgggcacccgggacgcacgcctcgtcgggccgcggacctggccggtaccagaggaccggcatgcccgcggccgcggcggcctcgacgccgacgcggctgtcctcgatcaccagcacgtccgcgggatcgaccgacaccgcctcggcggcggccgcgtacaggcccgggtcgggcttccacaccttcagctcgtaggcggagaagtgcgtgtccccgaagtagctgtcgagcccggtcgtccgcagccggtcgcggatcatctgcagcggcgagttcgacaccacgtacgtgggaagggtgatcgcgcgcagcgcctcctcgactccgggcacggccgtcaggcgcccggcgatcagctcctcgccccgggcgcgcagcaccccgaccgggtccggcggcatcggtttcgtcgcgaggcgggccaggatgtcgacgctgtcctggacgcggcgtccgttgaacaatcgttccacgtcggccgccgtcacgggggcgccgacgagacgggccaggtcgagcagggcgtcgttctcagcgtcctggctgtcgacgaggaccccgtcgaggtcgaagaagacgacggtcggggtcatcgggccaccacgtccgaccgcgcctgacgctcggcgaactcggcgtacttgtcggagagttcacgcgcgagcggcagcgcgtcctcgacgagcatctccgggcagtcgtagccgagcaggcgctgcatgacggacatgctctccttggcgaagacgatccgtccgcccggatggacggcgtcgatgccgtcgatgcgctggcactcctcgttcacggcgacggccgcctgctcgctcagcccggccggcaggtcgagccggatgccggtcgcggacacggcgacgggatagccgccgacgcggccgtgcggggccggcgcgtgcagccggcgttcctcggcggacgtcagagcccggacgacctggagggccgaggccgaggtcagctgctggccctgcgtgccgccctgccgcttcaacggccccgtcaggtgggcgaacatgcgctccggccggggccgcaggatctcgcccgtgaccgcgtccgacacctcgatcacgaacgggacgccgtcggcttcgccgaaccggtgcacgtggtggctgaagtagtggtgggccaccacccgcacccgcacgctcgccggatcgcggtcgagttcgagggcggccgcgaaggtgagcgcggggacgatgttgccgacgttcccgatgccgatgtgcggcgccagaccgatcgaggccagggcgggaccgaccgcgtcggggtaggcggtgttgacggcgagcgcggcggagccggcccggcgcagcgccagcatcagccggtggttgagcgccaggtgcatcggcagccacgggccgagctgggcctcgtcgagttcccggaaggtcttgtccgggaggtccaggatcgcgcgggcggcctggagggaagccgcgttgacgacgatgtccggccggatcccggcgagggtctccgcggtgcggtccacgtcctcgaggtcgatctccgcgctgcccacggaggtgacgcggcccagattcgcggccgtgtaccggcccaggttggcgaaccgcagggcgcgttccccggaacgggccgcgacgacgacctcgtacggggatccgtgctcgccgaccagcatgtgcagcaggcgttggcccagatcaccgaggccgatgatcagtactcgcgtcgttcctgcgtcgtcgttcatcttcaaggaatcccccgtatcggtgccgaatgcgtcacggaaaaggctgccgagaatgtgcgtgtcagacgtggaaacgagcggacgaattcgcttcgcgggcccttgtgtctttgctcccataaacggttcgggcgttcgcgtaaggaccgatctctgactcggagcagcgctcagcatagtcacaagtgcggcgtcctgttgagccgttcggcaacgccgacgtgcactgccttcgcgcggacatcgtcgaaccccaagtttccgggcgcgggcttgcgggagccattccttttgcgggtattggtcccttgacccttccctcgtgggtgtgcaactgttcccccgtccaggacgggggatacacaatggaccgatcgacgcctgccgtctccggctacctgctggaggaggtcggggccatctgccaaggacgttcgggggacgccgttcccggcgactgcgcccggatagcggacgagatcaacgccctcttcggcctgcggatcaccccacgagacgtcagcggcacgcgctccgtccccgaactctccgctctcgtccaggccgccctgtcgggcccggcgagcgcgccaccgccggacgacgccggccgcgccccgctctcggcggcgcaacagcggatctggttcatgcagcagttcgcgggcgattccgtgctctacaacgtgccgacccggctggagctgaccggccccctcgacgagaacgccctgcgctccgcgctcgccgacgtgtgggccacgcacgagatcctgcgcaccgtctaccccgtcgcctccggcgtcccgttcgcgcgggtcggcgcggcgaccgcgttaccaccggtccccgtcgtcgatctgacccgcgccgccgacccgaccgccgcgctcgaccgtctcgccgcgcaccaggcggcgcgcccctttctcatcgaccgagatccgcccgtccgcctgctgatggcgcgcctgggccccgatcgcctcacgctgctcggcacgttccaccacatcgccgtcgattgggtcgcggtcaatctcctcgtccgcgacctcggcgagcgctacaccgcacacgtgcggggcgtacccgaagcgcctgtcccaccggagtgcgcgtactccgacgtggcgcgccgggaggcctccccgcaggcgtcggttgccgtcgaccgggccgtcttcgaccggagcgccgccctggccgacatcccacctctcgccctgcccacggacctgccgcgcccgcgctcctcacgcttcaagggctccgccgtgcacggcgga

SEQ ID NO: 440 - DNA, 5372 bp, Unknown
  Kingdom: Bacteria, Phylum: Actinobacteria, Class: Actinobacteria, Order: Streptomycetales, Family: Streptomycetaceae, Genus: Streptomyces
ggacggccatgccgacgccgcggtgatcgaggtcggcggcgtcggcatggccgtccagtgcactccgaacaccctgtccacgctccggagcggacagagcgccaagctgcacacctccctggtcgtccgagaggactccctgaccctgtacggcttcgcggacgacgacgaacgccagaccttcgagctgctccagaccgccagcggcgtcggcccccgcctcgcccaggccatgctcgccgtgcacaccccggacgccctgcgccgggccgtcgccaccggcgacgagaaggccctcaccgccgtccccggcatcggcaagaagggcgcccagaagctgctcctcgaactgaaggaccgcctcggcgaaccggtcggcgcccccgcgatcggcgcacccgtcacccagggctggcgcgaccagctgcacgccgcgctgatcggactcggctacgccacccgcgaggccgacgaggccgtcaccgccgtggccccgcaggccgaggccgccggcggcacgccccaggtgggcgccctgctcaaggccgccctgcagaccctgaaccgagcccgctgaccccgaccgtcgtaaggcacaccacatgaactgggacgacacggacgacaccgccgccgagcggctggtgggctccgcggccgaccgcgaggaccaggccgtcgaggccgccctgcgccccaaggacctcggcgagttcatcggccaggagaaggtccgcgaacagctcgacctcgtgctgcgcgccgcacgcgcgcgcggcgccaccgccgaccacgtcctgctctccggcgcccccggcctcggcaagaccaccctctcgatgatcatcgccgccgagatgggcgcccccatccgcatcacctcgggccccgccatccagcacgccggcgacctcgccgccatcctgtcctcgctccaggaaggagaggtcctcttcctcgacgagatccaccgcatgtcccggcccgccgaggagatgctgtacatggcgatggaggacttccgcgtcgacgtgatcgtcggcaagggccccggcgccaccgccatcccgctggaactgccgccgttcaccctggtcggcgccaccacccgcgccggcctgctgccgcccccgctgcgcgaccgcttcggcttcaccgcgcacatggagttctacgagcccgccgagctggagcgcgtcgtccaccgttcggcgagcctgctcgacgtggagatcgagaccgagggcgccgccgagatcgccggccgctcccgcggcacgccccgcatcgccaaccgcctgctgcgccgagtgcgggactacgcgcaggtcaaggccgacggcatcatcacccgtgagatcgccggggcggccctcgccgtctacgaggtcgacgcccgcggcctcgaccggctggaccgcgcggtcctgcaggcgctgctgaagctgttcggcggcggcccggtcgggctgtcgacgctcgccgtcgcggtgggggaggagcgcgagaccgtcgaggaggtcgccgagcccttcctcgtccgcgagggcctgctggcccgcaccccgcgcggccgggtggccactcccgccgcctgggcgcacctcggcctcaccccgcccggcgcgcaaggcgggggaaacggacaacaagacctgttcggggcgtgacggcgatccattggcccggggaggaacccaggtgccatgctgagcgttgttccttgcgcgcggactcccttagactccgccgatgccgcccttgtcggcagcatgcacacccccaaccatcaggccgctccccatcgcggtcgtgtgaaggaagttccgacccgtgagtctcgtgaccctcctcccgttcatcgtgctcatcggggccatgttcctgatgacccggtcggccaagcgcaagcagcagcaggccgccaccatgcggaaccagatgcagcccggtagcggagtccgcaccatcggcggcatgtacgcgacggtcaaggaggtcagcgacgacacggtcctcctcgatgccggaccgggcgtggagcttctcttcgccaagaacgcgatcgcgaccgtcctgtccgacgacgagtacaaccgcatcgtccacggcatcgaacacgacctgaagtccgacgccgacatcgtccccgacgacgcctcctccctcaccgagaccgacgagcccgccgccgacgcttctgccgcctccgacgacaagcccatcgacctcggcaagaaggacgcggcggaggcggagcagcccgccgacgccgccaccgaggcgaaggcggacgaagagccgaagaagaccgacggcgactccgaggcgaagtagtcaccacccagggcgcgcggcaccgcccgcgcgccctgggacgtgttcacttcgcgcgggatcccgacatcatgcatggccgccgaccgggcccacccggcgcggagcggcccgagagggagtacgagaaggtggcagcacctaagaagggccggagcgcgagcgcccagagcaagccttggcgctcgctggccctcatcctgatcgccatcgtggcgctcaccggaggcatgttcgcctcagggcacaccaccccgcgcctcggcatcgacctggccggcggtacgagcatcaccctgcgggcggtccccgagcgcggtcaggaatccgcgatcaacaagaccaacatggacaccgcggtcgacatcatgaaccgccgtgtcaacggtctcggtgtctcggaggccgaggtccagacccagggcgatcgcaacatcatcgtcaacatccccaagggcacgaactccaaggaggcccgggaacaggtcggcaccaccgcgaagctgtacttccgcccggtgctggccaccgagccctccggtgcgcaggccccggccagcccgacgccgaacccctcctccagcgcctccggcaagcccggcgacaaggccacggacaagaccggcggcaaggacaaggcgacctccggcgccgacccgtcggcgaccgcgaccaagcagggccgcgccgtcaccgacggcctgaaggccgacgccacgccgaccaccggcgccacgggcagcgcggacccgaagaagtccccggccccgaagacctccacttccccctcggcgagcggcgccccctccggtgacgccaacgccaagctccaggcccagtacgccgccctcgactgctccaaggactcggtccgcgccacggccggcaagggcgtcaagcccaccgagccgaccgtcgcctgcggcaaggactcgcagggccagtggtccaagtacctcctcggccccgccgccgtggacggcaccgacgtcaagaaggcccaggccgtcttcaacacgcagaacgcgtcgggctggaccgtgaccatggagttcacctccaagggcgccaagaagttcgcggacgtcaccggccagctggccaagaaccagtcgccgcagaacgagttcgcgatcgtcctggacggcaacgtcgtctccaacccgtacgtctcgcaggcgctgaccggcggcaacgcggagatctcgggccgcttcacgcagtccgaggccgagggcctgtccaacatgctgtcctacggcgcgctgccgctgaccttcaaggaggacagcgtcaccaccgtcaccgccgcgctcggcggcgaccagctgcacgccggcctcatcgcgggcgccatcggcctcgccctggtcgtcatctacctgctgatcttctaccgcggcctgtcggtcatcgcgatcccctcgctgctggtctccgcgatcctcacctacgtgatcatggctctgctcggcccggccatcggcttcgcgctgaacctgcctgccgtgtgcggtgccatcgtcgcgatcggcatcacggcggactcgttcatcgtcttcttcgaacgcatccgggacgagatccgcgagggccgctcgctgcggccgtccgtggagcgcgcctggccgcgcgcccgccgcaccatcctcgtctccgacttcgtgtccttcctcgccgccgcggtgctcttcatcgtcaccgtcggcaaggtgcagggattcgccttcaccctcgggctcaccaccgtgctcgacgtggtggtcgtgttcctgttcaccaagccgctgatgacgctcctcgcccgcaggaagttcttcgcgaacggccacaagtggtccggcctcgaccccaaggccctgggtgccaaggctccgctgcgccgcacccgccgccccagccgtcccgccggccccgtcgacccgaaggaggcgtgagatgtcgaagatcggcagcatcggcgcccgactccaccgcggcgaggtcggctacgacttcgtcaagaaccgcaagatctggtacggcatctccatcctgatcaccatcacggccatcctcggcctggcggtgcgcggcctgaacatgggcatcgagttccagggtggagcggtcttcaccacgccgaagcacatgagcgcctcggtcagccagaccgagacgttcgcacaggacgcctccggccacgacgcgatcgtgcagaagctcggcgacggcagcctgcgcatccagatcgccggcatcgacaccggcaagtccgaccagatcaaggacgcgctctccaaggacctgaaggtcaacgccgagcagatcaacgccgacctggtcggccccagctggggtgagcagatcgccaacaaggcctgggagggcctggcgatcttcatggtcctcgtcgtgatctacctggccatcgccttcgaatggcgcatggcggtggccgcgctggtcgccctgatccacgacatcacgatcaccaccggcatctacgccctcgtcggtttcgaggtcacgcccggcacggtgatcggtctgctgacgatcctcggttactcgctctacgacacggtcgtcgtcttcgacagcctcaaggagcagacgaaggacatcaccaagcagaaccgctggacctacagcgacctcgccaaccgctccatcaacggcacgctgatgcgctccatcaacaccaccgtggtggcgctgctgccggttgcgggcctgctgttcatcggtggcggcgcgctcggcgcgggcatgctcaacgacatctcgctctcgctcttcgtcggtctggccgccggtgcgtactcctcgatcttcatcgccacgccgctcgtcgccgacctcaaggagcgcgagccgcagatgaaggccctcaagaagcgcgtactggccaagcgggcgcaggcgggcggcgaggacgagccggtcacggccgagcccgacgccacgtccttcgacgacgatcccgaggacgccgcacccgcggtggtcggcccgcgcaaccagcccgcctcccgcggccgcggccgcggcag

SEQ ID NO: 441 - DNA, 9616 bp, Unknown
  Kingdom: Bacteria, Phylum: Actinobacteria, Class: Actinobacteria, Order: Streptomycetales, Family: Streptomycetaceae, Genus: Streptomyces
tgtcctccacgccgcgaggcgggcgcctcgcggcgtggaggacagcaggacgctgaagtggcgcacggaagcgtcgagttgatcgcggggcgcggcgatttcctgattcacgtcactcagcgtggccactccgccttaccgtgggaagtgatcgacccgttgcgtagggtgactgtccggctcttgtccagtgctgtccgcactgtcgccgacgttcccacgggtgagagagcggcaccaggagggacgcggatgtcagtggacgatgtggtcgaggagacggacgagccgggctgggaggtggacccggacgacgactgggcactggccgtggtggccacggtgggacggcagttgaggctccgccgggaagcggcgggcctgcgcgcgggcgagttcgcggaggccgtcgggtacagcgaggacctcgtctacaagatcgagtccggcaaacggatcccccgccccgagtacctcgacatggcggacaaggtcctgaacgcgggtggcctcatctcggcgatgaaggaggacgtgaagaaggtccggtacccgaagaaggtgcgggatcttgctcagatggaggcgcgggcggttgaacttcagctctacgacccactgcacgtccacgggttgctgcagacccccgagtacgcgcgcgctctcctgtcgatgcggcggcccgcgtactcgctggaagaggtggagcggttcatcacagcacgtgtagcgcggacagcgatcttcgaacgggacccggcgcctgaactcagcttcgtcttggaggagtggacacttcggcgtccgctgggaggcaagaccgtcctgcgcgcccagctcgggcacttgcttgaggtaggtcagctgcgaagcgtcgagatccaggtgctgccgttggatctcgaagggcatgccggagtggatggcgggatcgaggtcctgaagttccaggacggttcagcaatcgggcgctctcaagtagtggccagcggccgcccggtctccgaccccaggcagcttcgtattcttgagctgcgctatggcatcatccgagcgcaggccctcacgcctcgtgagtcgatggccttcatcgagcaactgctgggggagacatgaccgccaccaccacgtccctggacggctcgggcctggcgtggttcaagagcagctacagcagcggcgccgaaggcgactcctgcgtggaagtcgcgctggactggttcaagagcagctacagcagtggccccgaaggcgactcctgcgtggaagtcgccaccgaccccaccaccatccacgtccgcgactcgaagcacaccggcggtggcccgcggctggccttcgggccgtccgcctgggcggacttcgtcccgtacgcgtccggagtgtgacggcgtgaggctcgtccagcggagctggcgagcctcacgctcccgatgtccgcgccgcctcagaacttcaggctgccgatcatccccgccacgttcttggtcagttcgctgatcgtcggggcgaccgtcgaggaggccaggtagaagccgaggaggacgcacacgaccgcgtgacctcccttcagccctgacttcttgatcagcaagaagacgatgatcgccagcagcaccaccgccgaaatcgagagtgccacggcggctcacctccaaagatcccaggacgcggggggtgtcggggggtcggactatgggggctagataaatccacacaacgagcagcaggttcatacccactatgcgctaacgatcataactatccgcacgcgcgcatcgctcggcgcacggccgcacaagggggcgcatggccaatatggtctgggtatgacgaccgagcctgtctccttcccccggcagcacgcacgcacccagcgcttcacgctcggcgcgccgcgtgccttcaccgtcgctcccgacgcctcccgcgtcgtgttcctgcgctccgactccggtaccgaccgggccagttcactgcgggtgctcgacctggccgagcgcaaggagcgcgtggccgcggacccgcgcgccctcctcggcggcgccctggagaacctctcacccgaggagcgcgcgcgccgcgagcgcacccgggagggcggcgcgggagtcgtgggctatgccaccgacgccgccgtggagttggcgtctttcgccttgtcagggcggctgttcacggccgagctgcgggcagggacagcacgtgaactggccgtaccggggccggtgatcgacccgcgtccctcccccgacgggcggcacatcgcctacgtcgcggccggcgccctgcgtgtggtcggcgccgagggcgacggcgaccgggcgctcgccgaacccgagtccgagtcggtgacctacgggctcgcggagttcatcgcggccgaggagatgcaccgcttccggggcttctggtgggcgccggagtcggaccggctgctcgtggcgcgtgcggacgacgcgccggtgcggcagtggtggatctccgatcctgcgcggcccgagcaggaaccccgccaggtgcgttacccggcggcggggacgcccaacgccgacgtacggttgttcgtgatcggcctggacgggacgcgcaccgaggtcacctgggaccgggcccgctacccgtaccttgcgagtgtgcactggtcagcggcgggtgcgccgctgctcctggtgcaggcgcgcgaccagcgcagccagctgtacctggccgtggacccggaggccgggacgacccgcatggtgcacgcggacgaagatcgaagttggcttgatcttttccccggtacgccctgctggagcccctccggacagctcgtgcgcatcgtggacgaagggggcgcacgggtcctggcggtcggcgaacgcccgctcaccggggcccagttgcacctgcgcgcggtgctcgacgtcggcgacagcgacgtgctggtctccgcctccgcgggcgaggaggccgccgaggcggaggtcggcgagacgcacgtctaccgggtcaacgagctgggcgtggagcgggtcagccaggagcccggcgtgcacacggccgtgcgctccggtgacgtcaccgtgctggtgtcggcgacgctggagcggcccgggtcgcgggtgcgggtgctgcgcgacggcgagcaggtggcggagatcgcctcgtacgccgaaatgcccggcatcgtcccgcgcgtgaccctcaccgaggggggcgcacgccgaattccgtgcgccgtgcttatgcctacggactacccccgtgacacagccacggccgcccccctcccggtcctcctcgacccctacggcggcccgcacggcgcccgtgtgatggccgcgcacaacgcgtacctcacctcccagtggttcgccgaccagggcttcgcggtggtcgtcgccgacggccgcggcacgcccggccgctcccccgcctgggagaaggcgatccaccaggacttcacggtcaccctcgacgaccagatcgaggcgctccaggacctcgccaagacccacccgctcgacctcggccgggtggcgatccgcggctggtcctacggcggctacctctccgccctcgccgtgctgcgccgaccggacgtcttccacgcgggcatcgccggcgcaccggtcaccgactggcgtctctacgacacccactacaccgagcggtacctgggcgacccggccgcggacccgcagccgtacgagcactcctcgctcgtcaccggcgacggcggcctgtccgcgcccgccgcaccgcaccgcccgctgatgatcgtgcacggtctcgccgacgacaacgtggtggtcgcgcacgcgctgcggctctcctcggcactgctcgccaccggccggccgcacgaggtgcttccgctgtccggggtcacccacatgaccccgcaggagcaggtcgccgagaacctgctgctgctccaggtggacttcctcaagcggtccctcggcctcggcggctgactggacacggcgacgggccggacgcgcccacccccagggggaagagcgcgcccggcccgtcaacggcacccgcacggccgtacggtcacagcctgccgcccgcgcgtctcggcgccgtttccccgaggtttcccgcgtgtcaacgcaccgactgccgctccgcggcgaagtggcacgccgagtcgtgggcggccggcccgcccgcacggcggaactcctcggggaccgcgagcagcggcacctcccgcgcgcagcgctcgcgcgccttgaagcagcgggtgcggaagcggcagccggaggggatgtccgccggtgagggcacgtcgccggtgaggatgatccgctcgcggcgctcgcgggccgccgggtccggcaccgggaccgccgacagcagcgcctgggtgtaggggtgcgtcgcgtggtcgtagatctgctcgtccgtgccggtctccacgatgcgtcccaggtacatgaccccgacccggtcggagatgtgccgcacgatggacaggtcgtgcgcgatgaagacgtaggagaggtcgaactccgcctgcagccgctccatcaggttgatcacctgcgcctgcacggagacgtccagcgccgagaccggctcgtcggcgacgatgatctccgggcgcagcgccaggccgcgggcgatgccgatgcgctggcgctgaccgccggagaactggtgggggtagcggttgacgtactccgggttcagcccgacgacgtccagcagctcctggaccttcctgcgccggtcgcccttcggggccacctccgggtggatctcgtacggttcgccgatgatgtcgcccaccgtcatgcgcgggttgagcgaggtgtacgggtcctggaacaccatctggatgttgcggcggaccgccttcagcgcgcgcccggagagtttcgtgacgtcctcgccgcggtagcggatctgtccggccgtgggccgctccagatggcacagcagcttggcgaccgtggacttgccgcagccggactcgccgacgatacccagcgtctcgccccggccgaggacgaagtcgacgccgtcgacggccttgaccgcgccgatctgcttgcggaacaggacgccctgggtgagcgggtagtgcttgacgagaccggtgacctccagcagcggctcagccatccaggcactccctccagaagtggcaggcggacccgcgctgttcgtccacctcgtagagcggcggtacgtccgtgcggcacacgtccctggccatcgggcagcgcgggtggaaggcgcagccggaggggatgcgtgtgaggttgggcggcaggcccttgatggcgtacagctcgcggcccttctggtccaggcgcgggatggagtcgagcaggccgcgtgtgtaggggtgcgcgggtgccttgtagagggcgtggacgggggcggtctccacgatgcggcccgcgtacatcaccgcgatcttgtcggcgacgtcggcgaccacgcccaggtcgtgggtgatgaggacgaggcccatgtcgaactcgcgctgcaactcggcgagcaagtccatgacctgcgcctggaccgtcacgtcgagcgccgtggtcggctcgtccgcgatgatcaggtccggctccagggccagcgccatggcgatcatgatgcgctggcgcataccgcccgagaactggtgcgggtagtcgcgcacgcgctgggcggcggccgggatgcgcacccggtccatcagctcgaccgccttggcccgcgcgtccttgcgggacatgccccggtgcacggtgaacatctcgccgagctggtcgcccacggtgagcaccgggttgagggcggacagcgcgtcctggaagatcatcgcgatcccggcgcccctgaccctgcgccgctgctccttgggcagcttcagcaggtcgcggccctggaagaggacctcgccgccggtgatgcggccgggcggcatgtcgaggatgcccatgacggcctgcgcggtgacggacttgcccgagccggactcgccgagcaccgcgagggtctcgcccgcgtccacctggtaggtgacgccgttgacggcgtgggcgacgccgtcgcgggtgcggaactccacgtgcagatcgcggacttcgagcagcatcgcgccgtcacctcagcttcgggtcgagggcgtcgcggaccgcgtcgccgagcatgatgaaggccaggacggtgatcgccagggcgccggcgggccacagcagcgcgtgcggggcgttgcggacgtagggcgaggcggcggagatctcgatgccccaggacacgctcggcggtttcagtccgacgccgaggtaggacagggtcgcctccagggcgatgtacgtgccgagcgcgatggtggcgaccacgatcacgggggcgacggcgttgggtgcgatgtggcgcagcaggatgcgcgtgtcggaggcgcccagggcgcgggcggcctggacgtagtcgtgctgtttggcggtgatgacggagccgcgggcgatgcggtagatctgcggccagccgagcagcacgatgaacccgacgacgggccagacggtgttgctggtgacgacggacagcaggaccaggccgccgaggacgacggggatggcgaagaagatgtcggtgaggcgggagaggaccgcgtcccacgcgccgccgaagtagccgccgagggcgccgaggacggagccgaggaccgcgacgccgagggtggcgcagacgccgacggtgacggaggcgcgggcgccgtgcacggtgcgcgtgtacacgtcgcagccctggccgtcgaagccgaacgggtgtcccggcgaggagccgtcctgggcgcgggccaggtcgcaggagagggggttgccgggggcgatcagggagggccggatcgcgatgacgatcaggaagcagatcaccagcgcggagagcaggaagacggggttgcggctcaggtcgcgccaggcgtccgaccacagcgagcggggccgctcccccgggcccgcaccgtccgcgccgccgtccggtcccggtgccagggtggtcgcctcgctcgccgcgaggtccatcccgccgcccatgccggtccccgcgacggcgccctcgggttcgaagggctgcggctgcggctgcgatggcggcggctgctcaggcatagcggatcctcgggtcgagtacggcgtacagcaggtccacgagcaggttggcgaccaggaagaccagcacgaggacggtgacgaagccgacgacggtctgcgtgttctggcgcaggatgccctggtagagctggtagccgacgccgtggatgttgaagatgcgctcggtgacgatggcgccgcccatcagcgccccgatgtcggtgccgatgaaggtgaccacggggatgagcgagttgcgcagcaggtgccgtacgacgacgcggcggcgcggcaggcccttggcgacggcggtgcggacgtagtcggcgcgccggttctcggcgatggaggtgcgggtcagccgggtgacgtaggcgagggagacggaggccaggaccaggccgggcaggatcagctcgtcgaaggaggcctccggcgggacggacggcctgatccagccccatttgacgccgagcagcagctgcaggagcaggcctgtgacgaaggtgggcacggagatgacgacgagggtgagcagcaggacgccggtgtcgacgggccggccgcgccgcagtccggtcaccacgcccagggtgatgccgatgacgatctcgaagacgatcgcgacgatggtgagccggatggtcaccgggaaggcggcgcccatcagttcggtgacgggctggccgttgaaagcggtgccgaagtcgccggtgaagacgttgcccatgtaggtcgcgtactgctgccacaccggcttgtcgaggccgaactcccgcttgagctgggcggccgtggccgtgtcgcaggcgcgttcgccgcacaggcccgcgatggggtcgcccatgacgttgaccatgaggaagatgagcagggtggccccgatgaagacggggatcatctggagcaggcgtctgacgacgtagcgtcccatggcgggtcagccgaccttgatctcgttgtagacgggcacgctgaacgggttgagggccacgttgtgcagccggtcggagtagccggcgctgccgttctggtaccagagcgggatggcggccatgttgtcgcgcaggacgccctcggcctgctggaagagccggacggccgcggccttgtcgctctcggcgttggcccggtcgacgaggtggtcgaactccttgtcggaccacttgccgtcgttggaggaggcgtcggtgtagtacagcggctggaggaagttctggatgagcgggtagtccatctgccagccggcccggaaggggccccgcatgcggtgctgggtgatctggttgcggaagtcggcgaaggtgccgaccgggttgccgacgcacgcccggtcgtcgccgagcgcgttgttgatggagttgcacacggcgtccacccactccttgtgcgagcccgtgtccgcgttgtaggtgatgcgcacctgcccgccgggcagcccgccgccctccttgaccagccgcttcgcctcggcggggtggtactcgcaggccttgccgcacagtccggccttgaagccgccgtccgtgccgagcaccggtgaggtccagtcggtggcgggggtgcgggtgccgcggaagagggtcttggtgatctgcgcccggtcgatggccatggacaggccggtgcggaccttgcgcgcgccgtcggtgttccaggccttgtcgtagaacgggaaggcgatggtctggatgatgccggccggggtgttgatgtagcggccgtccaggtccttggtgacgttcttgagctggctggcggggatgtcgtcgaccagatcgaggttgccggccaggacgtcggtgtaggcggtgttgttgtcggtgtagacgagcagggtcacgccctcgttgagcgccttgtccggccccggatagcggtcccgcttcttcaggtacatctgcgcgcccttggtgtaggactcgatggtgtacgggccgttgccgacgggccggtcgagccaggccttgtggtgggtgaagaaggtccggggcagcggggcgaaggcggcgtagccgagggtgtcggggaaggtggagaacttctggtcgagccggacggtgaaggtgcgcggtccggtgaccttcaggccgctcagcgtgtcggcgctctgcgtgccgctctccggatggaccttgtcgtagccgtcgatgtacccgaagaagtacgcgttcttctggttgttcttcaggctcgcgccgtagttccaggcgtcgacgaaggacttcgctgtgacgggttcgccgttgctgaatgtccagccgggcttgacggtgatcgtgtagttctgcgagtcggtggtctcgatccgctcggcgagcatgttctcggccttgccggtgcgcgggtcgtaccgcttcagtccgcggaagaccatgtcgagcaccttgccgccctgcacctcgttggtgttggcgggctccagcgggttctgcgggtcgccccaggaggagctgagcactccggccccggcgcccgtcgtgctgccgcaccccgcggccagcggcagtgcggccgccgcc

SEQ ID NO: 442 - DNA, 6022 bp, Unknown
  Kingdom: Bacteria, Phylum: Actinobacteria, Class: Actinobacteria, Order: Streptomycetales, Family: Streptomycetaceae, Genus: Streptomyces
gcgagctgccctgggcgccgtcggcgagggtgatccggtcggcgtcggcggggtcgatgtcggccacgtccacgctgccgtcggcgagcgcggcggcccgtttgtcgcgcgccacctcgtgcagcacgatctcgttcagcttggccgggtggccccaccagcgcgggttgcgggcgaggacgacgtccttctccttggtgtcgatcctctgcacggtgaacggtccggcgctgaccttgagcttcttgcgcgccccgtcgttgaagtcgttggcggtgccggtgacgtccttggggtagagcggggagaacagcgacttccagtccgcgtaggggcgggcgaaggtgacgcggacctccaggttgctggcgccgcgctcgaccttctcgatgcggtcgtagccggcgttgcgcgcggtccagtacgcggagtccttgccggacagggcgcgccactgggcggcgaagtcggcggcgccgatctcgcggccgtcgctccagacggcctgctggttgagccggtagacgacgacctgcttgggctcggtgtcgaccacccgggcggagtcgaggtagtcggcgtcgcgctgcggacggccgttcgcgtcgaggcggaacatggcgggcaggacggcctgggcgatccgggtggtgccggcgtcggcgtccgcctggaaggtgttgagcgtctccggcatcgcgtccacggcccagcgcagggtgcctccgtcggcgacctgggcacgggcggcgggtgcgatgtcctgtccggccaggggcttgctgccctcgtcgtcggagccgcagccggccagcaggggcaccgtgagggcgcccgcggtcaggaaggcgaccgagcgcatgaccgcgcggggcccgacaccgtcgtacgacatctgtgctacctccggggagccgcttcccgccggtgggcacgggtggcggcacaggtggggacgcgggcgggacatatgtggggctatctcgagctgcgtactacttgttcacatttggcggtattttggagctgatcagatctatggccccactgaagaggaaagggttcgtctgccgggggcgacacggcggcgggcgcccggaaggtcacccgtgcggagcaatgcgccccggcgcacacagagcgcgtgcgagcgcgcgcgtgggatgcgcgatccgccgatcgctgcacatcccttcccaccggcaggtgtgacgcgcgacactctcaggcgcatgaacgtcgccgtccagggccgcacggcccgtggaagtgaggtcacgtcatgtccgtgcacgacgacctgacgtccgtacagcacaccctcgacgaactgctgaggtcggtggcccggctggaacaccagctaggcggcgcactggagatacgccgggtgcgcaccgacgccgatcacctgcgcgagagcgtcgccctgctgcgcgaggccacccggagcccggccgccaccacgcagagcccagcggccgcaccccagcgccccgccctcgtcaccatctccgacacgccctacgacatctccctgtggacggactcggacgacgagggactcggcgcccgcgaccgccacgccccctgacccgaccggagtccttacgtggccactggtacggaaccccccggcacagccccccgtcccccgcgcggcggtgtccggtccccggcccgcgccgccatcgccgccgggaacctgcggaccgaccgctggtggctcgcaccggccgtcaccgccgccggcctgctcgccttcgtcgtgtactcgacctggcgggccttcgcgaacgccgactactacgcggccccgtacgtctcgccgttctactcgccctgcctggcgcagaactgcaggaccatgcacatgggccccaacgccgacgtcttcggcagctggtgggcgatctccccggcgatcatcatcctgatcttcccgctgggcttccgcctgacctgctactactaccgcaaggcgtactaccgcagcttctgggcctccccgccggcctgcgcggtcgccgaaccgcacggcaggtacaccggcgagacccgcttcccgctgatcctgcagaacatccaccggtacttcttctacgccgccctgctcgtcgccggggtgctgacctacgacacggtgctgtccttccgcgaccagcactaccactggggccacatgggtctgggcaccctggtgttcctcgtcaacatcgtgctgatctggacgtacaccctctcctgccactcctgccggcacatcgtcggcggcaagctcagacacttctcgaagcatccggtgcgctaccggatgtggcagttcgtgggacgcctgaacgcccggcacatgcaactggcctgggcctccctggtgagcgtggcactcgccgacttctacgtgtacctggtggcgtccggggtgttcgacgatccgcggttcttctgacgtgcggggagtccgccgggtccatcgggttcgtccggcggtcggcgagtccgttccagtgatctacgagttcgtccagtgatctacgagtgagggctgatgtccgtggtcgaccggcaggagtgggacgtcgtcgtggtcggcgccgggggcgccggactgcgcgccgccatcgaggcgcgcgagcgcggggcgcgcacggcggtgatctgcaagtcgctgttcggcaaggcgcacaccgtgatggccgagggcggcatcgcggcggccatgggcaacgccaatccgcacgacaactggcaggtccacttccgcgacaccctgcgcggcgggaagttcctcaaccagtggcggatggccgagctgcacgccaaggaggcgcccgagcgggtctgggagctggagacctggggcgcgctgttcgaccgtacgaaggaagggaagatctcgcagcgcaacttcggcggccacgagtacccgcgcctcgcccacgtcggcgaccgcaccggcctggaactgatccgcaccctccagcagaagatcgtctcgctccagcaggaggaccaccgcgagaccggggactacgagtcgcggctgaaggtcttccaggagtgcacggtgacgcgcgtcctcaaggacggcgaccgcgtctgcggtgtcttcgcctacgaccgcgagaccggccgtttcttcgtgctccaggcacccgcggtcgtcctcgccaccggcggcatcggcaagtcgttcaaggtgacctcgaactcgtgggagtacaccggcgacgggcacgcgctggcgctcctggccggggcgccgctgctgaacatggagttcgtgcagttccacccgaccggcatggtctggccgccgtcggtgaagggcatcctcgtcaccgagtcggtgcgcggcgacggcggggtgctgcgcaactccgagggcaagcggttcatgttcgactacgtccccgacgtcttcaagggcagctacgccgtggacgaggcggaggccgaccgctggtacgaggaccccgacaacaaccggcgcccgcccgacctgctcccccgcgacgaggtcgcccgcgccatcaacgccgaggtcaaagcgggccgcggctccccgcacggcggcgtctacctcgacgtctccacgcggatgcccgccgaggtcgtccggcgccggctgccgtcgatgtaccaccagttcaaggagctggccgacgtcgacatcaccgcggagccgatggaggtcgggccgacctgccactacgtgatgggcggcatcgccgtcgactccgacacggcggcggcacgcggagtcgcgggcctgtacgcggccggggaggtggccggcggcatgcacggctccaaccggctcggcggcaactccctctccgacctgctggtcttcggccgccgggcgggccggcacgcggccgagctcggcacgcctctcgcgtacgcccggccgcccgtccacgactcccaggtcgacgcggcggcggcggaggcgctgcggccgttctcggcggagagcggcccggcggggcggcccggagagggtggggaggcggacggggaggccggttcggcagaggtgcaggcaggcccgccggagaacccgtacaccctccaccaggaactccagcagaccatgaacgacctggtcggcatcatccgccgccagggcgagatggagcaggcactggagaagctcgccgagctgcggggccgagtgcgccgggccggggtcgaggggcaccggcagttcaaccccggctggcacctggccctggacctgcggaacatgctgctggtcagcgagtgcgtggcgcgggccgcgctggagcgcaccgagtcgcgcggcggccacacccgtgaggaccatccgcggatggagcgggagtggcgccggatcaacctgctgtgccggctggccgacccggcagggggcctcgcggcagccgaccccgcggggagtctcgcggggaccgatccggcccgcggccagatcgtcctcacccgtgagaccaccgcccccgtccgccccgacctgctcgccctcttcccgaaggaggagctgggcaagtacctcgccgaagaggagctgtacgaatgagcggctaccaggcccgcttcaaggtgtggcggggcgacgcgcagggcggcggcctgaaggacttcgaggtcgaggtcaatgacggcgaggtggtgctcgacatcatccaccgcatccaggccacccaggcacccgacctcgccgtgcgctggaactgcaaggcgggcaagtgcggttcctgctcggcggagatcaacgggcgcccgcgtctgatgtgcatgacccgcatgtcggtgttcacccgcgaggagaccatcaccgtcactccgatgcgtgccttcccggtcgtccgcgacctggtcacggacgtcggcttcaactacgccaaggcccgcgagatccccgccttcgtgccgccggccggtctggggcccggcgagtaccgcatgatgcaggaggacgtggaccgcccgcaggagttccgcaagtgcatcgagtgcttcctgtgccaggacgtgtgccacgtcgtacgcgaccacgaggacaacaagccggcgtacgccggtccgcgcttcctgatgcggatcgccgagctggacatgcacccgctggacgcggcggaggaggcgggcgtggaccgcgcccgcacggcccaggacgaccacggcctcggctactgcaacatcacgaagtgctgcacggaggtctgcccggagggcatccacatcaccgacaacgccctgatccccttgaaggaacgcgcggtggaccgcaagtacgacccgctggtgtggctgggctcgaagatcaggcgccgctcgccgtgagggtggcgacggcctggggggatcacgcccagccgttccggtacgccgtccagtccgcctccgtcgcggcgaagtcgacgtacagcgcgacgccgaagcgcacccggtcggcgtccgtgtgggacaggccgaggcggacgccccggacggcggcgggcacggtctcggcgtgcgcccagtggccgaaccggttctcgtggtagaagggcaggcccatcagcaggtcggtggtggacggggtgacctccagggcgagggaggtctgctgggcgacgtagccgccgtacaggctctgcagcggctgcatggtgtcgtacgacatcacggcgatctggtcgacgcggcgcgccacctcgccgaagtacgcctgcgaccaccacttggggtggttggtgagggtgccccagagggagtggaaggcgggcagcgggtcgatctggtgtgcggcgacggacagggccgcgccgtgcgcgcgggtgacggcgcgcaggtcgtcgaggaggccgaggtagttccggtcgccggagtgcagcggctccaggtcgaagtgggcgccctcgaaaccggcggccaggacggcgcgggtggacgcgacgacggcggtgcgcgtcgccgcccgctccagccgcagcccgtcggggctctcggtggccagcacgtcccccagccaggcctgcacccgcaccccggg

SEQ ID NO: 443 - DNA, 1674 bp, Unknown
  Kingdom: Bacteria, Phylum: Actinobacteria, Class: Actinobacteria, Order: Streptomycetales, Family: Streptomycetaceae, Genus: Streptomyces
  misc_feature (467)..(540): n is a, c, g, or t
cgcagcgccagcgcgccgcccgacgagatgccgtagagggccgcgtcgccgcccacggcgtcgatcacggccgcgaggtcctccacctcgcgctccaccgcgtacggcgccgtgtcaccgctctcgccgcggccccgccggtcgtacacgaccgcgccgaaccgctgcgacagcgccgccgcgagcggcgcgaccgtggcacccgtcgacatcgccccgctgaccaggacgaccaccgggcccgtgccggtgcgctggtaggcgatcggggtgccgtcgcgcgagagcgtcttcttgtccatggcttcgaagactgccacaagaccgtcgcgtcggcggctcagcgggctacagcacctcggcgtcgtagaagcacagatggtccttgatctgtgcgacctcgggcttcggatccgggtaggcccacaccaggtcggccgcgcccggcacggaccagtaggacgccnnnnnnnnnnnnnnnnnnnnnnnnnnnnnnnnnnnnnnnnnnnnnnnnnnnnnnnnnnnnnnnnnnnnnnnnnnggaggcctcttcccgcgcgcgggaagaggcctccggccgcgtaccgtggggcgcatgaacatctgcgtcttcctctccgccgccgacctcgacgaccgctacacacgtcccgcgcgggacttcgcccggctgctcggcaagggcggccacagcctggtgtggggcggctccgacagcgggctgatgaaggtcgtcgcggacggcgtgcaggaggcgggcgggcggctgatcggcgtgtcggtcgacttcctggcggccaaggcccggcccggcgccgacgagatggtgatcgcgggcgacctggccgagcgcaagcggctgctcctggagaaggccgacgccgtggtgatcatggtgggcggcaccggcaccctcgacgaggccaccgagatcctggagctgaagaagcacggccggaccgacaagccggtggtgctgctcaacacggcgggcttctacgacggcctgcgcgagcagttccgccggatggaggaggagggcttcctgccccggccgctggccgagctggtgttcttcgccgaggagcccgcggcggccctggcctacctggaggagtcgctgagcagccgttgacgtgcgggtgcgagcatggcgggcatggctacacatgtgatcaccggggccggttccggcatcggcgcggccgtcgcccgccgcctgcacgcgcgcggggacgacctcgtgctgcacgcgcgcgacgcgggccgggccaaggaactggccgccgagttccccggcgcccgcaccctggtcggcgacctggccgacccggaccggctcagctgggcgttctcgcaccagacgctgcccgaccgggtcgactccctgctgcacatcgcgggcgtggtcgacctgggtccgatcggcgagctgacgcccaaggcctggcaccaccagctcgacgtcaacctggtcgcccccgccgagctgacccgccacttcctgccccagctgcgcgccgcgcgcggccacgtggtgttcgtcaactcgggcgcgggcctgagcgcgcacgccgcctggggggcgtacgccgcctccaagcacggcctcaaggcgctcgcggacgccctgcgcgaggaggagcacgccggcggcgtccgcgtcacctccgtc

SEQ ID NO: 444 - DNA, 1329 bp, Unknown
  Kingdom: Bacteria, Phylum: Actinobacteria, Class: Actinobacteria, Order: Streptomycetales, Family: Streptomycetaceae, Genus: Streptomyces
gaaccgctcggcgaaggcgtcgtagacgtccgtgtgcacgatgaaccgcttggccgcgatgcaggactgcccgttgttctgcacccgcgcggtcaccgcgacctccgcggcccggtcgatgtcggccgacggcatcacgacgaacgggtcgctgccgcccagctccagcaccgtcttcttgatcatctccccggcggtggacgccaccgcccgcccggccggttcgctgccggtcagggtcgccgccttcacccgctcgtcgcgcaggacgtcgtcgaccgcgccggagccgatcagcagcgtctggaagcagccctcggtgaagcccgcacggtggaacaggtcctccaggtacagggcggtctgcggcacgttcgaggcgtgcttgagcaggccgacgttcccggccatcagcgcgggcgccgcgaaccgtacgacctgccagagcgggaagttccacggcatcaccgcgagcaccggacccagcggccggtagcgcaccagggcgcgcgaggcgccggagtccttcacgtcggcggcggccggctcctcgtcggcgagcagttcctcggcgtgctcggcgtaccagcgcatcgccttggcgcacttggcggcctccgcgcgcgcctgcttgaccggcttgcccatctcggtggtcatcacgcggccgatgtcctgctggtccgcctccagcagctcggcggcccggttcatcaggcgggcccgctcggcgaaggacgtcgtccggtacgtgcggaaggtggcctcggcgagctggaggcggcgctcgatctcctgctcgtccatggcctcgtacgtcttgatcgtctcgccggtggccgggttcaccgtggcgatggacatggctgacctccctcgggagcgggctgtgcttcgaccttcgcgcggcgcgccgcccgccgcaacgcgtgcggccctcgtcagcgcgagtgctcagccagtcggtcgagaaacgcactctgggcggtgacgatcacctcgcgggcgcggtcgagtccgagccacgccacccggtccagctcggggaattcctgggtccgccccgaccgcggcggccactccatcgtgaacgtgcccgggacgacctccgccgggtcgaggtcgccctccaccgcccacacggtcacggtctttccgcccgcctggcggacctcgccgagcggtaccgcctcgccgtcgggcggcgccacgcccagctcctcgcggaactcgcgccgggcggcgctcagggcgggttcgtccggcgcgtactcgcccttgggcacggtccaggcgcccgcctcgcgccgggaccagaacgggccgccc

SEQ ID NO: 445 - DNA, 8559 bp, Unknown
  Kingdom: Bacteria, Phylum: Actinobacteria, Class: Actinobacteria, Order: Streptomycetales, Family: Streptomycetaceae, Genus: Streptomyces
acggggaagcattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgagtctccaccgcatggtgggggctgtaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaaggagcacttctaagccgggcttgcctggttcagaggccagtacatcagcgaatgtctgatgctggttgctcatgggtggaacgttgactactcggcacacttcggatggatgagagcgctagtactgcttcggcgtggaacgcggatcttgtcagcgaggagtgtcgggcacgctgttgggtgtctgagggtgcgagcgttgctcggccttcgggatgccggccccagtgcactcgggatgttgtcccggggtgatgggtggttggtcgttgtttgagaactgcacagtggacgcgagcatctgtggccaagtttttaagggcgcacggtggatgccttggcaccaggaaccgatgaaggacgtgggaggccgcgatagtccccggggagtcgtcaaccaggctttgatccgggggtttccgaatggggaaacccggcagtcgtcatgggctgtcacccgctgctgaacacataggcagtgtggagggaacgaggggaagtgaaacatctcagtaccctcaggaagagaaaacaaccgtgattccgggagtagtggcgagcgaaaccggatgaggccaaaccgtatgcgtgtgagacccggcaggggttgcgtatgcggggttgtgggatctctcttctgtcgtctgccggcggcaggacgagtcagaaaccgttgatgtaggcgaaggacatgcgaaaggtccggcgtagagggtaagacccccgtagtcgaaacatcagcggctcgtttgagagacacccaagtagcacggggcccgagaaatcccgtgtgaatctggcgggaccacccgctaagcctaaatattccctggtgaccgatagcggatagtaccgtgagggaatggtgaaaagtaccccgggaggggagtgaaatagtacctgaaaccgtgtgcctacaagccgtgggagcgtcggaatgtgcttgcacattctcgtgactgcgtgccttttgaagaatgagcctgcgagtttgcggtgtgttgcgaggttaacccgggtggggtagccgtagcgaaagcgagtccgaatagggcgtttcagtagcacgctcaagacccgaagcggagtgatctagccatgggcaggttgaagcggaggtaagacttcgtggaggaccgaacccaccagggttgaaaacctgggggatgacctgtggttaggggtgaaaggccaatcaaactccgtgatagctggttctccccgaaatgcatttaggtgcagcgtcgtgtgtttcttgccggaggtagagcactggataggcgatgggccctaccgggttactgaccttagccaaactccgaatgccggtaagtgagagcgcggcagtgagactgtgggggataagctccatggtcgagagggaaacagcccagagcatcgactaaggcccctaagcgtacgctaagtgggaaaggatgtggagtcgcagagacaaccaggaggttggcttagaagcagccacccttgaaagagtgcgtaatagctcactggtctagtgattccgcgccgacaatgtagcggggctcaagcgtaccgccgaagtcgtgtcattgcagcaatacgcccaacggcggctgtgatgggtaggggagcgtcgtctgccgggtgaagcagcaccggaaggtagttgtggacggttgacgagtgagaatgcaggcatgagtagcgattcacacgtgagaaacgtgtgcgccgattgactaagggttcctgggtcaagctgatctgcccagggtaagtcgggacctaaggcgaggccgacaggcgtagtcgatggataaccggttgatattccggtacccgctgtgaagcgtcaaacatcgagcatcgtgatgctaaggccgtgaagccgccctgatctcttcggagttgaggggagtggtggagccgccggcccaagcggttagtaggtgagtgatggggtgacgcaggaaggtagtccatcccgggcggtggttgtcccggggtaagggtgtaggacggtgtgtaggcaaatccgcacaccttgtgtctgagacctgatgccgagccgattgtggtgaagtggatgatcctatgctgtcgagaaaagcctctagcgagtttcatggcggcccgtaccctaaaccgactcaggtggtcaggtagagaataccgaggcgttcgggtgaactatggttaaggaactcggcaaaatgcccccgtaacttcgggagaaggggggccacacctggtgatcggatttactccgtgagctgggggtggccgcagagaccagcgagaagcgactgtttactaaaaacacaggtccgtgcgaagccgtaaggcgatgtatacggactgacgcctgcccggtgctggaacgttaaggggaccggttagctccatttcggtggggcgaagctgagaacttaagcgccagtaaacggcggtggtaactataaccatcctaaggtagcgaaattccttgtcgggtaagttccgacctgcacgaatggcgtaacgacttctcgactgtctcaaccataggcccggtgaaattgcactacgagtaaagatgctcgtttcgcgcagcaggacggaaagaccccgggacctttactacagtttgatattggtgttcggttcggcttgtgtaggatagctgggagactttgaagcatgcacgccagtgtgtgtggagtcgtcgttgaaataccagtctggtcgtgctggatgtctaacctgggtccgtgatccggatcagggacagtgtctgatgggtagtttaactggggcggttgcctcctaaagggtaacggaggcgcccaaaggttccctcagcctggttggcaatcaggtgttgagtgtaagtgcacaagggagcttgactgtgagaccgacgggtcgagcagggacgaaagtcgggactagtgatccggcggtggcttgtggaagcgccgtcgctcaacggataaaaggtaccccggggataacaggctgatcttccccaagagtccatatcgacgggatggtttggcacctcgatgtcggctcgtcgcatcctggggctggagtcggtcccaagggttgggctgttcgcccattaaagcggtacgcgagctgggtttagaacgtcgtgagacagttcggtccctatccgctgtgcgcgtaggagtcttgagaagggctgtccctagtacgagaggaccgggacggacgaacctctggtgtgccagttgttctgccaagggcatggctggttggctacgttcgggagggataaccgctgaaagcatctaagcgggaagcctgcttcgagatgaggactcccacccacttgatggggtaaggctcccagtagacgactgggttgataggccagatatggaagcactgtaaagtgtggagttgactggtactaataggccgagggcttgtcctcagttgctcgcgtccactgtgttggttctgaaaccacgaacaaccccatgcctggtcacggtgtggtgcggttgacagtttcatagtgtttcggtggtcatagcgtgagggaaacgcccggttacattccgaacccggaagctaagccttacagcgccgatggtactgcaggggggaccctgtgggagagtaggacaccgccgaactacctttatagctctggctcttgggcacgcagcccaagagccagagcttttttgcgttgaggtaaggtcagatcgtaacgcaggcactttttcccaggaggcccccgggtggaggtccaggagacccgtgtccaaacggaccgggtcctcaccatcccgaacatcctcagcatggcgcgcctcgtcggcgtacccctgttcctgtggttgatcctcaggccggagttcggcggccccaagagcgatggctgggccctgctggtgctggcgctgagcggtgtcagtgactacctggacggcaaactcgcgcgccgttggaaccagatcagcaacctgggccggcttctcgacccggctgccgaccggctctacgtgctttccactctcgtcggactcacctggcgtgagatcctgccggtctggctgaccgccgctctactggcccgtgaattgatgttgttggtcgcggtggccgtcctgaggcggcacggctacccgccgccccaggtgaacttcctcgggaaggccgcgacgttcaacttgatgtacgccttcccgctgcttctgctcagtgacggaagcggatggatctcgtcactcgctgcgattttcggatgggcgttcgccggatggggtacaacgctctattggtgggcaggagtcctctacgtggtgcaagtccgccgtcttgttcgtgcggacgccatggccggctgagctcgcccattcaggaagtcgcggtggctccgatggcccgcttcggaaaagtgcgggacaatcaggacgggtgaagtcggctagatcgtcgtctcttggaggaggacgcttccgacatgaaggccgtcgtgatggccggaggcgaaggcacgcgccttcgcccgatgacctcgagcatgcccaagccgctcctgccggtggccaaccggccgatcatggagcacgttctacggctgctcaaaaagcatgggctgaatgagaccgtcgtcacagtgcagttcctggcttcgctggtcaagaactatttcggtgacggtgaagagctcggcatggagctcacctatgccaacgaggagaagccactcggtaccgccggaagcgtcaagaacgccgaggaggcgttgaaagacgatgccttcctggtcatctccggcgacgcgctgaccgacttcgacctcacggacctgatccgattccacaaggagaagggcgcgatggtgaccgtgtgtctcacgcgcgtgcccaacccgctggaattcggcatcaccatcgtggacgaggaaggcaaggtcgagcgtttcctcgagaagccgacctgggggcaggtcttctccgacaccgtgaacacgggcatttacgtgatggagcccgaggtcttcgactatgtcgaggccgacgttccggtcgactggtccggcgatgtcttcccgcagctgatgaaggaaggcaagccgatttacggctatgtcgccgagggctactgggaggacgtcggcacccacgagagctacgtgaaggcccaggccgacgtcctggaaggcaaggtagacgtcgacatcgacggcttcgagatctcgccgggcgtctgggtcgccgagggcgccgaggtgcacgccgacgcggtgctgcgcgggccgctgtacatcggcgactacgccaaggtggaggccggcgcggagatccgtgagcacaccgtcgtcggctcgaacgtcgtggtcaagagcggagccttcctgcacaaggcggtcgtacacgacaacgtgtacatcggacagcacagcaaccttcgcggctgcgtcgtcgggaagaacaccgacatcatgcgggcggcgcgcatcgaggacggcgcggtcatcggcgacgagtgcctgatcggtgaggaatcgatcgttcagggcaatgtgcgggtctacccgttcaagaccatcgaggcgggcgctttcgtcaacacctcggtgatctgggagtcgcggggccaggcgcacctgttcggcgcccgaggcgtctccggcatcctgaacgtggagatcaccccggaactcgccgtacggctcgcgggcgcgtacgcgacgacgttgaagaagggctcaacggtcaccaccgcccgtgaccactcccgcggcgcgcgtgcgctgaagcgggccgtcatctccgcgctccaggccagcgccatcgacgtacgggacctggagaacgtgccgctgccggtggcccggcagcagaccgcgcgcggcagtgccggcggcatcatgatccgtacgacgcccggggttcccgactcggtcgacatcatgttcttcgacggtcagggagcagacctgtcgcagggcagccagcgcaaactggaccgggtcttcgcgcggcaggagtaccggcgcgcgttccccggcgagatcggcgacctgtacttcccgtccagcgtcttcgactcgtacaccggttcgctcctgcgtgacgtcgacacgacggggatcgccgaggcgggcctcaaggtggtcgtggacgcctcgaacggcagcgccggtctggtgctgcccagcctgctcggcaagctcggtgtcgactcgctgacgatcaacccgggcctggacgagtcacggcccacggagaccgaggacatgcggcggtcggggctggtgcggctcggcgagatcgtggcgtcctcgggtgccgcgttcggtgtgcggttcgacccggtgggcgagcggttgtcgctcgtcgacgagaagggccgcatcatcgaggacgaccgggcgctgctggtgatgctcgacctgatcgccgccgagcggcgcagcggccgggtggcgctgcccgtcaccacgacccgtatcgccgagcaggtcgccgcgtaccacggcacccaggtggagtggacgaccacgtcccccgacgacctcacgcgggtcggcggcgaggaggggacgatcttcggcggtgacggcaagggcgggttcatcgtcccggagttcagcagcgtctacgacggtacggcggcgttcgtacggctgatcggactggtggcgcggacgcagctcacgctcagccagatcgacgcgcggatcccgcgggcgcacgtcctcaagcgggacctggcgacgccgtgggccgtcaagggcctggtgatgcgccgcgtcgtcgaggccgccggtgagcggttcgtggacacgacggacggggtgcgggtcgtggagaccgacgggcggtgggtcatggtgctgcccgacccggcggaggcggtcacccacctgtgggccgagggtcccgacgacgcctccgcgcaggccctgctcgacgagtgggcggccgtcgtggacagcgccggacggtaggacgaggaccgggtaccgggcgggccggagccggtccggtcggtagaacggacagcacgcg

SEQ ID NO: 446 - DNA, 4144 bp, Unknown
  Kingdom: Bacteria, Phylum: Actinobacteria, Class: Actinobacteria, Order: Streptomycetales, Family: Streptomycetaceae, Genus: Streptomyces
cgggacggaggcgcacgatgcgaccgtatgagctgaccctttccgacgcggcgcgcgagatccgggagcggcggctgtccccggtcgaactggtggactcggtcctggaccgcgtcgagcagtccgaaccgcacctcggcgcctacgtcgccgtccacgccgaccaggcgcgccgggcggcacgggaggccgagcgggaggttgcggccggccggctccgggggccgctgcacggcatccccatgggcctgaaggacctgatcgatgtcgccggcaccccgaccacggccagctcccgggtccgggagggccacctcgccgacaccgacagcaccgtcgccgcgcggctgcgggccgccggagcggtcctgctcggcaagacccacacccacgagttcgcctacgggctcaccaccccgcagacccgcaacgcctggcacggcgagcgggtggcgggcggctccagcggcggatcggcggtcgccgtcgcggccgggaccgcgaccttcgccctgggcacggacaccggcgggtcgatccgcgtccccgccgcgctcaacggcgtggtcggcctcaaaccgacgtacggcctcgtcccgcggcacggggtgacgtcgctgtcctggtcgctggaccacgtaggaccgctcacccgcaccgtcgaggacgcggcgctcgtcctggccgcactgaccggccacgacccacgcgacccggcctccctgcccacgcccgccgcgcccggccccggccaccggtccggcgacgccgccgacttgaccggcctgcgcgtgggcatcccgcgcacctactacttcgaccacgtcgaccccgaggtggaagccgcggtccgcacggcggcggaccggctcgccgacctcggcgcacgcctcgtcgaggtggagatccccctggccaggtacgtccaggccgtccagtggggcctcatggtgcccgaggccaccgcctaccacgaacgcactttgcggacggtccccgagcgctacgggccggacgtccgtgtgctgctcgaagccggcgaactgatgcccgccgccgaccacttgcgcgcccagcgcgcccggaccctgatgcggcgggagtgggcccgcctcttcgacggcgtcgacctgatcgccgccccggcggtaccggtgaccgcggtcgcgcgcgacgaacagaccctcacctggccggacggcacggtcgaggccgtctccgacgcgtatgtgcgcctgtcggcaccggccaacatcaccggagtgcccgcgctcgccgtgcccgtcggccacgaccgggccggactgccgatcggcatgcaactgctcgcccgcccgctcggcgaggacctgctcctacgggccggccgcgcctacgaacgcacccgcccggcccgcgcactcgccccggcaccctgatacggcggggaagcggcagagcggcggcggggcagcgatgtgcaaggggctctctgccgcaccccagaagcaacatcttcgctttaaggtggtgtcatgagcccccgacccatggtccgccccggcgggcgcagcgcccgagtccaggaagcggtgcacgacgccgtgcgcgcgctggaggcggagtccggccgcgacgccctgaccgtgccgctgatcgcccagcgggccggcgtcaccccgtcgacgatctaccgccgctggggcgacctgcgcgaactgctgtccgacgtggcggtggaacggctgcgcccggacacggcaccgggggaccacggcagcctggccgccgatctgaccgcctgggccgagcagttcctcgacgagatgtcctcaccctccgggcgccgctacatccgcgacgccgtcctcggcgacccggagggcggcaacgcggggcagtgctcggcctacgccgccgatcagatcgacgtcatcctcgcccgcgcggccggccgcggggagagcggccccgaggtcgagacggtcatcgacaccgtcgtggcgccgatgatgtaccgcatcctcttccgcccggccggcctggacgccgcctacgcccgccgccgggtgacggaactcctcggcgtacccggcgagaacggcccctgacgcggcctccgacgcggagatcgaggccctgctcgccgcccgtgaccggctgcccgcgctacgggccctgttcctgggcgacatggtctccgaggagtgcgaaccgtcctggatcacgccgaccgacgtgaccggactgctgcacggcttctgaccggcctccaccgccgcgcctccggcaccgaccccgccggggacgcgcagcgtctgcggctgtaccgcgccggacgcggccacctcctcgcgcacggctgcacccagcagccgatgcgcatgttccgctctacgacggctcctaccggacggcgctgctcccgcgcccctgcccgctcgccgtctgcgactgccacatcggctacggccacctcgaaccctgccgctgtacgacgtgttcgcggatggcgtcctggaacggataccggcgcaggcgcacttgagccggtagcccctcgtaccgccgactttcacacaggtgtcaccgcacccttccctcccgttcggtgctcttggaacactcgctgcgcgcagcactcgccccatccggccttccgtgcacgaggatgagaggacccccacatgccgtcacccacccccgaggtcaaccggcgccgcttcctgcagatagcgggcgcgaccacggcgttcaccgcgctgtccggcagtatccagcgcgccgcggccctgcccgccaaccgcctcaccgcgtcgatcgacgacgtcgagcacatcgtcgtcctcatgcaggagaaccggtccttcgaccactacttcggcacgctcagcggcgtccgcggcttcggcgacccgcgcccggtggcgcagccgaacggcaagccggtgtggcaccagacgaacggcgtgggcaaggagatcctgccgttccgccccgacaccgacgacctcggcctggccttcgtccaggacctcccgcacggctggaacgacggccattccgccttcgaccggggccgctacgacaagtgggtgccgtccaagggcagtacgacgatggcgtacctgacccgcaaggacatccccttccactacgcgctcgccgacgcgttcaccgtctgcgacgcctaccactgctcgctcatcggctccaccgaccccaaccgctattacatgtggacgggccacaccggaaacgacggcaagggcggcggcccggtcctcggcaacgaggaggcgggctacagctggacgacgtaccccgagcgcctggagaaggcgggcgtgtcctggaagatctaccaggacgtcggcgacgggctcgacgccgccggcggctggggctggatcaacgacgcctaccgcggcaactacggcgacaactccctgctgtacttcaaccagtaccgcaatgccaagcccggtgacccgttgtacgacaaggcccgcaccgggaccgacgccggtgcgggcgaggggttcttcgaccggctgaaggccgacgtcaagggcgggaagctgccgcaggtctcctggatcgtggccccggaggccttcaccgagcaccccaactggcccgcgaactacggcgcctggtacgtctcccaggtcctcgacgcgctgaccagcgaccccgcggtgtgggcgaagaccgccgtgttcctcacctacgacgagaacgacggcttcttcgaccacctcgtcccgcccttcccgccggcctccgccgaccagggcctgtccacggtcgacgcgggtctcgacgtgttcaagggcgacgccggacacgtcgccggaccctacggactcggccagcgcgtgccgatgatcgtgatctcgccgtggagcaagggcggcttcgtctgctccgagacgttcgaccacacctcgatcatccggttcatggagcgccgcttcggcgtgcgggagccgaacatctcgccctggcggcgggcggtctgcggcgacctgaccgccgcgttcgacttctccggctcggacacccggcccgtctccctgccggacaccgccggttacgccccgccggaccacaaccgtcaccccgactacgtgccgaccccgcccgcccagggctccctgcc

SEQ ID NO: 447 - DNA, 1923 bp, Unknown
  Kingdom: Bacteria, Phylum: Actinobacteria, Class: Actinobacteria, Order: Streptomycetales, Family: Streptomycetaceae, Genus: Streptomyces
ggtgccggtgccggtgccggcgccggtcccgttgtccgcgaccgtgaggcggacgtgctcggccgcgccggtgacgctgatctcgcagcggtccgcgccgctgtggcggaccgcgttcgtcacggcctcccgcaccacccagcccagcagcgcctccgtctgaggcgtcagcggcggtcccgagcggcgtacgacgggctcgatgccggcggcggtcagcgccgaacgcgcccggtccagctccgtgctcaggctgccctcgcggtagccggtgaccgcctcgcggatctcggtgagcgcctgccggccgaccgactcgatgtcggacacctgcgccagcgccgcgtccaggtcgcggggcgccagccgccgggccgcctccgacttcaccacgatcaccgacagggtgtgccccagcaggtcgtgcaggtcacgggagaaacgcatccgctcctcctccaccgcccgccgggccagctcctcccgcgccgcccgcagctcccgtacggcctcgctcaggctcaggatcgcggcggtcaccatggtcgacaggaacgtggcgtaggcgatgttcacgccgtcccagccctcgtggcaggcggcgaccaagccggagaacaccgccagcgacatgccggtacggcccagccaggggccccgcaggatcgaacctgccgccagccccagcagcgggaagaacagcagccagctgccgccgtagccgagccccagcgcggtggtgaccaggcccatcagacccagcgccacccgcggcccggccgcctcccgccgcttcttgtcgaaggcgttgaagacgatgtagacgtacagcgagttgaaggccagcaggcccaggacccccagccacgtgttcggggtcctgccgtggaagatgttggagaacgagcccagccccatcagcagccacggcagcagggcgaagccggtgggcggcgggcccgggttctcgggcacccggccggccttctgcgcggccttccagtccgccttcagctgctccttgttctccttccagagacgctgcgcctcccgcgcctcccggacggcctcccgccacgactccacctggcacgagatgccgcgcgcccacttcatcttccgttccccccggtcagacggttcccgcgttgcggcggtacgacagcacagcgtacgaaccgaacgccacgagccagcccgccagcacgaggatggcaccgacggccggggcgtgtccctcggtgacggcgatcccgacctgcgcgaaccggttcgtcggcgtgtacgccgacaccgcgcgcagccagcgcgggaagaggtcgaccgggaaccacaggccgccgagcaccgcgagccccaggttgcacaccaggttcgccacacccgtggtctgcggggtgagcccgtagccgttgccgagacccagcagcgtgaacgggatcgagcccagccacagcagcagcgccgtcagcgcccactgccacaccgccagccgtacgccgtcgaccaggccgcccgccagcagcaccgcgcagatcgcgggcagcacggtcaccgctccggtcagcgcccggccggcgaccacctggcgcggggtcatcggcgtcgccctgagctgccgcagccagccgagcgcacggtcctcggcgaccccgccgccggtgttgagcgcggagccgaccgcaccgtaggcggccatgcccaccatggcggccgtccgccagcccccgtcgttctgcgtgccgacgttggtgaacagcaggtacatcatcaccgggacggcgaccccgccgatcacgaacccggtgtcgcgcagcgtgcgccgcacctcaaggcgcaggtagtcccacatcagaccgtctcctcctcgtacgccggcgcgtccgcgggcgcgtccgccgggccggcgtacgaggaggagac

SEQ ID NO: 448 - DNA, 748 bp, Unknown
  Kingdom: Bacteria, Phylum: Actinobacteria, Class: Actinobacteria, Order: Streptomycetales, Family: Streptomycetaceae, Genus: Streptomyces
acgagcaagacgaacgacgagcaagacgaacgacgagcaagacgaacagcgaacagcgacaaccactaccaaggagcccacgatggaagcccgcctcaacatcttccagaaccccgtcgccggcaagttctcccgctacatcaactcggccggcaaggtcatctcggactcgacgctccccgccgcgacacaggaactggtgaagatccgcgccagccagatcaacggctgcggcttctgcacggacatgcacaccaaggacgccacggccgccggtgagacggcgcagcgcctccacctggtcgccgcgtggagggaggcgaaggtcttcacggaggccgagcgcgccgccctggaactgaccgagcagggcacccgcatcgcggacgcgtccggcggcgtcagtgacgaggtctgggagaacgcggccaagtactacgacgaggaccagctggccgcccttgtcggcctcatcgccgtgatcaacgcgtacaaccggatgaacgtcatcatccagcagcccgcgggcgactaccagccggggatgttcggctgacagccgccgcccggctccaccggcatagtctgaccaccgaatcgaacggtgatcttccgctggggggccgagcattgcctgacgaaccgaagaagacgcaccaggacgacgacaccaccaccaccgccaccacgatcaccaccgtccgtacccgtccgggccgcctgatccgcccggacgggtacggacggt

SEQ ID NO: 449 - DNA, 8243 bp, Unknown
  Kingdom: Bacteria, Phylum: Actinobacteria, Class: Actinobacteria, Order: Streptomycetales, Family: Streptomycetaceae, Genus: Streptomyces
gcccgcggtcagtgttcggagtagctgaggtcgcccacggtccaggcgctgacgtccttgatcgccacgcggtacatcccgcccgtctccgggatgccgaggctgccctgcaggatgcgggcgaggtggaagtgcaggtgcgtgggtgtcccgccgtgatcgggacgcgccgcgcggtggccggtgaagacgtcggagaaagggcccagccgctccgacgtcctcaggacctccgagacgcgctcgcgccacatgctctcgggagccagtcggccggtgatgacggcaccgtcgacgaccacggtcagaggcatctgattgctcggctgcgactccaccagcgccgcgacggcggtgagcagctcatcagcgttctgcatggaggcgattgtattcagcggggccgctcagtccctgctggaatcgagccgtcgtccgatccgcgcccgggccctcaccgcgtccgcctccgcctcgaagccgtcaccgcgccccggtgcgcccgtagcgtcacttgatccccgtcgtcgcgatgccctggacgatctgccgctggaagaccaggaagacggcgacgagcggcaggaagccgaggaccgaggaggccatgacctcggcgtactggatgttggtgttgttcaccagcgaggccaggccgaccgggatggtctgcgacttggtctggttcaggacgagcagcggccacaggaaggcgttccacgaggtgatgaacgtgaggatggcgaccgtggagatggccgggcggcacagcggcatgcagaccgtcgagtagatccgccaccagctcgccccgtccagccgggcggcctcgatcagggcccggggtatgccgcggaagaacgcctggaagacgaagacggacaccggggccgcgaccgagggcaggatcagcgcccagaaggtgccgagcaggtgcagcgagcggtactcgatgaactgcggcagcaccagcgcctcgctgggcagcatcagaccggcgccgaccacggccagcaccgcggtccggccgcggaagcgcagcagcgccagcgcgaagcccgccatcgagcagaagaccaccgtgaagagcacggcgagcgacgagatgacgaggctgttgaggtaccagctgccgatcgggtagtggtcccacgcgtaggagtaggcgtgcagggaccagccgccggcgaacggcgaggtcgggtcctgggtgatcgacccgtcgttgcgcagcgaggtgatcagcgcccaggcgaagggcaccagccagatcagcgcgaacagggtcaggcagacggcgcagagccggttgaagagcttcccgcggtcgagcgggggcgcggccgccgtcgtggtgggccgcggctgggtgatggtgctcaaggggtcctccactcaggccgcggagccggacgcgcgtcgccgccgcagcccgtaccaggccgccgataccgcgacgatgatgacgaaatagaccatggtggcggcggcgccgtagccgccccggtaggaggtgaagccggtgtcgtagatgtactcgatgaccggccgggtggactggctcggaccgccggccaggagcaggtagatctggtcgaagaccttgagcgaggcgaggatctggaggatcagcaccaggctcgtggtccggccgagcagcggcaccgtgatgtgccggatctgctgccaggggcccgctccgtcgatcgcggcggcctcgtagacgtccggcgggacgtcctggatcgcggcggtgtagaggacgaagttgaagccgaacgtccaccacagcgtcatcagtgtcacggcggtccagccgcccgcggtgctgccgatgaagtcgggcaccggcagcccgacggcgccgaagagcttgggcagcaggccgatctgcggggtgtacatccacaggaagatcagcgcgaccacggacgagggcaccacgtacggcgcgaagaaggccagccggtagaaggtgcggccgcgcggcatccgggaggccaggatggcgacgaccagcgccagcacgaccagcggtggagtggtcagcagggtgaagagcaccgagtgccacatggcgtcccagaacagcgggtcgccgatcacctcggagtagttcgacaggccgacccagtcgcccaggccgtccttgacggtggtggtgttgaagaagctgagcaccacgcccacgagcagcggaccgaccaggaacagcaggtagatcacgaggaagggcgcgctgagcagcgcaccggcgcggcgttcggagcggggcggccgctcacgcgccgggggtaccgcggacgccgtgggtgccggtcgcgtcgggacggcggtcgtcatggtggctgcctcctacttcatcgtgaccggcggtcgggccgtggtgtaccgctcgaggtcggcgcgcatgcccgcgaccgcgcccttggggctggtccgcccggcgaggacgtcgatgatcgtcgagcccacggtgctctggaagtccgagcccgcgccggtgtaccaggcggccgggtcgtactgggcgtcgaaggcggcccgcacgtagttgcgctgcggcgactggtcgaggaacgccttgctgcgctgggtcggcagccacgcggggatgtgcccgccctgcgcccacaccgcgctgttgtccagcaggctcttgatgaaccgggccgcgtcgcgggtacgggccgcggagcgggccgcgttgcgcgggacgaccagcgcgtgcgagtcggcgtacgccaccggccttgggccgagcagcgcggggaagggcacgacgtcgaagcggaagcccttgacctggcggtacgaggggatctgccattcgccgtcgaagaggaagccggccttgccggtgctgaacagggcgttggcgcctgagccgttgaggctcttgggcatcaggccgcccgcggtgaggctctgcatgaaggcgaacgtctcctgcatcgcctcctcgtcgatgctgatccgggtgccggagtcggtgacgatcggtccggcgaggccggagtagatcatgctgaagtaccgccacgcggtggacgggtcggcggtgatcgacatcaccgccccgtactgggcaccgccctcctccttcatcgccttgacggcgttcaggaagtcctccttgcccttgagcggcgtgaggccgtcgcccgcggggttgaggagaccggccttgcgggccaggtccacgttgtagaagagcacgaacgggtgcgtgtccagcgggaccgcgtacgtcgtcccgtcgaccgttgccttcttccaggccgccggggtgaagtggtccgcggtgacgcccagctcgccggccccggtccgctcgatcggctccagcagaccggacgcggccagcagcggcagccgcgagaggtgggcgatgccgacgtccggcggcgtaccgctcgccgtggccagggccagcttcgtgtagtacggattgccccagcccaggatggtcgcctcgaccgacgtaccggggttggccttccggaacgcgtcctccatcagcaccatgttggcgccgtcaccgccggtgaagaggttccagaagatgacatccgcggtgttcggctgcgagcccgtcaggccggacgcgagcggggaggagcacgccgcgagccctccggtcagggcaaggccgccgccgagggcaaggaaccgccggcgcgccatcgctccgctcataggggtattcacctcgtcacttcgatgtgaactcgatggcgcagaccttcgcacacgatttgcaacgatgcaatagatcggcggaaagtggccttgcgcgcaggctcaggccactgggaggggtgcccgggggcgttacgggttctgcgggtcctccccccgtgtgaagccgtggctgcgctccaccttcgcgacgtggagcgtgtagttctggtaccacgcgtcccgcccgcgccgctgcgccgcacggtgctcggcgttgctccgccaccgcgtgagggcatcggcgtcgcggaagtacccgacggtgatgccgaggccgccgggagtctgcgcgtggtccatccccaggaacccggggacgtccttgaccagctcctccatgcgcgcgctggtctcgcggtagccgctctggtccggggtgcgcaccgcggtgaagacggcaacgtagtacggcggttcgaaggcctcgacgggtgcgacaggcgcgtccaattgatcgctcatggcgccacggtagggcgggtgcgcccggggatccagggggtttcgggggcccaggggtcccgggggctcccggggttccagcggacttcggggctccgggggcccggggagcggccggccggcggccggtgctcattccgccggggcgcgccatcgcgaggactcgcggaccaccagccggaagggcgtcgcctcctgtgccgccggaacgggttccgcgggggcggtcccggtgtcttcgggcccggggcggcgctgggtctgttcctccagcagcgtgagcgcgcgttcggcgatgacgtccaggtcgggggcgatggaggtgagcggtgggtgggtgtaggccgactcctggatgtcgtcgatgccggccaccgcgacgtcgtcgggcacgcgcacgccggaggcgtccagggcccgcagcgctccgacggccagcgcgtcgttgaaggcgaagacggcgtcgggcagcgggccgtcaccttccagcagctcccgtacggcggcgtagccctgctccctggtccagtcgtcgaccggtgcgaccagccagttcacccgccgcacccgggccgccgacatcgcctgctggtagccctcggtgcgctggcggccgttctcgctgccgttgcggccgagcgcgacgatccggcggcagccctgctccagcaggtgctccacggcggtgcgggcggcggccacgttgtcgatgccgacccgcgggaactggtcgccgacgttgtgctcgcccagcatgaccagcgggaagtccggtttcgccgcggcgccgtcggtggccggcagcgtcagggcgctcagcagcacaccgtcggcgacgttggtcaggccgccctccaggatccgccgctccacctcgctgtcgcccgcggtcgcctcgaccagcaccgtgatcccgcgccgtccggcggcccggatgacggcctgggccagctcggcgaagtacggttcggcgaggaagggcaccgcgagggcgatgaacccggtgcggcccgagcgcaggccgcgggccatgtagtccatgcggtaaccgagttcgtccagtgagcgctgcaccttggcccgggtctgcgggctcacgtgcggatacccgctgaccacgttcgacaccgtccgcaccgacaccccggcgtgctcggccacgtcccgcatccgcactctggccactggaggggctccttcccgtcgaaccggcccgtcgaaccggctccccgagtctgccgcacgggcggcggcggcccgacgccgcactccgacctcgcgccgaccgctcttgcatcgatgcaaacgatcacccatgatgacagggcttcgattataggaacgctgaaatgccgacgccgggcctgccggaaaaaggcagcggcatgccgaaaaggcagaaggaggatccgtgagggcgagcgagcaggacgggacgtatccgaggccgatcctgcagcgggagcggtggcacagcctcgacggcgtctgggacttcgggttcgacgacggcgacgcgggcgagcgcgacgcgtggttcgccggggagagcgagcaggcggacggcgccttcgaccgggagatcaccgtgccctttccgcccgaggcgcccgcctccgggatcggcgagagggcaccgcaccgggtggtctggtaccgccgccgcgtcccgcacgagatcctcgccgccggcgacgacgagcggacgctgatccacttcggcgccgtcgaccaccgcgcgaaggtctggctcgacggccgcctggtggccgaacacgtcggcggccagaccccgttcaccgccgacgtcacccgcgcgctgtggcccggcgccgacacgcacgtgctcgtcgtgcgcgccgaggacgacccggccgacctcgcgcagccgcgcggcaagcaggactggcaggaccggccgcacgcggtctggtacgagcggaccaccggcatctggcagaccgtgtggacggagacggtgcccgcccagcgcgtcaccgacctggcctggatcccggaccccacgcgcggcgtcctcgccgaggtcaccctggccacgccccccgccgacccgctgacggtcgagatcgtgctgagccgcgacggcgaggtgctggccgagagcaccaccgcggtccgcaccccgcgcagccgcatcgacctggtcgtccccgcgctgcgcaacggcatcgaccgcgaggacctgctgtggagccccgagcggcccaccctgatcgacgcccgggtgaccgtgcgcgacgcgcggacctcggcggtcctcgacacggtctgcagctacgtcggtctgcgcagcaccggcgtcggccgcggcgccttcctcctcaacgaccgcccgtactacgtgcgttcggtgctcaaccagggctaccgcccggacaccctgatcgcgaactccggcaccgccgagctgcgccgcgaggtggagctgatcaaggcgatgggcttcaacgccgtccgcatccaccagaaggccgaggacccgcgcttcctgtactgggccgaccggctcggtctgctggtgtggggcgagacgggggccgcgtacgagttcggcaccgaggccgtggagctgctcacccgcgagtggctggacctcgtacggcgcgaccgcagccacccgtcggtcgtcacctgggtgccgatcaacgagagctggggcgcgtcggacatcccgcacgaccccgcgcagcggcactactccatcgccctggcgaacctcacccgcgccctcgacccgagcaggcccgtgctgtccaacgagggctgggagcacaccgacagcgacatcctcggcgtgcacgactactccggcgaccccgcggaactcacccggcgctacggtgacgccgccgccttcgacgccgtactcgcgggtccgggaccgcaggggcgggtgctgtcggtcaccggccggcagatcgagcggtacgccgccggggacgcgccgctgatgatcaccgagttcggcgggatctcgctgcgcgccgacgagggcgagttctcctacacccggaccggctccgacacccagtacgccgagctgctggaccgcctgttcggcgccctgcacgccagcccggtcgtcgcgggcttctgctacacgcagtacatggacacggcgcaggagaccaacggcctgctcttcccggacggttcaccgaagctgccgctggagacgatccgccgcatcgtcacgggggaagcggccgtggagacggaagagaaggccgaccaggcggagtaggcgacgcggggcgtaaaggcaggggggccggccaccacggggccggcccccctgcctacgcgtgctgacgcgcccgcgcgctcagagatcgcccttgaggtacgaacgcgccgccgccatggcgtccttgtggcggtcctcggcgatggcctggaccggcgagtcatcctccagctgcgggttcatcccgatcatccaggctctcgccgtgtgacagttctcagcgagcgtgatcatctggaagacctggtaggcggcgcgcaggcgcagctcggagtcgatgcggggactgttctgtccgctgcaccacttgccgacctgcttggggtcctcgatacccgcgatgaacgccgtcagccgctggccgaaattgtcctgcaggaagcgcgcgatggccgcggtggatgcctgcaccgtcccggcgtgggcggtggcctcggtctcccggtcggtcagggtctccatgatctcctcgattcctctgcgcgccggccggtgttccggacaccgcgacggaggtggtgaatggcgccgcctcagggcgcgcggacgcgcgccgcggtgcggcgaggcgcggggacacacgtgagcggacgggctcacgcaagcgggcggacacatgcgagcgggaggaggtgacggcggtcgcgggcgcgaacgcgggcgcacggtccggccggtcgacggtcggccgcggcgcgtcggcgggtaacggacgcgtggtcaacatcgctcccccctgggtgtcttggaggaagtctaccctcggccc

SEQ ID NO: 450 - DNA, 6347 bp, Unknown
  Kingdom: Bacteria, Phylum: Actinobacteria, Class: Actinobacteria, Order: Streptomycetales, Family: Streptomycetaceae, Genus: Streptomyces
gtgccgggccggcggcccctggcagcagttcctccccggcgtctacctgctccacccggggccgccggcccggcactgttcggccgtctcggccgccgacacgccgtgcgcacgcaactgggcggtggtcaggacccggcggtgcgcctcggccagatggctcagggggcggggggagagcggggtgtcgtggttcatgtcccgggacgttcccgtacccggcccgcccgctaaccgctgttacacgcccgtcgacaaatgaggacaaccctgccctaaaggacgggtgttcggatgccgaaaacccctggtccgccggggggcgggccaggggttacgggaactttgtaacggttactccacgcctgagccttggccagagctgcggccgtccgggtgacggctcagccgggctcagccgggctcggccgggctcagccggcggatccggccgtcgcggccgccgcgtcgcacgcctgtccgcgcagcgcgcgggcgaggtcgtcgcgcgcctccaggacgagacggcgcagcgcgggcgcggacgcctcgtgcgcggcgagccacgcgtccgccgcgtccagcgtctcccgcgagtcccgcagcgacgggaacagcccgcggaccacgtccatcccgatctggatcgaccgctcctgccagacgcgctcgatcaccgcgaagtacttctcggtgtacggcgcgagcagctcccgctgagagggccgcacgaatccggcgatggtcgcctccaccaacgcgttcgacagcgtgtccgactccaccacccgcgcccacgcctgctccttcacggcggcggacggccgggcggccaggcagcgcacctggtgccgcttgccggaggcggtgtcgtcgcgggccagctcgtcggcgagcgccttctcgtcggccgcaccgtacgtcgccagcggctcaaggaacgcccagcgcagctcctggtccatgtccaggccggtgatctcctcggtgccgtccagcagggccttcagcagctccaggtcggccggggccgacgccagcgacgcgaagaaacgcgcccacgccagctggtgctcgctgcccggctcggcctgccgcagctcggccagcgcgccctcggccagcacccgcgcacccgtctcccgccacgccggcgccacgtagtgcaccagcgaggacccggcccacgcgtgcagcatctgcagcacgccgatgtcggtctcgcggcccgcgaaccgcagcaccaggtcgatgaactcgcgggccggcagcagcgcgtcccgggtcaggttccacagcgccgaccagcacagcgcgcgggccagcgggtcggtgagggcgcccaggtgctcgcgcagcgtggccagcgaggtctcgtcgaagcggatcttgcagtaggtgaggtcgtcgtcgttgaccagcaccagctcgggggcgtcctgcccggccagctccgacacgaccgtacgggcgccgtcgacgtccacctccgcgcgcgcgtaccgctcaagcgcgccgacctccgagcgctggtacaggcccaccgccacccggtgcgggcgcagctcggggtgcgattcggcggactcctgcaccaccgccagctccgcgatccgcccctcggcgtccagcaccacctgcggggtgagcgagttgaccccggccgtctgcagccaggaccgcgcccaggcgcccatgtcccggccgctggtctcctcgaggaccgccagcagatcaccgaggcgcgtgttgccgtaggcgtgccgcttgaagtagcggcgcgcgccctccaggaacgcgtcctggccgacgtacgccaccagctgcttgagcacggaggcgcccttggcgtaggtgatgccgtcgaagttcagcttggcgtcctgcaggtcgcggatgtccgcggtgaccgggtgcgtggagggcagctggtccgcgcggtacgcccacgccttgcggcggttggcgaaggtgatccacccgtcggtgaaccgggtccccccgaccagggagaacgcccccatgaagtccgcgaaggactccttcagccacaggtcgtcccaccactccatggtgaccaggtcgccgaaccacatgtgcgccatctcgtgcaggatgacgttggcccgcgcctcgtaggacgcctgcgtcaccttgccgcggaagatgtactcctcgcggaaggtcaccagacccgggttctccatcgcgcccaggttgtactccggcacgaacgcctggtcgtacttgccgaacgggtacgggtagtcgaagtggtcgtggaagaagtccaggccctgcttggtgacgaggaagacgtcgtcggcgtcgaagtgcttggcgagccccttgcggcacagcgcgcccagcgggatctccagccgcgtcccgtcctcgaacacccgctcgtaggagtccgtcacatagtggtacggccccgccaccacgcacgtgatgtacgtcgagatcggcttggtctccgcgaaccgccacactccgtcgtgccgctcaccggtgccgttgctccacaccgtccactcctcgggcgcccgcacctcgaagcggaacggcgccttgaggtccggctgctcgaagttggcgaacacccggcgcgagtcggccggctcgtactgggtgtagaggtagacctcgccgtcctccgggtcgacgaagcggtgcaggccctcaccggtgcgcgagtaggcgcactgcgcgtcgacgaccagctcgttgtcggcggccaggtcctccaggacgatccgcgagccgtcgaagacctcgctcgggtcgaggtcgcggccgttgagggagacggccgtgacggcgggtgcgatcaggtccgcgaagctggacgcgcccggctcgttgcagcggaaccggatcgtggtgacggaccggaacgtgcgcggcccctcgccgtcctcctcgccgaccgccgaccgtacgtcgagggacacctcgtacccgtcgacggacagcagggcggcccgctcccgggcctcgtcgcgggacagattctcaccgggcacagacggcactccctcggatgtgttcaggatgcggacagcaccgatcctgccatgcggtcctgatgcgcgacatcagggaatgccctgcgcgacggtcgatgttgcccgttgcggggaccccaccgggtccgtcccgtacgcacacccgtaccgaggagagccatgtcccagaccgcccccgcggcgaccccctccggcaagacccccgtcgacttctggttcgaccccctgtgcccgtgggcctggatgacctcccggtgggtgctggaggtgcagaagcagcgcgacatcgaggtccgctggcacatcatgagcctggccgtgctcaacgagccgaagctggacgagctgcccgaggactaccgggaactgctcaccaccaaggcgtgggcgccggtccgcgtggtgaccgcggcctggcagaagcacggcgacgacatcctcggcccgctctacaccgcgctcggcacccgcttccacaaccagggggagggtcccacccgcgaggcgatcgccgccgcgctggccgaggtcggcctgcccgccgatctgatcgactacgccgaccaggaggacttcgagttcgacgccgagctgcgcgcctcccacaaggagggcatcgacaaggtcggccaggacgtcggcaccccggtcatcgccctgcccggcgcggacggcgagcagatcgccttcttcggcccggtcgtcaccccggtcccgcagggcgagcaggcactgcgcctgtgggacggcacgattgccgtcgcctcggtccccggcttctacgagatcaagcgcacccggacggcgggcccggacttcagcaacctgtaggtcacggccttcggcaacccgcaggccacggcacggccggcccctacgggaagacccccgcgagtcctgtcctcgcgggggtcttccttctctccgcccgcccgcgtgaaaggtgagaagacgatcacgaggagggacgatccggggcgcgcgtcagggcgcgagcagcagcacgttcgcgcgttccttggcggcggcgtagcgcttggcgacgtcctgccagttgacgacctgccacatggcgtcgatgaagtcgaccttctggttcttgtactgcaggtagaaggcgtgctcccaggcgtcgaagacgaggatcggggtggagccctggccgacgttgccctggtggtcgtagacctgctcgacgaccaggcgcccgctgagcggctcgtaggcgagcacgccccagcccgagccctgggtggtggccgccgccttggacagctgggccttgaaaccggcgaaggagccgaaggactcggcgatcgcgtccgccagctcgcccacgccgtccttctccagcggctcgccgccgccctcaccggtcatgttctgccagtagatggagtgcaggatgtgcccggacaggtggaacgccaggttcttctccagcccgttgaccgaaccccacgactccttgtcccgcgcctccgcgagctgctccagcgtgtcgttggcgcccttcacataggccgcgtggtgcttgtcgtggtgcagctcgatgatctcggggctgatgaccggcgcgagcgccgagtagtcgtacggcagttcaggcagcgtgtagacgggcatgaaggtcccctccgaccagttattgcaaaagggttgcaactacaaactaccaacaacaatccgggcgcgggcaacacgaaggcccccacgtgtcacgtgggggcctcgtcgcgagcggttttcggtgcgtcagctccgcgcgcgcgtgcgctgccaggcgtacccggccgccgccaggaccagcgccatcgcgcccgtcgagtacaactgcacccgcgtgtcgggctgccgggccatcagcacgaagatcgccgccatgcccgccagggccacccaggtgagccaggggaacccccacatccgcacgaccagccggtccggcgcctcccgctccagcctgcgccgcagccgcagctgcgaggcggcgatgaagatccagacgaccaggatcaccgcgccgatcatgttcagcagccacgggaagacgtcgtcgggccgccagtagctgagcagcacgcacaggaaaccgaagacgctcgacaccagcaccgcgatccgcggcacaccgccggacacccgggccagcgcccgcgggcccagaccgcgctccaccagcgagtacgcgatgcgcgaggaaccgtagacgttggcgttcatcgcgctcagcagcgcgaccagcaccaccacgttcatcagctggccggcgccagggatgccgaggtggtccagggcggcgacgtaggggcccttgtcgacgacctcggccgcgttccacgggacgagcgtgacgatgaccgccatggagccgacgtagaacagcgcgatgcgccacatcgccgtgcgcaccgcgctcgccacgccgcgcaccgggttctccgactcggccgccgcgatggtgaccgtctccaggccgccgtaggcgaacaccgaggcgagcaggccgatgatcaggccctggccgccgtgcgggaggaagtcgttcaggtgggaggcgcccggcgagtcggtgccgggcaggaccccggcgatcgccagcacgcccagcaccaggaacagggagatcgcgccgaccttcagcgccgcgaaccagaactcgaactcgccgaagttcttcaccgcggccaggttcgtgccgcagaacaccaccatgaacagggccacccacatccactgcggcgttcccggcagccagcccgtgacgatcttcgcggcgcccatgccctccaggccgaccgccgtgcacagcagcacccagaacgaccagccggcggtgaaaccggcccacggcccgaacgcccgctcggcgtgggccgagaacgaacccgaggacgggtacgccgccgacatctcgccgagcatccgcatcaccagcatcacgaggaggccggagagggcgtaggcgacgatgatcgacggaccggcggcggcgatacccgcgccggaaccgacgaacagcccggcgccgatcacgccgccgagggcgatcatcgacagatggcgctgcttgaggccgtgggacaaggagaccgcctccgccgccgggggcgtcccggcggcggtgctggtgcgggtactgctgctgggcatgggcgcgctcgtccagtggggggaggggaaaagtttccacagtctgggcagcgcgtccgctccggggaagccgctgcccactatccggacacgcatcctacgcagcgtgcaggctgcgctacggaatccggtcgccgccggggcctggtgccggggcccggc

SEQ ID NO: 451 - DNA, 6986 bp, Unknown
  Kingdom: Bacteria, Phylum: Actinobacteria, Class: Actinobacteria, Order: Streptomycetales, Family: Streptomycetaceae, Genus: Streptomyces
ggtgggggccttcgccgtcggtgccgcggccttgggcgccaccgtgggggacgcgtgccgtggtgtgggcccgtcgtcgtgcgcgtttccgggcgaaccaggtgtatggaacgctgcggctgccacgccgcccagcgccagactggcgaggaacgcggcgaccgcggccttgatcgagcgccggtgtgtgcggcgcggcctccagtcgtcacgtctccgtgcccgtgcgcccgcatgcacccccgcgtcgcgcgcggcccggaaaccggccacagcacgctgctgggccgagacagcgagctcgtcagtgagcagcgcgcgggccagtgcgtgctccagggcggtggtgtcgagcgcaccgtcggtgccacgcgcggatgcaggggcgtcggcgaggcggcgggtcacgccttcacgttcaccgtgtccgtcgtccatgcctgtgtccgtctccgtgtgctgtgtccgctgctgcgacggacctgacgccgtcaccgctcactccgactccctcagcgtatggagcccctcacctgtcacacccgccacgccgagctggcgggcgagccgcttcagcccccggtgcgccgccgtacggaccgcacctggacgcttgccgaggacgcgggcggcggccggcccgtcgagaccgacgaccacgcgcagcagcacggcttcggcctggtcgcggggaagcccgcgcacgagccggagtgcctgctcggtcgagagccgctccatggcctggtcgtatgccgtggacggctccggtgtctcggcgacgtcctttccgaacccggccgccaccgggcgtgagcgttgccggcgcagcaggtcgagggcccgatgacgggcgatggtcgcgctccagccacgaaagcccgccgcatcgcccttgaaccgccccagatcccgtgcgatctccaaccacgcctcggacgccacgtcttcggcgtcctgaccgaccagcccacgcagatagccgagcaggccgggctgcacgaggcggtagaccacctcgaaggcggcttcgtcgccctcctgcgcccgtgccacagccatgcccagctccccgtcgcgtgcgcgatcgggtcgtttcccgtacggcaagatccgtccctgtccctaccgaccggcaagaggggtacggcacttgcactgcgccaccggtcacgttgcccttcctcagtgatcagcggcagcgcacacagttctgtcacagcatgcctgccgtgacgtcgcccgctccccgatcgggcccgcctccggcacgggcgagcgcctccggtacgggcgagcgcctccggtacgggcgagcgcctccggtacggcgaccggggtgtgacgtcaggcagcgctcgcgcgcttgatcaatggcacccgcgaccggcgggctcgggccagcgttcatttggggtgggactgtgaggggccgaaagaggctgatgcacatgtcgtcgagaggaaggaagtggtcagcaggaacagccgtcgtactggccggttcggcgttcgtcacctacgccgcagccgcgccatcgccagcgtcaccgccgccggagcacggaggcgtgcccgctgtgcgcacggtggcgctgcagcacctgggggccgggcacgaaggactggcacggcagggtacggacagattcagcgccgcacttctgacctggagtgatgcgcatgccgggctgggaggcacggcccagatccgtacgcgcgcggcagggaccggcgagtggtcgcactggcgcacactgccggagaagccgttctccgcagacggcgcggagggacggcgtgccgaggcacgtggtggtacggcgtccgtgtggaccggcgctgcggacggtgtcgaggtccgggtcgcggcggacgagggtgcggccggcgcaggactgcctgccgggctgagtctcgcactccttgatcctggcactgggaccgaacagccgtccgtgccaccggtcttaccgtccggcgcagccgccaggccgggcggctcatcggcaccggccgagcccggatccgccgccagagcggcgccgcacgtcgcccttggcgcacggagaccgaaagccgtgagacctcccgtcatcccgcagacgcagtggggtgccttccccggccgtggaagcacacagagctacagcgccgacatcaaagcggcggtgattcacgacaccggcgtcgacagtgacacccggctctcctgtgctgagaccgctgcccgcatgcgcacccttcagctcgaatacctgacccgcggctaccgtgacatcggctacaacttcgtcgtggaccgctgcggtcacatcttcgagggccgtgcggggggtgtggacctgcctgtgaggggagcgcacgacagcggattcaacaccggcacggtcggcatcgcctacctcggcaactacggtaccggtcagccgagtcgggccgcgatcgacgccatcgcccatgtcgtggcgtggaaattcgaggcgtacggcatcgacccggccggtgaagtgaccctcgagcccggcgacgacgagagtgccaaggggacgccgatcaggctgccgcgtgtcttcgcccgccatgacaccgattccgtgggcagccggggaagaagccttcacgacagcctcgaccggatcgtcacgctcgccggcaccccgggcgtctcccacgccctgcccacgagggatggcgaccgggacggcacaggggatctggcggccggcctgcctgacgccggaggcggcgcgggagcagtgacggtgataccgggcagcaccaggggacccgacgccgcggcgaagctgacgctcacccaggacaccccgggggtacccggttcctccgaagcgggcgacgccttcggcaccgcgaccgcctggggtgacgtgaacggcgacggctacgcggatctcgtgatcggtgcgccgggcaaggaggacgccgacggccaccgcgaccgcggcgccgtcattgttctgtacggaccgggcctgaactccggcgcctcctgcaccaccgcgggcatcgcggccaccggcgcccggatgggcgaggccgtcgcggtcgcagacttcgacgccgacggcaccgaagacatcttcgccgccggccccggaggcggcggcaactggaacgtccgtctcaccggcggcaccaccacatccggcacgctcaccaagacccccgccccggtcgaccggctggccgctgccaccggtgacttcaaccgggacgggtacgccgatgtcgccctcggctaccgcgacgccgacggcatcggacatgtggccctcttcaccgggtcggccaccggaccggcaaagacacagaacctgaccgtcaagggcggcagatcgccggccgcgggggacttcgacggcgacggctacgacgacctcgtcgtcggtcagccggacgccttggagtcccaaggccgaccgggcggccagatcagcgtcttccggggcacccgggccggccttgtgcctaccggaacagtcatccaccaggacggcgtcggcgtggtcggcaccgacgagccgggcaacggcttcggcgccgccctctccgtcggcgactacgacgccgacggatacgccgacgcactggtcggcgcccctggcgaagacctcacacgcgacggcacccgacgcaccgacgccggccaggccaccctgctgcgcggcacggccgccggcctgaccgtcgacggctcgttcaccctcaaccaggacacccccggcgtcctcgactcgacggagaagggtgaccgcttcggatccgccgtcgccctggccgacctgtccggcaacgggcgggccggcctcgtcttcggagccgaaggcgaagacaccggtgacggcatcctgctctacaccccggtcgacgacaccggcttcggtctgggcagaaccgtcgctctgcgcaggagcgcgctggacacacccgccggagcacacctcggacatacgctgacaccgtaagtccctgccacaccgcacactcgatgaggcggagacggtggcgccgtggcgtcccgcggaagggcgggcgccacggcggtcgcggtcacgaagccaggtcttcgcgcactcggcgagtccggccgtgcaatgtcaggtagaagagccgcagggactgttcgggagtgccgtcttcgaagcgattgacgacctttcccagagggttccagacgcggctgtccggcatccggatgccgaccggctgcccgaagtaggcgcgctggtcggcgtcgaagtctgcccacaccgctcccgtacgacgcacgaggacctcaccgacgtacgcgccgagcccgaacagtgcgtcgcgggcctgttccccgtcggccccgcccttgcgcaacccgtcgatcaggaagtcgacgatccgcaagctgcgctccgaatagtccagcggcagccgactgcgcgcggtggcacgtgcgacgaaggccgcggcgtacgaccgcatctgactcgcgcggggcgcgtgtctgtccgtctcgcccatcgggctgtagtcctttcgctcggcagcggaaggaacttgaccttcattccccccgctgtgcgaagcggattccggctcttgggcatcacgggcagtgggggtgatccatgtcacgcaaaactcttgccggctcggtgcggcgcacgatcccctcctgtagctcaagtgcttgagaacaagggcctcctgatcaccgagggtcagcccttagactgcgaccgctccgaaatctggcgatcttctggagggtgtgcagggatgaaccgagctctcatgaccgcgttggcggcagcagcgctggtcgcgtccgggggcggcaccaccgcctccgctgccgatgccccgccgcgagtcacgcacggtccttgccagtacacccagaccccggacgagccggcggcgcggccggttcccctgccgccggacccgcggcacaccccccgtcacggcacggtcggcatggctgtaccgaccagccagggcccgcttccgctgcgcctggaccgggggaaagcgccgtgcaccgtccagagcttcgtgcacctggcacggcaccggttctacgaccgtacggtgtgccatcggctgacggcgtacccgacgctgaaggtcctgcagtgcggcgacccgaccggcaccggcgagggcgggccggggtacaagtacaaggacgagctgccggtggacctgccgccggcaccgagcgatccgaccggcgtccgtcgtctctacgggcgcggtgtgctggcgatggccaacgccgggccgaacacgaacggttcgcagttcttcgtcgtctacggcgactccgcgctgcgaccggactacacggtgttcggcacggtcggtgccgcaggccttcggacgctcgacaagatcgctgccggcggtatcgagccgaccgcgcaggatccggcgcctgtcgacggtacgcccgtgctgcggaccgagctgctcagcgtcctgccgtcctgccggccctgatcaactccggtgcggtcaccgtgagtccggctatgttcctggtctcacggtgaggtggagtagccgttgcgacgtccgccctggcccggtcagctgggaggggcacatgtgggccaggccgccgctgtccgagccgatgatcgctcgccctcccaggatctcggcggcggcgtccagccaacgccgcgccccaccgcatcgtcgtcacccgcctgcgcggtcgacccgcgtacccaggactactacgcccgccggatcacccttcgacctggtatcgcgcgcccgtactggaccaggtggaagacctcgcgggccgcgtagcgctcaccgacgacgtgctgcttcccctcggccgaagactcgccgacttgatcgggcgtcaggactggccggccaagtcttcgtcgagggcgtgcgctgccgcctccagcgtggcgaccagcgactgcaagcgcttcgggtcgtagcgcacgctgggcatcgacaccgacaggccggccagcgcggtgccgtctcgatcacgcaccgggacgccgacggcgatcagaccccgctcggagcgctccttgttgacggcgaacccgttgcggcgcagacgcctcagctcggtccgcagccgggcgagatccggccgctcggcgggacggtcgcggtagcgctccggcgcgtacacctcgtccagctcctcgtcggtgaggtccgcgagcagcagcagccccgccgtcgtgcggtgggccgggaacaccatgccctcgcgggaaccgaccctgagcgcctgccggcactcgacgctggcgatgaaccgggcggtgtccccggtgcgcacgatcaggttcgtcgtctcgtccagaaggtccacgacccggtgcagatgcggcagggccgccgcacgcagccgcgacaccagggactgggagtgcgcggccagctccagcaccggcccggcgcggtagacgcggtcctcgccctgcacggcgaagtcccggtacacgagcatcgccagcacccggtgggcggtcgaccgggcgacgccgaggcgctcggcgatctgcgacacggtcgcgccgccctccatctgcagcatggtcgccgcccgcagcgcgtggtccacgctcgcgatcgggtagggcggcggcgtcttgagcggcttgtccatggcggcctccggattctgcactccagaatctacatgttcttctgctggacgcgatgcacgctgtggccgtgactgagtcctccatcgcccatgacaccgcccccggttcccctgtccggctccaggccgtctccgcgcagggtcagccggaggtcaccccggccctcgaacagctctaccggggcttcgaacaggaactcctcgtcccgttgtggacggagatcggcgatctgatgccggcccacccccgctcgcgcgccgtgccgcacgtgtggcgctgggagcggctgcgcgcactggcggccgaggccggcgacctggtccccgt

SEQ ID NO: 452 - DNA, 9138 bp, Unknown
  Kingdom: Bacteria, Phylum: Actinobacteria, Class: Actinobacteria, Order: Streptomycetales, Family: Streptomycetaceae, Genus: Streptomyces
cggccggtggccacgaccgccgcgtacttgtgcgcgacgtccgggtggacctccgggttcgggttggccatggcgaagacgaaggcacccttcgccatcgaggccaccgcggtctcgggcaccgtaccgccggagacgccgatgaagacgtcggcgccggccagcgcgtcctccagggagccggtgaggcccgccttgttggtgaacccggccagttcccgcttgaccggggtgaggtcctcccggtcggccgacacgatgcccttgcggtcggtgaccgcgacgtcgccgatgccggcctcgaccagcatcttggcgatggcgacaccggccgcgcccgcaccggagatcacggcgcgcaggtcgccgatgccccggccgctcagccgcgccgcgttgcgcagcgcggccagcgtgacgaccgccgtgccgtgctggtcgtcgtggaagaccgggatgtccaggcgctcctggagcttgcgctcgatctcgaagcaccggggtgccgagatgtcctccaggttcacgccgccgaaggacggcgccaggcgcaccacggtctcgacgatctcgtcggcgtcggtgcagtcgagcgcgatcggcacggcgtccacgccgccgaactgcttgaagaggatcgccttgccctccatcacgggaagggaggcttcagggccgatgtcaccgaggcccagcacggccgttccgtcggtcacgacggcgaccacggacgatttccacgtgtagtcgtggaccagttccggctgctcggcgatggcggtgcacacccgcgcgacgccgggcgtgtacgccagggacaggtcgtccttgtcacggacgggaacggtggcctgcacggccatcttcccgccacggtgcagcgcgaaagccgggtcgaaggaatccagcggctctgccccgccgtcctgatccgtagtgctgtcgctgcgaggattgacgatctccgctgccacttggttttaccccttaattgttcatggattgagggtggccactcctggtgaggggtgggcgggaccgcgcacggcccgttgagtgatgcgttcgtgccgtacgcgacgggcgcgccgcacacgcgccctgagccccggatgaggggtgtaaagaaccttcttaccggacggatgccgtcgacgacgagtccataacgccaaggtcacatgccgacgacgtgacaggtggcccaatatggggacaagtcctcgccgaagcctcgacaaggcgtcgaattcgtccataagccgttcctctgccgcccgtatcccgagacgggccggagatcttccggccggaagggaacattcccgcggatgatccggtcaccgggggcggtcgcgcggccttcgggggtcacccgttatccgattttgacatggtgattgccctgaacggcgcagcccaaatggcaagatgcgtcaatcacacgaggtcgcaacacccgaaggtgtgtgttctcgtcgacccatcggcatctccacccatccgccggaggaacccaccatgaccgcacgctccacccgtcgcacgaccgccgcgcactcccgtctggcagcggtcggtgcgatcgcggtcgcaggcgccctgattctcaccggctgcggtgaccagaccaaggacaaggacaagtcctccggaagctccgcctccgccggttccgccccgctcgccgacaagctcccggcgcagatccgtgacaagggtgtcatcaaggtcggttccgacatcgcctacgcgccggtcgagttcaaggacaagtccggcaaggtcgccggactcgaccccgacatcgccgccgcgctgggcaagcagctcggggtgaccttccagttcgagaacggcaccttcgacgccctgctcaccggcatccgctccagccgctacgacatcgcgatgtcggcgatgacggacaacaagagccgccagcagggtgtcgacccgaccaccggcaagaaggtcggcgagggcgtcgacttcgtcgactacctgcaggccggcgtctccatctacacccgcaagggagacaccggaggcatcaactcctggtccgacctgtgcggcaagaagatcgccctggagcgcggcaccgtctcgcaggacctcgccaaggccgaggcgaagaagtgtccggccgccaagaagctcagcatcgagcccttcgacgacgaccagcaggcgcagacccgcctgcgctcgggcggcgtggacgcggcctcctccgacttcccggtcgccgcgtacgcggtgaagacctccggcggcggcaaggacttccagatcgtcggccagcaggtcgaggcggccccgtacggcatcgccgtcggcaagagcaacacccagctgcgcgacgcgctgcaggccgcggtggacgccatcatcaagaacggcgagtaccagaagatcctggagaagtggggcgtccaggacggcgccctcaagcagtccgcgatcaacggcggcaagtgaccgcgagcggccactgagaggcgacatccgtgactgctgacatcgacaagacggcggggcccggggacgcacccgccaccggaccccaggcgatcaaggccatccccgtacggcactacgggcgctacatcaccgcgctcgtcgcgatcgccgtcctggtggcgatcatctacgcgttcggccagggcaagatcaactggcacgccgttcccgactacttcttcgacgaccggatcacgaccggcgtcggcaagaccctcctgctgacggtcctgtcgatgctgatcggcatcgtcggcggcatcgtcctcgcggtgatgcgcctgtcgaagaacccggtgacctcggccatcgcctggttctacatctggttcttccgcggcaccccggtcctggtccagctgttcctctggttcaacctcggcctggtcttcgagtacgtcaacctgatgccgttctacaaggactactggtcgaacttcatgacgccgctgctgacggcgctgctcggcctgggtctgaacgaggcggcgtacatggcggagatctgccgcgccggcctgctcgccgtcgacgagggccagaccgaggccgcccacgcgctgggcatgagccacggcaggacactgcgccgcatcatcatcccgcaggcgatgcgggtgatcgtgccgccgaccggcaacgaggtcatcaacatgctgaagacgacctccctggtggcggccgtccagtatccggaactgttccgctacgcccaggacatcggccaggtctccggcgccccggtggagatgtacttcctggccgccgcctggtacctgatcatgacctcggtgctgagcgtggggcagtactacatcgagcgctactacgcgcggggctccagccgcactctcccggcgacgccgtggcagaaggtcagggcgcacctgacgtccttctccagcaggaaggtcacggcatgaccgacaagctcaccaagcaggactcccccgcgcgcgacaccggcgtggcgatggtgaaggccgagggcgtgcacaagtccttcggccaggtcgaggtgctcaagggcatcgacctggaggtgaagccgggcgaggtgttctgcctcatcggcccctccggttccggcaagtcgacgttcctgcgctgcatcaaccacctggagaagatcaacggcggccggctctacgtcgacggcgagctggtcggctaccgccagcacggcgacaagctgtacgagctgcgcgaccgcgaggtcgccatgaagcgccgggacatcggcatggtcttccagcgcttcaacctgttcccgcacatgacggccgtcgagaacgtcatggaggcaccggtccaggtcaagggcgccaagcgggccgacgcccaccaccgcgcgatgaacctgctggagcgggtgggcctcgccgaccgcgccgggcactacccctcgcagctctccggcggccagcagcagcgcgtggcgatcgcccgcgcgctggccatggacccgaagctgatgctgttcgacgagccgacctcggcgctcgacccggagctggtcggtgacgtcctggacgtcatgcgcgacctcgccgagtccggcatgacgatggtcgtcgtcacccacgagatgggcttcgcccgcgaggtcggcgacagcctggtcttcatggacgagggtgtggtggtcgagtccggccacccgcgggaggtcctgaccaacccgcggcacgaacgcacccagtcgttcctgtcgaaggtgctctgacgcccgccgcggcatgcggcggcgggcgtacgaaggggcggtcgtgcgtacgaaggggcggtacggaatctccgtgccgccccttcgcgcgacggcgcgtgtcctcgcgcgggcccctgcttcagcgtccctgcttcagcgccagcagcaacgtgtccgacggcgagcaccacaccggccgggcctccgcgaagcccttctcgcgcagcacgcgcgcgtgccaggcggcggagggcatgtcgccgtcggcgtgctccccgtagatctcgaagcggcgcgcggtcggtgcggccaggaccgggtcctcggcggccacctgccaccactcggcccagtccagggccccgttccgcttggccgcgtccatgcgcgcgtgccgctgggcgcgttcggccgcgttgatccgcggggtcgtctcgtcgatcatgtggtccgcgttcatgaacacaccgccgtcgcggacgagttccgcgacctgaccgtagagggcggcgaggggttcgctgtgcagccagtgcagggccgtggcggtcagcacggcgtcgtaggagtcgtacggcagcttcgccgtccagtcggggtccttcaggtccgcggtgacgaaggagacccgtttgtcgccctcgaaggtgccctcggcgatcgcgagcagcgccgggtcgaggtcgacgccggtgctggtggcctcggggaagcgggcgagcaggcgggcggtgatggtgccggtgccgcaggcgaggtccaggacccgcggcgcggcgccgaccagggcctcgaccatgtcgagcatgatgctgaagcggtcctcccggtcgggcatgtaccactcctgctgccggtcccagctctcctgccaggcccgccagtccgtgcccggcgccgtgatgccgccgtccgtcctcgtgatgtccgtgcccgtcctcgtgatgtccgtgcccgtcctcgtgatgtccgtgcccgtgtcggtcatcgccgccctccctcacccatcgcctgcgtaataccctggaaccacgaccggctcttacaaggtcgtgcccgtcaccatagagcgcccgcgtaaggactacaagtggaactggcctattactcggattacgccgtacgtctcgtcaacagcgaggaaccgggccggggcaaggacgtcctgaccacggtggaggcggtccgggacctgttcggcgccaacgcctcggcggcccgccgggccacggatgccgacgtcacccgcttccgctcggtacgggcccggctgcgcgcggtcttcgaggcggccgaccagggcgacgagaccctcgcggtcgccctgctgaactcactgctgctggagttcccggtgagtccgcagatctccgggcacgaccaccgtgacgacgacggccgcccgctgtggcacatgcacctggccgaccacccgtccaacgccacggcgggatacgcggcgatcgcagcgatgggcctggccttccatctgacggagtacggcgtggaccgcctgggactgtgcgaggcggccccgtgccgcaacgcctacctggacacctcgaccaaccgctcgcgccgctactgctccgaccgctgcgccacccgcgccaacgtggccgcctaccgggcccgcaaacgcctggaggccgaccggtcggtgaagacgggtctgacggccgacagcacccagcgcgcccgggcgaacggcgagcgctgaacggcctggcgcggccggtaacgcagccacacctttcccagcaccagctcggcgggcacggtgccgtagtcggtgctgtccccgccggcgtacgcgttgtcgccgagcacccaccagccgccctcgcgccgctccgccgcccgcttgacgacgagcaggtcctgctggaacggatggcgcagcacgatcacgtcacccggacggacgcgggcgccgtactgcaccacgagccggtctccgtgatgcagcgtgggcaccatggacggcccggtcacctcggccagcccgaagggcagtacggcgcccctgcgctcgctctcctgcaacagctccggcatccccggcacctccccggtccgttcctccaccagtctcagtctgaccctggacttttgtcctaagccccagggggcacccgcgaaaacgggccttgcacggagtaatgtcccacctgagaagacgatcacgaggaaggaatgctccatgctttcccgcctgtttgcccccaaggtcaaggtcagcgcgcactgcgacctgccctgcggtgtgtacgaccctgcccaggcccgcatcgaggcggagtcggtgaaggccgtccaggagaagatggccggcaacgacgacccgcacttccaggcccgcgccaccgtcatcaaggagcagcgcgccgagctggccaagcaccacgtctccgtgctgtggagcgactacttcaagcccccgcacttcgagaagtaccccgagctgcaccagctggtcaacgacaccctcaaggccctctcggccgccaaggcctccaccgacccggccacgggtcagaaggccctggactacatcgcccagatcgacaagatcttctgggagacgaagaaggcctgaaccacaggcacggtccggtgaccggcgggcggtgcaccaccgcgggccgctcggacggcgaaggggcccggccgcacggccgggccccttcgcggtgagcggggccttcgcggcgggcggatccttcccgaccgcgggtccttttcggcgggctgcgtgcgatgctgggccggtgataccgcgagaggatctggtccggctgcggcgggcccgcgaccggatggaccgggagtacgccgagcccctggacgtggcggcgctggcgcggaccgcgctgatgtcgccggggcacttccagcgcagtttccgtgaggcgtacggagagaccccgtacacctacctcatgacccggcgtatcgagcgggccaaggcgctgctcaggcggggcgacatgagcgtcacggaggtgtgcctggcggtggggtgcacctcgctgggctcgttcagttcgcgcttcaccgaactggtcggcgagaccccgagcgcctaccgggcccgctcgcacgaggcgagcgcggtgatcccgacctgcgtgtcccgcgctttcacccgcccgaggcgcacgggtccaccgcccgcgccatgaccggaaactggctagcgtgagggcatggacctcaaactgcgtcagtgcttcatcgccgtggacgatcacgacaaggcgctcaccttctaccgcgacgtgctgggactggaagtccgcaacgatgtcgggttcgaggggatgcggtgggtgaccgtgggctcgccctcgcagcccgatgtggagatcgtcctggagccgcccgcggcccatccggacatctctcccgccgacaaggagatcatggcccggctgctggccaagggcgtgctgcggggcgtcaacttcaccacgagcgactgcgacgccctcttcgcgcgggtccaggagtacggcgccgacgtcgtccaggagccgatggaccagccctacggcgtacgggactgcgcgttcagggacccggccgggaacatgctgcggttcatgcagcgcgcccgggagtgacgtgcggccgggcgcccagacgaggttctccgtcccgagtgccccctcctacgatcacgccatgagcatccgatggacgtacgccttcgtcgaccggcccgccgaacacttcggccgtgccctggacttctgggcggctgtcacggacacacagccgtccgaacgccgaggcgaactgggcgagttcgccaccctggtgccgacgggcgcgggcaccggcgccgacgcctgcggcaaggtgcaggccgtcgccgacggtgcgggcggcgcgcacctcgacctcgccgtcgacgacgtaccggggctggtgacggcggccgtgcggctcggcgccgcggccgtcaccgaacacgagggatggacggtactccgttcaccgggcgggcagttgttctgcgtggtgccctggcacggtgagtcggtccgcccgcccgtggtccgcggcagccgcctggaccaggtgtgcctcgatgtcccgccctccgtcttcgccgccgaagtcgccttctggagcggcctcctgacgggatgggagtcgctgcccggctcccggcccgagttccatgtgatcgcgccgccggccggcctgccggtccgcatcctgctgcaacggctggacgaggaacggcccgccaccgcccatgtggacctggcctgcacggacatcggcgccacccgcgcctggcacgagcgcctgggcgcgacccacgtggccgatcacccgcactggacggtactgcgggacccggccggcgctccgtactgcctgaccggccgcgacccggaaacaggcggcctgccgcgccaagcccccgccgacccgccgcagggctcctgaccggctgttgtgtccctctcccccctctcgcagccgcgcgacccgatcccggtctcccgctccggccccctccctcccgctctctcgactccgcaagcggcgccgatgcgggcgtcgggtgcactggccggtgccggggcggtgaggtggcgggccccgcacaccgtggggcagtgcgggaccccccgagccggagcccccccgtccgtacggggtcaggaaccgtacgggcccggggccgccggagcctggcgcacgcctcagctggtgcgtctggtcacgaactcggccagcgccagcagtcccccggccgcggcgggatccgggacggcgcgggaaagctcgtggacggcctgggccatccggtcggccgcctgggactgcgcccagtcccggccaccggcccgctccaccgccagcgcggcacgctcctcctctcc

SEQ ID NO: 453 - DNA, 2684 bp, Unknown
  Kingdom: Bacteria, Phylum: Actinobacteria, Class: Actinobacteria, Order: Streptomycetales, Family: Streptomycetaceae, Genus: Streptomyces
gtcgccgctgcggtacatgcggctgccggccgggccgaacgggtcaggcacgaaccgctcggccgtcaggtccgggcgcccgaggtagccgcgcgcgacccccggcccggcgacgtggatctcgccctcggcaccggccggcacctcgtggccgtcctggtcgagcaggtggacggtgaggtcggagagcgggcggccgaccgggttgcccgcgccggacgcgaagtcccgcttggtgagccggtggtaggtggtgtgcacggtggtctcggtgatcccgtacatgttgaccagcgaggtccggcccaggcccagcttctcggtccagggccggagtccggcgatctccagcttctcgcccgcgaagatcaccgcgcgcaggctcagctgcttgacgcggcggtccccggcggccgcggccgtgacgagggagcggaaggcggtgggcgtctgggagagcaccgagacctcctcctcgacgagcaggccgaggaactcctccgggctccgggtcaccgcctgcggcacgacgaccagccgcccgccgtgcgcgagggccccccacatctcgaagaccgacacgtcgaacgcgtacgagtgcgccatcgaccagacatcggactcgtcgaacgcgtaatgctcctgcgcactctccagaagccgcaccacgttccggtgagtcaggacgacacccttgggacgccccgtcgaacccgaggtgtagatcgtgtagatgacgttgtccggatcgctcacccgcaccggatcaccggccggagcctgcgccagcgccgccacggtcgactcctcgtccagcaccaccacattgccggaatacacagcggaaagagccggcagcagagcggacgtggtgatcaccgtcctcgcgcccgcgtccccgatcacgaaaccgatccggtccacaggattcgccggatccaaaggcagataacccgcacccgacttcagcacccccagcagcgccggcaccagatccgcaccccgctccagatgcacacccaccagatcctcaggacccaccccggccgcacgcagcacgtgcgccagccggttcgcccgctcgttcacctccgcatacgacaacgacaacccacccgcgaccaccgccaccgcctccggcgcctccaccacccgcgcctcgaacaactcatgcgcgagcacggtgacggactcgaccggtccggcggccgaaggccggtcccgcacggtgagcggggcgtccaggtcgccggccatcgactccagggcctcgcggtacagcgcggccaggcgctcggcgtggtcgcgggtgatcaggccggtgtcgctgtggatgccgatcttccggtcgccgtgggcgtgcacggacaggccgaactcggtgggcgcctcgctgatgccggtggtcgtgtcgacgagttgggcgtcggtctggtggaagtcgatgtagttgaagtggacgtcgagcaggcgctgccggccgccgaaggcgcgctggacggcgggcagcgggtagcggcggtgttcccaggcctcggtctcccggcggtagacgcggtcgatcgcctcgcgccaagtggcggcgcccttggtgtacgggaagggcagggtgttgaggtgcatgccgatcacccggtccgcgccgacggcctcgggccgggcgtggaagacgacgccggtgtggaaggcggtggcatcggtgagccggcccatgacctccaggtgggcggtgagcagcagggtcttcagcggcacgccggcctcggcggcccgctgcttcagcgcgtcggcgagccccgcgagggggacgtcgatgccgtagggctcggccgtgacggcggggtcgccggcccaggcggcgggcggtacgaggcggctgtggtccttgacgacccgctcccagtaggcgcggtcggcggcgctgtccagcgagtcgagctcgccggcgacgaagtccgcgaagcgcaccggcggggcctggtacggggcggtgcggcccgagtcgcggagttcccggtaggcgttcacaagctccatctccagggtgtgctggctccagccctcgatgatcacgtgggactgggtcagggtcagccaccacgcgtcgtcgctctccaggtggacggcgacgcggtacagcggggcggtgcggaagtcgaacaggtcggcacgctcggcggcgacgaacgactgcagttcgcgttcgccggcgacccggtcggtgcccctgcagtcgtgcacgacgaccgggacgtcgacgtccgcgtggacgatctgcaggggcacgccgtagccggtgacgtgcaccgaggtgcgcagcacgtcgtggcgtgcggtgacgacggcgacggcggcacgcagcgcgtcggcgtcgaaggggcggtcgtcgcggatccgcttggaggcgacgatgtggtagctgttgcggccgtcctcggtgaggagttcggcgaccatgccgagctggacctgcccgagggggtaggcgtcgacggcgtcggcgggcagcagcgcccggtccgcgtcggagagcagcgcgaacggggcgacggcggtgctctgttccgtcagccctgggcgctcggcggcgcgggcggcgagggcggcgaccgtgcggtgctcgaagacgtcccgtacggagatgtcgtagccgcggccgcgcagggctccgacgacggtgacgg

SEQ ID NO: 454 - DNA, 6720 bp, Unknown
  Kingdom: Bacteria, Phylum: Actinobacteria, Class: Actinobacteria, Order: Streptomycetales, Family: Streptomycetaceae, Genus: Streptomyces
cgccgctcaggacgccctgagcggcgagcagcgggcgcagtgccccggcccgcaggcgctgcaccagcggtgtgcagaaccggaaggccagcagcacgacgaggaccgagacgaggctgccgaccagggcgccgacggcgacgtcgtgcgggtagtgcgcgccgacgtagacccgggaggcgcccatcaccacggcggcgagcagtgcgatcgagcccagccggcggctgacgatcagcagcgcgatcgcgaaggcgaaggcgaccgtggtgtggttgctggggaaggcgtagtcgtccaccggcgggcacgcctcgatgaggaagtcgtgcggcagggcccggcaggggcggggctcctcgaagacgtccttgatgccggtgttggcgacgtaggcgatgacgacggcgaacggcgtggccagcacggcggccatcaccgagttcccctgccgccgggcgccccaccaggccgccagcagcaggagcacgaagacgcccatgccgacggaggagtaggcggcggccgtcccgttcagccagtgcgtgtggcgggcgaagtcggtgacgtcggtgtagaggccgccgtcgatggacgcgccgtcgagcgcaagggcggtcggggaggaagtcgtcatcaggtggatctccgggccaggttctctagagtgcgggagcgccgcggcgaacgctcgtgggtgcaggagtggaatcctcgtgaagtcggattgtccgacggatgaacgtctacaggttggtagacgttagcagccggaggtgtggttgcccggacggacggccccccgatgcgcatgtgacccacctcatgcgaggcgggtgggggcgtcgacggtgacgggaaaagcagagagcgggtgcgggggaggagcgtttcgctccttcccccgcacccgctcgggcgacagggcctgcagggcggccggacggccgcgggggatcagcgcaggcgcagggcctcgcggatcgtggtgaacaggtcggtctggttggtgacgccgaggacgcggtaggcctgcgggccctgggcggcgatgcggacctcggtgccggtgtgctcctgggactggccgggcgtgttggtcgagtagttgaccttcagctgctggccctcgtcggtgaccagcgtggaggacaggccgggcggggtggcgtccaccgggacgatctggctgctgtggccgtggtcggcggtggtcaccacgagggtgtcggggtgcttggcggcgtagtcgcgggccaccttgaccgcgcggtcgaaggccgcggtctcaccgatctggccgcacgggtcggcggcgtggtcctgcttgtcgatcgaggcgccctcgatctgcaggaagaagcccttgtcggagcggccgtggccctgcttctgcctggcctccaggagctggatcgccttggtggcggagtcggccaggctcggcgtggaggcgggacgctgcgagttggaggtcacgcagcgctgcggggccgtaccgccgacggcggcacccttgccggtccactccaccggcacgttcccctgggcgaacaggccgaggaccggcttgcccgccttcgccgccttcatcgacgcggcgtcggtgacgacctggtagccgagcttctgcgcctgctgggtgacggtcaggcccttgtacttcccgtcggtgaccttctggtcgaagcgctgcttgccgccgccgaagaggacgtccacctggtggttgacggactgctcggcgatggagccggggccgcccgccttgacggtgtccgtggggcacttggccatgtcggccgggccctggcaggagcggtcggtgacgtgcgaggcgagcaccgccggggtggcgtcggtcagctcggcggtggtgacgctgccggtcgcgtagccgttcttctgcgccagctccaggatcgtcgggacggccttgtccgtgcccggcgtcttggagatgcggccgttgaccgtcttctggccggtggcccagccggtgccgcttgcggcggagtcggtgacgtagtccggggtgccgtcggcgtgcaccgcgtacgtcgtgtaggcgccggtgagcgggaaccggtccatgttcaggcggccggccgcgcccaccgtgtagtcacgggcgagggtgatctcggagtcgcccatgccgtcgccgatcagcaggatgacgttcttcgccttgccgccctggacggcgtgccgggcgtgctgcgccgtgtccgaggcgccggcgaccgtggtggcggtcagggcggccgcggtggcggcggccagcgcggtggcgatcgtgaggtggcgacgggtgggtctgtgcatgggagcgactccttggaacggccgtacgacgggtgtggcgtacgggtgccttgcggctgccgacggagtgcagcccaccagctgttggtgaacccaggggaaagacctgacccggccttggttgcgcgggcatgacagccgcccgcgttcaccgagccctcggctcggtccgtacgggagttccgccggtcgggccgttcagtccgtacgggagttccgccggtgcgggccgttcagtccgtacgggtcgcctcgggcggtgccgccaggacgagctgggtcagcggggtgtcgtcgccggagtcgagcgtgacccggtacagccccggcgccggcacggtgacgcggccggcgacgacgtcctcgtcgtcctcgccgtggtccccggcaccgccggcctcctcggagtacgggtcgtacccggcgaacagggcggtgcgcgcgcggaagccgcccggcgcgcccacctcctcgaccgtgcactccagccccgccgggccgtccgcgccgtgcacccggaccgtccagtccgcgccgggcgcgacgaggtccggcacccgcagcccgagccccgccgcggcctgcggcggaccgaggtgctcgtcctcctccaggaacgaggtgaccgcgtccagcgccgcctgccccttggccagcgccccgtgctggagggccagcggcaccgtggcccgggtcagcgaggcggactccctgtgcacggttccgtcgcccgcgacgtcgaaccggcgcggcacgccgtccccgtcccgcatcaactccccgtcgctgtgctgccggtagcagtgctcgaacggcaccacgacgccctcgcgcagcgccagcgacagcgccgccgcgtcggcaccggcgatcgccttcgcgacgtcctgcacgcgcttgccgaaccgcttgcccagcgcacggaagttggccttcgcggtggtgtccaccagcgaaccgccgacctcgctcagcgacgccagcgaggagacgttcagctcctccgtgatctgcgcgtgcagttcgcggtccagggtgtcgaagcccgccaccgcgaccagcgcgcgcgacagcggctggcgggtcttgacgcccgactccgcgcgcgtggcccggcccagctccacgagccgccgcaccagcaccatctgctgggacagttcggggtcgatggccgacaggtccgcctccggccaggcggccaggtgcaccgactccggggcgcccggcgtgaccggcacgatcaggtcctgccagacccgctcggtgatgaacggggtcagcggggccatcagcttggtcaccgtctcgacgacctcgtgcagcgtgcgcagcgcggccttgtcgccctgccagaaacggcggcgcgagcggcggacgtaccagttggacaggtcgtcgacgaacgcggagagcaactttccggcacgctgcgtgtcgtaggcctccagggcctgcgtgacctggtcggtcagggcgtgcagttcgctgagcagccagcggtccaggaccgggcggtcggccggggccgggtcggccccgctcggcgcccagttcgacgtacgggcgtacagcgcctggaaggccaccgtgttccagtacgtcagcagcgtcttgcggacgacctcctggatggtgccgtgtccgacacggcgggccgcccacggagagccgccggccgccatgaaccagcgcacggcgtccgcgccgtgctggtccatcagcgggatcggctgcaggatgttgcccaggtgcttggacatcttgcggccgtcctcggcgaggatgtgacccaggcacacgacgttctcgtacgacgacttgtcgaacaccagcgtgccgatggccatcagcgtgtagaaccagccgcgggtctggtcgatcgcctcggagatgaactgcgccgggtagcggctctcgaacagttccttgttcttgtacgggtacccccactgcgcgaacggcatcgaccccgagtcgtaccaggcgtcgatgacctccggcacgcgcgtggccgtcgcctggcagccctcctgcgggcaggcgaaggtgacctcgtcgatgaacgggcggtgcgggtcgaggccggactggtcggtgccggtcagctcggtcagttccgcgcgggagcccacgcaggtgaggtggccctcctcgcagcgccagatcggcagcggcgtgccccagtagcggttgcgggacagcgcccagtcgatgttgttgttcagccagtcgccgtaccggccgtgcttgaccgtgtccgggaaccagttggtcttctcgttctccgccagcagccggtccttgacggccgtggtgcggatgtaccaggacggctgggcgtagtacagcagcgcggtgtggcagcgccagcagtgcgggtagctgtgctcgtagggcaggtgcttgaagagcaggccgcgctgctgcaggtcctcggtgagctgttcgtcggccttcttgaagaagacgccgccgaccagcgggacgtcctcctcgaaggtgccgtccgggcggaccgggttgacgaccggcaggccgtaggagcggcacaccttgaggtcgtcctcaccgaaggcgggggactggtggaccagacccgtgccgtcctcggtggtgacgtactcggcgttgacgacgaagtgcgccggctcggggaactcgacgagctcgaacggtcgctggtaggtccagcgctccatctcggcgccggtgaacgactcgccggtggtctcccagccctcgccgagcgccttggcgagaagcggctcggcgacgaccagcttctcctcgccgttcgtcgcgacgacgtaggtgacctccgggtgtgcggccacggccgtgttggagaccagcgtccacggggtcgtcgtccacaccaggagcgcggcctggccggccagcggtccggaggtcagcgggaagcggacgtagacggacgggtcgacgaccgtctcgtagccctgcgccagctcgtggtcggacaggccggtgccgcagcgcgggcaccagggggcgacgcggtggtcctggaccagcaggcccttggagaagatctccttcagcgaccaccagacggactcgatgtactccgggtccatcgtgacgtaggcgtcgtcgaggtcgacccagtagcccatgcgggtcgtcagctcggagaaggcgtcggtgtgccggagcacggactcacggcacttgtcgttgaaggccgcgatgccgtacgcctcgatgtcctgcttgccggagaagcccagctccttctcgacggccagctccacgggcaggccgtggcagtcccagccggccttgcgggccacgtggtagccgcgcatggtgcggaagcgggggaagacgtccttgaagacgcgcgcctcgatgtggtgggcgcccggcatgccgttggcggtgggcggcccctcgtagaacacccattcggggcggccctcggactgctgcaggctcttggcgaagatcttctgctcgcgccagaagtcgagcaccgcgtgttcgagcgcgggcaggtcgacctgggcgggcacctggcggtactgcggctgcgtgttcaacgagcttcctccggcggatgtgctgccttccgtcggagggacgagagccttcgtgctgcctacgccgtgtgcggcgcgctcccgcggtaccaccctccttggccccccggtgcgccctgtgctccggtgagccccctcattgggctcgcgatgccggttctactcgccccgtggggctttcttccgacggctccggggtgatcttcacgtcgcgctcgcccccgggctcccaccgtccccgggtcgctctgggctgcttacgccgctactcgtccccatccacgcttctcgctccgcccagtgtacggctcgccggggacagcggccgaccggttttcggcgcggggccggagcgggcggggtcatggaggaggcgggccgtgggtgacccgaacggcgccggtgcggtcggtcggatcgtaggacacccagctcgtcggattacccggcggggagctgggcacaacgcatgcatgccgggcgcgcgggacgcgcgaggcgggcgaatcgggcggcgtgccccgttgccgcgggactcaagtcgatttatcgtcccagcacgattcgcgagcgagatcacaatatgtgaaggggccgcggccatggtggcgaagaagaccgccgagcagtcggcgtccggcgggtcccggcataccggcgcccgcggtggcgcgacagagcccgcggaccgcaggaccacggcgacggcgaagagatccgcggcgcggcagaccgggacggcgggtgaacccgcgcgcgggaagcccggtgccgggcatgccaccggggcgcagggcgcagccaggacgccgcaggaggccgggag

SEQ ID NO: 455 - DNA, 1616 bp, Unknown
  Kingdom: Bacteria, Phylum: Actinobacteria, Class: Actinobacteria, Order: Streptomycetales, Family: Streptomycetaceae, Genus: Streptomyces
ccgacgggctggatgttgaggtacatccccgcgacccggtcggcgccggccgcctcgggccgtacgtgcgcggtgaggccggtgaggaaggcgggctcgggggtgagcaggctgagcgccttgaggtgggcggcgaacagcacgctcttcagcggcgcctgcgcgtcggcggcgagccgctccaggccgtcggcgaggtcggcgtacccgacgtcgaggaggtacatgtcctgcggcgcggccgggtcgctctcgccccagccaggcggcagcgtgaaccgttcgtgcgcggcgacgacgcccttccagtacgcccggtcctcctcgcgggccagggcccgcacctcggcggcgacggtgtcggcgaaccgcacggcgggtgcctcgtggccgggcagccgcccgatcagcgctccgtcgtacagcgcgagcagctcggtgagcaggatgcccaggctccagccgtcgaggatcacatgggagttgacggcggtgagctggcggcttccgtcggcgcacaggtgcacgctcaggtcgagcaggggcgcggcggccgggtccagggcggtgcggctgcgctcgtcgacgtacgcctcgatcgcggcggcggccccgtcctcgtccaggtccgtcaggtcgacgacgcggacggggagtgcggcggtggcgtgcacgagctggagtggcacggagtacgtgtcgaggtcgacgccggtgcgcagcacctcgtggcgggcgaccagttcgtcgacggcgcgctggaaggcggcggcgtcgaaggcccggccgtcgcggacgcggaggctggtgacgaggtggtagtcggggcgctcggccgccgacagcatctcgatctgcatgccgagctggttctgggtgagcgggtaggcgtccaccacaccggcgggcagcagcgcccggtcggccgcggtgatctgggcgtacggcgcgaccggcaccaggggttgggcgggcgcggtgccggtgtgccgcccggcgagcagctcggcgaggtcgccgaggaccgggtgctccatcagctcgcgcacgctcagttcgtacccggcgtcgcgcagggtgccgacgaccaggacggcacggatggagtcgccgccgaggtcgaagaagctgtcgtggacaccggcgcgcgcggcgccgaggacggaccggtagacgcccgccaccgcttcctccagcggggtgcgcggagcgacgtactcggtcgccgggccgagcaggccgccctcctgcgggcccggcagggcacgcttgtcgagcttgccgttggtggtgagcgggatggtgtcgagggccacgaaggcggacgggaccatgtagtcgggcaggtcgcgggccagttcggcccggagcgtgcccgcgtcgggcaggttctgtcccgccgcgaccaggtagccgaccaggcgcttgtcgcccggggtgtcctcgcggacgaccacgacggcctgcgcgatggcctcctgggccgtcaggcgggcggctatctcgccgagttctatgcggtagccgcggatcttgacctggtcgtcgacgcgtccgacgaagtccaggctgccgtccgggcggcggcgcgcgaggtcgccgctgcggtacatgcg

SEQ ID NO: 456 - DNA, 2375 bp, Unknown
  Kingdom: Bacteria, Phylum: Actinobacteria, Class: Actinobacteria, Order: Streptomycetales, Family: Streptomycetaceae, Genus: Streptomyces
tgggagcggcgttcgtgatgctcgtcgtcgtcctgcggagcctgctgcgcaaggcgacggacctgcagaccgagatcgccgaggtgatctgatggcgatcgtcgtggacctcgacgtccagctcgccaggcaccacctgtcggtcgccgagttcgccgccgcggtcggcatcacgcccgccaacatcgccgtactgaagaacggccgcgcgaaagccgtacggttcacgacgctcgacgcgatctgccgcaccctcggctgccagcccggcgcccagctcaccctcgtcgggcacccagcgcagtacgtcgccgggctggcagccgagggtgcggcagatcgcgtcgagcgtcgtgaaccgtacggctttcgcgcggccgttcttcagtacggcgatgttggcgggcgtgatgccgaccgcggcggcgaactcggcgaccgacaggtggtgcctggcgagctggacgtcgaggtccacgatgatcgccatcagatcacctcggcgatctcggtctgcaggtccgtcgccttgcgcagcaggctccgcaggacgacgacgagcatcacgaacgccgctcccacgccggcgcacgtgaccgcggagaaccatgcgctgatgacctccatgccgtcgccgggggaggggatgtcggccagggcgaggtgcccggcgaccccggtcaccagcagcgtcgccacggtcgcggccccgatgatggtgtcgacccagcggaaggcacgcggcgtgaagatcgcaccgtggcgcaccatggcgagcagcttccacagggcgacgaggccgacctggacgcaggccacgcagacgatcgccacggtctcgtagggcacggcgaagggagcgtacggagggaagcggtccacttcgtcggccgccgtcgccgggatgaccacgagctgaccgaagagcccgacgaggaccgccgcgacggtgccggcccggagcacgagtatgaagagacgaggcatgtatcgattatcgatcgattcctatcgaaaatcaatcactgacgtccggaacctgcccctggagctccgccaagtcgcccctgaactctccaccgtccgttcggaatcgtgcgttccatgtacggagttgtccgatacgggcctggtggaacggcgttgaggcacggtcactacgatcggggtcaagacaacagttcggccggtgcgcgatggtgggcgccggccggggtcgccgatgccagggtccgctccccgggctgcggtgatcttcctacccaggaggacctcccgcatgttccgacgcattgggaacatggtcgtccgacatcctgtctggacgatcgtggcgtggctgatagccgccgtggccatcgtggccaccgccccgagcctgccctcgaacagtgacgagagcagctttctgcccaagagttacgagtccatcaaagcggcggacctgcaggagaaggcgttccccagcgccttcaccccgtccgccatcgcgctgtaccggcgcaccgacggcggcgcgctgaccgccgccgacaagcaggacgtcgcccggatcacctccgaactgggcaagaagcacatcgaccaggtgcagaaggtcgtccccggcccgccgtccaaggacggcaagtacgccatgacgctggtccagatggacagcaagaaggccggccagcccgaacagaccgacgcggcgaaggtgttgcgtacggacgtcaaggaactggccaaggggacgcacctggaggccaagctcggcggttcggccgcgcaggcgctcgaccaggaggactcgtccaaacgcggtcaggcgctgatcggcatcggcaccttcgcgatcatcctggtgaccctgctgatcatcttccgggcgccgatcctggccgtactgccgctgatcctgatcggtctggtgtccgccatcgccaacggactgatcgcctacgccaccaagctgttcggcctgcaggccaacagctcgatctcgtcgatcctgatcgtcgtgctcttcggcgtgggcacggactacttcctcttcctgatgttccgctaccgagaacgtctgcgcgccggtgacgaacccaagcaagccatgatcaacgcggtggaccgggtcggcgaggccatcgcctcggccgccggcgcggtcatcatcgccttcctcgccctggtgctgtccacgctgggcttcctcaagcagatgggcccggcgctggccatcgcggtcgccgtcaccctggtcgccggcctgaccctgataccggcggtggtctcgctcatcggaccgaaggtcttctggccgtccaagtcgtggcagcgcgagccggacaacgcccgcttcgcggcgctcggccgcggcgtccagcgccggccgg

SEQ ID NO: 457 - DNA, 2430 bp, Unknown
  Kingdom: Bacteria, Phylum: Actinobacteria, Class: Actinobacteria, Order: Streptomycetales, Family: Streptomycetaceae, Genus: Streptomyces
cacaagcggcaggcagggcagcgcgagcaccgccgtgccggccgcgaaggcgagcgcgaggcccgtcagggcgctgcgcggcggcagccggtcggagcccgacaggaacagggtggcgcccagcacctgcgcgagggactggccgaacatgctcaccgcggacagcagcggcgagccggtcgcccggtagacgagggtgccgagcgccaggccgctcatcgtctgcgcggcggtctgggcggcggcggagaggaagagcggggtgaactccggggtgcggaagaggtcctggtagctgcgcatgcgctggagtctgggcgggtacgggggcgcacgttactgtttcgcgctgacgcgaaacgacgacggcagcagcggcagcgacggcagcgacggcagcggcggcagcagcagcagcgacggcagcggcagcagcggcagcagcagcagcagcgacgagggcgacgacgggcagggcatgggctggtggcaggtcaacgcggacacgctcgccgggagccggttcgtgctctcgccgctggccgagaccttcgcgagcctgatcctgctgcacaagggcgcgggcgggtacgccggcgcacaccccggcgagcaggcctggctgcgcgcacacctgcccggctaccgggcacgtctggcccgtgacccggtcaccgcgctgctcgtgcggacggggctcggccgggagtggatcgccgacttcctcacgcccacgccccgcgacggcgagtccttcgccgaggaggtggcacgggtacgggccgccggcccggccgccgcccgcgcgcacctgcggaccgctttcgcgggagccgtcccggcggaactggagcgggacgacctgcccgaccgcgcggccggactgctggagtacgtctgggcggaggccgtacggccctcctgggaccggcggcggcgcgtcctggaggccgatgtcgtggcgcggaccgcgcagatgggccggggcggctgggcggccgtgctggacgcgctgcggcccgggacgcgctggctcggcgagaaccggttccaggtcaacctgcacgagtatccgccgcgcgagatctccggcgcgcagctcctcttcgtaccggtgacaccgcagcacggctgggtgtcgtgggacgagccggagcgccggtacgccgtcgtctacccgtgcgcgggcgtgctggccgccggtggcggcggacggcggcgtacgaccgtgcccgcggcgctcggggcgctgctgggcggggcccgggcgcaggtgctcgtcctgctcgactcgccgctgagcaccacgcagctgaccgcggtgaccgggcaggcgctgggctccgtcggacggcacctgcgggtgctgctggacgcgggactggtggagcggcgccgggccgggcggtcggtgctgtactcgcgcacgggcgcgggccaggtcctcgtcacggccgcctccggcaccgggacggacgggaagccggtgacagggcctagcatccggacatgaccactgcagagagcaacagcggcgccgctccccagggttctcccctcggtgtggagatcggcgccctccagggcggtccggcgaacctcgggcagtacgcggggcgggtcgtactcatcgtgaacgtggcgtcgaagtgcgggctcaccccgcagtacgccggactcgaaaagctccacgagcgctacgcggaccagggcttcaccgtgctcggcgtgccctgcaaccagttcatggggcaggagccgggcagcgccggggagatcgccgagttctgctcggcgacgtacggcgtcaccttcccgatgaccgagaaggtggaggtcaacgggaagggccggcacccgctctacgagcgtctggcgggcttcgccgacgccggcgggcacagcggtgacatccgctggaacttcgagaagttcctcgtcggacgggacggcacggtcgtcgcccggttcgcgccgcagaccgagccggacgctcccgagctgatcgcggccgtcgaggaccggctgggctgagcaccgtgtgaccccgcggcttcggccgcccctttgaccttgcccctggggcagggccgagtctcctggtcaccgggcgggagggacccgtccggtgacggaggatggcacggtggacggggacgacgaagagctgctcaccatcggcgcgttcgccgcgcggtcccggctgtcggcgaaggcgctgcggctgtacgaccgcctcgggctgctggcgcccgcgcacgtcgacgaggccagcggctaccgctactaccgcgcctcgcaggccgagcgggcccggctggtggcgctgctgcgccagctggacatgccgctggcccgggtggcggaggttgtcgcggcggtggaggcggacggcgccggtgcggccggtctgctcgccgcgtactgggc

SEQ ID NO: 458 - DNA, 3524 bp, Unknown
  Kingdom: Bacteria, Phylum: Actinobacteria, Class: Actinobacteria, Order: Streptomycetales, Family: Streptomycetaceae, Genus: Streptomyces
gccagcagcgccacggtgacgccgtgcacggcgagggcgatcgcgtacgcgagtaccgcggcgccgtcccgccgcgcgcgcagttcggcgccgccctgcgtcacctcggcgtgcagcttctcgccgtaccgccgcgccagggcgcgccgggcctcctccagcctgccctgcggcctcggccgccttccccgccgacgcccgtccgctcgtgcctcctgctgctcccgcttctcctgctcctcctggtgaagcctcgggtcgacgttccagtcgcaggccgcgcaccagacggtgaaccggtcgtccacagggacctcagccccgcattccgggcacggctgtgtcgtttcccccacggcagcaggcatgaaggccttctctcccctccccgcgacccctccccaagggccgcccgaacatggcagaggaatctgatcacgcgagccggcgccggtaaagcggccggcttcaggaccgccgccggaacagcctccccagcccgaacaccacgaggaccaccgcgagcaccgccaccgcgcccgtcgtcagcttgcccgaaatgccgcccttgccgtccgaaggactggaacttccttcacccgcgggggatttggcgtcgccgccgcctcctcccggcgcgtcctgcacctgtacggggctgtcggcgccctccgtgccgtacagcagcttcgtgccgtcggcgctgtaggtgaccgactcgccctgccgttgcagtgggacgtcgaggcggccgaggcgtttgatcctgccgccgttccagtcgtagtagatgccgccgaagtagccgcgtacggcgagctgcttgccgtccggcgagaacgcggcgtcggtggcccagaggtcgacgggggcgatgggcttgaagatgttggtgccggaggcggacaggtgggccgggccctcgaagaggtggccgccgtcctccttcttgtcgatgatgtacacgcgccccgtcttcgggtgcacgatcagcgactcggcgttgcgggcgccgtccgcgtacttcaccacgtactgcgtggcccgcaccgtctggtccttgagcaccttcggctcggggagttcgtagatccacacgtgcggccaggtgccgtcgaggttgtcgccgatgtcaccgacgtagatctcgttgcccggtcctatggagatcgcctcgacgtcgcgggggcggccgacgcccttgagggtgacggtggcgacggtcttgccggtgcggctgtccacggcgtagatgtacgggccgtcgtcgctgtcgttgtgggtccagtagatgccgggatgcaggtgcgaggcggccaggccgctggactccttgatcctcgggtccttgatcgtgaacccgccgttccctcccccgtcggcggcgaaggcgggcggagctacggcgggcacggcgaacgcgcccacgagcagggccccggcgagcagggcggacggtcggcgcatgccccaagcctgccatcccgcgggcgcgttcacgtgaggtggcgggcctcacaccgctgcgcgcacccctcgtgcaccgcccgccgcaccgatcgtccatcatgagcggatgctcaggttcatgcccgtcggtgactccatgacgatcgggagcgcgggcgaacacacatggcgctaccggctgtggcagcacctgcgcgacacgtacgggcagccgttcgccctcgtcggcccgcgcgagacgctctacgacaaggcggcggacgcccccgtgtcgtacgagtacgccgacccggacttcccgcgcgcccacctggccggctggggcgagggctggacgcacatggccccgctgatcggcgaggcggtacgcgcgcaccgggcggacgtgctgctggtctcgctcggcctgatcgacctcggcttctacaccgacgccgagcagaccgcggcgaacgtgcgcgccttcgtcgccggggcgcgcgccgccaacccccgcgtccggatggtgctgctcccggtcatacccaacgtccgcgccgacaccgacgcgcccttcgccgcccaggtctccctcttcaacgaactgctggcgaaggccgtggccgacctggacgagccgcgctcaccgctgctgctcgcgcccccgccggacggctacgacatccaccgggacacctacgacggcacgcatcccaacgcgagcggcgagcacgccatcgcccgggcgttcgcggaggcgatgcacgaggagtggggaatcggacagccgtacattgctggaacaggttgaccggaatccggcgtctcctcgtcacggtgcgtaccgttgttccacgcggccccctctccgtgaggcgaccggggaggagcgccacgatgaccgtcctggaagaccggatcgcgatgaccgactccttcccccgcgactgagccgggtcgcccttgcctggagcgcactccaagccgttggcttggtggtcatggagtacacacagctcggacgcaccggactcaaggtcagcaggctggtcctcggcacgatgaacttcggtccgcagaccgacgaggcggacagtcacgcgatcatggacgcggcactggacgccgggatcaacttcttcgacaccgcgaacgtgtacggctggggcgagaacaagggccgcaccgagtcgatcatcggcaactggttcgcccagggcggcgaccgccgggacaaggtcgtcctcgccaccaaggtctacggcaacatgggcgccgacggcgaggcgtggcccaaccacgacaagctctccgcgctcaacatccggcgtgccgtcgacgcctccctcaaacggctccggaccgaccacatcgacctgtaccagttccaccacgtcgaccgcagcactcccttcgaggagatctggcaggccatcgacgtgctcgtccagcagggcaagatcctctacgccggttcgtccaacttcgccggctacaagatcgcccaggccaacgagaccgcggccagggtcggctcctacgggctggtcagcgagcagtgcctgtacaacctggtggagcggcgcgccgagatggaggtcatcccggccgcgcgggactacgggctcggcgtcatcccgtggtcgccgctgcacggcgggctgctgggcggcgtactcaagaagcaggccgagggcggtcggcgcgccggcgggcgggccgcggactccctcgccgacccggcgctgcgcggcaagatccaggcgtacgaggacctgctcgacaagcacggcctggagccgggcgagaccgcgctggcctggctgctcacccggcccggtgtgaccggcccgatcgtcggcccgcgcaccggcgaacagctcgcctccgcgctgcgcgccgtcgagctggaactgggcgaggagctgctggccgaactggaccagatcttcccgggcccggggccgtccccggaggcgttcgcctggtgagcaaggcctctgcgtgagcgccggcgtgaggcggtgagtgcgcgggcgcggtggtcgtctccgccgcgcccgcgcactcaccgc

SEQ ID NO: 459 - DNA, 5916 bp, Unknown
  Kingdom: Bacteria, Phylum: Actinobacteria, Class: Actinobacteria, Order: Streptomycetales, Family: Streptomycetaceae, Genus: Streptomyces
aggccggtgcgtcctcggccggtgccgcctcggccgaggtgtccgggccggtgcggaccaggcggtcgaggaacacggtcggtacggcgtgccgcgtgaggtaggcgacgaggtcgtcggggttcgcggagggagcgacgatcatgccgtccacgcggcgctcgtgcaggagctggaccacggtgcgttcatgcgccgggtcgtcgtgcggatcggcgatgagcaggctgtacccctgctccagggcgcccgcctcgactccctggaggatctccgtgaagtacgggttgctgatggcggacaccgcgagcccgatggaccgggtccgcgaggtgaccagggagcgggcgagaccgttgggcgtgtaaccgagctgctccaccgcgtcgagcaccgcctgacgggtgtgcggcagcacggggcgggtgccgttcagcacgtgcgagacggttgccacggagaccccggcactccgtgcgacgtcggccatggtcggcatggtgtcccctccccgagtgccccgccggttgtccgtggccgggacggtatcgcatccctgcggcgacgtaaacgcttgcgcaagcgtttacgtcgccgcaccatgcccttcccgctccgcggcctccgtcccgcgacccctgcccccggtcgagcgagggcggtcggtatcgtcgggcctgcacaaccttccgaacaggggagtccccatgccaggccgtccctccgcgagccgtcgtacgatcctgcggacggcggccgtcacgcccgtcgccgggctcgggctcgccgcctgtgggcccgagggcggcagcgcctcggctcccgccaccccgacggcaccggtcgacctcggtgccgagagcgagatccccaagggcggcgccaggctgttccgggaccacaacgtggtggtcagcagggggagtgacggcgcgctgaaggcgttcagcacgatctgcacgcacgcggggtgcgcgatcaacaagctggagggcacgacactggtgtgtccctgccacggaagtcagttcgacgccaccaccggcaaggtggtgcagtcaccggccaccgagccgctggccgcgctgccggtccgcgccgacggcggcaagatcgtcgcggggcccggcgcctgaccgcgcaccctgaccggatcccggccggatcccagccggtcattcccagtcccaggcgagccccacgatccccggccgcacccgtggctcgacgaggtggaccgaacggtgcagcgcgctcaccgtcagctcgtggcggccaccgcgcggtgccgccgccgactgctgggtgaaccggtggcagcgcaccgggagcgcgccggcgtcgaagcgcacctggagcgcgtactgtccgcccgccgagtcgaagctccgcaggtactcccggcacacaccggccgtgccgtcctcgacgccgtagcggaagaggaaggtgtccccggcccgcagcctggtgtcgaagaggaactcggcgacgagcagaccggtgccgtggtcacggcgcacgcgcccggcgcggcagttctccagcgcgtgcgcgcgcatcgcctccggcacgcaccccggatcgccctggtggacggccacgaagcggtccacaccgtcccggcaggcgcgcacgatgtgctgcgactcgcgcccggcgagttccccgcgcgccccgagccgtacacgctcgtggtgcccgagcgcctgcagtccgccgtcgggtggggcgtccagcccggccagcagcgtgcgcagggcgcccgacgtctcggcgagggaacggtaggagcggacgccggacctccgggcgaccgcgcgctccccggtctcggccagcagacggatcagcgactcgtccggcagccgcaggatctcctccagggcccgcacggcccgcagcgactcggggcgctgcgggcgccgggcgccctgctgccagtagctcagactggtcaccccgaccttgacgccgtggcgcgacaggtggtgctgcacccgctgcaacggcagcccgcgggcggcgatcgcggcgcgcagcgccacgtggaacggaccgccccgcagggccgtgtccagttcggcggtggcgacgtcctcctgctggggggcgtgcggcatgcacggggcctctctgtgaaaggtgcacaacggctggtcagaccgttcacgcggatcaccgggaccgcgcgcgggcaggagcgcgggagccgatcgcgcccgtccacgtccgcatgcgtcgtccgcggccccgacttcccccgcattgaagcgtgttgaccaagtcccgacaacacctgtgacccagcggaaggcgctcctggccgagtccgtaccccggtaccggccccgcccggcgcacccgcaccgggccccgcaccgaacgaagagggttggtcacagcaggtagtcgcgcatctgtccgatgggggaccgtgcggccgtgcgggttgtccacaggctcgccgccctgtcacaccgcgccagtagggtgtgagacatggccgacccctccagctaccgccccaagccgggagccgtcccggactctcccggggtgtacaagttccgcgacgagcaccgccgggtgatctacgtcggaaaggcgaagagcctgcgccagcgcctggcgaactacttccaggacctggccaacctccacccgcgcacccgcaccatggtgaccacggccgcctccgtggagtggaccgtggtctccaccgaggtcgaggcccttcagctggagtactcctggatcaaggagttcgacccccggttcaacgtcaagtaccgcgacgacaagagctacccgtacctcgcggtgaccatgaacgaggagttcccgcgcgtccaggtcatgcgcggccacaagaagaagggcgtgcgctacttcgggccgtacgggcacgcgtgggccatccgcgacacggtcgacctgctgctgcgcgtcttccccgtccgcacctgctcggccggcgtcttcaagaacgccgcccgcaccggccggccctgcctcctcgggtacatcggcaagtgctccgcgccctgcgtcggccgcatctccgccgaggaccaccgggaactcgccgaggagttcagcgacttcatggccggccgcacggggacgtacttgcgccgcctggagcagcagatggcggaggcggccgaggagatggagtacgagcgggccgcccgcctgcgcgacgacatcggagccctgaagaaggccatggagaagagcgcggtcgtgctcgcggacgcgaccgacgccgacctcatcgccgtcgccgaggacgaactggaggccgccgtgcagatcttccacgtgcgcggcgggcgcgtgcgcggccagcggggctgggtcaccgacaaggtggaggacgtcaccaccggcgccctcgtcgagcacgccctgcagcagctgtacggcgaggagagcggggacgccgtccccaaggaggtcctcgtccccgccctgcccgacccggtcgagccggtccagcagtggctcaccgaccgccgtggcgccggcgtgtccctgcgcatcccgcagcgcggcgacaagaaggccctcatggagaccgtgcagcgcaacgccctgcaggcgctcgcgctgcacaagacgaagcgcgcctccgacctgaccacccgctcgcgcgccctggaggagatcaccgacgccctgggcctggacagcgccccgctgcggatcgagtgctacgacatctcccacctccagggcgacgacgtggtggcctccatggtcgtcttcgaggacggactccagcgcaagagcgagtaccggcgcttccagatcaagggcttcgaggggcaggacgacgtccgctccatgcacgaggtgatcacccgccgcttcaggcggtacctggcggagaaggaacggaccggcgagtgggccgacggcgaggagacggccgagcccgctgccgtgcccaccgtgcccaccgcgtcctccatgcccgacgggacggccgacgcggcagccggcacggccgtggacggatcacccgacggttcccccggcagctcgccggccggttcgtccggcggcctggcaggcgccctcaccgaggacgacggacgccccaagcggttcgcctatccgccgcagctcgtcgtcgtcgacggcggacagccgcaggtcgccgccgcccagcgggcgctggacgagctgggcatcgacgacatcgcggtgtgcgggctggccaagcgcctggaggaggtgtggctgcccggcgaggacgacccggtggtcctgccccgcagcagcgaggggctgtacctgctgcagcgcgtccgtgacgaggcccaccgcttcgccatcacctaccagcgcaccaaacgcgccaagcgcttccgggccggcccgctggacgacgtgcccggtctgggcgagacacgcaagcgggcgctgctcaagcatttcggctcggtgaagaggctgcggtccgccacaatcgaccagatctgcgaggtacccggcataggccgcaagacggccgagacgatcgccgtggccctggcacaggcggccccggccgcacccgccgtgaacacggcgaccggagagatcatggaagacgtggaagaagcggcgcccgggacgacggcgggcaccgtaggggagcccgtgcccacgggcgccccggccgaacgacgggggcaggagacatgaccgagcacgagacgcagcccacagcgccacgagaacaggcacccgcggcggaacccgaccgggcccgcacggcgtcccgggaacggacacccgcgcggacacgcgaggagacgaacgcggagaccggcgcggacccgcacgcgggcagggacgcgcagaccggcgcggacacgcacgcgccacagcacgaggaccggcggcagggcccggtccaggagcacggagcacaggtgagtacgggcatcgacacggccggcgtccccgacgcggccatccccgaactggtgatcatctccggcatgtcgggagccggccggtccacggccgccaagtgcctggaggacctcggctggttcgtcgtggacaacctgccgccggcgctgatccccaccatggtggagctgggcgcccgctcgcagggcaacgtcgcgcgcatcgcggtcgtcgtcgacgtccggggccgccgcttcttcgacaacctccgtgagtccctggcggacctggaggcacgcaacgtcacgcggcggatcgtcttcctggagtcctccgacgacgccctggtgcgccgtttcgagtcggtgcgccgcccccaccccctccagggcgacggccgcatcgtcgacggcatcgccgccgagcgggagctgctgcgcgagctgcgcggcgacgccgacctcgtcatcgacacctccagcctcaacgtgcacgagctgcgcgccaagatggacgcccagttcgccggcgaggaggagcccgagctgcgggccaccgtgatgtccttcggcttcaagtacgggctgccggtcgacgccgatctggtcgccgacatgcggttcctgcccaacccgcactgggtgcccgagctgcgtccgtacaccggcctcaacgaggaggtcgccgggtacgtcttcaaccagcccggcgccaaggagttcctggaccgctacgccgaactgctgcggctcgtcgcggccggctaccgccgcgagggcaagcggtacgtgaccatcgccatcggctgcacgggcggcaagcaccgctcggtggccatgtcggagaagctcgccgcgcgactcgcggccgagggcgtggagaccgtcgtcgtccaccgggacatggggcgcgagtgaccggacgtactccgcggctgagcaggctgcgccgcgtggtccccgagggccgcgcgagccggctggcggccggtgcggtccgccagac

SEQ ID NO: 460 - DNA, 2014 bp, Unknown
  Kingdom: Bacteria, Phylum: Actinobacteria, Class: Actinobacteria, Order: Streptomycetales, Family: Streptomycetaceae, Genus: Streptomyces
ccgcggcaccctcgacgacctcgacgtcctgcgggacgcggccgccgcgtcggacggcgtggtccacctcgccttcaagcacgacatcgccttctccggcgacttccgcggcgccgccgaagccgatcgccgcgccgtcgacaccttcggtgacgcactcgccggcaccggccgtcccttcgtcctcgccagcggcctggccggcctcgcgccggggcgggtggcgaccgagcgggacgtgcccacacctcacggtccggctctctccatccgggggaccaccgcccaggcggtcctcgcgctgtcctcgcgcggcgtgcgttcgtccgtggtgcgcctctcgccgacctgccacggcgagggggacaacggtttcatggcagccctcacggccaccgcccgcgccaagggcgtgtccggctacgtcggtgacggcgccaaccgctggcccgccgtccaccggctcgacgccgcccggctgttccggctggcggtcgagaaggccccggcgggttcggtgctgcacggtgcggccgaggagggcgtcccgatccgcgacatcgccgaggtcatcggccgtcacctggacatccccgtcgtctccgtgcccgcgcaggacgcgtccgagcacttcacctggctgggcgacatcctgagcatggacatcccggcgtccagcgccctgacccgcgaactgctcggctgggagccggtcggacccggcctcctcgacgacctcgaccagggccactacttcatcgccccggcggccaccaccgtgtgaccccacgtgaagacgccacccgtgcgaaccgtttccggttcgcgcgggtggcgtctgacggggtcggccggtcgggccgcccggcactcagtccgcgtgatgcactgcgcggtcagccacggtcggcacagtcagccgcggcggcccggcgaatcctccgtgacccgctcctgcccgggctcgggaccggaagcagcggaaccggtggcagccgaaccggaagccgttccggtcaccgcttccctcgcccggtccccgtgccccggccaccacgccgcgtggccgatcagtgccgtgaggctaggcgtgaagaacatcgacatcacgaaggcggcgaccacgatgccgaaggagaccgcgaaacccatctccgtgagcagcgagttgccggcgagcatcatcgtggcgaaggtcgccgccaggatgaagccggccgctgccacggtggggccggcgtgccgtaccgccatgccggccgcctcgcgtggttcgcggccctcgcgggcctcctcgcggagccgggcgatcatcaggatattgtagtcggtcccgatggcgacgacgaagaggtacatgatcaccgggagcatgaacatcagtcccgggtccccgtggccgtcctggaagatccagaccgtggcgccgagggtggcgccgaagccgagacccaccgaggccatcaggtaccagggggcgaccaggctgcgcagcagcaggcccaggatgaccatgatcaggagggcggccaccgggaagaccgtacggtagtcgtggttcaccgcggtgttgatgtccttgaagatggaggacatgccgccgacgagcgcctcggtgccgtccggcgcgtcggagtgcgcgacgtcgcgcacctcgcccacggtgtcgatcgccttctccgtcgacgcctcgtacttgagggtgacggtgaagtccgcggtggtgccgtccttgctgacctgcgtcaggtgggcgtcggcgacgccgtccacggcgccgagcttcttcgcgtacgccccgaaggcggccttgtccagcggcttgccgccggtgctggagaggtagacgtcggtgggtgcggcggcgcccgccgagtacgccttctgcatctcgtcctggacgaccatggactccttggtcttgggcatggagcccgacgccaggtcgaacgtggccttgaaaccgagggtgccgagcgagagcgcgacgaggacgaggccggacacggcggcg

SEQ ID NO: 461 - DNA, 2924 bp, Unknown
  Kingdom: Bacteria, Phylum: Actinobacteria, Class: Actinobacteria, Order: Streptomycetales, Family: Streptomycetaceae, Genus: Streptomyces
gtccccgtacgcgccgcccgcaccggccccgtacgcatcggtggcgcccgacgcgggggccgagccggggcaggaccgtccgcgcggcgcctggcagcgcttcctgcgctggtggcgcggctactgagcagcccagtcggggtacgacgaccaggcctggagcacccgcgtgctgcggaaccggtgctccgtccccgtgaccgggtcggtgaactccagctcccgcgccagcagttgcagcgggcgccggaagtcaccggccgggccggggccggtcaccaccgggtagagcgggtcgccgaggatgggtacgcccagcgcggacaggtgcacgcgcagctggtgcgtctgcccggtcgccggggtgagccggtaccgggcgaggccgtccgcgcggtgctcgaccagctccacctgcgtgaccgcgttcggctcgcccggcacctcgcgggccgcgagcaccccgcgctccttcacgatccggctgcgcacggtccggggcagggccagcgcggggtcgtacggcgccacggcctcgtacaccttgcgcacccggcggtcgcggaagagcgtctggtaggcgccgcgctccttcggccgcaccgtgaacagcaccagtcccgcggtcagccggtccaggcggtgcgcggcgccgagcgtcgggagacccagctcgcggcggagccgggccagcgcggtctcggtgacgtgcgtgccgcgcggggtggtggcgaggaagtgcggcttgtccacgacgacgaggtgctcgtcacggtggaccacctccagcgggaacggcaccgccacctccgcgggcagctcccggtggaaccacacgaacatccccggctcgtacggcgcgtcgtacgccaccgcccgcccgtccgccccgacgacctgccccgcctcgaacatcgcggcgaccaccccgggagccgcaccggacagccgctccaccaggtgctcgcgcacggtcgcccacgccccctcggcgggcagccgcacccgcaccgggtccaccccctggcgctgggggaggggagcggggggagtgcgggtcctgcgtctcatccgtcgaagcctacgaggcgccgcggcgcacggaaaaccgctgggtcggccgccgcccgtcccggcaggatgcggaccatgcctgatctcaccgctcccgtgctgcccgcggacaccttctcgcgcaccgcccagcccaccgttcccaccggcgacggtctcctcctgcgccccttccggccggcggacgcgcccgccgtccacgtcgtcttccaggacccggtgatgcaccagtggcacgtccggtccgccgactccgaggccgaggtggcgggctggatcggccagtggggcgaggcctgggcggcggaccgggaggcccagtgggcggtggccgaggaggacaccggacggctggtgggccgggtcgcgctgcgcgaggtgcggttcgcggacggcgcggccgaggtggcgtactggacggccccggacgcccgcggccggggcgtggccgcgcgggccaccgccgcgctcgcccggtgggcgctggaggagaccggcttccaccggctcgaactgctgcacgccgtacgcaacgaggcctcctgccggatcgccgcccggacgggtttcgcgctggagggcaccaagcgcagtgcgggactgcacgcggacggctggcacgacatgcatctgcacgcgcgggtccggggcggtgcctgaccagggccgggccgagcgcttctctcttcgcgatacatcgcgtacccgttgacggctccggcctgtcgcgatatgttcggtcacggatattcgaaagcgaggtgatcgccgtggccgggaagcgccgcaagctcggcaacccgctggccctcgccgtcctggcgaccctccagcagaacccgatgcacccctacgagatcgcccagaccctgcgccggcagggcaaggacgccagcatcaagatcaactacggctcgctctacaccgtcgtgcagaacctcgagaagcacggcttcgtcgaggtggccgacgtcgagcggcagggcaaccggcccgagcgcaccgtctacggcctcaccgaggccgggcgccaggagatgaccgagtggatgtcggacctcgtggccgtaccggccagggagttcccgatcttcgagacggccctgtccctcatgggcgtcctgcaccccgacgacgtcgtacggctgctgcgggagcggctcagcaccctggaggtgcagatcgcgagcgggcgcggcggactggagaagctctacgagacgctgccgcggctcttcctcgtggagaacgagtaccagctccacatgctccaggcgcaggccgcgtgggtgcgtgccttcctggaggagctggagagcgggtccctgcccgaggtcgaggcctggcggcggttccacgagacgggcgaggtcccgcccgagttccggatcggggaggcgcccggcactcagagctgacgaagaagcgaacagaccccggcggagctgttgcagcagccccaccagggtctcgaaccccgaaaccggatccaccgtgaggcttctccgggcgatcgaggtgcggcacacccaggatagcccggtgctcctcgcgtggatcttccgacggcatgcgtcgaccgtcctgacggcatgcgtcggtcgtcctgacaggagagttccgtcatgagcgcaacccgtgcgcccgccgtcgaggcgcgccggctggtcaagacctatcccggtgacgtcagggccctggcgggcctggacatcaccgtcgaacccggcaccgtcttcggtctgctcgggcccaacggcgccggaaagtccaccaccgtcaagatcctcaccaccctggcccgccccgactccggcacggcgaccgtggccggccacggtcgccgtgcc

SEQ ID NO: 462 - DNA, 713 bp, Unknown
  Kingdom: Bacteria, Phylum: Actinobacteria, Class: Actinobacteria, Order: Streptomycetales, Family: Streptomycetaceae, Genus: Streptomyces
ccgccaagctggtggtgaccgaaggcaccctcaccggcaccaccgtcgcgctgcagggccagaccatcaccctgggccgcgcgcacgactccaccatcgtgctggacgacgactacgcctccagccgccatgccaggatctatccggaccagaacggccagtggatcgtcgaggacctcggatccaccaacggcacgtacctggaccggtcccggctgacgacccccacaccgatcccgctgggcgcgccgatccgcatcggcaagaccgtcatcgagctgcggaagtagtgctacgtcatgaatgagcgcgagcggagcgagcacgcagcggcggccggcacccagggccgcggcgcgctcccgaccggagggtgggcagtgtggctcgacacgatcggctgtacccggagccgacgggcgaggtgcgcatgagtctgtcactgcgcttcgccgccggatcgcacaagggcatgatccgcgagggcaacgaggactccggctacgccggtccgcggctgctcgcgatcgccgacggcatgggcggccaggccgccggcgaggtcgcctcctccgaggtgatctccaccatcgtcgccctcgacgacgacgttccgggctccgacatcctcacctcgctcggcacggccgtgcagcgcgccaacgaccagctgcgcgccatggtcgaggaggacccccagctggagggcatgg

SEQ ID NO: 463 - DNA, 2607 bp, Unknown
  Kingdom: Bacteria, Phylum: Actinobacteria, Class: Actinobacteria, Order: Streptomycetales, Family: Streptomycetaceae, Genus: Streptomyces
cagcacgcgggctgcgcgacacgctcctggcccgcccgggcggcgcgggccgggccggcgcgatcatcgccggcgtactgacggcggcgggcggatacgtcatcggcagcgtacgggcccgccgcgacggcgcgacgttctcacccacacgaatcgaaccggccgaagcggaggtcgagtcgaccggcgtgagtgccgagcgggccggagcgagtgccgagccggccggcgggcccggcgcggagaggagagcgggatgagcgggtccgtgccggtgctcatgtaccacgcggtggccgaggatccgaacgaggccacccgggggctgtccgtggcaccggaggctttcgcggagcagatggccgtgctggaggacctggggctgcagccggtcaccaccgccgagctggccgcccgctggcgcggtgggggcgcccggccgctgccccggcgtccggtcctgatcaccttcgacgacggctacgaaggagtgcaccggcacgccctgccggtgctggcgggacacggcttcccggccacgctgttcgtctccacgggctggctgcgcggcgcgtacgacaccggtggcggcctggacaccatgctcgactgggaccaggtgcgcgaactggcctcggccggagtggagatcggcggacacagccacacccacccgcagctcgaccagctcgacgacgacaccctgtggacggagctggtccgctgcaaggagatcgtcgccggtgaactgggctctgtgcccgcctcgttcgcgtacccgtacggctactccagccgccgggtgcgggcgcgggtgcgggcggccgggttccggcaggcgctcgcggtcggcaacgggctggcccgccgcgcccagggcccgtacgcgctgcaacgcctcaccgtgcgccgctccaccaccaccgaggagttcgagcggctggtcctgggccgcgagatcgcccggaacttcgccagggaccgtgccctcaccaaggggtacgccatggtccgcagagcccgccaggtccgccggaaggccatacccgcccgtgtctgacacgaccaccaccaccgagacgtcggcgaccggacccgagacgagcgggcggccggcacgccggctgcggctgcccggccggggccggtcccccggcggcagccagctgttccgcaacgcgtacgcgctgatgctcaacaccgggatctccgcggtgctgggactcggcttctggctggtcgccgcccgctactactccgactccgccgtcggccagggctccgcggcgatcgccgccatgaagttcctcgccggcctgaccgcggtcaccctcaccggcgcgctggcccgcttcatcccggtctccggccgcaccaccggttccctgatcgcccgtacgtacgcgggcagttcactgatcgtggcgtgcgccgcggccgtcttcctgctcacgctggacacctgggggccgtcgtaccgcttcctgcacgggctcacccacggcctcggcttcatcgcggccgtgacggcctggaacctgctcaccctgcaggacggcgtactgaccgggctgcgcagcgcgccctgggtgccggtgggcaacaccgtcttctccgcggtgaaactggcgctgctggtggggctggccgccgcgatcccgacgacgggtgtcttcgtctcctgggtgctggcgatcggcacgtccatcgtgccgctgggctggctggtgttccggcgcctggtgccccggcacgtgagggcgaccgaggaccgggcccggccgccgacgggcagggagctgggccgcttcctggccggcgactacaccggctccctgttctcgctcgccgtcgtctacctcgtaccggtcatcatcgcctcgcaggtcagctcggcggacaacgcgtacttctacatcacgacgacgatcggcggcacggtcaacctgctcgccatcaacatgggcgcctcactgaccgtcgagggctcgcacgacccggcccggctggccgccgacacgcgggccgcgctgcgccggatggccaagatcatggtgccggtctgcggtctgctgttcctgctggccccgcagatcctgcacgtcttcggtgaggagtacgcgcacgccgccacgccgctgctgcgctggttcgcggtgggcgcgctactgcgggtcgtgatggagacgtacttcgcggtcctgcgcgcacagagccggaccggcccactggcgtggctgcagggcctgttgtgcgtgctggtgctggggctgacgctgctgctgctgccccggatggggctgaccggcgcgggcgtcgcggagatctccagcctcgccgtgatcgtggcgatcgccgcgcccagactcttccggatcgtccgtgcggcacctgccgcaggtgttcccgaggacgcggcaccggacggggacctcgccgacctgggggcgggcgaggaccccggccgggccgccggactccggcggcccgcatgggcgctggagtccggcacgccggtcctcggcatccgcgtcggcttcgaccccgtggaacgccgtcccgacatccgtcccggtcccggtactccgccggcgggcacgccggtgg

SEQ ID NO: 464 - DNA, 1674 bp, Unknown
  Kingdom: Bacteria, Phylum: Actinobacteria, Class: Actinobacteria, Order: Streptomycetales, Family: Streptomycetaceae, Genus: Streptomyces
gtcctgaagaccgccctgacccggctggccggcggcccgcacccgctcacccgccacctggaggtcgagacctacacctggcaggccctcccgcccgcgctgcggccccgcgcccgcgcccagctcgccgacggcatcgccgccgaactcgccctcgcccgcgacctgctgaccgacctcggcctgaaggaactgccgtgacccaccccgaagaagccgcggtgaaccgcacccgggaagccacgcgagctgcggcggcccgccccggcgaaccgaccccgctgctcgtcctggacgtcgtaggactcaccccccgcctcctcgcccacatgccgcacctgcgggcgctcgccgactccggctcccacgccccgctcggcaccgtcctgcccgccgtcacctgcgccgcccagtccacgttcctgaccggcacgatgcccagcgaacacggcatcgtcggcaacggctggtacttccgcgaactcggcgacgtcctgctgtggcgccagcacaacggcctcgtcaccggcgacaaactctgggacgccgcccgccgcgcgcaccccggctacaccgtcgccaacatctgctggtggtacgcgatgggcgccgacaccgacatcaccgtcaccccgcgccccgtctactacgccgacggccgcaaggaacccgactgctacacccggccgcccgccctgcacgacgaactcaccgaacgcctcggcaccttcccgctgttccacttctggggcccgggagccgacctcgtctccagccggtggatcatcgacgccacccgccacatcaaccgcacccgccggcccgacctcaccctctgctacctcccgcacctcgactacgacctgcagcgccacggccccgacgacccgcgctccctgcaggccgccgccgacctggacgccgccctggccccgctgctcgccgacgcccgcgccgagggccgtaccgtcgtcgcgctgtccgagtacggcatcacccgcgccgaccggcccgtcgacatcaaccgcgccctgcgccgcgccgggctgctggaggtgcacacccaggacggcatggagtacctcgacccgatggcgtcgcgcgccttcgccgtcgccgaccaccagatcgcccacgtctacgtacgccgccccgaggacctcgcggccacccgggcggcgctcgacggcctgcccggcatcgaacggctcctggacgacgagggcaagaaggcccaccacctcgaccacccgcgctccggcgaactcgtcgccgtcgccgaaccggacgcctggttcacgtactactactggctcgacgacgaccgcgcacccgacttcgcccggctcgtcgagatccaccgcaaacccggctacgacccggtcgagctgttcatggacccgcacgacccgtacgtgaaggtcaaggcggccaccgccctggcccgcaagaaactcggcctgcgctaccgcatggcggtcgtgccgctggacgccgcaccgatccgcggcagccacggccgcctccccgcgagcgacgacgaaggtccgctcctcatctgctccaccccccgcgccgtcgacggccgcctcgcggccaccgacgtcaaggcactcctgctcgacctcgccggactcggcacacccggcccgtccggcacccccggcgccaccc

SEQ ID NO: 465 - DNA, 6131 bp, Unknown
  Kingdom: Bacteria, Phylum: Actinobacteria, Class: Actinobacteria, Order: Streptomycetales, Family: Streptomycetaceae, Genus: Streptomyces
gcctgcgccggatcaccagggccatcagcgccgccgccgcgcacagcgccccggaggcgtaccagacgacgtcgtacgaaccgaaggcgtcgcgggccacgccgccgaggtaggcgacgagggcggcgccgacctggtgggaggcgaggacccagccgaagacgatcgcgctgtcctcgccgtagtgctcccggcacagggccagggtgggcggcaccgtggcgacccagtcgaggccgtagaagacgatgaagaagatcatcggcgggtgcacgttcggtgcgagcagcatgggcaggaagagcagggcgacaccgcgcagggcgtagtagaccgcgagcagacggcgtggctcgaagcggtcggtgaaccagcccgaggcgatggttccggccacgtcgaacacaccgacgaccgcgagcagcgaggcggccgtggtgaccggcatgccgtggtcgtgggcggcgggcacgaagtgggtctggatcagaccgttggtggaggcgccgcagatggcgaaggtgccggccagcagccagaagggcccggtgcgcacggccgaggccagcacgcccagggtgcggcgcgcggcgcccggcaccggaggcggcttcggcacggactccgtcgcgccgtacggccgtacacccacgtccgccgggtggtcgcgcagcagcagccagacgaacggcacgacggcgagcgccgccagtgccacggtcacggccgccggacgccagccgtgcgactggaccgtccaggacaggatcggcaggaagatcagctggccggaggcggaggcggcggtgaggatgccgctgaccaggccgcgccgctcggtgaaccagcggttggtgaccgtggccgcgaaggccagcgccatcgagccggaaccgaggccgaccagcagcccccagcacagccacagctgccaggccgcggtcatccacacggtcgcgcccgagccggccgcgatcacggtcagcgcgacggcgaccaccttgcggatgccgaaacggtccatcagcgcggcggcgaagggcgcggtgagtccgtacagcgcgaggttgagcgagacggcggccccgatcgtgccgcgcgaccagccgaactcctggtgcagcggatcgatgagcagtccgggcagcgaccggaacgccgccgctccgatgatggtcacgaaggtgacggcggcgacgaaccacgcgcggtgcacgcgtgcccggcgccggggcggggacggggcctcggtgtcgagaggggattccgctgtctgggtcatgtcactcagcttcgcgggcgggaccccgctcatcgagtggcccgaaggacagcattcgctaggatcgggccatgggctctgtcagggacaccaccacctcggccgccggtgcggctgccacctcgaccaccggcgcgactgggcccgcgcagcgccgtccgcaccgcgtcgtcgtcctcgcgctcgacgggctgctgcccttcgaactgggcatcccgcaccggatcttcggacgccccaaggacgccgagggccggctgctgtacgaggtcgtcacctgctccgtccggccgccgggcccggtgcgtacggacgccgacttctcgatcgtcgtcgcgcacggaccggaggccctggccagcgccgacacggtgatcgttccggcgtcgtacgaacgcggcccgctctacgaggagggcgtgctgcccggcgacctggccgccgcgctcgcgcacatccggcccggcacccggctcgcctccatctgcaccggcgtgtacgtgctggccgccgccgggtacctggacggccgcccggcgaccacccactgggccgacgccgagcgcttccagcggctgttcccgcacatcagcgtcgacgcggacgtgctgttcatcgacgacggcgacgtactgacctccgcgggggtcgcggccggcatcgacctctgcctgcacatggtccgccgcgaccacggcaccgcggtcgccaacgacgtggcccgccgcacggtcgtgccgccgcaccgcgacggcggccaggcgcagtacatccaccggccgctgccggatccgcagctggccaccacgaccagcgcccgcgcctgggcactggggcggctgcacgagccgatccagctgcgcgacatggccgagcaggaggccatgtcggtacggaccttcacccggcgcttccgcgaggaggtcgggatcagccccggccagtggctcacccagcagcgcgtcgaacgggcccggcacctgctggagtccacggacctgtccgtcgaccaggtggcccagcaggccggcttcggtacggcgcagtcgatgcggcagcatctccaggccgccctcggcgtgaccccgaccgcctaccggcgcaccttccggatcacgggcgccggacggcccgcctaggtcaccgggtcctgccgccgcccgtaccttccgctgcctctcgtcgccgcttgacccttatggctcttctcacaatccaggagaaatggggatttcggtgacgggagtcaccgaccgggggcgggtgttctgtctatgttttcgcccatgctgaaacgcttgcgctccctgccgcacccgtcgaggaccggtgctctcctcgcctccgccgcggtgctgctgtccggcggcgccctgggcgccgccgcaccggcacaggcgcaggaccaggcacaggaccagtcccgtgtgacggcggccgtgctccctctggacggctccgggcacgaacccaccgtgtacggcgatgacgtcccgtacgacaccgccagcatcatcaaggtcgacatcctcgccacggtgctgctgcaggcacaggacgccggaaggaccctgaccgcacaggaacgcgcctacgcggagcccatgatcgagcacagcgacaacgcggcggcgaacgccctgtggcgccagatcggccgggcgccgggactggaggcggccaacaagcggctcggactgaccgcgacgaagggcggccccggccccaagtggggtctgacccggacgacggccagtgaccagatccggctgctgcgcgcggtgttcgacacgggcggcgggacgagcggcgggacgggcgcaaacgccgacggcagcaccggcggcagcaccggcggtgcgctgaacgccacctcccgcgcctacatccggagcctgatgaacaaggttgcgccggaacaggcctggggcgtctcggcggccgcgacgccgtcggccacggcactgaagaacggatggctgcagcgcagcacctccgggctctgggacgtcaacagcgtcggccgcatcacggtggacggacaccgctacctggtggcggtcctgtccgacggcaacgcctcgatgagcgacggggtttccctggtccagcggacggcgcgcgccgccgtctcgtcgacgacgtccggacactgacgccgcacggcggacgccctgcgcggtacgccgcgcacggtaggccgtaagccctccgtcgtccgccgtccgctgcgtccgtcgtccgttcgtccacaggctgtgggtttcgccacggcgtgcaccacggcgggcggcggtgaaaacccgggtgcccgtctcggtcgccgcaagggatgatcacggcatgaatgacagggcggatcggtcaggaacggaccaggcggaacagggtcaggcgcaacaggatcagacggggcccgacgaggaggcgcaggtcccgcgcgggacggcgccggtcccggacgaggaacggcgcaagcagttgcgcgaacggcgcatagccgtgagccggggcgcggagcgcgtgctctcgcgctccgcgtacctcggcacgctccgggagcggctcgcggacctggaccgcgtgcaggaggtctacgacctcgacgagccgtcggacctctacggcaacggcgtcgtcgaggccctggagggcaaggtcgcggcgctgctcggcaaggacgccgccgccttcttcccgaccggcacgatggcacagcaggtcgccctgcgctgctgggcggcccgcaccgggaacccggccgtggccctgcacgccctgtcccaccccgaggtgcacgaacgccacgccttcagccaggtctccggcctgcgcccggtgcggttgacgaacgagccgcggcagccgaccgcggaagaggtgcgcggcctggacgagtccatcgggacgctgatgctggagctgccgctgcgggacgccggtttcgtactgcccacctggcaggagctgaccgaggtcgtcgaggcagcgcgcgagcgggacgccgtggtgcacttcgacggtgcgcgcctgtgggagtcgaccgagcatttcgggcggtccctggcggagatcgcggacctggccgacagcgtgtacgtgtcgctctacaagtccctggagggcctcggcggcgcggtgctcgccgggccgagtgagctgatcgaggaggcgagggcctggcggcaccggtacggcggcacgaaaacacccgcccggcccagccgtacggctgcgtgcggtcagcggcggcgcaccagcgggaacggcagcgtctcacggatcgtcaggccggtgaggaacatgacgatccggtcgacgccgatgccgaggccgccggtgggcggcatggcgtattccagggcgtcgaggaagtcctcgtccagttccatcgcctccgggtcgccgccggcggcgagcagtgactgcgcggtgaggcggcggcgctgttcgacggggtcggtgagttcggagtaggcggtgccgagttcggtgccgaaggcgacgaggtcccagcgttcggcgagccgggggtcggtgcggtgctgccgggtgagcggggagacgtcggtggggaagtccttgtagaaggtgggcagtcgggtgcgttcctcgaccagccgctcgtacatctccagtacgacctcgccggggccgtcgtccggccggtagggcacgccggcgcgctcgcagtgccggtgcagtgccgccaggccggtgccggggccgatctcctcgccgagcgcctcggagatcgcgccgtgcacggtcctgaccggccagggcccggagatgtcgtactcctcgccgtccctgtgggcgacgggacggccgtaggcggcttcggctgcgccctggaccagttcgcgggtgaggtcgagcatcacgtcgtagtcggcgtacgcctggtaggcctccagcatcgtgaactcggggttgtgcttgtgggagacgccctcgttgcggaaggtgcggcccatctcgaagaccttctccaggccgccgacgcacagccgtttcaggtacagctcgggggcgatgcgcaggtacaggtcgaggtcgtaggcgttgatgtgggtggtgaaggggcgggcgttggcgccgccgtggatgcgttgcagcatcggggtctcgacctccaggaagccgcgctccagcaggccctggcgcagggcctggacggcggtggagcggacccggacgacggcgcgtgcctcggggctggcgacgaggtcgaggtagcgcatgcggaccctcgcctcggggtcggcgaggccgcggcgcttgtcgggcagggggcgcaggcacttgccgagcaggcgccaggaggtgacgaagacggtcggttcgcccttctcgctgacgccggtgcggccggtggcggtgatgtggtcgccgatgtcggtgtcggcggtgaagcggtcgagggtgtccggtcctgtgcggtcgcgggtgagggcgagctggtggtcgccggaccagtcgcgcagcacggcgaagacgatgccgccgaggtcgcgtacgagcatgatccgtccggcgacggtgacctgttcgcccgtgcgggccccggcgcggacctcggcgagggtgcgggtgcgggcggggacgccgaccgggtaggggtcggtgccggtggcgcgcagtcgccgcagccgggcgtggcggacgcggacctggtcggactgggcggcgagcgggtcgtcgctgctgtcccgtccggcccggtccaggccgaggtcggcgagcgggggcaggtgttcggtggtggcggggcgggggcccggccgggcgtgtcccttgccccagagcttgcgcagcgaggggacggggacgaagccctcggcga

SEQ ID NO: 466 - DNA, 2429 bp, Unknown
  Kingdom: Bacteria, Phylum: Actinobacteria, Class: Actinobacteria, Order: Streptomycetales, Family: Streptomycetaceae, Genus: Streptomyces
cccctcctcgccgccctcgacccctacatccaccgcgaccacagcgaacgcccccacatcgaccagcagtaccgcctccacctcgaccccaccatcaccaccaccggctgccacatctacgtccagaacgccgaacaccacacccacggcgtcggcacccccgacctcggcctcgccgcctggcgcagcgccaccatcctcaacaccatcaccggcaaagccacctaccccctccccacccgcaccgccttcaccaccttcggcctcccacagcaacggccccagatcccacccgtacgccagatcaaggaactcacccccctggcggacgagacctgaggccgccccgcaacacccaaccggtcagaacaccggcacaccctcccgcgtcagcttccagtccaccgacgcgaactccttcggatccagcacacccttcgccgtcacccactcagcgatccgcgtccggatctccgtcgactccgaccacaactccttcgccgacgccacatacgggaacgcaccgccaccgttcgcacggtagttgttcaccgccagcacgaactgctgcgcgtcatccaacgccgcaccgttgaacgtcaggttcctgatccgcgatcccaccggccgcgccacgtcgatgtcgtacgccagccccgacacatagtcgtagttgtagtccggccggccacccgcgttcgtcagcttgtccacgtccaccggcgcacccgccgccgtctgcacgtagtaccccgccgaatactccaggtacgcccgcacctgcgcacccgtcatcaacttcgccaccagcgtgttgtcgtacacgtacagactcgacagatcccggatcgtcacatcccccgcatggatctccgacgtccgcgagaacggcgacgcctgcgcgatcaccggcagcgacgcgtactgcgtgcccgccagcgccgccttcaccacgtcctcctgcaccttcgtgatcaggtcgatgatcggcgcgtccttgtaccgggcgtccaccgtcgtcaacgtctgagtcgcctgcccgacgacctggttgacataccccacgaccttctcgtgctcatcggccagcagcttgctgatcctcgggtcgtccgccaccgagttcgagttgcgcagcgacgccgcgaccgactccacctcccaccggccccgcgagaacaccagctcgatgtcgaacaccgtcagccgctccgcgaaacacagcggctccgacaacaccaccgtcttcccggacttctcgttgacgaccttcagctccggaatctccagatgcgcgtgccccaccagaatcgcgtcgatccccggcacctgccgcgccacgttcgccgccgcgtcctccacatacggcaactggtcaccgtacgacgactgacccgacgtacccgagtgcgccgacacgatcaccacgtccgcacccatcgaacgcagcttcggcacccacttcgccgcctgctcctcaagcccaggaaacgtcaactttccctgcacataagccttgtcccagatcgcgatacccgggttcgtcagccccagcacagccaccttcaccggccgggccccgtgcacacggaactccttcatcacgtacggcgcgaaagccggccgctgcgtcttcgcgtccagcgcgttcgcacccagcagcgggaagtcgcactgctgctcgaacttccgcagcgtctcgatcccgtagttgaactcgtggttgcccagcgccgccgcgtcgtacccgatcgcgttcatcgcctgcgccatcggatgcaccggaccacccttcgcggtgatcgggtccaccttcgcgtagtagtacgtcagcggagtgccctggatcgtgtcacccgcgtcgatgagcaacgtgttgtgacggcccttcgcctcacgcacctcgttcaccagcgtcgagatacgcgccagaccctgcgcgttgcccgcagcgtccgagtactcgccgtccttgaaataatcccagttgaagacgtgcccgtgcaggtccgtcgtccccatcacggtcagcgagtaacgcttctcgtgcgggcccggcccctgcccgggctcgtggccggacgcaggggtcgcggcctgggccgccggagccgccgccgcacccgtcagcgccacccccgccccggtcacggcggacttcttcaggaacttccggcggttcaacgccatgtcagtttctcctcgcgaaggatcggcttgcgtaccaccgtcccgccgacaacccggcctgcggacaacccggctcccggaccgtccgcggacaagtgacgacgcgcgtagatgtacgcgcgtagattctggccgggacacgccgaaacgcaacagcccccgcaggttgcgatctgatgaccggcaccccgcacccacccccgcggacgggtgacacagtggaacgcatgacctcaccc

SEQ ID NO: 467 - DNA, 2494 bp, Unknown
  Kingdom: Bacteria, Phylum: Actinobacteria, Class: Actinobacteria, Order: Streptomycetales, Family: Streptomycetaceae, Genus: Streptomyces
ggtgctcgatgccgagcgcgcaggcgatcagcagcgggtccggggcgggctgggtgctcatcagctcgcctgcgcctcgacgcggggcctctcgcccggcgtcttgccggcgaagggttcgccgtggacgtagcggccgagcgcggtgagcgggaacacctgccggtacaggtggtagttgatggagaagtcccaggggaagcccgtgccggtgaagtacggctcgtcccaggaaccgtcctcccgctgagtgtccgccagccaccggatgccgcgctcgacggcctcggactccttctgccccgccgcgagcagcgccatcagtgcccacgcggtctgcgaggcggtggaggcgcccttgccgctccactccttgctgtgcttgtaggagcgcaggtcctcgccccagccgccgtcgtcgttctgcacgctctccagccaggccaccgcgcggcggatcgccgggtgggagccgggcaggccggcggcggtcagggcgggtacgacggagccggtgccgtagatgtagttgacgccccagcggccgaaccacgagccgttcgcctcctgttcggcgagcagccactggatgccgcgccgggtgcgcgggtcgtgggacatgccctcgacggcgagcatctccacgacgtgcgcggtgacgtcggccgacggcgggtcgatgacctcgccgaagtcgcagaacggcagccggttggggaacgggctggtgttgtcgacgtcgaaggcgccccaggcgccgttcttcgactgcatgccgaggttccagcgcacaccgcggccgatggccttgtcgacccgttccgggtcgtggtgacggacccggcgcagcgcgaggacgacctcggcggtgtcgtcgatgtcggggtagttgtcgttgtggaactcgaacgcccagccgccgggcggcagtccggggcggcgcaccgaccagtcgccggggcgcacgatctgctcgccgagcatccagtcggcggccttgaccagttgcggatggtccgcgggcacgccggcgtcggcgagcgcgatggtggccaggcaggtgtcccacaccggggactggcaggcctcgatcatccgggcgccgtcctcgcgccggatcgcgaagcggtcgagtgactccaggcccgcgcgcatcacggggtggttgaggtcgtagcccatcaggtgcagggcgatcacggagtacacggcgggcggctggatgccgccccagcagccgtcgttctcctgacgttcgatgatccagcgcacggcggtgttcatcgcggctctgcgcagccgcttcggcgccaccttgcggaacgcctgcaggcccttgtccaggcgctggaagacgccgtcccagctggccgccggggcctgcggccggggcgggttggggcacagcgggtcggtgtgcagttcgtcgagcgggaacggcgcggggcgcaccgggcgtttggccgagacgatggtgagcggcacgatggtctgccgggcccagcagccgaagtcgtagatgttgagcggcatccagtccgggaaccagatcagttccggaggcatctccggcaggtcgtcccacttccaccagccgaacagggcgagccagatccgggtgaagacgcgggaggcggcgatgccgccccgggcgcggatccaggccgacgccttcgccatgtgcggggcgtcgggcgcgtcaccggccagacgcagggcgacgtaggcctcgatggtggtggagagttcgccggggccgccgtagaaggtggcccaggtgccgtcctcgcgctgctcgccgcggatgaagagcgcggcggcgcgggtggtctcctcgtcggagatgttcaggaactggcgcaggagcaggtcctcggcgtccatcgtgacgttcgtctcgaggtcgcccttccaccagccctcggcgtcctgctgtgcgagcaggaagtcggtggcacgccgggtggcgtgtgcggcggcttcttgtaccccggccgtcacgggggtggtgagtacgctttcgctggccgcggcagcgcgggtcggcagtgcggccccggtgcttccgtcggtcgtcgctgtcatggcttccccttcgtgcagtcgtgcaagtcgtgctgctgtgggtccgccgtcgaccggtgcctgaaacctttcggcaccggccggcgactacgcgagggtggttccgatagtgatcatctctttcgtacgacgacgaagtcggcgagcgccgtgaacgcggaccggacccggtcgggcatgttcacggagtcgagggcttcgatggcgatggtgtgctgacggcgcgcctcctgggcggtccactcgcggccgcccgcctcctcgatgagggcggcgcgggccgcgaactcctcctcggagaagttcgcgaagtcgctggccttggcgtcggcggcgaggatctcgccgagccgctcggaggcctcgccgccggccgcgagcgcggccaccaccggcagggacttcttgc

SEQ ID NO: 468 - DNA, 983 bp, Unknown
  Kingdom: Bacteria, Phylum: Actinobacteria, Class: Actinobacteria, Order: Streptomycetales, Family: Streptomycetaceae, Genus: Streptomyces
cgccgccctcgccctggccggtggccggctcgccgcccaccccgaggagaccctctccgacctcgccaaacggctgcacgccgacaccggcgagggcaccgcgctcgcccgcgtcctccgcctcgtccacgcggagctgccgaagtccgccgcccggacgctgcggctgctcgccctcgcgccggccggcgacgtcgacccgcccaccgcctccgccctcgccggcacctccgtcgacggcgcacaggccctgctcgaccgcttcgccgccctcggcctgctgcgccgcctgccctcgccgctgccccgctacgaggtgcccggctgcctgcacccgctgctgctggccctcgccgagcgcgaggagcgccccgccgagctgcagctggcccgcgcccggatgctggagcgcacggtacggctgctccagtcctgccgggcggtcaccgagaccgacagccccgagacccgcgagaagctgaagaacctgccgccggccctgcgcttcgccaccccgcgggccgccgaggactggctgcggacccgcaggcccgcgctgctcgccgccgcccgcctcgcggtcgccgacggcgagctggacaccctggcccgccgcctgatgtcccagctggtgcggaccatggtcgcccacctcggcacccaggcggcggccagcgacctctacggcatccaccgcctggtcctggacgtggccgtgcggcagcggctgccccgcgaacaggccgcggccctgctgaacctggccgacctggacgcccgcaccggtcggacggccgaggcgctcgcccgctaccgggccgcgctggacgccggacgcgcggcgaacgacccgtacgcgaccggccgcgcgatggaatccgtaggcgccgcccaccaggagctgggtgatcacgaccgggcggccgactggttcggccgcgccctggcccagcggctggcgcgcggcgagcacgcggaggccg

SEQ ID NO: 469 - DNA, 1029 bp, Unknown
  Kingdom: Bacteria, Phylum: Actinobacteria, Class: Actinobacteria, Order: Streptomycetales, Family: Streptomycetaceae, Genus: Streptomyces
ccggccgcccggcccaggcactccggccgcaccatggcgcaccggcgccgtggtgcggacacggcgcacccgggcgcgccgacgggaagggacggctcgtggcagcgaacagccgtcacgggtaagagacttggtggtgtccgggtcttcttctcacccaggatccggtccggcccggacgccgctggactaacgctcgattccgcgcaccggtgacctgtccgccccgcggcgcgttgcccgggtatgaccaccgttcctccggcagccgggcgtcgccggcgcatcttcgtgccgcggcccgcggaattggttccccccgcgcccccgcagctcccggatccgccgatctaccgcgatctgatgcgcacctgggccaaccggggccgtaccctgccggggcgccacgacccggaatgggtccggctggcggcgcccctgctcggcctcgcgcagttcagcgggtctcgggacccgcgacatgacgggcgatgaccatccgctggatctggttggtgccctcgacgatctgcagcaccttggcctcccgcaggtaccgctcgaccgggaagtccgcggtgtagccgtagccgccgagcacctggacggcgtcggtcgtcaccttcatggccgcgtccgtgcagaacagcttggccatggccgcctgccgcgcgaacggccggcccgcgtcgcgcagccgcgccgccgacaggtacagcgagcggcccgcctcgatctgcgtcgccatgtcggcgagcatgaagcgcagcccctggaagtcggcgatcggccgcccgaactgccgccggtcggtggcgtaggcgaccgcctcgtccagtgcggcctgagccaggcctatggcgcacgcggcgatgccgagccgtcccgagtcgagggcggccagcgcgatggtgaagccctggccctcctcgccgagccggcgggcgtcgggcacccgcacgccgtcgaggtggagctgcgcggtcggtgagcccttcaggcccatcttcttctccggcgccgcggcgc

SEQ ID NO: 470 - DNA, 2049 bp, Unknown
  Kingdom: Bacteria, Phylum: Actinobacteria, Class: Actinobacteria, Order: Streptomycetales, Family: Streptomycetaceae, Genus: Streptomyces
ggctacctcctgctgggcccgcacggcggtcgcccgcacggcggtgacggcccggcgacgcaggcggacgccgtggcccccagccgctgggccgctctccccaccggctggaagccgtggcagacgaccgcgtccgcgacggcggagcagggcgtcaagaaggcaccgggctacgaagggaacaggtcaccggcgtgcgtaccggatgccggcgccctctactgcgccggcagcgcactcctgcccgagcggatcgacgccaccacgggccgcaccctgtggcgctccggcatcgcacccgcgggactcccggccgaccgctacgtcacgacggtcctcggcgcctacgacggcgtggtgctcgtcgagctctcgatcaccggggaggacggcaagggacagacgcagtccgtcctcgcgctcgacgccgcgagcggcacgacagtctggtcccacgcggtgcgcaccgagagcctgggctcggtctacgccgccggcgtgacgctgacgcaggagggcgacggcagtacggtgaccgtccgctccgcgcgcgacggcaccgtacgccggcagatccccgtccccaccgggtacgactgcctgctgctcagcgtcgacaaccggccctacgtcgagtgcgcggcccaggcggagggctcgcacgacacgaagttcctcgtcgtcgaccccgccgacggctccgcgcgcaccctggcgtcccccgcccagcccaggagcttcgtcggcgcccaggacggacaactcgtcttcgtcgaggcggacgaccgccccgtgaccaacggccccgaccagatctacacccggatcgtgcgcgtcgacccgcgtaccgggaaacgcacgctgacaccgctgcccgagcggtaccggggcgggacgccggccctggcgcacggcacgctctacttcgccacctccagcggcctggtcacggccgtctcgccggtgacgggagcccggctctggcagagccacacgaccgtggagactccgggccaggcctcggtcgacccgaaggggcgcacggtgtacgtggcgggcgggagcggccgggtggccgccctcgacacggcccgcggcaccctgctgtgggagtcgtcggcgcgcgcggaagtgctggagaacggactcctgcccaccgtgtggttcaacaagggcgccctggtgctggcggcctccgacggcaccctcttcaccctcgacccggcccacccgaggcggaaacccacccccgtctgacccacggccgccccgctctccacacgcctgatgcctgcgcgcggtgaagcgagaccgtcatgcacttcctcaaccgccatgcagttcctcaactgagttgtcagccgcggggtggttcttcctcggtgaccgtcccacgcccctggcctgggcgggcatccgcgtcaccgtgcccgccctgcggtccgtggccgccggccgcctcgccgtcgtcctgcgctgaccgtcctgcgccgtcgtcattctgctctgcccggggtgaccaccggattcgccgacggcgctccgatgtcgccggggcgccgtcggggacgaggacgaccttgcccaaggggtgctcgtgttccaggtgggcgaaggccgcccggacgtcggtcagcgcaagggtccggctgatcggcacctcgatccggccggccgccgccaggtcggccagttcggtcagcaccgcccggccggtgccctcggcactgccctgcgaccgggtgccgagcgtggcggcggcgccgtggtcgagcgtgttgacccggtggggcagcacccccagccggagcgcgatccgcgggtagtcgccgccgtggaagtcgaggaaggcgtgcgccgtgccgtcgccgtcgccttcgatcgtgcggcgcaggcgttcggcgatctggctcccgtagccgaccagggtggcgccctgggactccagccagtcctggtgccgcgcggaggcgaccgcgaccacgcgggcccggcgcaggcgcaggagttggacggcgaggctgccgaccccgcccgtcgccccgctga

SEQ ID NO: 471 - DNA, 5900 bp, Unknown
  Kingdom: Bacteria, Phylum: Actinobacteria, Class: Actinobacteria, Order: Streptomycetales, Family: Streptomycetaceae, Genus: Streptomyces
ccgcaccctgcaccccggcgaaccggtcctcgacgtcgcgcgcgtgcgccggctggtcgccggggtgcagggtgcgggtgtcgctgtcggcacacatggacggcaagcaaacgagaacggccgccccgcagcaactccttttctcacgcgcccgcgtgccccggtgcgcccgccgccaccccggacgggtcaccacaacgcgccgacccggtgggccgcccggtgcaatggacgggtgaccgcgcccccggacgactgcctcgcgcgcaacgagtggatctgcggcgcctatctgagcacccgccgccacgtcctgctcgacgccgtcctccagcacctgcgcctgaccgccctggccgtgctcatcgggctcgtgatcgccgtcccgctggccgtgctcgcccgccgcctgcgctggagcgccgcacccgtcctggccgtcacgaccctcctctacaccatcccctcgctcgccatgttctccctgctcctgcccctgtacggactctccgcgaccctcgtcgtcgcgggtctcgtgctgtactcgctgaccctgctcgtccgcaacatcctcgccggactgcgcgccgtgcccgaggagacacggcaggcggcccgcggcatgggctacggccccgcccggctgctgctcgccgtcgaactgccgctcgccctgcccgccgcgatggccggactgcgcatcgccaccgtctcggcggtctccctggtcacggtgggcgcgatcgtcggcttcggcgggctcggcaacctcatctacgcggggatgaacacctacttcaaggcccaggtgctcaccgcctccgtgctgtgcgtggtgatcgccgtcgccgccgacctgctcctgctcggcgtccagcggctgatcaccccctggactcgggcggcccgcgcgtgatccgccccgcggcgcgcgcatgaacacgctcaccggcgcctgggactggctggccgaccccgcccactggacgggcgaggacggcatcgcgcaccgcctgctccagcacctcctgctcaccctcgtctgcctggccgtcagctgcctgatcgccctgccggtcgcgctcgtcctcggccacctcggcaagggcggcgccctcgccgtcaacatctccaacgtcggccgcgccgtgcccaccttcgccgtcctcgtcctgctgctgctcaccccggtcggccggtggggcgagggacccaccgtcgtggccctcgtcctgttcgcggtgccgccgctgctcaccaacgcctacgtcggcatgcgggaggtggaccgtgacgtcgtgcgggcggcgcgcggcatggggatgaccggccgccagaccctgctgcgcgtcgaactgcccctggcgctcccgatggtcctgaacggggtacggatcgccgccgtccagctcgtcgccaccgccaccatcgccgcactggccggcggcggcggactcggccggatcatcacggcgggcttcaacctggccagcacaccgcaggtcgtcgcgggagccgccctcgtcgccgtcttcgcgctgctcgtcgaggccgtcttcgagaccgccgagcggctggcccccaggcgcgcccggggcggcacccggtgagagcgcccgccgtacgcccgccgcacctgctgctcgcgctgctcccgctgctgctgctcggcccgctcgccgcctgcgccaccggaccgtccctggagaaccgcggccaggtcaccgcaccgccgggcgacagcaggcacctgaccatcggatccgcgggcttcaccgagagcgacctgctcgcgcagatgtacgccctcctcctggaccaggccgggtaccggacctccctgatcaccgtcgccaaccgtgaactgtacgaacccgccctggaatccggtcagatcgacgtcgtccccgagtacgcggccaccttcgccgactggctgaacaccaagacccacggcgcccccgcgcccccggccggctcacccgatctcgccgccaccatgaaggccctgcgcgccctggccgcaccccgcggcctcaccgtcctcgaccccggccgggccgtcgaccagaacgccttcgcggtgagccgcggctacgcccgcgcgcacggcctgaagaccctcagcgacctcggcgcctcgggcctgaaggtacggctcgctgcgggcgacgagtgcgtgcagcggccgtactgcgcaccgggcctgaagaagacgtacggcatcgacatcaccggcatcgaccccaagggcgtcggcaccacgcccgcgaagcaggccgtgcggagcggccgggaccagatgctgctcaccacgaccacggacgccaccctcgacgccttcggcctcgtcctcctcgccgacgacaaacacctgcagaacgccgactacgtcgtccccgtcgtcaaccgcgcccgcgccggaggccagggcgtgacccgggtgctcgaccggctgggcgccgtcctgaccaccgccgacctcgccgcgctgaaccagcgcgtcgacagctggcgccgcctgcccgcggacgtcgcccgcgcctacctgaaggacaagggcctgctgaagtgaggccgggctccgtggcccccctcaggcgtgcgccacagctcccgcaggcatgcgccacagctcccctcaggcgtctgccaccgagtcgaagccgacctgcccgcgcggcacaccgcgcgcgtccgcgtccaccgaacggcgcagcgcctcgtgcagtttggccggggtcagcaccccgaggaaacgcgcgccgtcgagcacggcgacccagcccgcgtcgtgctggagcatcaccccgaaggcctgcttcagcggggcgcccaccggcacccaggcgttcatccggtgcgccaggtcaccgacgcggccgcccgcggccagcgcctccaggctcacccagccgtgcagatcaccgaaggtgtcgaggacgaccgcccagcgcgcgccgtccgcacgcagccgcccggccgcgctctcggcgggttcgtcgagccgggcgacgggcggctgctccaggtcgccctgttcgaccgccgtcaccgacagccgcttcagaccgcggtcggcgcccacgaacgaggcgacgtacccgttcgccggggtgcccagcaccgccccgggcgtgtcgaactgctcgatgcgcccctgcccgtacacggcgatgcggtcgccgagccgcaccgcctcctcgatgtcgtgcgtgaccagcagcaccgtcttgcgcacggcggcctgcatgcgcaggaactcgtcctgcaactgctcgcgcaccaccgggtcgacggccccgaacggctcgtccatcagcagcaccggcgggtccgcggccagcgcccgcgccaccccgacccgctgccgctgcccgccggagagctgctccgggtagcgcggcccgtacgtcgccgggtcgagacccaccagctccagcagttcggcggcgcgcgcccgcgccctggcccgcttccagccgagcagcgcgggcacggtcgcggtgttgtcgaggaccgtgcggtgcgggaagagcccgacctgctggatgacgtagccgatccggcggcgcagccggaccgggtcgacgccggcgacgtcctcgccgtccacgaggatccggcccgaggtcggttcgatcagccggttgaccatcatcatcgtggtggtcttgccgcaccccgacggccccacgagggtgacgagttcaccctcggacacctcgaagtcgagaccgtccacggccgtggtcccgtccgggtaccgcttggtgacctgctcgaaccggatcatgctgtcacgctagctgcgcccttcactccgcgctcaccagcaccacctccagggtgcgtggcccgtgcaccccctccacccggtccagctcgatgtcgctggtcgcggagggcccggagatccaggtcagggggcggcgcggatcgaggcgggccagggcctcgggcaccgaggagaccacctggtccgggacgcgcacgacgcagacgtggtggtcggggatcagcgtgatccggcggcggccctggtcggcggagccgtccagcacgatcgtgccggtctcggcgacggcgaccgcgcagccggtgaccacgctgtcgacgcggtccagttcgtacggcgtgtcctccggccggtccgcgacccgggtcacctcggtgtccgtcagccacccctcgtcgagtcccggcgggaccaggacggtggccgccccccgctcaccgagcagccgggcgatcagcgcgggcagcccggccgggtcggtgcggtgcacgagcgcccggtagtccgccaggttctcggccagcagttcgaccgtcgccgggacgtccaggtcgccgtggcggcgcagatagtcccgggggacggcgtcctcgtacgccgggtcgtccgccggtacgtcggccagcgcacgccgcacccggcccaggatccgttccctgctgctcacttcgcgtcctcctcgcggccgtgcgtacgctgccaccagtcccggaacggctccggcggcagcgcgggcaggtcgcgcgtccccgtccaggcccggcccggtccgggcagcgtgcgcggatggaagcggcgggtgcgcgacgccagccgctggccgccgcgcagcagacccgggtgggtgaaggcgaggcgggccgcgcgcatcgccgcccgctccgcgccgtgtcccttcgcaggcttcaggacgaccttgttgccctcgcgcgtcgcctcgccgccctggacgacccgctcacgcaggtgcaccaggacctccgggatgtcgatggcgaccgggcacacctcgtagcaggcgccgcacagcgaggacgcgtacggcagcgaggcgtcgatcgcgctgccggtgccgcgcagctgggggctgaggatggcgccgatgggacccgggtagaccgagccgtacgcgtgcccgccggcccgctcgtagaccgggcacacgttcaggcacgccgaacagcggatgcagcgcagggcctgccggccgacctcgtcggcgagggtgtcggtgcggccgttgtcgagcaggacgaggtggaaggtgctcggcccgtcctcgtcggcggtgccggtccaggtggacgtgtacgggttcatccgctcggcggtggaggagcgcggcagcgtctgcaggaagacctccaggtcccgccaggtcggcacgatcttctcgatgccgacgaccgagatcagcgtctcgggcagggtcaggcacatgcgtccgttgccctcggactccacgaccaccagcgtgccgctctccgcgaccacgaagttggcgccggagatgccgaccttggcgcgcaggaacttctcccgcaggtgccgccgggccgcctcggcgagttcggcgggcgagtcggtcaggccctcgggggccgggcggccccactccttcatctcggagcggaagatgtcgcggatctcgccgcggttgcggtggatcgcgggcaccaggatgtgggagggccggtccttgcccaactgcacgatcagctcggcgagatcggtctcgtaggcgcggatgccctccgcctccagcgcctcgttgagcccgatctcctgcgtggccatcgacttgaccttgacgacctcgctctcgccggtcgcccgcaccaggtccgcgacgatccggttggcctcggccgcgtccaccgcccagtggacggtgccgccggccgccgtgaccgcctcctccacctgcaccaggtagcggtccaggtggcgcagcgtgtggtccttgatccgccgtcccgcctcgcgcagccgggcccagtcggacacctcggccaccgccttggcccgcttggcgcggatggtgtgcgtggcgtggcgcaggttgccgcgcagcgtcgtatcgcgcacggcgtcgtgcgcg

SEQ ID NO: 472 - DNA, 10843 bp, Unknown
  Kingdom: Bacteria, Phylum: Actinobacteria, Class: Actinobacteria, Order: Streptomycetales, Family: Streptomycetaceae, Genus: Streptomyces
gcggcgggatccgggcatcccacgtcgtccatgtccgccgccgacctgatggccgtactcctcgcccaccacctgcgctacgacttcgaccggcccgaacaccccggcaacgaccgcttcgtcctttccaaggggcacgcctccccgctgctgtactccgcctacaaggcggccggtgccatcgacgacggcgaactgctcaccttccgcaagctgggcagccgcctggaagggcatcccacgccgcagcggctgccctgggtcgagacggccaccggatcgctcggccagggcatgcccatcggcgtcggcatcgcactgtccggcaagcgcctcgaccacgccgactaccgggtgtgggtgctgtgcggcgacagcgagatggccgagggctcgatctgggaggccgccgagcacgccgggtacgagcacctggacaacctgaccgtgatcgtggacgtcaaccggctcggccagcgcggccccacccggcacggccacgacctggacgcctacgtccgccgcttccgtgccttcgactggcacacggtggagatcgacggccatgacgtggacgcgatcgaccgggcctacggcgaggcgctctccaccaagggccagcccaccgcgatcatcgcccgcaccctcaagggcaagggcgtcaaggacaccgaggaccgcgagggcctgcacggcaagccgctgaaggacgccgacgaggcgatcgaggaactgggcggtgtgcgcgacatccgcgtccgcgtgcacgagccgccgtccgtgcgctcactgcacgccgtcggggacggccgcctcgaactgccccgctgggagcgcggcgaggaggtcgccacccgcgacgcctacggcagggcgctggccgcgctcggcaccgcacggggcgacgtcgtggccctggacggcgaggtcggcgactccacccgctcggagttcttcgccaaggaacaccccgagcgctacttcgagtgctacatcgccgaacagcagatggtcgcgaccgcggtcggcatggcccggcgcggctgggtgccgtacgcctccacgttcgccgcgttcctgacccgcgccttcgacttcgtacggatggcctccatcagcggctccggcgtcaacctcaacgggtcgcacgccggagtgtcgatcgggcaggacgggcccagccagatgggcctggaggacctggccatgatgcggacggtgcacggctcgaccgtgctgtacccgtgcgacgccaaccagaccgcgaagctcgtcgcggccatggccggtctggacggcatccgctacctgcgcacctcgcgcggcgacagcccggtgctgtacgggcccgacgaggagttcccggtcggcggcagcaaggtgctgcgctcctccacgggggaccggctgacgatcgtcgccgcgggcgtcaccctgcacgaggcgctggccgccgccgacgccctcggcgaggagggcatcgccgcacgggtgatcgacctgtactccgtcaagcccgtcgaccgggccacgctgcgcaaggccgccgaggacaccgggtgcctgctcacggtcgaggaccaccgggaggagggcggcatcggcgacgcggtcctcgacgccttcctcgacgggcggccggtgccccggctggtccggctcgccgtccggaccatgcccggctcggccagtcccgccgagcaactgcacgccgccggcatcgacgcggagtccatcgccgcctccgcccggctgctggtggaagaggccgtggtgccgtgagcggtgatacgcgcacggtacgggccggccggcgcaccgtcgaggtgcaccggccggacaaggtcctcttcccgtccgcccacgacgaggagcacaccgagaggcacgacgagcacaccgacgagtacacgaagggcgacctggccgactactaccgctcggtcgcgcctttcatggtgccgcacctgcgcggccgtcccctgatgctggagcgccgtccggacggcctggacggccccgtgttcatgcagaagaacacaccggagcactacccggagtggatcacacgtgtggaggtcgccaaggagggcgggacggtcacacacaccgtctgcgacgacacggccaccctggtgtacctcgccgaccaggcctgcctgaccccgcaccgctggctgtcgcgcgcgcccggcatcgagcggcccgaccggatggtcttcgacctcgacccggccggcgacgacttcgagccggtgcgcacggcggcccggctgacgggcggactgctcgacgagctggggctgccctccgccctcatgaccaccggttcgcgcggcctgcacgtgatcgtccacctcgacggccggctgggcttcgacccggtgcgtgacttcgcccgggacgtcgcagagctgctggccgcccgccacccggaccggttcaccacggccgcccgcaagaaggaccggggcgaccgcctctacctggacgtgcagcgcaacggttacgcgcagaccgcggtcgcgccctacgccgtgcgggcccggccgggcgcacccgtggccgtacccctttcctgggaccagctcgacgaccccggcctcggggcgcggcgctggaccatcgccgacgccgccgaccaggcacggacccggccgtgggccggtgtgcccggccgtggtcgctccctggggccggcccggcggcggctggacgggctgcgcggctgaggtttggccaacgaacctgcggccacacggagaggaagaggtggccatggctgacacagaaagctctgaaagccctgaaagctctgaagagccgcaggaaacgcgcaagccgcggaattcacagcactcacagaagtctcagagaacacacagtacgcacaggacgcacagcacgcacgacaacgacagcgacaacgacagccacaacgaaagcgaccacgacagcaacgacgacaaccgtgcgaccgcgcggcggccccggccgatggaggtgctgcgtgaggcgcgcgcccagttcgcggagctgaccggtctcgccccggagtccgtcacgagtttcgagcggaccgaggacggctggtccctggaggtcgaagtcctcgaactcgcccgggtgcccgacacgatgagcctgatggcgagctacctggtcgaactcgacgccgaaggacaggtcaccggataccggcggctgagccgctacgaacggggccgggccgacgcacacaggtccggcggccggtaggccgcctgcggcgcggcacaccagaagtcgcacagacacccgggtcacagacacccggctcacagacacccgacccagacacagacaaggaggcacggtcggcatgaccgttgtcccggcacagacgtccggcggtggaggcggcagcagcggtctctacgacgtactggagctcgtcctcgacagggggctggtgatcgacgcgttcgtgagggtttccctggtcggcatcgagatcctgaagatcgacgtccgcgtcgtcgtcgccagcgtcgacacgtatctgcgcttcgccgaggcgtgcaaccggctcgacctggaggccgggccccgcaagagccccggtctgcccgagatcgtcggcgaggtcaccgagtccggcgcgcgcggcaagtccaagggcgcgctgtccggcgcggcccagaccgtctccgacgccttcaagcaggcccgctccgagggctcgggtgagtccgagtcccggccgcggccgcgcaagacctcgtcggcgcgcaggaaggaggagcaggagtgagcacgtacgtctacggcatcaccgcggcctcgcaccccgcgctgcccgaggacctcaccggcgtcggcgatccgcccctgccggtccgtgtcctcaccgtgggcgagctggccgctgtggtcagcgacgcgcccgaggggctgcggcccaagcgcagggacctgctcgcccaccagcatgtgctcggcgaggcaggcgcgggtggctgtgtgctgcccatgcggttcggcagcctcgccccggacgacgagtccgtcaccggcgtgctcaccgagcgcgccgagcactacagggaacggctgcgggcgctggacggcaaggtcgagtacaacgtcaagggcagccacgtcgaagaggcggtcctgcaccgcgtgatggccgagaacccggagatcagggctcaggccgacgccaaccggcaggcgggcggcgggagttacgaggacaagatcaagctcggcgagctggtcgcggcggccgtcaaggcccgcgaggccgaggacggcgccgcggtggtgcgggcggtcgagccgcgcgcggcagcggtcagcgcgggcccggagtccaccggctggctcgtcaacgcttccttcctggtcgaccgcgacgacgcggccgccttcctggaagccgtcgagcaggcccgcaaggacctgccccatctcgaactgcgcgtcaacggcccgttgccgccctacagcttcgtcgagcccggcccggccgagccggcgggcagcgcggcgggagccgacgcgggagcggagtgacgccatgggactgatctcggaggtgctgctgctgccgttcgcaccggcgcgcggcagcgcctgggcgatcaggcaggtgctgcacgaggcggagcgcatctactacgacccggccaccgtacgggccgaactcgcccggctggaggaacgcctggaggcggaggagatcaccgaggaggagttcgaccgcgaggaggacgcgctgctggaccggctggagatcggcctgcacgggggcgctgggacggctgaggggacggcacgatgaatcggatggggctcggtctcgcggtaggggccggctacttgctggggcgcacgaagaaggcgaaagtcgccctggccgtcggcagcatggtcgcgggcaagaagctgaacctcgggccgcgcgcgatcgccgacctgctcaaccagcagctcaaggacaacccccagttcaaggagatcggcgatcagctgcgccaggatctgcggggcgtcggcaaggcggcctccggggcgatggtcgagcggcagatgacctcgctcgccgaccggctgcacagccgtacggcgcaggtccgcgacgaagtgaccggcgtgttgcccgacggcggcggacggaagtccggggacggcggcggcgagcggcaggccgacgacggcaacggcggctccgaggacgagtacggcgacgaggacgagtacgaggacgaggacgaggacggctcccgggacgaggacggctcccgggacgagtacgaggacgagtacgaggaccgggagggccgcgaggccgacggggagcccggctccggggacgagtccggccgggaaccggaccgcgagcacaccgcgcggagggctcccgcgaagaagacggcgaagaaggcgcccgagaggagggcgcccgagaggagggcgcccgacaggaaggctcccgagaagagggcttccgagcagaggactgccgggaagaaggcgccggcgaagaaggctgccgagaaggcgcctgccaagaaggcgtcggcgaagaagaccgccgagaccggtgccgggagtgccaggagcgcccggagcgcgaagagcgcgaagaagacaccgtccggcgcaccggccaggaaggcggcgaagaaggcccccgccaggaagacggcggccccgaggacagcggcggccggcaagaagacggccgcaaggaagacgacgccggcccgaaggtcggcgaagggtggcggtgaccgatgaccgaggccctcggatccgcggcgtccacggccggcaaggccgcgggcggcgcggcgaagaacagtccgctcaccgatctcgcccacagcgaggccgccgaccggctcaaggcggaggcgcaggagtacctcgccgcccaggccgagcggctgctcgccggtttcgggcgcaagctcggcgagaccaccgggaagctcaatgacatcgccgagggcaacagccccggcttcgcgaaactcgccctcgaaggcggacggaagctcgccgagggcaagggaccggtgcgctccgcgctggaggtcggcgtctcgcacgccaaggacaaggtgatgggcgcggtcaagggcctcggcggcggcaagggctcgcgcaagagcggcagcgggaacaagcccaccgtcatcgtcgagtcggtcgacgtcggcgtctcgcggcgcaccgcctacgaccagtggacccggttccaggacttcagcaccttcgccaagggcgtcaagagcgcgagccgcgccgacgacacccactccgactggcaggcgaagatcttctggtccagccgcagctggaaggcccacaccaccgaacagatccccgactaccgcatccagtggacctcggaaggcgccaagggcaccacgaagggcgtcgtgtccttccaccgcctggacgacgacctcactcgcgtcctgctcgtcatcgagtactaccccagcggtctgttcgagaagaccggcaacatctggcggtcccagggccgccgtgcccggctcgacctgaagaacttcgcccgcttcatcacgctgaagggggaggcggaggacggctggcgcggtgagatccgcgacggcgaggtcgtccgcagccatgacgacgtggtcgccgaggaggaggaagaagaggagaacggcgagcacgacgaggaggagccggaggacgagtacgacgaggacgaggaagaggaagagcccgaagaagaggaagagccctacgaggacgaggacgaggaagagagcgaggccaggggtcggcaccaggacgaggacgaggacgaatacgaggacgaggaagagggcgaggacgaggaagaggcccggaacgaggaggagcccgaggcggagtacgagaacgatgaggccgacgaggacgaggacgaggacgagtacgagtacgccgagggcgggagccgtcgatgacgatgccgagcaggatgccggaaccgtacggcccgagcagtggagccaacctcgccgacatcctggagcgggtgctggacaagggtgtcgtcatcgccggtgacatccggatcaacctgctcgacatcgaactcctcacgatcaaactccggctcgtcatcgcctcggtcgacaaggccaaggagatgggcatcgactggtgggagagcgaccccgccctctcctcccgggcccgccgcgacgaactcgcccgggagaacgccgagttgcgtgaacggctggcccggctcgaggagctggagcagggcacgggcacgagcctgggcgcgcgcccgggcaccacacgccgcagcgacagcacggccccgaaggaggcaccatgacaggactgcggtacgtctacgccgtctgccgccccctcggggcgccgctgcaggcgcagctgaccggcgtcgcgggcgcgccggccaaaccgctggcgcaccacggcctgatcgccgtcgtcagcgaggtaccggaacgggacttctccgaggaggcgctgcgcgtccgcctggaggacctggactggctcgccgccaccgcccgcgcccaccagggcgtcatcgacgccctcaccgtcgtcaccaccccgctgccgctccggctggccaccgtcttccgggacgacagcggggtgcgcgccatgatcgagtcccgggaggaacacttccgcagcgctctggagcggctccaggggcgggtcgagtggggcgtcaaggtgtatctggagtccgagccgtccgaggaggcggaggcctccgggccggcgcagaagcccgcgtccggccgtgactacctgcgcctgcgccggcagcagacccgggcgcacgaggacctgtgggagcgtgccgagacgttcgccacccggctgcacggcaggctctcggcattcgccgaggattcccggctgcacgccccgcagaatcccgcgctctccggtgccgccggccgcaatgtgctcaacgcggcctatctggtgccgcgcacccattccgaggagttcgtggaactggtggaccgtacgaaggacgaagcgcctgggctgcgcgtggaactcacgggcccctgggcggcgtattccttcgccggggaaaacgtgtctcaggagcaggcatgacggtcgtcgaacgccgtgagatcgccttggtcgacctgctcgaccggctgctggccggcggagtcgtgatcacgggcgacgtcaccctgcgcatcgccgacgtcgacctcgtccgcatcgacctgaacgccctgatcagctcggtgaacgcacaggtgccctcgcccttcgaggcacccttcgacgccttggaggagccgtcgtgaccgcgcgcaagcatctcgaactcgaacccgacacggtggagcgcgacctcgtgaaactcgtcctcaccgtggtcgaactgctgcgccagctcatggaacggcaggcgttgcgccggttcgacgtgggcgacctgaccgaggcgcaggaggagcggataggcctcacgctgatgctgctcgaggaccgtatggccgaactgcgcgaccgctacggcctgcggcccgaggacctgaatctggacctcgggccgctgggaccgctgcttccccgggaatgaggagaacctccttaaaggaaacctcggaggagacctctggggaaatggggaaagtccccgtcttcttttcccgtttaccacctgtaccagcggccacggccaccgcccgcggaggctccgcggaacaggaagccgagcagccagatgacgaataccgccagtgctatccaccacaggactttcacggcgaagccgatcccgaagaggatgatcgcgagaagcagaacgagcagaatgggaaccatcatgacctcctgctttccgtgtttcccggaaagcggaaatcaggcatcccgctcagacgggttcgcgggggccggggccgcggcctccttgcggcacaggatctcgccgtgcaggaccgcgaaccagccgtcctcccgctcaccccactcgcgccacgccccggacacggcccgcagctgctcctcggtggcgtggccgccctcggtggcacgctcggcgtaggcggacgccagggtgcggtcggcccacagtccgctccaccactcccgttcgtcccgggtggcgtacgtccaggtgctggagccggccgtgatgccgctctccgtgaaaccggcccgcagggcccaggagcgcagccggcgcccggcgtccggctcgccgccgttggcccgggccacccgctcgtacaggtccagccagtcgtccagccccgctacctgcggataccaggtcatcgccgcgtagtccgcgtccctgaccgcgacgaacccgcccggcttggtcacgcgccgcatctcgcgcagggccgccacggggtcgccgacgtgctggagcacctggtgggcgtggaccacgcagaaggtgtcgtccggatagtccagggcgtggacgtccgccaccgcgaagtcgacgttgtccagcccgcgcgcggtcgctgtggcgcgggcctgctccagcacgcccggcgcgcggtcgacgcccgtgacgtgtccgtccgggaccagttcggccaggtcggcggtgatggtgccgggcccgcagccgatgtccaggatcttcatgtggggcttgagcgagccgagcaggtaggccgccgagttggcggcggtgcgccaggtgtgcgaacgcagcacggactcgtggtgcccgtgcgtgtagacggcggtctcctgcgttttcggcatggcggtaccccttctcctcacctgttcccgaacgggccgcgcggccccgggccggtaaggatcacggtacgcgcgcatgccgaatgatgagacccgtgtattgcaatgtggactgacggtgcgtcagtacgggggagtggctcacgcgtccggcagcgggcggtacaccgtcagcgccccgggcagctgctccaggcgtacctcgccctccacctccgtgacctcaccgtcgtaggcgaggagcgtgccggctgccaggccgttcaggcgtacgtggcgcagctggacggccgcgtgggcgggggagcgggtcagcgggcccgcgaaggcggccgagagcaggcgcagggccggcctgcggcccccgtgcaccaccctgacgtcgagcatcccgtcggccaggtcgagccggcggcccggcgcgaggcccctgcggtggtaggtgccgttgccggcgaacagcagccacagcgggcggcggcggccctggacctccgcctccaccggatggcggtcggcgcgcagcacccgcaccgccgccagcacgcccgccggccagccgccgatccgctgcgaccagcgttcgcgctcgcgcaccagctccgggtacacgccgaggctgaaggtgttgaggaagatgccctgcccgcgtccggagctgaaacggcccacgtccacccgtacgccgtgcccctcctccagggcccggcccaggtcccgggcgtcctccacgcccaggtcgtacgcgaagtggttgagcgtgccgccgggcagcacggcgagcggcaggccgtggcgcagggcggcctcggcggcggcgttcacggtgccgtcgccgccgcacacgccgagcgcccgggcacggcccgcggcctcctccagcgcggccgggatgccatccggttcacactcgacgacctccgccttcggcagcacgttccgcagggcacgggcccgctccgcggtgccggaggcgctgttcgccaccaggaccaggccctcgccctgcggcagcaccggcacgtcggcccgcggccgggccggcggcacgagctgggcgcgtgccggc
